United States Patent 7,745,391 (HUMAN THROMBOSPONDIN POLYPEPTIDE) - sequence listing, part 161

SEQ ID NO: 417327 - DNA, 2417 bp, Homo sapiens
ttctgttggaactgcactctttcagagcctctgggccctaatacaaagcaagcacactctaaagaagccagaagaatgcaagcagcgaagtcgccgctccccacaggcaagagagtaccggcagacagcggcgcgagacaggggcagaacgatgaggcgccggagttagctcgccggtgcgggtgcgggtgcgcggcgcgtcgcggcccctcctccgcgacgcgccgggtggtcacgtgacggccgcgcgcgttcccggcagctgcgggctccgaggccagagagaaaagactgcgaggtggccgcagctgtggccggagagcacaaagaatgaaccagcagtggaagagaaaatactgtaagctggctgactgctggtgaagaaaatgctttatttttgtggcaggcatctgtgggatctgtaatagaaatatattggagtaattcaagattctgtggttggcccttttgactgctctctctacaggtttaatttgggcatttactcattttcatggctccaaggaccatgtatgtgttggggatcttcaatattcatgttattttctcctttggtcttatatgattgttacctttatgaagctttagtgattacaaagcactttttttgtccatttttacctgagctttgtaaactctgatttgcaggatggctggctgtggtgaaattgatcattcaataaacatgcttcctacaaacaggaaagcgaacgagtcctgttctaatactgcaccttctttaaccgtccctgaatgtgccatttgtctgcaaacatgtgttcatccagtcagtctgccctgtaagcacgttttctgctatctatgtgtaaaaggagcttcatggcttggaaagcggtgtgctctttgtcgacaagaaattcccgaggatttccttgacaagccaaccttgttgtcaccagaagaactcaaggcagcaagtagaggaaatggtgaatatgcatggtattatgaaggaagaaatgggtggtggcagtacgatgagcgcactagtagagagctggaagatgctttttccaaaggtaaaaagaacactgaaatgttaattgctggctttctgtatgtcgctgatcttgaaaacatggttcaatataggagaaatgaacatggacgtcgcaggaagattaagcgagatataatagatataccaaagaagggagtagctggacttaggctagactgtgatgctaataccgtaaacctagcaagagagagctctgctgacggagcggacagtgtatcagcacagagtggagcttctgttcagcccctagtgtcttctgtaaggcccctaacatcagtagatggtcagttaacaagccctgcaacaccatcccctgatgcaagcacttctctggaagactcttttgctcatttacaactcagtggagacaacacagctgaaaggagtcataggggagaaggagaagaagatcatgaatcaccatcttcaggcagggtaccagcaccagacacctccattgaagaaactgaatcagatgccagtagtgatagtgaggatgtatctgcagttgttgcacagcactccttgacccaacagagacttttggtttctaatgcaaaccagacagtacccgatcgatcagatcgatcgggaactgatcgatcagtagcagggggtggaacagtgagtgtcagtgtcagatctagaaggcctgatggacagtgcacagtaactgaagtttaaataaaaatgtcttcagctccatgctcaaggttgaaagggttacctgtaaatttctgcccacataacattatactcatccctagtagtgcattttgggagttggggtgggaaggggtatgggaaggatagactcataattaaaatgtctaacatgtctctgttgagaaatttatttaatgtaaggaacttgggtgttaatagttgagagctgtttagtaataacccagttttcttgaggtctgtttactttatactttttaaaaacttctgtagttcttttggccagtgtgtttgtattatctgtgcattaatggtcctcatctgactcctgcattgtgtcttatttttctgcatggattggcataagaccattactaaaatttggcacctgtgagatgtttgatattatgaacaggaaacataatttaatgtatgaatagatgtgaatttgggatttcaaaatagatgaataacaactattttatagtaaagttattgaaatggaaatgaaaacagccagtaacttatgtttcagaatgtttgtaacacacttcatggtgttcccataggctttgctgtctagtcttatagtttgaggtttttttggtctgcatttttctttttgattacaaaatttataatttaataaatactagagtttatcaaaaaa

SEQ ID NO: 417328 - DNA, 2478 bp, Homo sapiens
ttctgttggaactgcactctttcagagcctctgggccctaatacaaagcaagcacactctaaagaagccagaagaatgcaagcagcgaagtcgccgctccccacaggcaagagagtaccggcagacagcggcgcgagacaggggcagaacgatgaggcgccggagttagctcgccggtgcgggtgcgggtgcgcggcgcgtcgcggcccctcctccgcgacgcgccgggtggtcacgtgacggccgcgcgcgttcccggcagctgcgggctccgaggccagagagaaaagactgcgaggtggccgcagctgtggccggagaggtgggagtcggagcgaggccctctcgggggagcagggtgaacgccggccactctaggatcctcactcggggagaggaggcatagctcgcggtgtcacctccagccgcaacgtactccgggtcggccttgcgctcggggcctgagaggggcggcggcggggtcaggggccgcacaaagaatgaaccagcagtggaagagaaaatactgtaagctggctgactgctggtgaagaaaatgctttatttttgtggcaggcatctgtgggatctgtaatagaaatgggatcttcaatattcatgttattttctcctttggtcttatatgattgttacctttatgaagctttagtgattacaaagcactttttttgtccatttttacctgagctttgtaaactctgatttgcaggatggctggctgtggtgaaattgatcattcaataaacatgcttcctacaaacaggaaagcgaacgagtcctgttctaatactgcaccttctttaaccgtccctgaatgtgccatttgtctgcaaacatgtgttcatccagtcagtctgccctgtaagcacgttttctgctatctatgtgtaaaaggagcttcatggcttggaaagcggtgtgctctttgtcgacaagaaattcccgaggatttccttgacaagccaaccttgttgtcaccagaagaactcaaggcagcaagtagaggaaatggtgaatatgcatggtattatgaaggaagaaatgggtggtggcagtacgatgagcgcactagtagagagctggaagatgctttttccaaaggtaaaaagaacactgaaatgttaattgctggctttctgtatgtcgctgatcttgaaaacatggttcaatataggagaaatgaacatggacgtcgcaggaagattaagcgagatataatagatataccaaagaagggagtagctggacttaggctagactgtgatgctaataccgtaaacctagcaagagagagctctgctgacggagcggacagtgtatcagcacagagtggagcttctgttcagcccctagtgtcttctgtaaggcccctaacatcagtagatggtcagttaacaagccctgcaacaccatcccctgatgcaagcacttctctggaagactcttttgctcatttacaactcagtggagacaacacagctgaaaggagtcataggggagaaggagaagaagatcatgaatcaccatcttcaggcagggtaccagcaccagacacctccattgaagaaactgaatcagatgccagtagtgatagtgaggatgtatctgcagttgttgcacagcactccttgacccaacagagacttttggtttctaatgcaaaccagacagtacccgatcgatcagatcgatcgggaactgatcgatcagtagcagggggtggaacagtgagtgtcagtgtcagatctagaaggcctgatggacagtgcacagtaactgaagtttaaataaaaatgtcttcagctccatgctcaaggttgaaagggttacctgtaaatttctgcccacataacattatactcatccctagtagtgcattttgggagttggggtgggaaggggtatgggaaggatagactcataattaaaatgtctaacatgtctctgttgagaaatttatttaatgtaaggaacttgggtgttaatagttgagagctgtttagtaataacccagttttcttgaggtctgtttactttatactttttaaaaacttctgtagttcttttggccagtgtgtttgtattatctgtgcattaatggtcctcatctgactcctgcattgtgtcttatttttctgcatggattggcataagaccattactaaaatttggcacctgtgagatgtttgatattatgaacaggaaacataatttaatgtatgaatagatgtgaatttgggatttcaaaatagatgaataacaactattttatagtaaagttattgaaatggaaatgaaaacagccagtaacttatgtttcagaatgtttgtaacacacttcatggtgttcccataggctttgctgtctagtcttatagtttgaggtttttttggtctgcatttttctttttgattacaaaatttataatttaataaatactagagtttatcaaaaaa

SEQ ID NO: 417329 - DNA, 2308 bp, Homo sapiens
ttctgttggaactgcactctttcagagcctctgggccctaatacaaagcaagcacactctaaagaagccagaagaatgcaagcagcgaagtcgccgctccccacaggcaagagagtaccggcagacagcggcgcgagacaggggcagaacgatgaggcgccggagttagctcgccggtgcgggtgcgggtgcgcggcgcgtcgcggcccctcctccgcgacgcgccgggtggtcacgtgacggccgcgcgcgttcccggcagctgcgggctccgaggccagagagaaaagactgcgaggtggccgcagctgtggccggagagcacaaagaatgaaccagcagtggaagagaaaatactgtaagctggctgactgctggtgaagaaaatgctttatttttgtggcaggcatctgtgggatctgtaatagaaatgggatcttcaatattcatgttattttctcctttggtcttatatgattgttacctttatgaagctttagtgattacaaagcactttttttgtccatttttacctgagctttgtaaactctgatttgcaggatggctggctgtggtgaaattgatcattcaataaacatgcttcctacaaacaggaaagcgaacgagtcctgttctaatactgcaccttctttaaccgtccctgaatgtgccatttgtctgcaaacatgtgttcatccagtcagtctgccctgtaagcacgttttctgctatctatgtgtaaaaggagcttcatggcttggaaagcggtgtgctctttgtcgacaagaaattcccgaggatttccttgacaagccaaccttgttgtcaccagaagaactcaaggcagcaagtagaggaaatggtgaatatgcatggtattatgaaggaagaaatgggtggtggcagtacgatgagcgcactagtagagagctggaagatgctttttccaaaggtaaaaagaacactgaaatgttaattgctggctttctgtatgtcgctgatcttgaaaacatggttcaatataggagaaatgaacatggacgtcgcaggaagattaagcgagatataatagatataccaaagaagggagtagctggacttaggctagactgtgatgctaataccgtaaacctagcaagagagagctctgctgacggagcggacagtgtatcagcacagagtggagcttctgttcagcccctagtgtcttctgtaaggcccctaacatcagtagatggtcagttaacaagccctgcaacaccatcccctgatgcaagcacttctctggaagactcttttgctcatttacaactcagtggagacaacacagctgaaaggagtcataggggagaaggagaagaagatcatgaatcaccatcttcaggcagggtaccagcaccagacacctccattgaagaaactgaatcagatgccagtagtgatagtgaggatgtatctgcagttgttgcacagcactccttgacccaacagagacttttggtttctaatgcaaaccagacagtacccgatcgatcagatcgatcgggaactgatcgatcagtagcagggggtggaacagtgagtgtcagtgtcagatctagaaggcctgatggacagtgcacagtaactgaagtttaaataaaaatgtcttcagctccatgctcaaggttgaaagggttacctgtaaatttctgcccacataacattatactcatccctagtagtgcattttgggagttggggtgggaaggggtatgggaaggatagactcataattaaaatgtctaacatgtctctgttgagaaatttatttaatgtaaggaacttgggtgttaatagttgagagctgtttagtaataacccagttttcttgaggtctgtttactttatactttttaaaaacttctgtagttcttttggccagtgtgtttgtattatctgtgcattaatggtcctcatctgactcctgcattgtgtcttatttttctgcatggattggcataagaccattactaaaatttggcacctgtgagatgtttgatattatgaacaggaaacataatttaatgtatgaatagatgtgaatttgggatttcaaaatagatgaataacaactattttatagtaaagttattgaaatggaaatgaaaacagccagtaacttatgtttcagaatgtttgtaacacacttcatggtgttcccataggctttgctgtctagtcttatagtttgaggtttttttggtctgcatttttctttttgattacaaaatttataatttaataaatactagagtttatcaaaaaa

SEQ ID NO: 417330 - DNA, 2180 bp, Homo sapiens
ttctgttggaactgcactctttcagagcctctgggccctaatacaaagcaagcacactctaaagaagccagaagaatgcaagcagcgaagtcgccgctccccacaggcaagagagtaccggcagacagcggcgcgagacaggggcagaacgatgaggcgccggagttagctcgccggtgcgggtgcgggtgcgcggcgcgtcgcggcccctcctccgcgacgcgccgggtggtcacgtgacggccgcgcgcgttcccggcagctgcgggctccgaggccagagagaaaagactgcgaggtggccgcagctgtggccggagagcacaaagaatgaaccagcagtggaagagaaaatactgtaagctggctgactgctggtgaagaaaatgctttatttttgtggcaggcatctgtgggatctgtaatagaaatgatggctggctgtggtgaaattgatcattcaataaacatgcttcctacaaacaggaaagcgaacgagtcctgttctaatactgcaccttctttaaccgtccctgaatgtgccatttgtctgcaaacatgtgttcatccagtcagtctgccctgtaagcacgttttctgctatctatgtgtaaaaggagcttcatggcttggaaagcggtgtgctctttgtcgacaagaaattcccgaggatttccttgacaagccaaccttgttgtcaccagaagaactcaaggcagcaagtagaggaaatggtgaatatgcatggtattatgaaggaagaaatgggtggtggcagtacgatgagcgcactagtagagagctggaagatgctttttccaaaggtaaaaagaacactgaaatgttaattgctggctttctgtatgtcgctgatcttgaaaacatggttcaatataggagaaatgaacatggacgtcgcaggaagattaagcgagatataatagatataccaaagaagggagtagctggacttaggctagactgtgatgctaataccgtaaacctagcaagagagagctctgctgacggagcggacagtgtatcagcacagagtggagcttctgttcagcccctagtgtcttctgtaaggcccctaacatcagtagatggtcagttaacaagccctgcaacaccatcccctgatgcaagcacttctctggaagactcttttgctcatttacaactcagtggagacaacacagctgaaaggagtcataggggagaaggagaagaagatcatgaatcaccatcttcaggcagggtaccagcaccagacacctccattgaagaaactgaatcagatgccagtagtgatagtgaggatgtatctgcagttgttgcacagcactccttgacccaacagagacttttggtttctaatgcaaaccagacagtacccgatcgatcagatcgatcgggaactgatcgatcagtagcagggggtggaacagtgagtgtcagtgtcagatctagaaggcctgatggacagtgcacagtaactgaagtttaaataaaaatgtcttcagctccatgctcaaggttgaaagggttacctgtaaatttctgcccacataacattatactcatccctagtagtgcattttgggagttggggtgggaaggggtatgggaaggatagactcataattaaaatgtctaacatgtctctgttgagaaatttatttaatgtaaggaacttgggtgttaatagttgagagctgtttagtaataacccagttttcttgaggtctgtttactttatactttttaaaaacttctgtagttcttttggccagtgtgtttgtattatctgtgcattaatggtcctcatctgactcctgcattgtgtcttatttttctgcatggattggcataagaccattactaaaatttggcacctgtgagatgtttgatattatgaacaggaaacataatttaatgtatgaatagatgtgaatttgggatttcaaaatagatgaataacaactattttatagtaaagttattgaaatggaaatgaaaacagccagtaacttatgtttcagaatgtttgtaacacacttcatggtgttcccataggctttgctgtctagtcttatagtttgaggtttttttggtctgcatttttctttttgattacaaaatttataatttaataaatactagagtttatcaaaaaa

SEQ ID NO: 417331 - DNA, 2350 bp, Homo sapiens
ttctgttggaactgcactctttcagagcctctgggccctaatacaaagcaagcacactctaaagaagccagaagaatgcaagcagcgaagtcgccgctccccacaggcaagagagtaccggcagacagcggcgcgagacaggggcagaacgatgaggcgccggagttagctcgccggtgcgggtgcgggtgcgcggcgcgtcgcggcccctcctccgcgacgcgccgggtggtcacgtgacggccgcgcgcgttcccggcagctgcgggctccgaggccagagagaaaagactgcgaggtggccgcagctgtggccggagaggtgggagtcggagcgaggccctctcgggggagcagggtgaacgccggccactctaggatcctcactcggggagaggaggcatagctcgcggtgtcacctccagccgcaacgtactccgggtcggccttgcgctcggggcctgagaggggcggcggcggggtcaggggccgcacaaagaatgaaccagcagtggaagagaaaatactgtaagctggctgactgctggtgaagaaaatgctttatttttgtggcaggcatctgtgggatctgtaatagaaatgatggctggctgtggtgaaattgatcattcaataaacatgcttcctacaaacaggaaagcgaacgagtcctgttctaatactgcaccttctttaaccgtccctgaatgtgccatttgtctgcaaacatgtgttcatccagtcagtctgccctgtaagcacgttttctgctatctatgtgtaaaaggagcttcatggcttggaaagcggtgtgctctttgtcgacaagaaattcccgaggatttccttgacaagccaaccttgttgtcaccagaagaactcaaggcagcaagtagaggaaatggtgaatatgcatggtattatgaaggaagaaatgggtggtggcagtacgatgagcgcactagtagagagctggaagatgctttttccaaaggtaaaaagaacactgaaatgttaattgctggctttctgtatgtcgctgatcttgaaaacatggttcaatataggagaaatgaacatggacgtcgcaggaagattaagcgagatataatagatataccaaagaagggagtagctggacttaggctagactgtgatgctaataccgtaaacctagcaagagagagctctgctgacggagcggacagtgtatcagcacagagtggagcttctgttcagcccctagtgtcttctgtaaggcccctaacatcagtagatggtcagttaacaagccctgcaacaccatcccctgatgcaagcacttctctggaagactcttttgctcatttacaactcagtggagacaacacagctgaaaggagtcataggggagaaggagaagaagatcatgaatcaccatcttcaggcagggtaccagcaccagacacctccattgaagaaactgaatcagatgccagtagtgatagtgaggatgtatctgcagttgttgcacagcactccttgacccaacagagacttttggtttctaatgcaaaccagacagtacccgatcgatcagatcgatcgggaactgatcgatcagtagcagggggtggaacagtgagtgtcagtgtcagatctagaaggcctgatggacagtgcacagtaactgaagtttaaataaaaatgtcttcagctccatgctcaaggttgaaagggttacctgtaaatttctgcccacataacattatactcatccctagtagtgcattttgggagttggggtgggaaggggtatgggaaggatagactcataattaaaatgtctaacatgtctctgttgagaaatttatttaatgtaaggaacttgggtgttaatagttgagagctgtttagtaataacccagttttcttgaggtctgtttactttatactttttaaaaacttctgtagttcttttggccagtgtgtttgtattatctgtgcattaatggtcctcatctgactcctgcattgtgtcttatttttctgcatggattggcataagaccattactaaaatttggcacctgtgagatgtttgatattatgaacaggaaacataatttaatgtatgaatagatgtgaatttgggatttcaaaatagatgaataacaactattttatagtaaagttattgaaatggaaatgaaaacagccagtaacttatgtttcagaatgtttgtaacacacttcatggtgttcccataggctttgctgtctagtcttatagtttgaggtttttttggtctgcatttttctttttgattacaaaatttataatttaataaatactagagtttatcaaaaaa

SEQ ID NO: 417332 - DNA, 1964 bp, Homo sapiens
ttctgttggaactgcactctttcagagcctctgggccctaatacaaagcaagcacactctaaagaagccagaagaatgcaagcagcgaagtcgccgctccccacagcacaaagaatgaaccagcagtggaagagaaaatactgtaagctggctgactgctggtgaagaaaatgctttatttttgtggcaggcatctgtgggatctgtaatagaaatgatggctggctgtggtgaaattgatcattcaataaacatgcttcctacaaacaggaaagcgaacgagtcctgttctaatactgcaccttctttaaccgtccctgaatgtgccatttgtctgcaaacatgtgttcatccagtcagtctgccctgtaagcacgttttctgctatctatgtgtaaaaggagcttcatggcttggaaagcggtgtgctctttgtcgacaagaaattcccgaggatttccttgacaagccaaccttgttgtcaccagaagaactcaaggcagcaagtagaggaaatggtgaatatgcatggtattatgaaggaagaaatgggtggtggcagtacgatgagcgcactagtagagagctggaagatgctttttccaaaggtaaaaagaacactgaaatgttaattgctggctttctgtatgtcgctgatcttgaaaacatggttcaatataggagaaatgaacatggacgtcgcaggaagattaagcgagatataatagatataccaaagaagggagtagctggacttaggctagactgtgatgctaataccgtaaacctagcaagagagagctctgctgacggagcggacagtgtatcagcacagagtggagcttctgttcagcccctagtgtcttctgtaaggcccctaacatcagtagatggtcagttaacaagccctgcaacaccatcccctgatgcaagcacttctctggaagactcttttgctcatttacaactcagtggagacaacacagctgaaaggagtcataggggagaaggagaagaagatcatgaatcaccatcttcaggcagggtaccagcaccagacacctccattgaagaaactgaatcagatgccagtagtgatagtgaggatgtatctgcagttgttgcacagcactccttgacccaacagagacttttggtttctaatgcaaaccagacagtacccgatcgatcagatcgatcgggaactgatcgatcagtagcagggggtggaacagtgagtgtcagtgtcagatctagaaggcctgatggacagtgcacagtaactgaagtttaaataaaaatgtcttcagctccatgctcaaggttgaaagggttacctgtaaatttctgcccacataacattatactcatccctagtagtgcattttgggagttggggtgggaaggggtatgggaaggatagactcataattaaaatgtctaacatgtctctgttgagaaatttatttaatgtaaggaacttgggtgttaatagttgagagctgtttagtaataacccagttttcttgaggtctgtttactttatactttttaaaaacttctgtagttcttttggccagtgtgtttgtattatctgtgcattaatggtcctcatctgactcctgcattgtgtcttatttttctgcatggattggcataagaccattactaaaatttggcacctgtgagatgtttgatattatgaacaggaaacataatttaatgtatgaatagatgtgaatttgggatttcaaaatagatgaataacaactattttatagtaaagttattgaaatggaaatgaaaacagccagtaacttatgtttcagaatgtttgtaacacacttcatggtgttcccataggctttgctgtctagtcttatagtttgaggtttttttggtctgcatttttctttttgattacaaaatttataatttaataaatactagagtttatcaaaaaa

SEQ ID NO: 417333 - DNA, 2533 bp, Homo sapiens
ttctgttggaactgcactctttcagagcctctgggccctaatacaaagcaagcacactctaaagaagccagaagaatgcaagcagcgaagtcgccgctccccacaggcaagagagtaccggcagacagcggcgcgagacaggggcagaacgatgaggcgccggagttagctcgccggtgcgggtgcgggtgcgcggcgcgtcgcggcccctcctccgcgacgcgccgggtggtcacgtgacggccgcgcgcgttcccggcagctgcgggctccgaggccagagagaaaagactgcgaggtggccgcagctgtggccggagaggtgggagtcggagcgaggccctctcgggggagcagggtgaacgccggccactctaggatcctcactcggggagaggaggcatagctcgcggtgtcacctccagccgcaacgtactccgggtcggccttgcgctcggggcctgagaggggcggcggcggggtcaggggccgcacaaagaatgaaccagcagtggaagagaaaatactgtaagctggctgactgctggtgaagaaaatgctttatttttgtggcaggcatctgtgggatctgtaatagaaatatattggagtaattcaagattctgtggttggcccttttgactgctctctctacaggtttaatttgggcatttactcattttcatggctccaaggaccatgtatgtgttggggatcttcaatattcatgttattttctcctttggtcttatatgattgttacctttatgaagctttagtgattacaaagcactttttttgtccatttttacctgagctttgtaaactctgatttgcaggatggctggctgtggtgaaattgatcattcaataaacatgcttcctacaaacaggaaagcgaacgagtcctgttctaatactgcaccttctttaaccgtccctgaatgtgccatttgtctgcaaacatgtgttcatccagtcagtctgccctgtaagcacgttttctgctatctatgtgtaaaaggagcttcatggcttggaaagcggtgtgctctttgtcgacaagaaattcccgaggatttccttgacaagccaaccttgttgtcaccagaagaactcaaggcagcaagtagaggaaatggtgaatatgcatggtattatgaaggaagaaatgggtggtggcagtacgatgagcgcactagtagagagctggaagatgctttttccaaaggtaaaaagaacactgaaatgttaattgctggctttctgtatgtcgctgatcttggagatataatagatataccaaagaagggagtagctggacttaggctagactgtgatgctaataccgtaaacctagcaagagagagctctgctgacggagcggacagtgtatcagcacagagtggagcttctgttcagcccctagtgtcttctgtaaggcccctaacatcagtagatggtcagttaacaagccctgcaacaccatcccctgatgcaagcacttctctggaagactcttttgctcatttacaactcagtggagacaacacagctgaaaggagtcataggggagaaggagaagaagatcatgaatcaccatcttcaggcagggtaccagcaccagacacctccattgaagaaactgaatcagatgccagtagtgatagtgaggatgtatctgcagttgttgcacagcactccttgacccaacagagacttttggtttctaatgcaaaccagacagtacccgatcgatcagatcgatcgggaactgatcgatcagtagcagggggtggaacagtgagtgtcagtgtcagatctagaaggcctgatggacagtgcacagtaactgaagtttaaataaaaatgtcttcagctccatgctcaaggttgaaagggttacctgtaaatttctgcccacataacattatactcatccctagtagtgcattttgggagttggggtgggaaggggtatgggaaggatagactcataattaaaatgtctaacatgtctctgttgagaaatttatttaatgtaaggaacttgggtgttaatagttgagagctgtttagtaataacccagttttcttgaggtctgtttactttatactttttaaaaacttctgtagttcttttggccagtgtgtttgtattatctgtgcattaatggtcctcatctgactcctgcattgtgtcttatttttctgcatggattggcataagaccattactaaaatttggcacctgtgagatgtttgatattatgaacaggaaacataatttaatgtatgaatagatgtgaatttgggatttcaaaatagatgaataacaactattttatagtaaagttattgaaatggaaatgaaaacagccagtaacttatgtttcagaatgtttgtaacacacttcatggtgttcccataggctttgctgtctagtcttatagtttgaggtttttttggtctgcatttttctttttgattacaaaatttataatttaataaatactagagtttatcaaaaaa

SEQ ID NO: 417334 - DNA, 772 bp, Homo sapiens
ttctgttggaactgcactctttcagagcctctgggccctaatacaaagcaagcacactctaaagaagccagaagaatgcaagcagcgaagtcgccgctccccacaggcaagagagtaccggcagacagcggcgcgagacaggggcagaacgatgaggcgccggagttagctcgccggtgcgggtgcgggtgcgcggcgcgtcgcggcccctcctccgcgacgcgccgggtggtcacgtgacggccgcgcgcgttcccggcagctgcgggctccgaggccagagagaaaagactgcgaggtggccgcagctgtggccggagagcacaaagaatgaaccagcagtggaagagaaaatactgtaagctggctgactgctggtgaagaaaatgctttatttttgtggcaggcatctgtgggatctgtaatagaaatgtaagtgtagcatcatggtttttttcagtgctgcagtaaattaaatggattggtttaacgtgtggtaaattgagtatctgtcatatgtagttttaattatattaaatgagcattttcttttgacttataggtgctttattaacaatttatttacattaagttatcgttaatgtagatttccaagtctcctcaaaaggaaaagtctctataagaaaaactgaagacacaggagtttgctcaaagaatgctgaaatagatctccaggtcctctgggttctaccttctttttacataataattttcttaaataactaagctaggcaagtagtactagcttttg

SEQ ID NO: 417335 - DNA, 203 bp, Homo sapiens
ccaaggtatgtacaagtagatgcttacaaaaaattttcatcggttggagagtttttcctctactttcatcttcatatccccattgtctagtatgtggcttgcatataatgcacatcataggtggttagtgttttcataattgttaaattaagatattgcaagaattaaaacatgactttaatattatatgtattttttcttag

SEQ ID NO: 417336 - DNA, 403 bp, Homo sapiens
tagacatagttttacttcctccttacccgtctgtatgcctttatctcttttccctaatttgctctgctagaacttacagtcatgttgaatagcagtggtaaaagcatgcatcttgtctttaatttttcccacttttaagataaagttttccactgaattttttgaaaggattatacataattaactgattctcttgatcttaattactctttttttcttttgcagcacaaagaatgaaccagcagtggaagagaaaatactgtaagctggctgactgctggtgaagaaaatgctttatttttgtggcaggcatctgtgggatctgtaatagaaatgtaagtgtagcatcatggtttttttcagtgctgcagtaaattaaatggattggtttaacgtgtggtaa

SEQ ID NO: 417337 - DNA, 2587 bp, Homo sapiens
ttctgttggaactgcactctttcagagcctctgggccctaatacaaagcaagcacactctaaagaagccagaagaatgcaagcagcgaagtcgccgctccccacaggcaagagagtaccggcagacagcggcgcgagacaggggcagaacgatgaggcgccggagttagctcgccggtgcgggtgcgggtgcgcggcgcgtcgcggcccctcctccgcgacgcgccgggtggtcacgtgacggccgcgcgcgttcccggcagctgcgggctccgaggccagagagaaaagactgcgaggtggccgcagctgtggccggagaggtgggagtcggagcgaggccctctcgggggagcagggtgaacgccggccactctaggatcctcactcggggagaggaggcatagctcgcggtgtcacctccagccgcaacgtactccgggtcggccttgcgctcggggcctgagaggggcggcggcggggtcaggggccgcacaaagaatgaaccagcagtggaagagaaaatactgtaagctggctgactgctggtgaagaaaatgctttatttttgtggcaggcatctgtgggatctgtaatagaaatatattggagtaattcaagattctgtggttggcccttttgactgctctctctacaggtttaatttgggcatttactcattttcatggctccaaggaccatgtatgtgttggggatcttcaatattcatgttattttctcctttggtcttatatgattgttacctttatgaagctttagtgattacaaagcactttttttgtccatttttacctgagctttgtaaactctgatttgcaggatggctggctgtggtgaaattgatcattcaataaacatgcttcctacaaacaggaaagcgaacgagtcctgttctaatactgcaccttctttaaccgtccctgaatgtgccatttgtctgcaaacatgtgttcatccagtcagtctgccctgtaagcacgttttctgctatctatgtgtaaaaggagcttcatggcttggaaagcggtgtgctctttgtcgacaagaaattcccgaggatttccttgacaagccaaccttgttgtcaccagaagaactcaaggcagcaagtagaggaaatggtgaatatgcatggtattatgaaggaagaaatgggtggtggcagtacgatgagcgcactagtagagagctggaagatgctttttccaaaggtaaaaagaacactgaaatgttaattgctggctttctgtatgtcgctgatcttgaaaacatggttcaatataggagaaatgaacatggacgtcgcaggaagattaagcgagatataatagatataccaaagaagggagtagctggacttaggctagactgtgatgctaataccgtaaacctagcaagagagagctctgctgacggagcggacagtgtatcagcacagagtggagcttctgttcagcccctagtgtcttctgtaaggcccctaacatcagtagatggtcagttaacaagccctgcaacaccatcccctgatgcaagcacttctctggaagactcttttgctcatttacaactcagtggagacaacacagctgaaaggagtcataggggagaaggagaagaagatcatgaatcaccatcttcaggcagggtaccagcaccagacacctccattgaagaaactgaatcagatgccagtagtgatagtgaggatgtatctgcagttgttgcacagcactccttgacccaacagagacttttggtttctaatgcaaaccagacagtacccgatcgatcagatcgatcgggaactgatcgatcagtagcagggggtggaacagtgagtgtcagtgtcagatctagaaggcctgatggacagtgcacagtaactgaagtttaaataaaaatgtcttcagctccatgctcaaggttgaaagggttacctgtaaatttctgcccacataacattatactcatccctagtagtgcattttgggagttggggtgggaaggggtatgggaaggatagactcataattaaaatgtctaacatgtctctgttgagaaatttatttaatgtaaggaacttgggtgttaatagttgagagctgtttagtaataacccagttttcttgaggtctgtttactttatactttttaaaaacttctgtagttcttttggccagtgtgtttgtattatctgtgcattaatggtcctcatctgactcctgcattgtgtcttatttttctgcatggattggcataagaccattactaaaatttggcacctgtgagatgtttgatattatgaacaggaaacataatttaatgtatgaatagatgtgaatttgggatttcaaaatagatgaataacaactattttatagtaaagttattgaaatggaaatgaaaacagccagtaacttatgtttcagaatgtttgtaacacacttcatggtgttcccataggctttgctgtctagtcttatagtttgaggtttttttggtctgcatttttctttttgattacaaaatttataatttaataaatactagagtttatcaaaaaa

SEQ ID NO: 417338 - DNA, 2536 bp, Homo sapiens
ttctgttggaactgcactctttcagagcctctgggccctaatacaaagcaagcacactctaaagaagccagaagaatgcaagcagcgaagtcgccgctccccacaggcaagagagtaccggcagacagcggcgcgagacaggggcagaacgatgaggcgccggagttagctcgccggtgcgggtgcgggtgcgcggcgcgtcgcggcccctcctccgcgacgcgccgggtggtcacgtgacggccgcgcgcgttcccggcagctgcgggctccgaggccagagagaaaagactgcgaggtggccgcagctgtggccggagaggtgggagtcggagcgaggccctctcgggggagcagggtgaacgccggccactctaggatcctcactcggggagaggaggcatagctcgcggtgtcacctccagccgcaacgtactccggcacaaagaatgaaccagcagtggaagagaaaatactgtaagctggctgactgctggtgaagaaaatgctttatttttgtggcaggcatctgtgggatctgtaatagaaatatattggagtaattcaagattctgtggttggcccttttgactgctctctctacaggtttaatttgggcatttactcattttcatggctccaaggaccatgtatgtgttggggatcttcaatattcatgttattttctcctttggtcttatatgattgttacctttatgaagctttagtgattacaaagcactttttttgtccatttttacctgagctttgtaaactctgatttgcaggatggctggctgtggtgaaattgatcattcaataaacatgcttcctacaaacaggaaagcgaacgagtcctgttctaatactgcaccttctttaaccgtccctgaatgtgccatttgtctgcaaacatgtgttcatccagtcagtctgccctgtaagcacgttttctgctatctatgtgtaaaaggagcttcatggcttggaaagcggtgtgctctttgtcgacaagaaattcccgaggatttccttgacaagccaaccttgttgtcaccagaagaactcaaggcagcaagtagaggaaatggtgaatatgcatggtattatgaaggaagaaatgggtggtggcagtacgatgagcgcactagtagagagctggaagatgctttttccaaaggtaaaaagaacactgaaatgttaattgctggctttctgtatgtcgctgatcttgaaaacatggttcaatataggagaaatgaacatggacgtcgcaggaagattaagcgagatataatagatataccaaagaagggagtagctggacttaggctagactgtgatgctaataccgtaaacctagcaagagagagctctgctgacggagcggacagtgtatcagcacagagtggagcttctgttcagcccctagtgtcttctgtaaggcccctaacatcagtagatggtcagttaacaagccctgcaacaccatcccctgatgcaagcacttctctggaagactcttttgctcatttacaactcagtggagacaacacagctgaaaggagtcataggggagaaggagaagaagatcatgaatcaccatcttcaggcagggtaccagcaccagacacctccattgaagaaactgaatcagatgccagtagtgatagtgaggatgtatctgcagttgttgcacagcactccttgacccaacagagacttttggtttctaatgcaaaccagacagtacccgatcgatcagatcgatcgggaactgatcgatcagtagcagggggtggaacagtgagtgtcagtgtcagatctagaaggcctgatggacagtgcacagtaactgaagtttaaataaaaatgtcttcagctccatgctcaaggttgaaagggttacctgtaaatttctgcccacataacattatactcatccctagtagtgcattttgggagttggggtgggaaggggtatgggaaggatagactcataattaaaatgtctaacatgtctctgttgagaaatttatttaatgtaaggaacttgggtgttaatagttgagagctgtttagtaataacccagttttcttgaggtctgtttactttatactttttaaaaacttctgtagttcttttggccagtgtgtttgtattatctgtgcattaatggtcctcatctgactcctgcattgtgtcttatttttctgcatggattggcataagaccattactaaaatttggcacctgtgagatgtttgatattatgaacaggaaacataatttaatgtatgaatagatgtgaatttgggatttcaaaatagatgaataacaactattttatagtaaagttattgaaatggaaatgaaaacagccagtaacttatgtttcagaatgtttgtaacacacttcatggtgttcccataggctttgctgtctagtcttatagtttgaggtttttttggtctgcatttttctttttgattacaaaatttataatttaataaatactagagtttatcaaaaaa

SEQ ID NO: 417339 - DNA, 2299 bp, Homo sapiens
ttctgttggaactgcactctttcagagcctctgggccctaatacaaagcaagcacactctaaagaagccagaagaatgcaagcagcgaagtcgccgctccccacaggcaagagagtaccggcagacagcggcgcgagacaggggcagaacgatgaggcgccggagttagctcgccggtgcgggtgcgggtgcgcggcgcgtcgcggcccctcctccgcgacgcgccgggtggtcacgtgacggccgcgcgcgttcccggcagctgcgggctccgaggccagagagaaaagactgcgaggtggccgcagctgtggccggagaggtgggagtcggagcgaggccctctcgggggagcagggtgaacgccggccactctaggatcctcactcggggagaggaggcatagctcgcggtgtcacctccagccgcaacgtactccggcacaaagaatgaaccagcagtggaagagaaaatactgtaagctggctgactgctggtgaagaaaatgctttatttttgtggcaggcatctgtgggatctgtaatagaaatgatggctggctgtggtgaaattgatcattcaataaacatgcttcctacaaacaggaaagcgaacgagtcctgttctaatactgcaccttctttaaccgtccctgaatgtgccatttgtctgcaaacatgtgttcatccagtcagtctgccctgtaagcacgttttctgctatctatgtgtaaaaggagcttcatggcttggaaagcggtgtgctctttgtcgacaagaaattcccgaggatttccttgacaagccaaccttgttgtcaccagaagaactcaaggcagcaagtagaggaaatggtgaatatgcatggtattatgaaggaagaaatgggtggtggcagtacgatgagcgcactagtagagagctggaagatgctttttccaaaggtaaaaagaacactgaaatgttaattgctggctttctgtatgtcgctgatcttgaaaacatggttcaatataggagaaatgaacatggacgtcgcaggaagattaagcgagatataatagatataccaaagaagggagtagctggacttaggctagactgtgatgctaataccgtaaacctagcaagagagagctctgctgacggagcggacagtgtatcagcacagagtggagcttctgttcagcccctagtgtcttctgtaaggcccctaacatcagtagatggtcagttaacaagccctgcaacaccatcccctgatgcaagcacttctctggaagactcttttgctcatttacaactcagtggagacaacacagctgaaaggagtcataggggagaaggagaagaagatcatgaatcaccatcttcaggcagggtaccagcaccagacacctccattgaagaaactgaatcagatgccagtagtgatagtgaggatgtatctgcagttgttgcacagcactccttgacccaacagagacttttggtttctaatgcaaaccagacagtacccgatcgatcagatcgatcgggaactgatcgatcagtagcagggggtggaacagtgagtgtcagtgtcagatctagaaggcctgatggacagtgcacagtaactgaagtttaaataaaaatgtcttcagctccatgctcaaggttgaaagggttacctgtaaatttctgcccacataacattatactcatccctagtagtgcattttgggagttggggtgggaaggggtatgggaaggatagactcataattaaaatgtctaacatgtctctgttgagaaatttatttaatgtaaggaacttgggtgttaatagttgagagctgtttagtaataacccagttttcttgaggtctgtttactttatactttttaaaaacttctgtagttcttttggccagtgtgtttgtattatctgtgcattaatggtcctcatctgactcctgcattgtgtcttatttttctgcatggattggcataagaccattactaaaatttggcacctgtgagatgtttgatattatgaacaggaaacataatttaatgtatgaatagatgtgaatttgggatttcaaaatagatgaataacaactattttatagtaaagttattgaaatggaaatgaaaacagccagtaacttatgtttcagaatgtttgtaacacacttcatggtgttcccataggctttgctgtctagtcttatagtttgaggtttttttggtctgcatttttctttttgattacaaaatttataatttaataaatactagagtttatcaaaaaa

SEQ ID NO: 417340 - DNA, 1797 bp, Homo sapiens
tgaggatccccgttctctcctacctgactttgtaaactctgatttgcaggatggctggctgtggtgaaattgatcattcaataaacatgcttcctacaaacaggaaagcgaacgagtcctgttctaatactgcaccttctttaaccgtccctgaatgtgccatttgtctgcaaacatgtgttcatccagtcagtctgccctgtaagcacgttttctgctatctatgtgtaaaaggagcttcatggcttggaaagcggtgtgctctttgtcgacaagaaattcccgaggatttccttgacaagccaaccttgttgtcaccagaagaactcaaggcagcaagtagaggaaatggtgaatatgcatggtattatgaaggaagaaatgggtggtggcagtacgatgagcgcactagtagagagctggaagatgctttttccaaaggtaaaaagaacactgaaatgttaattgctggctttctgtatgtcgctgatcttgaaaacatggttcaatataggagaaatgaacatggacgtcgcaggaagattaagcgagatataatagatataccaaagaagggagtagctggacttaggctagactgtgatgctaataccgtaaacctagcaagagagagctctgctgacggagcggacagtgtatcagcacagagtggagcttctgttcagcccctagtgtcttctgtaaggcccctaacatcagtagatggtcagttaacaagccctgcaacaccatcccctgatgcaagcacttctctggaagactcttttgctcatttacaactcagtggagacaacacagctgaaaggagtcataggggagaaggagaagaagatcatgaatcaccatcttcaggcagggtaccagcaccagacacctccattgaagaaactgaatcagatgccagtagtgatagtgaggatgtatctgcagttgttgcacagcactccttgacccaacagagacttttggtttctaatgcaaaccagacagtacccgatcgatcagatcgatcgggaactgatcgatcagtagcagggggtggaacagtgagtgtcagtgtcagatctagaaggcctgatggacagtgcacagtaactgaagtttaaataaaaatgtcttcagctccatgctcaaggttgaaagggttacctgtaaatttctgcccacataacattatactcatccctagtagtgcattttgggagttggggtgggaaggggtatgggaaggatagactcataattaaaatgtctaacatgtctctgttgagaaatttatttaatgtaaggaacttgggtgttaatagttgagagctgtttagtaataacccagttttcttgaggtctgtttactttatactttttaaaaacttctgtagttcttttggccagtgtgtttgtattatctgtgcattaatggtcctcatctgactcctgcattgtgtcttatttttctgcatggattggcataagaccattactaaaatttggcacctgtgagatgtttgatattatgaacaggaaacataatttaatgtatgaatagatgtgaatttgggatttcaaaatagatgaataacaactattttatagtaaagttattgaaatggaaatgaaaacagccagtaacttatgtttcagaatgtttgtaacacacttcatggtgttcccataggctttgctgtctagtcttatagtttgaggtttttttggtctgcatttttctttttgattacaaaatttataatttaataaatactagagtttatcaaaaaa

SEQ ID NO: 417341 - DNA, 2386 bp, Homo sapiens
ttctgttggaactgcactctttcagagcctctgggccctaatacaaagcaagcacactctaaagaagccagaagaatgcaagcagcgaagtcgccgctccccacaggcaagagagtaccggcagacagcggcgcgagacaggggcagaacgatgaggcgccggagttagctcgccggtgcgggtgcgggtgcgcggcgcgtcgcggcccctcctccgcgacgcgccgggtggtcacgtgacggccgcgcgcgttcccggcagctgcgggctccgaggccagagagaaaagactgcgaggtggccgcagctgtggccggagagcacaaagaatgaaccagcagtggaagagaaaatactgtaagctggctgactgctggtgaagaaaatgctttatttttgtggcaggcatctgtgggatctgtaatagaaatgatggctggctgtggtgaaattgatcattcaataaacatgcttcctacaaacaggaaagcgaacgagtcctgttctaatactgcaccttctttaaccgtccctgaatgtgccatttgtctgcaaacatgtgttcatccagtcagtctgccctgtaagcacgttttctgctatctatgtgtaaaaggagcttcatggcttggaaagcggtgtgctctttgtcgacaagaaattcccgaggatttccttgacaagccaaccttgttgtcaccagaagaactcaaggcagcaagtagaggaaatggtgaatatgcatggtattatgaaggaagaaatgggtggtggcagtacgatgagcgcactagtagagagctggaagatgctttttccaaaggtaaaaagaacactgaaatgttaattgctggctttctgtatgtcgctgatcttgaaaacatggttcaatataggagaaatgaacatggacgtcgcaggaagattaagcgagatataatagatataccaaagaagggagtagctggacttaggctagactgtgatgctaataccgtaaacctagcaagagagagctctgctgacggagcggacagtgtatcagcacagagtggagcttctgttcagcccctagtgtcttctgtaaggcccctaacatcagtagatggtcagttaacaagccctgcaacaccatcccctgatgcaagcacttctctggaagactcttttgctcatttacaactcagtggagacaacacagctgaaaggagtcataggggagaaggagaagaagatcatgaatcaccatcttcaggcagggtaccagcaccagacacctccattgaagaaactgaatcagatgccagtagtgatagtgaggatgtatctgcagttgttgcacagcactccttgacccaacagagacttttggtttctaatgcaaaccagacagtacccgatcgatcagatcgatcgggaactgatcgatcagtagcagggggtggaacagtgagtgtcagtgtcagatctagaaggcctgatggacagtgcacagtaactgaagtttaaataaaaatgtcttcagctccatgctcaaggttgaaagggttacctgtaaatttctgcccacataacattatactcatccctagtagtgcattttgggagttggggtgggaaggggtatgggaaggatagactcataattaaaatgtctaacatgtctctgttgagaaatttatttaatgtaaggaacttgggtgttaatagttgagagctgtttagtaataacccagttttcttgaggtctgtttactttatactttttaaaaacttctgtagttcttttggccagtgtgtttgtattatctgtgcattaatggtcctcatctgactcctgcattgtgtcttatttttctgcatggattggcataagaccattactaaaatttggcacctgtgagatgtttgatattatgaacaggaaacataatttaatgtatgaatagatgtgaatttgggatttcaaaatagatgaataacaactattttatagtaaagttattgaaatggaaatgaaaacagccagtaacttatgtttcagaatgtttgtaacacacttcatggtgttcccataggctttgctgtctagtcttatagtttgaggtttttttggtctgcatttttctttttgattacaaaatttataatttaataaatactagagtttatcaaaaaacagtttgtctcttgtttgagggtggaaagggtgtggaaacattttgacatttgtgaccaaaggtcacttaaaaagtggtggttttaattggttgttttcagcttaatcacctgctcagaaaagtttgatttttttcttagagattatttaaacagaatctataggcagtgtgtatataataaacatgtatggaaataaaactaaag

SEQ ID NO: 417342 - DNA, 863 bp, Homo sapiens
aatgcttgtttaagtattgggccggagctcggcaccagaacggaaggcttaaacgtgcgacggtatactgggctcgaagcgtatacttccatgtggtcagtagaacttagctgactctcgtgagttcatcaacgcaactatccatatatcgtcgcgcgcgggcgttacatgtggatacggtgtcatcgactctataatcccagatcgtctgttcgcgtagtttgcattatctggcatcctgatcaagtagcgagtcccaagcggaattctgatctgaaggggcaccttctgttcactcccacaaagtggtgtctggttctcactgagacgttttaagatttttccacaaatatttatatgtactaaatgtggaaccattagaaagttcttccaaaatctcattccagcatagttttggatttttcttttgtcttattttaaaataaggaagtcgagatgactttgatcattggtaacttgggcctgggccagacaaagtataaaacttacaaaagaatattctcatttggtcttaactaggtagatgtaatatatgactttttataaaaagggtatctatatgaacttgacacagtattttcagcttttgtattccatactaaagccatgaagaactacacgtaacatcatcatttgtattaattgcacaactccaatgctaaaggttggattgtgttagaggaatcggctctgtatttgcctctagagaaacacagtgttctctttgtatttatggattcctttttaccgtgtcacatttactttggtcctctatgtatttaaatgtttgaagtgccttagactcttgccatattttcaaaataaaattccattaagctctt

SEQ ID NO: 417343 - DNA, 5015 bp, Homo sapiens
tcaggttgaatgcctttgagaacttgatgcataaaatttgcatgactcctcactcctttctggatctctcattggactcaagccagcatggctcacaccacaaaggttaacggcagtgcctcaggaaaagcaggtgatattctcagtggagaccaggacaaggaacagaaagacccttactttgtggagaccccctatggttatcaactagacttagatttcctcaaatatgtggatgacatacagaagggaaataccatcaaaagactgaacatccagaagaggcggaagccgtccgtgccatgcccagaacccaggaccacatctggtcagcaaggtatatggacttccactgaatccctctcatcctccaacagtgatgacaacaagcagtgccccaacttcctcatagccagaagtcaagttacatcaactccaatctcaaagccacctccccctctggagacctcactcccttttcttaccatcccagaaaatcgacagctgccacctccctcaccacaactcccaaagcataaccttcatgtcaccaagacactgatggagacccggagaagactggaacaggagagagccaccatgcagatgacaccgggtgagttcagaaggcccaggctggccagttttggaggcatgggcaccacaagctccctcccttcttttgtgggttctggaaaccacaatcctgccaagcaccagcttcagaatggataccaaggtaatggggattatggtagctatgccccagctgctcccaccacttcctccatggggagctccatccgccacagccccctgagctcagggatctccaccccagtgaccaacgtgagccccatgcacctgcagcacatccgcgagcagatggccattgctctgaaacgcctgaaggagctggaggagcaggtgcgaaccatccctgtgctccaggtaaagatctctgtcttgcaagaagagaaaaggcagttggtctcacagctgaaaaaccaaagggctgcatcccagatcaatgtctgtggtgtgaggaagcggtcctatagtgcggggaacgcctcccagctggaacagctctcccgggcccgaagaagtggcggggaattatacattgactatgaggaggaagaaatggagaccgtagaacagagcacgcagaggataaaggagttccggcaacttacagcagacatgcaagccctggagcagaagatccaggacagcagctgtgaggcctcctcagagctcagggagaatggagagtgccggtctgtggctgtgggtgccgaggagaacatgaacgacatcgtcgtgtaccacagaggctccaggtcctgtaaggatgcagctgtagggacacttgttgagatgagaaattgtggggtcagcgtgacagaggccatgcttggagtgatgactgaagctgacaaagaaattgagctccaacagcagaccatagaagccttgaaggaaaagatctatcgcctagaagtacagcttagagaaaccacccatgaccgggagatgactaaactgaaacaagagctgcaggctgctggatcgaggaaaaaggttgacaaagccacgatggcccagccgcttgttttcagtaaggtggtggaggcagtggtgcagaccagagaccaaatggtcggcagtcacatggacctggtggacacgtgtgttgggacctccgtggaaacaaacagtgtaggcatctcctgccagcctgaatgtaagaataaagtcgtagggcctgagctgcctatgaattggtggattgttaaggagagggtggaaatgcatgaccgatgtgctgggaggtctgtggaaatgtgtgacaagagtgtgagtgtggaagtcagcgtctgcgaaacaggcagcaacacagaggagtctgtgaacgacctcacactcctcaagacaaacttgaatctcaaagaagtgcggtctatcggttgtggagattgttctgttgacgtgaccgtctgctctccaaaggagtgcgcctcccggggcgtgaacactgaggctgttagccaggtggaagctgccgtcatggcagtgcctcgtactgcagaccaggacactagcacagatttggaacaggtgcaccagttcaccaacaccgagacggccaccctcatagagtcctgcaccaacacttgtctaagcactttggacaagcagaccagcacccagactgtggagacgcggacagtagctgtaggagaaggccgtgtcaaggacatcaactcctccaccaagacgcggtccattggtgttggaacgttgctttctggccattctgggtttgacaggccatcagctgtgaagaccaaagagtcaggtgtggggcagataaatattaacgacaactatctggttggtctcaaaatgaggactatagcttgtgggccaccacagttgactgtggggctgacagccagcagaaggagcgtgggggttggggatgaccctgtaggggaatctctggagaacccccagcctcaagctccacttggaatgatgactggcctggatcactacattgagcgtatccagaagctgctggcagaacagcagacactgctggctgagaactacagtgaactggcagaagctttcggggaacctcactcacagatgggctccctcaactctcagctcatcagcaccctgtcgtctatcaactctgtcatgaaatctgcaagcactgaagagctgaggaaccctgacttccagaaaaccagtctgggtaaaatcacaggcaattatttgggatatacctgtaagtgtgggggccttcagtcaggaagtcccttaagctcccagacatcccagcctgagcaagaagtggggacctcagaaggaaagccaatcagcagcctggatgccttccccactcaggaaggtacgctgtctccagtgaacctgacagacgaccagatcgccgctggcctctatgcatgtacaaacaatgaaagtacactgaagtccatcatgaagaagaaagatggtaacaaagattcaaatggcgcaaaaaagaatcttcagtttgttggcattaatggagggtatgaaacaacttcaagtgatgattccagctcagatgaaagctcttcttccgagtcagatgacgagtgtgatgtcattgagtatcctcttgaagaagaggaggaggaggaggatgaagacactcggggaatggcagaagggcaccatgcagttaatattgaaggtttgaagtctgccagggtggaagatgaaatgcaggttcaagaatgtgaacctgagaaggtggaaatcagagagaggtatgaattaagtgaaaagatgttgtctgcatgcaacttactgaaaaatactataaatgaccccaaagctttgaccagcaaagatatgaggttctgtctgaacaccctccagcacgagtggttccgcgtgtccagtcagaagtcagccattccagccatggtgggggactacatagctgcttttgaggccatttccccagatgtcctccgctatgtcatcaacttggcagacggcaacggcaacacagccctccattacagcgtgtcccactccaacttcgagattgtgaagctgctgttagatgccgatgtgtgtaatgtggatcaccagaacaaggcaggctacacccccatcatgttggcggccctcgccgctgtggaagcagagaaggacatgcggattgtggaagaactcttcggctgtggggatgtgaatgccaaagctagtcaggcgggacagacggccctcatgctggcggtcagtcacggacggatagacatggtgaagggccttctggcctgtggggctgatgtcaacatccaggatgacgagggctccacggccctcatgtgtgccagcgagcacgggcacgtggagattgtcaagctgctgctggcccagcccggctgcaacggtcacctagaggacaacgatggcagcactgcgctctcaatcgccctggaagcaggacacaaggacatcgctgttcttctgtatgcccatgtcaactttgcaaaagcccagtctccgggcacccctaggcttggaaggaagacgtctcctggccccacccaccgaggttcatttgattgattgtatgcaaatagccctttatttacatgccactattaagctgctaattgttcctgttggggtgacagatactgaatgtatacgtattgtgcctgagctcaccagcaaacagaagcatcaagcccaggggtaaaggctgaagctttcacagtgcagagactgctagcctgggcacacacacctcctttctggccgtcttctgtgtagggcacactttaacccagtctctgttgctgttgagtctctgctccgttttgtacagtcacagggaattctgatctgaaggggcaccttctgttcactcccacaaagtggtgtctggttctcactgagacgttttaagatttttccacaaatatttatatgtactaaatgtggaaccattagaaagttcttccaaaatctcattccagcatagttttggatttttcttttgtcttattttaaaataaggaagtcgagatgactttgatcattggtaacttgggcctgggccagacaaagtataaaacttacaaaagaatattctcatttggtcttaactaggtagatgtaatatatgactttttataaaaagggtatctatatgaacttgacacagtattttcagcttttgtattccatactaaagccatgaagaactacacgtaacatcatcatttgtattaattgcacaactccaatgctaaaggttggattgtgttagaggaatcggctctgtatttgcctctagagaaacacagtgttctctttgtatttatggattcctttttaccgtgtcacatttactttggtcctctatgtatttaaatgtttgaagtgccttagactcttgccatattttcaaaataaaattccattaagctctt

SEQ ID NO: 417344 - DNA, 5196 bp, Homo sapiens
gaaaaacagagcctctctgtagagatgcttaaagtgctagctttatttaaaaatcagctggcaaagcgggagtgaagaacacacattttcagaagataccggtttcctgttttcattaagaaaacagggaatgcggaacagctgagtgcggcgggggtggtgtcactgcagccggagggagacctcgccggtgaaagctcagcctatggcatccgagcgtggccggccaagtttacacgaatgttgaaacttctcctcacggggtgaggatcgagggcgcccgaggccgggtccggctgagctggagcgagctgtgcggggcagcgcgggctggcggggagcgcggcgggcgccacgtggaaaagcaggtgatattctcagtggagaccaggacaaggaacagaaagacccttactttgtggagaccccctatggttatcaactagacttagatttcctcaaatatgtggatgacatacagaagggaaataccatcaaaagactgaacatccagaagaggcggaagccgtccgtgccatgcccagaacccaggaccacatctggtcagcaaggtatatggacttccactgaatccctctcatcctccaacagtgatgacaacaagcagtgccccaacttcctcatagccagaagtcaagttacatcaactccaatctcaaagccacctccccctctggagacctcactcccttttcttaccatcccagaaaatcgacagctgccacctccctcaccacaactcccaaagcataaccttcatgtcaccaagacactgatggagacccggagaagactggaacaggagagagccaccatgcagatgacaccgggtgagttcagaaggcccaggctggccagttttggaggcatgggcaccacaagctccctcccttcttttgtgggttctggaaaccacaatcctgccaagcaccagcttcagaatggataccaaggtaatggggattatggtagctatgccccagctgctcccaccacttcctccatggggagctccatccgccacagccccctgagctcagggatctccaccccagtgaccaacgtgagccccatgcacctgcagcacatccgcgagcagatggccattgctctgaaacgcctgaaggagctggaggagcaggtgcgaaccatccctgtgctccaggtaaagatctctgtcttgcaagaagagaaaaggcagttggtctcacagctgaaaaaccaaagggctgcatcccagatcaatgtctgtggtgtgaggaagcggtcctatagtgcggggaacgcctcccagctggaacagctctcccgggcccgaagaagtggcggggaattatacattgactatgaggaggaagaaatggagaccgtagaacagagcacgcagaggataaaggagttccggcaacttacagcagacatgcaagccctggagcagaagatccaggacagcagctgtgaggcctcctcagagctcagggagaatggagagtgccggtctgtggctgtgggtgccgaggagaacatgaacgacatcgtcgtgtaccacagaggctccaggtcctgtaaggatgcagctgtagggacacttgttgagatgagaaattgtggggtcagcgtgacagaggccatgcttggagtgatgactgaagctgacaaagaaattgagctccaacagcagaccatagaagccttgaaggaaaagatctatcgcctagaagtacagcttagagaaaccacccatgaccgggagatgactaaactgaaacaagagctgcaggctgctggatcgaggaaaaaggttgacaaagccacgatggcccagccgcttgttttcagtaaggtggtggaggcagtggtgcagaccagagaccaaatggtcggcagtcacatggacctggtggacacgtgtgttgggacctccgtggaaacaaacagtgtaggcatctcctgccagcctgaatgtaagaataaagtcgtagggcctgagctgcctatgaattggtggattgttaaggagagggtggaaatgcatgaccgatgtgctgggaggtctgtggaaatgtgtgacaagagtgtgagtgtggaagtcagcgtctgcgaaacaggcagcaacacagaggagtctgtgaacgacctcacactcctcaagacaaacttgaatctcaaagaagtgcggtctatcggttgtggagattgttctgttgacgtgaccgtctgctctccaaaggagtgcgcctcccggggcgtgaacactgaggctgttagccaggtggaagctgccgtcatggcagtgcctcgtactgcagaccaggacactagcacagatttggaacaggtgcaccagttcaccaacaccgagacggccaccctcatagagtcctgcaccaacacttgtctaagcactttggacaagcagaccagcacccagactgtggagacgcggacagtagctgtaggagaaggccgtgtcaaggacatcaactcctccaccaagacgcggtccattggtgttggaacgttgctttctggccattctgggtttgacaggccatcagctgtgaagaccaaagagtcaggtgtggggcagataaatattaacgacaactatctggttggtctcaaaatgaggactatagcttgtgggccaccacagttgactgtggggctgacagccagcagaaggagcgtgggggttggggatgaccctgtaggggaatctctggagaacccccagcctcaagctccacttggaatgatgactggcctggatcactacattgagcgtatccagaagctgctggcagaacagcagacactgctggctgagaactacagtgaactggcagaagctttcggggaacctcactcacagatgggctccctcaactctcagctcatcagcaccctgtcgtctatcaactctgtcatgaaatctgcaagcactgaagagctgaggaaccctgacttccagaaaaccagtctgggtaaaatcacaggcaattatttgggatatacctgtaagtgtgggggccttcagtcaggaagtcccttaagctcccagacatcccagcctgagcaagaagtggggacctcagaaggaaagccaatcagcagcctggatgccttccccactcaggaaggtacgctgtctccagtgaacctgacagacgaccagatcgccgctggcctctatgcatgtacaaacaatgaaagtacactgaagtccatcatgaagaagaaagatggtaacaaagattcaaatggcgcaaaaaagaatcttcagtttgttggcattaatggagggtatgaaacaacttcaagtgatgattccagctcagatgaaagctcttcttccgagtcagatgacgagtgtgatgtcattgagtatcctcttgaagaagaggaggaggaggaggatgaagacactcggggaatggcagaagggcaccatgcagttaatattgaaggtttgaagtctgccagggtggaagatgaaatgcaggttcaagaatgtgaacctgagaaggtggaaatcagagagaggtatgaattaagtgaaaagatgttgtctgcatgcaacttactgaaaaatactataaatgaccccaaagctttgaccagcaaagatatgaggttctgtctgaacaccctccagcacgagtggttccgcgtgtccagtcagaagtcagccattccagccatggtgggggactacatagctgcttttgaggccatttccccagatgtcctccgctatgtcatcaacttggcagacggcaacggcaacacagccctccattacagcgtgtcccactccaacttcgagattgtgaagctgctgttagatgccgatgtgtgtaatgtggatcaccagaacaaggcaggctacacccccatcatgttggcggccctcgccgctgtggaagcagagaaggacatgcggattgtggaagaactcttcggctgtggggatgtgaatgccaaagctagtcaggcgggacagacggccctcatgctggcggtcagtcacggacggatagacatggtgaagggccttctggcctgtggggctgatgtcaacatccaggatgacgagggctccacggccctcatgtgtgccagcgagcacgggcacgtggagattgtcaagctgctgctggcccagcccggctgcaacggtcacctagaggacaacgatggcagcactgcgctctcaatcgccctggaagcaggacacaaggacatcgctgttcttctgtatgcccatgtcaactttcccacccaccgaggttcatttgattgattgtatgcaaatagccctttatttacatgccactattaagctgctaattgttcctgttggggtgacagatactgaatgtatacgtattgtgcctgagctcaccagcaaacagaagcatcaagcccaggggtaaaggctgaagctttcacagtgcagagactgctagcctgggcacacacacctcctttctggccgtcttctgtgtagggcacactttaacccagtctctgttgctgttgagtctctgctccgttttgtacagtcacagggaattctgatctgaaggggcaccttctgttcactcccacaaagtggtgtctggttctcactgagacgttttaagatttttccacaaatatttatatgtactaaatgtggaaccattagaaagttcttccaaaatctcattccagcatagttttggatttttcttttgtcttattttaaaataaggaagtcgagatgactttgatcattggtaacttgggcctgggccagacaaagtataaaacttacaaaagaatattctcatttggtcttaactaggtagatgtaatatatgactttttataaaaagggtatctatatgaacttgacacagtattttcagcttttgtattccatactaaagccatgaagaactacacgtaacatcatcatttgtattaattgcacaactccaatgctaaaggttggattgtgttagaggaatcggctctgtatttgcctctagagaaacacagtgttctctttgtatttatggattcctttttaccgtgtcacatttactttggtcctctatgtatttaaatgtttgaagtgccttagactcttgccatattttcaaaataaaattccattaagctctt

SEQ ID NO: 417345 - DNA, 5250 bp, Homo sapiens
gaaaaacagagcctctctgtagagatgcttaaagtgctagctttatttaaaaatcagctggcaaagcgggagtgaagaacacacattttcagaagataccggtttcctgttttcattaagaaaacagggaatgcggaacagctgagtgcggcgggggtggtgtcactgcagccggagggagacctcgccggtgaaagctcagcctatggcatccgagcgtggccggccaagtttacacgaatgttgaaacttctcctcacggggtgaggatcgagggcgcccgaggccgggtccggctgagctggagcgagctgtgcggggcagcgcgggctggcggggagcgcggcgggcgccacgtggaaaagcaggtgatattctcagtggagaccaggacaaggaacagaaagacccttactttgtggagaccccctatggttatcaactagacttagatttcctcaaatatgtggatgacatacagaagggaaataccatcaaaagactgaacatccagaagaggcggaagccgtccgtgccatgcccagaacccaggaccacatctggtcagcaaggtatatggacttccactgaatccctctcatcctccaacagtgatgacaacaagcagtgccccaacttcctcatagccagaagtcaagttacatcaactccaatctcaaagccacctccccctctggagacctcactcccttttcttaccatcccagaaaatcgacagctgccacctccctcaccacaactcccaaagcataaccttcatgtcaccaagacactgatggagacccggagaagactggaacaggagagagccaccatgcagatgacaccgggtgagttcagaaggcccaggctggccagttttggaggcatgggcaccacaagctccctcccttcttttgtgggttctggaaaccacaatcctgccaagcaccagcttcagaatggataccaaggtaatggggattatggtagctatgccccagctgctcccaccacttcctccatggggagctccatccgccacagccccctgagctcagggatctccaccccagtgaccaacgtgagccccatgcacctgcagcacatccgcgagcagatggccattgctctgaaacgcctgaaggagctggaggagcaggtgcgaaccatccctgtgctccaggtaaagatctctgtcttgcaagaagagaaaaggcagttggtctcacagctgaaaaaccaaagggctgcatcccagatcaatgtctgtggtgtgaggaagcggtcctatagtgcggggaacgcctcccagctggaacagctctcccgggcccgaagaagtggcggggaattatacattgactatgaggaggaagaaatggagaccgtagaacagagcacgcagaggataaaggagttccggcaacttacagcagacatgcaagccctggagcagaagatccaggacagcagctgtgaggcctcctcagagctcagggagaatggagagtgccggtctgtggctgtgggtgccgaggagaacatgaacgacatcgtcgtgtaccacagaggctccaggtcctgtaaggatgcagctgtagggacacttgttgagatgagaaattgtggggtcagcgtgacagaggccatgcttggagtgatgactgaagctgacaaagaaattgagctccaacagcagaccatagaagccttgaaggaaaagatctatcgcctagaagtacagcttagagaaaccacccatgaccgggagatgactaaactgaaacaagagctgcaggctgctggatcgaggaaaaaggttgacaaagccacgatggcccagccgcttgttttcagtaaggtggtggaggcagtggtgcagaccagagaccaaatggtcggcagtcacatggacctggtggacacgtgtgttgggacctccgtggaaacaaacagtgtaggcatctcctgccagcctgaatgtaagaataaagtcgtagggcctgagctgcctatgaattggtggattgttaaggagagggtggaaatgcatgaccgatgtgctgggaggtctgtggaaatgtgtgacaagagtgtgagtgtggaagtcagcgtctgcgaaacaggcagcaacacagaggagtctgtgaacgacctcacactcctcaagacaaacttgaatctcaaagaagtgcggtctatcggttgtggagattgttctgttgacgtgaccgtctgctctccaaaggagtgcgcctcccggggcgtgaacactgaggctgttagccaggtggaagctgccgtcatggcagtgcctcgtactgcagaccaggacactagcacagatttggaacaggtgcaccagttcaccaacaccgagacggccaccctcatagagtcctgcaccaacacttgtctaagcactttggacaagcagaccagcacccagactgtggagacgcggacagtagctgtaggagaaggccgtgtcaaggacatcaactcctccaccaagacgcggtccattggtgttggaacgttgctttctggccattctgggtttgacaggccatcagctgtgaagaccaaagagtcaggtgtggggcagataaatattaacgacaactatctggttggtctcaaaatgaggactatagcttgtgggccaccacagttgactgtggggctgacagccagcagaaggagcgtgggggttggggatgaccctgtaggggaatctctggagaacccccagcctcaagctccacttggaatgatgactggcctggatcactacattgagcgtatccagaagctgctggcagaacagcagacactgctggctgagaactacagtgaactggcagaagctttcggggaacctcactcacagatgggctccctcaactctcagctcatcagcaccctgtcgtctatcaactctgtcatgaaatctgcaagcactgaagagctgaggaaccctgacttccagaaaaccagtctgggtaaaatcacaggcaattatttgggatatacctgtaagtgtgggggccttcagtcaggaagtcccttaagctcccagacatcccagcctgagcaagaagtggggacctcagaaggaaagccaatcagcagcctggatgccttccccactcaggaaggtacgctgtctccagtgaacctgacagacgaccagatcgccgctggcctctatgcatgtacaaacaatgaaagtacactgaagtccatcatgaagaagaaagatggtaacaaagattcaaatggcgcaaaaaagaatcttcagtttgttggcattaatggagggtatgaaacaacttcaagtgatgattccagctcagatgaaagctcttcttccgagtcagatgacgagtgtgatgtcattgagtatcctcttgaagaagaggaggaggaggaggatgaagacactcggggaatggcagaagggcaccatgcagttaatattgaaggtttgaagtctgccagggtggaagatgaaatgcaggttcaagaatgtgaacctgagaaggtggaaatcagagagaggtatgaattaagtgaaaagatgttgtctgcatgcaacttactgaaaaatactataaatgaccccaaagctttgaccagcaaagatatgaggttctgtctgaacaccctccagcacgagtggttccgcgtgtccagtcagaagtcagccattccagccatggtgggggactacatagctgcttttgaggccatttccccagatgtcctccgctatgtcatcaacttggcagacggcaacggcaacacagccctccattacagcgtgtcccactccaacttcgagattgtgaagctgctgttagatgccgatgtgtgtaatgtggatcaccagaacaaggcaggctacacccccatcatgttggcggccctcgccgctgtggaagcagagaaggacatgcggattgtggaagaactcttcggctgtggggatgtgaatgccaaagctagtcaggcgggacagacggccctcatgctggcggtcagtcacggacggatagacatggtgaagggccttctggcctgtggggctgatgtcaacatccaggatgacgagggctccacggccctcatgtgtgccagcgagcacgggcacgtggagattgtcaagctgctgctggcccagcccggctgcaacggtcacctagaggacaacgatggcagcactgcgctctcaatcgccctggaagcaggacacaaggacatcgctgttcttctgtatgcccatgtcaactttgcaaaagcccagtctccgggcacccctaggcttggaaggaagacgtctcctggccccacccaccgaggttcatttgattgattgtatgcaaatagccctttatttacatgccactattaagctgctaattgttcctgttggggtgacagatactgaatgtatacgtattgtgcctgagctcaccagcaaacagaagcatcaagcccaggggtaaaggctgaagctttcacagtgcagagactgctagcctgggcacacacacctcctttctggccgtcttctgtgtagggcacactttaacccagtctctgttgctgttgagtctctgctccgttttgtacagtcacagggaattctgatctgaaggggcaccttctgttcactcccacaaagtggtgtctggttctcactgagacgttttaagatttttccacaaatatttatatgtactaaatgtggaaccattagaaagttcttccaaaatctcattccagcatagttttggatttttcttttgtcttattttaaaataaggaagtcgagatgactttgatcattggtaacttgggcctgggccagacaaagtataaaacttacaaaagaatattctcatttggtcttaactaggtagatgtaatatatgactttttataaaaagggtatctatatgaacttgacacagtattttcagcttttgtattccatactaaagccatgaagaactacacgtaacatcatcatttgtattaattgcacaactccaatgctaaaggttggattgtgttagaggaatcggctctgtatttgcctctagagaaacacagtgttctctttgtatttatggattcctttttaccgtgtcacatttactttggtcctctatgtatttaaatgtttgaagtgccttagactcttgccatattttcaaaataaaattccattaagctctt

SEQ ID NO: 417346 - DNA, 5833 bp, Homo sapiens
gaaaaacagagcctctctgtagagatgcttaaagtgctagctttatttaaaaatcagctggcaaagcgggagtgaagaacacacattttcagaagataccggtttcctgttttcattaagaaaacagggaatgcggaacagctgagtgcggcgggggtggtgtcactgcagccggagggagacctcgccggtgaaagctcagcctatggcatccgagcgtggccggccaagtttacacgaatgttgaaacttctcctcacggggtgaggatcgagggcgcccgaggccgggtccggctgagctggagcgagctgtgcggggcagcgcgggctggcggggagcgcggcgggcgccacgtggaaaagcaggtgatattctcagtggagaccaggacaaggaacagaaagacccttactttgtggagaccccctatggttatcaactagacttagatttcctcaaatatgtggatgacatacagaagggaaataccatcaaaagactgaacatccagaagaggcggaagccgtccgtgccatgcccagaacccaggaccacatctggtcagcaaggtatatggacttccactgaatccctctcatcctccaacagtgatgacaacaagcagtgccccaacttcctcatagccagaagtcaagttacatcaactccaatctcaaagccacctccccctctggagacctcactcccttttcttaccatcccagaaaatcgacagctgccacctccctcaccacaactcccaaagcataaccttcatgtcaccaagacactgatggagacccggagaagactggaacaggagagagccaccatgcagatgacaccgggtgagttcagaaggcccaggctggccagttttggaggcatgggcaccacaagctccctcccttcttttgtgggttctggaaaccacaatcctgccaagcaccagcttcagaatggataccaaggtaatggggattatggtagctatgccccagctgctcccaccacttcctccatggggagctccatccgccacagccccctgagctcagggatctccaccccagtgaccaacgtgagccccatgcacctgcagcacatccgcgagcagatggccattgctctgaaacgcctgaaggagctggaggagcaggtgcgaaccatccctgtgctccaggtaaagatctctgtcttgcaagaagagaaaaggcagttggtctcacagctgaaaaaccaaagggctgcatcccagatcaatgtctgtggtgtgaggaagcggtcctatagtgcggggaacgcctcccagctggaacagctctcccgggcccgaagaagtggcggggaattatacattgactatgaggaggaagaaatggagaccgtagaacagagcacgcagaggataaaggagttccggcaacttacagcagacatgcaagccctggagcagaagatccaggacagcagctgtgaggcctcctcagagctcagggagaatggagagtgccggtctgtggctgtgggtgccgaggagaacatgaacgacatcgtcgtgtaccacagaggctccaggtcctgtaaggatgcagctgtagggacacttgttgagatgagaaattgtggggtcagcgtgacagaggccatgcttggagtgatgactgaagctgacaaagaaattgagctccaacagcagaccatagaagccttgaaggaaaagatctatcgcctagaagtacagcttagagaaaccacccatgaccgggagatgactaaactgaaacaagagctgcaggctgctggatcgaggaaaaaggttgacaaagccacgatggcccagccgcttgttttcagtaaggtggtggaggcagtggtgcagaccagagaccaaatggtcggcagtcacatggacctggtggacacgtgtgttgggacctccgtggaaacaaacagtgtaggcatctcctgccagcctgaatgtaagaataaagtcgtagggcctgagctgcctatgaattggtggattgttaaggagagggtggaaatgcatgaccgatgtgctgggaggtctgtggaaatgtgtgacaagagtgtgagtgtggaagtcagcgtctgcgaaacaggcagcaacacagaggagtctgtgaacgacctcacactcctcaagacaaacttgaatctcaaagaagtgcggtctatcggttgtggagattgttctgttgacgtgaccgtctgctctccaaaggagtgcgcctcccggggcgtgaacactgaggctgttagccaggtggaagctgccgtcatggcagtgcctcgtactgcagaccaggacactagcacagatttggaacaggtgcaccagttcaccaacaccgagacggccaccctcatagagtcctgcaccaacacttgtctaagcactttggacaagcagaccagcacccagactgtggagacgcggacagtagctgtaggagaaggccgtgtcaaggacatcaactcctccaccaagacgcggtccattggtgttggaacgttgctttctggccattctgggtttgacaggccatcagctgtgaagaccaaagagtcaggtgtggggcagataaatattaacgacaactatctggttggtctcaaaatgaggactatagcttgtgggccaccacagttgactgtggggctgacagccagcagaaggagcgtgggggttggggatgaccctgtaggggaatctctggagaacccccagcctcaagctccacttggaatgatgactggcctggatcactacattgagcgtatccagaagctgctggcagaacagcagacactgctggctgagaactacagtgaactggcagaagctttcggggaacctcactcacagatgggctccctcaactctcagctcatcagcaccctgtcgtctatcaactctgtcatgaaatctgcaagcactgaagagctgaggaaccctgacttccagaaaaccagtctgggtaaaatcacaggcaattatttgggatatacctgtaagtgtgggggccttcagtcaggaagtcccttaagctcccagacatcccagcctgagcaagaagtggggacctcagaaggaaagccaatcagcagcctggatgccttccccactcaggaaggtacgctgtctccagtgaacctgacagacgaccagatcgccgctggcctctatgcatgtacaaacaatgaaagtacactgaagtccatcatgaagaagaaagatggtaacaaagattcaaatggcgcaaaaaagaatcttcagtttgttggcattaatggagggtatgaaacaacttcaagtgatgattccagctcagatgaaagctcttcttccgagtcagatgacgagtgtgatgtcattgagtatcctcttgaagaagaggaggaggaggaggatgaagacactcggggaatggcagaagggcaccatgcagttaatattgaaggtttgaagtctgccagggtggaagatgaaatgcaggttcaagaatgtgaacctgagaaggtggaaatcagagagaggtatgaattaagtgaaaagatgttgtctgcatgcaacttactgaaaaatactataaatgaccccaaagctttgaccagcaaagatatgaggttctgtctgaacaccctccagcacgagtggttccgcgtgtccagtcagaagtcagccattccagccatggtgggggactacatagctgcttttgaggccatttccccagatgtcctccgctatgtcatcaacttggcagacggcaacggcaacacagccctccattacagcgtgtcccactccaacttcgagattgtgaagctgctgttagatgccgatgtgtgtaatgtggatcaccagaacaaggcaggctacacccccatcatgttggcggccctcgccgctgtggaagcagagaaggacatgcggattgtggaagaactcttcggctgtggggatgtgaatgccaaagctagtcaggcgggacagacggccctcatgctggcggtcagtcacggacggatagacatggtgaagggccttctggcctgtggggctgatgtcaacatccaggatgacgagggctccacggccctcatgtgtgccagcgagcacgggcacgtggagattgtcaagctgctgctggcccagcccggctgcaacggtcacctagaggacaacgatggcagcactgcgctctcaatcgccctggaagcaggacacaaggacatcgctgttcttctgtatgcccatgtcaactttgcaaaagcccagtctccggtcagtgttgtgcatttggcatttgtaaataggctgaaatccaccagactggtggacccccttcctccaggaattgacgggagacagattttatgttgattcagaaaatggaagttttagtctggagcttaagagttcatcctttccgcctccaccccgcaaaaagcaggagaactaatgttttagcagaggctggaccttgcttgtccttgcaagacatatgctcacagcttcccatagaggttttgattctgtgcagaattatccagatagcagcccctgagcccatggggatatttcgccatggttctggcattgttcctgaagcagatggcaggcagcctgtagtccacagttcactctgagtgggaaggtgacttcccaggacagccggacatagcactgctgagcccagctggccttggagctgtggacacctgttccctgttctcagccagagctctcctggctcgggctcacagctgcttgttgcctgtggtgggccaagatcctatgtcacagggtacacatctgcctgaggtcacttattaacccccagtttttttcctttcctggtctctagggcacccctaggcttggaaggaagacgtctcctggccccacccaccgaggttcatttgattgattgtatgcaaatagccctttatttacatgccactattaagctgctaattgttcctgttggggtgacagatactgaatgtatacgtattgtgcctgagctcaccagcaaacagaagcatcaagcccaggggtaaaggctgaagctttcacagtgcagagactgctagcctgggcacacacacctcctttctggccgtcttctgtgtagggcacactttaacccagtctctgttgctgttgagtctctgctccgttttgtacagtcacagggaattctgatctgaaggggcaccttctgttcactcccacaaagtggtgtctggttctcactgagacgttttaagatttttccacaaatatttatatgtactaaatgtggaaccattagaaagttcttccaaaatctcattccagcatagttttggatttttcttttgtcttattttaaaataaggaagtcgagatgactttgatcattggtaacttgggcctgggccagacaaagtataaaacttacaaaagaatattctcatttggtcttaactaggtagatgtaatatatgactttttataaaaagggtatctatatgaacttgacacagtattttcagcttttgtattccatactaaagccatgaagaactacacgtaacatcatcatttgtattaattgcacaactccaatgctaaaggttggattgtgttagaggaatcggctctgtatttgcctctagagaaacacagtgttctctttgtatttatggattcctttttaccgtgtcacatttactttggtcctctatgtatttaaatgtttgaagtgccttagactcttgccatattttcaaaataaaattccattaagctctt

SEQ ID NO: 417347 - DNA, 1460 bp, Homo sapiens
accgactacggcggactaatctgcaactcctacatacttcccccaattattcctagaaccaggcggcgttggataaagtctgccgatgtgtgtaatgtggatcaccagaacaaggcaggctacacccccatcatgttggcggccctcgccgctgtggaagcagagaaggacatgcggattgtggaagaactcttcggctgtggggatgtgaatgccaaagctagtcaggcgggacagacggccctcatgctggcggtcagtcacggacggatagacatggtgaagggccttctggcctgtggggctgatgtcaacatccaggatgacgagggctccacggccctcatgtgtgccagcgagcacgggcacgtggagattgtcaagctgctgctggcccagcccggctgcaacggtcacctagaggacaacgatggcagcactgcgctctcaatcgccctggaagcaggacacaaggacatcgctgttcttctgtatgcccatgtcaactttgcaaaagcccagtctccgggcacccctaggcttggaaggaagacgtctcctggccccacccaccgaggttcatttgattgattgtatgcaaatagccctttatttacatgccactattaagctgctaattgttcctgttggggtgacagatactgaatgtatacgtattgtgcctgagctcaccagcaaacagaagcatcaagcccaggggtaaaggctgaagctttcacagtgcagagactgctagcctgggcacacacacctcctttctggccgtcttctgtgtagggcacactttaacccagtctctgttgctgttgagtctctgctccgttttgtacagtcacagggaattctgatctgaaggggcaccttctgttcactcccacaaagtggtgtctggttctcactgagacgttttaagatttttccacaaatatttatatgtactaaatgtggaaccattagaaagttcttccaaaatctcattccagcatagttttggatttttcttttgtcttattttaaaataaggaagtcgagatgactttgatcattggtaacttgggcctgggccagacaaagtataaaacttacaaaagaatattctcatttggtcttaactaggtagatgtaatatatgactttttataaaaagggtatctatatgaacttgacacagtattttcagcttttgtattccatactaaagccatgaagaactacacgtaacatcatcatttgtattaattgcacaactccaatgctaaaggttggattgtgttagaggaatcggctctgtatttgcctctagagaaacacagtgttctctttgtatttatggattcctttttaccgtgtcacatttactttggtcctctatgtatttaaatgtttgaagtgccttagactcttgccatattttcaaaataaaattccattaagctctt

SEQ ID NO: 417348 - DNA, 358 bp, Homo sapiens
aattttgaggctaggagttctaggtctagactccctcccagggccattgtgagatttaaatgagatttaatgaatttgaaaacacattgtaagttttaaataacttcacagctataaggggttgctaatactatcagtgtctgagatatctagaataccaaggaattttcttctaatttgttagcaagattttattccttcaagtttccatttgtgagaggtccttttttgtaggctcgcctcttctgttccaacatttttaatcagcctttctgcatggctttttattgtgaactatcttcagtacctttttcttgccactacactccagcctggcaatagagcgagctccgtctca

SEQ ID NO: 417349 - DNA, 426 bp, Homo sapiens
gaataaaactgaaaatcaactccaaaaggaatattcaaaaccatgcaaatacatggaaattaaataacctgctcctgaatgagcattgggtgaaaaatgaaatcacgatggaaatgtaaaaaatttcttcgaactggatgacacaacctatcaagacctctgggatacagcaaaggcagtgctaagaggaaagtctgtagccctaaacacctacgtcaaaaagtctgaaagagcacagaccgaatctaagttcacatctcagggaactagagaagcaggaacaagccaaacccaatcccagcaaacaaaggaaataaccaagatcagagcagaactaaatgaaattgacacaagaacaacaacaacaaaaaacacaaaacataaataaaacaaaaattggctatttgaaaagataaataaaatcga

SEQ ID NO: 417350 - DNA, 381 bp, Homo sapiens
tgttactgttgccacatgcacttctagagtgaaatactttgggacaaacctgaagaatttttttctcttctagatgtcaactttcaaaattatggaaaaatgaactaaatatcataataaagattcactcattcataatttaaacaagcccctgaagccctctctccaaatgtaagaattgttccctgccagtttgttctcttctcaggttcattgtttggcccacacctcctcccctcaacactccccaaggctgtattccagttagtgatactctgcctgcaatgtagcttttctcagtcactagaaaatgtcaagaaagtatagtttgaactgtggaggttattaatctctacgacactgtcaaaggaaagagggaga

SEQ ID NO: 417351 - DNA, 671 bp, Homo sapiens
cagtgaattataatccctttttggaaatgagggaatgtaaattttaaaagttaagcaattatccaaggtgacacagctgtgaaagtggtagaggccaggctttctgacacccagtccagtactctccttggaattagcctccattttacccacagtgttaaaatggctgggtattgggaacctcaggaaattttccagcttcctgatctggtgcccctagtcacataggatgtgtgatcacgtgatagctacatctggaccagaatcccatggcaatatcccacggtttaagggcataatatctccgtggtggtagattgtcaagtcaaaaacgggacatgttctaacagcaaagctacccaatatgaaacacaaagctacttttagattttttaagacttactgatattcctgggccctaagagcttgtctatggtcctatctttgcaaactagtatttacacaaaatgagccacctggtttttttaaagtcagtattgtgtgtgtgtgtgtaaatatgacatggagaaagcttctgttacctagtaagatagtaaagtatgtaagacatggcccttcccccagtctacattgaggtatagtgtattaaaggatctcaggagacttgcagcaaattactactgcttctgtgcttaaattcagaagtctga

SEQ ID NO: 417352 - DNA, 2429 bp, Homo sapiens
  misc_feature (314)..(315): n is a, c, g, or t
ggaataggttagtttcagacaagcctgcttgccggagctcagcagacaccaggccttccgggcaggcctggcccaccgtgggcctcagagctgctgctggggcattcagaaccggctctccattggcattgggaccagagaccccgcaagtggcctgtttgcctggacatccacctgtacgtccccaggtttcgggaggcccaggggcgatgccagaccccgcggcgcacctgcccttcttctacggcagcatctcgcgtgccgaggccgaggagcacctgaagctggcgggcatggcggacgggctcttcctnntgcgccagtgcctgcgctcgctgggcggctatgtgtgtcgctcgtgcacgatgtgcgcttccaccactttcccatcgagcgccagctcaacggcacctacgccattgccggcggcaaagcgcactgtggaccggcagagctctgcgagttctactcgcgcgaccccgacgggctgccctgcaacctgcgcaagccgtgcaaccgccgtcgggcctcgagccgcagccgggggtcttcgactgcctgcgagacgccatggtgcgtgactacgtgcgccagacgtggaagctggagggcgaggccctggagcaggccatcatcagccaggccccgcaggtggagaagctcattgctacgacggcccacgagcggatgccctggtaccacagcagcctgacgcgtgaggaggccgagcgcaaactttactctggggcgcagaccgacggcaagttcctgctgaggccgcggaaggagcagggcacatacgccctgtccctcatctatgggaagacggtgtaccactacctcatcagccaagacaaggcgggcaagtactgcattcccgagggcaccaagtttgacacgctctggcagctggtggagtatctgaagctgaaggcggacgggctcatctactgcctgaaggaggcctgccccaacagcagtgccagcaacgcctcaggggctgctgctcccacactcccagcccacccatccacgttgactcatcctcagagacgaatcgacaccctcaactcagatggatacacccctgagccagcacgcataacgtccccagacaaaccgcggccgatgcccatggacacgagcgtgtatgagagcccctacagcgacccagaggagctcaaggacaagaagctcttcctgaagcgcgataacctcctcatagctgacattgaacttggctgcggcaactttggctcagtgcgccagggcgtgtaccgcatgcgcaagaagcagatcgacgtggccatcaaggtgctgaagcagggcacggagaaggcagacacggaagagatgatgcgcgaggcgcagatcatgcaccagctggacaacccctacatcgtgcggctcattggcgtctgccaggccgaggccctcatgctggtcatggagatggctgggggcgggccgctgcacaagttcctggtcggcaagagggaggagatccctgtgagcaatgtggccgagctgctgcaccaggtgtccatggggatgaagtacctggaggagaagaactttgtgcaccgtgacctggcggcccgcaacgtcctgctggttaaccggcactacgccaagatcagcgactttggcctctccaaagcactgggtgccgacgacagctactacactgcccgctcagcagggaagtggccgctcaagtggtacgcacccgaatgcatcaacttccgcaagttctccagccgcagcgatgtctggagctatggggtcaccatgtgggaggccttgtcctacggccagaagccctacaagaagatgaaagggccggaggtcatggccttcatcgagcagggcaagcggatggaatgcccaccagagtgtccacccgaactgtacgcactcatgagtgactgctggatctacaagtgggaggatcgccccgacttcctgaccgtggagcagcgcatgcgagcctgttactacagcctggccagcaaggtggaagggcccccaggcagcacacagaaggctgaggctgcctgtgcctgagctcccgctgcccaggggagccctccacgccggctcttccccaccctcagccccaccccaggtcctgcagtctggctgagccctgcttggttgtctccacacacagctgggctgtggtagggggtgtctcaggccacaccggccttgcattgcctgcctggccccctgtcctctctggctggggagcagggaggtccgggagggtgcggctgtgcagcctgtcctgggctggtggctcccggagggccctgagctgagggcattgcttacacggatgccttcccctgggccctgacattggagcctgggcatcctcaggtggtcaggcgtagatcaccagaataaacccagcttccctcttg

SEQ ID NO: 417353 - DNA, 1954 bp, Homo sapiens
ggggtctggaggggcgtggccgaagaggggcagtcgagggttttggggggataggagggaggaaaaggtcgtcttccccattcagtcccctttggaagctggagaggtggggcactggttggggaagaacctgaaaggaggcctcagaggcaggggctccgtggtggcggtcgcttccgcaggctgagcgatgctatggtgctctactatgccagatgggaaggtcttcaagctggagatgcgcttggggccgcgctggaagggcgaggccctggagcaggccatcatcagccaggccccgcaggtggagaagctcattgctacgacggcccacgagcggatgccctggtaccacagcagcctgacgcgtgaggaggccgagcgcaaactttactctggggcgcagaccgacggcaagttcctgctgaggccgcggaaggagcagggcacatacgccctgtccctcatctatgggaagacggtgtaccactacctcatcagccaagacaaggcgggcaagtactgcattcccgagggcaccaagtttgacacgctctggcagctggtggagtatctgaagctgaaggcggacgggctcatctactgcctgaaggaggcctgccccaacagcagtgccagcaacgcctcaggggctgctgctcccacactcccagcccacccatccacgttgactcatcctcagagacgaatcgacaccctcaactcagatggatacacccctgagccagcacgcataacgtccccagacaaaccgcggccgatgcccatggacacgagcgtgtatgagagcccctacagcgacccagaggagctcaaggacaagaagctcttcctgaagcgcgataacctcctcatagctgacattgaacttggctgcggcaactttggctcagtgcgccagggcgtgtaccgcatgcgcaagaagcagatcgacgtggccatcaaggtgctgaagcagggcacggagaaggcagacacggaagagatgatgcgcgaggcgcagatcatgcaccagctggacaacccctacatcgtgcggctcattggcgtctgccaggccgaggccctcatgctggtcatggagatggctgggggcgggccgctgcacaagttcctggtcggcaagagggaggagatccctgtgagcaatgtggccgagctgctgcaccaggtgtccatggggatgaagtacctggaggagaagaactttgtgcaccgtgacctggcggcccgcaacgtcctgctggttaaccggcactacgccaagatcagcgactttggcctctccaaagcactgggtgccgacgacagctactacactgcccgctcagcagggaagtggccgctcaagtggtacgcacccgaatgcatcaacttccgcaagttctccagccgcagcgatgtctggagctatggggtcaccatgtgggaggccttgtcctacggccagaagccctacaagaagatgaaagggccggaggtcatggccttcatcgagcagggcaagcggatggaatgcccaccagagtgtccacccgaactgtacgcactcatgagtgactgctggatctacaagtgagtgccagtggggaggggacccggctgggctgacccctggaaagtcctggtgcccgatgagttgatgtcaatataactctacccaatgtcatctcacccaaagcccttcacccagttcatagcctttgcagctgccccctacccccacacccagctctccaacacaccagggtttgctgtcctgctccagtgtgccacaccctgccatcccacctgtgggcctgtgcctcagcatctaaaacctcagccatcactcaacacatggaccctgcaacacgcaaacaggtccatactctgctactcaacctatgacactgacactcagggcatgagatgattctccagtacccaacac

SEQ ID NO: 417354 - DNA, 2737 bp, Homo sapiens
ggggtctggaggggcgtggccgaagaggggcagtcgagggttttggggggataggagggaggaaaaggtcgtcttccccattcagtcccctttggaagctggagaggtggggcactggttggggaagaacctgaaaggaggcctcagaggcaggggctccgtggtggcggtcgcttccgcaggctgagcgatgctatggtgctctactatgccagatgggaaggtcttcaagctggagatgcgcttggggccgcgctggaagggcgaggccctggagcaggccatcatcagccaggccccgcaggtggagaagctcattgctacgacggcccacgagcggatgccctggtaccacagcagcctgacgcgtgaggaggccgagcgcaaactttactctggggcgcagaccgacggcaagttcctgctgaggccgcggaaggagcagggcacatacgccctgtccctcatctatgggaagacggtgtaccactacctcatcagccaagacaaggcgggcaagtactgcattcccgagggcaccaagtttgacacgctctggcagctggtggagtatctgaagctgaaggcggacgggctcatctactgcctgaaggaggcctgccccaacagcagtgccagcaacgcctcaggggctgctgctcccacactcccagcccacccatccacgttgactcatcctcagagacgaatcgacaccctcaactcagatggatacacccctgagccagcacgcataacgtccccagacaaaccgcggccgatgcccatggacacgagcgtgtatgagagcccctacagcgacccagaggagctcaaggacaagaagctcttcctgaagcgcgataacctcctcatagctgacattgaacttggctgcggcaactttggctcagtgcgccagggcgtgtaccgcatgcgcaagaagcagatcgacgtggccatcaaggtgctgaagcagggcacggagaaggcagacacggaagagatgatgcgcgaggcgcagatcatgcaccagctggacaacccctacatcgtgcggctcattggcgtctgccaggccgaggccctcatgctggtcatggagatggctgggggcgggccgctgcacaagttcctggtcggcaagagggaggagatccctgtgagcaatgtggccgagctgctgcaccaggtgtccatggggatgaagtacctggaggagaagaactttgtgcaccgtgacctggcggcccgcaacgtcctgctggttaaccggcactacgccaagatcagcgactttggcctctccaaagcactgggtgccgacgacagctactacactgcccgctcagcagggaagtggccgctcaagtggtacgcacccgaatgcatcaacttccgcaagttctccagccgcagcgatgtctggagctatggggtcaccatgtgggaggccttgtcctacggccagaagccctacaagaagatgaaagggccggaggtcatggccttcatcgagcagggcaagcggatggaatgcccaccagagtgtccacccgaactgtacgcactcatgagtgactgctggatctacaagtgggaggatcgccccgacttcctgaccgtggagcagcgcatgcgagcctgttactacagcctggccagcaaggtggaagggcccccaggcagcacacagaaggctgaggctgcctgtgcctgagctcccgctgcccaggggagccctccacgccggctcttccccaccctcagccccaccccaggtcctgcagtctggctgagccctgcttggttgtctccacacacagctgggctgtggtagggggtgtctcaggccacaccggccttgcattgcctgcctggccccctgtcctctctggctggggagcagggaggtccgggagggtgcggctgtgcagcctgtcctgggctggtggctcccggagggccctgagctgagggcattgcttacacggatgccttcccctgggccctgacattggagcctgggcatcctcaggtggtcaggcgtagatcaccagaataaacccagcttccctcttgtctgagcgccctcatcttttccggggtgagggtaggtgtcaggggaggggtgggttatgaaaagtgcatggaggtgactgttcttgtgtggactgagcctggaagtgacccctgggaagatggggctgggtcccactctccaccctagggacaccttcatgtgagtgagcggctggggtggagtggggaacctgaggccaggcgggtgtgggcccaagggctgcgtgcctggctgagcccagctcccctgtgtggagatgagtgtgccccatgccaggtgcacgttaggatcacctggagctattttaacaaacgctaaccccccctcccccatccagctggggtcttcaccccccaggggtgccttgcaaatcatgagatacaatgcttttcattggtagatgcacgtattagctcccgtatgaaccgtattactgaatttgaatctgaaaaataccaaaatgcaaacattgtttttaaattaattgttttaaaagctaatgaacgaattaagacaaattgcatcaatttagtggtttcttaaatcgtggtttgcaggtagttcagttttattaaaattcatttgtgagtcgctgaacgacttacattatgtaaaatatatcagacagtaaatgaattgtggctttcaaagcct

SEQ ID NO: 417355 - DNA, 2082 bp, Homo sapiens
ggggtctggaggggcgtggccgaagaggggcagtcgagggttttggggggataggagggaggaaaaggtcgtcttccccattcagtcccctttggaagctggagaggtggggcactggttggggaagaacctgaaaggaggcctcagaggcaggggctccgtggtggcggtcgcttccgcaggctgagcgatgctatggtgctctactatgccagatgggaaggtcttcaagctggagatgcgcttggggccgcgctggaagggcgaggccctggagcaggccatcatcagccaggccccgcaggtggagaagctcattgctacgacggcccacgagcggatgccctggtaccacagcagcctgacgcgtgaggaggccgagcgcaaactttactctggggcgcagaccgacggcaagttcctgctgaggccgcggaaggagcagggcacatacgccctgtccctcatctatgggaagacggtgtaccactacctcatcagccaagacaaggcgggcaagtactgcattcccgagggcaccaagtttgacacgctctggcagctggtggagtatctgaagctgaaggcggacgggctcatctactgcctgaaggaggcctgccccaacagcagtgccagcaacgcctcaggggctgctgctcccacactcccagcccacccatccacgttgactcatcctcagagacgaatcgacaccctcaactcagatggatacacccctgagccagcacgcataacgtccccagacaaaccgcggccgatgcccatggacacgagcgtgtatgagagcccctacagcgacccagaggagctcaaggacaagaagctcttcctgaagcgcgataacctcctcatagctgacattgaacttggctgcggcaactttggctcagtgcgccagggcgtgtaccgcatgcgcaagaagcagatcgacgtggccatcaaggtgctgaagcagggcacggagaaggcagacacggaagagatgatgcgcgaggcgcagatcatgcaccagctggacaacccctacatcgtgcggctcattggcgtctgccaggccgaggccctcatgctggtcatggagatggctgggggcgggccgctgcacaagttcctggtcggcaagagggaggagatccctgtgagcaatgtggccgagctgctgcaccaggtgtccatggggatgaagtacctggaggagaagaactttgtgcaccgtgacctggcggcccgcaacgtcctgctggttaaccggcactacgccaagatcagcgactttggcctctccaaagcactgggtgccgacgacagctactacactgcccgctcagcagggaagtggccgctcaagtggtacgcacccgaatgcatcaacttccgcaagttctccagccgcagcgatgtctggagctatggggtcaccatgtgggaggccttgtcctacggccagaagccctacaagaagatgaaagggccggaggtcatggccttcatcgagcagggcaagcggatggaatgcccaccagagtgtccacccgaactgtacgcactcatgagtgactgctggatctacaagtgggaggatcgccccgacttcctgaccgtggagcagcgcatgcgagcctgttactacagcctggccagcaaggtggaagggcccccaggcagcacacagaaggctgaggctgcctgtgcctgagctcccgctgcccaggggagccctccacgccggctcttccccaccctcagccccaccccaggtcctgcagtctggctgagccctgcttggttgtctccacacacagctgggctgtggtagggggtgtctcaggccacaccggccttgcattgcctgcctggccccctgtcctctctggctggggagcagggaggtccgggagggtgcggctgtgcagcctgtcctgggctggtggctcccggagggccctgagctgagggcattgcttacacggatgccttcccctgggccctgacattggagcctgggcatcctcaggtggtcaggcgtagatcaccagaataaacccagcttccctcttg

SEQ ID NO: 417356 - DNA, 827 bp, Homo sapiens
cagttgtgtaagaacactcctgctgccctacttctttgccaacattttatatgtttagactttctcttttttccaaactaatgggtgtaaagtggtatttaattttaagttgcatttctctgattactaatgaaattgagtacctctttatattactagttagttatttggctttttattgttgtgacgatttaagatttcatgttgatgtagatcttaattttgagttggtcaaacatatcactttttaaaatcttatactttataattttagggcccagggccacagagttattttctgacgttttgttttctgttagtcacatttacattcaggccttgattcatcttgtggtcacctttggttatatcagcatcgtttgaggtagcacattcacactctcaaatacagtgtgatagtttggtatgcactagagggccatgctgtatcatggattcattttgaaagagtatttaatgaaaaatataaaagaaggctattcatagcatattgccatttatgaaaatttaaaacacacacacatatatgtaaaacaacacttaatatttttcaaagaaacactccatatccaaagacagatgccagacaattaagtttttgcttatgaaggtttaggaggaaatgggggagtagtgataaagggggtaaaaaaataaaataagccaacagaggccttggacagactgataataatagtataccctgaattgaggagtatgattatccccacagtcagggtgaatataatttaggagagatgacctcctaataggttagtgatgagcaaagctggaaaaagttaatt

SEQ ID NO: 417357 - DNA, 2520 bp, Homo sapiens
cctggggctttcgttgttatatactggcccttcgtcttacaaattaacaagcaaaacgggcacactagtcacccccgagggaggccaccatcactgtaactgttggccaaagctacaaaagaagcgagggaatccaaccgagcgcagcgacactgagaacagcttcccctgccttctgcggcggcagaagtgaagtgcctgaggaccggaaggatggtgcagtcctgctccgcctacggctgcaagaaccgctacgacaaggacaagcccgtttctttccacaagtttcctcttactcgacccagtctttgtaaagaatgggaggcagctgtcagaagaaaaaactttaaacccaccaagtatagcagtatttgttcagagcactttactccagactgctttaagagagagtgcaacaacaagttactgaaagagaatgctgtgcccacaatatttctttgtactgagccacatgacaagaaagaagatcttctggagccacaggaacagcttcccccacctcctttaccgcctcctgtttcccaggttgatgctgctattggattactaatgccgcctcttcagacccctgttaatctctcagttttctgtgaccacaactatactgtggaggatacaatgcaccagcggaaaaggattcatcagctagaacagcaagttgaaaaactcagaaagaagctcaagaccgcacagcagcgatgcagaaggcaagaacggcagcttgaaaaattaaaggaggttgttcacttccagaaagagaaagacgacgtatcagaaagaggttatgtgattctaccaaatgactactttgaaatagttgaagtaccagcataaaaaaatgaaatgtgtattgatttctaatggggcaataccacatatcctcctctagcctgtaaaggagtttcatttaaaaaaataacatttgattacttatataaaaacagttcagaatatttttttaaaaaaaattctatatatactgtaaaattataaatttttttgtttgtaatttcaggttttttacattttaacaaaatattttaaaagttataaactaacctcagacctctaatgtaagttggtttcaagattggggattttggggtttttttttagtatttatagaaataatgtaaaaataaaaagtaaagagaatgagaacagtgtggtaaaagggtgatttcagtttaaaacttaaaattagtactgttttattgagagaatttagttatattttaaatcagaagtatgggtcagatcatgggacataacttcttagaatatatatatacatatgtacatattctcatatgtaaagtcacaaggttcatttatctttctgaatcagttatcaaagataaattggcaagtcagtacttaagaaaaaagatttgattatcatcacagcagaaaaaagtcattgcatatctgatcaataacttcagattctaagagtggattttttttttttacatgggctcctattttttcccctactgtcttgcattataaaattagaagtgtattttcagtggaagaaacatttttcaataaataaagtaaggcattgtcatcaatgaagtaattaaaactgggacctgatctatgatacgcttttttctttcattacaccctagctgaaggacatccagttccccagctgtagttatgtatctgccttcaagtctctgacaaatgtgctgtgttagtagagtttgatttgtatcatatgataatcttgcacttgactgagttgggacaaggcttcacataaaaaattatttcttcacttttaacacaagttagaaattatatcccatttagttaaatgcgtgatttatattcagaacaacctactatgtagcgtttattttactgaatgtggagatttaaacactgaggtttctgttcaaactgtgagttctgttctttgtgagaaattttacatatattggaagtgaaaatatgttctgagtaaacaaatattgctatgggagttatctttttagatttagaataactgttccaatgataattattacttttatatttcaaagtacactaagatcgttgaagagcaatagaacctttaagacagtattaaaggtgtgaaacaatggcattcaaagtgttgggaatacaggcatgagccaccgcgcccaggcggtctcaatcttttaatactgccttataatgcaaatataaaggtcacctgaattgctacttggcttgaattagcacattccaattgaagttttaagtttttaaaaactaatttaaatgtttactaattgtatagaagtgtactaaaaataattctgttgttgcaaaactttgtacttggaaatccaagtacatgaggggattttttttctttcaactataatttatgtgatccctttcttagaattataacaataatggtgatggcaaatgaaagtttcacatgatacgggctctttagcttgcattaatattccctgatcatcttttaatgct

SEQ ID NO: 417358 - DNA, 716 bp, Homo sapiens
ggacatccagttccccagctgtagttatgtatctgccttcaagtctctgacaaatgtgctgtgttagtagagtttgatttgtatcatatgataatcttgcacttgactgagttgggacaaggcttcacataaaaaattatttcttcacttttaacacaagttagaaattatatcccatttagttaaatgcgtgatttatattcagaacaacctactatgtagcgtttattttactgaatgtggagatttaaacactgaggtttctgttcaaactgtgagttctgttctttgtgagaaattttacatatattggaagtgaaaatatgttctgagtaaacaaatattgctatgggagttatctttttagatttagaataactgttccaatgataattattacttttatatttcaaagtacactaagatcgttgaagagcaatagaacctttaagacagtattaaaggtgtgaaacaatggcattcaaaggtcttttgtagaactggttttcattgtagttcactgccatgctgccagtggatagcactgtgattcatgcatatttgatgttttatgaaccagtatctcaaaaatagaaataatgattagaagattacttgaagttgggcggggcgccatggctcacgcctgtaatcccagcactttgggaggccgaggcggatggatcacaaggtcaggagttcaagaccagcctggc

SEQ ID NO: 417359 - DNA, 2549 bp, Homo sapiens
gaggtgaggttgaagctgcctccgccatcttggagatgggagacgggcgatggctgtggtccttctgctaatgcaaacaacaaaacgggcacactagtcacccccgagggaggccaccatcactgtaactgttggccaaagctacaaaagaagcgagggaatccaaccgagcgcagcgacactgagaacagcttcccctgccttctgcggcggcagaagtgaagtgcctgaggaccggaaggatggtgcagtcctgctccgcctacggctgcaagaaccgctacgacaaggacaagcccgtttctttccacaagtttcctcttactcgacccagtctttgtaaagaatgggaggcagctgtcagaagaaaaaactttaaacccaccaagtatagcagtatttgttcagagcactttactccagactgctttaagagagagtgcaacaacaagttactgaaagagaatgctgtgcccacaatatttctttgtactgagccacatgacaagaaagaagatcttctggagccacaggaacagcttcccccacctcctttaccgcctcctgtttcccaggttgatgctgctattggattactaatgccgcctcttcagacccctgttaatctctcagttttctgtgaccacaactatactgtggaggatacaatgcaccagcggaaaaggattcatcagctagaacagcaagttgaaaaactcagaaagaagctcaagaccgcacagcagcgatgcagaaggcaagaacggcagcttgaaaaattaaaggaggttgttcacttccagaaagagaaagacgacgtatcagaaagaggttatgtgattctaccaaatgactactttgaaatagttgaagtaccagcataaaaaaatgaaatgtgtattgatttctaatggggcaataccacatatcctcctctagcctgtaaaggagtttcatttaaaaaaataacatttgattacttatataaaaacagttcagaatatttttttaaaaaaaattctatatatactgtaaaattataaatttttttgtttgtaatttcaggttttttacattttaacaaaatattttaaaagttataaactaacctcagacctctaatgtaagttggtttcaagattggggattttggggtttttttttagtatttatagaaataatgtaaaaataaaaagtaaagagaatgagaacagtgtggtaaaagggtgatttcagtttaaaacttaaaattagtactgttttattgagagaatttagttatattttaaatcagaagtatgggtcagatcatgggacataacttcttagaatatatatatacatatgtacatattctcatatgtaaagtcacaaggttcatttatctttctgaatcagttatcaaagataaattggcaagtcagtacttaagaaaaaagatttgattatcatcacagcagaaaaaagtcattgcatatctgatcaataacttcagattctaagagtggattttttttttttacatgggctcctattttttcccctactgtcttgcattataaaattagaagtgtattttcagtggaagaaacatttttcaataaataaagtaaggcattgtcatcaatgaagtaattaaaactgggacctgatctatgatacgcttttttctttcattacaccctagctgaaggacatccagttccccagctgtagttatgtatctgccttcaagtctctgacaaatgtgctgtgttagtagagtttgatttgtatcatatgataatcttgcacttgactgagttgggacaaggcttcacataaaaaattatttcttcacttttaacacaagttagaaattatatcccatttagttaaatgcgtgatttatattcagaacaacctactatgtagcgtttattttactgaatgtggagatttaaacactgaggtttctgttcaaactgtgagttctgttctttgtgagaaattttacatatattggaagtgaaaatatgttctgagtaaacaaatattgctatgggagttatctttttagatttagaataactgttccaatgataattattacttttatatttcaaagtacactaagatcgttgaagagcaatagaacctttaagacagtattaaaggtgtgaaacaatggcattcaaagtgttgggaatacaggcatgagccaccgcgcccaggcggtctcaatcttttaatactgccttataatgcaaatataaaggtcacctgaattgctacttggcttgaattagcacattccaattgaagttttaagtttttaaaaactaatttaaatgtttactaattgtatagaagtgtactaaaaataattctgttgttgcaaaactttgtacttggaaatccaagtacatgaggggattttttttctttcaactataatttatgtgatccctttcttagaattataacaataatggtgatggcaaatgaaagtttcacatgatacgggctctttagcttgcattaatattccctgatcatcttttaatgct

SEQ ID NO: 417360 - DNA, 2353 bp, Homo sapiens
gaggtgaggttgaagctgcctccgccatcttggagatgggagacgggcgatggctgtggtccttctgctaatgcaaacaacaaaacgggcacactagtcacccccgagggaggccaccatcactgtaactgttggccaaagctacaaaagaagcgagggaatccaaccgagcgcagcgacactgagaacagcttcccctgccttctgcggcggcagaagtgaagtgcctgaggaccggaaggatggtgcagtcctgctccgcctacggctgcaagaaccgctacgacaaggacaagcccgtttctttccacaaaaagaagatcttctggagccacaggaacagcttcccccacctcctttaccgcctcctgtttcccaggttgatgctgctattggattactaatgccgcctcttcagacccctgttaatctctcagttttctgtgaccacaactatactgtggaggatacaatgcaccagcggaaaaggattcatcagctagaacagcaagttgaaaaactcagaaagaagctcaagaccgcacagcagcgatgcagaaggcaagaacggcagcttgaaaaattaaaggaggttgttcacttccagaaagagaaagacgacgtatcagaaagaggttatgtgattctaccaaatgactactttgaaatagttgaagtaccagcataaaaaaatgaaatgtgtattgatttctaatggggcaataccacatatcctcctctagcctgtaaaggagtttcatttaaaaaaataacatttgattacttatataaaaacagttcagaatatttttttaaaaaaaattctatatatactgtaaaattataaatttttttgtttgtaatttcaggttttttacattttaacaaaatattttaaaagttataaactaacctcagacctctaatgtaagttggtttcaagattggggattttggggtttttttttagtatttatagaaataatgtaaaaataaaaagtaaagagaatgagaacagtgtggtaaaagggtgatttcagtttaaaacttaaaattagtactgttttattgagagaatttagttatattttaaatcagaagtatgggtcagatcatgggacataacttcttagaatatatatatacatatgtacatattctcatatgtaaagtcacaaggttcatttatctttctgaatcagttatcaaagataaattggcaagtcagtacttaagaaaaaagatttgattatcatcacagcagaaaaaagtcattgcatatctgatcaataacttcagattctaagagtggattttttttttttacatgggctcctattttttcccctactgtcttgcattataaaattagaagtgtattttcagtggaagaaacatttttcaataaataaagtaaggcattgtcatcaatgaagtaattaaaactgggacctgatctatgatacgcttttttctttcattacaccctagctgaaggacatccagttccccagctgtagttatgtatctgccttcaagtctctgacaaatgtgctgtgttagtagagtttgatttgtatcatatgataatcttgcacttgactgagttgggacaaggcttcacataaaaaattatttcttcacttttaacacaagttagaaattatatcccatttagttaaatgcgtgatttatattcagaacaacctactatgtagcgtttattttactgaatgtggagatttaaacactgaggtttctgttcaaactgtgagttctgttctttgtgagaaattttacatatattggaagtgaaaatatgttctgagtaaacaaatattgctatgggagttatctttttagatttagaataactgttccaatgataattattacttttatatttcaaagtacactaagatcgttgaagagcaatagaacctttaagacagtattaaaggtgtgaaacaatggcattcaaagtgttgggaatacaggcatgagccaccgcgcccaggcggtctcaatcttttaatactgccttataatgcaaatataaaggtcacctgaattgctacttggcttgaattagcacattccaattgaagttttaagtttttaaaaactaatttaaatgtttactaattgtatagaagtgtactaaaaataattctgttgttgcaaaactttgtacttggaaatccaagtacatgaggggattttttttctttcaactataatttatgtgatccctttcttagaattataacaataatggtgatggcaaatgaaagtttcacatgatacgggctctttagcttgcattaatattccctgatcatcttttaatgct

SEQ ID NO: 417361 - DNA, 436 bp, Homo sapiens
ggctgacggtgggtcatgtgaccaggctctgcattaggcctgccgagaggagtgttttcttgcatccagaaaagacctgagaggcggacgacacctgtgctccgcagagcagaacgtgggaggaacggcgggatgttaaggagctcaagaagcagagagtctacctgcccgacgcgttcgtggagaggagcagcggttgctgttggaggagattgatactggaaaagcagtttctattgagcccccaaatgaagagtgagtgcagatgaagaggaggcaggactcacaagcccttgaactttattccagatctgttagcacctacaggaccctgcaccaggatttcatctgtactatcagcttcttcaaagagagagaggttgttgagtgagtacccacaagggcacagtactaacatgtttacagtgtttgtcct

SEQ ID NO: 417362 - DNA, 797 bp, Homo sapiens
ggagaaccgccttcaggcgtttggactcagtggaggttgtgagtgcccagcagtgtggcctgaatctccgtggggtttagggagacgaaaggaccccagatcgacgtcccctcgttcccactttggggatcggcgctctggctgtttcgtgaaggagagagaggttgattccataccctggctattgtgaataatgctgcagtgaacatgggagtacatacatctgtttgaggaactcagagtggttttccagatgggaatcacattgctctctgtccctgagatcttgctggagacagggctactcagtccctctttgccagattgatactggaaaagcagtttctattgagcccccaaatgaagagtgagtgcagatgaagaggaggcaggactcacaagcccttgaactttattccagatctgttagcacctacaggaccctgcaccaggatttcatctgtactatcagcttcttcaaagagagagaggttgttgaattgatattggaaaagcagtttcccattgagtctcaaatgaagagagtgcagatgaagaggagaagactctgtattgaaccaaggtgctctacacagtagcccctactaagctcccagcagatgccagcatcagtcatccatctcttcatgtggatgtctgagctcatatcaggtgtctgaaagaggcagattctgaggatttgggtcatgatggctgccaaagcttctactcctgacttaaagggcaacaatcctaggagaccaccagcacttacatccctggtaggacatgacacc

SEQ ID NO: 417363 - DNA, 718 bp, Homo sapiens
ggagaaccgccttcaggcgtttggactcagtggaggttgtgagtgcccagcagtgtggcctgaatctccgtggggtttagggagacgaaaggaccccagatcgacgtcccctcgttcccactttggggatcggcgctctggctgtttcgtgaaggagagagaggttgattccataccctggctattgtgaataatgctgcagtgaacatgggagtacatacatctgtttgaggaactcagagtggttttccagatgggaatcacattgctctctgtccctgagatcttgctggagacagggctactcagtccctctttgccagattgatactggaaaagcagtttctattgagcccccaaatgaagagtgagtgcagatgaagaggaggcaggactcacaagcccttgaactttattccagatctgttagcacctacaggaccctgcaccaggatttcatctgtactatcagcttcttcaaagagagagaggttgttgaattgatattggaaaagcagtttcccattgagtctcaaatgaagagagtgcagatgaagaggagctcttcatgtggatgtctgagctcatatcaggtgtctgaaagaggcagattctgaggatttgggtcatgatggctgccaaagcttctactcctgacttaaagggcaacaatcctaggagaccaccagcacttacatccctggtaggacatgacacc

SEQ ID NO: 417364 - DNA, 5138 bp, Homo sapiens
ggctgacggtgggtcatgtgaccaggctctgcattaggcctgccgagaggagtgttttcttgcatccagaaaagacctgagaggcggacgacacctgtgctccgcagagcagaacgtgggaggaacggcgggatgttaaggagctcaagaagcagagagtctacctgcccgacgcgttcgtggagaggagcagcggttgctgttggaggagctttctaggttcctgtagagatctgtatgtagctgttcacttggaagttaattaagaaagaacaaaaactattcatttggattcaaggtccatctccactggtggctgtggtggctttggattgttggaagaccatcaccttcagcaggtctgcacttgggaacaatcattctcccccagcccgagcgtgcctctgccctctgtatcattgacagaggctgtatgtttggaaagagaactttgtgactgcagaactgacagttgactctaattcttgctaccaagtttttccccgacccagtgaaagagtgttaagacttcgacctaggacacattgagaaccaaggccaagactggacagggccatataactgggcttcaaccatggctgggactaagaataagacaagagcccaggccaaaactgaaaaaaaggctgctatacaagctaaagctggagcagagagggaggctactggtgttgttaggcctgtagccaagaccagggccaaagcaaaagccaagacagggtctaagacagatgcagtagcagagatgaaggcagtgtctaagaacaaggttgttgctgagacgaaggaaggagctctgtcagagcctaagactctgggcaaagccatgggagatttcactcccaaggctgggaatgagtccaccagctccacatgtaaaaatgaggctggtactgatgcctggttctgggctggggaagaggccactatcaattcctggttctggaatggagaagaggctggtaatagtttcagcactaagaatgataaacctgaaattggtgcccaggtctgtgctgaggagttggaacctgcggctggggccgattgcaaacctaggtcaggggctgaggaggaggaggaagagaatgttattgggaactggttttgggaaggagatgatactagttttgaccctaatcctaaacctgtgagcaggatagttaagcctcagcctgtgtatgaaattaatgaaaaaaataggcccaaggactggtctgaggtaactatctggcccaatgcccctgctgtaactccagctgtgttaggatttagatcccaggcaccatctgaggcaagccctccttcatatattgttctggcctccgctgaagaaaatgcctgttctttgcctgtggcaacagcttgccgcccttctaggaacactcgctcatgctcacagcctatccctgagtgtcgttttgattctgacccctgcatccagaccatagatgagattagacgtcaaatcaggatcagggaggtaaatgggattaagccatttgcttgtccttgcaaaatggaatgctatatggattctgaggaatttgaaaaacttgttagcttacttaagtcaactactgatcctcttattcataaaatagcacggattgcaatgggtgtccataatgttcacccatttgcccaagagtttattaacgaagtaggtgtagtgacacttattgaaagcttgctcagttttccttcccctgaaatgagaaaaaagactgtaattactctgaatcctccttctggggatgaaagacaacgcaaaattgaattacatgttaagcatatgtgtaaagaaaccatgtcatttcctttgaactcaccgggacagcaatctggattaaagatactaggacaactgactactgattttgtccatcactacattgttgccaattacttttcagagcttttccatttgctgtcctcaggaaattgcaaaaccagaaatcttgttttgaaactacttttaaatatgtctgaaaatccaactgcagccagagacatgatcaatatgaaggcattggcagcattaaaactcatctttaaccagaaagaggcaaaagccaatcttgttagtggtgtggccatatttattaacataaaggagcatatcagaaaaggctcaattgtagttgttgatcacttgagttataatacactcatggccattttcagggaagttaaagagattattgaaacaatgtaaaatgagccagagatagaacattttaagccatcttcaaactctagcaggctgtacattacagtgtacacattatacactgcatctttaacacagagtcacctgtgacaggctctaggtttgagctagactattttgggggtatcaaatgaatattataccttgggctgaaaatgtttgatttttatcttgtctagattggcatatttttaacattttacttaagatagcaaaccagttcgttttaagtaagctaacttgttcattagtatctgtggcttaaaatggcaaaaaagaaaatatccttgagtttgtaatctagttacagaagtaaggcatacacacacacaaagataacagtacctagagagagagtgtgtgtgagtgtgcgtgtctctgtgtgtgcacgtgcacgctcatggccaaatgtgcgcactctacataaaggaggcaggagttcctataggctatttaatgtaagagaaactatttttctcctgttccagctgtatcagatactcgttccgcaacacagaaatgactcagaatctcagacaaaatgtattatttgttcaattttaattttgctactacattcataactcttaaattgttaggctgtttcatttacatcaaagttatctcacaaaagagaaggcaggaaacgttttgtgagtgcctattctatgtcaaacactgtgttggcaccatattttacaagtttttttcctcttctcacagtgatcttgtgagttagttacttatatttttattagaactcattattctgggtaccctccaatgagaattagagaggttaaataccttttcctagattcccacagcaggaaggtggcatagctgttttgtctgacaccagaacccatctcaccacactgctttacagtcttcctgaaggacattttgaggtgggggggccttcaaagctcagagactggtttgaatggtttaattttgcaatggatcatgtccatgccaggtgttacaattcttaacttcctccaaattcgtgtgtccattagacatttggctacatctggctggaggtcaggagaaaattctgaggtaaatagatggattttatctggcagtgtcgaaaatagtaggagcctaaaactttgttcaatgagtaagatgtagatttggagtcatcagcaggggaaacttgttagatgtcctttgtatctttttctatccatttgtattttttctttcccaaagagctgaaatcattttataccctgaatttaaaaggtaattgcttttttcctccttgcgaaatcataccttaattttttttttttttttttttaccatttatgatttattctcctatgtgtcatatgaaaggccaaggggctttatcttttactagtaggcaagcctgggcatttctgcatttgtgccagctaacactacaaaatagacttaattagagaaatttagacccagaattgcagcttcaacaacacaaaacaggaaagctagaagaggttgctgtgtcaacctacaagatagtgattcttggaagttggtatggaccagaaagcattcccaggacatttaggctatggctgagttctctaagactcagggtgggaattataatccctggtctaagctgatatgaaagtttctatgtgtgaaaatatggagttatatgctttgagattttctgccagttaaactaaaacaagatcatactgtaaatgtttgtaacttgcttccccccactgtatactgtaaacatctttgcatgtcaataaatatgcctctacaacatatttttgaatcacttaatatttttcccatgttaacagttggtatatagtgttgtaaacctttattgcatattctcataacatacaatatacacattcttttgcaaaaatgggaacacagtattgagacttgccttttcctcttaacacttatcttttcaatttagtattatatagatctgtcacatgctttttatctaataactttatagaaatataattgccatacattaagctgcatgttgaaagtatacagtgtgatcagttttggaatgtatatacacacaaaaccataaccacaatcaaaattgtaaatacattcatcacccaccaaagctactttttttttgagacagagtcttgctctgtcacccaggctggagtacagtggcgcaatctcggcccactgcaacctctgcttcccaggttcaagtgattctcgtgccttagcctcctgagcagctgggactacaggtgcatgccaccacatccgactaattttttttttattttttgtatttttagtagagacagggtttcaccatgttggccaggctggtcttgaactcctggtctcaagtgatctacccatcttggtctccctgagtgccaggattacaggcgtgagccaccatgcccagcctcccccaaagcttcttaatgcccttttgtaatccctccctcccctctctccctgtgcccctaacccaggcaaccatgggacattttctgacaaaatagaattgttttcatttcctgtaattgtgtataaatggactcatatagcatgtactctttggtcgggaggggatctggcttatttcacttagtgtaattatttgagattcatccatatcatgtgtctcactatttcattgctttttattgccaagtagtattccaccatatggctttaccacagtttatttatccattcacttattgatggacatttgggctgttcagagtttggccattataagtaaagcagctatgagcatttgtgtacaagtgtttttatggacataggctttcatatctttggaatgacatctaacaatattgaatcttcgacccatgaataaaatctctctccactt

SEQ ID NO: 417365 - DNA, 5202 bp, Homo sapiens
ggctgacggtgggtcatgtgaccaggctctgcattaggcctgccgagaggagtgttttcttgcatccagaaaagacctgagaggcggacgacacctgtgctccgcagagcagaacgtgggaggaacggcgggatgttaaggagctcaagaagcagagagtctacctgcccgacgcgttcgtggagaggagcagcggttgctgttggaggaggtgggtgcaaggacggcagatggcatccctgagaggtggtgactgagactagatgcgggtgcagctttctaggttcctgtagagatctgtatgtagctgttcacttggaagttaattaagaaagaacaaaaactattcatttggattcaaggtccatctccactggtggctgtggtggctttggattgttggaagaccatcaccttcagcaggtctgcacttgggaacaatcattctcccccagcccgagcgtgcctctgccctctgtatcattgacagaggctgtatgtttggaaagagaactttgtgactgcagaactgacagttgactctaattcttgctaccaagtttttccccgacccagtgaaagagtgttaagacttcgacctaggacacattgagaaccaaggccaagactggacagggccatataactgggcttcaaccatggctgggactaagaataagacaagagcccaggccaaaactgaaaaaaaggctgctatacaagctaaagctggagcagagagggaggctactggtgttgttaggcctgtagccaagaccagggccaaagcaaaagccaagacagggtctaagacagatgcagtagcagagatgaaggcagtgtctaagaacaaggttgttgctgagacgaaggaaggagctctgtcagagcctaagactctgggcaaagccatgggagatttcactcccaaggctgggaatgagtccaccagctccacatgtaaaaatgaggctggtactgatgcctggttctgggctggggaagaggccactatcaattcctggttctggaatggagaagaggctggtaatagtttcagcactaagaatgataaacctgaaattggtgcccaggtctgtgctgaggagttggaacctgcggctggggccgattgcaaacctaggtcaggggctgaggaggaggaggaagagaatgttattgggaactggttttgggaaggagatgatactagttttgaccctaatcctaaacctgtgagcaggatagttaagcctcagcctgtgtatgaaattaatgaaaaaaataggcccaaggactggtctgaggtaactatctggcccaatgcccctgctgtaactccagctgtgttaggatttagatcccaggcaccatctgaggcaagccctccttcatatattgttctggcctccgctgaagaaaatgcctgttctttgcctgtggcaacagcttgccgcccttctaggaacactcgctcatgctcacagcctatccctgagtgtcgttttgattctgacccctgcatccagaccatagatgagattagacgtcaaatcaggatcagggaggtaaatgggattaagccatttgcttgtccttgcaaaatggaatgctatatggattctgaggaatttgaaaaacttgttagcttacttaagtcaactactgatcctcttattcataaaatagcacggattgcaatgggtgtccataatgttcacccatttgcccaagagtttattaacgaagtaggtgtagtgacacttattgaaagcttgctcagttttccttcccctgaaatgagaaaaaagactgtaattactctgaatcctccttctggggatgaaagacaacgcaaaattgaattacatgttaagcatatgtgtaaagaaaccatgtcatttcctttgaactcaccgggacagcaatctggattaaagatactaggacaactgactactgattttgtccatcactacattgttgccaattacttttcagagcttttccatttgctgtcctcaggaaattgcaaaaccagaaatcttgttttgaaactacttttaaatatgtctgaaaatccaactgcagccagagacatgatcaatatgaaggcattggcagcattaaaactcatctttaaccagaaagaggcaaaagccaatcttgttagtggtgtggccatatttattaacataaaggagcatatcagaaaaggctcaattgtagttgttgatcacttgagttataatacactcatggccattttcagggaagttaaagagattattgaaacaatgtaaaatgagccagagatagaacattttaagccatcttcaaactctagcaggctgtacattacagtgtacacattatacactgcatctttaacacagagtcacctgtgacaggctctaggtttgagctagactattttgggggtatcaaatgaatattataccttgggctgaaaatgtttgatttttatcttgtctagattggcatatttttaacattttacttaagatagcaaaccagttcgttttaagtaagctaacttgttcattagtatctgtggcttaaaatggcaaaaaagaaaatatccttgagtttgtaatctagttacagaagtaaggcatacacacacacaaagataacagtacctagagagagagtgtgtgtgagtgtgcgtgtctctgtgtgtgcacgtgcacgctcatggccaaatgtgcgcactctacataaaggaggcaggagttcctataggctatttaatgtaagagaaactatttttctcctgttccagctgtatcagatactcgttccgcaacacagaaatgactcagaatctcagacaaaatgtattatttgttcaattttaattttgctactacattcataactcttaaattgttaggctgtttcatttacatcaaagttatctcacaaaagagaaggcaggaaacgttttgtgagtgcctattctatgtcaaacactgtgttggcaccatattttacaagtttttttcctcttctcacagtgatcttgtgagttagttacttatatttttattagaactcattattctgggtaccctccaatgagaattagagaggttaaataccttttcctagattcccacagcaggaaggtggcatagctgttttgtctgacaccagaacccatctcaccacactgctttacagtcttcctgaaggacattttgaggtgggggggccttcaaagctcagagactggtttgaatggtttaattttgcaatggatcatgtccatgccaggtgttacaattcttaacttcctccaaattcgtgtgtccattagacatttggctacatctggctggaggtcaggagaaaattctgaggtaaatagatggattttatctggcagtgtcgaaaatagtaggagcctaaaactttgttcaatgagtaagatgtagatttggagtcatcagcaggggaaacttgttagatgtcctttgtatctttttctatccatttgtattttttctttcccaaagagctgaaatcattttataccctgaatttaaaaggtaattgcttttttcctccttgcgaaatcataccttaattttttttttttttttttttaccatttatgatttattctcctatgtgtcatatgaaaggccaaggggctttatcttttactagtaggcaagcctgggcatttctgcatttgtgccagctaacactacaaaatagacttaattagagaaatttagacccagaattgcagcttcaacaacacaaaacaggaaagctagaagaggttgctgtgtcaacctacaagatagtgattcttggaagttggtatggaccagaaagcattcccaggacatttaggctatggctgagttctctaagactcagggtgggaattataatccctggtctaagctgatatgaaagtttctatgtgtgaaaatatggagttatatgctttgagattttctgccagttaaactaaaacaagatcatactgtaaatgtttgtaacttgcttccccccactgtatactgtaaacatctttgcatgtcaataaatatgcctctacaacatatttttgaatcacttaatatttttcccatgttaacagttggtatatagtgttgtaaacctttattgcatattctcataacatacaatatacacattcttttgcaaaaatgggaacacagtattgagacttgccttttcctcttaacacttatcttttcaatttagtattatatagatctgtcacatgctttttatctaataactttatagaaatataattgccatacattaagctgcatgttgaaagtatacagtgtgatcagttttggaatgtatatacacacaaaaccataaccacaatcaaaattgtaaatacattcatcacccaccaaagctactttttttttgagacagagtcttgctctgtcacccaggctggagtacagtggcgcaatctcggcccactgcaacctctgcttcccaggttcaagtgattctcgtgccttagcctcctgagcagctgggactacaggtgcatgccaccacatccgactaattttttttttattttttgtatttttagtagagacagggtttcaccatgttggccaggctggtcttgaactcctggtctcaagtgatctacccatcttggtctccctgagtgccaggattacaggcgtgagccaccatgcccagcctcccccaaagcttcttaatgcccttttgtaatccctccctcccctctctccctgtgcccctaacccaggcaaccatgggacattttctgacaaaatagaattgttttcatttcctgtaattgtgtataaatggactcatatagcatgtactctttggtcgggaggggatctggcttatttcacttagtgtaattatttgagattcatccatatcatgtgtctcactatttcattgctttttattgccaagtagtattccaccatatggctttaccacagtttatttatccattcacttattgatggacatttgggctgttcagagtttggccattataagtaaagcagctatgagcatttgtgtacaagtgtttttatggacataggctttcatatctttggaatgacatctaacaatattgaatcttcgacccatgaataaaatctctctccactt

SEQ ID NO: 417366 - DNA, 5115 bp, Homo sapiens
ggctgacggtgggtcatgtgaccaggctctgcattaggcctgccgagaggagtgttttcttgcatccagaaaagacctgagaggcggacgacacctgtgctccgcagagcagaacgtgggaggaacggcgggatgttaaggagctcaagaagcagagagtctacctgcccgacgcgttcgtggagaggagcagcggttgctgttggaggaggtgggtgcaaggacggcagatggcatccctgagaggtggtgactgagactagatgcgggtgcaggtccatctccactggtggctgtggtggctttggattgttggaagaccatcaccttcagcaggtctgcacttgggaacaatcattctcccccagcccgagcgtgcctctgccctctgtatcattgacagaggctgtatgtttggaaagagaactttgtgactgcagaactgacagttgactctaattcttgctaccaagtttttccccgacccagtgaaagagtgttaagacttcgacctaggacacattgagaaccaaggccaagactggacagggccatataactgggcttcaaccatggctgggactaagaataagacaagagcccaggccaaaactgaaaaaaaggctgctatacaagctaaagctggagcagagagggaggctactggtgttgttaggcctgtagccaagaccagggccaaagcaaaagccaagacagggtctaagacagatgcagtagcagagatgaaggcagtgtctaagaacaaggttgttgctgagacgaaggaaggagctctgtcagagcctaagactctgggcaaagccatgggagatttcactcccaaggctgggaatgagtccaccagctccacatgtaaaaatgaggctggtactgatgcctggttctgggctggggaagaggccactatcaattcctggttctggaatggagaagaggctggtaatagtttcagcactaagaatgataaacctgaaattggtgcccaggtctgtgctgaggagttggaacctgcggctggggccgattgcaaacctaggtcaggggctgaggaggaggaggaagagaatgttattgggaactggttttgggaaggagatgatactagttttgaccctaatcctaaacctgtgagcaggatagttaagcctcagcctgtgtatgaaattaatgaaaaaaataggcccaaggactggtctgaggtaactatctggcccaatgcccctgctgtaactccagctgtgttaggatttagatcccaggcaccatctgaggcaagccctccttcatatattgttctggcctccgctgaagaaaatgcctgttctttgcctgtggcaacagcttgccgcccttctaggaacactcgctcatgctcacagcctatccctgagtgtcgttttgattctgacccctgcatccagaccatagatgagattagacgtcaaatcaggatcagggaggtaaatgggattaagccatttgcttgtccttgcaaaatggaatgctatatggattctgaggaatttgaaaaacttgttagcttacttaagtcaactactgatcctcttattcataaaatagcacggattgcaatgggtgtccataatgttcacccatttgcccaagagtttattaacgaagtaggtgtagtgacacttattgaaagcttgctcagttttccttcccctgaaatgagaaaaaagactgtaattactctgaatcctccttctggggatgaaagacaacgcaaaattgaattacatgttaagcatatgtgtaaagaaaccatgtcatttcctttgaactcaccgggacagcaatctggattaaagatactaggacaactgactactgattttgtccatcactacattgttgccaattacttttcagagcttttccatttgctgtcctcaggaaattgcaaaaccagaaatcttgttttgaaactacttttaaatatgtctgaaaatccaactgcagccagagacatgatcaatatgaaggcattggcagcattaaaactcatctttaaccagaaagaggcaaaagccaatcttgttagtggtgtggccatatttattaacataaaggagcatatcagaaaaggctcaattgtagttgttgatcacttgagttataatacactcatggccattttcagggaagttaaagagattattgaaacaatgtaaaatgagccagagatagaacattttaagccatcttcaaactctagcaggctgtacattacagtgtacacattatacactgcatctttaacacagagtcacctgtgacaggctctaggtttgagctagactattttgggggtatcaaatgaatattataccttgggctgaaaatgtttgatttttatcttgtctagattggcatatttttaacattttacttaagatagcaaaccagttcgttttaagtaagctaacttgttcattagtatctgtggcttaaaatggcaaaaaagaaaatatccttgagtttgtaatctagttacagaagtaaggcatacacacacacaaagataacagtacctagagagagagtgtgtgtgagtgtgcgtgtctctgtgtgtgcacgtgcacgctcatggccaaatgtgcgcactctacataaaggaggcaggagttcctataggctatttaatgtaagagaaactatttttctcctgttccagctgtatcagatactcgttccgcaacacagaaatgactcagaatctcagacaaaatgtattatttgttcaattttaattttgctactacattcataactcttaaattgttaggctgtttcatttacatcaaagttatctcacaaaagagaaggcaggaaacgttttgtgagtgcctattctatgtcaaacactgtgttggcaccatattttacaagtttttttcctcttctcacagtgatcttgtgagttagttacttatatttttattagaactcattattctgggtaccctccaatgagaattagagaggttaaataccttttcctagattcccacagcaggaaggtggcatagctgttttgtctgacaccagaacccatctcaccacactgctttacagtcttcctgaaggacattttgaggtgggggggccttcaaagctcagagactggtttgaatggtttaattttgcaatggatcatgtccatgccaggtgttacaattcttaacttcctccaaattcgtgtgtccattagacatttggctacatctggctggaggtcaggagaaaattctgaggtaaatagatggattttatctggcagtgtcgaaaatagtaggagcctaaaactttgttcaatgagtaagatgtagatttggagtcatcagcaggggaaacttgttagatgtcctttgtatctttttctatccatttgtattttttctttcccaaagagctgaaatcattttataccctgaatttaaaaggtaattgcttttttcctccttgcgaaatcataccttaattttttttttttttttttttaccatttatgatttattctcctatgtgtcatatgaaaggccaaggggctttatcttttactagtaggcaagcctgggcatttctgcatttgtgccagctaacactacaaaatagacttaattagagaaatttagacccagaattgcagcttcaacaacacaaaacaggaaagctagaagaggttgctgtgtcaacctacaagatagtgattcttggaagttggtatggaccagaaagcattcccaggacatttaggctatggctgagttctctaagactcagggtgggaattataatccctggtctaagctgatatgaaagtttctatgtgtgaaaatatggagttatatgctttgagattttctgccagttaaactaaaacaagatcatactgtaaatgtttgtaacttgcttccccccactgtatactgtaaacatctttgcatgtcaataaatatgcctctacaacatatttttgaatcacttaatatttttcccatgttaacagttggtatatagtgttgtaaacctttattgcatattctcataacatacaatatacacattcttttgcaaaaatgggaacacagtattgagacttgccttttcctcttaacacttatcttttcaatttagtattatatagatctgtcacatgctttttatctaataactttatagaaatataattgccatacattaagctgcatgttgaaagtatacagtgtgatcagttttggaatgtatatacacacaaaaccataaccacaatcaaaattgtaaatacattcatcacccaccaaagctactttttttttgagacagagtcttgctctgtcacccaggctggagtacagtggcgcaatctcggcccactgcaacctctgcttcccaggttcaagtgattctcgtgccttagcctcctgagcagctgggactacaggtgcatgccaccacatccgactaattttttttttattttttgtatttttagtagagacagggtttcaccatgttggccaggctggtcttgaactcctggtctcaagtgatctacccatcttggtctccctgagtgccaggattacaggcgtgagccaccatgcccagcctcccccaaagcttcttaatgcccttttgtaatccctccctcccctctctccctgtgcccctaacccaggcaaccatgggacattttctgacaaaatagaattgttttcatttcctgtaattgtgtataaatggactcatatagcatgtactctttggtcgggaggggatctggcttatttcacttagtgtaattatttgagattcatccatatcatgtgtctcactatttcattgctttttattgccaagtagtattccaccatatggctttaccacagtttatttatccattcacttattgatggacatttgggctgttcagagtttggccattataagtaaagcagctatgagcatttgtgtacaagtgtttttatggacataggctttcatatctttggaatgacatctaacaatattgaatcttcgacccatgaataaaatctctctccactt

SEQ ID NO: 417367 - DNA, 271 bp, Homo sapiens
cagcctcccaatgtgctgggattacaggtgtgagccaccacgcccggccaaactttctcagtttcgtgggaaagtaataaaaacaggaaatctaatggaggcatccttaatgaggctgggcgcacgtctgcatttgaagtgcctttatcggcatcactgcccaggcagcagctcactgacccagctccaccattggtcatttgtggctttctgtggacctcaagcctcctacctacccttcaagaaaatattccccgcctaaaacacacat

SEQ ID NO: 417368 - DNA, 509 bp, Homo sapiens
cagtgcatgtccaccataccacctgagagtctgtggaatctaattttctgttatacttctttccttacactcattttcctgtctttattatgatagtctaactttttctcctcaaaggtatagctgccttgctttcatgaaaacacactttcctattgtgatttatcagaggcctttccatatctcagccactatgctatgacagattttataattaataagtgcatttcaaagtgaaaacgttacaaacatgcttaacagatgtttttataacatgaaatattctactgcgttaagatcaaaatgctgactatacttgttccgtataccttcagaccactgttaatgtaatattttggcaaggtgaatggtcttttttggatataaaaatctcagcataagccaggcatggtggtacacagctgtattctcagctatttaagaggattgcttgagtccaggaaatcaagaccagcctgggtaacatagtgacacccagtctccattaa

SEQ ID NO: 417369 - DNA, 292 bp, Homo sapiens
gtgatcctcccacctcagcctcctgggactgcaagtgtatgccaccacactctgctaatttttttaattctttctttttgtagagatgaggtcacactgtattgcccaggctggtccccccaacacttctaattttccagctcaatgactaatttgcactgctgttgtctggtcctaacaggtaaggaccattctcagactgccacttgctcatccttcaggactcgtccaaatgtccctttttctctgcaccctcaggttcttgaccatctcaggcccccatcgttagctt

SEQ ID NO: 417370 - DNA, 708 bp, Homo sapiens
ctcaataaacactatctccatccctttggtgagagctcccttgatgagagatcactattactctactgttgcaatgcagtattctcttctacatcatcttaactgcttttcataatgcaactcttgtctagctttatagttttggcttttcattcatacttttccttttcaagcttatttttaaaaaaactttaatagctacatcgatgatacagttgatagcttaatttctcagatctttgacatcttcaattttaatgactctttccgcaatgacttgcagattgccaccttattactgtgtcttcacatggcagaaggggagagagatagagcaaacgttctggtctttgttcctctttttataagaacactaatcccatcatgggggcccaaccttcatgacctcatctaaatttaattacttcccaaaggccccgcctccaaatatcatcacattgtggattagggcttcaccatatgaatatttggtgggaacacaaacattcagtctataacactgtcttatctcttttttctccttgacggtttagtcttttctccttatgttcacattcttctgtccttttggcttctggtttgataggttacaattctagctaccttccgaataactagcgatttcagttttaattccaggttctttggcgaaacccactttgagacaactatctgtgtagaaaaatt

SEQ ID NO: 417371 - DNA, 640 bp, Homo sapiens
aagctcaacaacctgctcatgtacaggatacatacactgtgaaggtttgagagattatgactaattatatggaagtgaggatgttgagtaactttttgtacagtatccaaattactgaaacagagtgattttattttccaagtgttaagccatacccacaggaaacaaccagggctattctaccctagcaaagtgccttagctagtcatgcattctgcaacaagtctccatggcaaatttcctaacacacacttctaaacacaaagaactcctccaagtaataaagagggtggtgtgagctcaactaaaaggatattctgctactcctgggatatttttatgagaggatcataaccttattgtcaccttgccatcctaaaatggtgtaaaaaatataaaatcatagaacttctggaagtaagcagcagccttagaggtgatcaagtgaatccagttgcttcacttttcagatgaggaaattgtcacgagaaaaaaaaaaaaaagtgaatgacttgcccaaggccattcaattactcagtggcatagtaaagctatgatcaaggactcaggtccaccactttcttcacgaagtcacagaaatagccttgctaatcttaaaactatgtgccaaacataacct

SEQ ID NO: 417372 - DNA, 382 bp, Homo sapiens
aattctttaagcatgtacagaaaagtgacctgaaatgtttttgggtgatgaacttacagagctggtcttgaactcctgggctcaagtgatcctcccacctaggcctcctaaagtgctgggattacaggtgtcagctatcgtgtccagcctgagatatttcttatgagtaatgtggatggtacgtgagtccatagagtaaggcatttattgtaaacctccagggagtttctgaaaatagtatcttctcttcaaacctaggatgaagctggaggcagattcgtcgctttctctggagaaggacagtcattgcgtaaaaagggaagaaagccctaagtgaggactgttggctgattggaaaataataaaagaatcatttgcaaca

SEQ ID NO: 417373 - DNA, 1095 bp, Homo sapiens
tgagcctctggggcgtaccggcttggcgcggcggcagcggcagcggcggctgggagagcggtcggcggggtttcttcgttgcattgcctgagaggagcggagtctgccaggtggtgtccatcatgttctctttcaacatgttcgaccaccctattcccagggtcttccaaaaccgcttctccacacagtaccgctgcttctctgtgtccatgctagcagggcctaatgacaggtcagatgtggagaaaggagggaagataattatgccaccctcggccctggaccaactcagccgacttaacattacctatcccatgctgttcaaactgaccaataagaattcggaccgcatgacgcattgtggcgtgctggagtttgtggctgatgagggcatctgctacctcccacactggatgatgcagaacttactcttggaagaaggcggcctggtccaggtggagagcgtcaaccttcaagtggccacctactccaaattccaacctcagagccctgacttcctggacatcaccaaccccaaagccgtattagaaaacgcacttaggaactttgcctgtctgaccaccggggatgtgattgccatcaactataatgaaaagatctacgaactgcgtgtgatggagaccaaacccgacaaggcagtgtccatcattgagtgtgacatgaacgtggactttgatgctcccctgggctacaaagaacccgaaagacaagtccagcatgaggagtcgacagaaggtgaagccgaccacagtggctatgctggagagctgggcttccgcgctttctctggatctggcaatagactggatggaaagaagaaaggggtagagcccagcccctccccaatcaagcctggagatattaaaagaggaattcccaattatgaatttaaacttggtaagataactttcatcagaaattcacgtccccttgtcaaaaaggttgaagaggatgaagctggaggcagattcgtcgctttctctggagaaggacagtcattgcgtaaaaagggaagaaagccctaagtgaggactgttggctgattggaaaataataaaagaatcatttgcaaca

SEQ ID NO: 417374 - DNA, 1199 bp, Homo sapiens
tgagcctctggggcgtaccggcttggcgcggcggcagcggcagcggcggctgggagagcggtcggcggggtttcttcgttgcattgcctgagaggagcggagtctgccaggtggtgtccatcatgttctctttcaacatgttcgaccaccctattcccagggtcttccaaaaccgcttctccacacagtaccgctgcttctctgtgtccatgctagcagggcctaatgacaggtcagatgtggagaaaggagggaagataattatgccaccctcggccctggaccaactcagccgacttaacattacctatcccatgctgttcaaactgaccaataagaattcggaccgcatgacgcattgtggcgtgctggagtttgtggctgatgagggcatctgctacctcccacactggtgcagaacttactcttggaagaaggcggcctggtccaggtggagagcgtcaaccttcaagtggccacctactccaagagtaagttctgctacctcccacactggatgatgcagaacttactcttggaagaaggcggcctggtccaggtggagagcgtcaaccttcaagtggccacctactccaaattccaacctcagagccctgacttcctggacatcaccaaccccaaagccgtattagaaaacgcacttaggaactttgcctgtctgaccaccggggatgtgattgccatcaactataatgaaaagatctacgaactgcgtgtgatggagaccaaacccgacaaggcagtgtccatcattgagtgtgacatgaacgtggactttgatgctcccctgggctacaaagaacccgaaagacaagtccagcatgaggagtcgacagaaggtgaagccgaccacagtggctatgctggagagctgggcttccgcgctttctctggatctggcaatagactggatggaaagaagaaaggggtagagcccagcccctccccaatcaagcctggagatattaaaagaggaattcccaattatgaatttaaacttggtaagataactttcatcagaaattcacgtccccttgtcaaaaaggttgaagaggatgaagctggaggcagattcgtcgctttctctggagaaggacagtcattgcgtaaaaagggaagaaagccctaagtgaggactgttggctgattggaaaataataaaagaatcatttgcaaca

SEQ ID NO: 417375 - DNA, 1915 bp, Homo sapiens
tgagcctctggggcgtaccggcttggcgcggcggcagcggcagcggcggctgggagagcggtcggcggggtttcttcgttgcattgcctgagaggagcggagtctgccaggtggtgtccatcatgttctctttcaacatgttcgaccaccctattcccagggtcttccaaaaccgcttctccacacagtaccgctgcttctctgtgtccatgctagcagggcctaatgacaggtcagatgtggagaaaggagggaagataattatgccaccctcggccctggaccaactcagccgacttaacattacctatcccatgctgttcaaactgaccaataagaattcggaccgcatgacgcattgtggcgtgctggagtttgtggctgatgagggcatctgctacctcccacactggatgatgcagaacttactcttggaagaaggcggcctggtccaggtggagagcgtcaaccttcaagtggccacctactccaaattccaacctcagagccctgacttcctggacatcaccaaccccaaagccgtattagaaaacgcacttaggaactttgcctgtctgaccaccggggatgtgattgccatcaactataatgaaaagatctacgaactgcgtgtgatggagaccaaacccgacaaggcagtgtccatcattgagtgtgacatgaacgtggactttgatgctcccctgggctacaaagaacccgaaagacaagtccagcatgaggagtcgacagaaggtgaagccgaccacagtggctatgctggagagctgggcttccgcgctttctctggatctggcaatagactggatggaaagaagaaaggggtagagcccagcccctccccaatcaagcctggagatattaaaagaggaattcccaattatgaatttaaacttggatgaagctggaggcagattcgtcgctttctctggagaaggacagtcattgcgtaaaaagggaagaaagccctaagtgaggactgttggctgattggaaaataataaaagaatcatttgcaacatcttggcttttagttactggcactgacagggacgagcctcatcagagaatactctgttacttaagatttatttagagttacctaagaattattaagtttgacttggaagtggagcagcaggactttgtagttgtatgcttgatttggggaaagacaaagagctgtccctgagggcctgtagatagctgcctcctcacctcttcacgctttcagcttgaggggagctcccactgcctcagcaggagcaattctgcatccctaattctgtcaaaacctatgaaggtgactaaattgtctaacatgaagtgttctttctttttcttcatttatcctttcttttcctacatcaattgcataggtgtcagtctttggcctaaaaaaaggctttaaatagacatgtgttctataagtagtggctgtcccactactgtggctgcaatttaagtatttgacaaagaatgtttctatttttattttacatatttttttcaaaaacaccactcagaagaacctgatctgaatgagtttgcacttttattctcatttcatatggacataactggctccttagtgaacctgttcatagtgaaacaactccatggagaagcaaacatgtgaatgttagaatgaacaaatgctaaagagatgttcctctccttcttccctactccccaactcccaattttaatttattaaatcatccaagcttctgctggcctgtattttttatcagtatttatttggtcttagatcttcactttctataacgtgagatcttttgacatgctaatctgattattttaaatttgttcccatgagccactgtgcctggccccattggggtcgacgctaagccaagaatttcaagtaaaa

SEQ ID NO: 417376 - DNA, 1042 bp, Homo sapiens
tgagcctctggggcgtaccggcttggcgcggcggcagcggcagcggcggctgggagagcggtcggcggggtttcttcgttgcattgcctgagaggagcggagtctgccaggtggtgtccatcatgttctctttcaacatgttcgaccaccctattcccagggtcttccaaaaccgcttctccacacagtaccgctgcttctctgtgtccatgctagcagggcctaatgacaggtcagatgtggagaaaggagggaagataattatgccaccctcggccctggaccaactcagccgacttaacattacctatcccatgctgttcaaactgaccaataagaattcggaccgcatgacgcattgtggcgtgctggagtttgtggctgatgagggcatctgctacctcccacactggatgatgcagaacttactcttggaagaaggcggcctggtccaggtggagagcgtcaaccttcaagtggccacctactccaaattccaacctcagagccctgacttcctggacatcaccaaccccaaagccgtattagaaaacgcacttaggaactttgcctgtctgaccaccggggatgtgattgccatcaactataatgaaaagatctacgaactgcgtgtgatggagaccaaacccgacaaggcagtgtccatcattgagtgtgacatgaacgtggactttgatgctcccctgggctacaaagaacccgaaagacaagtccagcatgaggagtcgacagaaggtgaagccgaccacagtggctatgctggagagctgggcttccgcgctttctctggatctggcaatagactggatggaaagaagaaaggggtagagcccagcccctccccaatcaagcctggagatattaaaagaggaattcccaattatgaatttaaacttggatgaagctggaggcagattcgtcgctttctctggagaaggacagtcattgcgtaaaaagggaagaaagccctaagtgaggactgttggctgattggaaaataataaaagaatcatttgcaaca

SEQ ID NO: 417377 - DNA, 2360 bp, Homo sapiens
tgagcctctggggcgtaccggcttggcgcggcggcagcggcagcggcggctgggagagcggtcggcggggtttcttcgttgcattgcctgagaggagcggagtctgccaggtggtgtccatcatgttctctttcaacatgttcgaccaccctattcccagggtcttccaaaaccgcttctccacacagtaccgctgcttctctgtgtccatgctagcagggcctaatgacaggtcagatgtggagaaaggagggaagataattatgccaccctcggccctggaccaactcagccgacttaacattacctatcccatgctgttcaaactgaccaataagaattcggaccgcatgacgcattgtggcgtgctggagtttgtggctgatgagggcatctgctacctcccacactggatgatgcagaacttactcttggaagaaggcggcctggtccaggtggagagcgtcaaccttcaagtggccacctactccaaattccaacctcagagccctgacttcctggacatcaccaaccccaaagccgtattagaaaacgcacttaggaactttgcctgtctgaccaccggggatgtgattgccatcaactataatgaaaagatctacgaactgcgtgtgatggagaccaaacccgacaaggcagtgtccatcattgagtgtgacatgaacgtggactttgatgctcccctgggctacaaagaacccgaaagacaagtccagcatgaggagtcgacagaaggtgaagccgaccacagtggctatgctggagagctgggcttccgcgctttctctggatctggcaatagactggatggaaagaagaaaggggtagagcccagcccctccccaatcaagcctggagatattaaaagaggaattcccaattatgaatttaaacttggtaagataactttcatcagaaattcacgtccccttgtcaaaaaggttgaagaggtgagtgtatttccttgtatttccttggttggtaatgaggagatttatttgctagtgatgactgaagttcttggcattctgagtaggggtgtgcattagtctgtttccaagctgctggtaaagatgtacccgagactgggcaatttacaaaagaaagaggtttaatggacttacagttcacatggctggggaggcctcacaatcatggcagggggcaagtcacatcttacatggatggtagcaggcagagaaaaagctggtgcagggaaacacctacttataaaaccatcagatctcatgagacttattcactatcatgataacagcacggaaaagacccgccctcatgactcagttacctcccaccgactcagttacctcccacctggtccctcccacaacacgtggtaattcaagatgagatttgggtggggacgcagccaaaccacatgagggtgtctgtcatgttttccctttcctagggtccctctgctccctggtgtcctgtttttttctgtagagctggtgtagggtgtatgaaacagaagacttgcagcatgggggtcaggagctctgtcttgctctagagccgactccaggctctgttatcacagaactgtgtgccctgggtgggcttcgtcttccaacagagaccttgaacttcaaatataggcagcaccttctagctgagcagggtggtggcgggacagaggaaggcaagggctgagcatcctgtagacatgggcactttgtgggaatatggccaggcctggcagcaactggaacgcagtcacctctttgtgatgaggatttctacaacaccagcgcttcagacccatcgctctcctggttccttttctcaaaggattggacccttgaggatccaggatcagggcagagggcagatgtactgagccacccattcaggaccagctgctacatgggagccatcccaattactgaactcttttctctagcacttggggtggttggggacagagaccactgtgaagtttgcacacctggtcctactcacaaccacttctgggctcaatgttcaagttgaaacagcattgggcattgggacctttcaggctcagaggagcaaacatagtggccagtcagacctcaccctccagctcctccttcaggcaccatccaggcttcaccagctacaggctgcctttctcactaaaagccagtgcctgactccgacctaagaccttagcatgggacgtcccccaggctgactgtgacctgactgttgcaaatttacagaaggcaggggaggccagtgggcacagcaggcctgtttgaccataaatatgtatttaagaagtatatgtttaaagatgggattgaagacatatttagctctattccatcctg

SEQ ID NO: 417378 - DNA, 1140 bp, Homo sapiens
caagcaggacccttgaccactaaccgcctgtggtcgcgtccgccggtcctgaacgtggctcgcattctgtctcagccggacttgccctccttgacgaaagaaaggaaggtttgtgtccattcacgggtttcccaagtgctggacgcgcaacaggtttccataaacccaaattctctttcaacatgttcgaccaccctattcccagggtcttccaaaaccgcttctccacacagtaccgctgcttctctgtgtccatgctagcagggcctaatgacaggtcagatgtggagaaaggagggaagataattatgccaccctcggccctggaccaactcagccgacttaacattacctatcccatgctgttcaaactgaccaataagaattcggaccgcatgacgcattgtggcgtgctggagtttgtggctgatgagggcatctgctacctcccacactggatgatgcagaacttactcttggaagaaggcggcctggtccaggtggagagcgtcaaccttcaagtggccacctactccaaattccaacctcagagccctgacttcctggacatcaccaaccccaaagccgtattagaaaacgcacttaggaactttgcctgtctgaccaccggggatgtgattgccatcaactataatgaaaagatctacgaactgcgtgtgatggagaccaaacccgacaaggcagtgtccatcattgagtgtgacatgaacgtggactttgatgctcccctgggctacaaagaacccgaaagacaagtccagcatgaggagtcgacagaaggtgaagccgaccacagtggctatgctggagagctgggcttccgcgctttctctggatctggcaatagactggatggaaagaagaaaggggtagagcccagcccctccccaatcaagcctggagatattaaaagaggaattcccaattatgaatttaaacttggtaagataactttcatcagaaattcacgtccccttgtcaaaaaggttgaagaggatgaagctggaggcagattcgtcgctttctctggagaaggacagtcattgcgtaaaaagggaagaaagccctaagtgaggactgttggctgattggaaaataataaaagaatcatttgcaaca

SEQ ID NO: 417379 - DNA, 962 bp, Homo sapiens
tgagcctctggggcgtaccggcttggcgcggcggcagcggcagcggcggctgggagagcggtcggcggggtttcttcgttgcattgcctgagaggagcggagtctgccaggtggtgtccatcatgtaattatgccaccctcggccctggaccaactcagccgacttaacattacctatcccatgctgttcaaactgaccaataagaattcggaccgcatgacgcattgtggcgtgctggagtttgtggctgatgagggcatctgctacctcccacactggatgatgcagaacttactcttggaagaaggcggcctggtccaggtggagagcgtcaaccttcaagtggccacctactccaaattccaacctcagagccctgacttcctggacatcaccaaccccaaagccgtattagaaaacgcacttaggaactttgcctgtctgaccaccggggatgtgattgccatcaactataatgaaaagatctacgaactgcgtgtgatggagaccaaacccgacaaggcagtgtccatcattgagtgtgacatgaacgtggactttgatgctcccctgggctacaaagaacccgaaagacaagtccagcatgaggagtcgacagaaggtgaagccgaccacagtggctatgctggagagctgggcttccgcgctttctctggatctggcaatagactggatggaaagaagaaaggggtagagcccagcccctccccaatcaagcctggagatattaaaagaggaattcccaattatgaatttaaacttggtaagataactttcatcagaaattcacgtccccttgtcaaaaaggttgaagaggatgaagctggaggcagattcgtcgctttctctggagaaggacagtcattgcgtaaaaagggaagaaagccctaagtgaggactgttggctgattggaaaataataaaagaatcatttgcaaca

SEQ ID NO: 417380 - DNA, 1069 bp, Homo sapiens
tgagcctctggggcgtaccggcttggcgcggcggcagcggcagcggcggctgggagagcggtcggcggggtttcttcgttgcattgcctgagaggagcggagtctgccaggtggtgtccatcatgttctctttcaacatgttcgaccaccctattcccagggtcttccaaaaccgcttctccacacagtaccgctgcttctctgtgtccatgctagcagggcctaatgacagtaattatgccaccctcggccctggaccaactcagccgacttaacattacctatcccatgctgttcaaactgaccaataagaattcggaccgcatgacgcattgtggcgtgctggagtttgtggctgatgagggcatctgctacctcccacactggatgatgcagaacttactcttggaagaaggcggcctggtccaggtggagagcgtcaaccttcaagtggccacctactccaaattccaacctcagagccctgacttcctggacatcaccaaccccaaagccgtattagaaaacgcacttaggaactttgcctgtctgaccaccggggatgtgattgccatcaactataatgaaaagatctacgaactgcgtgtgatggagaccaaacccgacaaggcagtgtccatcattgagtgtgacatgaacgtggactttgatgctcccctgggctacaaagaacccgaaagacaagtccagcatgaggagtcgacagaaggtgaagccgaccacagtggctatgctggagagctgggcttccgcgctttctctggatctggcaatagactggatggaaagaagaaaggggtagagcccagcccctccccaatcaagcctggagatattaaaagaggaattcccaattatgaatttaaacttggtaagataactttcatcagaaattcacgtccccttgtcaaaaaggttgaagaggatgaagctggaggcagattcgtcgctttctctggagaaggacagtcattgcgtaaaaagggaagaaagccctaagtgaggactgttggctgattggaaaataataaaagaatcatttgcaaca

SEQ ID NO: 417381 - DNA, 929 bp, Homo sapiens
tgagcctctggggcgtaccggcttggcgcggcggcagcggcagcggcggctgggagagcggtcggcggggtttcttcgttgcattgcctgagaggagcggagtctgccaggtggtgtccatcatggccgacttaacattacctatcccatgctgttcaaactgaccaataagaattcggaccgcatgacgcattgtggcgtgctggagtttgtggctgatgagggcatctgctacctcccacactggatgatgcagaacttactcttggaagaaggcggcctggtccaggtggagagcgtcaaccttcaagtggccacctactccaaattccaacctcagagccctgacttcctggacatcaccaaccccaaagccgtattagaaaacgcacttaggaactttgcctgtctgaccaccggggatgtgattgccatcaactataatgaaaagatctacgaactgcgtgtgatggagaccaaacccgacaaggcagtgtccatcattgagtgtgacatgaacgtggactttgatgctcccctgggctacaaagaacccgaaagacaagtccagcatgaggagtcgacagaaggtgaagccgaccacagtggctatgctggagagctgggcttccgcgctttctctggatctggcaatagactggatggaaagaagaaaggggtagagcccagcccctccccaatcaagcctggagatattaaaagaggaattcccaattatgaatttaaacttggtaagataactttcatcagaaattcacgtccccttgtcaaaaaggttgaagaggatgaagctggaggcagattcgtcgctttctctggagaaggacagtcattgcgtaaaaagggaagaaagccctaagtgaggactgttggctgattggaaaataataaaagaatcatttgcaaca

SEQ ID NO: 417382 - DNA, 649 bp, Homo sapiens
gcagagagggcagaatgatgggaagctgagctatggggcagtcacaacagtagccttagcccacccatagagcttgaactgggtggccctgcagaggcagggatcaggtcttttaacccaacactgactgctggctgcccttggccaagtggctgtcttcagctcatggccaccccctgaggaactgggcagagttcttagctgccagcaccccagcagttgaggagtcagggcttcagtcctgaaggggtctgcacagcacccccagctcacatccctgcagtgatctccaagcaaaggacatatcgtcctcacacttgggcttattatatgactcacctacttcctgtctaggctttctctggatctggcaatagactggatggaaagaagaaaggggtagagcccagcccctccccaatcaagcctggagatattaaaagaggaattcccaattatgaatttaaacttggtaagataactttcatcagaaattcacgtccccttgtcaaaaaggttgaagaggatgaagctggaggcagattcgtcgctttctctggagaaggacagtcattgcgtaaaaagggaagaaagccctaagtgaggactgttggctgattggaaaataataaaagaatcatttgcaaca

SEQ ID NO: 417383 - DNA, 1690 bp, Homo sapiens
cagagatgtgggtcttgtaaaggagatcaggaggtcactgtgcaaggtactctccgcgatggacactcatcatggtagaaaaggcagaaacgactccttgggtattgcttaatcgaccattttcagcaagcaaattgatcaggttgtgagtgaggggagagtacctctcttttgctgtgatgtcatgtaggcttttcactgtaatggaacgcttcacataggaattcccaattatgaatttaaacttggtaagataactttcatcagaaattcacgtccccttgtcaaaaaggttgaagaggtgagtgtatttccttgtatttccttggttggtaatgaggagatttatttgctagtgatgactgaagttcttggcattctgagtaggggtgtgcattagtctgtttccaagctgctggtaaagatgtacccgagactgggcaatttacaaaagaaagaggtttaatggacttacagttcacatggctggggaggcctcacaatcatggcagggggcaagtcacatcttacatggatggtagcaggcagagaaaaagctggtgcagggaaacacctacttataaaaccatcagatctcatgagacttattcactatcatgataacagcacggaaaagacccgccctcatgactcagttacctcccaccgactcagttacctcccacctggtccctcccacaacacgtggtaattcaagatgagatttgggtggggacgcagccaaaccacatgagggtgtctgtcatgttttccctttcctagggtccctctgctccctggtgtcctgtttttttctgtagagctggtgtagggtgtatgaaacagaagacttgcagcatgggggtcaggagctctgtcttgctctagagccgactccaggctctgttatcacagaactgtgtgccctgggtgggcttcgtcttccaacagagaccttgaacttcaaatataggcagcaccttctagctgagcagggtggtggcgggacagaggaaggcaagggctgagcatcctgtagacatgggcactttgtgggaatatggccaggcctggcagcaactggaacgcagtcacctctttgtgatgaggatttctacaacaccagcgcttcagacccatcgctctcctggttccttttctcaaaggattggacccttgaggatccaggatcagggcagagggcagatgtactgagccacccattcaggaccagctgctacatgggagccatcccaattactgaactcttttctctagcacttggggtggttggggacagagaccactgtgaagtttgcacacctggtcctactcacaaccacttctgggctcaatgttcaagttgaaacagcattgggcattgggacctttcaggctcagaggagcaaacatagtggccagtcagacctcaccctccagctcctccttcaggcaccatccaggcttcaccagctacaggctgcctttctcactaaaagccagtgcctgactccgacctaagaccttagcatgggacgtcccccaggctgactgtgacctgactgttgcaaatttacagaaggcaggggaggccagtgggcacagcaggcctgtttgaccataaatatgtatttaagaagtatatgtttaaagatgggattgaagacatatttagctctattccatcctg

SEQ ID NO: 417384 - DNA, 644 bp, Homo sapiens
tgagcctctggggcgtaccggcttggcgcggcggcagcggcagcggcggctgggagagcggtcggcggggtttcttcgttgcattgcctgagaggagcggagtctgccaggtggtgtccatcatgttctctttcaacatgttcgaccaccctattcccagggtcttccaaaaccgcttctccacacagtaccgctgcttctctgtgtccatgctagcagggcctaatgacaggtcagatgtggagaaaggagggaagatcacttatgccacgcctcggccctggaaccgaacatcgagccgacttaacattacctatcccatgctgttcaaactgaccaataagaattcggaccgcatgacgcattgtggcgtgctggagtttgtggctgatgagggcatctgctacctcccacactggtgcagaacttactcttggaagaaggcggcctggtccaggtggagagcgtcgaatcgcattgcacacgtcggtcgctatccgttacattcgcagatagttgcacaaccactgcaagaggccccttgaaccattcccgtgggtaccaatgcaatccaatacacgccaaataggccctgctcatgtcaaggcaaaaaccaggcatcgtttagggaacaacctctttgg

SEQ ID NO: 417385 - DNA, 402 bp, Homo sapiens
cagcctcccaagtagctgggatcataggcacataccacactgagctatttttggtagagatgggatctcactatgttgcccaggctggtcttgaactcctgggctcaagtgatcctcccacctaggcctcctaaagtgctgggattacaggtgtcagctatcgtgtccagcctgagatatttcttatgagtaatgtggatggtacgtgagtccatagagtaaggcatttattgtaaacctccagggagtttctgaaaatagtatcttctcttcaaacctaggatgaagctggaggcagattcgtcgctttctctggagaaggacagtcattgcgtaaaaagggaagaaagccctaagtgaggactgttggctgattggaaaataataaaagaatcatttgca

SEQ ID NO: 417386 - DNA, 463 bp, Homo sapiens
gggtggtcatgtctcaatattttacttttaaaatcctggaaacacaggtggactttgatgctcccctgggctacaaagaacccgaaagacaagtccagcatgaggagtcgacagtaagtgttatcctcagtgtcctttgctgtcctgctgcatgctgcttttgagttcctggcagtggctcgtgggtggcctctgctagtgttggtgtagtcatatcctctgcgtcccttccagccatgcttccgggggacatcctagccgggggtgggggtgagagggaagctgggtgtccccgctgaggagctcacctgtttttctttttccctgtcaggaaggtgaagccgaccacagtggctatgctggagagctgggcttccgcgtgagtaccagaccacttgacttatattgctgtgccctctgctccttgaaattagagcactcactcaaggtgttctccatgatg

SEQ ID NO: 417387 - DNA, 1531 bp, Homo sapiens
tgagcctctggggcgtaccggcttggcgcggcggcagcggcagcggcggctgggagagcggtcggcggggtttcttcgttgcattgcctgagaggagcggagtctgccaggtggtgtccatcatgttctctttcaacatgttcgaccaccctattcccagggtcttccaaaaccgcttctccacacagtaccgctgcttctctgtgtccatgctagcagggcctaatgacaggtcagatgtggagaaaggagggaagataattatgccaccctcggccctggaccaactcagccgacttaacattacctatcccatgctgttcaaactgaccaataagaattcggaccgcatgacgcattgtggcgtgctggagtttgtggctgatgagggcatctgctacctcccacactggatgatgcagaacttactcttggaagaaggcggcctggtccaggtggagagcgtcaaccttcaagtggccacctactccaaattccaacctcagagccctgacttcctggacatcaccaaccccaaagccgtattagaaaacgcacttaggaactttgcctgtctgaccaccggggatgtgattgccatcaactataatgaaaagatctacgaactgcgtgtgatggagaccaaacccgacaaggcagtgtccatcattgagtgtgacatgaacgtggactttgatgctcccctgggctacaaagaacccgaaagacaagtccagcatgaggagtcgacagaaggtgaagccgaccacagtggctatgctggagagctgggcttccgcgctttctctggatctggcaatagactggatggaaagaagaaaggggtagagcccagcccctccccaatcaagcctggagatattaaaagaggaattcccaattatgaatttaaacttggtaagataactttcatcagaaattcacgtccccttgtcaaaaaggttgaagaggatgaagctggaggcagattcgtcgctttctctggagaaggacagtcattgcgtaaaaagggaagaaagccctaagtgaggactgttggctgattggaaaataataaaagaatcatttgcaacaaaaaaaaagaaaagaacaaaaaaaacaaaatttgtggggggttgggccttgaaaaggtttttttaaaccattttttggggggcggggcccattggtatgtggacatgggactaggggtccagaggaaaccgggccaggaacggcggggttcacccaataaaaggcgcgggggcacgggcgtctggacaaccccagtgggttcgcggcaactcggctctccaacgggccaagcaggctgatagtccacccgcgggggaggagacaacacaaggaccgacacagatcagcgagcacgacaaccgtagagagaccagaacaggcgagaccagccgaccagacaggacagagcgagagaacgaagaagcagaccaacgaacaacagaaacccaagcatggagcagcaaaagggcagccaggagacgacaaccacgacacg

SEQ ID NO: 417388 - DNA, 1968 bp, Homo sapiens
tgagcctctggggcgtaccggcttggcgcggcggcagcggcagcggcggctgggagagcggtcggcggggtttcttcgttgcattgcctgagaggagcggagtctgccaggtggtgtccatcatgttctctttcaacatgttcgaccaccctattcccagggtcttccaaaaccgcttctccacacagtaccgctgcttctctgtgtccatgctagcagggcctaatgacaggtcagatgtggagaaaggagggaagataattatgccaccctcggccctggaccaactcagccgacttaacattacctatcccatgctgttcaaactgaccaataagaattcggaccgcatgacgcattgtggcgtgctggagtttgtggctgatgagggcatctgctacctcccacactggatgatgcagaacttactcttggaagaaggcggcctggtccaggtggagagcgtcaaccttcaagtggccacctactccaaattccaacctcagagccctgacttcctggacatcaccaaccccaaagccgtattagaaaacgcacttaggaactttgcctgtctgaccaccggggatgtgattgccatcaactataatgaaaagatctacgaactgcgtgtgatggagaccaaacccgacaaggcagtgtccatcattgagtgtgacatgaacgtggactttgatgctcccctgggctacaaagaacccgaaagacaagtccagcatgaggagtcgacagaaggtgaagccgaccacagtggctatgctggagagctgggcttccgcgctttctctggatctggcaatagactggatggaaagaagaaaggggtagagcccagcccctccccaatcaagcctggagatattaaaagaggaattcccaattatgaatttaaacttggtaagataactttcatcagaaattcacgtccccttgtcaaaaaggttgaagaggatgaagctggaggcagattcgtcgctttctctggagaaggacagtcattgcgtaaaaagggaagaaagccctaagtgaggactgttggctgattggaaaataataaaagaatcatttgcaacatcttggcttttagttactggcactgacagggacgagcctcatcagagaatactctgttacttaagatttatttagagttacctaagaattattaagtttgacttggaagtggagcagcaggactttgtagttgtatgcttgatttggggaaagacaaagagctgtccctgagggcctgtagatagctgcctcctcacctcttcacgctttcagcttgaggggagctcccactgcctcagcaggagcaattctgcatccctaattctgtcaaaacctatgaaggtgactaaattgtctaacatgaagtgttctttctttttcttcatttatcctttcttttcctacatcaattgcataggtgtcagtctttggcctaaaaaaaggctttaaatagacatgtgttctataagtagtggctgtcccactactgtggctgcaatttaagtatttgacaaagaatgtttctatttttattttacatatttttttcaaaaacaccactcagaagaacctgatctgaatgagtttgcacttttattctcatttcatatggacataactggctccttagtgaacctgttcatagtgaaacaactccatggagaagcaaacatgtgaatgttagaatgaacaaatgctaaagagatgttcctctccttcttccctactccccaactcccaattttaatttattaaatcatccaagcttctgctggcctgtattttttatcagtatttatttggtcttagatcttcactttctataacgtgagatcttttgacatgctaatctgattattttaaatttgttcccatgagccactgtgcctggccccattggggtcgacgctaagccaagaatttcaagtaaaa

SEQ ID NO: 417389 - DNA, 1923 bp, Homo sapiens
  misc_feature (2)..(2): n is a, c, g, or t
  misc_feature (4)..(4): n is a, c, g, or t
  misc_feature (6)..(8): n is a, c, g, or t
gncncnnngccaagagctacgcggcggcggcggagcgcaggcctcgtgccgttacggccatcacggcggccgcagtggcgtcctggagccctcctcagtgctgaagctgctgaaagatggcagaagaagtggtggtagtagccaaatttgattatgtggcccaacaagaacaagagttggacatcaagaagaatgagagattatggcttctggatgattctaagtcctggtggcgagttcgaaattccatgaataaaacaggttttgtgccttctaactatgtggaaaggaaaaacagtgctcggaaagcatctattgtgaaaaacctaaaggataccttaggcattggaaaagtgaaaagaaaacctagtgtgccagattctgcatctcctgctgatgatagttttgttgacccaggggaacgtctctatgacctcaacatgcccgcttatgtgaaatttaactacatggctgagagagaggatgaattatcattgataaaggggacaaaggtgatcgtcatggagaaatgcagtgatgggtggtggcgtggtagctacaatggacaagttggatggttcccttcaaactatgtaactgaagaaggtgacagtcctttgggtgaccatgtgggttctctgtcagagaaattagcagcagtcgtcaataacctaaatactgggcaagtgttgcatgtggtacaggctctttacccattcagctcatctaatgatgaagaacttaatttcgagaaaggagatgtaatggatgttattgaaaaacctgaaaatgacccagagtggtggaaatgcaggaagatcaatggtatggttggtctagtaccaaaaaactatgttaccgttatgcagaataatccattaacttcaggtttggaaccatcacctccacagtgtgattacattaggccttcactcactggaaagtttgctggcaatccttggtattatggcaaagtcaccaggcatcaagcagaaatggcattaaatgaaagaggacatgaaggggatttcctcattcgtgatagtgaatcttcgccaaatgatttctcagtatcactaaaagcacaagggaaaaacaagcattttaaagtccaactaaaagagactgtctactgcattgggcagcgtaaattcagcaccatggaagaacttgtagaacattacaaaaaggcaccaatttttacaagtgaacaaggagaaaaattatatcttgtcaagcatttatcatgatactgctgaccagaagtgactgctgtgtagctgtaatttgtcatgtaattgaagactgagaaaatgttgggtccagtcgtgcttgattggaaattgttgtttctaaatctatatgagaattgacaataagtatttttattataactcagcccatacatatatactatgtatgcagtgcatctgcatagaacagttccttatccttggccttctgttttattgtttttttctttgctgttttccctttgcttctaatattacagttttgtattttgtaaacaaaaatcaaataatgcatatcagaatctttatatggaagaaatcctttattgcctttcctttgtttccttgtaaaggcaccctgttctgttatggtttttcattatataaaattattatatctatatatgacatatgctaaaatttcttggagagtgttaatcttttctgtgactaaatagcaataataagtggaaaattagaaattatttccaggtattatatttgtcacaggccattgtaaataccaagtatattgtgtctgccataatttttaaaaatacattcattgtcttcagtcatacagcaagacacatgagacatagattagaaaacatgttgtacaattttaatttacaactgttggaaataaaaatcacttaatttttttcca

SEQ ID NO: 417390 - DNA, 425 bp, Homo sapiens
cactataggcgaagggtaccgggccccccctcgtgccggcaataaaagataaattatattgcaatactagtaaacaataaaactataaaaccataaaagttgaaaaataatatggtttcatggtctcttttagatactgcttaggatattagaatttgatgacactcattttccttaaaaatggcctttctttttccttgatgaaagatatcactacttttccatttattaaatcatggttaatcttggctttgcgtgagtatatttgtacaaaagggaatgtgtaattgcacaaaattttgaaagaaaatgtgtggaagtggggtgtggtggggagagagattaattgaacttcctgatgtgaagttcaggaaaatggggcctgtgcctaatccctcagaaaagcagttggttggcagtaggga

SEQ ID NO: 417391 - DNA, 1908 bp, Homo sapiens
ggaattccggaattccgcggagcaggcctcgtgccgttacggccatcacggcggccgcagtggcgtcctggagccctcctcagtgctgaagctgctgaaagatggcagaagaagtggtggtagtagccaaatttgattatgtggcccaacaagaacaagagttggacatcaagaagaatgagagattatggcttctggatgattctaagtcctggtggcgagttcgaaattccatgaataaaacaggttttgtgccttctaactatgtggaaaggaaaaacagtgctcggaaagcatctattgtgaaaaacctaaaggataccttaggcattggaaaagtgaaaagaaaacctagtgtgccagattctgcatctcctgctgatgatagttttgttgacccaggggaacgtctctatgacctcaacatgcccgcttatgtgaaatttaactacatggctgagagagaggatgaattatcattgataaaggggacaaaggtgatcgtcatggagaaatgcagtgatgggtggtggcgtggtagctacaatggacaagttggatggttcccttcaaactatgtaactgaagaaggtgacagtcctttgggtgaccatgtgggttctctgtcagagaaattagcagcagtcgtcaataacctaaatactgggcaagtgttgcatgtggtacaggctctttacccattcagctcatctaatgatgaagaacttaatttcgagaaaggagatgtaatggatgttattgaaaaacctgaaaatgacccagagtggtggaaatgcaggaagatcaatggtatggttggtctagtaccaaaaaactatgttaccgttatgcagaataatccattaacttcaggtttggaaccatcacctccacagtgtgattacattaggccttcactcactggaaagtttgctggcaatccttggtattatggcaaagtcaccaggcatcaagcagaaatggcattaaatgaaagaggacatgaaggggatttcctcattcgtgatagtgaatcttcgccaaatgatttctcagtatcactaaaagcacaagggaaaaacaagcattttaaagtccaactaaaagagactgtctactgcattgggcagcgtaaattcagcaccatggaagaacttgtagaacattacaaaaaggcaccaatttttacaagtgaacaaggagaaaaattatatcttgtcaagcatttatcatgatactgctgaccagaagtgactgctgtgtagctgtaatttgtcatgtaattgaagactgagaaaatgttgggtccagtcgtgcttgattggaaattgttgtttctaaatctatatgagaattgacaataagtatttttattataactcagcccatacatatatactatgtatgcagtgcatctgcatagaacagttccttatccttggccttctgttttattgtttttttctttgctgttttccctttgcttctaatattacagttttgtattttgtaaacaaaaatcaaataatgcatatcagaatctttatatggaagaaatcctttattgcctttcctttgtttccttgtaaaggcaccctgttctgttatggtttttcattatataaaattattatatctatatatgacatatgctaaaatttcttggagagtgttaatcttttctgtgactaaatagcaataataagtggaaaattagaaattatttccaggtattatatttgtcacaggccattgtaaataccaagtatattgtgtctgccataatttttaaaaatacattcattgtcttcagtcatacagcaagacacatgagacatagattagaaaacatgttgtacaattttaatttacaactgttggaaataaaaatcacttaatttttttcca

SEQ ID NO: 417392 - DNA, 1957 bp, Homo sapiens
  misc_feature (2)..(2): n is a, c, g, or t
  misc_feature (4)..(4): n is a, c, g, or t
  misc_feature (6)..(8): n is a, c, g, or t
gncncnnngccaagagctacgcggcggcggcggagcgcaggcctcgtgccgttacggccatcacggcggccgcagtggcgtcctggagccctcctcaggtgagctggagctgcccggctcggcagcgggaagtgctgaagctgctgaaagatggcagaagaagtggtggtagtagccaaatttgattatgtggcccaacaagaacaagagttggacatcaagaagaatgagagattatggcttctggatgattctaagtcctggtggcgagttcgaaattccatgaataaaacaggttttgtgccttctaactatgtggaaaggaaaaacagtgctcggaaagcatctattgtgaaaaacctaaaggataccttaggcattggaaaagtgaaaagaaaacctagtgtgccagattctgcatctcctgctgatgatagttttgttgacccaggggaacgtctctatgacctcaacatgcccgcttatgtgaaatttaactacatggctgagagagaggatgaattatcattgataaaggggacaaaggtgatcgtcatggagaaatgcagtgatgggtggtggcgtggtagctacaatggacaagttggatggttcccttcaaactatgtaactgaagaaggtgacagtcctttgggtgaccatgtgggttctctgtcagagaaattagcagcagtcgtcaataacctaaatactgggcaagtgttgcatgtggtacaggctctttacccattcagctcatctaatgatgaagaacttaatttcgagaaaggagatgtaatggatgttattgaaaaacctgaaaatgacccagagtggtggaaatgcaggaagatcaatggtatggttggtctagtaccaaaaaactatgttaccgttatgcagaataatccattaacttcaggtttggaaccatcacctccacagtgtgattacattaggccttcactcactggaaagtttgctggcaatccttggtattatggcaaagtcaccaggcatcaagcagaaatggcattaaatgaaagaggacatgaaggggatttcctcattcgtgatagtgaatcttcgccaaatgatttctcagtatcactaaaagcacaagggaaaaacaagcattttaaagtccaactaaaagagactgtctactgcattgggcagcgtaaattcagcaccatggaagaacttgtagaacattacaaaaaggcaccaatttttacaagtgaacaaggagaaaaattatatcttgtcaagcatttatcatgatactgctgaccagaagtgactgctgtgtagctgtaatttgtcatgtaattgaagactgagaaaatgttgggtccagtcgtgcttgattggaaattgttgtttctaaatctatatgagaattgacaataagtatttttattataactcagcccatacatatatactatgtatgcagtgcatctgcatagaacagttccttatccttggccttctgttttattgtttttttctttgctgttttccctttgcttctaatattacagttttgtattttgtaaacaaaaatcaaataatgcatatcagaatctttatatggaagaaatcctttattgcctttcctttgtttccttgtaaaggcaccctgttctgttatggtttttcattatataaaattattatatctatatatgacatatgctaaaatttcttggagagtgttaatcttttctgtgactaaatagcaataataagtggaaaattagaaattatttccaggtattatatttgtcacaggccattgtaaataccaagtatattgtgtctgccataatttttaaaaatacattcattgtcttcagtcatacagcaagacacatgagacatagattagaaaacatgttgtacaattttaatttacaactgttggaaataaaaatcacttaatttttttcca

SEQ ID NO: 417393 - DNA, 1524 bp, Homo sapiens
  misc_feature (2)..(2): n is a, c, g, or t
  misc_feature (4)..(4): n is a, c, g, or t
  misc_feature (6)..(8): n is a, c, g, or t
gncncnnngccaagagctacgcggcggcggcggagcgcaggcctcgtgccgttacggccatcacggcggccgcagtggcgtcctggagccctcctcagtgctgaagctgctgaaagatggcagaagaagtggtggtagtagccaaatttgattatgtggcccaacaagaacaagagttggacatcaagaagaatgagagattatggcttctggatgattctaagtcctggtggcgagttcgaaattccatgaataaaacaggttttgtgccttctaactatgtggaaaggaaaaacagtgctcggaaagcatctattgtgaaaaacctaaaggataccttaggcattggaaaagtgaaaagaaaacctagtgtgccagattctgcatctcctgctgatgatagttttgttgacccaggggaacgtctctatgacctcaacatgcccgcttatgtgaaatttaactacatggctgagagagaggatgaattatcattgataaaggggacaaagtgtgattacattaggccttcactcactggaaagtttgctggcaatccttggtattatggcaaagtcaccaggcatcaagcagaaatggcattaaatgaaagaggacatgaaggggatttcctcattcgtgatagtgaatcttcgccaaatgatttctcagtatcactaaaagcacaagggaaaaacaagcattttaaagtccaactaaaagagactgtctactgcattgggcagcgtaaattcagcaccatggaagaacttgtagaacattacaaaaaggcaccaatttttacaagtgaacaaggagaaaaattatatcttgtcaagcatttatcatgatactgctgaccagaagtgactgctgtgtagctgtaatttgtcatgtaattgaagactgagaaaatgttgggtccagtcgtgcttgattggaaattgttgtttctaaatctatatgagaattgacaataagtatttttattataactcagcccatacatatatactatgtatgcagtgcatctgcatagaacagttccttatccttggccttctgttttattgtttttttctttgctgttttccctttgcttctaatattacagttttgtattttgtaaacaaaaatcaaataatgcatatcagaatctttatatggaagaaatcctttattgcctttcctttgtttccttgtaaaggcaccctgttctgttatggtttttcattatataaaattattatatctatatatgacatatgctaaaatttcttggagagtgttaatcttttctgtgactaaatagcaataataagtggaaaattagaaattatttccaggtattatatttgtcacaggccattgtaaataccaagtatattgtgtctgccataatttttaaaaatacattcattgtcttcagtcatacagcaagacacatgagacatagattagaaaacatgttgtacaattttaatttacaactgttggaaataaaaatcacttaatttttttcca

SEQ ID NO: 417394 - DNA, 1500 bp, Homo sapiens
ttcagactggttttgaattcctggcctcaaacgatcctcccaccttggcttctcaacgtgctgggattatagggtgctgaagctgctgaaagatggcagaagaagtggtggtagtagccaaatttgattatgtggcccaacaagaacaagagttggacatcaagaagaatgagagattatggcttctggatgattctaagtcctggtggcgagttcgaaattccatgaataaaacaggttttgtgccttctaactatgtggaaaggaaaaacagtgctcggaaagcatctattgtgaaaaacctaaaggataccttaggcattggaaaagtgaaaagaaaacctagtgtgccagattctgcatctcctgctgatgatagttttgttgacccaggggaacgtctctatgacctcaacatgcccgcttatgtgaaatttaactacatggctgagagagaggatgaattatcattgataaaggggacaaagtgtgattacattaggccttcactcactggaaagtttgctggcaatccttggtattatggcaaagtcaccaggcatcaagcagaaatggcattaaatgaaagaggacatgaaggggatttcctcattcgtgatagtgaatcttcgccaaatgatttctcagtatcactaaaagcacaagggaaaaacaagcattttaaagtccaactaaaagagactgtctactgcattgggcagcgtaaattcagcaccatggaagaacttgtagaacattacaaaaaggcaccaatttttacaagtgaacaaggagaaaaattatatcttgtcaagcatttatcatgatactgctgaccagaagtgactgctgtgtagctgtaatttgtcatgtaattgaagactgagaaaatgttgggtccagtcgtgcttgattggaaattgttgtttctaaatctatatgagaattgacaataagtatttttattataactcagcccatacatatatactatgtatgcagtgcatctgcatagaacagttccttatccttggccttctgttttattgtttttttctttgctgttttccctttgcttctaatattacagttttgtattttgtaaacaaaaatcaaataatgcatatcagaatctttatatggaagaaatcctttattgcctttcctttgtttccttgtaaaggcaccctgttctgttatggtttttcattatataaaattattatatctatatatgacatatgctaaaatttcttggagagtgttaatcttttctgtgactaaatagcaataataagtggaaaattagaaattatttccaggtattatatttgtcacaggccattgtaaataccaagtatattgtgtctgccataatttttaaaaatacattcattgtcttcagtcatacagcaagacacatgagacatagattagaaaacatgttgtacaattttaatttacaactgttggaaataaaaatcacttaatttttttcca

SEQ ID NO: 417395 - DNA, 1345 bp, Homo sapiens
  misc_feature (2)..(2): n is a, c, g, or t
  misc_feature (4)..(4): n is a, c, g, or t
  misc_feature (6)..(8): n is a, c, g, or t
gncncnnngccaagagctacgcggcggcggcggagcgcaggcctcgtgccgttacggccatcacggcggccgcagtggcgtcctggagccctcctcagtgctgaagctgctgaaagatggcagaagaagtggtggtagtagccaaatttgattatgtggcccaacaagaacaagagttggacatcaagaagaatgagagattatggcttctggatgattctaagtcctggtggcgagttcgaaattccatgaataaaacaggttttgtgccttctaactatgtggaaaggaaaaacagtgctcggaaagcatctattgtgaaaaacctaaaggataccttaggcattggaaaagtgaaaagaaaacctagtgtgccagattctgcatctcctgctgatgatagttttgttgacccaggggaacgtctctatgacctcaacatgcccgcttatgtgaaatttaactacatggctgagagagaggatgaattatcattgataaaggggacaaaggtgatcgtcatggagaaatgcagtgatgggtggtggcgtggtagctacaatggacaagttggatggttcccttcaaactatgtaactgaagaaggtgacagtcctttgggtgaccatgtgggttctctgtcagagaaattagcagcagtcgtcaataacctaaatactgggcaagtgttgcatgtggtacaggctctttacccattcagctcatctaatgatgaagaacttaatttcgagaaaggagatgtaatggatgttattgaaaaacctgaaaatgacccagagtggtggaaatgcaggaagatcaatggtatggttggtctagtaccaaaaaactatgttaccgttatgcagaataatccattaacttcaggtttggaaccatcacctccacagtgtgattacattaggccttcactcactggaaagtttgctggcaatccttggtattatggcaaagtcaccaggcatcaagcagaaatggcattaaatgaaagaggacatgaaggggatttcctcattcgtgatagtgaatcttcggtaagttgattttcggaggtaaatacaaatagagctctgggtattttaaaaaaaagagagagagaaatggagaggttaagtggcttccctaaagttaaccaggtaacaagctgggacgtaacataagcataaatgttccaaagctaaagtccgcattctttctagctatctattttgaataaaagagagctgtggcagtgttgctacacactgaattatttcgtcttgtctagttctgttgattttgcattcctgatatattttctgtttctgttgcattaaactaaatg

SEQ ID NO: 417396 - DNA, 2198 bp, Homo sapiens
  misc_feature (2)..(2): n is a, c, g, or t
  misc_feature (4)..(4): n is a, c, g, or t
  misc_feature (6)..(8): n is a, c, g, or t
gncncnnngccaagagctacgcggcggcggcggagcgcaggcctcgtgccgttacggccatcacggcggccgcagtggcgtcctggagccctcctcagtgctgaagctgctgaaagatggcagaagaagtggtggtagtagccaaatttgattatgtggcccaacaagaacaagagttggacatcaagaagaatgagagattatggcttctggatgattctaagtcctggtggcgagttcgaaattccatgaataaaacaggttttgtgccttctaactatgtggaaaggaaaaacagtgctcggaaagcatctattgtgaaaaacctaaaggataccttaggcattggaaaagtgaaaagaaaacctagtgtgccagattctgcatctcctgctgatgatagttttgttgacccaggggaacgtctctatgacctcaacatgcccgcttatgtgaaatttaactacatggctgagagagaggatgaattatcattgataaaggggacaaaggtgatcgtcatggagaaatgcagtgatgggtggtggcgtggtagctacaatggacaagttggatggttcccttcaaactatgtaactgaagaaggtgacagtcctttgggtgaccatgtgggttctctgtcagagaaattagcagcagtcgtcaataacctaaatactgggcaagtgttgcatgtggtacaggctctttacccattcagctcatctaatgatgaagaacttaatttcgagaaaggagatgtaatggatgttattgaaaaacctgaaaatgacccagagtggtggaaatgcaggaagatcaatggtatggttggtctagtaccaaaaaactatgttaccgttatgcagaataatccattaacttcaggtttggaaccatcacctccacagtgtgattacattaggccttcactcactggaaagtttgctggcaatccttggtattatggcaaagtcaccaggcatcaagcagaaatggcattaaatgaaagaggacatgaaggggatttcctcattcgtgatagtgaatcttcggccactccctgctgatgcaacatctgggtttgggcagaaaggagggtgcttcggagcccgccctttctgagcttcctgggccggctctagaacaattcaggcttcgctgcgactcagacctcagctccaacatatgcattctgaagaaagatggctgagatggacagaatgctttattttggaaagaaacaatgttctaggtcaaactgagtctaccaaatgcagactttcacaatggttctagaagaaatctggacaagtcttttcatgtggtttttctacgcattgattccatgtttgctcacagatgaagtggccattctgcctgcccctcagaacctctctgtactctcaaccaacatgaagcatctcttgatgtggagcccagtgatcgcgcctggagaaacagtgtactattctgtcgaataccagggggagtacgagagcctgtacacgagccacatctggatccccagcagctggtgctcactcactgaaggtcctgagtgtgatgtcactgatgacatcacggccactgtgccatacaaccttcgtgtcagggccacattgggctcacagacctcagcctggagcatcctgaagcatccctttaatagaaactcaaccatccttacccgacctgggatggagatcaccaaagatggcttccacctggttattgagctggaggacctggggccccagtttgagttccttgtggcctactggaggagggagcctggtgccgaggaacatgtcaaaatggtgaggagtgggggtattccagtgcacctagaaaccatggagccaggggctgcatactgtgtgaaggcccagacattcgtgaaggccattgggaggtacagcgccttcagccagacagaatgtgtggaggtgcaaggagaggccattcccctggtactggccctgtttgcctttgttggcttcatgctgatccttgtggtcgtgccactgttcgtctggaaaatgggccggctgctccagtactcctgttgccccgtggtggtcctcccagacaccttgaaaataaccaattcaccccagaagttaatcagctgcagaagggaggaggtggatgcctgtgccacggctgtgatgtcgttcagaggtaggaaaccgagc

SEQ ID NO: 417397 - DNA, 1346 bp, Homo sapiens
attctcatttgtgtattcttcatttttgggaattcagcatgttatctctaagacagctactgttagctacacattgaaaaggggttgggtgggtatcttagactttctcatgtgtttctctgactggagagaagatagctcttgttcttcaaatatttaactaaaggatttgctgtgggtgtctgctgttggagccgtgggtgttaagagacttttgattatgcaggtttgaatcctggctctgttgttaactagatggatgatattggccaagttattaatagcttctttgagactcagttttcacatgtgtaaaaagggtttgttttgaagagtaaaggagataatctatgtaaataatttaccatggtgcctaggacttagtaagtgcttagattttagcttttagtttaatataaaaatactgatagagggctttcaaaatgtttactatatgtatcttttttttctcttttagccaaatgatttctcagtatcactaaaagcacaagggaaaaacaagcattttaaagtccaactaaaagagactgtctactgcattgggcagcgtaaattcagcaccatggaagaacttgtagaacattacaaaaaggcaccaatttttacaagtgaacaaggagaaaaattatatcttgtcaagcatttatcatgatactgctgaccagaagtgactgctgtgtagctgtaatttgtcatgtaattgaagactgagaaaatgttgggtccagtcgtgcttgattggaaattgttgtttctaaatctatatgagaattgacaataagtatttttattataactcagcccatacatatatactatgtatgcagtgcatctgcatagaacagttccttatccttggccttctgttttattgtttttttctttgctgttttccctttgcttctaatattacagttttgtattttgtaaacaaaaatcaaataatgcatatcagaatctttatatggaagaaatcctttattgcctttcctttgtttccttgtaaaggcaccctgttctgttatggtttttcattatataaaattattatatctatatatgacatatgctaaaatttcttggagagtgttaatcttttctgtgactaaatagcaataataagtggaaaattagaaattatttccaggtattatatttgtcacaggccattgtaaataccaagtatattgtgtctgccataatttttaaaaatacattcattgtcttcagtcatacagcaagacacatgagacatagattagaaaacatgttgtacaattttaatttacaactgttggaaataaaaatcacttaatttttttcca

SEQ ID NO: 417398 - DNA, 1880 bp, Homo sapiens
  misc_feature (2)..(2): n is a, c, g, or t
  misc_feature (4)..(4): n is a, c, g, or t
  misc_feature (6)..(8): n is a, c, g, or t
gncncnnngccaagagctacgcggcggcggcggagcgcaggcctcgtgccgttacggccatcacggcggccgcagtggcgtcctggagccctcctcagtgctgaagctgctgaaagatggcagaagaagtggtggtagtagccaaatttgattatgtggcccaacaagaacaagagttggacatcaagaagaatgagagattatggcttctggatgattctaagtcctggtggcgagttcgaaattccatgaataaaacaggttttgtgccttctaactatgtggaaaggaaaaacagtgctcggaaagcatctattgtgaaaaacctaaaggataccttaggcattggaaaagtgaaaagaaaacctagtgtgccagattctgcatctcctgctgatgatagttttgttgacccaggggaacgtctctatgacctcaacatgcccgcttatgtgaaatttaactacatggctgagagagaggatgaattatcattgataaaggggacaaaggtgatcgtcatggagaaatgcagtgatgggtggtggcgtggtagctacaatggacaagttggatggttcccttcaaactatgtaactgaagaaggtgacagtcctttgggtgaccatgtgggttctctgtcagagaaattagcagcagtcgtcaataacctaaatactgggcaagtgttgcatgtggtacaggctctttacccattcagctcatctaatgatgaagaacttaatttcgagaaaggagatgtaatggatgttattgaaaaacctgaaaatgacccagagtggtggaaatgcaggaagatcaatggtatggttggtctagtaccaaaaaactatgttaccgttatgcagaataatccattaacttcaggtttggaaccatcacctccacagtgtgattacattaggccttcactcactggaaagtttgctggcaatccttggtattatggcaaagtcaccaggcatcaagcagaaatggcattaaatgaaagaggacatgaaggggatttcctcattcgtgatagtgaatcttcggccactccctgctgatgcaacatctgggtttgggcagaaaggagggtgcttcggagcccgccctttctgagcttcctgggccggctctagaacaattcaggcttcgctgcgactcagacctcagctccaacatatgcattctgaagaaagatggctgagatggacagaatgctttattttggaaagaaacaatgttctaggtcaaactgagtctaccaaatgcagactttcacaatggttctagaagaaatctggacaagtcttttcatgtggtttttctacgcattgattccatgtttgctcacagccatccttacccgacctgggatggagatcaccaaagatggcttccacctggttattgagctggaggacctggggccccagtttgagttccttgtggcctactggaggagggagcctggtgccgaggaacatgtcaaaatggtgaggagtgggggtattccagtgcacctagaaaccatggagccaggggctgcatactgtgtgaaggcccagacattcgtgaaggccattgggaggtacagcgccttcagccagacagaatgtgtggaggtgcaaggagaggccattcccctggtactggccctgtttgcctttgttggcttcatgctgatccttgtggtcgtgccactgttcgtctggaaaatgggccggctgctccagtactcctgttgccccgtggtggtcctcccagacaccttgaaaataaccaattcaccccagaagttaatcagctgcagaagggaggaggtggatgcctgtgccacggctgtgatgtcgttcagaggtaggaaaccgagc

SEQ ID NO: 417399 - DNA, 2106 bp, Homo sapiens
  misc_feature (2)..(2): n is a, c, g, or t
  misc_feature (4)..(4): n is a, c, g, or t
  misc_feature (6)..(8): n is a, c, g, or t
gncncnnngccaagagctacgcggcggcggcggagcgcaggcctcgtgccgttacggccatcacggcggccgcagtggcgtcctggagccctcctcagtgctgaagctgctgaaagatggcagaagaagtggtggtagtagccaaatttgattatgtggcccaacaagaacaagagttggacatcaagaagaatgagagattatggcttctggatgattctaagtcctggtggcgagttcgaaattccatgaataaaacaggttttgtgccttctaactatgtggaaaggaaaaacagtgctcggaaagcatctattgtgaaaaacctaaaggataccttaggcattggaaaagtgaaaagaaaacctagtgtgccagattctgcatctcctgctgatgatagttttgttgacccaggggaacgtctctatgacctcaacatgcccgcttatgtgaaatttaactacatggctgagagagaggatgaattatcattgataaaggggacaaaggtgatcgtcatggagaaatgcagtgatgggtggtggcgtggtagctacaatggacaagttggatggttcccttcaaactatgtaactgaagaaggtgacagtcctttgggtgaccatgtgggttctctgtcagagaaattagcagcagtcgtcaataacctaaatactgggcaagtgttgcatgtggtacaggctctttacccattcagctcatctaatgatgaagaacttaatttcgagaaaggagatgtaatggatgttattgaaaaacctgaaaatgacccagagtggtggaaatgcaggaagatcaatggtatggttggtctagtaccaaaaaactatgttaccgttatgcagaataatccattaacttcaggtttggaaccatcacctccacagtgtgattacattaggccttcactcactggaaagtttgctggcaatccttggtattatggcaaagtcaccaggcatcaagcagaaatggcattaaatgaaagaggacatgaaggggatttcctcattcgtgatagtgaatcttcggccactccctgctgatgcaacatctgggtttgggcagaaaggagggtgcttcggagcccgccctttctgagcttcctgggccggctctagaacaattcaggcttcgctgcgactcagacctcagctccaacatatgcattctgaagaaagatggctgagatggacagaatgctttattttggaaagaaacaatgttctaggtcaaactgagtctaccaaatgcagactttcacaatggttctagaagaaatctggacaagtcttttcatgtggtttttctacgcattgattccatgtttgctcacaggctggagtgcagtggtgcaatctcagcttactgcaacctccgccagtgaggcccttcattagacactaatttgaagctatggcattcccccactatgagcccacctgtcagccaggctatctgccttgatcctagatgaagtggccattctgcctgcccctcagaacctctctgtactctcaaccaacatgaagcatctcttgatgtggagcccagtgatcgcgcctggagaaacagtgtactattctgtcgaataccagggggagtacgagagcctgtacacgagccacatctggatccccagcagctggtgctcactcactgaaggtcctgagtgtgatgtcactgatgacatcacggccactgtgccatacaaccttcgtgtcagggccacattgggctcacagacctcagcctggagcatcctgaagcatccctttaatagaaactcaaccatccttacccgacctgggatggagatcaccaaagatggcttccacctggttattgagctggaggacctggggccccagtttgagttccttgtggcctactggaggagggagcctggtgccgaggagaggccattcccctggtactggccctgtttgcctttgttggcttcatgctgatccttgtggtcgtgccactgttcgtctggaaaatgggccggctgctccagtactcctgttgccccgtggtggtcctcccagacaccttgcttggtaatagagtagttcttta

SEQ ID NO: 417400 - DNA, 2213 bp, Homo sapiens
  misc_feature (2)..(2): n is a, c, g, or t
  misc_feature (4)..(4): n is a, c, g, or t
  misc_feature (6)..(8): n is a, c, g, or t
gncncnnngccaagagctacgcggcggcggcggagcgcaggcctcgtgccgttacggccatcacggcggccgcagtggcgtcctggagccctcctcagtgctgaagctgctgaaagatggcagaagaagtggtggtagtagccaaatttgattatgtggcccaacaagaacaagagttggacatcaagaagaatgagagattatggcttctggatgattctaagtcctggtggcgagttcgaaattccatgaataaaacaggttttgtgccttctaactatgtggaaaggaaaaacagtgctcggaaagcatctattgtgaaaaacctaaaggataccttaggcattggaaaagtgaaaagaaaacctagtgtgccagattctgcatctcctgctgatgatagttttgttgacccaggggaacgtctctatgacctcaacatgcccgcttatgtgaaatttaactacatggctgagagagaggatgaattatcattgataaaggggacaaaggtgatcgtcatggagaaatgcagtgatgggtggtggcgtggtagctacaatggacaagttggatggttcccttcaaactatgtaactgaagaaggtgacagtcctttgggtgaccatgtgggttctctgtcagagaaattagcagcagtcgtcaataacctaaatactgggcaagtgttgcatgtggtacaggctctttacccattcagctcatctaatgatgaagaacttaatttcgagaaaggagatgtaatggatgttattgaaaaacctgaaaatgacccagagtggtggaaatgcaggaagatcaatggtatggttggtctagtaccaaaaaactatgttaccgttatgcagaataatccattaacttcaggtttggaaccatcacctccacagtgtgattacattaggccttcactcactggaaagtttgctggcaatccttggtattatggcaaagtcaccaggcatcaagcagaaatggcattaaatgaaagaggacatgaaggggatttcctcattcgtgatagtgaatcttcggccactccctgctgatgcaacatctgggtttgggcagaaaggagggtgcttcggagcccgccctttctgagcttcctgggccggctctagaacaattcaggcttcgctgcgactcagacctcagctccaacatatgcattctgaagaaagatggctgagatggacagaatgctttattttggaaagaaacaatgttctaggtcaaactgagtctaccaaatgcagactttcacaatggttctagaagaaatctggacaagtcttttcatgtggtttttctacgcattgattccatgtttgctcacagatgaagtggccattctgcctgcccctcagaacctctctgtactctcaaccaacatgaagcatctcttgatgtggagcccagtgatcgcgcctggagaaacagtgtactattctgtcgaataccagggggagtacgagagcctgtacacgagccacatctggatccccagcagctggtgctcactcactgaaggtcctgagtgtgatgtcactgatgacatcacggccactgtgccatacaaccttcgtgtcagggccacattgggctcacagacctcagcctggagcatcctgaagcatccctttaatagaaactcaagaactgcctttcttctgagtgtccacttgtgtccggaattggtgggttcttgatctcactgacttcaagaatgaagccgcagaccctcgcgccatccttacccgacctgggatggagatcaccaaagatggcttccacctggttattgagctggaggacctggggccccagtttgagttccttgtggcctactggaggagggagcctggtgccgaggaacatgtcaaaatggtgaggagtgggggtattccagtgcacctagaaaccatggagccaggggctgcatactgtgtgaaggcccagacattcgtgaaggccattgggaggtacagcgccttcagccagacagaatgtgtggaggtgcaaggagaggccattcccctggtactggccctgtttgcctttgttggcttcatgctgatccttgtggtcgtgccactgttcgtctggaaaatgggccggctgctccagtactcctgttgccccgtggtggtcctcccagacaccttgcttggtaatagagtagttcttta

SEQ ID NO: 417401 - DNA, 1347 bp, Homo sapiens
  misc_feature (2)..(2): n is a, c, g, or t
  misc_feature (4)..(4): n is a, c, g, or t
  misc_feature (6)..(8): n is a, c, g, or t
gncncnnngccaagagctacgcggcggcggcggagcgcaggcctcgtgccgttacggccatcacggcggccgcagtggcgtcctggagccctcctcagtgctgaagctgctgaaagatggcagaagaagtggtggtagtagccaaatttgattatgtggcccaacaagaacaagagttggacatcaagaagaatgagagattatggcttctggatgattctaagtcctggtggcgagttcgaaattccatgaataaaacaggttttgtgccttctaactatgtggaaaggaaaaacagtgctcggaaagcatctattgtgaaaaacctaaaggataccttaggcattggaaaagtgaaaagaaaacctagtgtgccagattctgcatctcctgctgatgatagttttgttgacccaggggaacgtctctatgacctcaacatgcccgcttatgtgaaatttaactacatggctgagagagaggatgaattatcattgataaaggggacaaaggtgatcgtcatggagaaatgcagtgatgggtggtggcgtggtagctacaatggacaagttggatggttcccttcaaactatgtaactgaagaaggtgacagtcctttgggtgaccatgtgggttctctgtcagagaaattagcagcagtcgtcaataacctaaatactgggcaagtgttgcatgtggtacaggctctttacccattcagctcatctaatgatgaagaacttaatttcgagaaaggagatgtaatggatgttattgaaaaacctgaaaatgacccagagtggtggaaatgcaggaagatcaatggtatggttggtctagtaccaaaaaactatgttaccgttatgcagaataatccattaacttcaggtttggaaccatcacctccacagtgtgattacattaggccttcactcactggaaagtttgctggcaatccttggtattatggcaaagtcaccaggcatcaagcagaaatggcattaaatgaaagaggacatgaaggggatttcctcattcgtgatagtgaatcttcgatactgcttaggatattagaatttgatgacactcattttccttaaaaatggcctttctttttccttgatgaaagatatcactacttttccatttattaaatcatggttaatcttggctttgcgtgagtatatttgtacaaaagggaatgtgtaattgcacaaaattttgaaagaaaatgtgtggaagtggggtgtggtggggagagagattaattgaacttcctgatgtgaagttcaggaaaatggggcctgtgcctaatccctcagaaaagcagttggttggcagtaggga

SEQ ID NO: 417402 - DNA, 989 bp, Homo sapiens
  misc_feature (2)..(2): n is a, c, g, or t
  misc_feature (4)..(4): n is a, c, g, or t
  misc_feature (6)..(8): n is a, c, g, or t
gncncnnngccaagagctacgcggcggcggcggagcgcaggcctcgtgccgttacggccatcacggcggccgcagtggcgtcctggagccctcctcagtgctgaagctgctgaaagatggcagaagaagtggtggtagtagccaaatttgattatgtggcccaacaagaacaagagttggacatcaagaagaatgagagattatggcttctggatgattctaagtcctggtggcgagttcgaaattccatgaataaaacaggttttgtgccttctaactatgtggaaaggaaaaacagtgctcggaaagcatctattgtgaaaaacctaaaggataccttaggtaagatattttttaaaagaaaagcaactttgttttaaatgaaacctgcaacttagttctttgtacataattctggcagcagtgtgcataattgacttgaaaaggcaagggctaggtaagtttgagtcatagcaggtggtcaacccagaagaccagtgaaggtcataagtgttaacatgcagtttctgtaaatctaggcccatgctccaagtcaaggcagagtgataccaatgagtagaactaactctcaccttctagcaggggctttttgaaccatgaatcactgttggagtttagacttataggcagaattgcctctttggcaccaaggcaacttatgtacatggcacataatgaattttaacatctaatgaccttatgttttgaacttcacttaaaaccctccattttgtttttctatttgataagagaactgtggatcattactgtacattagcacctacagagctcttttctattttgtttctctttttccctttatttctccaaagtttttgttttttatttttactggccctccattagggcctgagacagtggagcccacttcacactggacttggcgtctgtccccgtggcgacgtaggcgtctgtccgacagacgccacgtggcgtcaatccgggac

SEQ ID NO: 417403 - DNA, 961 bp, Homo sapiens
aggggaggacattttcctgaagatgtatttgtggtgttggttgaatatggcactttggctttgattctagtgctgaagctgctgaaagatggcagaagaagtggtggtagtagccaaatttgattatgtggcccaacaagaacaagagttggacatcaagaagaatgagagattatggcttctggatgattctaagtcctggtggcgagttcgaaattccatgaataaaacaggttttgtgccttctaactatgtggaaaggaaaaacagtgctcggaaagcatctattgtgaaaaacctaaaggataccttaggtaagatattttttaaaagaaaagcaactttgttttaaatgaaacctgcaacttagttctttgtacataattctggcagcagtgtgcataattgacttgaaaaggcaagggctaggtaagtttgagtcatagcaggtggtcaacccagaagaccagtgaaggtcataagtgttaacatgcagtttctgtaaatctaggcccatgctccaagtcaaggcagagtgataccaatgagtagaactaactctcaccttctagcaggggctttttgaaccatgaatcactgttggagtttagacttataggcagaattgcctctttggcaccaaggcaacttatgtacatggcacataatgaattttaacatctaatgaccttatgttttgaacttcacttaaaaccctccattttgtttttctatttgataagagaactgtggatcattactgtacattagcacctacagagctcttttctattttgtttctctttttccctttatttctccaaagtttttgttttttatttttactggccctccattagggcctgagacagtggagcccacttcacactggacttggcgtctgtccccgtggcgacgtaggcgtctgtccgacagacgccacgtggcgtcaatccgggac

SEQ ID NO: 417404 - DNA, 442 bp, Homo sapiens
ctctgatgagggacgcgatggggaaaggctttgttctctgaaaactccctgtaggaactgcctttcttctgagtgtccacttgtgtccggaattggtgggttcttgatctcactgacttcaagaatgaagccgcagaccctcgcggtgagtgttacagctcttaaggtggcgcgtctggagtctgtcccttctgatgttcggatgtgttcagagtttcttccttctggtgggttcctagtctcgctggctcaggagtgaagctgcagatcttcacggtgagtgttacagctcttaaggcggcgcgtctggagttgttcgttcctcctggtgggctcgtggtctcgctggcttcaggagtgaagctgcagaccttcgcggtgagtgttacagctcataaaagcagtgtggacccaaagagtgagcagtagcaagatttattgc

SEQ ID NO: 417405 - DNA, 378 bp, Homo sapiens
agcaggggctttttgaaccatgaatcactgttggagtttagacttataggcagaattgcctctttggcaccaaggcaacttatgtacatggcacataatgaattttaacatctaatgaccttatgttttgaacttcacttaaaaccctccattttgtttttctatttgataagagaactgtggatcattactgtacattagcacctacagagctcttttctattttgtttctctttttccctttatttctccaaagtttttgttttttatttttactggccctccattagggcctgagacagtggagcccacttcacactggacttggctaagctgataggaaggaaatatgcatgggcaaggaatggcctcttcttt

SEQ ID NO: 417406 - DNA, 787 bp, Homo sapiens
cgcgccgcatatatagcagcggcggcggtggcggcggccacaccgggcggcggacacgtggagggacccggcccgcgccttctgcccctgctgccggccgcgccatgcggtgagcgccccaggccgccagagcccacccgacccggcccgacgcccggacctgccgcccagacccgccaccgcacccggaccccgacgctccgaacccgggcgcagccgcagctcaagatggcccgaggcagcgccctcctgctcgcctccctcctcctcgccgcggccctttctgcctctgcggggctctggtcgccggccaaggaaaaacgaggctggaccctgaacagcgcgggctacctgctgggcccacatgccgttggcaaccacaggtcattcagcgacaagaatggcctcaccagcaagcgggagctgcggcccgaagatgacatgaaaccaggaagctttgacaggtccatacctgaaaacaatatcatgcgcacaatcattgagtttctgtctttcttgcatctcaaagaggccggtgccctcgaccgcctcctggatctccccgccgcagcctcctcagaagacatcgagcggtcctgagagcctcctgggcacgtttgtctgtgtgctgtaacctgaagtcaaaccttaagataatggataatcttcggccaatttatgcagagtcagccattcctgttctctttgccttgatgttgtgttgttatcatttaagatttttttttttggtaattattttgagtggcaaaataaagaatagcaatta

SEQ ID NO: 417407 - DNA, 750 bp, Homo sapiens
  misc_feature (729)..(729): n is a, c, g, or t
  misc_feature (733)..(734): n is a, c, g, or t
accgccctgcgaaggtctggaaaaggtggtgttcattagaaatctcaaaaccgagtcaccaagttccctctgttggagcccagtggagcctctgggagaaaagctggggtgacttttcctacaaggggcagagggactctgctagatttttgtttttcatttgtttttaattttgtaacatggaaactctttccttaggatataccagctctcattactcagctaggaattatacctctttaaagcctgaatttaaaagtctgacagttttaaatgcttactaactgtgggagttaaatcattacgaagtgaggaatacagagtgttgtccctgattctgggtttaatctggtaagaatctttacagaggacgaccacacgccgcttcctgtagcatgtgtcgtggttgtaattctctcatgtgcatattaagaagttgctgctcagatgtggctcttccctttgcagaggccggtgccctcgaccgcctcctggatctccccgccgcagcctcctcagaagacatcgagcggtcctgagagcctcctgggcacgtttgtctgtgtgctgtaacctgaagtcaaaccttaagataatggataatcttcggccaatttatgcagagtcagccattcctgttctctttgccttgatgttgtgttgttatcatttaagatttttttttttggtaattattttgagtggcaaaataaagaatagcaattaaanagannaaaaaattatatatat

SEQ ID NO: 417408 - DNA, 811 bp, Homo sapiens
  misc_feature (790)..(790): n is a, c, g, or t
  misc_feature (794)..(795): n is a, c, g, or t
cgcgccgcatatatagcagcggcggcggtggcggcggccacaccgggcggcggacacgtggagggacccggcccgcgccttctgcccctgctgccggccgcgccatgcggtgagcgccccaggccgccagagcccacccgacccggcccgacgcccggacctgccgcccagacccgccaccgcacccggaccccgacgctccgaacccgggcgcagccgcagctcaagatggcccgaggcagcgccctcctgctcgcctccctcctcctcgccgcggccctttctgcctctgcggggctctggtcgccggccaaggaaaaacgaggctggaccctgaacagcgcgggctacctgctgggcccacatgccgttggcaaccacaggtcattcagcgacaagaatggcctcaccagcaagcgggagctgcggcccgaagatgacatgaaaccaggaagctttgacaggtccatacctgaaaacaatatcatgcgcacaatcattgagtttctgtctttcttgcatctcaaagaggccggtgccctcgaccgcctcctggatctccccgccgcagcctcctcagaagacatcgagcggtcctgagagcctcctgggcacgtttgtctgtgtgctgtaacctgaagtcaaaccttaagataatggataatcttcggccaatttatgcagagtcagccattcctgttctctttgccttgatgttgtgttgttatcatttaagatttttttttttggtaattattttgagtggcaaaataaagaatagcaattaaanagannaaaaaattatatatat

SEQ ID NO: 417409 - DNA, 309 bp, Homo sapiens
ggctataaataattcccctctaatttcgacactaatcgtcccgcccttttaaggccggtgccctcgaccgcctcctggatctccccgccgcagcctcctcagaagacatcgagcggtcctgagagcctcctgggcacgtttgtctgtgtgctgtaacctgaagtcaaaccttaagataatggataatcttcggccaatttatgcagagtcagccattcctgttctctttgccttgatgttgtgttgttatcatttaagatttttttttttggtaattattttgagtggcaaaataaagaatagcaatta

SEQ ID NO: 417410 - DNA, 597 bp, Homo sapiens
gtcccagctactgtgttgcctccttgtgcactgtgtagatggcccgaggcagcgccctcctgctcgcctccctcctcctcgccgcggccctttctgcctctgcggggctctggtcgccggccaaggaaaaacgaggctggaccctgaacagcgcgggctacctgctgggcccacatgccgttggcaaccacaggtcattcagcgacaagaatggcctcaccagcaagcgggagctgcggcccgaagatgacatgaaaccaggaagctttgacaggtccatacctgaaaacaatatcatgcgcacaatcattgagtttctgtctttcttgcatctcaaagaggccggtgccctcgaccgcctcctggatctccccgccgcagcctcctcagaagacatcgagcggtcctgagagcctcctgggcacgtttgtctgtgtgctgtaacctgaagtcaaaccttaagataatggataatcttcggccaatttatgcagagtcagccattcctgttctctttgccttgatgttgtgttgttatcatttaagatttttttttttggtaattattttgagtggcaaaataaagaatagcaatta

SEQ ID NO: 417411 - DNA, 726 bp, Homo sapiens
accgccctgcgaaggtctggaaaaggtggtgttcattagaaatctcaaaaccgagtcaccaagttccctctgttggagcccagtggagcctctgggagaaaagctggggtgacttttcctacaaggggcagagggactctgctagatttttgtttttcatttgtttttaattttgtaacatggaaactctttccttaggatataccagctctcattactcagctaggaattatacctctttaaagcctgaatttaaaagtctgacagttttaaatgcttactaactgtgggagttaaatcattacgaagtgaggaatacagagtgttgtccctgattctgggtttaatctggtaagaatctttacagaggacgaccacacgccgcttcctgtagcatgtgtcgtggttgtaattctctcatgtgcatattaagaagttgctgctcagatgtggctcttccctttgcagaggccggtgccctcgaccgcctcctggatctccccgccgcagcctcctcagaagacatcgagcggtcctgagagcctcctgggcacgtttgtctgtgtgctgtaacctgaagtcaaaccttaagataatggataatcttcggccaatttatgcagagtcagccattcctgttctctttgccttgatgttgtgttgttatcatttaagatttttttttttggtaattattttgagtggcaaaataaagaatagcaatta

SEQ ID NO: 417412 - DNA, 409 bp, Homo sapiens
agggtgactattattttttgaaaaactaacagtgacttttgactatgaagaaatttgcatttaacttttattcacttgaaagtgctgagaggaaaactcaagaaaaactacaaggctgtttattgataagtggatcctgaaatttaccagtttatggagcagccagagttaagtagtacccaggaaaggatcaggtgtgaataagacatacattatttgtcctgggacctttcaagtttaatctgagagatactgtgttaattttaatttttcatatgccccatcttcttactaatctttctttctatctaacacctatgatttatagagaattatttgaaaataactctccattcctgaggctattgtgtttcagtccactagaaccttccagcaaatcaactggaac

SEQ ID NO: 417413 - DNA, 4048 bp, Homo sapiens
ggcgggcgcccctcccccagcctcgctgccgacttgcagtttgatctcagactgctgtgctagcaatcagcgagattccgtgggcgtaggaccctccgagccaggtgtgggatatagtctcgtggtgcgccgttttttaagccggtctgaaaagcgcaatattcgggtgggagtgacccgattttccagttacagcagatgaatggaacagcaaccatacgatagaaatagagataaatcagactctggaaataccatgctttcaaaatagctcctcaaaaatttcatctgagttcacctatgcatggtcggtggaggataatggaactcaggaaacacttatctcccaaaatcacctcatcagcaattccacattacttaaagatagagtcaagcttggtacagactacagactccacctctctccagtccaaatcttcgatgatgggcggaagttctcttgccacattagagtcggtcctaacaaaatcttgaggagctccaccacagtcaaggtttttgctaaaccagaaatccctgtgattgtggaaaataactccacggatgtcttggtagagagaagatttacctgcttactaaagaatgtatttcccaaagcaaatatcacatggtttatagatggaagttttcttcatgatgaaaaagaaggaatatatattactaatgaagagagaaaaggcaaagatggatttttggaactgaagtctgttttaacaagggtacatagtaataaaccagcccaatcagacaacttgaccatttggtgtatggctctgtctccagtcccaggaaataaagtgtggaacatctcatcagaaaagatcacttttctcttaggttctgaaatttcctcaacagaccctccactgagtgttacagaatctacccttgacacccaaccttctccagccagcagtgtatctcctgcaagatatccagctacatcttcagtgacccttgtagatgtgagtgccttgaggccaaacaccactcctcaacccagcaattccagtatgactacccgaggcttcaactatccctggacctccagtgggacagataccaaaaaatcagtttcacggatacctagtgaaacatacagttcatccccctcaggtgcaggctcaacacttcatgacaatgtctttaccagcacagccagagcattttcagaagtccccacaactgccaatggatctacgaaaactaatcacgtccatatcactggtattgtggtcaataagcccaaagatggaatgtcctggccagtgattgtagcagctttactcttttgctgcatgatattgtttggtcttggagtgagaaaatggtgtcagtaccaaaaagaaataatggaaagacctccacctttcaagccaccaccacctcccatcaagtacacttgcattcaagagcccaacgaaagtgatctgccttatcatgagatggagaccctctagtctcgtgagactttgccccatggcagaactctgctggaatcctattgagaaggtagacattgtgctttattaatatagtcgctcttcagccatgcctttgctgcagctgaaatggaagtcagaagtgagtgacctgttttcccagcaactcaccctctttcatctccaaacgcctgaagcttaaccaagagtgagaggatatgtcatgttcacactcaatgcaattcgtagtggttttcttgcttattgtaagaagtacatattagtctgccatctttaaaaaaaatacagtattttcatttaaattctctgatggagggacaacaatggtttcaactgtatgcccatgcctgatcctcttatttgaacatctatcaacattgtaaactctttgccaaaatcctggggctttgctgcattccctaagataattataggaaaaagaaaatgtaaaagtgctaacaaggctgccaagtaatggagaagtatggttagccttcatattgaaattctgttgcttattttcatggaaggaaacagaatactttgcacaggaaccacattttcaatcctccttcactgtcttcctaccatgttcagcccagactcctgccacatggaccaggatgaagagggatcaaagagataattagccaaaaacccagtagcctagaagatacaaaactccactggcctctaaaattatattagccaagagtggtttcatttgagtgccttcgtgtgtatgtccatcaaactggaaccaaactgttttgtaagtaaacaggcagcctaagcccaaccctactttctaattccggttattctctttttcatctggggatttacctgttcatttaatctgcctgttttgatctgttttgaaaaagataaagagcctcaaatcagaccagcactgattaattaaccctgctcctaccaatcttttttaaagcagttgaagcagaatgtataggtgtcagagaagaaacctagtcagccagacgtgctctgtattcagcaatagtttgtgaatgaataaattactaatcctccttgtcgcttgaaaccttcccacactccctgctccaggagggaaaaacagatgttgttgacagatagagtgataggcaaattctgtgtggactttagtcccaaaaggaaactttagttcacttgcagtatgcttatccttgactgcacatgagaatgccttgtgcagagttatttggagattatgtctttttcttaaacaccatggctgtcacacttcagttcaattaaatcagaatgtctgaggagtgagacacaggcatcaacactctcaaatgattcacatgttcagccaaagttgagaaccatcgagcctgtggaagttctttctcatggctcagaatcttaggtaggtgcttaactcttgtggtggccagcctccaagatgagccccagtgttcttgcctcctactattcacatctttatgtggtcccctccaatgctgaatacagatgatttgtgtaacctgaggccaggattaaggtgaggcaatcaatgtacctagggaaaaaatttaaggaggtattcacactcagggtcatgcacttgcacaatgttgagaatgagtaccactctcaccattggtatagccaaaaaaagcttggaagtgaccaaggctaggtcacaaaatacactgtggcttcttctttgatctctctttgaccatactgacactgggaaaagcccattcccatgccatgaagacaccaaggcagccctattgagaaatctacctgtcgtggccgggcgcagtggctcacgcctgtaatcccagcactttgggaggccgaggtgggtggatcacgaggtcaggagatcgagaccatcctggctaacacagtgaaaccccgtctctactaaaaatacaaaaattagccgggtgtggtgtcgggcacctgtagtcccagctactcaggaggctgaggcaggagaagggtgggaacccgggaggcagagcttgcagtgagccgagattgtgccactgcacactccaatctgggtgaaagaccgagactccgcctcaaaaaaaaaaaaaaaagaaagaaagaaagaaagaaagaaagaaatctacctgtcaaggaactaaggtattttgctaacaagcaccaacttgccagccatgtaagggagccatcttggaagcagatcctccagcctccagtcaagtcttcagataattgcaacttcagttgatcttttgaccaagacctcaagagagccagaactacccagctaagccttttactaaatttctgaacttctaacactattagataataagtgcttattgtttaacaccattaattttgagtataatttgttacatagcgacagataactatacagctcaacaactagaaaaataaactgtttacctgccttaattatttatctttagttccttattagttctcaagaaacaaatgctagcttcatatgtatggctgttgctttgcttcatgtgtatggctatttgtatttaacaagacttaatcatcagtaatttgtatac

SEQ ID NO: 417414 - DNA, 816 bp, Homo sapiens
cacgaagtgggtggctggagtttgcttgaaaacatcaattgactttgtgatcattacagaaatgctggtgtaaggtgttcagaagacaatggagaaaaaatggaaatactgtgctgtctattacatcatccagatacattttgtcaagggtaagacttccagttgtcccttcttgtcggatgggccgctttaggggcggatggggcctctgttcatttaaaatgccttgtgactgctgctgaaattgatcaccaaaggacaaatcattactaagggtttcagttatgtatttaagcggcaggtataagagagatgctagaatctagaaatgattactaatgaacactaaaaataagaagggaatgggtcatttgtgccactgctctgaggcattttcacccatttcctttctaacaggatctctggagtaattggcaaattgtgtttcttggaaatgaaatgctctccaaatggtagccaaaacaactgcggaaaaattaaaaattacaaagccatcaacgctcagagatccttgtttaacttttttctctctcaagtactctctttcttttggatataacaagtatttctcatccaaatactaaggtctttgggagttgaaaacacgttgaattttaatgaggcatgtgtaggtatgaacctgggagacaaagtggaatccttatgacagtgggaacgagagcctaatgggcctatttaaaaagagaaggaagcaagattagttctgtattccacagtatgagagtatcatagtaagcctgagtgtcttaagaattaactgtgcttttcagacat

SEQ ID NO: 417415 - DNA, 5205 bp, Homo sapiens
tcttgagagtgttcaaccatagaaatctaatggttggttggtgtcttttcagtcaaatgctacatgtttttcactccaatatttggcatgcatatagaattttgtgcgtcaagttggccttttcctttttctaattggttctggtcttttttggagaggttagagacacaatacaactttaaaaagagtgcatgtgtacacacagccacccacccacccacaccctcttcccggattgccctccacccccatgattataaagatgcttatggtgctcttaaaatctctctcatgtcagttgccatttgcattgagctcaaaaaataatattaaggcttttggcttcactaaacaaaagcaaatacaatttctgcttgcaattctatcctttacccaccctgcagtgcagggcccagtcaagtgtgagataagcaggggaggtccagagagaggccggtagaggcactgcacaagccttgccagcgtcacctcccacctcctggtccctttcactgctaagacatgcaactgctccatgacagccttgtgccttttgccaaatgtccagaaattttgcgaatctaagtattaaaaacacactgatttggtggtgctaataagaatagaaaaaggtcatttgaacagatctattttatgaatgaatacagacctaaaaatccttaagaaaacacaaatttcagagaacaatttcaacattgttctgtcgaacgttatactcagtcctgaaccacattactttcctgtctacgtttcatttcctgggggcttgccaagtgataaacagacccaggcgtgtgtggtagagttcgggttttttagcacgaagtgggtggctggagtttgcttgaaaacatcaattgactttgtgatcattacagaaatgctggtgtaaggtgttcagaagacaatggagaaaaaatggaaatactgtgctgtctattacatcatccagatacattttgtcaagggagtttgggaaaaaacagtcaacacagaagaaaatgtttatgctacacttggctctgatgtcaacctgacctgccaaacacagacagtaggcttcttcgtgcagatgcaatggtccaaggtcaccaataagatagacctgattgctgtctatcatccccaatacggcttctactgtgcctatgggagaccctgtgagtcacttgtgactttcacagaaactcctgagaatgggtcaaaatggactctgcacttaaggaatatgtcttgttcagtcagtggaaggtacgagtgtatgcttgttctgtatccagagggcattcagactaaaatctacaaccttctcattcagacacacgttacagcagatgaatggaacagcaaccatacgatagaaatagagataaatcagactctggaaataccatgctttcaaaatagctcctcaaaaatttcatctgagttcacctatgcatggtcggtggaggataatggaactcaggaaacacttatctcccaaaatcacctcatcagcaattccacattacttaaagatagagtcaagcttggtacagactacagactccacctctctccagtccaaatcttcgatgatgggcggaagttctcttgccacattagagtcggtcctaacaaaatcttgaggagctccaccacagtcaaggtttttgctaaaccagaaatccctgtgattgtggaaaataactccacggatgtcttggtagagagaagatttacctgcttactaaagaatgtatttcccaaagcaaatatcacatggtttatagatggaagttttcttcatgatgaaaaagaaggaatatatattactaatgaagagagaaaaggcaaagatggatttttggaactgaagtctgttttaacaagggtacatagtaataaaccagcccaatcagacaacttgaccatttggtgtatggctctgtctccagtcccaggaaataaagtgtggaacatctcatcagaaaagatcacttttctcttaggttctgaaatttcctcaacagaccctccactgagtgttacagaatctacccttgacacccaaccttctccagccagcagtgtatctcctgcaagatatccagctacatcttcagtgacccttgtagatgtgagtgccttgaggccaaacaccactcctcaacccagcaattccagtatgactacccgaggcttcaactatccctggacctccagtgggacagataccaaaaaatcagtttcacggatacctagtgaaacatacagttcatccccctcaggtgcaggctcaacacttcatgacaatgtctttaccagcacagccagagcattttcagaagtccccacaactgccaatggatctacgaaaactaatcacgtccatatcactggtattgtggtcaataagcccaaagatggaatgtcctggccagtgattgtagcagctttactcttttgctgcatgatattgtttggtcttggagtgagaaaatggtgtcagtaccaaaaagaaataatggaaagacctccacctttcaagccaccaccacctcccatcaagtacacttgcattcaagagcccaacgaaagtgatctgccttatcatgagatggagaccctctagtctcgtgagactttgccccatggcagaactctgctggaatcctattgagaaggtagacattgtgctttattaatatagtcgctcttcagccatgcctttgctgcagctgaaatggaagtcagaagtgagtgacctgttttcccagcaactcaccctctttcatctccaaacgcctgaagcttaaccaagagtgagaggatatgtcatgttcacactcaatgcaattcgtagtggttttcttgcttattgtaagaagtacatattagtctgccatctttaaaaaaaatacagtattttcatttaaattctctgatggagggacaacaatggtttcaactgtatgcccatgcctgatcctcttatttgaacatctatcaacattgtaaactctttgccaaaatcctggggctttgctgcattccctaagataattataggaaaaagaaaatgtaaaagtgctaacaaggctgccaagtaatggagaagtatggttagccttcatattgaaattctgttgcttattttcatggaaggaaacagaatactttgcacaggaaccacattttcaatcctccttcactgtcttcctaccatgttcagcccagactcctgccacatggaccaggatgaagagggatcaaagagataattagccaaaaacccagtagcctagaagatacaaaactccactggcctctaaaattatattagccaagagtggtttcatttgagtgccttcgtgtgtatgtccatcaaactggaaccaaactgttttgtaagtaaacaggcagcctaagcccaaccctactttctaattccggttattctctttttcatctggggatttacctgttcatttaatctgcctgttttgatctgttttgaaaaagataaagagcctcaaatcagaccagcactgattaattaaccctgctcctaccaatcttttttaaagcagttgaagcagaatgtataggtgtcagagaagaaacctagtcagccagacgtgctctgtattcagcaatagtttgtgaatgaataaattactaatcctccttgtcgcttgaaaccttcccacactccctgctccaggagggaaaaacagatgttgttgacagatagagtgataggcaaattctgtgtggactttagtcccaaaaggaaactttagttcacttgcagtatgcttatccttgactgcacatgagaatgccttgtgcagagttatttggagattatgtctttttcttaaacaccatggctgtcacacttcagttcaattaaatcagaatgtctgaggagtgagacacaggcatcaacactctcaaatgattcacatgttcagccaaagttgagaaccatcgagcctgtggaagttctttctcatggctcagaatcttaggtaggtgcttaactcttgtggtggccagcctccaagatgagccccagtgttcttgcctcctactattcacatctttatgtggtcccctccaatgctgaatacagatgatttgtgtaacctgaggccaggattaaggtgaggcaatcaatgtacctagggaaaaaatttaaggaggtattcacactcagggtcatgcacttgcacaatgttgagaatgagtaccactctcaccattggtatagccaaaaaaagcttggaagtgaccaaggctaggtcacaaaatacactgtggcttcttctttgatctctctttgaccatactgacactgggaaaagcccattcccatgccatgaagacaccaaggcagccctattgagaaatctacctgtcgtggccgggcgcagtggctcacgcctgtaatcccagcactttgggaggccgaggtgggtggatcacgaggtcaggagatcgagaccatcctggctaacacagtgaaaccccgtctctactaaaaatacaaaaattagccgggtgtggtgtcgggcacctgtagtcccagctactcaggaggctgaggcaggagaagggtgggaacccgggaggcagagcttgcagtgagccgagattgtgccactgcacactccaatctgggtgaaagaccgagactccgcctcaaaaaaaaaaaaaaaagaaagaaagaaagaaagaaagaaagaaatctacctgtcaaggaactaaggtattttgctaacaagcaccaacttgccagccatgtaagggagccatcttggaagcagatcctccagcctccagtcaagtcttcagataattgcaacttcagttgatcttttgaccaagacctcaagagagccagaactacccagctaagccttttactaaatttctgaacttctaacactattagataataagtgcttattgtttaacaccattaattttgagtataatttgttacatagcgacagataactatacagctcaacaactagaaaaataaactgtttacctgccttaattatttatctttagttccttattagttctcaagaaacaaatgctagcttcatatgtatggctgttgctttgcttcatgtgtatggctatttgtatttaacaagacttaatcatcagtaatttgtatac

SEQ ID NO: 417416 - DNA, 3994 bp, Homo sapiens
ggcgggcgcccctcccccagcctcgctgccgacttgcagtttgatctcagactgctgtgctagcaatcagcgagattccgtgggcgtaggaccctccgagccaggtgtgggatatagtctcgtggtgcgccgttttttaagccggtctgaaaagcgcaatattcgggtgggagtgacccgattttccagttacagcagatgaatggaacagcaaccatacgatagaaatagagataaatcagactctggaaataccatgctttcaaaatagctcctcaaaaatttcatctgagttcacctatgcatggtcggtggaggataatggaactcaggaaacacttatctcccaagactacagactccacctctctccagtccaaatcttcgatgatgggcggaagttctcttgccacattagagtcggtcctaacaaaatcttgaggagctccaccacagtcaaggtttttgctaaaccagaaatccctgtgattgtggaaaataactccacggatgtcttggtagagagaagatttacctgcttactaaagaatgtatttcccaaagcaaatatcacatggtttatagatggaagttttcttcatgatgaaaaagaaggaatatatattactaatgaagagagaaaaggcaaagatggatttttggaactgaagtctgttttaacaagggtacatagtaataaaccagcccaatcagacaacttgaccatttggtgtatggctctgtctccagtcccaggaaataaagtgtggaacatctcatcagaaaagatcacttttctcttaggttctgaaatttcctcaacagaccctccactgagtgttacagaatctacccttgacacccaaccttctccagccagcagtgtatctcctgcaagatatccagctacatcttcagtgacccttgtagatgtgagtgccttgaggccaaacaccactcctcaacccagcaattccagtatgactacccgaggcttcaactatccctggacctccagtgggacagataccaaaaaatcagtttcacggatacctagtgaaacatacagttcatccccctcaggtgcaggctcaacacttcatgacaatgtctttaccagcacagccagagcattttcagaagtccccacaactgccaatggatctacgaaaactaatcacgtccatatcactggtattgtggtcaataagcccaaagatggaatgtcctggccagtgattgtagcagctttactcttttgctgcatgatattgtttggtcttggagtgagaaaatggtgtcagtaccaaaaagaaataatggaaagacctccacctttcaagccaccaccacctcccatcaagtacacttgcattcaagagcccaacgaaagtgatctgccttatcatgagatggagaccctctagtctcgtgagactttgccccatggcagaactctgctggaatcctattgagaaggtagacattgtgctttattaatatagtcgctcttcagccatgcctttgctgcagctgaaatggaagtcagaagtgagtgacctgttttcccagcaactcaccctctttcatctccaaacgcctgaagcttaaccaagagtgagaggatatgtcatgttcacactcaatgcaattcgtagtggttttcttgcttattgtaagaagtacatattagtctgccatctttaaaaaaaatacagtattttcatttaaattctctgatggagggacaacaatggtttcaactgtatgcccatgcctgatcctcttatttgaacatctatcaacattgtaaactctttgccaaaatcctggggctttgctgcattccctaagataattataggaaaaagaaaatgtaaaagtgctaacaaggctgccaagtaatggagaagtatggttagccttcatattgaaattctgttgcttattttcatggaaggaaacagaatactttgcacaggaaccacattttcaatcctccttcactgtcttcctaccatgttcagcccagactcctgccacatggaccaggatgaagagggatcaaagagataattagccaaaaacccagtagcctagaagatacaaaactccactggcctctaaaattatattagccaagagtggtttcatttgagtgccttcgtgtgtatgtccatcaaactggaaccaaactgttttgtaagtaaacaggcagcctaagcccaaccctactttctaattccggttattctctttttcatctggggatttacctgttcatttaatctgcctgttttgatctgttttgaaaaagataaagagcctcaaatcagaccagcactgattaattaaccctgctcctaccaatcttttttaaagcagttgaagcagaatgtataggtgtcagagaagaaacctagtcagccagacgtgctctgtattcagcaatagtttgtgaatgaataaattactaatcctccttgtcgcttgaaaccttcccacactccctgctccaggagggaaaaacagatgttgttgacagatagagtgataggcaaattctgtgtggactttagtcccaaaaggaaactttagttcacttgcagtatgcttatccttgactgcacatgagaatgccttgtgcagagttatttggagattatgtctttttcttaaacaccatggctgtcacacttcagttcaattaaatcagaatgtctgaggagtgagacacaggcatcaacactctcaaatgattcacatgttcagccaaagttgagaaccatcgagcctgtggaagttctttctcatggctcagaatcttaggtaggtgcttaactcttgtggtggccagcctccaagatgagccccagtgttcttgcctcctactattcacatctttatgtggtcccctccaatgctgaatacagatgatttgtgtaacctgaggccaggattaaggtgaggcaatcaatgtacctagggaaaaaatttaaggaggtattcacactcagggtcatgcacttgcacaatgttgagaatgagtaccactctcaccattggtatagccaaaaaaagcttggaagtgaccaaggctaggtcacaaaatacactgtggcttcttctttgatctctctttgaccatactgacactgggaaaagcccattcccatgccatgaagacaccaaggcagccctattgagaaatctacctgtcgtggccgggcgcagtggctcacgcctgtaatcccagcactttgggaggccgaggtgggtggatcacgaggtcaggagatcgagaccatcctggctaacacagtgaaaccccgtctctactaaaaatacaaaaattagccgggtgtggtgtcgggcacctgtagtcccagctactcaggaggctgaggcaggagaagggtgggaacccgggaggcagagcttgcagtgagccgagattgtgccactgcacactccaatctgggtgaaagaccgagactccgcctcaaaaaaaaaaaaaaaagaaagaaagaaagaaagaaagaaagaaatctacctgtcaaggaactaaggtattttgctaacaagcaccaacttgccagccatgtaagggagccatcttggaagcagatcctccagcctccagtcaagtcttcagataattgcaacttcagttgatcttttgaccaagacctcaagagagccagaactacccagctaagccttttactaaatttctgaacttctaacactattagataataagtgcttattgtttaacaccattaattttgagtataatttgttacatagcgacagataactatacagctcaacaactagaaaaataaactgtttacctgccttaattatttatctttagttccttattagttctcaagaaacaaatgctagcttcatatgtatggctgttgctttgcttcatgtgtatggctatttgtatttaacaagacttaatcatcagtaatttgtatac

SEQ ID NO: 417417 - DNA, 317 bp, Homo sapiens
aaacaagttaaaaactagttcagattcaactgttgtgcaatgtcacactaaaagaggcttggctctagtgaaataattaattaaaaccaaagatataatcagcatatcacattgcatacttatttgtatactttgcttataatcagtctcctttgttggaatctaagctctgaaaaaagaattttgtctgttttgttcaatgtcttattcaaaatgcctgtaatttgcctggcacataacaaaaattcagtaattatttgttgaataaatggatgaatggaaaccttcacaacacctttacagaggctgtaagctct

SEQ ID NO: 417418 - DNA, 361 bp, Homo sapiens
ggaactctggactagatgacctctaagatcctcctcacctccaatcactaatgaaactttttctctctttattcacttgaacccccagaaatgagagttgccctcaactccccaactgatgcctccttagcctcttcctgctctgctcccccgttatctcaggcagcatcacaaccacctgcctggtgactaccatctctccgtgttctggccatttagcctctttttaaattcttttcctatttaactctttcttaaagaaaatattccagctcactagtgttagaaaggtgcttaatgatctggagattttgttaactaaaatcatactataaatacaagcagcaactagttacagtag

SEQ ID NO: 417419 - DNA, 130 bp, Homo sapiens
aaaggcttctgtcgtgagtggcacacgtagggcaactcgattgctctgcgtgcggaatcgacatcaagagatttcggaagcataatttttggtatttgggcagctggtgatcgttggtcccggcgccctt

SEQ ID NO: 417420 - DNA, 321 bp, Homo sapiens
ggacctagtggacaatattatgatggagagcaggagagttctcatggccctgaggaaagacagtgaagttatactcttgctcctaccaagtgaaagctaattgtgtcttgctctgataccaaaaccagacaaggaaactacaaaaaaagaaaactgcagactaatactcctgatgaacatagatgtaataatcttcaacaaaatactagcaaaccaaaatccaacagcatatcaaaaagataatacaccatgatcaaatgggattcataccagggatgtaaggatggttcaatatataaatcataaacatgattcaacaga

SEQ ID NO: 417421 - DNA, 1774 bp, Homo sapiens
atagaaagcacgtgatggaatctgtgatgtctaatgtgtcttatgaaaattgccaaacaactgtccctggggattctgctttgattggcatttttagtcatgggaatgtatatttgctgatatatctgctctgtgtttgggcctctcttgctgtcattatgatgtattttgagatgattagtcaagagtcaaggttgcgagtacaggccaagaccatgggaaaaaaagccatgctcactggccaataaagagcttgatgctgcctggccaaatgaggtgactcagatagaatctgatcccattcagagcttggtaaatgtcactgtacagaagacattgaaaaggaagaggcatagtcatgatcaaaaggatatattgacagttatctatagccagggtagttgttaatacctgcttgtttggggagatatgtttgattatagagagactctgggccaccctcaaacaccgtcagatgcattagcagcccactgcatgggacaatcgcaggcagatacgaggaatgtatcccctgcctattttccttgtgtaacaaatggaaaacattctcccctgtgagaaataatgcaatttctaattatctggatgttcgttgaaaatatattagacattctccctgaggttaaaaacaaaaagtacgtgaccagtctggtaagaagtattaatgaagtagctaatattacagcttcattttctactagcacctatcataatggtcttagtcatttcacacaaatcagaacttccttccccaccagggaggacaacatcttcatgctgtgattgaagcatccattcagaacacgaggcaatattgtagtccacagggaatggatgcttcacttgatctccggaccttggctgcagaggccatcgcagcttttgaaaagtgaaggggttaattcccattggtgtctttgcttatagcatttttctctaacctataacaaggagacattacattttactttagaacatgagaatagcagttttgctcatgacttaccattccagctgcatgggaaagcaaagcagaaaacagtgccccaaatggaaaaaagatactcacacagaacaaaacagttcttggtcttgttcttggtcttgtcaaaccttgcctgatgctctttctaaagtcaaaatatgaatgctaagaaggcataacctacatccttctctgatttcttcagcagggtcaaaagacagttactagcaatggggaatgcttgtcactgtggagaaagagttttgtatatgtctgataccgttgttataacaaaacaaatttttttactatagttttttgttttctacctgcacacccaccagaagagcacaaagcaaggccattgcaacaggcatttaaaaattattatcaaacatgcacatgcttgtacacacacacacacacacacacacaaacaggggcatttgtaaaggtgtccctggaatgtaagatttataatgtttaaggcaaggtgaaggcattgccaagtgtgtgtcgctcataggactagtgtatattcactgaaagttaacctgatgatttgttattgtttgaaccatatgctgatttgcttctggtttctgtttagtgtgttctctctgataaggggctgaaagattctgcatcacacatcctctgagacctaccatgtcgcacactttgttaatgacaaacttcactctacactatacagtaccttgttgatatattcagtaaagtcttattttaaaagaaaaaaaaaacatt

SEQ ID NO: 417422 - DNA, 379 bp, Homo sapiens
ggatcctagcacagaggaagggaggctgagatggtggaggaaaagggtcactgacaaaatatttgataatctcagagtttaagggtctggggctgggggagcagagacgttctttcatccatagcataggttagcttgacaattgcatacaaaccaaaggtctggcgaagaccagctggaggtatttagttggcaacggataagattgactccaccaaggcagggcacagtggctcacaatctcagcatgttgagaggctgaggagggtggatcatttgaggccaggaactcgagaacagcttggccaacatggcaaaaccccatctgtactaaaaatacaaaaattagccaggcatggcgatgcgcacctgtaatccc

SEQ ID NO: 417423 - DNA, 236 bp, Homo sapiens
tgggctctggcactaaccagctatgggagatgggtccttacctgcaaaatgaagtggacctgagaggtctgcacggaccacacacagcccagggaaggcacctgtgcttctccatggaggcctacattcatcgctctctctcaggaagggggaagagtcctccaagacatgggaatggaaaaaccaagtgcttccaaaactactggctcccctgggaaacatccactcagatgagc

SEQ ID NO: 417424 - DNA, 4785 bp, Homo sapiens
  misc_feature (1)..(1): n is a, c, g, or t
ngcctgtcagggtgttgtgggggtgcccagctgcctgtcagaccctgaggactaccagacagagagtgggcagccatttcccgggaggcttccccttcccccacctcactctcttgccatacgggggtcaggagtcacgtgtagccacagcgctctgggccaggggtcggggctctggtgtggctcccccaggccctggctgtatgtgggtgggcatgtggcctccccccaccctgtgtgttaggaactcgtgtcctgtcccggagtgtctgtctctgtttcacttcttgtgttcccgtgtctgtctgtcttgcatccctagcccgcagtctttttctctgtccctttatctttctgtttttgtctgtgtcctaggtcggtttctgccactggctctcctgtccctgtgatctgggtctctgtgtggtctccgctggcagggggaggggagtgtgaggaaacagaactaaaagtgctgggctgtgtgggtcggggctgtgtggacagagggggcgtggcagccccgggtgggtgtgatctgtggcttgaagggaaggatgacgctgagtgggtctcgggggcaggaggagcccccaccgagccgagtcccacgggccgtgcgcgtggccagtctgctgagcgagggagaggaactgtctggggacgaccaaggggatgaggaagaggatgaccacgcctatgagggcgtccccaatggcggatggcataccagcagcctgagcttgtccttgcccagcacaatagctgcgccacaccccatggacgggccgcctgggggctccacccccgtcacaccagtcatcaaggctggctggctggacaagaacccaccgcagggatcttacatctatcagaaacgatgggtgagactggatactgatcacctgcgatactttgacagtaacaaggacgcttactctaagcgctttatctctgtggcctgcatctcccacgtggctgccatcggggaccagaagtttgaagtgatcacaaacaaccgaacctttgccttccgggcagagagtgatgtggagcggaaggagtggatgcaggccctgcagcaggccatggctgagcagcgtgcccgggcccggctctctagcgcttatctgctgggagttccaggctcagagcagcctgaccgcgctggcagcctggagcttcgtggcttcaagaataagctgtacgtggccgtggtcggggacaaagtgcagctctacaagaatctagaggagtaccacctgggcattggcatcaccttcatcgacatgagcgtgggcaacgtgaaggaagtggaccggcgcagcttcgacctcaccacgccctaccgcatcttcagcttctctgctgactcagagctagagaaggagcagtggttggaggccatgcagggagccatcgctgaggccctgtctacctcggaggtggccgagcgcatctgggctgcagcccccaacaggttctgtgctgactgcggggctcctcagcctgactgggcctccatcaacctctgtgttgttatctgcaagcgctgtgcaggggagcaccgtggcctgggcgctggcgtctccaaggtgcggagcctgaagatggacaggaaggtgtggacagaaacacttatcgagctcttcttacagctggggaatggcgctgggaaccgcttctgggcagccaacgtgccccccagtgaggccctgcagcccagcagcagccccagcacccggcggtgccacctggaggccaagtaccgtgagggcaagtaccgccgctaccacccgctctttggcaaccaggaggagctggacaaggccctgtgtgctgcagtcaccaccacagacctggctgagacccaggcgctcctgggctgtggggctgggatcaactgcttctcgggggaccctgaggcccccacgcccctggctcttgcagagcaggcggggcagacgctgcagatggaattccttcggaacaaccggaccacagaggtgcctcggctggactcgatgaagcccctggaaaagcactactcagttgtcctgccgaccgtgagccacagtggcttcctctacaagactgcctctgccggcaagctgctacaggaccgccgggcccgggaagagttcagccggcgctggtgtgtccttggtgacggggtcctgagctactttgagaatgagcgggcagtgacccccaatggagagattcgggccagcgagattgtgtgcctggcagtgccccctcctgacacccatggctttgagcacacctttgaggtgtacacggagggagaacggctgtacctgtttgggctggagagtgcggagcaggctcatgagtgggtcaagtgtattgctaaggcattcgtgcctcccctagccgaggatctgctggcccgggattttgagcggctgggacgcctaccctacaaagctggcctgagcctacagcgggcccaggagggctggttctctctcagtggctcggagctccgtgctgtcttcccggaggggccctgcgaagagccgctgcaactacggaaactgcaggagctttccatccagggggacagtgagaaccaggtgctggtgctggtggagcgaaggaggacactgtacatacagggcgagcggcggctggacttcatgggttggctgggggccatccagaaagcagccgccagcatgggggacacgctgtcggagcagcagcttggggactcggatatcccggtgatcgtgtaccgctgtgtggactacatcacgcagtgcggcctgacctccgagggcatctaccgcaagtgtgggcagacatcgaagacacagcggctgctggagagcctgcggcaggatgcgcgctctgtgcacctcaaggagggcgagcagcacgtggatgatgtttcctcggcgctcaagcgcttcctgcgcgacctgcctgatgggctcttcactcgcgcccagcgcctaacctggctggaggcctcagagattgaggacgaggaggagaaggtctccaggtaccgagagctgctggtgcggctgccccctgtcaaccgggccacagtgaaggcccttatcagccacctgtactgtgttcagtgcttctcagacacgaaccagatgaacgtgcacaacctggcaattgtgtttgggcccacgctcttccagacagatgggcaggactacaaggctggccgtgtggtggaagacctcattaaccactatgtggtggtgtttagtgtggatgaggaagagctcaggaagcagcgggaggagatcactgccattgtgaagatgcgcgtggctggcactgccagtgggacccagcatgccggtgacttcatctgcacagtgtatctggaagagaagaaggcagagactgagcagcatatcaaggtcccagcatccatgactgctgaggagctcaccctggagatcctggatcgccggaacgtgggcatcagggagaaggactattggacctgctttgaggtcaacgagagggaggaggcagagcgccccctgcactttgcggagaaggtgctgcccatcctgcacgggctgggcacggacagccacctggtggtgaagaagcaccaggccatggaggccatgctgctgtacctggccagccgtgtcggtgacaccaagcatggcatgatgaagttccgtgaggaccgcagcctcctgggcctgggcctgccctcaggtggcttccacgatcgctacttcatcctcaacagcagctgcttgcggctctacaaggaggtccggagccagaggccgtggagcggggcccctgagaccagtcaccggcctgagaaggagtggcctattaagagtctcaaagtctacctgggagtgaagaagaaactcaggccacccacctgctggggcttcacagtggtgcatgagacagagaaacatgagaagcagcagtggtacctctgctgtgacacacagatggagctccgggagtggttcgctacctttctgtttgtgcagcatgacggcctggtgtggccctcagagccctcacgcgtgtcccgggcagtgcctgaggtccggctgggtagtgtgtcactgatcccccttcgaggtagtgaaaatgaaatgcgccggagtgtggctgccttcaccgcggaccctctgtctcttctgcgcaacgtctgagcacaggagcccatccttggctctaggattccgccgctggaagccttctgttcagacaccccttatgctccaaggcctgatgtgagccagcggggggtgcatgggaaactgcaccccacaacccacatcctccatcctgactgcagcatggggttccccggcaggggtgggaggcagcaggggtcagcctgggcaggaacctctcccaactctgtccaggtgttcagacctcttggcccaacctgctcaccccaccgggttcactgtccttgtggggctggagagatgggcataagtcaggaacttgggaggaccaccaccctttcagaggcgtgaggccctggggccctgccggaagggagccccctgctcctcccaacaaactccagaacagcagaaagcgggtgctgtagaggagcactcagctcacggggagggagctcttggctgagcttctacagggctgagagctgcgctttggggacttcagccttccttccagtctgggctgagtggggggtccagactacctgatgccccttccccaatttggggactttttgataatataaatatatctgtatattttacccta

SEQ ID NO: 417425 - DNA, 1030 bp, Homo sapiens
ccagttgcagagggctggtgcaggagcccaggcaaggattacggggctcagtcctgccctgtggggagcaagagtacacggctggattccagagctgccagcaggcctaccccctggggcctgcctgtggcctctcatccctgcctgtcccagtagacactgggggtgggtaagtgctcccgtgaagggggggcccaggtgattctgggtctggccctgtgtctacaggggagcaccgtggcctgggcgctggcgtctccaaggtgcggagcctgaagatggacaggaaggtgtggacagaaacacttatcgaggtggggatgcccctgcttgccaccgatacttggggtctgccccattcaacagctgtctgggtctcccagccccctccctatctcagtgaccacagcaccttggagctggaagagaccctttgtgataatctagtgggtggggatttcggaaaagcaatttttggcaaagtcagcaaactggccagtgagctaagaatgtttttatagttgtaaagtgttatttttttttaaagaaaaaaaaaggaagaaaatgcagcagagactgtatgtgttctgtaaagccgaaaataattactatttcgccctttagagaaagaatttgctaacttctgatctaatttcactgtcatccattgaatagatgtgtaaactgaggtcctgggcagggctgtaatctgcctgagattaccctgtaaatgcatattgaccaccatccctgcctctttccatcccacttctggctgacccagggccttctcccctaccttgcacagcccctcagaggccctcagcctccatttcatgtgaactcacatgtaccagtgggtatatatatgtgtgctgtgtgtgcacacacgtgtacatttatgcccctgtactggaaactcccaggtacccatatgtggtagatataggggagaacctgcaatgggagggtagacccaggctgcagactccagacacttggagtgtcacatccgtttctcacctcccca

SEQ ID NO: 417426 - DNA, 218 bp, Homo sapiens
agaatcgagctggtaccatctcgacaagttgtgcatgcatgccttgtcatatcgtatgtcatatgcctcccgggccaccctcctccctcattctgtccacatgcaggtgttctcccaacccagactccatttgacaccctccaccttctgcacatacatgccatacacacaccccaaccccacacatcactgcacacttgtcgagtcctggctctaga

SEQ ID NO: 417427 - DNA, 4160 bp, Homo sapiens
  misc_feature (49)..(49): n is a, c, g, or t
gccggtctgacctcttatgaggagtctcccctgagatatatgctgtttnccaaaaaaaaaaaaaaaaaaaagagaatgtgctactttgagtctgacttcagtcactcttgctgtaaagtccatcttcttgccagtggccatttgggattcttcctccctagaacctggctgatcctcactctgagtgtggcttctgagggctggggtggtcctggaacctgtcctcctacccccggtcatttgcttgttgtccctctccctctccagatcttacatctatcagaaacgatgggtgagactggatactgatcacctgcgatactttgacagtaacaaggacgcttactctaagcgctttatctctgtggcctgcatctcccacgtggctgccatcggggaccagaagtttgaagtgatcacaaacaaccgaacctttgccttccgggcagagagtgatgtggagcggaaggagtggatgcaggccctgcagcaggccatggctgagcagcgtgcccgggcccggctctctagcgcttatctgctgggagttccaggctcagagcagcctgaccgcgctggcagcctggagcttcgtggcttcaagaataagctgtacgtggccgtggtcggggacaaagtgcagctctacaagaatctagaggagtaccacctgggcattggcatcaccttcatcgacatgagcgtgggcaacgtgaaggaagtggaccggcgcagcttcgacctcaccacgccctaccgcatcttcagcttctctgctgactcagagctagagaaggagcagtggttggaggccatgcagggagccatcgctgaggccctgtctacctcggaggtggccgagcgcatctgggctgcagcccccaacaggttctgtgctgactgcggggctcctcagcctgactgggcctccatcaacctctgtgttgttatctgcaagcgctgtgcaggggagcaccgtggcctgggcgctggcgtctccaaggtgcggagcctgaagatggacaggaaggtgtggacagaaacacttatcgagctcttcttacagctggggaatggcgctgggaaccgcttctgggcagccaacgtgccccccagtgaggccctgcagcccagcagcagccccagcacccggcggtgccacctggaggccaagtaccgtgagggcaagtaccgccgctaccacccgctctttggcaaccaggaggagctggacaaggccctgtgtgctgcagtcaccaccacagacctggctgagacccaggcgctcctgggctgtggggctgggatcaactgcttctcgggggaccctgaggcccccacgcccctggctcttgcagagcaggcggggcagacgctgcagatggaattccttcggaacaaccggaccacagaggtgcctcggctggactcgatgaagcccctggaaaagcactactcagttgtcctgccgaccgtgagccacagtggcttcctctacaagactgcctctgccggcaagctgctacaggaccgccgggcccgggaagagttcagccggcgctggtgtgtccttggtgacggggtcctgagctactttgagaatgagcgggcagtgacccccaatggagagattcgggccagcgagattgtgtgcctggcagtgccccctcctgacacccatggctttgagcacacctttgaggtgtacacggagggagaacggctgtacctgtttgggctggagagtgcggagcaggctcatgagtgggtcaagtgtattgctaaggcattcgtgcctcccctagccgaggatctgctggcccgggattttgagcggctgggacgcctaccctacaaagctggcctgagcctacagcgggcccaggagggctggttctctctcagtggctcggagctccgtgctgtcttcccggaggggccctgcgaagagccgctgcaactacggaaactgcaggagctttccatccagggggacagtgagaaccaggtgctggtgctggtggagcgaaggaggacactgtacatacagggcgagcggcggctggacttcatgggttggctgggggccatccagaaagcagccgccagcatgggggacacgctgtcggagcagcagcttggggactcggatatcccggtgatcgtgtaccgctgtgtggactacatcacgcagtgcggcctgacctccgagggcatctaccgcaagtgtgggcagacatcgaagacacagcggctgctggagagcctgcggcaggatgcgcgctctgtgcacctcaaggagggcgagcagcacgtggatgatgtttcctcggcgctcaagcgcttcctgcgcgacctgcctgatgggctcttcactcgcgcccagcgcctaacctggctggaggcctcagagattgaggacgaggaggagaaggtctccaggtaccgagagctgctggtgcggctgccccctgtcaaccgggccacagtgaaggcccttatcagccacctgtactgtgttcagtgcttctcagacacgaaccagatgaacgtgcacaacctggcaattgtgtttgggcccacgctcttccagacagatgggcaggactacaaggctggccgtgtggtggaagacctcattaaccactatgtggtggtgtttagtgtggatgaggaagagctcaggaagcagcgggaggagatcactgccattgtgaagatgcgcgtggctggcactgccagtgggacccagcatgccggtgacttcatctgcacagtgtatctggaagagaagaaggcagagactgagcagcatatcaaggtcccagcatccatgactgctgaggagctcaccctggagatcctggatcgccggaacgtgggcatcagggagaaggactattggacctgctttgaggtcaacgagagggaggaggcagagcgccccctgcactttgcggagaaggtgctgcccatcctgcacgggctgggcacggacagccacctggtggtgaagaagcaccaggccatggaggccatgctgctgtacctggccagccgtgtcggtgacaccaagcatggcatgatgaagttccgtgaggaccgcagcctcctgggcctgggcctgccctcaggtggcttccacgatcgctacttcatcctcaacagcagctgcttgcggctctacaaggaggtccggagtcaccggcctgagaaggagtggcctattaagagtctcaaagtctacctgggagtgaagaagaaactcaggccacccacctgctggggcttcacagtggtgcatgagacagagaaacatgagaagcagcagtggtacctctgctgtgacacacagatggagctccgggagtggttcgctacctttctgtttgtgcagcatgacggcctggtgtggccctcagagccctcacgcgtgtcccgggcagtgcctgaggtccggctgggtagtgtgtcactgatcccccttcgaggtagtgaaaatgaaatgcgccggagtgtggctgccttcaccgcggaccctctgtctcttctgcgcaacgtctgagcacaggagcccatccttggctctaggattccgccgctggaagccttctgttcagacaccccttatgctccaaggcctgatgtgagccagcggggggtgcatgggaaactgcaccccacaacccacatcctccatcctgactgcagcatggggttccccggcaggggtgggaggcagcaggggtcagcctgggcaggaacctctcccaactctgtccaggtgttcagacctcttggcccaacctgctcaccccaccgggttcactgtccttgtggggctggagagatgggcataagtcaggaacttgggaggaccaccaccctttcagaggcgtgaggccctggggccctgccggaagggagccccctgctcctcccaacaaactccagaacagcagaaagcgggtgctgtagaggagcactcagctcacggggagggagctcttggctgagcttctacagggctgagagctgcgctttggggacttcagccttccttccagtctgggctgagtggggggtccagactacctgatgccccttccccaatttggggactttttgataatataaatatatctgtatattttacccta

SEQ ID NO: 417428 - DNA, 4568 bp, Homo sapiens
  misc_feature (49)..(49): n is a, c, g, or t
gccggtctgacctcttatgaggagtctcccctgagatatatgctgtttnccaaaaaaaaaaaaaaaaaaaagagaatgtgctactttgagtctgacttcagtcactcttgctgtaaagtccatcttcttgccagtggccatttgggattcttcctccctagaacctggctgatcctcactctgagtgtggcttctgagggctggggtggtcctggaacctgtcctcctacccccggtcatttgcttgttgtccctctccctctccagatcttacatctatcagaaacgatgggtgagactggatactgatcacctgcgatactttgacagtaacaaggacgcttactctaagcgctttatctctgtggcctgcatctcccacgtggctgccatcggggaccagaagtttgaagtgatcacaaacaaccgaacctttgccttccgggcagagagtgatgtggagcggaaggagtggatgcaggccctgcagcaggccatggctgagcagcgtgcccgggcccggctctctagcgcttatctgctgggagttccaggctcagagcagcctgaccgcgctggcagcctggagcttcgtggcttcaagaataagctgtacgtggccgtggtcggggacaaagtgcagctctacaagaatctagaggtgctaaggggtcatggaacctctcccctgcccatgtccacctaccctgccccaggctgacctagggccttagccctgccttttctgttccctcttttcctgcactgggcccagccctttgcctggatatgtcctcgctcccccaagttctgaccacttcccccaggctctgagcactgccctccagtccctgccctggcccttgctcccccgcacctctgttcattgctgtgtgggccctgaacctgcagccccttaccctgcccagcctcccatgtcccctgctgtctccctcctgggcaccccccccagtccctgagttgcaccaccttcccttcctctccctgtcccaagcctcacgccctgcccccaaagccttgccctcatcccgtcccatctgccctccaggagtaccacctgggcattggcatcaccttcatcgacatgagcgtgggcaacgtgaaggaagtggaccggcgcagcttcgacctcaccacgccctaccgcatcttcagcttctctgctgactcagagctagagaaggagcagtggttggaggccatgcagggagccatcgctgaggccctgtctacctcggaggtggccgagcgcatctgggctgcagcccccaacaggttctgtgctgactgcggggctcctcagcctgactgggcctccatcaacctctgtgttgttatctgcaagcgctgtgcaggggagcaccgtggcctgggcgctggcgtctccaaggtgcggagcctgaagatggacaggaaggtgtggacagaaacacttatcgagctcttcttacagctggggaatggcgctgggaaccgcttctgggcagccaacgtgccccccagtgaggccctgcagcccagcagcagccccagcacccggcggtgccacctggaggccaagtaccgtgagggcaagtaccgccgctaccacccgctctttggcaaccaggaggagctggacaaggccctgtgtgctgcagtcaccaccacagacctggctgagacccaggcgctcctgggctgtggggctgggatcaactgcttctcgggggaccctgaggcccccacgcccctggctcttgcagagcaggcggggcagacgctgcagatggaattccttcggaacaaccggaccacagaggtgcctcggctggactcgatgaagcccctggaaaagcactactcagttgtcctgccgaccgtgagccacagtggcttcctctacaagactgcctctgccggcaagctgctacaggaccgccgggcccgggaagagttcagccggcgctggtgtgtccttggtgacggggtcctgagctactttgagaatgagcgggcagtgacccccaatggagagattcgggccagcgagattgtgtgcctggcagtgccccctcctgacacccatggctttgagcacacctttgaggtgtacacggagggagaacggctgtacctgtttgggctggagagtgcggagcaggctcatgagtgggtcaagtgtattgctaaggcattcgtgcctcccctagccgaggatctgctggcccgggattttgagcggctgggacgcctaccctacaaagctggcctgagcctacagcgggcccaggagggctggttctctctcagtggctcggagctccgtgctgtcttcccggaggggccctgcgaagagccgctgcaactacggaaactgcaggagctttccatccagggggacagtgagaaccaggtgctggtgctggtggagcgaaggaggacactgtacatacagggcgagcggcggctggacttcatgggttggctgggggccatccagaaagcagccgccagcatgggggacacgctgtcggagcagcagcttggggactcggatatcccggtgatcgtgtaccgctgtgtggactacatcacgcagtgcggcctgacctccgagggcatctaccgcaagtgtgggcagacatcgaagacacagcggctgctggagagcctgcggcaggatgcgcgctctgtgcacctcaaggagggcgagcagcacgtggatgatgtttcctcggcgctcaagcgcttcctgcgcgacctgcctgatgggctcttcactcgcgcccagcgcctaacctggctggaggcctcagagattgaggacgaggaggagaaggtctccaggtaccgagagctgctggtgcggctgccccctgtcaaccgggccacagtgaaggcccttatcagccacctgtactgtgttcagtgcttctcagacacgaaccagatgaacgtgcacaacctggcaattgtgtttgggcccacgctcttccagacagatgggcaggactacaaggctggccgtgtggtggaagacctcattaaccactatgtggtggtgtttagtgtggatgaggaagagctcaggaagcagcgggaggagatcactgccattgtgaagatgcgcgtggctggcactgccagtgggacccagcatgccggtgacttcatctgcacagtgtatctggaagagaagaaggcagagactgagcagcatatcaaggtcccagcatccatgactgctgaggagctcaccctggagatcctggatcgccggaacgtgggcatcagggagaaggactattggacctgctttgaggtcaacgagagggaggaggcagagcgccccctgcactttgcggagaaggtgctgcccatcctgcacgggctgggcacggacagccacctggtggtgaagaagcaccaggccatggaggccatgctgctgtacctggccagccgtgtcggtgacaccaagcatggcatgatgaagttccgtgaggaccgcagcctcctgggcctgggcctgccctcaggtggcttccacgatcgctacttcatcctcaacagcagctgcttgcggctctacaaggaggtccggagtcaccggcctgagaaggagtggcctattaagagtctcaaagtctacctgggagtgaagaagaaactcaggccacccacctgctggggcttcacagtggtgcatgagacagagaaacatgagaagcagcagtggtacctctgctgtgacacacagatggagctccgggagtggttcgctacctttctgtttgtgcagcatgacggcctggtgtggccctcagagccctcacgcgtgtcccgggcagtgcctgaggtccggctgggtagtgtgtcactgatcccccttcgaggtagtgaaaatgaaatgcgccggagtgtggctgccttcaccgcggaccctctgtctcttctgcgcaacgtctgagcacaggagcccatccttggctctaggattccgccgctggaagccttctgttcagacaccccttatgctccaaggcctgatgtgagccagcggggggtgcatgggaaactgcaccccacaacccacatcctccatcctgactgcagcatggggttccccggcaggggtgggaggcagcaggggtcagcctgggcaggaacctctcccaactctgtccaggtgttcagacctcttggcccaacctgctcaccccaccgggttcactgtccttgtggggctggagagatgggcataagtcaggaacttgggaggaccaccaccctttcagaggcgtgaggccctggggccctgccggaagggagccccctgctcctcccaacaaactccagaacagcagaaagcgggtgctgtagaggagcactcagctcacggggagggagctcttggctgagcttctacagggctgagagctgcgctttggggacttcagccttccttccagtctgggctgagtggggggtccagactacctgatgccccttccccaatttggggactttttgataatataaatatatctgtatattttacccta

SEQ ID NO: 417429 - DNA, 4148 bp, Homo sapiens
tgcaaccttgggcttactcctctacccttctcctgcagtggagcggaaggagtggatgcaggccctgcagcaggccatggctgagcagcgtgcccgggcccggctctctagcgcttatctgctgggagttccaggctcagagcagcctgaccgcgctggcagcctggagcttcgtggcttcaagaataagctgtacgtggccgtggtcggggacaaagtgcagctctacaagaatctagaggtgctaaggggtcatggaacctctcccctgcccatgtccacctaccctgccccaggctgacctagggccttagccctgccttttctgttccctcttttcctgcactgggcccagccctttgcctggatatgtcctcgctcccccaagttctgaccacttcccccaggctctgagcactgccctccagtccctgccctggcccttgctcccccgcacctctgttcattgctgtgtgggccctgaacctgcagccccttaccctgcccagcctcccatgtcccctgctgtctccctcctgggcaccccccccagtccctgagttgcaccaccttcccttcctctccctgtcccaagcctcacgccctgcccccaaagccttgccctcatcccgtcccatctgccctccaggagtaccacctgggcattggcatcaccttcatcgacatgagcgtgggcaacgtgaaggaagtggaccggcgcagcttcgacctcaccacgccctaccgcatcttcagcttctctgctgactcagagctagagaaggagcagtggttggaggccatgcagggagccatcgctgaggccctgtctacctcggaggtggccgagcgcatctgggctgcagcccccaacaggttctgtgctgactgcggggctcctcagcctgactgggcctccatcaacctctgtgttgttatctgcaagcgctgtgcaggggagcaccgtggcctgggcgctggcgtctccaaggtgcggagcctgaagatggacaggaaggtgtggacagaaacacttatcgagctcttcttacagctggggaatggcgctgggaaccgcttctgggcagccaacgtgccccccagtgaggccctgcagcccagcagcagccccagcacccggcggtgccacctggaggccaagtaccgtgagggcaagtaccgccgctaccacccgctctttggcaaccaggaggagctggacaaggccctgtgtgctgcagtcaccaccacagacctggctgagacccaggcgctcctgggctgtggggctgggatcaactgcttctcgggggaccctgaggcccccacgcccctggctcttgcagagcaggcggggcagacgctgcagatggaattccttcggaacaaccggaccacagaggtgcctcggctggactcgatgaagcccctggaaaagcactactcagttgtcctgccgaccgtgagccacagtggcttcctctacaagactgcctctgccggcaagctgctacaggaccgccgggcccgggaagagttcagccggcgctggtgtgtccttggtgacggggtcctgagctactttgagaatgagcgggcagtgacccccaatggagagattcgggccagcgagattgtgtgcctggcagtgccccctcctgacacccatggctttgagcacacctttgaggtgtacacggagggagaacggctgtacctgtttgggctggagagtgcggagcaggctcatgagtgggtcaagtgtattgctaaggcattcgtgcctcccctagccgaggatctgctggcccgggattttgagcggctgggacgcctaccctacaaagctggcctgagcctacagcgggcccaggagggctggttctctctcagtggctcggagctccgtgctgtcttcccggaggggccctgcgaagagccgctgcaactacggaaactgcaggagctttccatccagggggacagtgagaaccaggtgctggtgctggtggagcgaaggaggacactgtacatacagggcgagcggcggctggacttcatgggttggctgggggccatccagaaagcagccgccagcatgggggacacgctgtcggagcagcagcttggggactcggatatcccggtgatcgtgtaccgctgtgtggactacatcacgcagtgcggcctgacctccgagggcatctaccgcaagtgtgggcagacatcgaagacacagcggctgctggagagcctgcggcaggatgcgcgctctgtgcacctcaaggagggcgagcagcacgtggatgatgtttcctcggcgctcaagcgcttcctgcgcgacctgcctgatgggctcttcactcgcgcccagcgcctaacctggctggaggcctcagagattgaggacgaggaggagaaggtctccaggtaccgagagctgctggtgcggctgccccctgtcaaccgggccacagtgaaggcccttatcagccacctgtactgtgttcagtgcttctcagacacgaaccagatgaacgtgcacaacctggcaattgtgtttgggcccacgctcttccagacagatgggcaggactacaaggctggccgtgtggtggaagacctcattaaccactatgtggtggtgtttagtgtggatgaggaagagctcaggaagcagcgggaggagatcactgccattgtgaagatgcgcgtggctggcactgccagtgggacccagcatgccggtgacttcatctgcacagtgtatctggaagagaagaaggcagagactgagcagcatatcaaggtcccagcatccatgactgctgaggagctcaccctggagatcctggatcgccggaacgtgggcatcagggagaaggactattggacctgctttgaggtcaacgagagggaggaggcagagcgccccctgcactttgcggagaaggtgctgcccatcctgcacgggctgggcacggacagccacctggtggtgaagaagcaccaggccatggaggccatgctgctgtacctggccagccgtgtcggtgacaccaagcatggcatgatgaagttccgtgaggaccgcagcctcctgggcctgggcctgccctcaggtggcttccacgatcgctacttcatcctcaacagcagctgcttgcggctctacaaggaggtccggagtcaccggcctgagaaggagtggcctattaagagtctcaaagtctacctgggagtgaagaagaaactcaggccacccacctgctggggcttcacagtggtgcatgagacagagaaacatgagaagcagcagtggtacctctgctgtgacacacagatggagctccgggagtggttcgctacctttctgtttgtgcagcatgacggcctggtgtggccctcagagccctcacgcgtgtcccgggcagtgcctgaggtccggctgggtagtgtgtcactgatcccccttcgaggtagtgaaaatgaaatgcgccggagtgtggctgccttcaccgcggaccctctgtctcttctgcgcaacgtctgagcacaggagcccatccttggctctaggattccgccgctggaagccttctgttcagacaccccttatgctccaaggcctgatgtgagccagcggggggtgcatgggaaactgcaccccacaacccacatcctccatcctgactgcagcatggggttccccggcaggggtgggaggcagcaggggtcagcctgggcaggaacctctcccaactctgtccaggtgttcagacctcttggcccaacctgctcaccccaccgggttcactgtccttgtggggctggagagatgggcataagtcaggaacttgggaggaccaccaccctttcagaggcgtgaggccctggggccctgccggaagggagccccctgctcctcccaacaaactccagaacagcagaaagcgggtgctgtagaggagcactcagctcacggggagggagctcttggctgagcttctacagggctgagagctgcgctttggggacttcagccttccttccagtctgggctgagtggggggtccagactacctgatgccccttccccaatttggggactttttgataatataaatatatctgtatattttacccta

SEQ ID NO: 417430 - DNA, 3977 bp, Homo sapiens
  misc_feature (49)..(49): n is a, c, g, or t
gccggtctgacctcttatgaggagtctcccctgagatatatgctgtttnccaaaaaaaaaaaaaaaaaaaagagaatgtgctactttgagtctgacttcagtcactcttgctgtaaagtccatcttcttgccagtggccatttgggattcttcctccctagaacctggctgatcctcactctgagtgtggcttctgagggctggggtggtcctggaacctgtcctcctacccccggtcatttgcttgttgtccctctccctctccagatcttacatctatcagaaacgatgggtgagactggatactgatcacctgcgatactttgacagtaacaaggacgcttactctaagcgctttatctctgtggcctgcatctcccacgtggctgccatcggggaccagaagtttgaagtgatcacaaacaaccgaacctttgccttccgggcagagagtgatgtggagcggaaggagtggatgcaggccctgcagcaggccatggctgagcagcgtgcccgggcccggctctctagcgcttatctgctgggagttccaggctcagagcagcctgaccgcgctggcagcctggagcttcgtggcttcaagaataagctgtacgtggccgtggtcggggacaaagtgcagctctacaagaatctagaggagtaccacctgggcattggcatcaccttcatcgacatgagcgtgggcaacgtgaaggaagtggaccggcgcagcttcgacctcaccacgccctaccgcatcttcagcttctctgctgactcagagctagagaaggagcagtggttggaggccatgcagggagccatcgctgaggccctgtctacctcggaggtggccgagcgcatctgggctgcagcccccaacaggttctgtgctgactgcggggctcctcagcctgactgggcctccatcaacctctgtgttgttatctgcaagcgctgtgcaggggagcaccgtggcctgggcgctggcgtctccaaggtgcggagcctgaagatggacaggaaggtgtggacagaaacacttatcgaggccctgtgtgctgcagtcaccaccacagacctggctgagacccaggcgctcctgggctgtggggctgggatcaactgcttctcgggggaccctgaggcccccacgcccctggctcttgcagagcaggcggggcagacgctgcagatggaattccttcggaacaaccggaccacagaggtgcctcggctggactcgatgaagcccctggaaaagcactactcagttgtcctgccgaccgtgagccacagtggcttcctctacaagactgcctctgccggcaagctgctacaggaccgccgggcccgggaagagttcagccggcgctggtgtgtccttggtgacggggtcctgagctactttgagaatgagcgggcagtgacccccaatggagagattcgggccagcgagattgtgtgcctggcagtgccccctcctgacacccatggctttgagcacacctttgaggtgtacacggagggagaacggctgtacctgtttgggctggagagtgcggagcaggctcatgagtgggtcaagtgtattgctaaggcattcgtgcctcccctagccgaggatctgctggcccgggattttgagcggctgggacgcctaccctacaaagctggcctgagcctacagcgggcccaggagggctggttctctctcagtggctcggagctccgtgctgtcttcccggaggggccctgcgaagagccgctgcaactacggaaactgcaggagctttccatccagggggacagtgagaaccaggtgctggtgctggtggagcgaaggaggacactgtacatacagggcgagcggcggctggacttcatgggttggctgggggccatccagaaagcagccgccagcatgggggacacgctgtcggagcagcagcttggggactcggatatcccggtgatcgtgtaccgctgtgtggactacatcacgcagtgcggcctgacctccgagggcatctaccgcaagtgtgggcagacatcgaagacacagcggctgctggagagcctgcggcaggatgcgcgctctgtgcacctcaaggagggcgagcagcacgtggatgatgtttcctcggcgctcaagcgcttcctgcgcgacctgcctgatgggctcttcactcgcgcccagcgcctaacctggctggaggcctcagagattgaggacgaggaggagaaggtctccaggtaccgagagctgctggtgcggctgccccctgtcaaccgggccacagtgaaggcccttatcagccacctgtactgtgttcagtgcttctcagacacgaaccagatgaacgtgcacaacctggcaattgtgtttgggcccacgctcttccagacagatgggcaggactacaaggctggccgtgtggtggaagacctcattaaccactatgtggtggtgtttagtgtggatgaggaagagctcaggaagcagcgggaggagatcactgccattgtgaagatgcgcgtggctggcactgccagtgggacccagcatgccggtgacttcatctgcacagtgtatctggaagagaagaaggcagagactgagcagcatatcaaggtcccagcatccatgactgctgaggagctcaccctggagatcctggatcgccggaacgtgggcatcagggagaaggactattggacctgctttgaggtcaacgagagggaggaggcagagcgccccctgcactttgcggagaaggtgctgcccatcctgcacgggctgggcacggacagccacctggtggtgaagaagcaccaggccatggaggccatgctgctgtacctggccagccgtgtcggtgacaccaagcatggcatgatgaagttccgtgaggaccgcagcctcctgggcctgggcctgccctcaggtggcttccacgatcgctacttcatcctcaacagcagctgcttgcggctctacaaggaggtccggagtcaccggcctgagaaggagtggcctattaagagtctcaaagtctacctgggagtgaagaagaaactcaggccacccacctgctggggcttcacagtggtgcatgagacagagaaacatgagaagcagcagtggtacctctgctgtgacacacagatggagctccgggagtggttcgctacctttctgtttgtgcagcatgacggcctggtgtggccctcagagccctcacgcgtgtcccgggcagtgcctgaggtccggctgggtagtgtgtcactgatcccccttcgaggtagtgaaaatgaaatgcgccggagtgtggctgccttcaccgcggaccctctgtctcttctgcgcaacgtctgagcacaggagcccatccttggctctaggattccgccgctggaagccttctgttcagacaccccttatgctccaaggcctgatgtgagccagcggggggtgcatgggaaactgcaccccacaacccacatcctccatcctgactgcagcatggggttccccggcaggggtgggaggcagcaggggtcagcctgggcaggaacctctcccaactctgtccaggtgttcagacctcttggcccaacctgctcaccccaccgggttcactgtccttgtggggctggagagatgggcataagtcaggaacttgggaggaccaccaccctttcagaggcgtgaggccctggggccctgccggaagggagccccctgctcctcccaacaaactccagaacagcagaaagcgggtgctgtagaggagcactcagctcacggggagggagctcttggctgagcttctacagggctgagagctgcgctttggggacttcagccttccttccagtctgggctgagtggggggtccagactacctgatgccccttccccaatttggggactttttgataatataaatatatctgtatattttacccta

SEQ ID NO: 417431 - DNA, 2949 bp, Homo sapiens
ctgaggatggactgctccaggcctgggccctgtgtgctgcagtcaccaccacagacctggctgagacccaggcgctcctgggctgtggggctgggatcaactgcttctcgggggaccctgaggcccccacgcccctggctcttgcagagcaggcggggcagacgctgcagatggaattccttcggaacaaccggaccacagaggtgcctcggctggactcgatgaagcccctggaaaagcactactcagttgtcctgccgaccgtgagccacagtggcttcctctacaagactgcctctgccggcaagctgctacaggaccgccgggcccgggaagagttcagccggcgctggtgtgtccttggtgacggggtcctgagctactttgagaatgagcgggcagtgacccccaatggagagattcgggccagcgagattgtgtgcctggcagtgccccctcctgacacccatggctttgagcacacctttgaggtgtacacggagggagaacggctgtacctgtttgggctggagagtgcggagcaggctcatgagtgggtcaagtgtattgctaaggcattcgtgcctcccctagccgaggatctgctggcccgggattttgagcggctgggacgcctaccctacaaagctggcctgagcctacagcgggcccaggagggctggttctctctcagtggctcggagctccgtgctgtcttcccggaggggccctgcgaagagccgctgcaactacggaaactgcaggagctttccatccagggggacagtgagaaccaggtgctggtgctggtggagcgaaggaggacactgtacatacagggcgagcggcggctggacttcatgggttggctgggggccatccagaaagcagccgccagcatgggggacacgctgtcggagcagcagcttggggactcggatatcccggtgatcgtgtaccgctgtgtggactacatcacgcagtgcggcctgacctccgagggcatctaccgcaagtgtgggcagacatcgaagacacagcggctgctggagagcctgcggcaggatgcgcgctctgtgcacctcaaggagggcgagcagcacgtggatgatgtttcctcggcgctcaagcgcttcctgcgcgacctgcctgatgggctcttcactcgcgcccagcgcctaacctggctggaggcctcagagattgaggacgaggaggagaaggtctccaggtaccgagagctgctggtgcggctgccccctgtcaaccgggccacagtgaaggcccttatcagccacctgtactgtgttcagtgcttctcagacacgaaccagatgaacgtgcacaacctggcaattgtgtttgggcccacgctcttccagacagatgggcaggactacaaggctggccgtgtggtggaagacctcattaaccactatgtggtggtgtttagtgtggatgaggaagagctcaggaagcagcgggaggagatcactgccattgtgaagatgcgcgtggctggcactgccagtgggacccagcatgccggtgacttcatctgcacagtgtatctggaagagaagaaggcagagactgagcagcatatcaaggtcccagcatccatgactgctgaggagctcaccctggagatcctggatcgccggaacgtgggcatcagggagaaggactattggacctgctttgaggtcaacgagagggaggaggcagagcgccccctgcactttgcggagaaggtgctgcccatcctgcacgggctgggcacggacagccacctggtggtgaagaagcaccaggccatggaggccatgctgctgtacctggccagccgtgtcggtgacaccaagcatggcatgatgaagttccgtgaggaccgcagcctcctgggcctgggcctgccctcaggtggcttccacgatcgctacttcatcctcaacagcagctgcttgcggctctacaaggaggtccggagtcaccggcctgagaaggagtggcctattaagagtctcaaagtctacctgggagtgaagaagaaactcaggccacccacctgctggggcttcacagtggtgcatgagacagagaaacatgagaagcagcagtggtacctctgctgtgacacacagatggagctccgggagtggttcgctacctttctgtttgtgcagcatgacggcctggtgtggccctcagagccctcacgcgtgtcccgggcagtgcctgaggtccggctgggtagtgtgtcactgatcccccttcgaggtagtgaaaatgaaatgcgccggagtgtggctgccttcaccgcggaccctctgtctcttctgcgcaacgtctgagcacaggagcccatccttggctctaggattccgccgctggaagccttctgttcagacaccccttatgctccaaggcctgatgtgagccagcggggggtgcatgggaaactgcaccccacaacccacatcctccatcctgactgcagcatggggttccccggcaggggtgggaggcagcaggggtcagcctgggcaggaacctctcccaactctgtccaggtgttcagacctcttggcccaacctgctcaccccaccgggttcactgtccttgtggggctggagagatgggcataagtcaggaacttgggaggaccaccaccctttcagaggcgtgaggccctggggccctgccggaagggagccccctgctcctcccaacaaactccagaacagcagaaagcgggtgctgtagaggagcactcagctcacggggagggagctcttggctgagcttctacagggctgagagctgcgctttggggacttcagccttccttccagtctgggctgagtggggggtccagactacctgatgccccttccccaatttggggactttttgataatataaatatatctgtatattttacccta

SEQ ID NO: 417432 - DNA, 2369 bp, Homo sapiens
cacgaggccgtgctgtcttcccggaggggccctgcgaagagccgctgagagagaaccagccctcctgggcccgctgtaggctcaggccagctttgtaggctggttctctctcagtggctcggagctccgtgctgtcttcccggaggggccctgcgaagagccgctgcaactacggaaactgcaggagctttccatccagggggacagtgagaaccaggtgctggtgctggtggagcgaaggaggacactgtacatacagggcgagcggcggctggacttcatgggttggctgggggccatccagaaagcagccgccagcatgggggacacgctgtcggagcagcagcttggggactcggatatcccggtgatcgtgtaccgctgtgtggactacatcacgcagtgcggcctgacctccgagggcatctaccgcaagtgtgggcagacatcgaagacacagcggctgctggagagcctgcggcaggatgcgcgctctgtgcacctcaaggagggcgagcagcacgtggatgatgtttcctcggcgctcaagcgcttcctgcgcgacctgcctgatgggctcttcactcgcgcccagcgcctaacctggctggaggcctcagagattgaggacgaggaggagaaggtctccaggtaccgagagctgctggtgcggctgccccctgtcaaccgggccacagtgaaggcccttatcagccacctgtactgtgttcagtgcttctcagacacgaaccagatgaacgtgcacaacctggcaattgtgtttgggcccacgctcttccagacagatgggcaggactacaaggctggccgtgtggtggaagacctcattaaccactatgtggtggtgtttagtgtggatgaggaagagctcaggaagcagcgggaggagatcactgccattgtgaagatgcgcgtggctggcactgccagtgggacccagcatgccggtgacttcatctgcacagtgtatctggaagagaagaaggcagagactgagcagcatatcaaggtcccagcatccatgactgctgaggagctcaccctggagatcctggatcgccggaacgtgggcatcagggagaaggactattggacctgctttgaggtcaacgagagggaggaggcagagcgccccctgcactttgcggagaaggtgctgcccatcctgcacgggctgggcacggacagccacctggtggtgaagaagcaccaggccatggaggccatgctgctgtacctggccagccgtgtcggtgacaccaagcatggcatgatgaagttccgtgaggaccgcagcctcctgggcctgggcctgccctcaggtggcttccacgatcgctacttcatcctcaacagcagctgcttgcggctctacaaggaggtccggagtcaccggcctgagaaggagtggcctattaagagtctcaaagtctacctgggagtgaagaagaaactcaggccacccacctgctggggcttcacagtggtgcatgagacagagaaacatgagaagcagcagtggtacctctgctgtgacacacagatggagctccgggagtggttcgctacctttctgtttgtgcagcatgacggcctggtgtggccctcagagccctcacgcgtgtcccgggcagtgcctgaggtccggctgggtagtgtgtcactgatcccccttcgaggtagtgaaaatgaaatgcgccggagtgtggctgccttcaccgcggaccctctgtctcttctgcgcaacgtctgagcacaggagcccatccttggctctaggattccgccgctggaagccttctgttcagacaccccttatgctccaaggcctgatgtgagccagcggggggtgcatgggaaactgcaccccacaacccacatcctccatcctgactgcagcatggggttccccggcaggggtgggaggcagcaggggtcagcctgggcaggaacctctcccaactctgtccaggtgttcagacctcttggcccaacctgctcaccccaccgggttcactgtccttgtggggctggagagatgggcataagtcaggaacttgggaggaccaccaccctttcagaggcgtgaggccctggggccctgccggaagggagccccctgctcctcccaacaaactccagaacagcagaaagcgggtgctgtagaggagcactcagctcacggggagggagctcttggctgagcttctacagggctgagagctgcgctttggggacttcagccttccttccagtctgggctgagtggggggtccagactacctgatgccccttccccaatttggggactttttgataatataaatatatctgtatattttacccta

SEQ ID NO: 417433 - DNA, 4249 bp, Homo sapiens
  misc_feature (49)..(49): n is a, c, g, or t
gccggtctgacctcttatgaggagtctcccctgagatatatgctgtttnccaaaaaaaaaaaaaaaaaaaagagaatgtgctactttgagtctgacttcagtcactcttgctgtaaagtccatcttcttgccagtggccatttgggattcttcctccctagaacctggctgatcctcactctgagtgtggcttctgagggctggggtggtcctggaacctgtcctcctacccccggtcatttgcttgttgtccctctccctctccagatcttacatctatcagaaacgatgggtgagactggatactgatcacctgcgatactttgacagtaacaaggacgcttactctaagcgctttatctctgtggcctgcatctcccacgtggctgccatcggggaccagaagtttgaagtgatcacaaacaaccgaacctttgccttccgggcagagagtgatgtggagcggaaggagtggatgcaggccctgcagcaggccatggctgagcagcgtgcccgggcccggctctctagcgcttatctgctgggagttccaggctcagagcagcctgaccgcgctggcagcctggagcttcgtggcttcaagaataagctgtacgtggccgtggtcggggacaaagtgcagctctacaagaatctagaggagtaccacctgggcattggcatcaccttcatcgacatgagcgtgggcaacgtgaaggaagtggaccggcgcagcttcgacctcaccacgccctaccgcatcttcagcttctctgctgactcagagctagagaaggagcagtggttggaggccatgcagggagccatcgctgaggccctgtctacctcggaggtggccgagcgcatctgggctgcagcccccaacaggttctgtgctgactgcggggctcctcagcctgactgggcctccatcaacctctgtgttgttatctgcaagcgctgtgcaggggagcaccgtggcctgggcgctggcgtctccaaggtgcggagcctgaagatggacaggaaggtgtggacagaaacacttatcgagctcttcttacagctggggaatggcgctgggaaccgcttctgggcagccaacgtgccccccagtgaggccctgcagcccagcagcagccccagcacccggcggtgccacctggaggccaagtaccgtgagggcaagtaccgccgctaccacccgctctttggcaaccaggaggagctggacaaggccctgtgtgctgcagtcaccaccacagacctggctgagacccaggcgctcctgggctgtggggctgggatcaactgcttctcgggggaccctgaggcccccacgcccctggctcttgcagagcaggcggggcagacgctgcagatggaattccttcggaacaaccggaccacagaggtgcctcggctggactcgatgaagcccctggaaaagcactactcagttgtcctgccgaccgtgagccacagtggcttcctctacaagactgcctctgccggcaagctgctacaggaccgccgggcccgggaagagttcagccggcgctggtgtgtccttggtgacggggtcctgagctactttgagaatgagcgggcagtgacccccaatggagagattcgggccagcgagattgtgtgcctggcagtgccccctcctgacacccatggctttgagcacacctttgaggtgtacacggagggagaacggctgtacctgtttgggctggagagtgcggagcaggctcatgagtgggtcaagtgtattgctaaggcattcgtgcctcccctagccgaggatctgctggcccgggattttgagcggctgggacgcctaccctacaaagctggcctgagcctacagcgggcccaggagggctggttctctctcagtggctcggagctccgtgctgtcttcccggaggggccctgcgaagagccgctgcaactacggaaactgcaggagctttccatccagggggacagtgagaaccaggtgctggtgctggtggagcgaaggaggacactgtacatacagggcgagcggcggctggacttcatgggttggctgggggccatccagaaagcagccgccagcatgggggacacgctgtcggagcagcagcttggggactcggatatcccggtgatcgtgtaccgctgtgtggactacatcacgcagtgcggcctgacctccgagggcatctaccgcaagtgtgggcagacatcgaagacacagcggctgctggagagcctgcggcaggatgcgcgctctgtgcacctcaaggagggcgagcagcacgtggatgatgtttcctcggcgctcaagcgcttcctgcgcgacctgcctgatgggctcttcactcgcgcccagcgcctaacctggctggaggcctcagagattgaggacgaggaggagaaggtctccaggtaccgagagctgctggtgcggctgccccctgtcaaccgggccacagtgaaggcccttatcagccacctgtactgtgttcagtgcttctcagacacgaaccagatgaacgtgcacaacctggcaattgtgtttgggcccacgctcttccagacagatgggcaggactacaaggctggccgtgtggtggaagacctcattaaccactatgtggtggtgtttagtgtgcgtccctggccagtgggcagtggagggcaggggtgatccttgcagatgacggtgaccacctgtccctgcctctcgccccttcccaggtggatgaggaagagctcaggaagcagcgggaggagatcactgccattgtgaagatgcgcgtggctggcactgccagtgggacccagcatgccggtgacttcatctgcacagtgtatctggaagagaagaaggcagagactgagcagcatatcaaggtcccagcatccatgactgctgaggagctcaccctggagatcctggatcgccggaacgtgggcatcagggagaaggactattggacctgctttgaggtcaacgagagggaggaggcagagcgccccctgcactttgcggagaaggtgctgcccatcctgcacgggctgggcacggacagccacctggtggtgaagaagcaccaggccatggaggccatgctgctgtacctggccagccgtgtcggtgacaccaagcatggcatgatgaagttccgtgaggaccgcagcctcctgggcctgggcctgccctcaggtggcttccacgatcgctacttcatcctcaacagcagctgcttgcggctctacaaggaggtccggagtcaccggcctgagaaggagtggcctattaagagtctcaaagtctacctgggagtgaagaagaaactcaggccacccacctgctggggcttcacagtggtgcatgagacagagaaacatgagaagcagcagtggtacctctgctgtgacacacagatggagctccgggagtggttcgctacctttctgtttgtgcagcatgacggcctggtgtggccctcagagccctcacgcgtgtcccgggcagtgcctgaggtccggctgggtagtgtgtcactgatcccccttcgaggtagtgaaaatgaaatgcgccggagtgtggctgccttcaccgcggaccctctgtctcttctgcgcaacgtctgagcacaggagcccatccttggctctaggattccgccgctggaagccttctgttcagacaccccttatgctccaaggcctgatgtgagccagcggggggtgcatgggaaactgcaccccacaacccacatcctccatcctgactgcagcatggggttccccggcaggggtgggaggcagcaggggtcagcctgggcaggaacctctcccaactctgtccaggtgttcagacctcttggcccaacctgctcaccccaccgggttcactgtccttgtggggctggagagatgggcataagtcaggaacttgggaggaccaccaccctttcagaggcgtgaggccctggggccctgccggaagggagccccctgctcctcccaacaaactccagaacagcagaaagcgggtgctgtagaggagcactcagctcacggggagggagctcttggctgagcttctacagggctgagagctgcgctttggggacttcagccttccttccagtctgggctgagtggggggtccagactacctgatgccccttccccaatttggggactttttgataatataaatatatctgtatattttacccta

SEQ ID NO: 417434 - DNA, 5290 bp, Homo sapiens
  misc_feature (1)..(1): n is a, c, g, or t
ngcctgtcagggtgttgtgggggtgcccagctgcctgtcagaccctgaggactaccagacagagagtgggcagccatttcccgggaggcttccccttcccccacctcactctcttgccatacgggggtcaggagtcacgtgtagccacagcgctctgggccaggggtcggggctctggtgtggctcccccaggccctggctgtatgtgggtgggcatgtggcctccccccaccctgtgtgttaggaactcgtgtcctgtcccggagtgtctgtctctgtttcacttcttgtgttcccgtgtctgtctgtcttgcatccctagcccgcagtctttttctctgtccctttatctttctgtttttgtctgtgtcctaggtcggtttctgccactggctctcctgtccctgtgatctgggtctctgtgtggtctccgctggcagggggaggggagtgtgaggaaacagaactaaaagtgctgggctgtgtgggtcggggctgtgtggacagagggggcgtggcagccccgggtgggtgtgatctgtggcttgaagggaaggatgacgctgagtgggtctcgggggcaggaggagcccccaccgagccgagtcccacgggccgtgcgcgtggccagtctgctgagcgagggagaggaactgtctggggacgaccaaggggatgaggaagaggatgaccacgcctatgagggcgtccccaatggcggatggcataccagcagcctgagcttgtccttgcccagcacaatagctgcgccacaccccatggacgggccgcctgggggctccacccccgtcacaccagtcatcaaggctggctggctggacaagaacccaccgcagggatcttacatctatcagaaacgatgggtgagactggatactgatcacctgcgatactttgacagtaacaaggacgcttactctaagcgctttatctctgtggcctgcatctcccacgtggctgccatcggggaccagaagtttgaagtgatcacaaacaaccgaacctttgccttccgggcagagagtgatgtggagcggaaggagtggatgcaggccctgcagcaggccatggctgagcagcgtgcccgggcccggctctctagcgcttatctgctgggagttccaggctcagagcagcctgaccgcgctggcagcctggagcttcgtggcttcaagaataagctgtacgtggccgtggtcggggacaaagtgcagctctacaagaatctagaggagtaccacctgggcattggcatcaccttcatcgacatgagcgtgggcaacgtgaaggaagtggaccggcgcagcttcgacctcaccacgccctaccgcatcttcagcttctctgctgactcagagctagagaaggagcagtggttggaggccatgcagggagccatcgctgaggccctgtctacctcggaggtggccgagcgcatctgggctgcagcccccaacaggttctgtgctgactgcggggctcctcagcctgactgggcctccatcaacctctgtgttgttatctgcaagcgctgtgcaggggagcaccgtggcctgggcgctggcgtctccaaggtgcggagcctgaagatggacaggaaggtgtggacagaaacacttatcgagctcttcttacagctggggaatggcgctgggaaccgcttctgggcagccaacgtgccccccagtgaggccctgcagcccagcagcagccccagcacccggcggtgccacctggaggccaagtaccgtgagggcaagtaccgccgctaccacccgctctttggcaaccaggaggagctggacaaggccctgtgtgctgcagtcaccaccacagacctggctgagacccaggcgctcctgggctgtggggctgggatcaactgcttctcgggggaccctgaggcccccacgcccctggctcttgcagagcaggcggggcagacgctgcagatggaattccttcggaacaaccggaccacagaggtgcctcggctggactcgatgaagcccctggaaaagcactactcagttgtcctgccgaccgtgagccacagtggcttcctctacaagactgcctctgccggcaagctgctacaggaccgccgggcccgggaagagttcagccggcgctggtgtgtccttggtgacggggtcctgagctactttgagaatgagcgggcagtgacccccaatggagagattcgggccagcgagattgtgtgcctggcagtgccccctcctgacacccatggctttgagcacacctttgaggtgtacacggagggagaacggctgtacctgtttgggctggagagtgcggagcaggctcatgagtgggtcaagtgtattgctaaggcattcgtgcctcccctagccgaggatctgctggcccgggattttgagcggctgggacgcctaccctacaaagctggcctgagcctacagcgggcccaggagggctggttctctctcagtggctcggagctccgtgctgtcttcccggaggggccctgcgaagagccgctgcaactacggaaactgcaggagctttccatccagggggacagtgagaaccaggtgctggtgctggtggagcgaaggaggacactgtacatacagggcgagcggcggctggacttcatgggttggctgggggccatccagaaagcagccgccagcatgggggacacgctgtcggagcagcagcttggggactcggatatcccggtgatcgtgtaccgctgtgtggactacatcacgcagtgcggcctgacctccgagggcatctaccgcaagtgtgggcagacatcgaagacacagcggctgctggagagcctgcggcaggatgcgcgctctgtgcacctcaaggagggcgagcagcacgtggatgatgtttcctcggcgctcaagcgcttcctgcgcgacctgcctgatgggctcttcactcgcgcccagcgcctaacctggctggaggcctcagagattgaggacgaggaggagaaggtctccaggtaccgagagctgctggtgcggctgccccctgtcaaccgggccacagtgaaggcccttatcagccacctgtactgtgttcagtgcttctcagacacgaaccagatgaacgtgcacaacctggcaattgtgtttgggcccacgctcttccagacagatgggcaggactacaaggctggccgtgtggtggaagacctcattaaccactatgtggtggtgtttagtgtggatgaggaagagctcaggaagcagcgggaggagatcactgccattgtgaagatgcgcgtggctggcactgccagtgggacccagcatgccggtgacttcatctgcacagtgtatctggaagagaagaaggcagagactgagcagcatatcaaggtcccagcatccatgactgctgaggagctcaccctggagatcctggatcgccggaacgtgggcatcagggagaaggactattggacctgctttgaggtcaacgagagggaggaggcagagcgccccctgcactttgcggagaaggtgctgcccatcctgcacgggctgggcacggacagccacctggtggtgaagaagcaccaggccatggaggccatgctgctgtacctggccagccgtgtcggtgacaccaagcatggcatgatgaagttccgtgaggaccgcagcctcctgggcctgggcctgccctcaggtggcttccacgatcgctacttcatcctcaacagcagctgcttgcggctctacaaggaggtccggagccagaggccgtggagcggggcccctgagaccagtcaccggcctgagaaggagtggcctattaagagtctcaaagtctacctgggagtgaagaagaaactcaggccacccacctgctggggcttcacagtggtgcatgagacagagaaacatgagaagcagcagtggtacctctgctgtgacacacagatggagctccgggagtggttcgctacctttctgtttgtgcagcatgacggcctggtgtggccctcagagccctcacgcgtgtcccgggcagtgcctgaggtccggctgggtagtgtgtcactgatcccccttcgaggtagtgaaaatgaaatgcgccggagtgtggctgccttcaccgcggaccctctgtctcttctgcgcaacgtctgagcacaggagcccatccttggctctaggattccgccgctggaagccttctgttcagacaccccttatgctccaaggcctgatgtgagccagcggggggtgcatgggaaactgcaccccacaacccacatcctccatcctgactgcagcatggggttccccggcaggggtgggaggcagcaggggtcagcctgggcaggaacctctcccaactctgtccaggtgttcagacctcttggcccaacctgctcaccccaccgggttcactgtccttgtggggctggagagatgggcataagtcaggaacttgggaggaccaccaccctttcagaggcgtgaggccctggggccctgccggaagggagccccctgctcctcccaacaaactccagaacagcagaaagcgggtgctgtagaggagcactcagctcacggggagggagctcttggctgagcttctacagggctgagagctgcgctttggggacttcagccttccttccagtctgggctgagtggggggtccagactacctgatgccccttccccaatttggggactttttgataatataaatatatctgtatattttaccctaaaaaaaaaaaagaacaaaacgaagaaaccaacaaaacaccgcgggcgctcctcttgtccgggcgggggacaacaaagggcggcttggcactcgccccggggcctacacatgggggtttccgcgaccccactttttttgtcccaccggggggacaatccgggggcccccccaaatagggggccggaataaattgcgaaaagcccgggttacctgctttagggtctccggggccaaagtgatacaactaaaggccgaacgaactacgcggagcactgacaggggtgcatcacatctgggaacagaaacacatggttcgagcaaccgtctacgactacagctactcgaaacacaccttaccccgcacgccatacacctgactcgcgaggccgactgcatatcacctcgagtactcacgcgagcaggaagatcactacccatgctagacatcagcgcagccctagagagcgccacggacgaagccataactcacagcacactgcggcca

SEQ ID NO: 417435 - DNA, 2317 bp, Homo sapiens
aaaaaatattactaagcgagcgaggcccgcgtgttaaattaccttcaatagggctgaggcgatcgaggtatatatacatggggccgcggggacgacgaattctatcaaaagtggcacagttgatccaaacgacgtgtactccggtggactcacatggtatgcgtatagtaacagacgatgtgtagcatcatcggcgggctatccgcgtatagttgaggtctcttttagtttgtcgtagtaaggccatgtaaaacatgcaatcgatgcatgggggacacgctgtcggagcagcagcttggggactcggatatcccggtgatcgtgtaccgctgtgtggactacatcacgcagtgcggcctgacctccgagggcatctaccgcaagtgtgggcagacatcgaagacacagcggctgctggagagcctgcggcaggatgcgcgctctgtgcacctcaaggagggcgagcagcacgtggatgatgtttcctcggcgctcaagcgcttcctgcgcgacctgcctgatgggctcttcactcgcgcccagcgcctaacctggctggaggcctcagagattgaggacgaggaggagaaggtctccaggtaccgagagctgctggtgcggctgccccctgtcaaccgggccacagtgaaggcccttatcagccacctgtactgtgttcagtgcttctcagacacgaaccagatgaacgtgcacaacctggcaattgtgtttgggcccacgctcttccagacagatgggcaggactacaaggctggccgtgtggtggaagacctcattaaccactatgtggtggtgtttagtgtggatgaggaagagctcaggaagcagcgggaggagatcactgccattgtgaagatgcgcgtggctggcactgccagtgggacccagcatgccggtgacttcatctgcacagtgtatctggaagagaagaaggcagagactgagcagcatatcaaggtcccagcatccatgactgctgaggagctcaccctggagatcctggatcgccggaacgtgggcatcagggagaaggactattggacctgctttgaggtcaacgagagggaggaggcagagcgccccctgcactttgcggagaaggtgctgcccatcctgcacgggctgggcacggacagccacctggtggtgaagaagcaccaggccatggaggccatgctgctgtacctggccagccgtgtcggtgacaccaagcatggcatgatgaagttccgtgaggaccgcagcctcctgggcctgggcctgccctcaggtggcttccacgatcgctacttcatcctcaacagcagctgcttgcggctctacaaggaggtccggagtcaccggcctgagaaggagtggcctattaagagtctcaaagtctacctgggagtgaagaagaaactcaggccacccacctgctggggcttcacagtggtgcatgagacagagaaacatgagaagcagcagtggtacctctgctgtgacacacagatggagctccgggagtggttcgctacctttctgtttgtgcagcatgacggcctggtgtggccctcagagccctcacgcgtgtcccgggcagtgcctgaggtccggctgggtagtgtgtcactgatcccccttcgaggtagtgaaaatgaaatgcgccggagtgtggctgccttcaccgcggaccctctgtctcttctgcgcaacgtctgagcacaggagcccatccttggctctaggattccgccgctggaagccttctgttcagacaccccttatgctccaaggcctgatgtgagccagcggggggtgcatgggaaactgcaccccacaacccacatcctccatcctgactgcagcatggggttccccggcaggggtgggaggcagcaggggtcagcctgggcaggaacctctcccaactctgtccaggtgttcagacctcttggcccaacctgctcaccccaccgggttcactgtccttgtggggctggagagatgggcataagtcaggaacttgggaggaccaccaccctttcagaggcgtgaggccctggggccctgccggaagggagccccctgctcctcccaacaaactccagaacagcagaaagcgggtgctgtagaggagcactcagctcacggggagggagctcttggctgagcttctacagggctgagagctgcgctttggggacttcagccttccttccagtctgggctgagtggggggtccagactacctgatgccccttccccaatttggggactttttgataatataaatatatctgtatattttacccta

SEQ ID NO: 417436 - DNA, 5102 bp, Homo sapiens
  misc_feature (1)..(1): n is a, c, g, or t
ngcctgtcagggtgttgtgggggtgcccagctgcctgtcagaccctgaggactaccagacagagagtgggcagccatttcccgggaggcttccccttcccccacctcactctcttgccatacgggggtcaggagtcacgtgtagccacagcgctctgggccaggggtcggggctctggtgtggctcccccaggccctggctgtatgtgggtgggcatgtggcctccccccaccctgtgtgttaggaactcgtgtcctgtcccggagtgtctgtctctgtttcacttcttgtgttcccgtgtctgtctgtcttgcatccctagcccgcagtctttttctctgtccctttatctttctgtttttgtctgtgtcctaggtcggtttctgccactggctctcctgtccctgtgatctgggtctctgtgtggtctccgctggcagggggaggggagtgtgaggaaacagaactaaaagtgctgggctgtgtgggtcggggctgtgtggacagagggggcgtggcagccccgggtgggtgtgatctgtggcttgaagggaaggatgacgctgagtgggtctcgggggcaggaggagcccccaccgagccgagtcccacgggccgtgcgcgtggccagtctgctgagcgagggagaggaactgtctggggacgaccaaggggatgaggaagaggatgaccacgcctatgagggcgtccccaatggcggatggcataccagcagcctgagcttgtccttgcccagcacaatagctgcgccacaccccatggacgggccgcctgggggctccacccccgtcacaccagtcatcaaggctggctggctggacaagaacccaccgcagggatcttacatctatcagaaacgatgggtgagactggatactgatcacctgcgatactttgacagtaacaaggacgcttactctaagcgctttatctctgtggcctgcatctcccacgtggctgccatcggggaccagaagtttgaagtgatcacaaacaaccgaacctttgccttccgggcagagagtgatgtggagcggaaggagtggatgcaggccctgcagcaggccatggctgagcagcgtgcccgggcccggctctctagcgcttatctgctgggagttccaggctcagagcagcctgaccgcgctggcagcctggagcttcgtggcttcaagaataagctgtacgtggccgtggtcggggacaaagtgcagctctacaagaatctagaggagtaccacctgggcattggcatcaccttcatcgacatgagcgtgggcaacgtgaaggaagtggaccggcgcagcttcgacctcaccacgccctaccgcatcttcagcttctctgctgactcagagctagagaaggagcagtggttggaggccatgcagggagccatcgctgaggccctgtctacctcggaggtggccgagcgcatctgggctgcagcccccaacaggttctgtgctgactgcggggctcctcagcctgactgggcctccatcaacctctgtgttgttatctgcaagcgctgtgcaggggagcaccgtggcctgggcgctggcgtctccaaggtgcggagcctgaagatggacaggaaggtgtggacagaaacacttatcgagctcttcttacagctggggaatggcgctgggaaccgcttctgggcagccaacgtgccccccagtgaggccctgcagcccagcagcagccccagcacccggcggtgccacctggaggccaagtaccgtgagggcaagtaccgccgctaccacccgctctttggcaaccaggaggagctggacaaggccctgtgtgctgcagtcaccaccacagacctggctgagacccaggcgctcctgggctgtggggctgggatcaactgcttctcgggggaccctgaggcccccacgcccctggctcttgcagagcaggcggggcagacgctgcagatggaattccttcggaacaaccggaccacagaggtgcctcggctggactcgatgaagcccctggaaaagcactactcagttgtcctgccgaccgtgagccacagtggcttcctctacaagactgcctctgccggcaagctgctacaggaccgccgggcccgggaagagttcagccggcgctggtgtgtccttggtgacggggtcctgagctactttgagaatgagcgggcagtgacccccaatggagagattcgggccagcgagattgtgtgcctggcagtgccccctcctgacacccatggctttgagcacacctttgaggtgtacacggagggagaacggctgtacctgtttgggctggagagtgcggagcaggctcatgagtgggtcaagtgtattgctaaggcattcgtgcctcccctagccgaggatctgctggcccgggattttgagcggctgggacgcctaccctacaaagctggcctgagcctacagcgggcccaggagggctggttctctctcagtggctcggagctccgtgctgtcttcccggaggggccctgcgaagagccgctgcaactacggaaactgcaggagctttccatccagggggacagtgagaaccaggtgctggtgctggtggagcgaaggaggacactgtacatacagggcgagcggcggctggacttcatgggttggctgggggccatccagaaagcagccgccagcatgggggacacgctgtcggagcagcagcttggggactcggatatcccggtgatcgtgtaccgctgtgtggactacatcacgcagtgcggcctgacctccgagggcatctaccgcaagtgtgggcagacatcgaagacacagcggctgctggagagcctgcggcaggatgcgcgctctgtgcacctcaaggagggcgagcagcacgtggatgatgtttcctcggcgctcaagcgcttcctgcgcgacctgcctgatgggctcttcactcgcgcccagcgcctaacctggctggaggcctcagagattgaggacgaggaggagaaggtctccaggtaccgagagctgctggtgcggctgccccctgtcaaccgggccacagtgaaggcccttatcagccacctgtactgtgttcagtgcttctcagacacgaaccagatgaacgtgcacaacctggcaattgtgtttgggcccacgctcttccagacagatgggcaggactacaaggctggccgtgtggtggaagacctcattaaccactatgtggtggtgtttagtgtggatgaggaagagctcaggaagcagcgggaggagatcactgccattgtgaagatgcgcgtggctggcactgccagtgggacccagcatgccggtgacttcatctgcacagtgtatctggaagagaagaaggcagagactgagcagcatatcaaggtcccagcatccatgactgctgaggagctcaccctggagatcctggatcgccggaacgtgggcatcagggagaaggactattggacctgctttgaggtcaacgagagggaggaggcagagcgccccctgcactttgcggagaaggtgctgcccatcctgcacgggctgggcacggacagccacctggtggtgaagaagcaccaggccatggaggccatgctgctgtacctggccagccgtgtcggtgacaccaagcatggcatgatgaagttccgtgaggaccgcagcctcctgggcctgggcctgccctcaggtggcttccacgatcgctacttcatcctcaacagcagctgcttgcggctctacaaggaggtccggagccagaggccgtggagcggggcccctgagaccagtcaccggcctgagaaggagtggcctattaagagtctcaaagtctacctgggagtgaagaagaaactcaggccacccacctgctggggcttcacagtggtgcatgagacagagaaacatgagaagcagcagtggtacctctgctgtgacacacagatggagctccgggagtggttcgctacctttctgtttgtgcagcatgacggcctggtgtggccctcagagccctcacgcgtgtcccgggcagtgcctgaggtccggctgggtagtgtgtcactgatcccccttcgaggtagtgaaaatgaaatgcgccggagtgtggctgccttcaccgcggaccctctgtctcttctgcgcaacgtctgagcacaggagcccatccttggctctaggattccgccgctggaagccttctgttcagacaccccttatgctccaaggcctgatgtgagccagcggggggtgcatgggaaactgcaccccacaacccacatcctccatcctgactgcagcatggggttccccggcaggggtgggaggcagcaggggtcagcctgggcaggaacctctcccaactctgtccaggtgttcagacctcttggcccaacctgctcaccccaccgggttcactgtccttgtggggctggagagatgggcataagtcaggaacttgggaggaccaccaccctttcagaggcgtgaggccctggggccctgccggaagggagccccctgctcctcccaacaaactccagaacagcagaaagcgggtgctgtagaggagcactcagctcacggggagggagctcttggctgagcttctacagggctgagagctgcgctttggggacttcagccttccttccagtctgggctgagtggggggtccagactacctgatgccccttccccaatttggggactttttgataatataaatatatctgtatattttaccctaaccacacaaagcaacaaaagagcacaaacaaaaccacacacacgacacaagcacaaggccgcggtacacaagcggaggggaaccgcgggctccactacgcggagacctcccacccaggagggtatccccccagcccccatagagcctacgcgcggaaggcgagatgtcacccagaagagacgaccaccgaggacctatcgaggtcgccaactgatgcagccctatctcccggcggggacgacgagaagaacgacgcgacagcagcgaccagacccgaccgcgagcccaccgcgcacgcagacgggtactacacgtgg

SEQ ID NO: 417437 - DNA, 4345 bp, Homo sapiens
  misc_feature (49)..(49): n is a, c, g, or t
gccggtctgacctcttatgaggagtctcccctgagatatatgctgtttnccaaaaaaaaaaaaaaaaaaaagagaatgtgctactttgagtctgacttcagtcactcttgctgtaaagtccatcttcttgccagtggccatttgggattcttcctccctagaacctggctgatcctcactctgagtgtggcttctgagggctggggtggtcctggaacctgtcctcctacccccggtcatttgcttgttgtccctctccctctccagatcttacatctatcagaaacgatgggtgagactggatactgatcacctgcgatactttgacagtaacaaggacgcttactctaagcgctttatctctgtggcctgcatctcccacgtggctgccatcggggaccagaagtttgaagtgatcacaaacaaccgaacctttgccttccgggcagagagtgatgtggagcggaaggagtggatgcaggccctgcagcaggccatggctgagcagcgtgcccgggcccggctctctagcgcttatctgctgggagttccaggctcagagcagcctgaccgcgctggcagcctggagcttcgtggcttcaagaataagctgtacgtggccgtggtcggggacaaagtgcagctctacaagaatctagaggagtaccacctgggcattggcatcaccttcatcgacatgagcgtgggcaacgtgaaggaagtggaccggcgcagcttcgacctcaccacgccctaccgcatcttcagcttctctgctgactcagagctagagaaggagcagtggttggaggccatgcagggagccatcgctgaggccctgtctacctcggaggtggccgagcgcatctgggctgcagcccccaacaggttctgtgctgactgcggggctcctcagcctgactgggcctccatcaacctctgtgttgttatctgcaagcgctgtgcaggggagcaccgtggcctgggcgctggcgtctccaaggtgcggagcctgaagatggacaggaaggtgtggacagaaacacttatcgagctcttcttacagctggggaatggcgctgggaaccgcttctgggcagccaacgtgccccccagtgaggccctgcagcccagcagcagccccagcacccggcggtgccacctggaggccaagtaccgtgagggcaagtaccgccgctaccacccgctctttggcaaccaggaggagctggacaaggccctgtgtgctgcagtcaccaccacagacctggctgagacccaggcgctcctgggctgtggggctgggatcaactgcttctcgggggaccctgaggcccccacgcccctggctcttgcagagcaggcggggcagacgctgcagatggaattccttcggaacaaccggaccacagaggtgcctcggctggactcgatgaagcccctggaaaagcactactcagttgtcctgccgaccgtgagccacagtggcttcctctacaagactgcctctgccggcaagctgctacaggaccgccgggcccgggaagagttcagccggcgctggtgtgtccttggtgacggggtcctgagctactttgagaatgagcgggcagtgacccccaatggagagattcgggccagcgagattgtgtgcctggcagtgccccctcctgacacccatggctttgagcacacctttgaggtgtacacggagggagaacggctgtacctgtttgggctggagagtgcggagcaggctcatgagtgggtcaagtgtattgctaaggcattcgtgcctcccctagccgaggatctgctggcccgggattttgagcggctgggacgcctaccctacaaagctggcctgagcctacagcgggcccaggagggctggttctctctcagtggctcggagctccgtgctgtcttcccggaggggccctgcgaagagccgctgcaactacggaaactgcaggagctttccatccagggggacagtgagaaccaggtgctggtgctggtggagcgaaggaggacactgtacatacagggcgagcggcggctggacttcatgggttggctgggggccatccagaaagcagccgccagcatgggggacacgctgtcggagcagcagcttggggactcggatatcccggtgatcgtgtaccgctgtgtggactacatcacgcagtgcggcctgacctccgagggcatctaccgcaagtgtgggcagacatcgaagacacagcggctgctggagagcctgcggcaggatgcgcgctctgtgcacctcaaggagggcgagcagcacgtggatgatgtttcctcggcgctcaagcgcttcctgcgcgacctgcctgatgggctcttcactcgcgcccagcgcctaacctggctggaggcctcagagattgaggacgaggaggagaaggtctccaggtaccgagagctgctggtgcggctgccccctgtcaaccgggccacagtgaaggcccttatcagccacctgtactgtgttcagtgcttctcagacacgaaccagatgaacgtgcacaacctggcaattgtgtttgggcccacgctcttccagacagatgggcaggactacaaggctggccgtgtggtggaagacctcattaaccactatgtggtggtgtttagtgtggatgaggaagagctcaggaagcagcgggaggagatcactgccattgtgaagatgcgcgtggctggcactgccagtgggacccagcatgccggtgacttcatctgcacagtgtatctggaagagaagaaggcagagactgagcagcatatcaaggtcccagcatccatgactgctgaggagctcaccctggagatcctggatcgccggaacgtgggcatcagggagaaggactattggacctgctttgaggtcaacgagagggaggaggcagagcgccccctgcactttgcggagaaggtgctgcccatcctgcacgggctgggcacggacagccacctggtggtgaagaagcaccaggccatggaggccatgctgctgtacctggccagccgtgtcggtgacaccaagcatggcatgatgaagttccgtgaggaccgcagcctcctgggcctgggcctgccctcaggtggcttccacgatcgctacttcatcctcaacagcagctgcttgcggctctacaaggaggtccggagtcaccggcctgagaaggagtggcctattaagagtctcaaagtctacctgggagtgaagaagaaactcaggccacccacctgctggggcttcacagtggtgcatgagacagagaaacatgagaagcagcagtggtgagtgagcgcctcatcctgagatcccaggctgaggaaagatggtggcacgtcccccttcattgtgtccctcatcactgcccagatctgtgaccactagcagaccctgggctgggaaggcagacacggtgttccctgctcagtcaggcctttggcatcatgtgggtccgcgtccaaccctgcaggtacctctgctgtgacacacagatggagctccgggagtggttcgctacctttctgtttgtgcagcatgacggcctggtgtggccctcagagccctcacgcgtgtcccgggcagtgcctgaggtccggctgggtagtgtgtcactgatcccccttcgaggtagtgaaaatgaaatgcgccggagtgtggctgccttcaccgcggaccctctgtctcttctgcgcaacgtctgagcacaggagcccatccttggctctaggattccgccgctggaagccttctgttcagacaccccttatgctccaaggcctgatgtgagccagcggggggtgcatgggaaactgcaccccacaacccacatcctccatcctgactgcagcatggggttccccggcaggggtgggaggcagcaggggtcagcctgggcaggaacctctcccaactctgtccaggtgttcagacctcttggcccaacctgctcaccccaccgggttcactgtccttgtggggctggagagatgggcataagtcaggaacttgggaggaccaccaccctttcagaggcgtgaggccctggggccctgccggaagggagccccctgctcctcccaacaaactccagaacagcagaaagcgggtgctgtagaggagcactcagctcacggggagggagctcttggctgagcttctacagggctgagagctgcgctttggggacttcagccttccttccagtctgggctgagtggggggtccagactacctgatgccccttccccaatttggggactttttgataatataaatatatctgtatattttacccta

SEQ ID NO: 417438 - DNA, 1832 bp, Homo sapiens
ccgtacccctttcaacatctcatttctctgggtggggtaatagttacagggggtttctgacttgatttatctttcccacccagagattgaggacgaggaggagaaggtctccaggtaccgagagctgctggtgcggctgccccctgtcaaccgggccacagtgaaggcccttatcagccacctgtactgtgttcagtgcttctcagacacgaaccagatgaacgtgcacaacctggcaattgtgtttgggcccacgctcttccagacagatgggcaggactacaaggctggccgtgtggtggaagacctcattaaccactatgtggtggtgtttagtgtggatgaggaagagctcaggaagcagcgggaggagatcactgccattgtgaagatgcgcgtggctggcactgccagtgggacccagcatgccggtgacttcatctgcacagtgtatctggaagagaagaaggcagagactgagcagcatatcaaggtcccagcatccatgactgctgaggagctcaccctggagatcctggatcgccggaacgtgggcatcagggagaaggactattggacctgctttgaggtcaacgagagggaggaggcagagcgccccctgcactttgcggagaaggtgctgcccatcctgcacgggctgggcacggacagccacctggtggtgaagaagcaccaggccatggaggccatgctgctgtacctggccagccgtgtcggtgacaccaagcatggcatgatgaagttccgtgaggaccgcagcctcctgggcctgggcctgccctcaggtggcttccacgatcgctacttcatcctcaacagcagctgcttgcggctctacaaggaggtccggagtcaccggcctgagaaggagtggcctattaagagtctcaaagtctacctgggagtgaagaagaaactcaggccacccacctgctggggcttcacagtggtgcatgagacagagaaacatgagaagcagcagtggtacctctgctgtgacacacagatggagctccgggagtggttcgctacctttctgtttgtgcagcatgacggcctggtgtggccctcagagccctcacgcgtgtcccgggcagtgcctgaggtccggctgggtagtgtgtcactgatcccccttcgaggtagtgaaaatgaaatgcgccggagtgtggctgccttcaccgcggaccctctgtctcttctgcgcaacgtctgagcacaggagcccatccttggctctaggattccgccgctggaagccttctgttcagacaccccttatgctccaaggcctgatgtgagccagcggggggtgcatgggaaactgcaccccacaacccacatcctccatcctgactgcagcatggggttccccggcaggggtgggaggcagcaggggtcagcctgggcaggaacctctcccaactctgtccaggtgttcagacctcttggcccaacctgctcaccccaccgggttcactgtccttgtggggctggagagatgggcataagtcaggaacttgggaggaccaccaccctttcagaggcgtgaggccctggggccctgccggaagggagccccctgctcctcccaacaaactccagaacagcagaaagcgggtgctgtagaggagcactcagctcacggggagggagctcttggctgagcttctacagggctgagagctgcgctttggggacttcagccttccttccagtctgggctgagtggggggtccagactacctgatgccccttccccaatttggggactttttgataatataaatatatctgtatattttacccta

SEQ ID NO: 417439 - DNA, 4614 bp, Homo sapiens
  misc_feature (1)..(1): n is a, c, g, or t
ngcctgtcagggtgttgtgggggtgcccagctgcctgtcagaccctgaggactaccagacagagagtgggcagccatttcccgggaggcttccccttcccccacctcactctcttgccatacgggggtcaggagtcacgtgtagccacagcgctctgggccaggggtcggggctctggtgtggctcccccaggccctggctgtatgtgggtgggcatgtggcctccccccaccctgtgtgttaggaactcgtgtcctgtcccggagtgtctgtctctgtttcacttcttgtgttcccgtgtctgtctgtcttgcatccctagcccgcagtctttttctctgtccctttatctttctgtttttgtctgtgtcctaggtcggtttctgccactggctctcctgtccctgtgatctgggtctctgtgtggtctccgctggcagggggaggggagtgtgaggaaacagaactaaaagtgctgggctgtgtgggtcggggctgtgtggacagagggggcgtggcagccccgggtgggtgtgatctgtggcttgaagggaaggatgacgctgagtgggtctcgggggcaggaggagcccccaccgagccgagtcccacgggccgtgcgcgtggccagtctgctgagcgagggagaggaactgtctggggacgaccaaggggatgaggaagaggatgaccacgcctatgagggcgtccccaatggcggatggcataccagcagcctgagcttgtccttgcccagcacaatagctgcgccacaccccatggacgggccgcctgggggctccacccccgtcacaccagtcatcaaggctggctggctggacaagaacccaccgcagggatcttacatctatcagaaacgatgggtgagactggatactgatcacctgcgatactttgacagtaacaaggacgcttactctaagcgctttatctctgtggcctgcatctcccacgtggctgccatcggggaccagaagtttgaagtgatcacaaacaaccgaacctttgccttccgggcagagagtgatgtggagcggaaggagtggatgcaggccctgcagcaggccatggctgagcagcgtgcccgggcccggctctctagcgcttatctgctgggagttccaggctcagagcagcctgaccgcgctggcagcctggagcttcgtggcttcaagaataagctgtacgtggccgtggtcggggacaaagtgcagctctacaagaatctagaggagtaccacctgggcattggcatcaccttcatcgacatgagcgtgggcaacgtgaaggaagtggaccggcgcagcttcgacctcaccacgccctaccgcatcttcagcttctctgctgactcagagctagagaaggagcagtggttggaggccatgcagggagccatcgctgaggccctgtctacctcggaggtggccgagcgcatctgggctgcagcccccaacaggttctgtgctgactgcggggctcctcagcctgactgggcctccatcaacctctgtgttgttatctgcaagcgctgtgcaggggagcaccgtggcctgggcgctggcgtctccaaggtgcggagcctgaagatggacaggaaggtgtggacagaaacacttatcgagctcttcttacagctggggaatggcgctgggaaccgcttctgggcagccaacgtgccccccagtgaggccctgcagcccagcagcagccccagcacccggcggtgccacctggaggccaagtaccgtgagggcaagtaccgccgctaccacccgctctttggcaaccaggaggagctggacaaggccctgtgtgctgcagtcaccaccacagacctggctgagacccaggcgctcctgggctgtggggctgggatcaactgcttctcgggggaccctgaggcccccacgcccctggctcttgcagagcaggcggggcagacgctgcagatggaattccttcggaacaaccggaccacagaggtgcctcggctggactcgatgaagcccctggaaaagcactactcagttgtcctgccgaccgtgagccacagtggcttcctctacaagactgcctctgccggcaagctgctacaggaccgccgggcccgggaagagttcagccggcgctggtgtgtccttggtgacggggtcctgagctactttgagaatgagcgggcagtgacccccaatggagagattcgggccagcgagattgtgtgcctggcagtgccccctcctgacacccatggctttgagcacacctttgaggtgtacacggagggagaacggctgtacctgtttgggctggagagtgcggagcaggctcatgagtgggtcaagtgtattgctaaggcattcgtgcctcccctagccgaggatctgctggcccgggattttgagcggctgggacgcctaccctacaaagctggcctgagcctacagcgggcccaggagggctggttctctctcagtggctcggagctccgtgctgtcttcccggaggggccctgcgaagagccgctgcaactacggaaactgcaggagctttccatccagggggacagtgagaaccaggtgctggtgctggtggagcgaaggaggacactgtacatacagggcgagcggcggctggacttcatgggttggctgggggccatccagaaagcagccgccagcatgggggacacgctgtcggagcagcagcttggggactcggatatcccggtgatcgtgtaccgctgtgtggactacatcacgcagtgcggcctgacctccgagggcatctaccgcaagtgtgggcagacatcgaagacacagcggctgctggagagcctgcggcaggatgcgcgctctgtgcacctcaaggagggcgagcagcacgtggatgatgtttcctcggcgctcaagcgcttcctgcgcgacctgcctgatgggctcttcactcgcgcccagcgcctaacctggctggaggcctcagagattgaggacgaggaggagaaggtctccaggtaccgagagctgctggtgcggctgccccctgtcaaccgggccacagtgaaggcccttatcagccacctgtactgtgttcagtgcttctcagacacgaaccagatgaacgtgcacaacctggcaattgtgtttgggcccacgctcttccagacagatgggcaggactacaaggctggccgtgtggtggaagacctcattaaccactatgtggtggtgtttagtgtggatgaggaagagctcaggaagcagcgggaggagatcactgccattgtgaagatgcgcgtggctggcactgccagtgggacccagcatgccggtgacttcatctgcacagtgtatctggaagagaagaaggcagagactgagcagcatatcaaggtcccagcatccatgactgctgaggagctcaccctggagatcctggatcgccggaacgtgggcatcagggagaaggactattggacctgctttgaggtcaacgagagggaggaggcagagcgccccctgcactttgcggagaaggtgctgcccatcctgcacgggctgggcacggacagccacctggtggtgaagaagcaccaggccatggaggccatgctgctgtacctggccagccgtgtcggtgacaccaagcatggcatgatgaagttccgtgaggaccgcagcctcctgggcctgggcctgccctcaggtggcttccacgatcgctacttcatcctcaacagcagctgcttgcggctctacaaggaggtccggagccagaggccgtggagcggggcccctgagaccagtcaccggcctgagaaggagtggcctattaagagtctcaaagtctacctgggagtgaagaagaaactcaggccacccacctgctggggcttcacagtggtgcatgagacagagaaacatgagaagcagcagtggtacctctgctgtgacacacagatggagctccgggagtggttcgctacctttctgtttgtgcagcatgacggcctggtgtggccctcagagccctcacgcgtgtcccgggcagtgcctgaggtccggctgggtagtgtgtcactgatcccccttcgaggtagtgaaaatgaaatgcgccggagtgtggctgccttcaccgcggaccctctgtctcttctgcgcaacgtctgagcacaggagcccatccttggctctaggattccgccgctggaagccttctgttcagacaccccttatgctccaaggcctgatgtgagccagcggggggtgcatgggaaactgcaccccacaacccacatcctccatcctgactgcagcatggggttccccggcaggggtgggaggcagcaggggtcagcctgggcaggaacctctcccaactctgtccaggtgttcagacctcttggcccaacctgctcaccccaccgggttcactgtccttgtggggctggagagatgggcataagtcaggaacttgggaggaccaccaccctttcagaggcgtgaggccctggggccctgccggaagggagccccctgctcctcccaacaaactccagcacccgctttctgctgttctggagtttgttggtcg

SEQ ID NO: 417440 - DNA, 4107 bp, Homo sapiens
  misc_feature (49)..(49): n is a, c, g, or t
gccggtctgacctcttatgaggagtctcccctgagatatatgctgtttnccaaaaaaaaaaaaaaaaaaaagagaatgtgctactttgagtctgacttcagtcactcttgctgtaaagtccatcttcttgccagtggccatttgggattcttcctccctagaacctggctgatcctcactctgagtgtggcttctgagggctggggtggtcctggaacctgtcctcctacccccggtcatttgcttgttgtccctctccctctccagatcttacatctatcagaaacgatgggtgagactggatactgatcacctgcgatactttgacagtaacaaggacgcttactctaagcgctttatctctgtggcctgcatctcccacgtggctgccatcggggaccagaagtttgaagtgatcacaaacaaccgaacctttgccttccgggcagagagtgatgtggagcggaaggagtggatgcaggccctgcagcaggccatggctgagcagcgtgcccgggcccggctctctagcgcttatctgctgggagttccaggctcagagcagcctgaccgcgctggcagcctggagcttcgtggcttcaagaataagctgtacgtggccgtggtcggggacaaagtgcagctctacaagaatctagaggagtaccacctgggcattggcatcaccttcatcgacatgagcgtgggcaacgtgaaggaagtggaccggcgcagcttcgacctcaccacgccctaccgcatcttcagcttctctgctgactcagagctagagaaggagcagtggttggaggccatgcagggagccatcgctgaggccctgtctacctcggaggtggccgagcgcatctgggctgcagcccccaacaggttctgtgctgactgcggggctcctcagcctgactgggcctccatcaacctctgtgttgttatctgcaagcgctgtgcaggggagcaccgtggcctgggcgctggcgtctccaaggtgcggagcctgaagatggacaggaaggtgtggacagaaacacttatcgagctcttcttacagctggggaatggcgctgggaaccgcttctgggcagccaacgtgccccccagtgaggccctgcagcccagcagcagccccagcacccggcggtgccacctggaggccaagtaccgtgagggcaagtaccgccgctaccacccgctctttggcaaccaggaggagctggacaaggccctgtgtgctgcagtcaccaccacagacctggctgagacccaggcgctcctgggctgtggggctgggatcaactgcttctcgggggaccctgaggcccccacgcccctggctcttgcagagcaggcggggcagacgctgcagatggaattccttcggaacaaccggaccacagaggtgcctcggctggactcgatgaagcccctggaaaagcactactcagttgtcctgccgaccgtgagccacagtggcttcctctacaagactgcctctgccggcaagctgctacaggaccgccgggcccgggaagagttcagccggcgctggtgtgtccttggtgacggggtcctgagctactttgagaatgagcgggcagtgacccccaatggagagattcgggccagcgagattgtgtgcctggcagtgccccctcctgacacccatggctttgagcacacctttgaggtgtacacggagggagaacggctgtacctgtttgggctggagagtgcggagcaggctcatgagtgggtcaagtgtattgctaaggcattcgtgcctcccctagccgaggatctgctggcccgggattttgagcggctgggacgcctaccctacaaagctggcctgagcctacagcgggcccaggagggctggttctctctcagtggctcggagctccgtgctgtcttcccggaggggccctgcgaagagccgctgcaactacggaaactgcaggagctttccatccagggggacagtgagaaccaggtgctggtgctggtggagcgaaggaggacactgtacatacagggcgagcggcggctggacttcatgggttggctgggggccatccagaaagcagccgccagcatgggggacacgctgtcggagcagcagcttggggactcggatatcccggtgatcgtgtaccgctgtgtggactacatcacgcagtgcggcctgacctccgagggcatctaccgcaagtgtgggcagacatcgaagacacagcggctgctggagagcctgcggcaggatgcgcgctctgtgcacctcaaggagggcgagcagcacgtggatgatgtttcctcggcgctcaagcgcttcctgcgcgacctgcctgatgggctcttcactcgcgcccagcgcctaacctggctggaggcctcagagattgaggacgaggaggagaaggtctccaggtaccgagagctgctggtgcggctgccccctgtcaaccgggccacagtgaaggcccttatcagccacctgtactgtgttcagtgcttctcagacacgaaccagatgaacgtgcacaacctggcaattgtgtttgggcccacgctcttccagacagatgggcaggactacaaggctggccgtgtggtggaagacctcattaaccactatgtggtggtgtttagtgtggatgaggaagagctcaggaagcagcgggaggagatcactgccattgtgaagatgcgcgtggctggcactgccagtgggacccagcatgccggtgacttcatctgcacagtgtatctggaagagaagaaggcagagactgagcagcatatcaaggtcccagcatccatgactgctgaggagctcaccctggagatcctggatcgccggaacgtgggcatcagggagaaggactattggacctgctttgaggtcaacgagagggaggaggcagagcgccccctgcactttgcggagaaggtgctgcccatcctgcacgggctgggcacggacagccacctggtggtgaagaagcaccaggccatggaggccatgctgctgtacctggccagccgtgtcggtgacaccaagcatggcatgatgaagttccgtgaggaccgcagcctcctgggcctgggcctgccctcaggtggcttccacgatcgctacttcatcctcaacagcagctgcttgcggctctacaaggaggtccggagtcaccggcctgagaaggagtggcctattaagagtctcaaagtctacctgggagtgaagaagaaactcaggccacccacctgctggggcttcacagtggtgcatgagacagagaaacatgagaagcagcagtggtacctctgctgtgacacacagatggagctccgggagtggttcgctacctttctgtttgtgcagcatgacggcctggtgtggccctcagagccctcacgcgtgtcccgggcagtgcctgaggtccggctgggtagtgtgtcactgatcccccttcgaggtacttctgcgcaacgtctgagcacaggagcccatccttggctctaggattccgccgctggaagccttctgttcagacaccccttatgctccaaggcctgatgtgagccagcggggggtgcatgggaaactgcaccccacaacccacatcctccatcctgactgcagcatggggttccccggcaggggtgggaggcagcaggggtcagcctgggcaggaacctctcccaactctgtccaggtgttcagacctcttggcccaacctgctcaccccaccgggttcactgtccttgtggggctggagagatgggcataagtcaggaacttgggaggaccaccaccctttcagaggcgtgaggccctggggccctgccggaagggagccccctgctcctcccaacaaactccagaacagcagaaagcgggtgctgtagaggagcactcagctcacggggagggagctcttggctgagcttctacagggctgagagctgcgctttggggacttcagccttccttccagtctgggctgagtggggggtccagactacctgatgccccttccccaatttggggactttttgataatataaatatatctgtatattttacccta

SEQ ID NO: 417441 - DNA, 1635 bp, Homo sapiens
aactctacaggacttaagttacagcgtcaggcaccctggcaattgtgtttgggcccacgctcttccagacagatgggcaggactacaaggctggccgtgtggtggaagacctcattaaccactatgtggtggtgtttagtgtggatgaggaagagctcaggaagcagcgggaggagatcactgccattgtgaagatgcgcgtggctggcactgccagtgggacccagcatgccggtgacttcatctgcacagtgtatctggaagagaagaaggcagagactgagcagcatatcaaggtcccagcatccatgactgctgaggagctcaccctggagatcctggatcgccggaacgtgggcatcagggagaaggactattggacctgctttgaggtcaacgagagggaggaggcagagcgccccctgcactttgcggagaaggtgctgcccatcctgcacgggctgggcacggacagccacctggtggtgaagaagcaccaggccatggaggccatgctgctgtacctggccagccgtgtcggtgacaccaagcatggcatgatgaagttccgtgaggaccgcagcctcctgggcctgggcctgccctcaggtggcttccacgatcgctacttcatcctcaacagcagctgcttgcggctctacaaggaggtccggagtcaccggcctgagaaggagtggcctattaagagtctcaaagtctacctgggagtgaagaagaaactcaggccacccacctgctggggcttcacagtggtgcatgagacagagaaacatgagaagcagcagtggtacctctgctgtgacacacagatggagctccgggagtggttcgctacctttctgtttgtgcagcatgacggcctggtgtggccctcagagccctcacgcgtgtcccgggcagtgcctgaggtccggctgggtagtgtgtcactgatcccccttcgaggtagtgaaaatgaaatgcgccggagtgtggctgccttcaccgcggaccctctgtctcttctgcgcaacgtctgagcacaggagcccatccttggctctaggattccgccgctggaagccttctgttcagacaccccttatgctccaaggcctgatgtgagccagcggggggtgcatgggaaactgcaccccacaacccacatcctccatcctgactgcagcatggggttccccggcaggggtgggaggcagcaggggtcagcctgggcaggaacctctcccaactctgtccaggtgttcagacctcttggcccaacctgctcaccccaccgggttcactgtccttgtggggctggagagatgggcataagtcaggaacttgggaggaccaccaccctttcagaggcgtgaggccctggggccctgccggaagggagccccctgctcctcccaacaaactccagaacagcagaaagcgggtgctgtagaggagcactcagctcacggggagggagctcttggctgagcttctacagggctgagagctgcgctttggggacttcagccttccttccagtctgggctgagtggggggtccagactacctgatgccccttccccaatttggggactttttgataatataaatatatctgtatattttacccta

SEQ ID NO: 417442 - DNA, 1753 bp, Homo sapiens
ttgacctccaaccagcctcttccttgggggtcattgcccccatccctctgcctccgagccagcctgctccttccaagcccagacccatatgcagaggcgggggccagaggtgaacattttggcaatctggtgtccctccccagtacattggtctctcgcttcctgacctagaccattgggaagttcttcctgtggtctgttgaacagctgttctgcttcagcttgagtcattagcctccttgtggaaccaaagagctagtaactgctggtccctcaagccttctgttcacacggtcaaccctggagcctccatggggcagagagggctgagaaatgaataatctgagatgaacatagacacaggcagccaaccgaggctctctgatcacacccgctcgttccagtttggtgctgggggaggatgtacagttctccctccacatacaatctgattcagggtgatacttcaagtcctccagtttgcagggcatcagggtggtgctgggattcgctgttacagatgtcccagttgggacggctgcctcggagactgagggttgactgtctgatactgctgcagggagacaggccttgggggcctagggctgggaggttggttgggctagattgtgaacagggagggctttatcaggaaggcttcttggaggaggcgccctgtgctgggatgcaaagagggctggggagttggaagagggagctgcccagtcgggagagcggccccagtgccctttctgcagactaaagtgccctcttctccttgccctacctcagagtcaccggcctgagaaggagtggcctattaagagtctcaaagtctacctgggagtgaagaagaaactcaggccacccacctgctggggcttcacagtggtgcatgagacagagaaacatgagaagcagcagtggtacctctgctgtgacacacagatggagctccgggagtggttcgctacctttctgtttgtgcagcatgacggcctggtgtggccctcagagccctcacgcgtgtcccgggcagtgcctgaggtccggctgggtagtgtgtcactgatcccccttcgaggtagtgaaaatgaaatgcgccggagtgtggctgccttcaccgcggaccctctgtctcttctgcgcaacgtctgagcacaggagcccatccttggctctaggattccgccgctggaagccttctgttcagacaccccttatgctccaaggcctgatgtgagccagcggggggtgcatgggaaactgcaccccacaacccacatcctccatcctgactgcagcatggggttccccggcaggggtgggaggcagcaggggtcagcctgggcaggaacctctcccaactctgtccaggtgttcagacctcttggcccaacctgctcaccccaccgggttcactgtccttgtggggctggagagatgggcataagtcaggaacttgggaggaccaccaccctttcagaggcgtgaggccctggggccctgccggaagggagccccctgctcctcccaacaaactccagaacagcagaaagcgggtgctgtagaggagcactcagctcacggggagggagctcttggctgagcttctacagggctgagagctgcgctttggggacttcagccttccttccagtctgggctgagtggggggtccagactacctgatgccccttccccaatttggggactttttgataatataaatatatctgtatattttacccta

SEQ ID NO: 417443 - DNA, 1634 bp, Homo sapiens
cacgctgcatctgcagtgactctagagatcccggtacagcttcctgacctagaccattgggaagttcttcctgtggtctgttgaacagctgttctgcttcagcttgagtcattagcctccttgtggaaccaaagagctagtaactgctggtccctcaagccttctgttcacacggtcaaccctggagcctccatggggcagagagggctgagaaatgaataatctgagatgaacatagacacaggcagccaaccgaggctctctgatcacacccgctcgttccagtttggtgctgggggaggatgtacagttctccctccacatacaatctgattcagggtgatacttcaagtcctccagtttgcagggcatcagggtggtgctgggattcgctgttacagatgtcccagttgggacggctgcctcggagactgagggttgactgtctgatactgctgcagggagacaggccttgggggcctagggctgggaggttggttgggctagattgtgaacagggagggctttatcaggaaggcttcttggaggaggcgccctgtgctgggatgcaaagagggctggggagttggaagagggagctgcccagtcgggagagcggccccagtgccctttctgcagactaaagtgccctcttctccttgccctacctcagagtcaccggcctgagaaggagtggcctattaagagtctcaaagtctacctgggagtgaagaagaaactcaggccacccacctgctggggcttcacagtggtgcatgagacagagaaacatgagaagcagcagtggtacctctgctgtgacacacagatggagctccgggagtggttcgctacctttctgtttgtgcagcatgacggcctggtgtggccctcagagccctcacgcgtgtcccgggcagtgcctgaggtccggctgggtagtgtgtcactgatcccccttcgaggtagtgaaaatgaaatgcgccggagtgtggctgccttcaccgcggaccctctgtctcttctgcgcaacgtctgagcacaggagcccatccttggctctaggattccgccgctggaagccttctgttcagacaccccttatgctccaaggcctgatgtgagccagcggggggtgcatgggaaactgcaccccacaacccacatcctccatcctgactgcagcatggggttccccggcaggggtgggaggcagcaggggtcagcctgggcaggaacctctcccaactctgtccaggtgttcagacctcttggcccaacctgctcaccccaccgggttcactgtccttgtggggctggagagatgggcataagtcaggaacttgggaggaccaccaccctttcagaggcgtgaggccctggggccctgccggaagggagccccctgctcctcccaacaaactccagaacagcagaaagcgggtgctgtagaggagcactcagctcacggggagggagctcttggctgagcttctacagggctgagagctgcgctttggggacttcagccttccttccagtctgggctgagtggggggtccagactacctgatgccccttccccaatttggggactttttgataatataaatatatctgtatattttacccta

SEQ ID NO: 417444 - DNA, 3330 bp, Homo sapiens
  misc_feature (49)..(49): n is a, c, g, or t
gccggtctgacctcttatgaggagtctcccctgagatatatgctgtttnccaaaaaaaaaaaaaaaaaaaagagaatgtgctactttgagtctgacttcagtcactcttgctgtaaagtccatcttcttgccagtggccatttgggattcttcctccctagaacctggctgatcctcactctgagtgtggcttctgagggctggggtggtcctggaacctgtcctcctacccccggtcatttgcttgttgtccctctccctctccagatcttacatctatcagaaacgatgggtgagactggatactgatcacctgcgatactttgacagtaacaaggacgcttactctaagcgctttatctctgtggcctgcatctcccacgtggctgccatcggggaccagaagtttgaagtgatcacaaacaaccgaacctttgccttccgggcagagagtgatgtggagcggaaggagtggatgcaggccctgcagcaggccatggctgagcagcgtgcccgggcccggctctctagcgcttatctgctgggagttccaggctcagagcagcctgaccgcgctggcagcctggagcttcgtggcttcaagaataagctgtacgtggccgtggtcggggacaaagtgcagctctacaagaatctagaggagtaccacctgggcattggcatcaccttcatcgacatgagcgtgggcaacgtgaaggaagtggaccggcgcagcttcgacctcaccacgccctaccgcatcttcagcttctctgctgactcagagctagagaaggagcagtggttggaggccatgcagggagccatcgctgaggccctgtctacctcggaggtggccgagcgcatctgggctgcagcccccaacaggttctgtgctgactgcggggctcctcagcctgactgggcctccatcaacctctgtgttgttatctgcaagcgctgtgcaggggagcaccgtggcctgggcgctggcgtctccaaggtgcggagcctgaagatggacaggaaggtgtggacagaaacacttatcgagctcttcttacagctggggaatggcgctgggaaccgcttctgggcagccaacgtgccccccagtgaggccctgcagcccagcagcagccccagcacccggcggtgccacctggaggccaagtaccgtgagggcaagtaccgccgctaccacccgctctttggcaaccaggaggagctggacaaggccctgtgtgctgcagtcaccaccacagacctggctgagacccaggcgctcctgggctgtggggctgggatcaactgcttctcgggggaccctgaggcccccacgcccctggctcttgcagagcaggcggggcagacgctgcagatggaattccttcggaacaaccggaccacagaggtgcctcggctggactcgatgaagcccctggaaaagcactactcagttgtcctgccgaccgtgagccacagtggcttcctctacaagactgcctctgccggcaagctgctacaggaccgccgggcccgggaagagttcagccggcgctggtgtgtccttggtgacggggtcctgagctactttgagaatgagcgggcagtgacccccaatggagagattcgggccagcgagattgtgtgcctggcagtgccccctcctgacacccatggctttgagcacacctttgaggtgtacacggagggagaacggctgtacctgtttgggctggagagtgcggagcaggctcatgagtgggtcaagtgtattgctaaggcattcgtgcctcccctagccgaggatctgctggcccgggattttgagcggctgggacgcctaccctacaaagctggcctgagcctacagcgggcccaggagggctggttctctctcagtggctcggagctccgtgctgtcttcccggaggggccctgcgaagagccgctgcaactacggaaactgcaggagctttccatccagggggacagtgagaaccaggtgctggtgctggtggagcgaaggaggacactgtacatacagggcgagcggcggctggacttcatgggttggctgggggccatccagaaagcagccgccagcatgggggacacgctgtcggagcagcagcttggggactcggatatcccggtgatcgtgtaccgctgtgtggactacatcacgcagtgcggcctgacctccgagggcatctaccgcaagtgtgggcagacatcgaagacacagcggctgctggagagcctgcggcaggatgcgcgctctgtgcacctcaaggagggcgagcagcacgtggatgatgtttcctcggcgctcaagcgcttcctgcgcgacctgcctgatgggctcttcactcgcgcccagcgcctaacctggctggaggcctcagagattgaggacgaggaggagaaggtctccaggtaccgagagctgctggtgcggctgccccctgtcaaccgggccacagtgaaggcccttatcagccacctgtactgtgttcagtgcttctcagacacgaaccagatgaacgtgcacaacctggcaattgtgtttgggcccacgctcttccagacagatgggcaggactacaaggctggccgtgtggtggaagacctcattaaccactatgtggtggtgtttagtgtggatgaggaagagctcaggaagcagcgggaggagatcactgccattgtgaagatgcgcgtggctggcactgccagtgggacccagcatgccggtgacttcatctgcacagtgtatctggaagagaagaaggcagagactgagcagcatatcaaggtcccagcatccatgactgctgaggagctcaccctggagatcctggatcgccggaacgtgggcatcagggagaaggactattggacctgctttgaggtcaacgagagggaggaggcagagcgccccctgcactttgcggagaaggtgctgcccatcctgctcaccccaccgggttcactgtccttgtggggctggagagatgggcataagtcaggaacttgggaggaccaccaccctttcagaggcgtgaggccctggggccctgccggaagggagccccctgctcctcccaacaaactccagaacagcagaaagcgggtgctgtagaggagcactcagctcacggggagggagctcttggctgagcttctacagggctgagagctgcgctttggggacttcagccttccttccagtctgggctgagtggggggtccagactacctgatgccccttccccaatttggggactttttgataatataaatatatctgtatattttacccta

SEQ ID NO: 417445 - DNA, 3601 bp, Homo sapiens
  misc_feature (49)..(49): n is a, c, g, or t
gccggtctgacctcttatgaggagtctcccctgagatatatgctgtttnccaaaaaaaaaaaaaaaaaaaagagaatgtgctactttgagtctgacttcagtcactcttgctgtaaagtccatcttcttgccagtggccatttgggattcttcctccctagaacctggctgatcctcactctgagtgtggcttctgagggctggggtggtcctggaacctgtcctcctacccccggtcatttgcttgttgtccctctccctctccagatcttacatctatcagaaacgatgggtgagactggatactgatcacctgcgatactttgacagtaacaaggacgcttactctaagcgctttatctctgtggcctgcatctcccacgtggctgccatcggggaccagaagtttgaagtgatcacaaacaaccgaacctttgccttccgggcagagagtgatgtggagcggaaggagtggatgcaggccctgcagcaggccatggctgagcagcgtgcccgggcccggctctctagcgcttatctgctgggagttccaggctcagagcagcctgaccgcgctggcagcctggagcttcgtggcttcaagaataagctgtacgtggccgtggtcggggacaaagtgcagctctacaagaatctagaggagtaccacctgggcattggcatcaccttcatcgacatgagcgtgggcaacgtgaaggaagtggaccggcgcagcttcgacctcaccacgccctaccgcatcttcagcttctctgctgactcagagctagagaaggagcagtggttggaggccatgcagggagccatcgctgaggccctgtctacctcggaggtggccgagcgcatctgggctgcagcccccaacaggttctgtgctgactgcggggctcctcagcctgactgggcctccatcaacctctgtgttgttatctgcaagcgctgtgcaggggagcaccgtggcctgggcgctggcgtctccaaggtgcggagcctgaagatggacaggaaggtgtggacagaaacacttatcgagctcttcttacagctggggaatggcgctgggaaccgcttctgggcagccaacgtgccccccagtgaggccctgcagcccagcagcagccccagcacccggcggtgccacctggaggccaagtaccgtgagggcaagtaccgccgctaccacccgctctttggcaaccaggaggagctggacaaggccctgtgtgctgcagtcaccaccacagacctggctgagacccaggcgctcctgggctgtggggctgggatcaactgcttctcgggggaccctgaggcccccacgcccctggctcttgcagagcaggcggggcagacgctgcagatggaattccttcggaacaaccggaccacagaggtgcctcggctggactcgatgaagcccctggaaaagcactactcagttgtcctgccgaccgtgagccacagtggcttcctctacaagactgcctctgccggcaagctgctacaggaccgccgggcccgggaagagttcagccggcgctggtgtgtccttggtgacggggtcctgagctactttgagaatgagcgggcagtgacccccaatggagagattcgggccagcgagattgtgtgcctggcagtgccccctcctgacacccatggctttgagcacacctttgaggtgtacacggagggagaacggctgtacctgtttgggctggagagtgcggagcaggctcatgagtgggtcaagtgtattgctaaggcattcgtgcctcccctagccgaggatctgctggcccgggattttgagcggctgggacgcctaccctacaaagctggcctgagcctacagcgggcccaggagggctggttctctctcagtggctcggagctccgtgctgtcttcccggaggggccctgcgaagagccgctgcaactacggaaactgcaggagctttccatccagggggacagtgagaaccaggtgctggtgctggtggagcgaaggaggacactgtacatacagggcgagcggcggctggacttcatgggttggctgggggccatccagaaagcagccgccagcatgggggacacgctgtcggagcagcagcttggggactcggatatcccggtgatcgtgtaccgctgtgtggactacatcacgcagtgcggcctgacctccgagggcatctaccgcaagtgtgggcagacatcgaagacacagcggctgctggagagcctgcggcaggatgcgcgctctgtgcacctcaaggagggcgagcagcacgtggatgatgtttcctcggcgctcaagcgcttcctgcgcgacctgcctgatgggctcttcactcgcgcccagcgcctaacctggctggaggcctcagagattgaggacgaggaggagaaggtctccaggtaccgagagctgctggtgcggctgccccctgtcaaccgggccacagtgaaggcccttatcagccacctgtactgtgttcagtgcttctcagacacgaaccagatgaacgtgcacaacctggcaattgtgtttgggcccacgctcttccagacagatgggcaggactacaaggctggccgtgtggtggaagacctcattaaccactatgtggtggtgtttagtgtggatgaggaagagctcaggaagcagcgggaggagatcactgccattgtgaagatgcgcgtggctggcactgccagtgggacccagcatgccggtgacttcatctgcacagtgtatctggaagagaagaaggcagagactgagcagcatatcaaggtcccagcatccatgactgctgaggagctcaccctggagatcctggatcgccggaacgtgggcatcagggagaaggactattggacctgctttgaggtcaacgagagggaggaggcagagcgccccctgcactttgcggagaaggtgctgcccatcctgcacgggctgggcacggacagccacctggtggtgaagaagcaccaggccatggaggccatgctgctgtacctggccagccgtgtcggtgacaccaagcatggcatgatgaagttccgtgaggaccgcagcctcctgggcctgggcctgccctcaggtggcttccacgatcgctacttcatcctcaacagcagctgcttgcggctctacaaggaggtccgggctctcaggatggcacagcagtgggggagaactgtagactctcaagacccctcctgctgtggccctggacggccactctagtgtgccctgtagccccactaagccctggcacccggatgccatcacaccactccatgcccatgctctgtctcactgtgcctgtgccttatcactgcatccacaggaacctgttacttgatgacagccccaagttgtgcatgcatgccttgtcatatcgtatgtcatatgcctcccgggccaccctcctccctcattctgtccacatgcaggtgttctcccaacccagactccatttgacaccctccaccttctgcacatacatgccatacacacaccccaaccccacacatcactgcacacttgtcgagtcctggctctaga

SEQ ID NO: 417446 - DNA, 3171 bp, Homo sapiens
  misc_feature (49)..(49): n is a, c, g, or t
gccggtctgacctcttatgaggagtctcccctgagatatatgctgtttnccaaaaaaaaaaaaaaaaaaaagagaatgtgctactttgagtctgacttcagtcactcttgctgtaaagtccatcttcttgccagtggccatttgggattcttcctccctagaacctggctgatcctcactctgagtgtggcttctgagggctggggtggtcctggaacctgtcctcctacccccggtcatttgcttgttgtccctctccctctccagatcttacatctatcagaaacgatgggtgagactggatactgatcacctgcgatactttgacagtaacaaggacgcttactctaagcgctttatctctgtggcctgcatctcccacgtggctgccatcggggaccagaagtttgaagtgatcacaaacaaccgaacctttgccttccgggcagagagtgatgtggagcggaaggagtggatgcaggccctgcagcaggccatggctgagcagcgtgcccgggcccggctctctagcgcttatctgctgggagttccaggctcagagcagcctgaccgcgctggcagcctggagcttcgtggcttcaagaataagctgtacgtggccgtggtcggggacaaagtgcagctctacaagaatctagaggagtaccacctgggcattggcatcaccttcatcgacatgagcgtgggcaacgtgaaggaagtggaccggcgcagcttcgacctcaccacgccctaccgcatcttcagcttctctgctgactcagagctagagaaggagcagtggttggaggccatgcagggagccatcgctgaggccctgtctacctcggaggtggccgagcgcatctgggctgcagcccccaacaggttctgtgctgactgcggggctcctcagcctgactgggcctccatcaacctctgtgttgttatctgcaagcgctgtgcaggggagcaccgtggcctgggcgctggcgtctccaaggtgcggagcctgaagatggacaggaaggtgtggacagaaacacttatcgagctcttcttacagctggggaatggcgctgggaaccgcttctgggcagccaacgtgccccccagtgaggccctgcagcccagcagcagccccagcacccggcggtgccacctggaggccaagtaccgtgagggcaagtaccgccgctaccacccgctctttggcaaccaggaggagctggacaaggccctgtgtgctgcagtcaccaccacagacctggctgagacccaggcgctcctgggctgtggggctgggatcaactgcttctcgggggaccctgaggcccccacgcccctggctcttgcagagcaggcggggcagacgctgcagatggaattccttcggaacaaccggaccacagaggtgcctcggctggactcgatgaagcccctggaaaagcactactcagttgtcctgccgaccgtgagccacagtggcttcctctacaagactgcctctgccggcaagctgctacaggaccgccgggcccgggaagagttcagccggcgctggtgtgtccttggtgacggggtcctgagctactttgagaatgagcgggcagtgacccccaatggagagattcgggccagcgagattgtgtgcctggcagtgccccctcctgacacccatggctttgagcacacctttgaggtgtacacggagggagaacggctgtacctgtttgggctggagagtgcggagcaggctcatgagtgggtcaagtgtattgctaaggcattcgtgcctcccctagccgaggatctgctggcccgggattttgagcggctgggacgcctaccctacaaagctggcctgagcctacagcgggcccaggagggctggttctctctcagtggctcggagctccgtgctgtcttcccggaggggccctgcgaagagccgctgcaactacggaaactgcaggagctttccatccagggggacagtgagaaccaggtgctggtgctggtggagcgaaggaggacactgtacatacagggcgagcggcggctggacttcatgggttggctgggggccatccagaaagcagccgccagcatgggggacacgctgtcggagcagcagcttggggactcggatatcccggtgatcgtgtaccgctgtgtggactacatcacgcagtgcggcctgacctccgagggcatctaccgcaagtgtgggcagacatcgaagacacagcggctgctggagagcctgcggcaggatgcgcgctctgtgcacctcaaggagggcgagcagcacgtggatgatgtttcctcggcgctcaagcgcttcctgcgcgacctgcctgatgggctcttcactcgcgcccagcgcctaacctggctggaggcctcagagattgaggacgaggaggagaaggtctccaggtaccgagagctgctggtgcggctgccccctgtcaaccgggccacagtgaaggcccttatcagccacctgtactgtgttcagtgcttctcagacacgaaccagatgaacgtgcacaacctggcaattgtgtttgggcccacgctcttccagacagatgggcaggactacaaggctggccgtgtggtggaagacctcattaaccactatgtggtggtgtttagtgtggatgaggaagagctcaggaagcagcgggaggagatcactgccattgtgaagatgcgcgtggctggcactgccagtgggacccagcatgccggtgacttcatctgcacagtgtatctggaagagaagaaggcagagactgagcagcatatcaaggtcccagcatccatgactgctgaggagctcaccctggagatcctggatcgccggaacgtgggcatcagggagaaggactattggacctgctttgaggtcaacgagagggaggaggcaggtgggtgacgctgggcttgtgcagggtgtggtatggcttgtcttgtctcagctgtagccccagtctgtcctcccctaccctgcacatgaggatgggtggtgaaaagggctttgatgacatgttgctgtcacactgatctctgtgatggtggtgatagggtgctggcagggattgaggttatggctgtcatgtggctgatagaagatgtcagtgacagtggtgatggttgagg

SEQ ID NO: 417447 - DNA, 1770 bp, Homo sapiens
  misc_feature (49)..(49): n is a, c, g, or t
gccggtctgacctcttatgaggagtctcccctgagatatatgctgtttnccaaaaaaaaaaaaaaaaaaaagagaatgtgctactttgagtctgacttcagtcactcttgctgtaaagtccatcttcttgccagtggccatttgggattcttcctccctagaacctggctgatcctcactctgagtgtggcttctgagggctggggtggtcctggaacctgtcctcctacccccggtcatttgcttgttgtccctctccctctccagatcttacatctatcagaaacgatgggtgagactggatactgatcacctgcgatactttgacagtaacaaggacgcttactctaagcgctttatctctgtggcctgcatctcccacgtggctgccatcggggaccagaagtttgaagtgatcacaaacaaccgaacctttgccttccgggcagagagtgatgtggagcggaaggagtggatgcaggccctgcagcaggccatggctgagcagcgtgcccgggcccggctctctagcgcttatctgctgggagttccaggctcagagcagcctgaccgcgctggcagcctggagcttcgtggcttcaagaataagctgtacgtggccgtggtcggggacaaagtgcagctctacaagaatctagaggagtaccacctgggcattggcatcaccttcatcgacatgagcgtgggcaacgtgaaggaagtggaccggcgcagcttcgacctcaccacgccctaccgcatcttcagcttctctgctgactcagagctagagaaggagcagtggttggaggccatgcagggagccatcgctgaggccctgtctacctcggaggtggccgagcgcatctgggctgcagcccccaacaggttctgtgctgactgcggggctcctcagcctgactgggcctccatcaacctctgtgttgttatctgcaagcgctgtgcaggggagcaccgtggcctgggcgctggcgtctccaaggtgcggagcctgaagatggacaggaaggtgtggacagaaacacttatcgaggtggggatgcccctgcttgccaccgatacttggggtctgccccattcaacagctgtctgggtctcccagccccctccctatctcagtgaccacagcaccttggagctggaagagaccctttgtgataatctagtgggtggggatttcggaaaagcaatttttggcaaagtcagcaaactggccagtgagctaagaatgtttttatagttgtaaagtgttatttttttttaaagaaaaaaaaaggaagaaaatgcagcagagactgtatgtgttctgtaaagccgaaaataattactatttcgccctttagagaaagaatttgctaacttctgatctaatttcactgtcatccattgaatagatgtgtaaactgaggtcctgggcagggctgtaatctgcctgagattaccctgtaaatgcatattgaccaccatccctgcctctttccatcccacttctggctgacccagggccttctcccctaccttgcacagcccctcagaggccctcagcctccatttcatgtgaactcacatgtaccagtgggtatatatatgtgtgctgtgtgtgcacacacgtgtacatttatgcccctgtactggaaactcccaggtacccatatgtggtagatataggggagaacctgcaatgggagggtagacccaggctgcagactccagacacttggagtgtcacatccgtttctcacctcccca

SEQ ID NO: 417448 - DNA, 1386 bp, Homo sapiens
  misc_feature (49)..(49): n is a, c, g, or t
  misc_feature (1244)..(1244): n is a, c, g, or t
  misc_feature (1272)..(1272): n is a, c, g, or t
gccggtctgacctcttatgaggagtctcccctgagatatatgctgtttnccaaaaaaaaaaaaaaaaaaaagagaatgtgctactttgagtctgacttcagtcactcttgctgtaaagtccatcttcttgccagtggccatttgggattcttcctccctagaacctggctgatcctcactctgagtgtggcttctgagggctggggtggtcctggaacctgtcctcctacccccggtcatttgcttgttgtccctctccctctccagatcttacatctatcagaaacgatgggtgagactggatactgatcacctgcgatactttgacagtaacaaggacgcttactctaagcgctttatctctgtggcctgcatctcccacgtggctgccatcggggaccagaagtttgaagtgatcacaaacaaccgaacctttgccttccgggcagagagtgatgtggagcggaaggagtggatgcaggccctgcagcaggccatggctgagcagcgtgcccgggcccggctctctagcgcttatctgctgggagttccaggctcagagcagcctgaccgcgctggcagcctggagcttcgtggcttcaagaataagctgtacgtggccgtggtcggggacaaagtgcagctctacaagaatctagaggagtaccacctgggcattggcatcaccttcatcgacatgagcgtgggcaacgtgaaggaagtggaccggcgcagcttcgacctcaccacgccctaccgcatcttcagcttctctgctgactcagagctagagaaggagcagtggttggaggccatgcagggagccatcgctgaggccctgtctacctcggaggtggccgagcgcatctgggctgcagcccccaacaggttctgtgctgactgcggggctcctcagcctgactgggcctccatcaacctctgtgttgttatctgcaagcgctgtgcaggggagcaccgtggcctgggcgctggcgtctccaaggtgcggagcctgaagatggacaggaaggtgtggacagaaacacttatcgagctcttcttacagctggggaatggcgctgggaaccgcttctgggcagccaacgtgccccccagtgaggccctgcagcccagcagcagccccagcacccggcggtgccacctggaggccaagtaccgtgagggcaagtaccgccgctaccacccgctctttggcaaccaggaggagctggacaagccctgtntgctgccctcagtcatcatgggtctctntcccatcttgggcaaagacaacaccatcgagcaccttttgcccctcttcctggctcagctgaaggatgagtgccctgaggtacggctgaacatcatctcttaacctggactgtt

SEQ ID NO: 417449 - DNA, 836 bp, Homo sapiens
  misc_feature (49)..(49): n is a, c, g, or t
gccggtctgacctcttatgaggagtctcccctgagatatatgctgtttnccaaaaaaaaaaaaaaaaaaaagagaatgtgctactttgagtctgacttcagtcactcttgctgtaaagtccatcttcttgccagtggccatttgggattcttcctccctagaacctggctgatcctcactctgagtgtggcttctgagggctggggtggtcctggaacctgtcctcctacccccggtcatttgcttgttgtccctctccctctccagatcttacatctatcagaaacgatgggtgagactggatactgatcacctgcgatactttgacagtaacaaggacgcttactctaagcgctttatctctgtggcctgcatctcccacgtggctgccatcggggaccagaagtttgaagtgatcacaaacaaccgaacctttgccttccgggcagagagtgatggtggggagtgtggggtgttgtgtgtgtgtgtagaagagggtagagaagactggaagtttgggcagaggagggggaagagagtcatggtgcatctgccctctcacatcacatccggggaggcatgctgcctttgtgaggtgggcagaggaagggggcaccctctgtgaccggctctgtgcttggcacggtcactgactcctcagaaccacacaatcagcgggagcaggcttggaggggtgaggtcacttgcccagcatcagtggcatagctgggattggagcctgagctcgttcaagtcagagaagtcaagcaaaatgatgggggcatctgagtgggctttctggaggaggtgttgcatgaggagcctagggccaggag

SEQ ID NO: 417450 - DNA, 204 bp, Homo sapiens
cagagatgcagtcatgttctccccacagctgcttctcatatcggcggggatcaaagctgagggtgtcatctcagaccacagctggaggcatttctgggaagggtgggcagatctgaggctgagtgtctgggtgaactgaagctgagcccagccccttcctctctgctccccagcatgacggcctggtgtggccctcagagccct

SEQ ID NO: 417451 - DNA, 307 bp, Homo sapiens
cagcctcctcctcctccacccatccctccggactcctgcgcccttcccttgtggcacttgcactaggcttaccctaacccacaggctccagttgcctgcctctgcttctcattcccatcgccgctccatacagagccaggggccctggaagaccgagagttccttaccctggttgaatgcctggcctgcattgacttggagggcacagggactgctgtcacccaccatgagaggcacagcagcccaggcggggtggggggaagatagttacagggggtttctgacttgatttatctttcccacccag

SEQ ID NO: 417452 - DNA, 332 bp, Homo sapiens
ttgtgtttgggcccacgctcttccagacagatgggcaggactacaaggctggccgtgtggtggaagacctcattaaccactatgtggtggtgtttagtgtgcgtccctggccagtgggcagtggagggcaggggtgatccttgcagatgacggtgaccacctgtccctgcctctcgccccttcccaggtggatgaggaagagctcaggaagcagcgggaggagatcactgccattgtgaagatgcgcgtggctggcactgccagtgggacccaggtgaaggctggagcctgggtggggggcttggacctgccacctgcacccatttcctagg

SEQ ID NO: 417453 - DNA, 443 bp, Homo sapiens
gtcccagcatccatgactgctgaggagctcaccctggagatcctggatcgccggaacgtgggcatcagggagaaggactattggacctgctttgaggtcaacgagagggaggaggcaggtgggtgacgctgggcttgtgcagggtgtggtatggcttgtcttgtctcagctgtagccccagtctgtcctcccctaccctgcacatgaggatgggtggtgaaaagggctttgatgacatgttgctgtcacactgatctctgtgatggtggtgatagggtgctggcagggattgaggttatggctgtcatgtggctgatagaagatgtcagtgacagtggtgatggttgaggtgagaaatgtattttatggtaaaggtggtcttgatggcagtggaggatgaggctgtatctgttcatttgttttactatatttgttgagtgcca

SEQ ID NO: 417454 - DNA, 1160 bp, Homo sapiens
agccccgggtaggggttggtgcagcctgtgcccactccagtcccaccccccagccagccgtgtcggtgacaccaagcatggcatgatgaagttccgtgaggaccgcagcctcctgggcctgggcctgccctcaggtggcttccacgatcgctacttcatcctcaacagcagctgcttgcggctctacaaggaggtccggagtcaccggcctgagaaggagtggcctattaagagtctcaaagtctacctgggagtgaagaagaaactcaggccacccacctgctggggcttcacagtggtgcatgagacagagaaacatgagaagcagcagtggtacctctgctgtgacacacagatggagctccgggagtggttcgctacctttctgtttgtgcagcatgacggcctggtgtggccctcagagccctcacgcgtgtcccgggcagtgcctgaggtccggctgggtagtgtgtcactgatcccccttcgaggtagtgaaaatgaaatgcgccggagtgtggctgccttcaccgcggaccctctgtctcttctgcgcaacgtctgagcacaggagcccatccttggctctaggattccgccgctggaagccttctgttcagacaccccttatgctccaaggcctgatgtgagccagcggggggtgcatgggaaactgcaccccacaacccacatcctccatcctgactgcagcatggggttccccggcaggggtgggaggcagcaggggtcagcctgggcaggaacctctcccaactctgtccaggtgttcagacctcttggcccaacctgctcaccccaccgggttcactgtccttgtggggctggagagatgggcataagtcaggaacttgggaggaccaccaccctttcagaggcgtgaggccctggggccctgccggaagggagccccctgctcctcccaacaaactccagaacagcagaaagcgggtgctgtagaggagcactcagctcacggggagggagctcttggctgagcttctacagggctgagagctgcgctttggggacttcagccttccttccagtctgggctgagtggggggtccagactacctgatgccccttccccaatttggggactttttgataatataaatatatctgtatattttacccta

SEQ ID NO: 417455 - DNA, 3896 bp, Homo sapiens
  misc_feature (49)..(49): n is a, c, g, or t
gccggtctgacctcttatgaggagtctcccctgagatatatgctgtttnccaaaaaaaaaaaaaaaaaaaagagaatgtgctactttgagtctgacttcagtcactcttgctgtaaagtccatcttcttgccagtggccatttgggattcttcctccctagaacctggctgatcctcactctgagtgtggcttctgagggctggggtggtcctggaacctgtcctcctacccccggtcatttgcttgttgtccctctccctctccagatcttacatctatcagaaacgatgggtgagactggatactgatcacctgcgatactttgacagtaacaaggacgcttactctaagcgctttatctctgtggcctgcatctcccacgtggctgccatcggggaccagaagtttgaagtgatcacaaacaaccgaacctttgccttccgggcagagagtgatgtggagcggaaggagtggatgcaggccctgcagcaggccatggctgagcagcgtgcccgggcccggctctctagcgcttatctgctgggagttccaggctcagagcagcctgaccgcgctggcagcctggagcttcgtggcttcaagaataagctgtacgtggccgtggtcggggacaaagtgcagctctacaagaatctagaggagtaccacctgggcattggcatcaccttcatcgacatgagcgtgggcaacgtgaaggaagtggaccggcgcagcttcgacctcaccacgccctaccgcatcttcagcttctctgctgactcagagctagagaaggagcagtggttggaggccatgcagggagccatcgctgaggccctgtctacctcggaggtggccgagcgcatctgggctgcagcccccaacaggttctgtgctgactgcggggctcctcagcctgactgggcctccatcaacctctgtgttgttatctgcaagcgctgtgcaggggagcaccgtggcctgggcgctggcgtctccaaggtgcggagcctgaagatggacaggaaggtgtggacagaaacacttatcgagctcttcttacagctggggaatggcgctgggaaccgcttctgggcagccaacgtgccccccagtgaggccctgcagcccagcagcagccccagcacccggcggtgccacctggaggccaagtaccgtgagggcaagtaccgccgctaccacccgctctttggcaaccaggaggagctggacaaggccctgtgtgctgcagtcaccaccacagacctggctgagacccaggcgctcctgggctgtggggctgggatcaactgcttctcgggggaccctgaggcccccacgcccctggctcttgcagagcaggcggggcagacgctgcagatggaattccttcggaacaaccggaccacagaggtgcctcggctggactcgatgaagcccctggaaaagcactactcagttgtcctgccgaccgtgagccacagtggcttcctctacaagactgcctctgccggcaagctgctacaggaccgccgggcccgggaagagttcagccggcgctggtgtgtccttggtgacggggtcctgagctactttgagaatgagcgggcagtgacccccaatggagagattcgggccagcgagattgtgtgcctggcagtgccccctcctgacacccatggctttgagcacacctttgaggtgtacacggagggagaacggctgtacctgtttgggctggagagtgcggagcaggctcatgagtgggtcaagtgtattgctaaggcattcgtgcctcccctagccgaggatctgctggcccgggattttgagcggctgggacgcctaccctacaaagctggcctgagcctacagcgggcccaggagggctggttctctctcagtggctcggagctccgtgctgtcttcccggaggggccctgcgaagagccgctgcaactacggaaactgcaggagctttccatccagggggacagtgagaaccaggtgctggtgctggtggagcgaaggaggacactgtacatacagggcgagcggcggctggacttcatgggttggctgggggccatccagaaagcagccgccagcatgggggacacgctgtcggagcagcagcttggggactcggatatcccggtgatcgtgtaccgctgtgtggactacatcacgcagtgcggcctgacctccgagggcatctaccgcaagtgtgggcagacatcgaagacacagcggctgctggagagcctgcggcaggatgcgcgctctgtgcacctcaaggagggcgagcagcacgtggatgatgtttcctcggcgctcaagcgcttcctgcgcgacctgcctgatgggctcttcactcgcgcccagcgcctaacctggctggaggcctcagagattgaggacgaggaggagaaggtctccaggtaccgagagctgctggtgcggctgccccctgtcaaccgggccacagtgaaggcccttatcagccacctgtactgtgttcagtgcttctcagacacgaaccagatgaacgtgcacaacctggcaattgtgtttgggcccacgctcttccagacagatgggcaggactacaaggctggccgtgtggtggaagacctcattaaccactatgtggtggtgtttagtgtggatgaggaagagctcaggaagcagcgggaggagatcactgccattgtgaagatgcgcgtggctggcactgccagtgggacccagcatgccggtgacttcatctgcacagtgtatctggaagagaagaaggcagagactgagcagcatatcaaggtcccagcatccatgactgctgaggagctcaccctggagatcctggatcgccggaacgtgggcatcagggagaaggactattggacctgctttgaggtcaacgagagggaggaggcagagcgccccctgcactttgcggagaaggtgctgcccatcctgcacgggctgggcacggacagccacctggtggtgaagaagcaccaggccatggaggccatgctgctgtacctggccagccgtgtcggtgacaccaagcatggcatgatgaagttccgtgaggaccgcagcctcctgggcctgggcctgccctcaggtggcttccacgatcgctacttcatcctcaacagcagctgcttgcggctctacaaggaggtccggagtcaccggcctgagaaggagtggcctattaagagtctcaaagtctacctgggagtgaagaagaaactcaggccacccacctgctggggcttcacagtggtgcatgagacagagaaacatgagaagcagcagtggtacctctgctgtgacacacagatggagctccgggagtggttcgctacctttctgtttgtgcagcatgacggcctggtgtggccctcagagccctcacgcgtgtcccgggcagtgcctgaggtccggctgggtagtgtgtcactgatcccccttcgaggtagtgaaaatgaaatgcgccggagtgtggctgccttcaccgcggaccctctgtctgtgagtggctctccatgcctttgggcagggggctgggggcctggctgggtgcctgccttctactccacagtagatgattgccctgattgccctccccgattgccctccggccccctccctccagccttggtgggggccctcataggcctctttggttcacaccattcaaaggagccccttctgcctggccctggaagctgggagtcccctctgcctggccctgggagctgggagcctggctgattggagtgctccccggctggcagtggagagtggctgcagcagctgcagcagcttcagcggggcgccagcccctctgggccttcacaaaatacctgtgggtctcttg

SEQ ID NO: 417456 - DNA, 3702 bp, Homo sapiens
  misc_feature (49)..(49): n is a, c, g, or t
gccggtctgacctcttatgaggagtctcccctgagatatatgctgtttnccaaaaaaaaaaaaaaaaaaaagagaatgtgctactttgagtctgacttcagtcactcttgctgtaaagtccatcttcttgccagtggccatttgggattcttcctccctagaacctggctgatcctcactctgagtgtggcttctgagggctggggtggtcctggaacctgtcctcctacccccggtcatttgcttgttgtccctctccctctccagatcttacatctatcagaaacgatgggtgagactggatactgatcacctgcgatactttgacagtaacaaggacgcttactctaagcgctttatctctgtggcctgcatctcccacgtggctgccatcggggaccagaagtttgaagtgatcacaaacaaccgaacctttgccttccgggcagagagtgatgtggagcggaaggagtggatgcaggccctgcagcaggccatggctgagcagcgtgcccgggcccggctctctagcgcttatctgctgggagttccaggctcagagcagcctgaccgcgctggcagcctggagcttcgtggcttcaagaataagctgtacgtggccgtggtcggggacaaagtgcagctctacaagaatctagaggagtaccacctgggcattggcatcaccttcatcgacatgagcgtgggcaacgtgaaggaagtggaccggcgcagcttcgacctcaccacgccctaccgcatcttcagcttctctgctgactcagagctagagaaggagcagtggttggaggccatgcagggagccatcgctgaggccctgtctacctcggaggtggccgagcgcatctgggctgcagcccccaacaggttctgtgctgactgcggggctcctcagcctgactgggcctccatcaacctctgtgttgttatctgcaagcgctgtgcaggggagcaccgtggcctgggcgctggcgtctccaaggtgcggagcctgaagatggacaggaaggtgtggacagaaacacttatcgagctcttcttacagctggggaatggcgctgggaaccgcttctgggcagccaacgtgccccccagtgaggccctgcagcccagcagcagccccagcacccggcggtgccacctggaggccaagtaccgtgagggcaagtaccgccgctaccacccgctctttggcaaccaggaggagctggacaaggccctgtgtgctgcagtcaccaccacagacctggctgagacccaggcgctcctgggctgtggggctgggatcaactgcttctcgggggaccctgaggcccccacgcccctggctcttgcagagcaggcggggcagacgctgcagatggaattccttcggaacaaccggaccacagaggtgcctcggctggactcgatgaagcccctggaaaagcactactcagttgtcctgccgaccgtgagccacagtggcttcctctacaagactgcctctgccggcaagctgctacaggaccgccgggcccgggaagagttcagccggcgctggtgtgtccttggtgacggggtcctgagctactttgagaatgagcgggcagtgacccccaatggagagattcgggccagcgagattgtgtgcctggcagtgccccctcctgacacccatggctttgagcacacctttgaggtgtacacggagggagaacggctgtacctgtttgggctggagagtgcggagcaggctcatgagtgggtcaagtgtattgctaaggcattcgtgcctcccctagccgaggatctgctggcccgggattttgagcggctgggacgcctaccctacaaagctggcctgagcctacagcgggcccaggagggctggttctctctcagtggctcggagctccgtgctgtcttcccggaggggccctgcgaagagccgctgcaactacggaaactgcaggagctttccatccagggggacagtgagaaccaggtgctggtgctggtggagcgaaggaggacactgtacatacagggcgagcggcggctggacttcatgggttggctgggggccatccagaaagcagccgccagcatgggggacacgctgtcggagcagcagcttggggactcggatatcccggtgatcgtgtaccgctgtgtggactacatcacgcagtgcggcctgacctccgagggcatctaccgcaagtgtgggcagacatcgaagacacagcggctgctggagagcctgcggcaggatgcgcgctctgtgcacctcaaggagggcgagcagcacgtggatgatgtttcctcggcgctcaagcgcttcctgcgcgacctgcctgatgggctcttcactcgcgcccagcgcctaacctggctggaggcctcagagattgaggacgaggaggagaaggtctccaggtaccgagagctgctggtgcggctgccccctgtcaaccgggccacagtgaaggcccttatcagccacctgtactgtgttcagtgcttctcagacacgaaccagatgaacgtgcacaacctggcaattgtgtttgggcccacgctcttccagacagatgggcaggactacaaggctggccgtgtggtggaagacctcattaaccactatgtggtggtgtttagtgtggatgaggaagagctcaggaagcagcgggaggagatcactgccattgtgaagatgcgcgtggctggcactgccagtgggacccagcatgccggtgacttcatctgcacagtgtatctggaagagaagaaggcagagactgagcagcatatcaaggtcccagcatccatgactgctgaggagctcaccctggagatcctggatcgccggaacgtgggcatcagggagaaggactattggacctgctttgaggtcaacgagagggaggaggcagagcgccccctgcactttgcggagaaggtgctgcccatcctgcacgggctgggcacggacagccacctggtggtgaagaagcaccaggccatggaggccatgctgctgtacctggccagccgtgtcggtgacaccaagcatggcatgatgaagttccgtgaggaccgcagcctcctgggcctgggcctgccctcaggtggcttccacgatcgctacttcatcctcaacagcagctgcttgcggctctacaaggaggtccgggtaagtggccccgctgggttctgccccagggtgggcacctgtacacctgaatgtgctcagagattccccttggtctgcaagtggaaatattcccgttacaggctctcaggatggcacagcagtgggggagaactgtagactctcaagacccctcctgctgtggccctggacggccactctagtgtgccctgtagccccactaagccctggcacccggatgccatcacaccactccatgcccatgctctgtctcactgtgcctgtgccttatcactgcatccacaggaacctgttacttgatgacagccccaagttgtgcatgcatgccttgtcatatcgtatgtcatatgcctcccgggccaccctcctccctcattctgtccacatgcaggtgttctcccaacccagactccatttgacaccctccaccttctgcacatacatgccatacacacaccccaaccccacacatcactgcacacttgtcgagtcctggctctaga

SEQ ID NO: 417457 - DNA, 3074 bp, Homo sapiens
  misc_feature (49)..(49): n is a, c, g, or t
gccggtctgacctcttatgaggagtctcccctgagatatatgctgtttnccaaaaaaaaaaaaaaaaaaaagagaatgtgctactttgagtctgacttcagtcactcttgctgtaaagtccatcttcttgccagtggccatttgggattcttcctccctagaacctggctgatcctcactctgagtgtggcttctgagggctggggtggtcctggaacctgtcctcctacccccggtcatttgcttgttgtccctctccctctccagatcttacatctatcagaaacgatgggtgagactggatactgatcacctgcgatactttgacagtaacaaggacgcttactctaagcgctttatctctgtggcctgcatctcccacgtggctgccatcggggaccagaagtttgaagtgatcacaaacaaccgaacctttgccttccgggcagagagtgatgtggagcggaaggagtggatgcaggccctgcagcaggccatggctgagcagcgtgcccgggcccggctctctagcgcttatctgctgggagttccaggctcagagcagcctgaccgcgctggcagcctggagcttcgtggcttcaagaataagctgtacgtggccgtggtcggggacaaagtgcagctctacaagaatctagaggagtaccacctgggcattggcatcaccttcatcgacatgagcgtgggcaacgtgaaggaagtggaccggcgcagcttcgacctcaccacgccctaccgcatcttcagcttctctgctgactcagagctagagaaggagcagtggttggaggccatgcagggagccatcgctgaggccctgtctacctcggaggtggccgagcgcatctgggctgcagcccccaacaggttctgtgctgactgcggggctcctcagcctgactgggcctccatcaacctctgtgttgttatctgcaagcgctgtgcaggggagcaccgtggcctgggcgctggcgtctccaaggtgcggagcctgaagatggacaggaaggtgtggacagaaacacttatcgagctcttcttacagctggggaatggcgctgggaaccgcttctgggcagccaacgtgccccccagtgaggccctgcagcccagcagcagccccagcacccggcggtgccacctggaggccaagtaccgtgagggcaagtaccgccgctaccacccgctctttggcaaccaggaggagctggacaaggccctgtgtgctgcagtcaccaccacagacctggctgagacccaggcgctcctgggctgtggggctgggatcaactgcttctcgggggaccctgaggcccccacgcccctggctcttgcagagcaggcggggcagacgctgcagatggaattccttcggaacaaccggaccacagaggtgcctcggctggactcgatgaagcccctggaaaagcactactcagttgtcctgccgaccgtgagccacagtggcttcctctacaagactgcctctgccggcaagctgctacaggaccgccgggcccgggaagagttcagccggcgctggtgtgtccttggtgacggggtcctgagctactttgagaatgagcgggcagtgacccccaatggagagattcgggccagcgagattgtgtgcctggcagtgccccctcctgacacccatggctttgagcacacctttgaggtgtacacggagggagaacggctgtacctgtttgggctggagagtgcggagcaggctcatgagtgggtcaagtgtattgctaaggcattcgtgcctcccctagccgaggatctgctggcccgggattttgagcggctgggacgcctaccctacaaagctggcctgagcctacagcgggcccaggagggctggttctctctcagtggctcggagctccgtgctgtcttcccggaggggccctgcgaagagccgctgcaactacggaaactgcaggagctttccatccagggggacagtgagaaccaggtgctggtgctggtggagcgaaggaggacactgtacatacagggcgagcggcggctggacttcatgggttggctgggggccatccagaaagcagccgccagcatgggggacacgctgtcggagcagcagcttggggactcggatatcccggtgatcgtgtaccgctgtgtggactacatcacgcagtgcggcctgacctccgagggcatctaccgcaagtgtgggcagacatcgaagacacagcggctgctggagagcctgcggcaggatgcgcgctctgtgcacctcaaggagggcgagcagcacgtggatgatgtttcctcggcgctcaagcgcttcctgcgcgacctgcctgatgggctcttcactcgcgcccagcgcctaacctggctggaggcctcagagattgaggacgaggaggagaaggtctccaggtaccgagagctgctggtgcggctgccccctgtcaaccgggccacagtgaaggcccttatcagccacctgtactgtgttcagtgcttctcagacacgaaccagatgaacgtgcacaacctggcaattgtgtttgggcccacgctcttccagacagatgggcaggactacaaggctggccgtgtggtggaagacctcattaaccactatgtggtggtgtttagtgtggatgaggaagagctcaggaagcagcgggaggagatcactgccattgtgaagatgcgcgtggctggcactgccagtgggacccagcatgccggtgacttcatctgcacagtgtatctggaagagaagaaggcagagactgagcagcatatcaaggtcccagcatccatgactgctgaggagctcaccctggagatcctggatcgccggaacgtgggcatcagggagaaggactattggacctgctttgaggtcaacgagagggaggaggcagagcgccccctgcactttgcggagaaggtgctgcccatcctgcacgggctgggcacggacagccacctggtggtgaagaagcaccaggccatggaggccatgctgctgtacctgggtaggtggtgcctgcagggtg

SEQ ID NO: 417458 - DNA, 746 bp, Homo sapiens
  misc_feature (49)..(49): n is a, c, g, or t
gccggtctgacctcttatgaggagtctcccctgagatatatgctgtttnccaaaaaaaaaaaaaaaaaaaagagaatgtgctactttgagtctgacttcagtcactcttgctgtaaagtccatcttcttgccagtggccatttgggattcttcctccctagaacctggctgatcctcactctgagtgtggcttctgagggctggggtggtcctggaacctgtcctcctacccccggtcatttgcttgttgtccctctccctctccagatcttacatctatcagaaacgatgggtgagactggatactgatcacctgcgatactttgacagtaacaaggacgcttactctaagcgctttatctctgtggcctgcatctcccacgtggctgccatcggggaccagaagtttgaagtgatcacaaacaaccgaacctttgccttccgggcagagagtgatgtggagcggaaggagtggatgcaggccctgcagcaggccatggctgagcagcgtgcccgggcccggctctctagcgcttatctgctgggagttccaggctcagagcagcctgaccgcgctggcagcctggagcttcgtggcttcaagaataagctgagtaccacctgggcattggcatcaccttcatcgacatgagcgtgggcaacgtgaaggaagtggaccggcgcagcttcgacctcaccacgccctaccgcatcttcaggtgaccctccatcttcttggctcaccg

SEQ ID NO: 417459 - DNA, 501 bp, Homo sapiens
gcagccgctactactactaaattcgcggccgtcgtcgacccgccaacatgggccgcgttcgcaccaaaaccgtgaagaaggcggcccgggtcatcatagaaaagtactacacgcgcctgggcaacgacttccacacgaacaagcgcgtgtgcgaggagatcgccattatccccagcaaaaagctccgcaacaagatagcaggttacgtcacgcatctgatgaagcgaattcagagaggcccagtaagaggtatctccatcaagctgcaggaggaggagagagaaaggagagacaattatgttcctgaggtctcagccttggatcaggagattattgaagtagatcctgacactaaggaaatgctgaagcttttggacttcggcagtctgtccaaccttcaggtcactcagcctacagttgggatgaatttcaaaacgcctcggggacctgtttgaattttttctgtagtgctgtattattttcaataaatctgggacaaca

SEQ ID NO: 417460 - DNA, 571 bp, Homo sapiens
ggtggctcccgagtaggctcagagcgaccgtggccgggcggaagcggctttctggcctaagctttaacaggcttcgcctgtgcttcctgtttcctcttttaccaaggacccgccaacatgggccgcgttcgcaccaaaaccgtgaagaaggcggcccgggtcatcatagaaaagtactacacgcgcctgggcaacgacttccacacgaacaagcgcgtgtgcgaggagatcgccattatccccagcaaaaagctccgcaacaagatagcaggttacgtcacgcatctgatgaagcgaattcagagaggcccagtaagaggtatctccatcaagctgcaggaggaggagagagaaaggagagacaattatgttcctgaggtctcagccttggatcaggagattattgaagtagatcctgacactaaggaaatgctgaagcttttggacttcggcagtctgtccaaccttcaggtcactcagcctacagttgggatgaatttcaaaacgcctcggggacctgtttgaattttttctgtagtgctgtattattttcaataaatctgggacaaca

SEQ ID NO: 417461 - DNA, 764 bp, Homo sapiens
caacatggtaggtgttttggctcgaggccgccatcctccacaatcgtcccccatctgcagcttcccgcggtcctcagcccacagagaggccctgggccgggaaggcgcagagccctgtcaggctggagcgcaacgggccggcggcttccgcattaagcccggcgcccggcactgtttagccgggccctctccggctcagcgcagccggcggtccccaaccacaccggccggggctcggcgccgcactcttcccagaaggttgcgctggctcgtgagtgatcctgtcctctccacccgcagacccgccaacatgggccgcgttcgcaccaaaaccgtgaagaaggcggcccgggtcatcatagaaaagtactacacgcgcctgggcaacgacttccacacgaacaagcgcgtgtgcgaggagatcgccattatccccagcaaaaagctccgcaacaagatagcaggttacgtcacgcatctgatgaagcgaattcagagaggcccagtaagaggtatctccatcaagctgcaggaggaggagagagaaaggagagacaattatgttcctgaggtctcagccttggatcaggagattattgaagtagatcctgacactaaggaaatgctgaagcttttggacttcggcagtctgtccaaccttcaggtcactcagcctacagttgggatgaatttcaaaacgcctcggggacctgtttgaattttttctgtagtgctgtattattttcaataaatctgggacaaca

SEQ ID NO: 417462 - DNA, 503 bp, Homo sapiens
aaagtaggctaggtacgaggccgggtggttaatcggccgacccgccaacatgggccgcgttcgcaccaaaaccgtgaagaaggcggcccgggtcatcatagaaaagtactacacgcgcctgggcaacgacttccacacgaacaagcgcgtgtgcgaggagatcgccattatccccagcaaaaagctccgcaacaagatagcaggttacgtcacgcatctgatgaagcgaattcagagaggcccagtaagaggtatctccatcaagctgcaggaggaggagagagaaaggagagacaattatgttcctgaggtctcagccttggatcaggagattattgaagtagatcctgacactaaggaaatgctgaagcttttggacttcggcagtctgtccaaccttcaggtcactcagcctacagttgggatgaatttcaaaacgcctcggggacctgtttgaattttttctgtagtgctgtattattttcaataaatctgggacaaca

SEQ ID NO: 417463 - DNA, 703 bp, Homo sapiens
gcagccgctactactactaaattcgcggccgtcgtcgacccgccaacatgggccgcgttcgcaccaaaaccgtgaagaaggcggcccgggtcatcatagaaaagtactacacgcgcctgggcaacgacttccacacgaacaagcgcgtgtgcgaggagatcgccattatccccagcaaaaagctccgcaacaagatagcaggttacgtcacgcatctgatgaagcgaattcagagaggcccagtaagaggtatctccatcaagctgcaggaggaggagagagaaaggagagacaattatgttcctgaggtctcagccttggatcaggagattattgaagtagatcctgacactaaggaaatgctgaagcttttggacttcggcagtctgtccaaccttcaggtcactcagcctacagttgggatgaatttcaaaacgcctcggggacctgtttgaattttttctgtagtgctgtattattttcaataaatctgggacaacagcaaaaaaaaaaaaaaaaaacaaaaaaaaaaaaaacaaaaaaaaacaaaaaaaaaaggggggggcctacagaaaggaacccccaggggggcccacaaagagagacgagcccacggttccgggaagccaagggggccccaaagggggagccctatcaaaacgacgaggctgggcgccctcaaaaagaggcggaaggggaaaag

SEQ ID NO: 417464 - DNA, 616 bp, Homo sapiens
  misc_feature (582)..(582): n is a, c, g, or t
caacatggtaggtgttttggctcgaggccgccatcctccacaatcgtcccccatctgcagcttcccgcggtcctcagcccacagagaggccctgggccgggaaggcgcagagccctgtcaggctggagcgcaacgggccggcggcttccgcattaagcccggcgcccggcactgtttagccgggccctctccggctcagcgcagccggcggtccccaaccacaccggccggggctcggcgccgcactcttcccagaaggttgcgctggctcgtgagtgatcctgtcctctccacccgcagacccgccaacatgggccgcgttcgcaccaaaaccgtgaagaaggcggcccgggtcatcatagaaaagtactacacgcgcctgggcaacgacttccacacgaacaagcgcgtgtgcgaggagatcgccattatcagaggcccagtaagaggtatctccatcaagctgcaggaggaggagagagaaaggagagacaattatgttcctgaggtctcagccttggatcaggagattattgaagtagatcctgacactaaggaaatgctgaagcttttggtgctganagctttgggacttcgcagtctgtccccttaggtc

SEQ ID NO: 417465 - DNA, 1424 bp, Homo sapiens
ggtggctcccgagtaggctcagagcgaccgtggccgggcggaagcggctttctggcctaagctttaacaggcttcgcctgtgcttcctgtttcctcttttaccaaggacccgccaacatgggccgcgttcgcaccaaaaccgtgaagaaggcggcccgggtcatcatagaaaagtactacacgcgcctgggcaacgacttccacacgaacaagcgcgtgtgcgaggagatcgccattatccccagcaaaaagctccgcaacaagatagcaggttacgtcacgcatctgatgaagcgaattcagagaggcccagtaagaggtatctccatcaagctgcaggaggaggagagagaaaggagagacaattatgttcctgaggtctcagccttggatcaggagattattgaagtagatcctgacactaaggaaatgctgaagcttttggacttcggcagtctgtccaaccttcaggtcactcagcctacagttgggatgaatttcaaaacgcctcggggacctgtttgaattttttctgtagtgctgtattattttcaataaatctgggacaacagcaacaaacaaaaacaaagacacaagaaaaaacacacagggagactaacatggaggcagggaagccagaaaaagagggatacacaacagcgcgcaagcgggcacacacaaaaacgcaacacacgcgaacacccacagaaacacaccagcgagcacacaaaggggacaacacccacggccgagacacacacaagacgaccagagacaagacaacaagacaacgaaaaaaagacaaggaacacacacgggaacacacaaagaagaagaggacaaaagaaaacagcaaggcaacgacgacacacaggagaaaaagaaacagagcaaaagaccaacacgcgacgggaccgccaaacaaggcggagcgaggaagccggcagagcggaaggagcaggccacccaggagaacgcgggacgagggcgagaaaaagcagacaaaagaagaagacacgaacgcagacagcacaggcagccagcgacccacaaaacggccgaaaggagaaaaacagaaaagggggaggaaagaggaggcgacgagcgaaggaaagaacgggcgacgaacagaggagaagggaggagaacaggggagaaagcggggagacggacaaggcggcagagacgggagcagaaggggacgacgaacgacccaggccacgaagccagaaaacaagcaacgcaaacaacgaacgacagaggcacacagaagcaacgagacagaacgcaaccgagacaagaaagggaagacaggggacaagggcgaaagagagcaaaagcaaagaataaaaggagaaagaggaggaaagaggagagaacgcaggaaggaggggaagaagacggaagaagagcgaataaggaaa

SEQ ID NO: 417466 - DNA, 863 bp, Homo sapiens
gcagccgctactactactaaattcgcggccgtcgtcgacccgccaacatgggccgcgttcgcaccaaaaccgtgaagaaggcggcccgggtcatcatagaaaagtactacacgcgcctgggcaacgacttccacacgaacaagcgcgtgtgcgaggagatcgccattatccccagcaaaaagctccgcaacaagatagcaggttacgtcacgcatctgatgaagcgaattcagagaggcccagtaagaggtatctccatcaagctgcaggaggaggagagagaaaggagagacaattatgttcctgaggtctcagccttggatcaggagattattgaagtagatcctgacactaaggaaatgctgaagcttttggtggtaagtgtttgctggattcctaaagtggtattttcctggtcaaaaaccatcagtaggtcttattatccaaggtcacccagctagtaagtggcagagttgggaatcccatctaaacttgtagccactaaactggactgctttcataaggggtgtagcggaagttgtgtgcattgagttagttcgccacaagatcatgattcccaaatctagtggcttccaggacaccttttctctcttggctgcttctgttcttggtttatagctggcttacgttgccccctttgtgtcagccctggctgaatctccctgcttttcttctgtgaaggcattcctttggtgtctccatgctaaccactcagaaatgagcttagggtccattatccaggtacatacaaggcactacttaggtagatcacgagtatcttcattgcactttggatgtatcctatggcttatctttagtcctttggcatacttggggtgaaa

SEQ ID NO: 417467 - DNA, 786 bp, Homo sapiens
ggtggctcccgagtaggctcagagcgaccgtggccgggcggaagcggctttctggcctaagctttaacaggcttcgcctgtgcttcctgtttcctcttttaccaaggacccgccaacatgggccgcgttcgcaccaaaaccgtgaagaaggcggcccgggtcatcatagaaaagtactacacgcgcctgggcaacgacttccacacgaacaagcgcgtgtgcgaggagatcgccattatccccagcaaaaagctccgcaacaagatagcaggttacgtcacgcatctgatgaagcgaattcagagaggcccagtaagaggtatctccatcaagctgcaggaggaggagagagaaaggagagacaattatgttcctgaggtctcagccttggatcaggagattattgaagtagatcctgacactaaggaaatgctgaagcttttggacttcggcagtctgtccaaccttcaggtcactcagcctacagttgggatgaatttcaaaacgcctcggggacctgtttgaattttttctgtagtgctgtattattttcaataaatctgggacaacaaaaaaaaaaaaaaaaaaaaaaaaaaaaaaaaaaaaaaaaaaaaaaaaacaaaaaaaaaaaaaaaaacacccggaggacacaaggggggggggcgaacaaacaggcacaaaagggcgaagtggataaaggtgtcggaaaaaggtttgttgtaaaaaggggaaacacgggaggccaaaagggggggaaaatataaacaaaaaggagaaacctgttaa

SEQ ID NO: 417468 - DNA, 1236 bp, Homo sapiens
ggggataatggcgatctcctcgcacacgcgcttgttcgtgtggaagtcgttgcccagcaaaaagctccgcaacaagatagcaggttacgtcacgcatctgatgaagcgaattcagagaggcccagtaagaggtatctccatcaagctgcaggaggaggagagagaaaggagagacaattatgttcctgaggtctcagccttggatcaggagattattgaagtagatcctgacactaaggaaatgctgaagcttttggacttcggcagtctgtccaaccttcaggtcactcagcctacagttgggatgaatttcaaaacgcctcggggacctgtttgaattttttctgtagtgctgtattattttcaataaatctgggacaacagcaacaaacaaaaacaaagacacaagaaaaaacacacagggagactaacatggaggcagggaagccagaaaaagagggatacacaacagcgcgcaagcgggcacacacaaaaacgcaacacacgcgaacacccacagaaacacaccagcgagcacacaaaggggacaacacccacggccgagacacacacaagacgaccagagacaagacaacaagacaacgaaaaaaagacaaggaacacacacgggaacacacaaagaagaagaggacaaaagaaaacagcaaggcaacgacgacacacaggagaaaaagaaacagagcaaaagaccaacacgcgacgggaccgccaaacaaggcggagcgaggaagccggcagagcggaaggagcaggccacccaggagaacgcgggacgagggcgagaaaaagcagacaaaagaagaagacacgaacgcagacagcacaggcagccagcgacccacaaaacggccgaaaggagaaaaacagaaaagggggaggaaagaggaggcgacgagcgaaggaaagaacgggcgacgaacagaggagaagggaggagaacaggggagaaagcggggagacggacaaggcggcagagacgggagcagaaggggacgacgaacgacccaggccacgaagccagaaaacaagcaacgcaaacaacgaacgacagaggcacacagaagcaacgagacagaacgcaaccgagacaagaaagggaagacaggggacaagggcgaaagagagcaaaagcaaagaataaaaggagaaagaggaggaaagaggagagaacgcaggaaggaggggaagaagacggaagaagagcgaataaggaaa

SEQ ID NO: 417469 - DNA, 1068 bp, Homo sapiens
ggtggctcccgagtaggctcagagcgaccgtggccgggcggaagcggctttctggcctaagctttaacaggcttcgcctgtgcttcctgtttcctcttttaccaaggacccgccaacatgggccgcgttcgcaccaaaaccgtgaagaaggcggcccgggtcatcatagaaaagtactacacgcgcctgggcaacgacttccacacgaacaagcgcgtgtgcgaggagatcgccattatccccagcaaaaagctccgcaacaagatagcaggttacgtcacgcatctgatgaagcgaattcagagaggcccagtaagaggtatctccatcaagctgcaggaggaggagagagaaaggagagacaattatgttcctgaggtctcagccttggatcaggagattattgaagtagatcctgacactaaggaaatgctgaagcttttggacttcggcagtctgtccaaccttcaggtcactcagcctacagttgggatgaatttcaaaacgcctcggggacctgtttgaattttttctgtagtgctgtattattttcaataaatctgggacaacaaaaaaaaaaaaaaaaaaaaaaaaaaaacaaaaaaaaaaaaagagagggggggggggataaaaattttcccggggggggcccaaattttaagcgcgttatccccggctttttgtgtttccaagggtggcccccataagggggagcgcgttttttagcccggggccgcgggcgcggcgtatcacagcggcttgtgggcgtgggaaaacccgtcgtcaccgtgtgggcactctttggcgaaggcgacccgctttatatttggggggggggcggggagacaatttatttgtgagcaacaattttactcctaaaaagagaagagtatcttaagacaggggtcatagagggggacaatatattaaaactttttaaaagggttgtatataattgtggtgttaaacacaaataggtggtaatattattttgttacgagtgtgttaaaaacactttattcgactcaaacggaggatatatattttagggaacattttttttcggag

SEQ ID NO: 417470 - DNA, 763 bp, Homo sapiens
  misc_feature (763)..(763): n is a, c, g, or t
ggtggctcccgagtaggctcagagcgaccgtggccgggcggaagcggctttctggcctaagctttaacaggcttcgcctgtgcttcctgtttcctcttttaccaaggacccgccaacatgggccgcgttcgcaccaaaaccgtgaagaaggcggcccgggtcatcatagaaaagtactacacgcgcctgggcaacgacttccacacgaacaagcgcgtgtgcgaggagatcgccattatccccagcaaaaagctccgcaacaagatagcaggttacgtcacgcatctgatgaagcgaattcagagaggcccagtaagaggtatctccatcaagctgcaggaggaggagagagaaaggagagacaattatgttcctgaggtctcagccttggatcaggagattattgaagtagatcctgacactaaggaaatgctgaagcttttggacttcggcagtctgtccaaccttcaggtcactcagcctacagttgggatgaatttcaaaacgcctcggggacctgtttgaattttttctgtagtgctgtattattttcaataaatctgggacaacaaaaaaaaaaaaaaaaaaaaaaccccgcaggccccaaggccgcgcgcgcgacacacgaggcacggacggggcccggggcccccgcggtcccggacccagctcccggcccaaaggggaaaaccggccggccccccaacagcggaccccgcacaaccccccaacaccccggccacccggcccacgcccccgcacn

SEQ ID NO: 417471 - DNA, 595 bp, Homo sapiens
ggtggctcccgagtaggctcagagcgaccgtggccgggcggaagcggctttctggcctaagctttaacaggcttcgcctgtgcttcctgtttcctcttttaccaaggacccgccaacatgggccgcgttcgcaccaaaaccgtgaagaaggcggcccgggtcatcatagaaaagtactacacgcgcctgggcaacgacttccacacgaacaagcgcgtgtgcgaggagatcgccattatccccagcaaaaagctccgcaacaagatagcaggttacgtcacgcatctgatgaagcgaattcagagaggcccagtaagaggtatctccatcaagctgcaggaggaggagagagaaaggagagacaattatgttcctgaggtctcagccttggatcaggagattattgaagtagatcctgacactaaggaaatgctgaagcttttggacttcggcagtctgtccaaccttcaggtcactcagcctacagttgggatgaatttcaaaacgcctcggggacctgtttgaattttttctgtagtgctgtattattttcaataaatctgggacaacagctggggaaaaaaaacaaaaacaa

SEQ ID NO: 417472 - DNA, 253 bp, Homo sapiens
ccaagtgtagatgtagcattgttccacacatttaaaacatttgaaggacctaaattcgtagcaaattctgtggcagttttaaaaagttaagctgctatagtaagttactgggcattctcaatacttgaatatggaacatatgcacaggggaaggaaataacattgcactttataaacactgtattgtaagtggaaaatgcaatgtcttaaataaaactatttaaaattggcaccataaaaaaagaaaccttaa

SEQ ID NO: 417473 - DNA, 182 bp, Homo sapiens
cggacgcgtgggtcgacccacgcgtccggtaagttactgggcattctcaatacttgaatatggaacatatgcacaggggaaggaaataacattgcactttataaacactgtattgtaagtggaaaatgcaatgtcttaaataaaactatttaaaattggcaccataaaaaaagaaaccttaa

SEQ ID NO: 417474 - DNA, 1696 bp, Homo sapiens
  misc_feature (1)..(2): n is a, c, g, or t
nncacgagcctggctctactgcaggcgctgggggttggggtgggggagaggcccagggcacatgatgccgcccccagcccgcccagcacatgacccaggcaggccggcggggtcctggcacacccgagccgcgtccgcgaacacagcccatggcctccccgcgcctagggaccttctgctgccccacgcgggacgcagccacgcagctcgtgctgagcttccagccgcgggccttccacgcgctctgcctgggcagcggcgggctccgcttggcgctgggccttctgcagctgctgcccggccgccggcccgcgggccccgggtcccccgcgacgtccccgccggcctcggtccgcatcctgcgcgctgccgctgcctgcgaccttctcggctgcctgggtatggtgatccggtccaccgtgtggttaggattcccaaattttgttgacagcgtctcggatatgaaccacacggaaatttggcctgctgctttctgcgtggggagtgcgatgtggatccagctgttgtacagtgcctgcttctggtggctgttttgctatgcagtggatgcttatctggtgatccggagatcggcaggactgagcaccatcctgctgtatcacatcatggcgtggggcctggccaccctgctctgtgtggagggagccgccatgctctactacccttccgtgtccaggtgtgagcggggcctggaccacgccatcccccactatgtcaccatgtacctgcccctgctgctggttctcgtggcgaaccccatcctgttccaaaagacagtgactgcagtggcctctttacttaaaggaagacaaggcatttacacggagaacgagaggaggatgggagccgtgatcaagatccgatttttcaaaatcatgctggttttaattatttgttggttgtcgaatatcatcaatgaaagccttttattctatcttgagatgcaaacagatatcaatggaggttctttgaaacctgtcagaactgcagccaagaccacatggtttattatgggaatcctgaatccagcccagggatttctcttgtctttggccttctacggctggacaggatgcagcctgggttttcagtctcccaggaaggagatccagtgggaatcactgaccacctcggctgctgagggggctcacccatccccactgatgccccatgaaaaccctgcttccgggaaggtgtctcaagtgggtgggcagacttctgacgaagccctgagcatgctgtctgaaggttctgatgccagcacaattgaaattcacactgcaagtgaatcctgcaacaaaaatgagggtgaccctgctctcccaacccatggagacctatgaaggggatgtgctgggggtccagaccccatattcctcagactcaacaattcttgttctttagaactgtgttctcaccttcccaacactgcactgccgaagtgtagcggcccccaaaccttgctctcatcaccagctagagcttcttcccgaagggcctttaggataggagaaagggttcatgcacacacgtgtgagaatggaagagccccctccagaccactctacagctgctctagccttagttgccactaggaagttttctgaggctggctgtaaagtaagtgtaaggtccacatccttggggaagtagttaaataaaatagttatgactg

SEQ ID NO: 417475 - DNA, 1767 bp, Homo sapiens
  misc_feature (1)..(2): n is a, c, g, or t
nncacgagcctggctctactgcaggcgctgggggttggggtgggggagaggcccagggcacatgatgccgcccccagcccgcccagcacatgacccaggcaggccggcggggtcctggcacacccgagccgcgtccgcgaacacagcccatggcctccccgcgcctagggaccttctgctgccccacgcgggacgcagccacgcagctcgtgctgagcttccagccgcgggccttccacgcgctctgcctgggcagcggcgggctccgcttggcgctgggccttctgcagctgctgcccggccgccggcccgcgggccccgggtcccccgcgacgtccccgccggcctcggtccgcatcctgcgcgctgccgctgcctgcgaccttctcggctgcctgggtatggtgatccggtccaccgtgtggttaggattcccaaattttgttgacagcgtctcggatatgaaccacacggaaatttggcctgctgctttctgcgtggggagtgcgatgtggatccagctgttgtacagtgcctgcttctggtggctgttttgctatgcagtggatgcttatctggtgatccggagatcggcaggactgagcaccatcctgctgtatcacatcatggcgtggggcctggccaccctgctctgtgtggagggagccgccatgctctactacccttccgtgtccaggtgtgagcggggcctggaccacgccatcccccactatgtcaccatgtacctgcccctgctgctggttctcgtggcgaaccccatcctgttccaaaagacagtgactgcagtggcctctttacttaaaggaagacaaggcatttacacggagaacgagaggaggatgggagccgtgatcaagatccgatttttcaaaatcatgctggttttaattatttgttggttgtcgaatatcatcaatgaaagccttttattctatcttgagatgcaaacagatatcaatggaggttctttgaaacctgtcagaactgcagccaagaccacatggtttattatgggaatcctgaatccagcccagggatttctcttgtctttggccttctacggctggacaggatgcagcctgggttttcagtctcccaggaaggagatccagtgggaatcactgaccacctcggctgctgagggggctcacccatccccactgatgccccatgaaaaccctgcttccgggaaggtgtctcaagtgggtgggcagacttctgacgaagccctgagcatgctgtctgaaggttctgatgccagcacaattgaaattcacactgcaagtgaatcctgcaacaaaaatgagggtgaccctgctctcccaacccatggagacctatgaaggggatgtgctgggggtccagaccccatattcctcagactcaacaattcttgttctttagaactgtgttctcaccttcccaacactgcactgccgaagtgtagcggcccccaaaccttgctctcatcaccagctagagcttcttcccgaagggcctttaggataggagaaagggttcatgcacacacgtgtgagaatggaagagccccctccagaccactctacagctgctctagccttagttgccactaggaagttttctgaggctggctgtaaagtaagtgtaaggtccacatccttggggaagtagttaaataaaatagttatgactgagctctcagcctgacttggattctgtcttaacacttctagcaaaagaaaataaatatatgtacagttaaaa

SEQ ID NO: 417476 - DNA, 940 bp, Homo sapiens
  misc_feature (1)..(2): n is a, c, g, or t
nncacgagcctggctctactgcaggcgctgggggttggggtgggggagaggcccagggcacatgatgccgcccccagcccgcccagcacatgacccaggcaggccggcggggtcctggcacacccgagccgcgtccgcgaacacagcccatggcctccccgcgcctagggaccttctgctgccccacgcgggacgcagccacgcagctcgtgctgagcttccagccgcgggccttccacgcgctctgcctgggcagcggcgggctccgcttggcgctgggccttctgcagctgctgcccggccgccggcccgcgggccccgggtcccccgcgacgtccccgccggcctcggtccgcatcctgcgcgctgccgctgcctgcgaccttctcggctgcctgggtatggtgatccggtccaccgtgtggttaggattcccaaattttgttgacagcgtctcggatatgaaccacacggaaatttggcctgctgctttctgcgtggggagtgcgatgtggatccagctgttgtacagtgcctgcttctggtggctgttttgctatgcagtggatgcttatctggtgatccggagatcggcaggactgagcaccatcctgctgtatcacatcatggcgtggggcctggccaccctgctctgtgtggagggagccgccatgctctactacccttccgtgtccagagggagatgtggccgctggaactgtctcaagcatttcctcaagtttacattcctgtccatgcaaccctcagttgcaaagccaaggtctttccaaggatatatactctaacttccaatggaaaactggaaaatggaagtggacagtgtctttgtctgtgatttttataccagggatcaacacagtgtagccctcaggacaaatccggcgttcttccgtttttgtaaataaagttttattggaat

SEQ ID NO: 417477 - DNA, 1037 bp, Homo sapiens
tgttagctttaagcatccttttgataaactatctctttaagagaaattgattctctgtgtatagttcttttaaaaggcatagacgtggccaggagcggtggctcatgcctgtaatcccagtgctttggaaggccaagatgtgaggattgcttgaggccaggagtttgagaccagcctgggcaacatagggagaccccgtccctacaaaaaacattaaaaattagccaggtacaatggcatgcatctgtagtcccagccacatgggaggctgaggcaggaggatcgcttgagcccagcagatgctgctatgatctatggtcacgccactgtactatagcctgggtgacagaatgaatgaatacatagacaaccctggattttgagaaaaaacaaatattgactgtacttcagttatccatttgttcctggttgcaagaaaacagtttttatatcaatgtttaagagaattaatggttcagatgtcacatagaatttttattctttgaaagaataatttttattccagatactcatttctttactaatcctagcccagtctctagcccagagccatcattgcaccactgcacaccaggttgggcaacagagaaaaacccttttccaaaaagaaaaaaaattcaaaaactgcttttagctcatggtggtagattacgtaaaacaggtggattaccactggagaaactgggcgaagcatacaagggctttttctgtattacttcttacaactgcacatgaatctacaattatctcaataaaaatttcaatttaacttgcaggttattggctagagttgacccataggcgttaatttcctaactcctgctctagctggtcagagcagcttatgagatatggtattgaattttaaactattgctttaaaaaatttttttattaatatttgtgattataggatacacatgatattttgttacatgcatagaatgtgtcatgatctagtcaatgtatttggggtgtctatcgcctcgagtattcattttttttttgagacagcct

SEQ ID NO: 417478 - DNA, 258 bp, Homo sapiens
aacaaaataatagtgacttacatttacatcttgcttctgaactgtcagtacatttactagctgtcagtaaaagagaaaaataaaaaaaactgactgtcagttttaaaagacagtaagaaagagaaagtatgccagtaaatgtagagaaaataattttgaaaaatattttacctacttcagcatgagtttttgtcctgtgtgaaatgtataactacataatttgaattgtttgatatcttaaaaccatagattctagga

SEQ ID NO: 417479 - DNA, 1483 bp, Homo sapiens
ggggctgctggagcttgggggctggtggcaggaacaagccctttccgaccccatggagctgtatgagacatccccctacttctaccaggaaccccgcttctatgatggggaaaactacctgcctgtccacctccagggcttcgaaccaccaggctacgagcggacggagctcaccctgagccccgaggccccagggccccttgaggacaaggggctggggacccccgagcactgtccaggccagtgcctgccgtgggcgtgtaaggtgtgtaagaggaagtcggtgtccgtggaccggcggcgggcggccacactgagggagaagcgcaggctcaagaaggtgaatgaggccttcgaggccctgaagagaagcaccctgctcaaccccaaccagcggctgcccaaggtggagatcctgcgcagtgccatccagtacatcgagcgcctccaggccctgctcagctccctcaaccaggaggagcgtgacctccgctaccggggcgggggcgggccccagccaggggtgcccagcgaatgcagctctcacagcgcctcctgcagtccagagtggggcagtgcactggagttcagcgccaacccaggggatcatctgctcacggctgaccctacagatgcccacaacctgcactccctcacctccatcgtggacagcatcacagtggaagatgtgtctgtggccttcccagatgaaaccatgcccaactgagattgtcttccaagccgggcatccttcgagccccccaagctggccacagatgccactacttctgtagcaggggcctcctaagccaggctgccctgatgctaggaagccagctctggggtgccataggccagactatccccttcctcatccatgtaaggttaacccaccccccagcaagggactggacgccctcattcagctgcctccttagaggagagggcatccctttccagggaggtaaagcaggggaccagagcgccccctcgtgtatgccccagctcagggggcaaactcaggagcttcctttttatcataacgcggcctctaattccaccccccaagtgaaacggtttgagagacgccgtgccctgacctggacaagctgtgcacgtctcctgttctggtctcttcccgatgcagtggctggctggcctgccctgaattgagagagaagaagggggagaggaacagccctctgttcccaagtcctggggggccaaacttttgcagtgaatattgggaaccttccagtggttttatgttttgttttgtttcgtgtgttgtttgtaaagctgccatccgaccaaggtctcctgtgctgaagttgccggggacaggcagggaaaaggggttggggcctcttgggggtgatttcttttgttaacaaagcatcgtgtggttttgccattgttttgtattttttttttttttttttttttttgctaacttatttggatttccttttttaaaaaatga

SEQ ID NO: 417480 - DNA, 1483 bp, Homo sapiens
gtctatgatacgaggtgtttgacgcagaccaccgttgtgacttggtgcaagtaggtcctcctagttctcatcgaggcaagcgtctgcttgtatgatggggaaaatcttgcctggctttgcttcctcacttcctagaggcttcgaaccaccaggctacgagcggacggagctcaccctgagccccgaggccccagggccccttgaggacaaggggctggggacccccgagcactgtccaggccagtgcctgccgtgggcgtgtaaggtgtgtaagaggaagtcggtgtccgtggaccggcggcgggcggccacactgagggagaagcgcaggctcaagaaggtgaatgaggccttcgaggccctgaagagaagcaccctgctcaaccccaaccagcggctgcccaaggtggagatcctgcgcagtgccatccagtacatcgagcgcctccaggccctgctcagctccctcaaccaggaggagcgtgacctccgctaccggggcgggggcgggccccagccaggggtgcccagcgaatgcagctctcacagcgcctcctgcagtccagagtggggcagtgcactggagttcagcgccaacccaggggatcatctgctcacggctgaccctacagatgcccacaacctgcactccctcacctccatcgtggacagcatcacagtggaagatgtgtctgtggccttcccagatgaaaccatgcccaactgagattgtcttccaagccgggcatccttcgagccccccaagctggccacagatgccactacttctgtagcaggggcctcctaagccaggctgccctgatgctaggaagccagctctggggtgccataggccagactatccccttcctcatccatgtaaggttaacccaccccccagcaagggactggacgccctcattcagctgcctccttagaggagagggcatccctttccagggaggtaaagcaggggaccagagcgccccctcgtgtatgccccagctcagggggcaaactcaggagcttcctttttatcataacgcggcctctaattccaccccccaagtgaaacggtttgagagacgccgtgccctgacctggacaagctgtgcacgtctcctgttctggtctcttcccgatgcagtggctggctggcctgccctgaattgagagagaagaagggggagaggaacagccctctgttcccaagtcctggggggccaaacttttgcagtgaatattgggaaccttccagtggttttatgttttgttttgtttcgtgtgttgtttgtaaagctgccatccgaccaaggtctcctgtgctgaagttgccggggacaggcagggaaaaggggttggggcctcttgggggtgatttcttttgttaacaaagcatcgtgtggttttgccattgttttgtattttttttttttttttttttttttgctaacttatttggatttccttttttaaaaaatga

SEQ ID NO: 417481 - DNA, 1493 bp, Homo sapiens
ctcagagccttcctgatgtatatatgcaggtagtgagaattgaatcggccctttgagacagtaatataataaaactctgatttggggagcagcggttctccttatttttctactctcttgtgggaatgagttgccaagcttttacttcggctgatacctttatacctctgaattctgacgcctctgcaactctgcctctgataatgcatcacagtgctgccgagtgtctaccagtctccaaccatgccaccaatgtgatgtctacagcaacaggacttcattattctgttccttcctgtcattatggaaaccagccatcaacctatggagtgatggcaggtagtttaaccccttgtctttataaatttcctgaccacaccttgagtcatggatttcctcctatacaccagcctcttctggcagaggaccccacagctgctgatttcaagcaggaactcaggcggaaaagtaaattggtggaagagccaatagacatggattctccagaaatcagagaacttgaaaagtttgccaatgaatttaaagtgagacgaattaaattaggatacacccagacaaatgttggggaggccctggcagctgtgcatggctctgaattcagtcaaacaacaatctgccgatttgaaaatctgcagctcagctttaaaaatgcatgcaaactgaaagcaatattatccaaatggctggaggaagctgagcaagtaggagctttgtacaatgaaaaagtgggagcaaatgaaaggaaaagaaaacgaagaacaactataagcattgctgctaaagatgctctggagagacactttggagaacagaataaaccttcttctcaagagatcatgaggatggctgaagaactgaatctggagaaagaagtagtaagagtttggttttgcaaccggaggcagagagaaaaacgggtgaaaacaagtctgaatcagagtttattttctatttctaaggaacatcttgagtgcagataagatttttctattgtataatagcctttttctcccgtttcattcctttctcttcctcaacaaaaacagaaattacttggttgacttaaaatcattttatatcaatagcttttacagaagctttacttttccacttttttttaaaaaaaagaaaccaacaatttaaattatattgatgttatttacttaaaataattattctcagaagccacattatctattttaagccaaatatattaacagtaataaaatgatctctctgtctctcccgctctctttctcacacacacgcagacatatgagtatgggtttataagttccttttccaaacatgtatattagctttttaacatgtaagtcagtaatgacacatatgtaaagcacatcaccagaaatatccaattcaaaaattaaccaatgttctgctttctaccaactctactaatttgtctgaactaaaagttttgaacttaagagctggaggtgtcttatagt

SEQ ID NO: 417482 - DNA, 1487 bp, Homo sapiens
  misc_feature (5)..(5): n is a, c, g, or t
tctanagtcccatctattttgtctttgatccaaactcctaaatgtttgtgcacacatttctcggtgacaacgttgggaaacacagcaacaggacttcattattctgttccttcctgtcattatggaaaccagccatcaacctatggagtgatggcaggtagtttaaccccttgtctttataaatttcctgaccacaccttgagtcatggatttcctcctatacaccagcctcttctggcagaggaccccacagctgctgatttcaagcaggaactcaggcggaaaagtaaattggtggaagagccaatagacatggattctccagaaatcagagaacttgaaaagtttgccaatgaatttaaagtgagacgaattaaattaggatacacccagacaaatgttggggaggccctggcagctgtgcatggctctgaattcagtcaaacaacaatctgccgatttgaaaatctgcagctcagctttaaaaatgcatgcaaactgaaagcaatattatccaaatggctggaggaagctgagcaagtaggagctttgtacaatgaaaaagtgggagcaaatgaaaggaaaagaaaacgaagaacaactataagcattgctgctaaacgactgctctggacgacgacccctttggacaacccgaactaaacccattcttcatcacgacgactcctgactgatggcttgaagaccctgacctcttggcgaaacgacacgtagtaccgacgttttggtatatgccacccgcgacggtcagagaccaaaaacaccggggttgacaaaccaacgtcttgaatccagagtttcatttatctcatttctcaagtgaacatcattgcagtgcgaggatcaagcatttttactcatctgtcataaatagccctttatactcaccggtttccattccctattctctttccctccaagcaacaaaccaggcaaattcaacttgggttttgcaccttcaacacatccatttctcatactcaacatagcctactataacgagaacgcctatcaactatttaccacgttattctttacataacaaccacacaagtaacacacactcgcacggggggggccccgtgtaccgccaagtaggcactaatcgatgagatggtcattaacaattacactggccggtccgattaaacaacgagtacgtgtacctgggggcccctgcacgttacccaaacttatatctgccatgtcagcaacatcccccatatcgaccaactggcgctacctaggcacaatgtccgagccggatcagcccttcccagcagttgtccacactaacatggcaatggcaacctgtatccgacacatatcgcacaatacggatcaatttggtcacacgatctatttaccccatcgcaaccggcaggggcgataagcacagaaccagaatggtagaggtcccctgacaaagcctatcacattcctcttatgacgctatgaggccccct

SEQ ID NO: 417483 - DNA, 1311 bp, Homo sapiens
  misc_feature (5)..(5): n is a, c, g, or t
tctanagtcccatctattttgtctttgatccaaactcctaaatgtttgtgcacacatttctcggtgacaacgttgggaaacacagcaacaggacttcattattctgttccttcctgtcattatggaaaccagccatcaacctatggagtgatggcaggtagtttaaccccttgtctttataaatttcctgaccacaccttgagtcatggatttcctcctatacaccagcctcttctggcagaggaccccacagctgctgatttcaagcaggaactcaggcggaaaagtaaattggtggaagagccaatagacatggattctccagaaatcagagaacttgaaaagtttgccaatgaatttaaagtgagacgaattaaattaggatacacccagacaaatgttggggaggccctggcagctgtgcatggctctgaattcagtcaaacaacaatctgccgatttgaaaatctgcagctcagctttaaaaatgcatgcaaactgaaagcaatattatccaaatggctggaggaagctgagcaagtaggagctttgtacaatgaaaaagtgggagcaaatgaaaggaaaagaaaacgaagaacaactataagcattgctgctaaagatgctctggagagacactttggagaacagaataaaccttcttctcaagagatcatgaggatggctgaagaactgaatctggagaaagaagtagtaagagtttggttttgcaaccggaggcagagagaaaaacgggtgaaaacaagtctgaatcagagtttattttctatttctaaggaacatcttgagtgcagataagatttttctattgtataatagcctttttctcccgtttcattcctttctcttcctcaacaaaaacagaaattacttggttgacttaaaatcattttatatcaatagcttttacagaagctttacttttccacttttttttaaaaaaaagaaaccaacaatttaaattatattgatgttatttacttaaaataattattctcagaagccacattatctattttaagccaaatatattaacagtaataaaatgatctctctgtctctcccgctctctttctcacacacacgcagacatatgagtatgggtttataagttccttttccaaacatgtatattagctttttaacatgtaagtcagtaatgacacatatgtaaagcacatcaccagaaatatccaattcaaaaattaaccaatgttctgctttctaccaactctactaatttgtctgaactaaaagttttgaacttaagagctggaggtgtcttatagt

SEQ ID NO: 417484 - DNA, 332 bp, Homo sapiens
ggagttcaagatcagcctgggcctcataaggagacccccatctctttatttaaaaaataaaataaaactacatgccggccaagagcagtggctcacgcctgtaatcccagcactttgggaggctgaggcaggtggatcacctgaggtcaggagtttgaaatcagcctgaccaatatggtgaaaccccgtctctaataaaaatataaaaattagccaggcatggtggcgtgcatctgtaaacccagctgcttggaaggctgaggcaggagaatcacttgaacccgggaggcagaggttgcagtgagccattgcactccagcctgggcaacaag

SEQ ID NO: 417485 - DNA, 353 bp, Homo sapiens
agtctcttcttacctaattagaaaaaaaatctagtcaaacaattataataatggggaagtcatatacaaaatacagagggtaccacttcagagtgtcctaagctgtgaatgagtgcttaccagcatcttacttccacgttcctgtttgtcatttcattgagtatgtgtatgtggcttcatatattgttattaacagggaacagattatgaaaagctgatgtactttttcctggggaaactgtcagtatttaccacttactattgtgaaagatttaactaaggcactcatcttaaattcttatgttttattggatttaaaaattattttcattggcttgattgtatttgaaatc

SEQ ID NO: 417486 - DNA, 459 bp, Homo sapiens
taaatatgagatggctgttgtgaagagaaggaagtcagttttttctcagtataattgtaaactttaaaaaaaattaaatcatcttccacttaatccccgagacttcccataatgtttagtaatacggacatgtgcaaagaattaaatcgtataattaaacaaaattttgtcaagttaactttgcttctcaaataaggaagttatataattaaacacatttgcttgtacctaatgagacgttagcatcaacatgactgtatatcatttccagaatttaattcaattagttattggctgagggatgaaatagagatgaaactaaatcctggcctcaaactagttttgtaccttattttccagcaatttggtttttttatatctagattttatctttactattttccctcatcttacccattcttagtctccatacacacctattaactttaatttcctttt

SEQ ID NO: 417487 - DNA, 663 bp, Homo sapiens
aagggagatactctatcattcttcatgtattagctgaagtagtctatgaagggagacttcccctcatctaccatttcattacccggtggtacagtttgatgaggaaaggcagagtgagcatttagatctcttcctacatttaccagttctcaaaaacagctacttcatccagggctttatttaaacattttcctagacacttgataaacatcttttttgtgtagagaactgcgctgggcactctgacggctacaaaggtgagttgggcacagtgcctgcatttaaggagctccccgtctaatcaagcaagacagaactgggcacaagtaataggaagcagtaactgaaaagatctggggctagaggcaatgctgtatggtaggagaatggactatatatcctttatattgcaaattggaacactggggtattggtgccacttttaaattccgtccaaattgtacatttaaaggtggagaatctcttttgagtatggaggaggagcagtgcagttgtgagtggagtgtgtgaggagttgggagggtggtttctggtagaagtgtgtttaattagccggctctcccattcctgttttccagacctggtatactgatgggagcaagactggcgcatcttagtcccatcagtagtaaaaaccatacc

SEQ ID NO: 417488 - DNA, 2589 bp, Homo sapiens
ggaccagagccggtagcgaggttgggagagacggagcggacctcagcgctgaagcagaagtccccggagctgcggtctccccgccgcggctgagccatgcggctccctgacctgagaccctggacctccctgctgctggtggacgcggctttactgtggctgcttcagggccctctggggactttgcttcctcaagggctgccaggactatggctggaggggaccctgcggctgggagggctgtgggggctgctaaagctaagagggctgctgggatttgtggggacactgctgctcccgctctgtctggccacccccctgactgtctccctgagagccctggtcgcgggggcctcacgtgctcccccagccagagtcgcttcagccccttggagctggctgctggtggggtacggggctgcggggctcagctggtcactgtgggctgttctgagccctcctggagcccaggagaaggagcaggaccaggtgaacaacaaagtcttgatgtggaggctgctgaagctctccaggccggacctgcctctcctcgttgccgccttcttcttccttgtccttgctgttttgggtgagacattaatccctcactattctggtcgtgtgattgacatcctgggaggtgattttgacccccatgcctttgccagtgccatcttcttcatgtgcctcttctcctttggcagctcactgtctgcaggctgccgaggaggctgcttcacctacaccatgtctcgaatcaacttgcggatccgggagcagcttttctcctccctgctgcgccaggacctcggtttcttccaggagactaagacaggggagctgaactcacggctgagctcggataccaccctgatgagtaactggcttcctttaaatgccaatgtgctcttgcgaagcctggtgaaagtggtggggctgtatggcttcatgctcagcatatcgcctcgactcaccctcctttctctgctgcacatgcccttcacaatagcagcggagaaggtgtacaacacccgccatcaggaagtgcttcgggagatccaggatgcagtggccagggcggggcaggtggtgcgggaagccgttggagggctgcagaccgttcgcagttttggggccgaggagcatgaagtctgtcgctataaagaggcccttgaacaatgtcggcagctgtattggcggagagacctggaacgcgccttgtacctgctcgtaaggagggtgctgcacttgggggtgcagatgctgatgctgagctgtgggctgcagcagatgcaggatggggagctcacccagggcagcctgctttcctttatgatctaccaggagagcgtggggagctatgtgcagaccctggtatacatatatggggatatgctcagcaacgtgggagctgcagagaaggttttctcctacatggaccgacagccaaatctgccttcacctggcacgcttgcccccaccactctgcagggggttgtgaaattccaagacgtctcctttgcatatcccaatcgccctgacaggcctgtgctcaaggggctgacgtttaccctacgtcctggtgaggtgacggcgctggtgggacccaatgggtctgggaagagcacagtggctgccctgctgcagaatctgtaccagcccacagggggacaggtgctgctggatgaaaagcccatctcacagtatgaacactgctacctgcacagccaggtggtttcagttgggcaggagcctgtgctgttctccggttctgtgaggaacaacattgcttatgggctgcagagctgcgaagatgataaggtgatggcggctgcccaggctgcccacgcagatgacttcatccaggaaatggagcatggaatatacacagatgtaggggagaaggggagccagctggctgcgggacagaaacaacgtctggccattgcccgggcccttgtacgagacccgcgggtcctcatcctggatgaggctactagtgccctagatgtgcagtgcgagcaggccctgcaggactggaattcccgtggggatcgcacagtgctggtgattgctcacaggctgcaggcagttcagcgcgcccaccagatcctggtgctccaggagggcaagctgcagaagcttgcccagctccaggagggacaggacctctattcccgcctggttcagcagcggctgatggactgaggccccagggatactgggccctcttctcaggggcgtctccaggacccagagctgttcctgctttgagtttccctagagctgtgcggccagatagctgttcctgagttgcaagcacgatggagatttggacactgtgtgcttttggtggggtggagaggtggggtggggtggggtgtggtggggtggaggctgtctgtgtccaggaaacttaattccctggtgactagagctttgcctggtgatgaggagtattttgtggcataatacatatattttaaaatattttccttcttacgtgaactgtatacattcatatagaaaatttagacaatataaaaaagtacaaagaagaaaagtaaaagtacccattgtttcacttcc

SEQ ID NO: 417489 - DNA, 475 bp, Homo sapiens
aggactgagaggtgtcagagctgctggtgacaggagcagggaaagcaccatctggccagcccccaggggccccctgtagggttcctctgcctggcagcgtttcgacgcttcttggcaggatccttgggtccttggcccccggcaccatctccctccttgacctgctgaggcccacataaaacatgttgctacttggggtgggcccgtcctcacgctctgtggcttcctgggtgtccacctccccacagcctgcctcacctacctccccagacttctcacgcacgtcaggagcctcctgtggactctggctctacctgcctctggcctctgcttaatcaggaacccacagtgggaaagctcctagggcccgcctgctgaagcaaacgcctccttgcaaagcccgtctgcagccccccacacacctcctcacctccctgtgcttcctctggagcccaagaccagtctgcctcacttg

SEQ ID NO: 417490 - DNA, 563 bp, Homo sapiens
attttcattcattcaacaaatacttattgagcatctgtggtggcccaggtcctctgtgaagcactgagaattcatccattaacaataaagaataagtccttgtttctaggagtgttcagtcttttccagcagagaggtagcagaggatcacacacattgactaacttgtaagagtggaggaaaatgttaggatagagaagtgcaggagagtctaattaaatactgtcgtcagccaacgctttcctgaagaagtgactagctttgctcaggaactgaaagaaggcctctggctgcagcatcgttgccaaaaggggaagctgagccagacaggcctgatcagggagccacagctggaccctctgaagatggctcagatccatgaagcatttggaaaaccactagagttttaagcaagacaggctaatgaaatgctgatatcttataaaggggaccttttttctttacatttctgacggtttttatcagaatgtatgtattaatgctatttgtctttgtatatttattttatttccacctgggtgacagagtgagactccgtctca

SEQ ID NO: 417491 - DNA, 1651 bp, Homo sapiens
attttcattcattcaacaaatacttattgagcatctgtggtggcccaggtcctctgtgaagcactgagaattcatccattaacaataaagaataagtccttgtttctaggagtgttcagtcttttccagcagagaggtagcagaggatcacacacattgactaacttgtaagagtggaggaaaatgttaggatagagaagtgcaggagagtctaattaaatactgtcgtcagccaacgctttcctgaagaagtgactagctttgctcaggaactgaaagaaggcctctggctgcagcatcgttgccaaaaggggaagctgagccagacaggcctgatcagggagccacagctggaccctctgaagatggctcagatccatgaagcatttggaaaaccactagagttttaagcaagacaggctaatgaaatgctgatatcttataaaggggaccttttttctttacatttctgacggtttttatcagaatgtatgtattaatgctatttgtctttgtatatttattttatttccagccactttacaaaactctttagctttgaaagtttttctgttgattttcttggattttccagctcatctacaaataatgatcgttttgtctgcaccttttcaatatacctctttagtctgttcctgtattgcatagttagaacctctaaagtaatgtttttaaggaatagcagtgcagctgagcttcctaattttatctctagttcagaggatgttaactttttgggggtcatggatcctgttgaaaatgtgatgaaagcttggagtctctcccatcctgaagcatacttgcctcatatgtatgcacagaccttcccccagccctcatttcaactgcagatccccatcaggttcctgttggactaaggttaagttgtctctagtatttgctgtttgtttctgataaccatgttttatcatgttcagattcttttttattcatccttgtatgctaatgtttgttttaaatcaaaaaatcaattttatcatgccttttcagcatctatcaagatggtcatgtaatctaacctttcaactgctacagtgctctcacttatattcacagatttcctaatgttgatcaacacttaacatttctggaatatatcctgatggtcattatgttttgtttactgtgctgctagttttaatctacatcacacatagagttgttgcagctttcttataaggaaaataacttttaaaaatattttttaagttttggttttggagttttgctattctgggaaggtaccttttactacaacaagtaaacatgcataataaagtaggattcatccaatgtctgacctttctttgcatcaaaagaacatttccggccaggcacggtggctcacgcctgtaatcccagcactttgggaggccgagccaggtggatcacgaggtcaggagatcgagaccagcctggctaacatggtgaaaccctgtctctactaaaaatacaaaaatgagccgggcatggtgggggggcaccgtagtcccagctacttgagaggctgagacaggagaatggcgtgaacccggggggcggagcttgtagtgagccgagatcgcgccactgcactccagcctgggtgacagagtgagactccgtctca

SEQ ID NO: 417492 - DNA, 1521 bp, Homo sapiens
tctgcccttgttaattaccggagcgacagactagggagctccgcccgggatttgcccatcggcggaggcgccaggctcccgtttctccccatccctctcgctgccgtccaggtgcaccgcctgcctctcagcaggatggacgtgatggatggctgccagttctcaccttctgagtacttctacgacggctcctgcataccgtcccccgagggtgaatttggggacgagtttgtgccgcgagtggctgccttcggagcgcacaaagcagagctgcagggctcagatgaggacgagcacgtgcgagcgcctaccggccaccaccaggctggtcactgcctcatgtgggcctgcaaagcctgcaagaggaagtccaccaccatggatcggcggaaggcagccactatgcgcgagcggaggcgcctgaagaaggtcaaccaggctttcgaaaccctcaagaggtgtaccacgaccaaccccaaccagaggctgcccaaggtggagatcctcaggaatgccatccgctacatcgagagcctgcaggagttgctgagagagcaggtggagaactactatagcctgccgggacagagctgctcggagcccaccagccccacctccaactgctctgatggcatgcccgaatgtaacagtcctgtctggtccagaaagagcagtacttttgacagcatctactgtcctgatgtatcaaatgtatatgccacagataaaaactccttatccagcttggattgcttatccaacatagtggaccggatcacctcctcagagcaacctgggttgcctctccaggatctggcttctctctctccagttgccagcaccgattcacagcctcgaactccaggggcttctagttccaggcttatctatcatgtgctatgaactaattttctggtctatatgacttcttccaggagggcctaatacacaggacgaagaaggcttcaaaaagtcccaaaccaagacaacatgtacataaagatttcttttcagttgtaaatttgtaaagattaccttgccactttataagaaagtgtatttaactaaaaagtcatcattgcaaataatactttcttcttctttattattctttgcttagatattaatacatagttccagtaatactatttctgatagggggccattgattgagggtagcttgttcgcaatgcttaacttatatatacatatatatatattataaatattgctcatcaaaatgtctctggtgtttagagctttatttttttctttaaaacattaaaacagctgagaatcagttaaatggaattttaaatatatttaactatttcttttctctttaatcctttagttatattgtattaaataaaaatataatactgcctaatgtatatattttgatcttttcttgtaagaaatgtatcttttaaatgtaagcacaaaatagtactttgtggatcatttcaagatataagaaattttggaaattccaccataaataaaattttttactacaag

SEQ ID NO: 417493 - DNA, 299 bp, Homo sapiens
gagagagagagactccatatcaaaaaaatgataataataaaaataaataaataaaaaataaaataaccaagtttaatgtatttttactacagtcagtttcttagttcatttgtactgctttaacagtacctgagacctggtaatttaaaaagaacagtagttggccgggcacagtggctcacacctataatctcagcactttgggaggctcaggtgagtggatcacttgagtccaggagttcaagaccactctgggcaacatagggagaccccatctctacaaaaaataataataataa

SEQ ID NO: 417494 - DNA, 468 bp, Homo sapiens
gtgagcattagtgtcctgatgtataatgtggcagtaacaaccctatctaccttatagggttgctaggaagattaagtgcaataatcaatgtaaagtacttagcacagttcttgtctcatagtaagccctcagtaaatgagaataatgacaataatggtaattattgatgctgttcttttacctacctagtaattagaccctgtttggtttataatttggtatatgtaggctccaaggaaatagtatccatttaggattttactaatcttaattgctctcaaaactagaacatctgtttaactcataaaattttccccttggctttttccattaaaacgttcattgatgctcccctgggccctttttaaaatgtatacaagaatctaatgttaacaccaatgaagaaggtttagtggaaagtaacaatgatgtgtcatttgtctggtattaaaaagaagtgcctatgag

SEQ ID NO: 417495 - DNA, 981 bp, Homo sapiens
cggcgtctgcgcagctgccagcgcctttaagcccgggctcgcgctctcggaccgtgctttcgccgcctgggagccgtccggcgcagcagtttctaggtccccactgtccccgccgtcccgccccttcgcgtcccgggaaccggctggcttccgagccgcactcgccgatcctccaggcatgccccgctacgagctggctttaatcctgaaagccatgcagcggccagagactgctgctactttgaaacgtacgatagaggccctgatggacagaggagcaatagtgagggacttggaaaacctgggtgaacgagcgcttccttataggatctctgcccacagtcagcagcacaacagaggcgggtatttcttggtggatttttatgcacccaccgcagctgttgaaagcatggtggagcacttgtctcgagatatagatgtgattagagggaatattgtcaaacaccctctgacccaggaactaaaagaatgtgaagggattgtcccagtcccactcgcagaaaaattatattccacaaagaagaggaagaagtgagaagattcgccagattttagccttatatgtaattccttcacatttgggcagcatggacgagaaggaagaatttgcaagtttggcctttatataagcatgtgttgcaggtgctgtttgatttttctaaggtatttttagcccttgatcccctttgcttgcgagaggtggggaactgctcactgacagcttctctgtaacctgcagtaccagtggatcattcttgattttgttttcattagtgtcatttctttgtcattgaggacttttccccttacaacagtaacaccattttttgaagagcaaaacttataatacctcctgggattgtgagctagtcattcagcctgtgtaaccatgtggaaataaaaattgacgaccaatgtattatatggacaacttttgctttgagtaataaacttgattgg

SEQ ID NO: 417496 - DNA, 5799 bp, Homo sapiens
gcaatagcaatggtgctgtgtccttcggcctaaattcaatagatctcatctcctagggcttccttttcacttggctcaaaggatccattgtattttggcacaaagagcctggccagggtcatgtagccatagctcttagggatgatacctcaagaaattagctgggacccatcactctgtgaaacttcacattttaagaactgagttgagggggttgttatgcacttctgtaacttgaggctaagcaaggggttaactcttgtgagagccaatagagtgtgtctgtattcgcagtccatggctcattttctttatagtaggcatatggatcttcccctctgactttgaatatcatttggtgtggcctgtgggttattttcattctttaccaccaaataaagcggcttattagctactcagttacttgctactcaaaggttaggtcttccctgttcctgcttggcagtgttaaagcttacagggttaacttatgatgattctcctggctcattttcatcagaggcatgatgactggaaagggatcacatgggtcgttggtggtgacacctcactgtttcctaggtttggatagagagatgtatacaagacctttcctgttaaattacgtgactacagagacttgccaggacaaaattttcctaagaaatcagaaaaatgattaagtgagataagtacctgggtgacacagatattagcccgttggtaaaagacaacaaatattagcttaaaatctgcatatgtagaatcattttcattagatttagagcttgaagcaccttggctctcagctactttaaactcctccccatataaatcagggcaccaataaataagtttcagctttttaaaccctggtttgatgttaagcattataaagtacgaagtttgttaccacagtagagataatttagtagaaaaatgctttgaggcttcagtatttgtaagattttgcattagccagatgctaggttgttgaaggcatttcagtgttgataatagcctgagcagacttctttacaaatgggatctgtttctatatgtgtatatgcccacttaccattcagagagactggtctttctctttgtcttccttcacattgctgtgtcagttctacacctagtcttttcagcacttagcaaattcaaattttgatttttttgtcagcttagttcactttaaggcatattggcatggtgtgtgaaagtgatgttttgccccagtattgaggacttttagatccaaataatgactcattaaatataattatgttttaagtatactgaatttctgttagcttaaaatgttaattctcaggaatgattttctcacactttgtgttggctaataataaaagcactgttttattctcaaaactcctttttcaaaaattagggagagagcagtagtgatcatttatgtgagcccctttgaaatgatggtgtcagagtgcagagaaacaatggagttttgatgccaaaaaggtttttttgcagtaaaagtaaaaatttggaattagttggcatatagaggaacccttttgtactggaacgtatgaggctggattgtgaaaaggtaatctttcgattgctagacttggttaacttagggctgcaaatctttttcttctatcaaggtcacttaatatggaatgtttttgtcagactgtcctttgttggaatactttagctgttcagctactttgactcctaggagagaatttagttaaggttcaaagtaattaactggctttgccagtggtgagtcccacaccattattcacttagtagtcatataaatgtttttatttaaacttctctctcttcaatgctgagaataaggctttaaattactgattcacctttaaaggaatgttgtgagaattgatgtaatttctgtttctgtttccatctaaacttctttataaaaagagggattagtttttttgttttggggtaagcacctaatttatccagtaaccaacaaccctaaccattggcatatatagtctttcactcagaaataaacaaaaactgtttggtatatctgtatcattgctaatcttgtgcactttactttttgggcagtaccatacatagtctgaggctattgacttaaaccaataactgtactttatgtaatgactcttaaatttggttacctgggttcacagcttgcttgaagagaaaggatgctagaataaagtaagcagctgaagagcgagcaaatcaagacaaaacacagtggtctcagatttttcgtagtgtgggaacagtggttttgctctataccactgaaaagcactataacataattgttgtccatgatactgaagcttttcccctcacttctaggttgtttacattcagagctctatcaataagaggaatacatattacagtgaattcgacaaccgcacaagttggcagtaggtatccccaacctaatttatcttggtaaattcaccctgtttcctagtgctgctggataaaagagtgtttactttttattgctcttagacagagtagtctagataagttttcaatttatcaacatagcctagacttctgtaagtggaatgttcattagtaactcatctttttgttgttataattggaaacagaaacgaggcttattgctattgcagaaatcccaaactggcaaaggccagtatatatggtattccataatataaccagcttttgaaatttatgtgtttggattagtgccttctggttaccagtattgactctgctagtttgcacctttccgttcttaacagaaaatttgtatttgttattcctcttaaattttgtcgtaactagtgaaggaagtaaaaaaaaaaaaaaaaacatgcattacattgacatactttatgtgcagcctttatttaggttcagtgaaaccaggtagttctgtatttgtgttgtagcctaaatgttgtttcttttatatccattaaaaacttaaagttacttatgttctgtgatcttaattttgttgtgtttccattgtaggttgataggtatatcgagaacaggtacgtgacaacagtttatattccatgatagaaagctaaagtccatagaaagcacaaaatcgtgttcacacattagtgtacccacacatagaaagcacaagactaatagtattctctgtatcccacaagtgccagtcataaaggccaccaggtatttgtctcagagttgctatgagcactacagtattgataagcccaagacaatgcggtatctaaactggtcctaatggtaagggacccaaaggaataatctcaataagtttgtaccacattgatggagggagagaatataaatgtcaagaatgccaaaattatatttgggggttactagctaaaatggggtttgagggctttttactgcaacttgaaactggagaaatagggacagatgtctaggtttttggtgggtggaacaggtgacatatttctgttttaagctgtagtgtgattggggttttttgtaaaaaatcttaaatcttttaggaaatattacctcttaacagtgcccccccaaacatgcagaaagtcatactttaacagggcaaatactacttgtctttgattttttttgtgtacgtttgtatgtgagagatgaagttacctttatttttttcctatacttgactgtgcttcattttaataaaggataatttgatctgagtgttctgagcatcagactaattctgaagcatatttgctagaggagctactttgcttttcacaatggggtggagaggattctttcacttgtcccattaaccctcttctagtctagatgagatgaaatctgttaatgtgtgtgtagaagaaaacgtatgttcttctactcagcattgcccttttccacctcctcacttcacctccgagtagcttgtttatcaagaatgaatgaatgtctttgtcttaaattttgcccatgtgttaaaagatgtaattctcagaatgggagagaaatgactacctttgttcctactcttttatataattatccttttagggaaagacttggtcaactctaatatatctagaaggaagactatatctggtgtagactaatatgagatgttttagaagagttaacctgaacactttgagggagagattattcagctagcaaaaagctagccaggaatgagcctaccacattatttgagaatatcaaacctcaggcctggggggatgaggggaagaagattaccagaagtgcaggaaagagaagtttgaggaacacccttggcttagcaacatgtgataatgcaaagctgttataacctgttaatcctacgtactatgtgttctgtacctttacatgtttttaaatttaagatagtttgtaagaactgtacaaaaaaatgcttctggagatttctttggcagaaatgcctttcatctataatttcatggagaactgctttaattagcctaggtgaaaagtagtcctagcagtgtaaatatgtataattagagttttctaatttcactgtgagatctctaacttttgagtggcaaacagatcaagtcttttgctcatagacttttctgtggggttattaaaatgcaaaagctttattttttttaataatgccatactccattagtgtcagatgatggtatggaatttgttcccttgctttcccccactgttactgcttcagtttatagattgccagcagagttcagaaatagagcagggatttacccgttctttgcttggacatcccattttcttttgtccagacccatgttggcaatcatgtatgaactgtgttatacttctcagtgctttcttttttctttttgataagatggatatcaaaaatagttgctgtgcaaaagttagtagtcttcttcaagaagaaaaccaattctttttctaataatatcctgtgaaattgcttcattcattcatttatttttaagccaaatgtcagcagagtgctgctgcttttatctagtaattttgatatgtaagtattaatgcatttttaaaagatgtctacattgaaacatgttcttcccagtgtcctgcttatgatgctttgttcagattttttgtaagagaccagttagtacactgggggtgtatattgtgtacatgtgtcattttagttaggcattgtaggccaaatgtgattataaatgaagttgatgaacattaattttgttattagtgagttttttgaattgtaaatggatttccagtttaccttctgttgtctacagcttttttaattttaaggtttgactaattgtatccatctcattgtacagtgttttagttgcaagcagaaagtagaatttggtataaagcaggttatttctatattgaaaggagtacagttgaaattgtagatttaagattgttaaaatcatgacaattctaacttgtctattctaacctattgtgtacaatctgattttttaaaattgtaaacatgtatgatcttggtttcatgtgtttttgaaagtgttattgtttaaaaaatgaaaaaagcatatctgctaaagagctgtcagttttcattactgactctgtaaaatacactgttctttgtgtactgtgtgttattttgccagctgctgcattagccttcaaaagtatttggaaacttaagatgaactacatttcttgcaaagtacattcctttctgtggtattttgtcctgtaactgaagtatagtaattattttatggaaatgttagcaattctgtaccaactttgaataaaatgaaaaattta

SEQ ID NO: 417497 - DNA, 940 bp, Homo sapiens
cggcgtctgcgcagctgccagcgcctttaagcccgggctcgcgctctcggaccgtgctttcgccgcctgggagccgtccggcgcagcagtttctaggtccccactgtccccgccgtcccgccccttcgcgtcccgggaaccggctggcttccgagccgcactcgccgatcctccaggcatgccccgctacgagctggctttaatcctgaaagccatgcagcggccagagactgctgctactttgaaacgtacgatagaggccctgatggacagaggagcaatagtgagggacttggaaaacctgggtgaacgagcgcttccttataggatctctgcccacagtcagcagcacaacagaggcgggtatttcttggtggatttttatgcacccaccgcagctgttgaaagcatggtggagcacttgtctcgagatatagatgtgattagagggaatattgtcaaacaccctctgacccaggaactaaaagaatgtgaagggattgtcccagtcccactcgcagaaaaattatattccacaaagaagaggaagaagtgagaagattcgccagattttagccttatatgtaattccttcacatttgggcagcatggacgagaaggaagaatttgcaagtttggcctttatataagcatgtgttgcaggtgctgtttgatttttctaaggtatttttagcccttgatcccctttgcttgcgagaggtggggaactgctcactgacagcttctctgtaacctgcagtaccagtggatcattcttgattttgttttcattagtgtcatttctttgtcattgaggacttttccccttacaacagtaacaccattttttgaagagcaaaacttataatacctcctgggattgtgagctagtcattcagcctgtgtaaccatgtggaaataaaaattgacgaccaatgta

SEQ ID NO: 417498 - DNA, 3215 bp, Homo sapiens
gcaatagcaatggtgctgtgtccttcggcctaaattcaatagatctcatctcctagggcttccttttcacttggctcaaaggatccattgtattttggcacaaagagcctggccagggtcatgtagccatagctcttagggatgatacctcaagaaattagctgggacccatcactctgtgaaacttcacattttaagaactgagttgagggggttgttatgcacttctgtaacttgaggctaagcaaggggttaactcttgtgagagccaatagagtgtgtctgtattcgcagtccatggctcattttctttatagtaggcatatggatcttcccctctgactttgaatatcatttggtgtggcctgtgggttattttcattctttaccaccaaataaagcggcttattagctactcagttacttgctactcaaaggttaggtcttccctgttcctgcttggcagtgttaaagcttacagggttaacttatgatgattctcctggctcattttcatcagaggcatgatgactggaaagggatcacatgggtcgttggtggtgacacctcactgtttcctaggtttggatagagagatgtatacaagacctttcctgttaaattacgtgactacagagacttgccaggacaaaattttcctaagaaatcagaaaaatgattaagtgagataagtacctgggtgacacagatattagcccgttggtaaaagacaacaaatattagcttaaaatctgcatatgtagaatcattttcattagatttagagcttgaagcaccttggctctcagctactttaaactcctccccatataaatcagggcaccaataaataagtttcagctttttaaaccctggtttgatgttaagcattataaagtacgaagtttgttaccacagtagagataatttagtagaaaaatgctttgaggcttcagtatttgtaagattttgcattagccagatgctaggttgttgaaggcatttcagtgttgataatagcctgagcagacttctttacaaatgggatctgtttctatatgtgtatatgcccacttaccattcagagagactggtctttctctttgtcttccttcacattgctgtgtcagttctacacctagtcttttcagcacttagcaaattcaaattttgatttttttgtcagcttagttcactttaaggcatattggcatggtgtgtgaaagtgatgttttgccccagtattgaggacttttagatccaaataatgactcattaaatataattatgttttaagtatactgaatttctgttagcttaaaatgttaattctcaggaatgattttctcacactttgtgttggctaataataaaagcactgttttattctcaaaactcctttttcaaaaattagggagagagcagtagtgatcatttatgtgagcccctttgaaatgatggtgtcagagtgcagagaaacaatggagttttgatgccaaaaaggtttttttgcagtaaaagtaaaaatttggaattagttggcatatagaggaacccttttgtactggaacgtatgaggctggattgtgaaaaggtaatctttcgattgctagacttggttaacttagggctgcaaatctttttcttctatcaaggtcacttaatatggaatgtttttgtcagactgtcctttgttggaatactttagctgttcagctactttgactcctaggagagaatttagttaaggttcaaagtaattaactggctttgccagtggtgagtcccacaccattattcacttagtagtcatataaatgtttttatttaaacttctctctcttcaatgctgagaataaggctttaaattactgattcacctttaaaggaatgttgtgagaattgatgtaatttctgtttctgtttccatctaaacttctttataaaaagagggattagtttttttgttttggggtaagcacctaatttatccagtaaccaacaaccctaaccattggcatatatagtctttcactcagaaataaacaaaaactgtttggtatatctgtatcattgctaatcttgtgcactttactttttgggcagtaccatacatagtctgaggctattgacttaaaccaataactgtactttatgtaatgactcttaaatttggttacctgggttcacagcttgcttgaagagaaaggatgctagaataaagtaagcagctgaagagcgagcaaatcaagacaaaacacagtggtctcagatttttcgtagtgtgggaacagtggttttgctctataccactgaaaagcactataacataattgttgtccatgatactgaagcttttcccctcacttctaggttgtttacattcagagctctatcaataagaggaatacatattacagtgaattcgacaaccgcacaagttggcagtaggtatccccagagactgctgctactttgaaacgtacgatagaggccctgatggacagaggagcaatagtgagggacttggaaaacctgggtgaacgagcgcttccttataggatctctgcccacagtcagcagcacaacagaggcgggtatttcttggtggatttttatgcacccaccgcagctgttgaaagcatggtggagcacttgtctcgagatatagatgtgattagagggaatattgtcaaacaccctctgacccaggaactaaaagaatgtgaagggattgtcccagtcccactcgcagaaaaattatattccacaaagaagaggaagaagtgagaagattcgccagattttagccttatatgtaattccttcacatttgggcagcatggacgagaaggaagaatttgcaagtttggcctttatataagcatgtgttgcaggtgctgtttgatttttctaaggtatttttagcccttgatcccctttgcttgcgagaggtggggaactgctcactgacagcttctctgtaacctgcagtaccagtggatcattcttgattttgttttcattagtgtcatttctttgtcattgaggacttttccccttacaacagtaacaccattttttgaagagcaaaacttataatacctcctgggattgtgagctagtcattcagcctgtgtaaccatgtggaaataaaaattgacgaccaatgtattatatggacaacttttgctttgagtaataaacttgattgg

SEQ ID NO: 417499 - DNA, 2843 bp, Homo sapiens
  misc_feature (92)..(92): n is a, c, g, or t
atgagagctgtactggacacagcagacattgccatagtggccctgtattttatcctggtcatgtgcattggtttttttgccatgtggaaatntaatagaagcaccgtgagtggatacttcctggcggggcgctctatgacctgggtaacaattggtgcctctctgtttgtgagcaatattgggagtgagcacttcattgggctggcaggatctggagctgcaagtggatttgcagtgggcgcatgggaattcaatgccttactgcttttacaacttctgggatgggttttcatcccaatttacatccggtcaggggtatataccatgcctgaatacttgtccaagcgatttggtggccataggattcaggtctattttgcagccttgtctctgattctctatattttcaccaagctctcggtggatctgtattcgggtgccctttttatccaggagtctttgggttggaatctttatgtgtctgtcatcctgctcattggcatgactgctttgctgactgtcaccggaggccttgttgcagtgatctacacagacactctgcaggctctgctcatgatcattggggcacttacacttatgattattagcataatggagattggcgggtttgaggaagttaagagaaggtacatgttggcctcacccgatgtcacttccatcttattgacatacaacctttccaacacaaattcttgtaatgtctcccctaagaaagaagccctgaaaatgctgcggaatccaacagatgaagatgttccttggcctggattcattcttgggcagaccccagcttcagtatggtactggtgtgctgaccaagtcatcgtgcagagggtccttgcagccaaaaacattgctcatgccaaaggctctactcttatggctggcttcttaaagctcctgccaatgtttatcatagttgtcccaggaatgatttccaggatactgtttactgatgatatagcttgcatcaacccagagcactgcatgctggtgtgtggaagcagagctggttgctccaatattgcttacccacgcctggtgatgaagctggttcctgtgggccttcggggtttaatgatggcagtgatgattgcagctctgatgagtgacttagactctatctttaacagtgccagtaccatattcaccctcgatgtgtacaaacttatccgcaagagcgcaagctcccgggagttaatgattgtggggaggatatttgtggcatttatggtggtgatcagcatagcatgggtgccaatcatcgtggagatgcaaggaggccagatgtacctttacattcaggaggtagcagattacctgacacccccagtggcagccttgttcctgctggcaattttctggaagcgctgcaatgaacaaggggctttctatggtggaatggctggctttgttcttggagcagtccgtttgatactggcctttgcctaccgtgccccagaatgtgaccaacctgataataggccgggcttcatcaaagacatccattatatgtatgtggccacaggattgttttgggtcacgggactcattactgtaattgtgagccttctcacaccacctcccacaaaggaacagattcgaaccaccaccttttggtctaagaagaacctggtggtgaaggagaactgctccccaaaagaggaaccataccaaatgcaagaaaagagcattctgagatgcagtgagaataatgagaccatcaaccacatcattcccaacgggaaatctgaagacagcattaagggccttcagcctgaagatgttaatctgttggtaacctgcagagaggagggcaacccagtggcatccttaggtcattcagaggcagaaacaccagttgacgcttactccaatgggcaagcagctctcatgggtgagaaagagagaaagaaagaaacggatgatggaggtcggtactggaagttcatagactggttttgtggctttaaaagtaagagcctcagcaagaggagtctcagagacctgatggaagaggaggctgtttgtttacagatgctagaagagactcggcaagttaaaccagagactgctgctactttgaaacgtacgatagaggccctgatggacagaggagcaatagtgagggacttggaaaacctgggtgaacgagcgcttccttataggatctctgcccacagtcagcagcacaacagaggcgggtatttcttggtggatttttatgcacccaccgcagctgttgaaagcatggtggagcacttgtctcgagatatagatgtgattagagggaatattgtcaaacaccctctgacccaggaactaaaagaatgtgaagggattgtcccagtcccactcgcagaaaaattatattccacaaagaagaggaagaagtgagaagattcgccagattttagccttatatgtaattccttcacatttgggcagcatggacgagaaggaagaatttgcaagtttggcctttatataagcatgtgttgcaggtgctgtttgatttttctaaggtatttttagcccttgatcccctttgcttgcgagaggtggggaactgctcactgacagcttctctgtaacctgcagtaccagtggatcattcttgattttgttttcattagtgtcatttctttgtcattgaggacttttccccttacaacagtaacaccattttttgaagagcaaaacttataatacctcctgggattgtgagctagtcattcagcctgtgtaaccatgtggaaataaaaattgacgaccaatgtattatatggacaacttttgctttgagtaataaacttgattgg

SEQ ID NO: 417500 - DNA, 887 bp, Homo sapiens
gaggagaaggaaggcatggaaagttccagccggttcgagagctaggttgtttacattcagagctctatcaataagaggaatacatattacagtgaattcgacaaccgcacaagttggcagtaggtatccccagagactgctgctactttgaaacgtacgatagaggccctgatggacagaggagcaatagtgagggacttggaaaacctgggtgaacgagcgcttccttataggatctctgcccacagtcagcagcacaacagaggcgggtatttcttggtggatttttatgcacccaccgcagctgttgaaagcatggtggagcacttgtctcgagatatagatgtgattagagggaatattgtcaaacaccctctgacccaggaactaaaagaatgtgaagggattgtcccagtcccactcgcagaaaaattatattccacaaagaagaggaagaagtgagaagattcgccagattttagccttatatgtaattccttcacatttgggcagcatggacgagaaggaagaatttgcaagtttggcctttatataagcatgtgttgcaggtgctgtttgatttttctaaggtatttttagcccttgatcccctttgcttgcgagaggtggggaactgctcactgacagcttctctgtaacctgcagtaccagtggatcattcttgattttgttttcattagtgtcatttctttgtcattgaggacttttccccttacaacagtaacaccattttttgaagagcaaaacttataatacctcctgggattgtgagctagtcattcagcctgtgtaaccatgtggaaataaaaattgacgaccaatgtattatatggacaacttttgctttgagtaataaacttgattgg

SEQ ID NO: 417501 - DNA, 975 bp, Homo sapiens
aaaagaaggctgctgggcttaaaatgtcatgagaccaagagacagtggagcaatgcatgtttgaaaagggaaagagaaaagaagctcagaaggaattccaatattcagatgtgacatatagaagaaagtgtcgacatgaaagaattatccgccagagaattcagaggaaaatcaagaatgcattatatcatgaaagtaaagaaaggataatgacccaccagagactgctgctactttgaaacgtacgatagaggccctgatggacagaggagcaatagtgagggacttggaaaacctgggtgaacgagcgcttccttataggatctctgcccacagtcagcagcacaacagaggcgggtatttcttggtggatttttatgcacccaccgcagctgttgaaagcatggtggagcacttgtctcgagatatagatgtgattagagggaatattgtcaaacaccctctgacccaggaactaaaagaatgtgaagggattgtcccagtcccactcgcagaaaaattatattccacaaagaagaggaagaagtgagaagattcgccagattttagccttatatgtaattccttcacatttgggcagcatggacgagaaggaagaatttgcaagtttggcctttatataagcatgtgttgcaggtgctgtttgatttttctaaggtatttttagcccttgatcccctttgcttgcgagaggtggggaactgctcactgacagcttctctgtaacctgcagtaccagtggatcattcttgattttgttttcattagtgtcatttctttgtcattgaggacttttccccttacaacagtaacaccattttttgaagagcaaaacttataatacctcctgggattgtgagctagtcattcagcctgtgtaaccatgtggaaataaaaattgacgaccaatgtattatatggacaacttttgctttgagtaataaacttgattgg

SEQ ID NO: 417502 - DNA, 1017 bp, Homo sapiens
tctgacccatgtactaaaagaatgtgaagggattgtccccgtcccactcgcagttatattatattccaccaagaagaggaagaagtgagaagattcgtcagattttagcctgatatgtaattccgtcacatttgggcagcatggacgagaaggaagaatttgcaagtttggcctttatataagcatgtgttgcaggtgctgtttgatttttctaaggtatttttagcccttgatcccctttgcttgcgagaggtggggaccagagactgctgctactttgaaacgtacgatagaggccctgatggacagaggagcaatagtgagggacttggaaaacctgggtgaacgagcgcttccttataggatctctgcccacagtcagcagcacaacagaggcgggtatttcttggtggatttttatgcacccaccgcagctgttgaaagcatggtggagcacttgtctcgagatatagatgtgattagagggaatattgtcaaacaccctctgacccaggaactaaaagaatgtgaagggattgtcccagtcccactcgcagaaaaattatattccacaaagaagaggaagaagtgagaagattcgccagattttagccttatatgtaattccttcacatttgggcagcatggacgagaaggaagaatttgcaagtttggcctttatataagcatgtgttgcaggtgctgtttgatttttctaaggtatttttagcccttgatcccctttgcttgcgagaggtggggaactgctcactgacagcttctctgtaacctgcagtaccagtggatcattcttgattttgttttcattagtgtcatttctttgtcattgaggacttttccccttacaacagtaacaccattttttgaagagcaaaacttataatacctcctgggattgtgagctagtcattcagcctgtgtaaccatgtggaaataaaaattgacgaccaatgtattatatggacaacttttgctttgagtaataaacttgattgg

SEQ ID NO: 417503 - DNA, 1039 bp, Homo sapiens
cggcgtctgcgcagctgccagcgcctttaagcccgggctcgcgctctcggaccgtgctttcgccgcctgggagccgtccggcgcagcagtttctaggtccccactgtccccgccgtcccgccccttcgcgtcccgggaaccggctggcttccgagccgcactcgccgatcctccaggcatgccccgctacgagctggctttaatcctgaaagccatgcagcggccagagactgctgctactttgaaacgtacgatagaggccctgatggacagaggagcaatagtgagggacttggaaaacctgggtgaacgagcgcttccttataggatctctgcccacagtcagcagcacaacagaggcgggtatttcttggtggatttttatgcacccaccgcagctgttgaaagcatggtggagcacttgtctcgagatatagatgtgattagagggaatattgtcaaacaccctctgacccaggaactaaaagaatgtgaagggattgtcccagtcccactcgcagaaaaattatattccacaaagaagaggaagaagtgagaagattcgccagattttagccttatatgtaattccttcacatttgggcagcatggacgagaaggaagaatttgcaagtttggcctttatataagcatgtgttgcaggtgctgtttgatttttctaaggtatttttagcccttgatcccctttgcttgcgagaggtggggaactgctcactgacagcttctctgtaacctgcagtaccagtggatcattcttgattttgttttcattagtgtcatttctttgtcattgaggacttttccccttacaacagtaacaccattttttgaagagcaaaacttataatacctcctgggattgtgagctagtcattcagcctgtgtaaccatgtggaaataaaaattgacgaccaatgtattatatggacaacttttgctttgagtaataaacttgattggaaaaaaaaaaaaaaaaaaaaaaaaaaaaaaaaaaaaaaaaaaaaaaaggggggggggg

SEQ ID NO: 417504 - DNA, 5857 bp, Homo sapiens
gcaatagcaatggtgctgtgtccttcggcctaaattcaatagatctcatctcctagggcttccttttcacttggctcaaaggatccattgtattttggcacaaagagcctggccagggtcatgtagccatagctcttagggatgatacctcaagaaattagctgggacccatcactctgtgaaacttcacattttaagaactgagttgagggggttgttatgcacttctgtaacttgaggctaagcaaggggttaactcttgtgagagccaatagagtgtgtctgtattcgcagtccatggctcattttctttatagtaggcatatggatcttcccctctgactttgaatatcatttggtgtggcctgtgggttattttcattctttaccaccaaataaagcggcttattagctactcagttacttgctactcaaaggttaggtcttccctgttcctgcttggcagtgttaaagcttacagggttaacttatgatgattctcctggctcattttcatcagaggcatgatgactggaaagggatcacatgggtcgttggtggtgacacctcactgtttcctaggtttggatagagagatgtatacaagacctttcctgttaaattacgtgactacagagacttgccaggacaaaattttcctaagaaatcagaaaaatgattaagtgagataagtacctgggtgacacagatattagcccgttggtaaaagacaacaaatattagcttaaaatctgcatatgtagaatcattttcattagatttagagcttgaagcaccttggctctcagctactttaaactcctccccatataaatcagggcaccaataaataagtttcagctttttaaaccctggtttgatgttaagcattataaagtacgaagtttgttaccacagtagagataatttagtagaaaaatgctttgaggcttcagtatttgtaagattttgcattagccagatgctaggttgttgaaggcatttcagtgttgataatagcctgagcagacttctttacaaatgggatctgtttctatatgtgtatatgcccacttaccattcagagagactggtctttctctttgtcttccttcacattgctgtgtcagttctacacctagtcttttcagcacttagcaaattcaaattttgatttttttgtcagcttagttcactttaaggcatattggcatggtgtgtgaaagtgatgttttgccccagtattgaggacttttagatccaaataatgactcattaaatataattatgttttaagtatactgaatttctgttagcttaaaatgttaattctcaggaatgattttctcacactttgtgttggctaataataaaagcactgttttattctcaaaactcctttttcaaaaattagggagagagcagtagtgatcatttatgtgagcccctttgaaatgatggtgtcagagtgcagagaaacaatggagttttgatgccaaaaaggtttttttgcagtaaaagtaaaaatttggaattagttggcatatagaggaacccttttgtactggaacgtatgaggctggattgtgaaaaggtaatctttcgattgctagacttggttaacttagggctgcaaatctttttcttctatcaaggtcacttaatatggaatgtttttgtcagactgtcctttgttggaatactttagctgttcagctactttgactcctaggagagaatttagttaaggttcaaagtaattaactggctttgccagtggtgagtcccacaccattattcacttagtagtcatataaatgtttttatttaaacttctctctcttcaatgctgagaataaggctttaaattactgattcacctttaaaggaatgttgtgagaattgatgtaatttctgtttctgtttccatctaaacttctttataaaaagagggattagtttttttgttttggggtaagcacctaatttatccagtaaccaacaaccctaaccattggcatatatagtctttcactcagaaataaacaaaaactgtttggtatatctgtatcattgctaatcttgtgcactttactttttgggcagtaccatacatagtctgaggctattgacttaaaccaataactgtactttatgtaatgactcttaaatttggttacctgggttcacagcttgcttgaagagaaaggatgctagaataaagtaagcagctgaagagcgagcaaatcaagacaaaacacagtggtctcagatttttcgtagtgtgggaacagtggttttgctctataccactgaaaagcactataacataattgttgtccatgatactgaagcttttcccctcacttctaggttgtttacattcagagctctatcaataagaggaatacatattacagtgaattcgacaaccgcacaagttggcagtaggtatccccaacctaatttatcttggtaaattcaccctgtttcctagtgctgctggataaaagagtgtttactttttattgctcttagacagagtagtctagataagttttcaatttatcaacatagcctagacttctgtaagtggaatgttcattagtaactcatctttttgttgttataattggaaacagaaacgaggcttattgctattgcagaaatcccaaactggcaaaggccagtatatatggtattccataatataaccagcttttgaaatttatgtgtttggattagtgccttctggttaccagtattgactctgctagtttgcacctttccgttcttaacagaaaatttgtatttgttattcctcttaaattttgtcgtaactagtgaaggaagtaaaaaaaaaaaaaaaaacatgcattacattgacatactttatgtgcagcctttatttaggttcagtgaaaccaggtagttctgtatttgtgttgtagcctaaatgttgtttcttttatatccattaaaaacttaaagttacttatgttctgtgatcttaattttgttgtgtttccattgtaggttgataggtatatcgagaacaggtacgtgacaacagtttatattccatgatagaaagctaaagtccatagaaagcacaaaatcgtgttcacacattagtgtacccacacatagaaagcacaagactaatagtattctctgtatcccacaagtgccagtcataaaggccaccaggtatttgtctcagagttgctatgagcactacagtattgataagcccaagacaatgcggtatctaaactggtcctaatggtaagggacccaaaggaataatctcaataagtttgtaccacattgatggagggagagaatataaatgtcaagaatgccaaaattatatttgggggttactagctaaaatggggtttgagggctttttactgcaacttgaaactggagaaatagggacagatgtctaggtttttggtgggtggaacaggtgacatatttctgttttaagctgtagtgtgattggggttttttgtaaaaaatcttaaatcttttaggaaatattacctcttaacagtgcccccccaaacatgcagaaagtcatactttaacagggcaaatactacttgtctttgattttttttgtgtacgtttgtatgtgagagatgaagttacctttatttttttcctatacttgactgtgcttcattttaataaaggataatttgatctgagtgttctgagcatcagactaattctgaagcatatttgctagaggagctactttgcttttcacaatggggtggagaggattctttcacttgtcccattaaccctcttctagtctagatgagatgaaatctgttaatgtgtgtgtagaagaaaacgtatgttcttctactcagcattgcccttttccacctcctcacttcacctccgagtagcttgtttatcaagaatgaatgaatgtctttgtcttaaattttgcccatgtgttaaaagatgtaattctcagaatgggagagaaatgactacctttgttcctactcttttatataattatccttttagggaaagacttggtcaactctaatatatctagaaggaagactatatctggtgtagactaatatgagatgttttagaagagttaacctgaacactttgagggagagattattcagctagcaaaaagctagccaggaatgagcctaccacattatttgagaatatcaaacctcaggcctggggggatgaggggaagaagattaccagaagtgcaggaaagagaagtttgaggaacacccttggcttagcaacatgtgataatgcaaagctgttataacctgttaatcctacgtactatgtgttctgtacctttacatgtttttaaatttaagatagtttgtaagaactgtacaaaaaaatgcttctggagatttctttggcagaaatgcctttcatctataatttcatggagaactgctttaattagcctaggtgaaaagtagtcctagcagtgtaaatatgtataattagagttttctaatttcactgtgagatctctaacttttgagtggcaaacagatcaagtcttttgctcatagacttttctgtggggttattaaaatgcaaaagctttattttttttaataatgccatactccattagtgtcagatgatggtatggaatttgttcccttgctttcccccactgttactgcttcagtttatagattgccagcagagttcagaaatagagcagggatttacccgttctttgcttggacatcccattttcttttgtccagacccatgttggcaatcatgtatgaactgtgttatacttctcagtgctttcttttttctttttgataagatggatatcaaaaatagttgctgtgcaaaagttagtagtcttcttcaagaagaaaaccaattctttttctaataatatcctgtgaaattgcttcattcattcatttatttttaagccaaatgtcagcagagtgctgctgcttttatctagtaattttgatatgtaagtattaatgcatttttaaaagatgtctacattgaaacatgttcttcccagtgtcctgcttatgatgctttgttcagattttttgtaagagaccagttagtacactgggggtgtatattgtgtacatgtgtcattttagttaggcattgtaggccaaatgtgattataaatgaagttgatgaacattaattttgttattagtgagttttttgaattgtaaatggatttccagtttaccttctgttgtctacagcttttttaattttaaggtttgactaattgtatccatctcattgtacagtgttttagttgcaagcagaaagtagaatttggtataaagcaggttatttctatattgaaaggagtacagttgaaattgtagatttaagattgttaaaatcatgacaattctaacttgtctattctaacctattgtgtacaatctgattttttaaaattgtaaacatgtatgatcttggtttcatgtgtttttgaaagtgttattgtttaaaaaatgaaaaaagcatatctgctaaagagctgtcagttttcattactgactctgtaaaatacactgttctttgtgtactgtgtgttattttgccagctgctgcattagccttcaaaagtatttggaaacttaagatgaactacatttcttgcaaagtacattcctttctgtggtattttgtcctgtaactgaagtatagtaattattttatggaaatgttagcaattctgtaccaactttgaataaaatgaaaaatttaaaaaaaaaaaaaaaaaaaaaaaaaaaaaaaaaaaaaaaaaaaaaaaaggggggggggg

SEQ ID NO: 417505 - DNA, 5745 bp, Homo sapiens
gcaatagcaatggtgctgtgtccttcggcctaaattcaatagatctcatctcctagggcttccttttcacttggctcaaaggatccattgtattttggcacaaagagcctggccagggtcatgtagccatagctcttagggatgatacctcaagaaattagctgggacccatcactctgtgaaacttcacattttaagaactgagttgagggggttgttatgcacttctgtaacttgaggctaagcaaggggttaactcttgtgagagccaatagagtgtgtctgtattcgcagtccatggctcattttctttatagtaggcatatggatcttcccctctgactttgaatatcatttggtgtggcctgtgggttattttcattctttaccaccaaataaagcggcttattagctactcagttacttgctactcaaaggttaggtcttccctgttcctgcttggcagtgttaaagcttacagggttaacttatgatgattctcctggctcattttcatcagaggcatgatgactggaaagggatcacatgggtcgttggtggtgacacctcactgtttcctaggtttggatagagagatgtatacaagacctttcctgttaaattacgtgactacagagacttgccaggacaaaattttcctaagaaatcagaaaaatgattaagtgagataagtacctgggtgacacagatattagcccgttggtaaaagacaacaaatattagcttaaaatctgcatatgtagaatcattttcattagatttagagcttgaagcaccttggctctcagctactttaaactcctccccatataaatcagggcaccaataaataagtttcagctttttaaaccctggtttgatgttaagcattataaagtacgaagtttgttaccacagtagagataatttagtagaaaaatgctttgaggcttcagtatttgtaagattttgcattagccagatgctaggttgttgaaggcatttcagtgttgataatagcctgagcagacttctttacaaatgggatctgtttctatatgtgtatatgcccacttaccattcagagagactggtctttctctttgtcttccttcacattgctgtgtcagttctacacctagtcttttcagcacttagcaaattcaaattttgatttttttgtcagcttagttcactttaaggcatattggcatggtgtgtgaaagtgatgttttgccccagtattgaggacttttagatccaaataatgactcattaaatataattatgttttaagtatactgaatttctgttagcttaaaatgttaattctcaggaatgattttctcacactttgtgttggctaataataaaagcactgttttattctcaaaactcctttttcaaaaattagggagagagcagtagtgatcatttatgtgagcccctttgaaatgatggtgtcagagtgcagagaaacaatggagttttgatgccaaaaaggtttttttgcagtaaaagtaaaaatttggaattagttggcatatagaggaacccttttgtactggaacgtatgaggctggattgtgaaaaggtaatctttcgattgctagacttggttaacttagggctgcaaatctttttcttctatcaaggtcacttaatatggaatgtttttgtcagactgtcctttgttggaatactttagctgttcagctactttgactcctaggagagaatttagttaaggttcaaagtaattaactggctttgccagtggtgagtcccacaccattattcacttagtagtcatataaatgtttttatttaaacttctctctcttcaatgctgagaataaggctttaaattactgattcacctttaaaggaatgttgtgagaattgatgtaatttctgtttctgtttccatctaaacttctttataaaaagagggattagtttttttgttttggggtaagcacctaatttatccagtaaccaacaaccctaaccattggcatatatagtctttcactcagaaataaacaaaaactgtttggtatatctgtatcattgctaatcttgtgcactttactttttgggcagtaccatacatagtctgaggctattgacttaaaccaataactgtactttatgtaatgactcttaaatttggttacctgggttcacagcttgcttgaagagaaaggatgctagaataaagtaagcagctgaagagcgagcaaatcaagacaaaacacagtggtctcagatttttcgtagtgtgggaacagtggttttgctctataccactgaaaagcactataacataattgttgtccatgatactgaagcttttcccctcacttctaggttgtttacattcagagctctatcaataagaggaatacatattacagtgaattcgacaaccgcacaagttggcagtaggtatccccaacctaatttatcttggtaaattcaccctgtttcctagtgctgctggataaaagagtgtttactttttattgctcttagacagagtagtctagataagttttcaatttatcaacatagcctagacttctgtaagtggaatgttcattagtaactcatctttttgttgttataattggaaacagaaacgaggcttattgctattgcagaaatcccaaactggcaaaggccagtatatatggtattccataatataaccagcttttgaaatttatgtgtttggattagtgccttctggttaccagtattgactctgctagtttgcacctttccgttcttaacagaaaatttgtatttgttattcctcttaaattttgtcgtaactagtgaaggaagtaaaaaaaaaaaaaaaaacatgcattacattgacatactttatgtgcagcctttatttaggttcagtgaaaccaggtagttctgtatttgtgttgtagcctaaatgttgtttcttttatatccattaaaaacttaaagttacttatgttctgtgatcttaattttgttgtgtttccattgtaggttgataggtatatcgagaacaggtacgtgacaacagtttatattccatgatagaaagctaaagtccatagaaagcacaaaatcgtgttcacacattagtgtacccacacatagaaagcacaagactaatagtattctctgtatcccacaagtgccagtcataaaggccaccaggtatttgtctcagagttgctatgagcactacagtattgataagcccaagacaatgcggtatctaaactggtcctaatggtaagggacccaaaggaataatctcaataagtttgtaccacattgatggagggagagaatataaatgtcaagaatgccaaaattatatttgggggttactagctaaaatggggtttgagggctttttactgcaacttgaaactggagaaatagggacagatgtctaggtttttggtgggtggaacaggtgacatatttctgttttaagctgtagtgtgattggggttttttgtaaaaaatcttaaatcttttaggaaatattacctcttaacagtgcccccccaaacatgcagaaagtcatactttaacagggcaaatactacttgtctttgattttttttgtgtacgtttgtatgtgagagatgaagttacctttatttttttcctatacttgactgtgcttcattttaataaaggataatttgatctgagtgttctgagcatcagactaattctgaagcatatttgctagaggagctactttgcttttcacaatggggtggagaggattctttcacttgtcccattaaccctcttctagtctagatgagatgaaatctgttaatgtgtgtgtagaagaaaacgtatgttcttctactcagcattgcccttttccacctcctcacttcacctccgagtagcttgtttatcaagaatgaatgaatgtctttgtcttaaattttgcccatgtgttaaaagatgtaattctcagaatgggagagaaatgactacctttgttcctactcttttatataattatccttttagggaaagacttggtcaactctaatatatctagaaggaagactatatctggtgtagactaatatgagatgttttagaagagttaacctgaacactttgagggagagattattcagctagcaaaaagctagccaggaatgagcctaccacattatttgagaatatcaaacctcaggcctggggggatgaggggaagaagattaccagaagtgcaggaaagagaagtttgaggaacacccttggcttagcaacatgtgataatgcaaagctgttataacctgttaatcctacgtactatgtgttctgtacctttacatgtttttaaatttaagatagtttgtaagaactgtacaaaaaaatgcttctggagatttctttggcagaaatgcctttcatctataatttcatggagaactgctttaattagcctaggtgaaaagtagtcctagcagtgtaaatatgtataattagagttttctaatttcactgtgagatctctaacttttgagtggcaaacagatcaagtcttttgctcatagacttttctgtggggttattaaaatgcaaaagctttattttttttaataatgccatactccattagtgtcagatgatggtatggaatttgttcccttgctttcccccactgttactgcttcagtttatagattgccagcagagttcagaaatagagcagggatttacccgttctttgcttggacatcccattttcttttgtccagacccatgttggcaatcatgtatgaactgtgttatacttctcagtgctttcttttttctttttgataagatggatatcaaaaatagttgctgtgcaaaagttagtagtcttcttcaagaagaaaaccaattctttttctaataatatcctgtgaaattgcttcattcattcatttatttttaagccaaatgtcagcagagtgctgctgcttttatctagtaattttgatatgtaagtattaatgcatttttaaaagatgtctacattgaaacatgttcttcccagtgtcctgcttatgatgctttgttcagattttttgtaagagaccagttagtacactgggggtgtatattgtgtacatgtgtcattttagttaggcattgtaggccaaatgtgattataaatgaagttgatgaacattaattttgttattagtgagttttttgaattgtaaatggatttccagtttaccttctgttgtctacagcttttttaattttaaggtttgactaattgtatccatctcattgtacagtgttttagttgcaagcagaaagtagaatttggtataaagcaggttatttctatattgaaaggagtacagttgaaattgtagatttaagattgttaattaaaattgtaaacatgtatgatcttggtttcatgtgtttttgaaagtgttattgtttaaaaaatgaaaaaagcatatctgctaaagagctgtcagttttcattactgactctgtaaaatacactgttctttgtgtactgtgtgttattttgccagctgctgcattagccttcaaaagtatttggaaacttaagatgaactacatttcttgcaaagtacattcctttctgtggtattttgtcctgtaactgaagtatagtaattattttatggaaatgttagcaattctgtaccaactttgaataaaatgaaaaattta

SEQ ID NO: 417506 - DNA, 3174 bp, Homo sapiens
gcaatagcaatggtgctgtgtccttcggcctaaattcaatagatctcatctcctagggcttccttttcacttggctcaaaggatccattgtattttggcacaaagagcctggccagggtcatgtagccatagctcttagggatgatacctcaagaaattagctgggacccatcactctgtgaaacttcacattttaagaactgagttgagggggttgttatgcacttctgtaacttgaggctaagcaaggggttaactcttgtgagagccaatagagtgtgtctgtattcgcagtccatggctcattttctttatagtaggcatatggatcttcccctctgactttgaatatcatttggtgtggcctgtgggttattttcattctttaccaccaaataaagcggcttattagctactcagttacttgctactcaaaggttaggtcttccctgttcctgcttggcagtgttaaagcttacagggttaacttatgatgattctcctggctcattttcatcagaggcatgatgactggaaagggatcacatgggtcgttggtggtgacacctcactgtttcctaggtttggatagagagatgtatacaagacctttcctgttaaattacgtgactacagagacttgccaggacaaaattttcctaagaaatcagaaaaatgattaagtgagataagtacctgggtgacacagatattagcccgttggtaaaagacaacaaatattagcttaaaatctgcatatgtagaatcattttcattagatttagagcttgaagcaccttggctctcagctactttaaactcctccccatataaatcagggcaccaataaataagtttcagctttttaaaccctggtttgatgttaagcattataaagtacgaagtttgttaccacagtagagataatttagtagaaaaatgctttgaggcttcagtatttgtaagattttgcattagccagatgctaggttgttgaaggcatttcagtgttgataatagcctgagcagacttctttacaaatgggatctgtttctatatgtgtatatgcccacttaccattcagagagactggtctttctctttgtcttccttcacattgctgtgtcagttctacacctagtcttttcagcacttagcaaattcaaattttgatttttttgtcagcttagttcactttaaggcatattggcatggtgtgtgaaagtgatgttttgccccagtattgaggacttttagatccaaataatgactcattaaatataattatgttttaagtatactgaatttctgttagcttaaaatgttaattctcaggaatgattttctcacactttgtgttggctaataataaaagcactgttttattctcaaaactcctttttcaaaaattagggagagagcagtagtgatcatttatgtgagcccctttgaaatgatggtgtcagagtgcagagaaacaatggagttttgatgccaaaaaggtttttttgcagtaaaagtaaaaatttggaattagttggcatatagaggaacccttttgtactggaacgtatgaggctggattgtgaaaaggtaatctttcgattgctagacttggttaacttagggctgcaaatctttttcttctatcaaggtcacttaatatggaatgtttttgtcagactgtcctttgttggaatactttagctgttcagctactttgactcctaggagagaatttagttaaggttcaaagtaattaactggctttgccagtggtgagtcccacaccattattcacttagtagtcatataaatgtttttatttaaacttctctctcttcaatgctgagaataaggctttaaattactgattcacctttaaaggaatgttgtgagaattgatgtaatttctgtttctgtttccatctaaacttctttataaaaagagggattagtttttttgttttggggtaagcacctaatttatccagtaaccaacaaccctaaccattggcatatatagtctttcactcagaaataaacaaaaactgtttggtatatctgtatcattgctaatcttgtgcactttactttttgggcagtaccatacatagtctgaggctattgacttaaaccaataactgtactttatgtaatgactcttaaatttggttacctgggttcacagcttgcttgaagagaaaggatgctagaataaagtaagcagctgaagagcgagcaaatcaagacaaaacacagtggtctcagatttttcgtagtgtgggaacagtggttttgctctataccactgaaaagcactataacataattgttgtccatgatactgaagcttttcccctcacttctaggttgtttacattcagagctctatcaataagaggaatacatattacagtgaattcgacaaccgcacaagttggcagtaggtatccccagagactgctgctactttgaaacgtacgatagaggccctgatggacagaggagcaatagtgagggacttggaaaacctgggtgaacgagcgcttccttataggatctctgcccacagtcagcagcacaacagaggcgggtatttcttggtggatttttatgcacccaccgcagctgttgaaagcatggtggagcacttgtctcgagatatagatgtgattagagggaatattgtcaaacaccctctgacccaggaactaaaagaatgtgaagggattgtcccagtcccactcgcagaaaaattatattccacaaagaagaggaagaagtgagaagattcgccagattttagccttatatgtaattccttcacatttgggcagcatggacgagaaggaagaatttgcaagtttggcctttatataagcatgtgttgcaggtgctgtttgatttttctaaggtatttttagcccttgatcccctttgcttgcgagaggtggggaactgctcactgacagcttctctgtaacctgcagtaccagtggatcattcttgattttgttttcattagtgtcatttctttgtcattgaggacttttccccttacaacagtaacaccattttttgaagagcaaaacttataatacctcctgggattgtgagctagtcattcagcctgtgtaaccatgtggaaataaaaattgacgaccaatgta

SEQ ID NO: 417507 - DNA, 329 bp, Homo sapiens
acgaccaatgtattatatggacaacttttgctttgagtaataaacttgattggtgtaggaatgtgggaggtgttttgtccctttacttacccagtgcagtgcacttccagggccccgcagctccagtctagctggcagtgcctggcagtgtcggggaggcattacccagtacccactgaggtccagagccggggtggggcaggggaggaggggtgtctgtctgttccttactgggcacgccacaaaatcagtgacttttccctgcacacctcacttgtcattgtggtttgtgctgctctttgtggtgggacgtgtgttctggtgcagtt

SEQ ID NO: 417508 - DNA, 2675 bp, Homo sapiens
  misc_feature (92)..(92): n is a, c, g, or t
atgagagctgtactggacacagcagacattgccatagtggccctgtattttatcctggtcatgtgcattggtttttttgccatgtggaaatntaatagaagcaccgtgagtggatacttcctggcggggcgctctatgacctgggtaacaattggtgcctctctgtttgtgagcaatattgggagtgagcacttcattgggctggcaggatctggagctgcaagtggatttgcagtgggcgcatgggaattcaatgccttactgcttttacaacttctgggatgggttttcatcccaatttacatccggtcaggggtatataccatgcctgaatacttgtccaagcgatttggtggccataggattcaggtctattttgcagccttgtctctgattctctatattttcaccaagctctcggtggatctgtattcgggtgccctttttatccaggagtctttgggttggaatctttatgtgtctgtcatcctgctcattggcatgactgctttgctgactgtcaccggaggccttgttgcagtgatctacacagacactctgcaggctctgctcatgatcattggggcacttacacttatgattattagcataatggagattggcgggtttgaggaagttaagagaaggtacatgttggcctcacccgatgtcacttccatcttattgacatacaacctttccaacacaaattcttgtaatgtctcccctaagaaagaagccctgaaaatgctgcggaatccaacagatgaagatgttccttggcctggattcattcttgggcagaccccagcttcagtatggtactggtgtgctgaccaagtcatcgtgcagagggtccttgcagccaaaaacattgctcatgccaaaggctctactcttatggctggcttcttaaagctcctgccaatgtttatcatagttgtcccaggaatgatttccaggatactgtttactgatgatatagcttgcatcaacccagagcactgcatgctggtgtgtggaagcagagctggttgctccaatattgcttacccacgcctggtgatgaagctggttcctgtgggccttcggggtttaatgatggcagtgatgattgcagctctgatgagtgacttagactctatctttaacagtgccagtaccatattcaccctcgatgtgtacaaacttatccgcaagagcgcaagctcccgggagttaatgattgtggggaggatatttgtggcatttatggtggtgatcagcatagcatgggtgccaatcatcgtggagatgcaaggaggccagatgtacctttacattcaggaggtagcagattacctgacacccccagtggcagccttgttcctgctggcaattttctggaagcgctgcaatgaacaaggggctttctatggtggaatggctggctttgttcttggagcagtccgtttgatactggcctttgcctaccgtgccccagaatgtgaccaacctgataataggccgggcttcatcaaagacatccattatatgtatgtggccacaggattgttttgggtcacgggactcattactgtaattgtgagccttctcacaccacctcccacaaaggaacagattcgaaccaccaccttttggtctaagaagaacctggtggtgaaggagaactgctccccaaaagaggaaccataccaaatgcaagaaaagagcattctgagatgcagtgagaataatgagaccatcaaccacatcattcccaacgggaaatctgaagacagcattaagggccttcagcctgaagatgttaatctgttggtaacctgcagagaggagggcaacccagtggcatccttaggtcattcagaggcagaaacaccagttgacgcttactccaatgggcaagcagctctcatgggtgagaaagagagaaagaaagaaacggatgatggaggtcggtactggaagttcatagactggttttgtggctttaaaagtaagagcctcagcaagaggagtctcagagacctgatggaagaggaggctgtttgtttacagatgctagaagagactcggcaagttaaagtaatactaaatattggactttttgctgtgtgttcacttggaattttcatgtttgtttatttctccttatgaacttaaggatatggtgagacactaacttaagacaatactgactggtctttggggaaaaaagttatgtaactgtgcatctctcaggcattgtttacgctgtaggttttagccaaattttacttagcagaaaatcatctaattacaagactttattttcccagagatggattaaagtaaatcttcaacttaagtgaagccaaacctaacagactgaattgtgcaaatgtggttttaaattttgcataccaaagtaagaagagaccaattattctcacagagcacttagagcagaatatatgttaagttaccatgaattaaggtatactgtctgcactgccaagtcttggcagaccttaccctgaagtagaagatttgctcatttctaaagttttttttctgtctctgtaatccctcctaccattaagaaaaacttatttcttagacattgtacaatcagttatgtactgaaaatcgaatgtgcttgtgtgatacttgtttcaggacaagttcatttgcca

SEQ ID NO: 417509 - DNA, 1037 bp, Homo sapiens
  misc_feature (1025)..(1028): n is a, c, g, or t
cggcgtctgcgcagctgccagcgcctttaagcccgggctcgcgctctcggaccgtgctttcgccgcctgggagccgtccggcgcagcagtttctaggtccccactgtccccgccgtcccgccccttcgcgtcccgggaaccggctggcttccgagccgcactcgccgatcctccaggcatgccccgctacgagctggctttaatcctgaaagccatgcagcggccagagactgctgctactttgaaacgtacgatagaggccctgatggacagaggagcaatagtgagggacttggaaaacctgggtgaacgagcgcttccttataggatctctgcccacagtcagcagcacaacagaggcgggtatttcttggtggatttttatgcacccaccgcagctgttgaaagcatggtggagcacttgtctcgagatatagatgtgattagagggaatattgtcaaacaccctctgacccaggaactaaaagaatgtgaagggattgtcccagtcccactcgcagaaaaattatattccacaaagaagaggaagaagtgagaagattcgccagattttagccttatatgtaattccttcacatttgggcagcatggacgagaaggaagaatttgcaagtttggcctttatataagcatgtgttgcaggtgctgtttgatttttctaaggtatttttagcccttgatcccctttgcttgcgagaggtggggaactgctcactgacagcttctctgtaacctgcagtaccagtggatcattcttgattttgttttcattagtgtcatttctttgtcattgaggacttttccccttacaacagtaacaccattttttgaagagcaaaacttataatacctcctgggattgtgagctagtcattcagcctgtgtaaccatgtggaaataaaaattgacgaccaatgtattatatggacaacttttgctttgagtaataaacttgattgggatggcctcgttggcctcagcggtggagctctgcggccggaaannnngtccccttt

SEQ ID NO: 417510 - DNA, 1065 bp, Homo sapiens
cggcgtctgcgcagctgccagcgcctttaagcccgggctcgcgctctcggaccgtgctttcgccgcctgggagccgtccggcgcagcagtttctaggtccccactgtccccgccgtcccgccccttcgcgtcccgggaaccggctggcttccgagccgcactcgccgatcctccaggcatgccccgctacgagctggctttaatcctgaaagccatgcagcgggttgtttacattcagagctctatcaataagaggaatacatattacagtgaattcgacaaccgcacaagttggcagtaggtatccccagagactgctgctactttgaaacgtacgatagaggccctgatggacagaggagcaatagtgagggacttggaaaacctgggtgaacgagcgcttccttataggatctctgcccacagtcagcagcacaacagaggcgggtatttcttggtggatttttatgcacccaccgcagctgttgaaagcatggtggagcacttgtctcgagatatagatgtgattagagggaatattgtcaaacaccctctgacccaggaactaaaagaatgtgaagggattgtcccagtcccactcgcagaaaaattatattccacaaagaagaggaagaagtgagaagattcgccagattttagccttatatgtaattccttcacatttgggcagcatggacgagaaggaagaatttgcaagtttggcctttatataagcatgtgttgcaggtgctgtttgatttttctaaggtatttttagcccttgatcccctttgcttgcgagaggtggggaactgctcactgacagcttctctgtaacctgcagtaccagtggatcattcttgattttgttttcattagtgtcatttctttgtcattgaggacttttccccttacaacagtaacaccattttttgaagagcaaaacttataatacctcctgggattgtgagctagtcattcagcctgtgtaaccatgtggaaataaaaattgacgaccaatgtattatatggacaacttttgctttgagtaataaacttgattgg

SEQ ID NO: 417511 - DNA, 434 bp, Homo sapiens
cttttctttgggaatgaaaatctagaatcctaagtttcttctaggtgctctgaagttaaacagccaaaacagaatgattcatggtagtttccaattgtaatcccagaatatttttagttattcagtcagctgaagacctgggcctctcagctcagaacaggataaataatgtctgtttggggaaggggggtctgccagtagatttgatgttaatgcagcttttaagatcacatttttacagtgaggaattcagcttttcttctatagtgttatcaagtgcctgaaattatcactatcttatttttgtaaatgcatattttaaatgtatatgtagggttttctttaaacaggcttcatagtagtttggattgactagaatgctccttttttgtatgcttctcagtgccaggaattaaatcaggaaaatgccttaa

SEQ ID NO: 417512 - DNA, 105 bp, Homo sapiens
gggcaacagagtgaggccctgactcaaaataaataaatagcttagttcagcattccctaaacaggagacacatcaatcctttaagatggtttgtgtctccctgct

SEQ ID NO: 417513 - DNA, 381 bp, Homo sapiens
cacctcacaggacctgtatccatctcttctggaggatagcagaggtatggagggagacctggcagggtctcctgccccacgggcagctgagactctgttgggggtgggggatggaaggtgtatggaagaagagtgagaactagaccacacttgcaccggggttccccacactcagcgcaggctctgttgttctgttaaacttcacttgcaaaacacaaattccaagacaaaaattaaaaatttcaagaggaccaccagagaacattaaaccccaagtactgaaaccttgtgagcaaaggtgctgtattactacactggtcacacacccatgagccaggcttgctaaatggttgttcaagactatccacaggctgggtgagg

SEQ ID NO: 417514 - DNA, 1808 bp, Homo sapiens
tgcgcgcgcaggggagaggccagcccaggcagccgttgtcgggttcgactggaggggcgggggagtcacctgcgagcggctgcgctggcggccagcccgcccaccgcgtctggatcgcgccggctgcgcggggctgcggacagcacacaccctggaaggccccggcggggaacgggcagagtccgcgccctgcgtccgcgaccaggaggatcggaccttcgccttcgctgtcgccgccgccgccgcccgcggccgtcggggctattagtgaaagatggtggatcgcttggcaaacagtgaagcaaatactagacgtataagtatagtggaaaactgttttggagcagctggtcaacctttaactatacctggacgagttcttattggagaaggagtattgactaagttgtgcaggaaaaagcccaaagcaaggcagtttttcttgtttaatgatattcttgtatatggcaatattgtcatccagaagaaaaaatataacaaacaacatattattcccctggaaaatgtcactattgattccatcaaagatgagggagacttaaggaatggatggctaatcaagacaccaactaaatcttttgcagtttatgctgccactgctacggagaaatcagaatggatgaatcatataaataaatgtgttactgatttactctccaaaagtgggaagacacccagtaatgaacatgctgctgtctgggttcctgactctgaggcaactgtatgtatgcgttgtcagaaagcaaaattcacacctgttaatcgtcgccaccattgccgcaaatgtggttttgttgtctgtgggccctgctctgaaaagagatttcttcttcccagccagtcctctaagcctgtgcggatttgtgacttctgctatgacctgctttctgctggggacatggccacatgccagcctgctagatcagactcttacagccagtcattgaagtctcctttaaatgatatgtctgatgatgatgacgatgatgatagcagtgactaaggacacatttgggagtatttaatcaggtgtggctatctgagaaatcaactttgggggaaatgtaagattctgagctctctctctgttttgttctagccatgaatttgcctgagaaacttgtaacctatgtgcctcaatatattccatagaaagtaggtccccctgccttctcccactcctcacactcttctacagggataggcttttgcaaatatatcagataaattttttgtttcttgtttatttttaggttattttcttggaaggttgggaaaagatgtttgttttaacaggtcatgtactacgttgttgttttcatttctgttataagtaaaactaaaagcacagaatggtgggaaaggggctataatgtggttcattaataatgttagcagcttttttctaaccatcctgtctaatggttaagacaccagtaacaaaaacacatgatttggaaatactttggctttttcatatacctagtggtgccttatcataatagcactgttacatgaaataagcccctaccttcttactttctggtttgttgaaaaaatacactggtgctctttgaagtgataaaatgagtgtttatgaatgggtgtaattaggaaatacttctcatctgacagctacaaataactaagtttggaggtattttcactctatatgaataaatatttttccataaaatagttgtgattatatttttgttttatataggtcccaaattataattgtcaaatatatattttaaattaataaaagttgtcattcttaggaa

SEQ ID NO: 417515 - DNA, 2902 bp, Homo sapiens
acgcgaaactttccgggcgcttcctcccgcggtcccggagccgtcgcagcgccgggaggtgtcgtcgtcgcgggcggtggcggccgacgccatgttggggtctgtgagaaacggggcgctcccggccgctcccctcgcgccggggccggcccgcgggccagttgccgccgccgtcccgccagcccgggagcgagccgcgcccgcccgtaggacgccgccgccgccgcggggggacgggggccgccgggctattagtgaaagatggtggatcgcttggcaaacagtgaagcaaatactagacgtataagtatagtggaaaactgttttggagcagctggtcaacctttaactatacctggacgagttcttattggagaaggagtattgactaagttgtgcaggaaaaagcccaaagcaaggcagtttttcttgtttaatgatattcttgtatatggcaatattgtcatccagaagaaaaaatataacaaacaacatattattcccctggaaaatgtcactattgattccatcaaagatgagggagacttaaggaatggatggctaatcaagacaccaactaaatcttttgcagtttatgctgccactgctacggagaaatcagaatggatgaatcatataaataaatgtgttactgatttactctccaaaagtgggaagacacccagtaatgaacatgctgctgtctgggttcctgactctgaggcaactgtatgtatgcgttgtcagaaagcaaaattcacacctgttaatcgtcgccaccattgccgcaaatgtggttttgttgtctgtgggccctgctctgaaaagagatttcttcttcccagccagtcctctaagcctgtgcggatttgtgacttctgctatgacctgctttctgctggggacatggccacatgccagcctgctagatcagactcttacagccagtcattgaagtctcctttaaatgatatgtctgatgatgatgacgatgatgatagcagtgactaaggacacatttgggagtatttaatcaggtgtggctatctgagaaatcaactttgggggaaatgtaagattctgagctctctctctgttttgttctagccatgaatttgcctgagaaacttgtaacctatgtgcctcaatatattccatagaaagtaggtccccctgccttctcccactcctcacactcttctacagggataggcttttgcaaatatatcagataaattttttgtttcttgtttatttttaggttattttcttggaaggttgggaaaagatgtttgttttaacaggtcatgtactacgttgttgttttcatttctgttataagtaaaactaaaagcacagaatggtgggaaaggggctataatgtggttcattaataatgttagcagcttttttctaaccatcctgtctaatggttaagacaccagtaacaaaaacacatgatttggaaatactttggctttttcatatacctagtggtgccttatcataatagcactgttacatgaaataagcccctaccttcttactttctggtttgttgaaaaaatacactggtgctctttgaagtgataaaatgagtgtttatgaatgggtgtaattaggaaatacttctcatctgacagctacaaataactaagtttggaggtattttcactctatatgaataaatatttttccataaaatagttgtgattatatttttgttttatataggtcccaaattataattgtcaaatatatattttaaattaataaaagttgtcattcttaggaatttggtttgaaatttatcagttatacagaattgtcatactgcattagcttctacctttagtaagacatattttttaggtataaattcttatgctttaacattatttctggattgaaaatcttataaaacccttgaaaataaacagtctcttttttacaaagcctgtgttagagcacagatttacctaggcttgaagatttggaagaaataatatgtaagaatggcctcaaggcagaccactttaagtttggctagacttcatatcgtggaagtattgtctatttcagtgtgaaactatcttgaatttgcaaatatagtgttatattttataaagttttgtaaaatcccaaacaatatttctatttttgtaaaacaattgtatgtataatctgtatttgaaatcattttgcaatctatggaaatagagtagcaattgctatttctaaattgtgaactttaagtcaatctagatttattttgagaagtaattgttcactctttacttttgaggcagccattaggttgaaagtatatatttatcatataaaacttgatgcgttttgcactactctttccatttatatgctgcaaacaactacagtctttgaaatatggaaaatcagcagtctaaagtttgttttaaattctaaatttaaaaaatcttcaaatctgaatataccgcaaatgtcatgagaagtttgattcagtaacttgtgatggaggattctttggtatcttactgtttggttaaggcactaattttacttacctattagattttgaaagtatctgagatatacaaatctccctgtaggaaatgtgaaagaaaagcacaacaaaactagggttttttgttcatttgcttgcttttatgattttttttggtttgttttaatatcaggtggatttttgtttctaagcaatatatacataaaatcaaccaacatatctgaaaaggatcatgaaacctgagaaatgctaatggagatttgctggtacataggaatctagcaaattcaggaaccaaggggaaatgttgtgagataacatttacattgtcaacctttattgactttgtttttacaataaaaaatattttacaactta

SEQ ID NO: 417516 - DNA, 2043 bp, Homo sapiens
  misc_feature (1926)..(1926): n is a, c, g, or t
  misc_feature (1949)..(1949): n is a, c, g, or t
  misc_feature (2019)..(2019): n is a, c, g, or t
tgcgcgcgcaggggagaggccagcccaggcagccgttgtcgggttcgactggaggggcgggggagtcacctgcgagcggctgcgctggcggccagcccgcccaccgcgtctggatcgcgccggctgcgcggggctgcggacagcacacaccctggaaggccccggcggggaacgggcagagtccgcgccctgcgtccgcgaccaggaggatcggaccttcgccttcgctgtcgccgccgccgccgcccgcggccgtcggggctattagtgaaagatggtggatcgcttggcaaacagtgaagcaaatactagacgtataagtatagtggaaaactgttttggagcagctggtcaacctttaactatacctggacgagttcttattggagaaggagtattgactaagttgtgcaggaaaaagcccaaagcaaggcagtttttcttgtttaatgatattcttgtatatggcaatattgtcatccagaagaaaaaatataacaaacaacatattattcccctggaaaatgtcactattgattccatcaaagatgagggagacttaaggaatggatggctaatcaagacaccaactaaatcttttgcagtttatgctgccactgctacggagaaatcagaatggatgaatcatataaataaatgtgttactgatttactctccaaaagtgggaagacacccagtaatgaacatgctgctgtctgggttcctgactctgaggcaactgtatgtatgcgttgtcagaaagcaaaattcacacctgttaatcgtcgccaccattgccgcaaatgtggttttgttgtctgtgggccctgctctgaaaagagatttcttcttcccagccagtcctctaagcctgtgcggatttgtgacttctgctatgacctgctttctgctggggacatggccacatgccagcctgctagatcagactcttacagccagtcattgaagtctcctttaaatgatatgtctgatgatgatgacgatgatgatagcagtgactaaggacacatttgggagtatttaatcaggtgtggctatctgagaaatcaactttgggggaaatgtaagattctgagctctctctctgttttgttctagccatgaatttgcctgagaaacttgtaacctatgtgcctcaatatattccatagaaagtaggtccccctgccttctcccactcctcacactcttctacagggataggcttttgcaaatatatcagataaattttttgtttcttgtttatttttaggttattttcttggaaggttgggaaaagatgtttgttttaacaggtcatgtactacgttgttgttttcatttctgttataagtaaaactaaaagcacagaatggtgggaaaggggctataatgtggttcattaataatgttagcagcttttttctaaccatcctgtctaatggttaagacaccagtaacaaaaacacatgatttggaaatactttggctttttcatatacctagtggtgccttatcataatagcactgttacatgaaataagcccctaccttcttactttctggtttgttgaaaaaatacactggtgctctttgaagtgataaaatgagtgtttatgaatgggtgtaattaggaaatacttctcatctgacagctacaaataactaagtttggaggtattttcactctatatgaataaatatttttccataaaatagttgtgattatatttttgttttatataggtcccaaattataattgtcaaatatatattttaaattaataaaagttgtcattcttaggaaaaaaaaaaaaaaaaaaaaaactcgagactagttcctcgtgccgggagtggagctgctctgagattttgagttcttctgcagagatgattaaatatatccaagagacattggaaaaccngctgaacattttacattggtctnctcagcacatggctggatgcggatatttctataattccagaaagtcacacagctcctctgtatgagaccngtgggcgccatttaaaagaacagg

SEQ ID NO: 417517 - DNA, 2915 bp, Homo sapiens
tgcgcgcgcaggggagaggccagcccaggcagccgttgtcgggttcgactggaggggcgggggagtcacctgcgagcggctgcgctggcggccagcccgcccaccgcgtctggatcgcgccggctgcgcggggctgcggacagcacacaccctggaaggccccggcggggaacgggcagagtccgcgccctgcgtccgcgaccaggaggatcggaccttcgccttcgctgtcgccgccgccgccgcccgcggccgtcggggctattagtgaaagatggtggatcgcttggcaaacagtgaagcaaatactagacgtataagtatagtggaaaactgttttggagcagctggtcaacctttaactatacctggacgagttcttattggagaaggagtattgactaagttgtgcaggaaaaagcccaaagcaaggcagtttttcttgtttaatgatattcttgtatatggcaatattgtcatccagaagaaaaaatataacaaacaacatattattcccctggaaaatgtcactattgattccatcaaagatgagggagacttaaggaatggatggctaatcaagacaccaactaaatcttttgcagtttatgctgccactgctacggagaaatcagaatggatgaatcatataaataaatgtgttactgatttactctccaaaagtgggaagacacccagtaatgaacatgctgctgtctgggttcctgactctgaggcaactgtatgtatgcgttgtcagaaagcaaaattcacacctgttaatcgtcgccaccattgccgcaaatgtggttttgttgtctgtgggccctgctctgaaaagagatttcttcttcccagccagtcctctaagcctgtgcggatttgtgacttctgctatgacctgctttctgctggggacatggccacatgccagcctgctagatcagactcttacagccagtcattgaagtctcctttaaatgatatgtctgatgatgatgacgatgatgatagcagtgactaaggacacatttgggagtatttaatcaggtgtggctatctgagaaatcaactttgggggaaatgtaagattctgagctctctctctgttttgttctagccatgaatttgcctgagaaacttgtaacctatgtgcctcaatatattccatagaaagtaggtccccctgccttctcccactcctcacactcttctacagggataggcttttgcaaatatatcagataaattttttgtttcttgtttatttttaggttattttcttggaaggttgggaaaagatgtttgttttaacaggtcatgtactacgttgttgttttcatttctgttataagtaaaactaaaagcacagaatggtgggaaaggggctataatgtggttcattaataatgttagcagcttttttctaaccatcctgtctaatggttaagacaccagtaacaaaaacacatgatttggaaatactttggctttttcatatacctagtggtgccttatcataatagcactgttacatgaaataagcccctaccttcttactttctggtttgttgaaaaaatacactggtgctctttgaagtgataaaatgagtgtttatgaatgggtgtaattaggaaatacttctcatctgacagctacaaataactaagtttggaggtattttcactctatatgaataaatatttttccataaaatagttgtgattatatttttgttttatataggtcccaaattataattgtcaaatatatattttaaattaataaaagttgtcattcttaggaatttggtttgaaatttatcagttatacagaattgtcatactgcattagcttctacctttagtaagacatattttttaggtataaattcttatgctttaacattatttctggattgaaaatcttataaaacccttgaaaataaacagtctcttttttacaaagcctgtgttagagcacagatttacctaggcttgaagatttggaagaaataatatgtaagaatggcctcaaggcagaccactttaagtttggctagacttcatatcgtggaagtattgtctatttcagtgtgaaactatcttgaatttgcaaatatagtgttatattttataaagttttgtaaaatcccaaacaatatttctatttttgtaaaacaattgtatgtataatctgtatttgaaatcattttgcaatctatggaaatagagtagcaattgctatttctaaattgtgaactttaagtcaatctagatttattttgagaagtaattgttcactctttacttttgaggcagccattaggttgaaagtatatatttatcatataaaacttgatgcgttttgcactactctttccatttatatgctgcaaacaactacagtctttgaaatatggaaaatcagcagtctaaagtttgttttaaattctaaatttaaaaaatcttcaaatctgaatataccgcaaatgtcatgagaagtttgattcagtaacttgtgatggaggattctttggtatcttactgtttggttaaggcactaattttacttacctattagattttgaaagtatctgagatatacaaatctccctgtaggaaatgtgaaagaaaagcacaacaaaactagggttttttgttcatttgcttgcttttatgattttttttggtttgttttaatatcaggtggatttttgtttctaagcaatatatacataaaatcaaccaacatatctgaaaaggatcatgaaacctgagaaatgctaatggagatttgctggtacataggaatctagcaaattcaggaaccaaggggaaatgttgtgagataacatttacattgtcaacctttattgactttgtttttacaataaaaaatattttacaactta

SEQ ID NO: 417518 - DNA, 2860 bp, Homo sapiens
tgcgcgcgcaggggagaggccagcccaggcagccgttgtcgggttcgactggaggggcgggggagtcacctgcgagcggctgcgctggcggccagcccgcccaccgcgtctggatcgcgccggctgcgcggggctgcggacagcacacaccctggaaggccccggcggggaacgggcagagtccgcgccctgcgtccgcgaccaggaggatcggaccttcgccttcgctgtcgccgccgccgccgcccgcggccgtcggggctattagtgaaagatggtggatcgcttggcaaacagtgaagcaaatactagacgtataagtatagtggaaaactgttttggagcagctggtcaacctttaactatacctggacgagttcttattggagaaggagtattgactaagttgtgcaggaaaaagcccaaagcaaggcagtttttcttgtttaatgatattcttgtatatggcaatattgtcatccagaagaaaaaatataacaaacaacatattattcccctggaaaatgtcactattgattccatcaaagatgagggagacttaaggaatggatggctaatcaagacaccaactaaatcttttgcagtttatgctgccactgctacggagaaatcagaatggatgaatcatataaataaatgtgttactgatttactctccaaaagtgggaagacacccagtaatgaacatgctgctgtctgggttcctgactctgaggcaactgtatgtatgcgttgtcagaaagcaaaattcacacctgttaatcgtcgccaccattgccgcaaatgtggttttgttgtctgtgggccctgctctgaaaagagatttcttcttcccagccagtcctctaagcctgtgcggatttgtgacttctgctatgacctgctttctgctggggacatggccacatgccagcctgctagatcagactcttacagccagtcattgaagtctcctttaaatgatatgtctgatgatgatgacgatgatgatagcagtgactaaggacacatttgggagtatttaatcaggtgtggctatctgagaaatcaactttgggggaaatgtaagattctgagctctctctctgttttgttctagccatgaatttgcctgagaaacttgtaacctatgtgcctcaatatattccatagaaagtaggtccccctgccttctcccactcctcacactcttctacagggataggcttttgcaaatatatcagataaattttttgtttcttgtttatttttaggttattttcttggaaggttgggaaaagatgtttgttttaacaggtcatgtactacgttgttgttttcatttctgttataagtaaaactaaaagcacagaatggtgggaaaggggctataatgtggttcattaataatgttagcagcttttttctaaccatcctgtctaatggttaagacaccagtaacaaaaacacatgatttggaaatactttggctttttcatatacctagtggtgccttatcataatagcactgttacatgaaataagcccctaccttcttactttctggtttgttgaaaaaatacactggtgctctttgaagtgataaaatgagtgtttatgaatgggtgtaattaggaaatacttctcatctgacagctacaaataactaagtttggaggtattttcactctatatgaataaatatttttccataaaatagttgtgattatatttttgttttatataggtcccaaattataattgtcaaatatatattttaaattaataaaagttgtcattcttaggaatttggtttgaaatttatcagttatacagaattgtcatactgcattagcttctacctttagtaagacatattttttaggtataaattcttatgctttaacattatttctggattgaaaatcttataaaacccttgaaaataaacagtctcttttttacaaagcctgtgttagagcacagatttacctaggcttgaagatttggaagaaataatatgtaagaatggcctcaaggcagaccactttaagtttggctagacttcatatcgtggaagtattgtctatttcagtgtgaaactatcttgaatttgcaaatatagtgttatattttataaagttttgtaaaatcccaaacaatatttctatttttgtaaaacaattgtatgtataatctgtatttgaaatcattttgcaatctatggaaatagagtagcaattgctatttctaaattgtgaactttaagtcaatctagatttattttgagaagtaattgttcactctttacttttgaggcagccattaggttgaaagtatatatttatcatataaaacttgatgcgttttgcactactctttccatttatatgctgcaaacaactacagtctttgaaatatggaaaatcagcagtctaaagtttgttttaaattctaaatttaaaaaatcttcaaatctgaatataccgcaaatgtcatgagaagtttgattcagtaacttgtgatggaggattctttggtatcttactgtttggttaaggcactaattttacttacctattagattttgaaagtatctgagatatacaaatctccttgcttttatgattttttttggtttgttttaatatcaggtggatttttgtttctaagcaatatatacataaaatcaaccaacatatctgaaaaggatcatgaaacctgagaaatgctaatggagatttgctggtacataggaatctagcaaattcaggaaccaaggggaaatgttgtgagataacatttacattgtcaacctttattgactttgtttttacaataaaaaatattttacaactta

SEQ ID NO: 417519 - DNA, 1254 bp, Homo sapiens
tgcgcgcgcaggggagaggccagcccaggcagccgttgtcgggttcgactggaggggcgggggagtcacctgcgagcggctgcgctggcggccagcccgcccaccgcgtctggatcgcgccggctgcgcggggctgcggacagcacacaccctggaaggccccggcggggaacgggcagagtccgcgccctgcgtccgcgaccaggaggatcggaccttcgccttcgctgtcgccgccgccgccgcccgcggccgtcggggctattagtgaaagatggtggatcgcttggcaaacagtgaagcaaatactagacgtataagtatagtggaaaactgttttggagcagctggtcaacctttaactatacctggacgagttcttattggagaaggagtattgactaagttgtgcaggaaaaagcccaaagcaaggcagtttttcttgtttaatgatattcttgtatatggcaatattgtcatccagaagaaaaaatataacaaacaacatattattcccctggaaaatgtcactattgattccatcaaagatgagggagacttaaggaatggatggctaatcaagacaccaactaaatcttttgcagtttatgctgccactgctacggagaaatcagaatggatgaatcatataaataaatgtgttactgatttactctccaaaagtgggaagacacccagtaatgaacatgctgctgtctgggttcctgactctgaggcaactgtatgtatgcgttgtcagaaagcaaaattcacacctgttaatcgtcgccaccattgccgcaaatgtggttttgttgtctgtgggccctgctctgaaaagagatttcttcttcccagccagtcctctaagcctgtgcggatttgtgacttctgctatgacctgctttctgctggggacatggccacatgccagcctgctagatcagactcttacagccagtcattgaagtctcctttaaatgatatgtctgatgatgatgacgatgatgatagcagtgactaaggacacatttgggagtatttaatcaggtgtggctatctgagaaatcaactttgggggaaatgtaagattctgagctctctctctgttttgttctagccatgaatttgcctgagaaacttgtaacctatgtgcctcaatatattccatagaaagtaggtccccctgccttctcccactcctcacactcttctacagggataggcttttgcaaatatatcagataaattttt

SEQ ID NO: 417520 - DNA, 348 bp, Homo sapiens
ctttgggaggctgaggcaggaggatccgtctcaaaaaaaaaaaaaaaaaggaatatagggagcaggggaagagtcaagggagccagggagttggtgcctggtcacccattttgcagatgggaaagctgcccccatgcatggggcctgccaagggtcacagcagggagacctcagagctgtggacggacctggacagaggctgtggacagggctgaggcctcctggctgttcctgtaacaagcgtgacacagccctgccccagggcctttgcacaggctgtgccctttgcctggagcatcttcccgcagaccctgtcattgcaggcccagttcaactggcccagcctct

SEQ ID NO: 417521 - DNA, 303 bp, Homo sapiens
aatacataatataacacctttaatttgatagaccagtcaagagcatttagtctatactgctctaggctaaaatttatcttaataaggatgtcaggtttctttgctttttgctgtcctagtcaaaatagcatcattgttccctaaactcagttgctaaactcctttttttttttttttctggatgagtgtttagtttctaaagttgctaaattcttaaagaaaatttattctagaaagataaagcatttctctattttggagctattgatcacacttgtaggggccaaggcttagtcctttctg

SEQ ID NO: 417522 - DNA, 926 bp, Homo sapiens
tgtcggtcgggttggtcttgaactcctggcctcaagtgatctgcctacctcgggctctccaagtgctgggattacaggcatgagccactgcccctggcccaactttctgttaatctttattggatactttttcactgtgctgaccccatgtgaatactattcaggaggtatgacagtaccattatggttatagctgtggacactattcttttatgctctgtactcatagctcttcacctttaggaactagagtagatgtaaagcatttaagaattttaaggtttgagctatttcatgatcaacctgaaagggccataacttgtaggtaatacgtatttttgttttgactgtcatgtggtagaagttacctgaaaaatgaagccaaccaactcttttgcatttcaactgttggtttattttttttgagacggaatttcactacgtggcccaggttggagtgcagtggtgtgatctaggttgactgcaacctctacttcccaggttcaggcaattctcctgcctcagcctcctgagtagctgggattacaggcccacaccaccaatcccagtgaacttttgtatttttagtagagacagggttttgccatcttggccaggctggtttcagactcctgacctcaagtgatccacctgcctcggcctcccaaagtgctggaattataggcgtgaacctccacgcctggcctcaactgtttaatttttcactttactgtttatatctcctaacatgagttattgttctgaagcactcaaaattttaatctctatttgattgtgttcgaaggtggatatcatatgttacactcttgatttgtggattctggattcattaagaatatcaagatttcttctgtaatttgtgtggttcttcctaaatacaataacttgatttacgaattcctgtt

SEQ ID NO: 417523 - DNA, 1549 bp, Homo sapiens
tattcattcttttggtcacctagggatcttctaagtgtgatattactttcagagaattcagacaagtgagaaacaataatgtaggagtcagcaaagcagaattcagagacttcagccaatcactgctgctctgagaggatccagttagagactcagtatcagcggtcagaacttatctcactcctgtgaactttcaggctggacttaaagctgccaagtttcccctgcagggaaggaaacactgcctcccttcagcaggtagctcattagaaagccaaacaggcaaacgatcctggcctctcccgccagctgaccgctcttcagcatccatgcggttgtagtcgtgactttctcagtcacgatcaagggtgattttttcttaaatatcaagctgttctttgaacagggaatgaacatgagtttttgtaacgtgactgaagttgagtttaagtaggaagcgcaggaagttcccaagtgccaggtgtgtgtagctcagagttccttttacagtgaggtgtctctcactgggggagcttccaggatcctgagcagactggacacaatcatctctcccttcctctatgtcaagcactgttacaaaagactgtgagcaaatttccatctaaatattaataattctgaagaagaggcaaaactgttgaatgcaagcgatacctattgttgaagaaacccacaaatttctgattctaagatcaggggatacaacaaaatctacaagtcatttcaaatagcacacaggaatcaaactttggtaaatcatttctgaggcacaattaaatatattgtagcactatgttaattaattatattaaatgtcgattcatcttgaatgtattctcaattgcctaccaaaaattggtatgattatcatttctgggtctactgatttttcatcatggcaacagaaattgtcattaaatagaattaagatacaactatatatcttattatttaaaaacattcatagacatattcataaagtttgaatttaaagttttatttttgcaattcagttgtatagaaatgttacataaattcctaaatgctcaattcaggtggcatgatttttagaatattatcttcttcaagatgaatacttaggtctacttcagctctgatattctatttttactttcttacttgaagtgagaaaagagaatggtgaattgtattatagcggtaatacattatttttattttagcttagatttacatttatcagtaaaacgtgtcagtgggctgggtgcagtggctcacatctgtaatctcagcagtttgggaggctgaggtgggcacgccacttgagcaccggagttccagacgagcctggacaacatggcgaaaccccaaaaccccatctctacaaaaaatacaaaaattagctgggtgtggtgggacacgcctgtagtcccagctacttaggaggctgaggtacgaggatctcttgagtccaggaggtgcaggttgcagtgagccaatattgccccactgcactccagcctgggaagcagagtgagaccttgcctca

SEQ ID NO: 417524 - DNA, 1534 bp, Homo sapiens
tattcattcttttggtcacctagggatcttctaagtgtgatattactttcagagaattcagacaagtgagaaacaataatgtaggagtcagcaaagcagaattcagagacttcagccaatcactgctgctctgagaggatccagttagagactcagtatcagcggtcagaacttatctcactcctgtgaactttcaggctggacttaaagctgccaagtttcccctgcagggaaggaaacactgcctcccttcagcaggtagctcattagaaagccaaacaggcaaacgatcctggcctctcccgccagctgaccgctcttcagcatccatgcggttgtagtcgtgactttctcagtcacgatcaagggtgattttttcttaaatatcaagctgttctttgaacagggaatgaacatgagtttttgtaacgtgactgaagttgagtttaagtaggaagcgcaggaagttcccaagtgccaggtgtgtgtagctcagagttccttttacagtgaggtgtctctcactgggggagcttccaggatcctgagcagactggacacaatcatctctcccttcctctatgtcaagcactgttacaaaagactgtgagcaaatttccatctaaatattaataattctgaagaagaggcaaaactgttgaatgcaagcgatacctattgttgaagaaacccacaaatttctgattctaagatcaggggatacaacaaaatctacaagtcatttcaaatagcacacaggaatcaaactttggtaaatcatttctgaggcacaattaaatatattgtagcactatgttaattaattatattaaatgtcgattcatcttgaatgtattctcaattgcctaccaaaaattggtatgattatcatttctgggtctactgatttttcatcatggcaacagaaattgtcattaaatagaattaagatacaactatatatcttattatttaaaaacattcatagacatattcataaagtttgaatttaaagttttatttttgcaattcagttgtatagaaatgttacataaattcctaaatgctcaattcaggtggcatgatttttagaatattatcttcttcaagatgaatacttaggtctacttcagctctgatattctatttttactttcttacttgaagtgagaaaagagaatggtgaattgtattatagcggtaatacattatttttattttagcttagatttacatttatcagtaaaacgtgtcagtgggctgggtgcagtggtcatcctcttatcccacccagatttctatctggttggttagggtagtccatgcctcaaggaaggcggtgcagcttaatttaacatattgttcagtaaagaatcccattgtgtatcataagaatcccttatccttttcgggccctccaccataccagactgaaaagtattccattgtccagaagtagctggtcttgagatttttattttcaagtgtattttctgtgatgttgtctcattgttatggaatagtttaggataat

SEQ ID NO: 417525 - DNA, 1370 bp, Homo sapiens
agcggctctagtcccagtaggaggtttgactaagatcaatcatgacgacttacagtgacaaaggggcaaagcctgagagaggccgattcctccacttccactctgtgaccttctgggttggcaacgccaagcaggccgcgtcattctactgcagcaagatgggctttgaacctctagcctacaggggcctggagaccggttcccgggaggtggtcagccatgtaatcaaacaagggaagattgtgtttgtcctctcctcagcgctcaacccctggaacaaagagatgggcgatcacctggtgaaacacggtgacggagtgaaggacattgcgttcgaggtggaagattgtgactacatcgtgcagaaagcacgggaacggggcgccaaaatcatgcgggagccctgggtagagcaagacaagtttgggaaggtgaagtttgctgtgctgcagacgtatggggacaccacacacaccctggtggagaagatgaactacatcggccaattcttgcctggatatgaggccccagcgttcatggaccccctacttcctaaactgcccaaatgcagtctggagatgatcgaccacattgtgggaaaccagcctgatcaggagatggtgtccgcctccgaatggtgcacacggaatatagctctctgcgatccattgtggtggccaactatgaagagtccatcaagatgcccatcaatgagccagcgcctggcaagaagaagtcccagatccaggaatatgtggactataacgggggcgctggggtccagcacatcgctctcaagaccgaagacatcatcacagcgattcgccacttgagagagagaggcctggagttcttatctgttccctccacgtactacaaacaactgcgggagaagctgaagacggccaagatcaaggtgaaggagaacattgatgccctggaggagctgaaaatcctggtggactacgacgagaaaggctacctcctgcagatcttcaccaaaccggtgcaggaccggcccacgctcttcctggaagtcatccagcgccacaaccaccagggttttggagccggcaacttcaactcactgttcaaggctttcgaggaggagcagaacctgcggggtaacctcaccaacatggagaccaatggggtggtgcccggcatgtaagccccgcccaccccacggaggccacagccacacagccacgccccctgattctggaactcgcccaacttccctactggctgctccccttgggtcccgcccaccagcggactcggcccccaaggctccgcccacactgaccacgcccctcggcggggccgccctctgctccagccctcccgattaaagcgtgccccggtcc

SEQ ID NO: 417526 - DNA, 1201 bp, Homo sapiens
  misc_feature (1065)..(1065): n is a, c, g, or t
  misc_feature (1090)..(1090): n is a, c, g, or t
  misc_feature (1151)..(1152): n is a, c, g, or t
agcggctctagtcccagtaggaggtttgactaagatcaatcatgacgacttacagtgacaaaggggcaaagcctgagagaggccgattcctccacttccactctgtgaccttctgggttggcaacgccaagcaggccgcgtcattctactgcagcaagatgggctttgaacctctagcctacaggggcctggagaccggttcccgggaggtggtcagccatgtaatcaaacaagggaagattgtgtttgtcctctcctcagcgctcaacccctggaacaaagagatgggcgatcacctggtgaaacacggtgacggagtgaaggacattgcgttcgaggtggaagattgtgactacatcgtgcagaaagcacgggaacggggcgccaaaatcatgcgggagccctgggtagagcaagacaagtttgggaaggtgaagtttgctgtgctgcagacgtatggggacaccacacacaccctggtggagaagatgaactacatcggccaattcttgcctggatatgaggccccagcgttcatggaccccctacttcctaaactgcccaaatgcagtctggagatgatcgaccacattgtgggaaaccagcctgatcaggagatggtgtccgcctccgaatggtgcacacggaatatagctctctgcgatccattgtggtggccaactatgaagagtccatcaagatgcccatcaatgagccagcgcctggcaagaagaagtcccagatccaggaatatgtggactataacgggggcgctggggtccagcacatcgctctcaagaccgaagacatcatcacagcgattcgccacttgagagagagaggcctggagttcttatctgttccctccacgtactacaaacaactgcgggagaagctgaagacggccaagatcaaggtgaaggagaacattgatgccctggaggagctgaaaatcctggtggactacgacgagaaaggctacctcctgcagatcttcaccaaaccggtgcaggaccggcccacgctcttcctggaagtcatccagcgccacaaccaccagggttntggagccggcacttcactcactgtnaaggctttgaagaggacagacctgcggggaactaccacatggacaagggggggggcccgcnntttattcccccccacccaacgggcgccagcacacacccgccctgttttg

SEQ ID NO: 417527 - DNA, 1422 bp, Homo sapiens
agcggctctagtcccagtaggaggtttgactaagatcaatcatgacgacttacagtgacaaaggggcaaagcctgagagaggccgattcctccacttccactctgtgaccttctgggttggcaacgccaagcaggccgcgtcattctactgcagcaagatgggctttgaacctctagcctacaggggcctggagaccggttcccgggaggtggtcagccatgtaatcaaacaagggaagattgtgtttgtcctctcctcagcgctcaacccctggaacaaagagatgggcgatcacctggtgaaacacggtgacggagtgaaggacattgcgttcgaggtggaagattgtgactacatcgtgcagaaagcacgggaacggggcgccaaaatcatgcgggagccctgggtagagcaagacaagtttgggaaggtgaagtttgctgtgctgcagacgtatggggacaccacacacaccctggtggagaagatgaactacatcggccaattcttgcctggatatgaggccccagcgttcatggaccccctacttcctaaactgcccaaatgcagtctggagatgatcgaccacattgtgggaaaccagcctgatcaggagatggtgtccgcctccgaatggtacctgaaaaacctgcagttccaccgcttctggtccgtggatgacacgcaggtgcacacggaatatagctctctgcgatccattgtggtggccaactatgaagagtccatcaagatgcccatcaatgagccagcgcctggcaagaagaagtcccagatccaggaatatgtggactataacgggggcgctggggtccagcacatcgctctcaagaccgaagacatcatcacagcgattcgccacttgagagagagaggcctggagttcttatctgttccctccacgtactacaaacaactgcgggagaagctgaagacggccaagatcaaggtgaaggagaacattgatgccctggaggagctgaaaatcctggtggactacgacgagaaaggctacctcctgcagatcttcaccaaaccggtgcaggaccggcccacgctcttcctggaagtcatccagcgccacaaccaccagggttttggagccggcaacttcaactcactgttcaaggctttcgaggaggagcagaacctgcggggtaacctcaccaacatggagaccaatggggtggtgcccggcatgtaagccccgcccaccccacggaggccacagccacacagccacgccccctgattctggaactcgcccaacttccctactggctgctccccttgggtcccgcccaccagcggactcggcccccaaggctccgcccacactgaccacgcccctcggcggggccgccctctgctccagccctcccgattaaagcgtgccccggtcc

SEQ ID NO: 417528 - DNA, 351 bp, Homo sapiens
tgaccattcatgagaaatccgttcccatgatctaatcatttcccaccaggcccctcgtccaacactggggattacagttcaacatgagatttgggcagggccacacatccaagctatagcacgtggctactgggaaattttaaattacatatgtcatttgtgttttggcccacattatatttccatggggcagctaatcaaggggcctctagcctcccttttggatgaggaccgtgtacagaatcgtattcatctcatcctcattctggatctagaagaccttgctgaatagaattttcctgtgaatatagtccttttgaacctctctttcttactctgctagaatctctg

SEQ ID NO: 417529 - DNA, 338 bp, Homo sapiens
cttcatagaaggttttccccaggcatggataactgagggagtggggtagcctgagacccagttgttcaggctgtttctgtgaaattgcaatgttttcttcatgactgcaaaacatgtgacctcaccatttcagaaatgagtaaggaggtgcatgagtttgagtcagatcaacaacaatgcaaacacagctatccacccagaaatacaattgttttagctcattattgaagtactagtaattgcagttttttaccattacttacaatggcagaaaccgcaattacttttgcaccaatctaatacatgctggctttcctttctactttaagagcttcgag

SEQ ID NO: 417530 - DNA, 265 bp, Homo sapiens
gaagtagaaaatattaaattgagttttaaaaaataacggcttattgagatatattcatatacccaaaaagtaccattttaaaatgaacaattcagtgactttactgtgttcacagaaatgtacagtcattaccactatttaattttttatacacacacatactttgtgttgtagaggaattttaggttcacagcaagattgaacagaaagtacagagattttcccctgtatcttctaccccacatgcaggaatagccttccccac

SEQ ID NO: 417531 - DNA, 440 bp, Homo sapiens
cggtcttggttctgctcaaatatgcccagaagtctgcctagttttcctttgactccagcctcctcataaacttccctcacggcagcaccgccaggttcctcctcgggttccattcctcctcctgggacaatccactggtctgggtaccggctgctactcaccagcagcacctcgtcctcctgctcgctccggaagcacaggcacgccgcccgcttcttgaagccctcgcggtcgtaggtccgcgtctggttgggcttgaacttcatcatagaggcgggctcctgctgctgctgctgctgctccggccgccgccgtgggggcccggccgccgccgacccgccggggagtgggggcgagggcgaatgggcgaggaacgcccgggagcgctagtcggtgcgggaggatgcgcgaggccggtcagtcccggggccggcggccgc

SEQ ID NO: 417532 - DNA, 314 bp, Homo sapiens
atagcaataggtcctagaagggaaatgaaagagaaatttcctcccaatggtatcaacttgcttttataaatgaatttttccaaatgtttttttctgattcaaataatttggaaatagtctttctaacaaaagatggacttcagtgcttttgaaataattatggaagttttcaggtgcatacggcatataaagatgagaaagcagcatctgcatatggctatggaggaaaatatgaacattaagatgtccacctaattgggaagattaattgtaattgtagaaattaaactataatttgggttccaggattatcc

SEQ ID NO: 417533 - DNA, 296 bp, Homo sapiens
aaactggtaacacttaatcaaactgttaccttctaattttagagctctcccaccttcctttttcctttttaattgtaaaaaaacacataatgtaaaatgcaccacctcaaccatttttaagtgtacaattcagtggcattcgtttactcgtgttattgtataaccataaccaccatccatctccagaagtcttcgtcttgcaaaactgaaactctgtaccaagtaaacaataagtcccatctcccctttctctgtagcccttggcaactaccattctatttcctgtctatgaattt

SEQ ID NO: 417534 - DNA, 286 bp, Homo sapiens
tgtagtcccagctactcaggaggctgaggcaggagaatcacttgaacccgggaggtggaggttgcagtgagccaagatcgtgccattgcactccagcctgggtgacagagcaagactctgtctcaaaaaaaaaaaaaaaaagatttttctttaatagcaaaccagctcttgtttcctgggagccaatatttatgtgcttggatagcaaaggttttaaagtctttacttcattagattcagttgcccaagattatgaagtcacatatatacttctgttttgattata

SEQ ID NO: 417535 - DNA, 508 bp, Homo sapiens
ttagagttgtttaagtatttgacgtaattttagtaaaacttcatgtctttggaattctcaagaactaaatagttcttcaggtagtctatagtagacttggaaaaagttcactaggcttatcggaactgtacttgaaacacaaacatgtcccaattgaaggaaaggacttttcttgatgacatgagcatctgagatttttttctttctttctctttagttttcaactttaaatcagtgagatttgcaacaacagtagtatgttggcattaaatattcatgtcaggccaggtgcagtcgttcacgcctgtaatcccaacactatgggaggccagaaaggtggatcacttaagctttggagtttgagaccagcctaggtaacatggcaaaactctgtctctacaaagaatacagaaattaaccagctgtggtggcatgctcatatagtcccagctacttgggtggtagaggcaggatgatccagcctggatgacagtgagaccccgtctca

SEQ ID NO: 417536 - DNA, 792 bp, Homo sapiens
gatactctggtttctcttcaaatcgtataaatctttcgccttttactaaagatttccgtggagagaaacgagtgtgagtctgaaaccaattttttgaggccttgcgtttcttagcagggcttattttaagtgttttaaaaacagatgcgattccgttaaatcgcgtgtggagctatgtaaagtgtattatagaacaaatgcgagttacggtttttcagcttttcgctttgttaagtatgtgatatcaattgtattgcatttctgagcagttataatattaagatgttggggtggcttactgcttttgaccaagaagtaggtttgttggttgattacaccatggtttttaaccccagccactgagtgatggagggttaccgactcacaagcgagcataacgcctgaggtccgcctgctgtcaggcagcaagcatcagatctcctaggagcgggaacctatgtgaactgcgtatacgaggtatctaggtgcgtgctccttttaagaatctaatggctgatgacgaggggcacagtttcaacctggaactgtccacaccccctacccaccttcccccgcccttggaaaaactgccttccatgaactgggtcccttgtgccagaaaggttggggaccgctggactatccgatcaaatgaagcagggactcggggcgagctcccccgctgctcccgccggcttctccgtgtagaatcgaagaaggcagtcccaagggctcttctgccccgtatccccgcctgaggagcgtgccaggcgcgcagctagtcctcccccg

SEQ ID NO: 417537 - DNA, 756 bp, Homo sapiens
  misc_feature (577)..(577): n is a, c, g, or t
  misc_feature (755)..(756): n is a, c, g, or t
tgcatgtgccattccccggatggaatatctttctctctctatgcccaccaactcctacacatccttcaaaacccaagcacattgctcctcctctattcagacttctccatcctccaggcagagcccaggctccagcttggaacgcctccagcctcaggtccctccctgattcctttacagtcctgacctcacctggcacccacctgcctgggaacccctctagggccaagagctgtggctcataaagagatggggtctcgccatattgccaggctggtctcaaactcctgagctcaagctgtcctcccaccttgggctcccacagtgctgggattccaggcgtgagccaccgcacccggccctggatttaacttagtatattaaaggccacagatggaacgaggtgccaggaaaagactgcgctttaaaattggccccgacttgccgggcgcggtggttcacacctgtcatcccagcactttgggaggccgaggcgggcagatcacgaagtcaggagttcgagaccagcctggccaacatggtgaaagcccgtctctactaaaaatacaaaaattanccgggcgtggtggcgggagcctgtaatcccagctactcgggaggctgaggcaggagaatcgcttgaacctggaaggcggaggttgtagtgagccgagatcgtgccactgcactccagcctgggcgacagagcgatgctccgtctcaaaaaaaataaaataaaataaaataaaattggnn

SEQ ID NO: 417538 - DNA, 365 bp, Homo sapiens
tgcatgtgccattccccggatggaatatctttctctctctatgcccaccaactcctacacatccttcaaaacccaagcacattgctcctcctctattcagacttctccatcctccaggcagagcccaggctccagcttggaacgcctccagcctcaggtccctccctgattcctttacagtcctgacctcacctggcacccacctgcctgggaacccctctagggccaagagctgtggctcataaaggtgagcccaccgatggccttgtgcttagagccaaaccaggtagcttcccctagcatccccttcacacattactgccccgtgccaggcacatggagggctgaggggcccccttgtgccc

SEQ ID NO: 417539 - DNA, 472 bp, Homo sapiens
cagcctcttccttgtccacctcctccggcgcatcggtccgcatcagccatgatgccggtggggcccttcagagcccaaagttgaagcctagctggttgctgtgttgaccctgacgccgaggcggggtcaccatcccttgtttgggatttcccgggaatctacagttagcctagagataaagaatctcgttggggccaggtttttccaataccggtatttactgtttatgttctgaaagcagaggaaatgcttacccacaagtcaaagctgggatgctcacatttcttccatcaaaataatgttgttatgaaaataaaaccaactcatttcaccaatgtggcattttggttgaaagcctggtagtttgcaattgatgaagtttccaaatagaaagtcaacagtgaaacctatgcatctatattgggtaatttctagccataataaagtgttcacactttgattttagttgagg

SEQ ID NO: 417540 - DNA, 204 bp, Homo sapiens
ccacaccgctcagaggaggggtgcggcagccacacactcaccaggtacacactcgcaatccagcacactcacagcgccctaatccactttttgcctagtgcttattatcagctgacacattaaatatttgttatgtttctgttggcctctcctcacacaaagaagacaggtttgttgactgctgtatctccagcatgcacagcc

SEQ ID NO: 417541 - DNA, 111 bp, Homo sapiens
acacctaactccacgatcatcagaccttactttaaggcctcagaaacagagaagaatagacatatttcttataccctcaaagtaggttccctgaagcctggatacgacaga

SEQ ID NO: 417542 - DNA, 259 bp, Homo sapiens
gaaccatcaggtccagaattacatactgctcccttttttgtgcttcaatgatgctacagaaggacaaccctagcaagagtgcctgaactatgtaacataataaaaagtaagatagaggcgatgccactgacaactctggggatgtctcagaagatagttgagatttatcattaggtaacgatccaactgacaggttaaaaacaaactcactcctgaaaacaaacacatcctttttgagacaggatctcgctttgtcaca

SEQ ID NO: 417543 - DNA, 412 bp, Homo sapiens
tcattgcttgtaccctaacagcatgtccgccccccgccagggcctttgcactgctatttgctctgcctggaatgttccttccccaggtatctcctaggcttgtatctttcctttctgcaaattcactcaaatgtcaccagatcaccaaagcttcttctcatcaccagctgaacaatgccactcccaccgcagacaccacctaactctcttccctcctggattcttctgtacggtgttcctgatcagccgccatggtatagacttcactcacttgcttttctgttgtctgtccccttacccgcatcccaacaaaatcttcactccaagaaggcagggggtctttctttaatctgctttgatcactgatgtatgcactgccagtaacaggatagtatctagcactacttctgaa

SEQ ID NO: 417544 - DNA, 485 bp, Homo sapiens
aactattttaattagcattatacagtggaatgccatggacgaagagtcagaagaattcagattctttaacaaccgaccatccttcaaatttctcatcttcagaaggggatcctacttttttcccttgtggggttctaacaagaaacaaaccggaaagtgctctgtaaagtgaagcaattcccgtgtccaaaagatctcctatcaactccctacccaggacagcctagaggggaaactgatgagaacgaggagttttgctttatccaccattaaaactgaaagggtttccccctaaagatctgccatcaagagctgagccactgacgccattcctagttccactgctactagaagccttcatcacttgcaataatagaggatgatgattcattacaataaaaacagtatctactcccctgtggaagataatcctagggaagttctggaagaagtattaaaaacagcagcagagcaaagagggggaa

SEQ ID NO: 417545 - DNA, 1219 bp, Homo sapiens
taaatttaaaaaatgtatctataaaccaagaacagagtctgatatgaaatagacaaactttaataaggaaaaatgcaaaatccggtagttaaaaagcatgatggcaaaactgaagggtagaaggaggcaggagtttttgcaaaataaccagggaattttaatttcaaattaaatataagccaatagtgcaatgcaaccgataaagggaaaaatcaaatacaactgatcaagttggaaaacagtgagctattgggcttcattaatccacaaaaggaaatatgtggtaaagttggaatcacacctggcctatttatacaactttcaggccacacattaaggggaacattggcaaactgatcttctgcctggatgttttatccattattaaaaggggaatattgaagtctaccactattattgtattgctgtcaatttctccattcagatatgtcaatatttgctttgtatatttaaatgctctagtattgaatatgtatatacttataattgttatatcttcttactgaattgatcattttgtcatatggtgacctttatctctagagacaattttcaattttaagtctgttttgcctgacataaatatagccatttctgctttctttttgttaccattttggaatgtctttttctatcttgtcactttcagcctatgtgtatctttacatctagggtgagtttcttgtagatagcaagtcactggatcttgttttcttcataattcagtcttgacgtattgttatattagttcattttcacagtgctataaagaaatacccaagactaggtaatttataaaggaaagaagtttaattgactcacagttccatatggctgtgctgggggaggtcaagtaacttacaatcatggcagaaagcaacggagaagtaagtaccttcttcacaaggcagcgggaaagataaaacgaagggagaagagcctcttataaaaatctccagatctcctgagaactcactcactatcaagagaaaagcctgggggaaatcacccttatgatctaatcacctcttacctagtccctgccgtgacaagtgtggattacagtcagagatgagatttgcgtggggacacagagccaaaccatactgcttgtatatttataagaattcatcaatttcttctatattatccaatttttggcacataattgtaaataaaagtcccttatgatctttta

SEQ ID NO: 417546 - DNA, 4136 bp, Homo sapiens
ggacaagaaacacaagcaaatataaaacattcaattctaagagaagttcatcagagacatccttcaggattgtgagctggattttcctctacgtgcttcagtcttctctacacaaagagctgcaaaccaggtctttgttttgcactcttatttcaagcagaatgagtgctcctaaactcctctctctgggctgtatcttcttccccttgctactttttcagcaggcccgggctcaattcccaagacagtgtgccactgttgaggctttgagaagtggtatgtgttgcccagacctgtcccctgtgtctgggcctgggacagaccgctgtggctcatcatcagggaggggcagatgtgaggcagtgactgcagactcccggccccacagccctcagtatccccatgatggcagagatgatcgggaggtctggcccttgcgcttcttcaataggacatgtcactgcaacggcaatttctcaggacacaactgtgggacgtgccgtcctggctggagaggagctgcctgtgaccagagggttctcatagtcaggagaaatcttctggacttaagtaaagaagaaaagaaccactttgtccgggccctggatatggcaaagcgcacaactcaccctttatttgtcattgccaccaggagatcagaagaaatactggggccagatggcaacacgccacaatttgagaacatttccatttataactactttgtttggacacactattactcagtcaaaaagactttccttggggtaggacaggaaagctttggtgaagtggatttctctcatgagggaccagcttttctcacatggcacaggtaccacctcctgcgtctggagaaagacatgcaggaaatgttgcaagagccttctttctcccttccttactggaattttgcaacggggaaaaatgtctgtgatatctgcacggatgacttgatgggatccagaagcaactttgattccactctaataagcccaaactctgtcttttctcaatggcgagtggtctgtgactccttggaagattatgataccctgggaacactttgtaacagcaccgaggatgggccaattaggagaaatccagctggaaatgtggccagaccaatggtgcaacgtcttcctgaaccacaggatgtcgctcagtgcttggaagttggtttatttgacacgcctcctttttattccaactctacaaacagtttccgaaacacagtggaaggttacagtgaccccacgggaaagtatgaccctgctgttcgaagtcttcacaatttggctcatctattcctgaatggaacagggggacaaacccatttgtctccaaatgatcctatttttgtcctcctgcacaccttcacagatgcagtctttgatgaatggctgaggagatacaatgctgatatatccacatttccattggaaaatgcccctattggacataatagacaatacaacatggtgccattctggcccccagtcaccaacacagaaatgtttgttactgctccagacaacctgggatacacttatgaaattcaatggccaagtcgggagtttagtgtacctgagataattgccatagcagtagttggcgctttgttactggttgcactcatttttgggactgcttcttatctgattcgtgccagacgcagtatggatgaagctaaccagcctctcctcactgatcagtatcaatgctatgctgaagaatatgaaaaactccagaatcctaatcagtctgtggtctaacaaatgccctactctcttatgcattagtatcacaaaaccacctggttgaatataatagattgagttattaactgtattttctttcactttattaccttctttctaatacaagcatatgttagaattaaagttctaggcatacttttcaaagctgggaagaccctttcagaatcttttcaatgggttttaattttcagttctatttaaaatggtgaatgacactaaactccatgatatttaaggatagtgtgaagatctttggcatgatttaaaggttgagtatgtgaagatataagtgaactaccatgctttgtttacgtgtaaaggaaaataatgtttgatagtaaatgtccacttaaaatacatgaatgggcatttctaaaatgttaaaacataaacacatttccattcatggatatttgtcaacagatttaaagaaaaccacagttattaattaaagaaaattatgtgtagttataaaccaatgaaattttgattaaccttttcaaattaatgttccagtttgaagaccaatcaaatatattatttagtcaacatatactatttagtctcaggttcaaggctacaacaaaaatcaccatctttgtcaaactttggagagggaaaatcttcactttcttaagcaacaatggatattgcctgtgtttgccactgtgtttccctgcctctcaattcgctgaaaaaggaactacctatccttacatttcacctactaatgtctcttctaacatcttagaggtccatggagaaggcatatggagaacatgttttatactgctctataaatagtattccaatcactgtgcttaatttaaatagcattatcttatcatttatcagccttttatgtattttccaagtaaaatattaacatattatttcattggtcttcttttttatctggttctatatgaatgctattttttcccttctcttctaacatgaaatatattttctctttttgatcttgtgctatgaaacaatcttccaaagaactgtataaggtggtcataagtgaatattttaattaaaattggtaaaaataaataataacagtaataatcatgcactatagaaaatggctaaactgagattctaaattctacaaacagaaacaagtttaagttatgtatccctgattggttactgggttttcctatattcaaaaatattaaggctatatatacacaagataaacaaataaaatatatcaaagagcatgcatataacaataggatgttttacactagcattattcaatttattctcttggaatacattgcgatttgttaaaatacagtatactcacagcttttcaaagaaattactgtgtaatgtaagatgcctttttatatagaacatcaatgaaactaaatacttcactttatatttttgtagacttactaattactcatttcagaaacatttattaagcacatactagatatcaagtatttcaaggcactatagatttagagagaagaaaataagaattgtaaaattgagaaggtcatgtttgacttgtacttcaaggactgccaatggatttaccaaatatagaagcagagaagggaattttattcaaaagtgacagcatggacaagggcacagaagtttaaaagagcatggaactttttaaaatataaaataggtcagtgtgattacagtatagtttttatggaggggagtaaaaagataaattggaaataaaaccagagtgtcctatatgcaattcttaatacttggaattaattccatgggaaataggaaacagggagagtcataatcaagctgtatatttataaatatagtagtgatggtgctgttcacaaataacgttgatgagaaataatttggaatggttaaaagcaaagaaactcattaatatggaatagattgtgggagagaggagaaagccttgtttcaaagcattaattctaaataatcataattataagataaagttgtacacatctataaataaataaatacagcttatattataaatactatataatattgaaattataagtataatataaatatagctttaagtaaatcattacaaaaatgtcagttaacaatggaagactgtgagagagaggattaaaacaagagcaaaacagaaaactattaacaaaatggcagttagtaagtcctcagcaatcagtaattattttaatgtaaatggcttaatatcccaaataagaatgcttaaagtagctgagtgaatcaaaaaacatgatccagtgacttgctgtctataagagactcactttagatttaaaaatacatataggctggaagtaaagagatggaaaaggatattatgaaaatggt

SEQ ID NO: 417547 - DNA, 2584 bp, Homo sapiens
ggacaagaaacacaagcaaatataaaacattcaattctaagagaagttcatcagagacatccttcaggattgtgagctggattttcctctacgtgcttcagtcttctctacacaaagagctgcaaaccaggtctttgttttgcactcttatttcaagcagaatgagtgctcctaaactcctctctctgggctgtatcttcttccccttgctactttttcagcaggcccgggctcaattcccaagacagtgtgccactgttgaggctttgagaagtggtatgtgttgcccagacctgtcccctgtgtctgggcctgggacagaccgctgtggctcatcatcagggaggggcagatgtgaggcagtgactgcagactcccggccccacagccctcagtatccccatgatggcagagatgatcgggaggtctggcccttgcgcttcttcaataggacatgtcactgcaacggcaatttctcaggacacaactgtgggacgtgccgtcctggctggagaggagctgcctgtgaccagagggttctcatagtcaggagaaatcttctggacttaagtaaagaagaaaagaaccactttgtccgggccctggatatggcaaagcgcacaactcaccctttatttgtcattgccaccaggagatcagaagaaatactggggccagatggcaacacgccacaatttgagaacatttccatttataactactttgtttggacacactattactcagtcaaaaagactttccttggggtaggacaggaaagctttggtgaagtggatttctctcatgagggaccagcttttctcacatggcacaggtaccacctcctgcgtctggagaaagacatgcaggaaatgttgcaagagccttctttctcccttccttactggaattttgcaacggggaaaaatgtctgtgatatctgcacggatgacttgatgggatccagaagcaactttgattccactctaataagcccaaactctgtcttttctcaatggcgagtggtctgtgactccttggaagattatgataccctgggaacactttgtaacagcaccgaggatgggccaattaggagaaatccagctggaaatgtggccagaccaatggtgcaacgtcttcctgaaccacaggatgtcgctcagtgcttggaagttggtttatttgacacgcctcctttttattccaactctacaaacagtttccgaaacacagtggaaggttacagtgaccccacgggaaagtatgaccctgctgttcgaagtcttcacaatttggctcatctattcctgaatggaacagggggacaaacccatttgtctccaaatgatcctatttttgtcctcctgcacaccttcacagatgcagtctttgatgaatggctgaggagatacaatgctgatatatccacatttccattggaaaatgcccctattggacataatagacaatacaacatggtgccattctggcccccagtcaccaacacagaaatgtttgttactgctccagacaacctgggatacacttatgaaattcaatggccaagtcgggagtttagtgtacctgagataattgccatagcagtagttggcgctttgttactggttgcactcatttttgggactgcttcttatctgattcgtgccagacgcagtatggatgaagctaaccagcctctcctcactgatcagtatcaatgctatgctgaagaatatgaaaaactccagaatcctaatcagtctgtggtctaacaaatgccctactctcttatgcattagtatcacaaaaccacctggttgaatataatagattgagttattaactgtattttctttcactttattaccttctttctaatacaagcatatgttagaattaaagttctaggcatacttttcaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaagggggaggggggggggggtggcacagacgaaccgcgcggaggagcaggagagaggacagcgaggccggagcagaatgaaggagagataagagagggaacacgcggccgggaggacgacaggagcatggaacgcaggacggaaccaggctgcagctgagatagaaagaagagagagggaggcggagagacgaacaaagagacgaagcgacgagagagagaccaggaaagagaagagaacggtataagaagaagcaagaggcaggcacgagaccaaaacggaaagagcaagagatagccgacgcgaggagaaaaaagaaagagagaagaacgcagagaaagcaaaaaaaagcagaaaaataccaagagaggagagaaggcgaagctaggagcaacaaagagcaagaaaagaaagagacaaagacggagagagggagaaggagcggcagatagaagcagacaaaaacgaacatacgaacaaaataaacgagagcggacaagaagaagagacacaaaaaaaaacaaa

SEQ ID NO: 417548 - DNA, 3819 bp, Homo sapiens
ggacaagaaacacaagcaaatataaaacattcaattctaagagaagttcatcagagacatccttcaggattgtgagctggattttcctctacgtgcttcagtcttctctacacaaagagctgcaaaccaggtctttgttttgcactcttatttcaagcagaatgagtgctcctaaactcctctctctgggctgtatcttcttccccttgctactttttcagcaggcccgggctcaattcccaagacagtgtgccactgttgaggctttgagaagtggtatgtgttgcccagacctgtcccctgtgtctgggcctgggacagaccgctgtggctcatcatcagggaggggcagatgtgaggcagtgactgcagactcccggccccacagccctcagtatccccatgatggcagagatgatcgggaggtctggcccttgcgcttcttcaataggacatgtcactgcaacggcaatttctcaggacacaactgtgggacgtgccgtcctggctggagaggagctgcctgtgaccagagggttctcatagtcaggagaaatcttctggacttaagtaaagaagaaaagaaccactttgtccgggccctggatatggcaaagcgcacaactcaccctttatttgtcattgccaccaggagatcagaagaaatactggggccagatggcaacacgccacaatttgagaacatttccatttataactactttgtttggacacactattggacataatagacaatacaacatggtgccattctggcccccagtcaccaacacagaaatgtttgttactgctccagacaacctgggatacacttatgaaattcaatggccaagtcgggagtttagtgtacctgagataattgccatagcagtagttggcgctttgttactggttgcactcatttttgggactgcttcttatctgattcgtgccagacgcagtatggatgaagctaaccagcctctcctcactgatcagtatcaatgctatgctgaagaatatgaaaaactccagaatcctaatcagtctgtggtctaacaaatgccctactctcttatgcattagtatcacaaaaccacctggttgaatataatagattgagttattaactgtattttctttcactttattaccttctttctaatacaagcatatgttagaattaaagttctaggcatacttttcaaagctgggaagaccctttcagaatcttttcaatgggttttaattttcagttctatttaaaatggtgaatgacactaaactccatgatatttaaggatagtgtgaagatctttggcatgatttaaaggttgagtatgtgaagatataagtgaactaccatgctttgtttacgtgtaaaggaaaataatgtttgatagtaaatgtccacttaaaatacatgaatgggcatttctaaaatgttaaaacataaacacatttccattcatggatatttgtcaacagatttaaagaaaaccacagttattaattaaagaaaattatgtgtagttataaaccaatgaaattttgattaaccttttcaaattaatgttccagtttgaagaccaatcaaatatattatttagtcaacatatactatttagtctcaggttcaaggctacaacaaaaatcaccatctttgtcaaactttggagagggaaaatcttcactttcttaagcaacaatggatattgcctgtgtttgccactgtgtttccctgcctctcaattcgctgaaaaaggaactacctatccttacatttcacctactaatgtctcttctaacatcttagaggtccatggagaaggcatatggagaacatgttttatactgctctataaatagtattccaatcactgtgcttaatttaaatagcattatcttatcatttatcagccttttatgtattttccaagtaaaatattaacatattatttcattggtcttcttttttatctggttctatatgaatgctattttttcccttctcttctaacatgaaatatattttctctttttgatcttgtgctatgaaacaatcttccaaagaactgtataaggtggtcataagtgaatattttaattaaaattggtaaaaataaataataacagtaataatcatgcactatagaaaatggctaaactgagattctaaattctacaaacagaaacaagtttaagttatgtatccctgattggttactgggttttcctatattcaaaaatattaaggctatatatacacaagataaacaaataaaatatatcaaagagcatgcatataacaataggatgttttacactagcattattcaatttattctcttggaatacattgcgatttgttaaaatacagtatactcacagcttttcaaagaaattactgtgtaatgtaagatgcctttttatatagaacatcaatgaaactaaatacttcactttatatttttgtagacttactaattactcatttcagaaacatttattaagcacatactagatatcaagtatttcaaggcactatagatttagagagaagaaaataagaattgtaaaattgagaaggtcatgtttgacttgtacttcaaggactgccaatggatttaccaaatatagaagcagagaagggaattttattcaaaagtgacagcatggacaagggcacagaagtttaaaagagcatggaactttttaaaatataaaataggtcagtgtgattacagtatagtttttatggaggggagtaaaaagataaattggaaataaaaccagagtgtcctatatgcaattcttaatacttggaattaattccatgggaaataggaaacagggagagtcataatcaagctgtatatttataaatatagtagtgatggtgctgttcacaaataacgttgatgagaaataatttggaatggttaaaagcaaagaaactcattaatatggaatagattgtgggagagaggagaaagccttgtttcaaagcattaattctaaataatcataattataagataaagttgtacacatctataaataaataaatacagcttatattataaatactatataatattgaaattataagtataatataaatatagctttaagtaaatcattacaaaaatgtcagttaacaatggaagactgtgagagagaggattaaaacaagagcaaaacagaaaactattaacaaaatggcagttagtaagtcctcagcaatcagtaattattttaatgtaaatggcttaatatcccaaataagaatgcttaaagtagctgagtgaatcaagtcactggatcttgttttcttcataattcagtcttgacgtattgttatattagttcattttcacagtgctataaagaaatacccaagactaggtaatttataaaggaaagaagtttaattgactcacagttccatatggctgtgctgggggaggtcaagtaacttacaatcatggcagaaagcaacggagaagtaagtaccttcttcacaaggcagcgggaaagataaaacgaagggagaagagcctcttataaaaatctccagatctcctgagaactcactcactatcaagagaaaagcctgggggaaatcacccttatgatctaatcacctcttacctagtccctgccgtgacaagtgtggattacagtcagagatgagatttgcgtggggacacagagccaaaccatactgcttgtatatttataagaattcatcaatttcttctatattatccaatttttggcacataattgtaaataaaagtcccttatgatctttta

SEQ ID NO: 417549 - DNA, 3439 bp, Homo sapiens
aaatacatttaatgaattttattcaaattgctttatgtaatttttaaaaattattcaagatcaccataggtgatgaaatactaaaactcccctgcttttaaactctcttttttattaagtggtatattggtactgtattcaaagcattttctgttttatgtaatttctcatcctgctgtagtgaaacttcatatctttattcagtgtaaaataagaataaaattttttcaggttctccttgaatattggatgcctttagaactcaataatgataggaatattaattttattatgtttattaatacgttgtctttggaataatttagatatatccacatttccattggaaaatgcccctattggacataatagacaatacaacatggtgccattctggcccccagtcaccaacacagaaatgtttgttactgctccagacaacctgggatacacttatgaaattcaatggccaagtcgggagtttagtgtacctgagataattgccatagcagtagttggcgctttgttactggttgcactcatttttgggactgcttcttatctgattcgtgccagacgcagtatggatgaagctaaccagcctctcctcactgatcagtatcaatgctatgctgaagaatatgaaaaactccagaatcctaatcagtctgtggtctaacaaatgccctactctcttatgcattagtatcacaaaaccacctggttgaatataatagattgagttattaactgtattttctttcactttattaccttctttctaatacaagcatatgttagaattaaagttctaggcatacttttcaaagctgggaagaccctttcagaatcttttcaatgggttttaattttcagttctatttaaaatggtgaatgacactaaactccatgatatttaaggatagtgtgaagatctttggcatgatttaaaggttgagtatgtgaagatataagtgaactaccatgctttgtttacgtgtaaaggaaaataatgtttgatagtaaatgtccacttaaaatacatgaatgggcatttctaaaatgttaaaacataaacacatttccattcatggatatttgtcaacagatttaaagaaaaccacagttattaattaaagaaaattatgtgtagttataaaccaatgaaattttgattaaccttttcaaattaatgttccagtttgaagaccaatcaaatatattatttagtcaacatatactatttagtctcaggttcaaggctacaacaaaaatcaccatctttgtcaaactttggagagggaaaatcttcactttcttaagcaacaatggatattgcctgtgtttgccactgtgtttccctgcctctcaattcgctgaaaaaggaactacctatccttacatttcacctactaatgtctcttctaacatcttagaggtccatggagaaggcatatggagaacatgttttatactgctctataaatagtattccaatcactgtgcttaatttaaatagcattatcttatcatttatcagccttttatgtattttccaagtaaaatattaacatattatttcattggtcttcttttttatctggttctatatgaatgctattttttcccttctcttctaacatgaaatatattttctctttttgatcttgtgctatgaaacaatcttccaaagaactgtataaggtggtcataagtgaatattttaattaaaattggtaaaaataaataataacagtaataatcatgcactatagaaaatggctaaactgagattctaaattctacaaacagaaacaagtttaagttatgtatccctgattggttactgggttttcctatattcaaaaatattaaggctatatatacacaagataaacaaataaaatatatcaaagagcatgcatataacaataggatgttttacactagcattattcaatttattctcttggaatacattgcgatttgttaaaatacagtatactcacagcttttcaaagaaattactgtgtaatgtaagatgcctttttatatagaacatcaatgaaactaaatacttcactttatatttttgtagacttactaattactcatttcagaaacatttattaagcacatactagatatcaagtatttcaaggcactatagatttagagagaagaaaataagaattgtaaaattgagaaggtcatgtttgacttgtacttcaaggactgccaatggatttaccaaatatagaagcagagaagggaattttattcaaaagtgacagcatggacaagggcacagaagtttaaaagagcatggaactttttaaaatataaaataggtcagtgtgattacagtatagtttttatggaggggagtaaaaagataaattggaaataaaaccagagtgtcctatatgcaattcttaatacttggaattaattccatgggaaataggaaacagggagagtcataatcaagctgtatatttataaatatagtagtgatggtgctgttcacaaataacgttgatgagaaataatttggaatggttaaaagcaaagaaactcattaatatggaatagattgtgggagagaggagaaagccttgtttcaaagcattaattctaaataatcataattataagataaagttgtacacatctataaataaataaatacagcttatattataaatactatataatattgaaattataagtataatataaatatagctttaagtaaatcattacaaaaatgtcagttaacaatggaagactgtgagagagaggattaaaacaagagcaaaacagaaaactattaacaaaatggcagttagtaagtcctcagcaatcagtaattattttaatgtaaatggcttaatatcccaaataagaatgcttaaagtagctgagtgaatcaagtcactggatcttgttttcttcataattcagtcttgacgtattgttatattagttcattttcacagtgctataaagaaatacccaagactaggtaatttataaaggaaagaagtttaattgactcacagttccatatggctgtgctgggggaggtcaagtaacttacaatcatggcagaaagcaacggagaagtaagtaccttcttcacaaggcagcgggaaagataaaacgaagggagaagagcctcttataaaaatctccagatctcctgagaactcactcactatcaagagaaaagcctgggggaaatcacccttatgatctaatcacctcttacctagtccctgccgtgacaagtgtggattacagtcagagatgagatttgcgtggggacacagagccaaaccatactgcttgtatatttataagaattcatcaatttcttctatattatccaatttttggcacataattgtaaataaaagtcccttatgatctttta

SEQ ID NO: 417550 - DNA, 303 bp, Homo sapiens
cacaggtaccacctcctgcgtctggagaaagacatgcaggtatgtaagaagcatttcagtttgcagactctttacagacaagatgccttgtttgtaagtgattttaattcactagttttcagaatcatcagaacatttgatgaaaaagcaattttatgttactaacctgtctttggcatttcgttttctccttattttggttacttgttaattaatctttatcttggtgaagtgaaaataaagcaaaatcaataatgagcaaaatgagacatttgcaggaatgaattaaaagtttaaaaatat

SEQ ID NO: 417551 - DNA, 4535 bp, Homo sapiens
ggacaagaaacacaagcaaatataaaacattcaattctaagagaagttcatcagagacatccttcaggattgtgagctggattttcctctacgtgcttcagtcttctctacacaaagagctgcaaaccaggtctttgttttgcactcttatttcaagcagaatgagtgctcctaaactcctctctctgggctgtatcttcttccccttgctactttttcagcaggcccgggctcaattcccaagacagtgtgccactgttgaggctttgagaagtggtatgtgttgcccagacctgtcccctgtgtctgggcctgggacagaccgctgtggctcatcatcagggaggggcagatgtgaggcagtgactgcagactcccggccccacagccctcagtatccccatgatggcagagatgatcgggaggtctggcccttgcgcttcttcaataggacatgtcactgcaacggcaatttctcaggacacaactgtgggacgtgccgtcctggctggagaggagctgcctgtgaccagagggttctcatagtcaggagaaatcttctggacttaagtaaagaagaaaagaaccactttgtccgggccctggatatggcaaagcgcacaactcaccctttatttgtcattgccaccaggagatcagaagaaatactggggccagatggcaacacgccacaatttgagaacatttccatttataactactttgtttggacacactattactcagtcaaaaagactttccttggggtaggacaggaaagctttggtgaagtggatttctctcatgagggaccagcttttctcacatggcacaggtaccacctcctgcgtctggagaaagacatgcaggaaatgttgcaagagccttctttctcccttccttactggaattttgcaacggggaaaaatgtctgtgatatctgcacggatgacttgatgggatccagaagcaactttgattccactctaataagcccaaactctgtcttttctcaatggcgagtggtctgtgactccttggaagattatgataccctgggaacactttgtaacagcaccgaggatgggccaattaggagaaatccagctggaaatgtggccagaccaatggtgcaacgtcttcctgaaccacaggatgtcgctcagtgcttggaagttggtttatttgacacgcctcctttttattccaactctacaaacagtttccgaaacacagtggaaggttacagtgaccccacgggaaagtatgaccctgctgttcgaagtcttcacaatttggctcatctattcctgaatggaacagggggacaaacccatttgtctccaaatgatcctatttttgtcctcctgcacaccttcacagatgcagtctttgatgaatggctgaggagatacaatgctgatatatccacatttccattggaaaatgcccctattggacataatagacaatacaacatggtgccattctggcccccagtcaccaacacagaaatgtttgttactgctccagacaacctgggatacacttatgaaattcaatggccaagtcgggagtttagtgtacctgagataattgccatagcagtagttggcgctttgttactggttgcactcatttttgggactgcttcttatctgattcgtgccagacgcagtatggatgaagctaaccagcctctcctcactgatcagtatcaatgctatgctgaagaatatgaaaaactccagaatcctaatcagtctgtggtctaacaaatgccctactctcttatgcattagtatcacaaaaccacctggttgaatataatagattgagttattaactgtattttctttcactttattaccttctttctaatacaagcatatgttagaattaaagttctaggcatacttttcaaagctgggaagaccctttcagaatcttttcaatgggttttaattttcagttctatttaaaatggtgaatgacactaaactccatgatatttaaggatagtgtgaagatctttggcatgatttaaaggttgagtatgtgaagatataagtgaactaccatgctttgtttacgtgtaaaggaaaataatgtttgatagtaaatgtccacttaaaatacatgaatgggcatttctaaaatgttaaaacataaacacatttccattcatggatatttgtcaacagatttaaagaaaaccacagttattaattaaagaaaattatgtgtagttataaaccaatgaaattttgattaaccttttcaaattaatgttccagtttgaagaccaatcaaatatattatttagtcaacatatactatttagtctcaggttcaaggctacaacaaaaatcaccatctttgtcaaactttggagagggaaaatcttcactttcttaagcaacaatggatattgcctgtgtttgccactgtgtttccctgcctctcaattcgctgaaaaaggaactacctatccttacatttcacctactaatgtctcttctaacatcttagaggtccatggagaaggcatatggagaacatgttttatactgctctataaatagtattccaatcactgtgcttaatttaaatagcattatcttatcatttatcagccttttatgtattttccaagtaaaatattaacatattatttcattggtcttcttttttatctggttctatatgaatgctattttttcccttctcttctaacatgaaatatattttctctttttgatcttgtgctatgaaacaatcttccaaagaactgtataaggtggtcataagtgaatattttaattaaaattggtaaaaataaataataacagtaataatcatgcactatagaaaatggctaaactgagattctaaattctacaaacagaaacaagtttaagttatgtatccctgattggttactgggttttcctatattcaaaaatattaaggctatatatacacaagataaacaaataaaatatatcaaagagcatgcatataacaataggatgttttacactagcattattcaatttattctcttggaatacattgcgatttgttaaaatacagtatactcacagcttttcaaagaaattactgtgtaatgtaagatgcctttttatatagaacatcaatgaaactaaatacttcactttatatttttgtagacttactaattactcatttcagaaacatttattaagcacatactagatatcaagtatttcaaggcactatagatttagagagaagaaaataagaattgtaaaattgagaaggtcatgtttgacttgtacttcaaggactgccaatggatttaccaaatatagaagcagagaagggaattttattcaaaagtgacagcatggacaagggcacagaagtttaaaagagcatggaactttttaaaatataaaataggtcagtgtgattacagtatagtttttatggaggggagtaaaaagataaattggaaataaaaccagagtgtcctatatgcaattcttaatacttggaattaattccatgggaaataggaaacagggagagtcataatcaagctgtatatttataaatatagtagtgatggtgctgttcacaaataacgttgatgagaaataatttggaatggttaaaagcaaagaaactcattaatatggaatagattgtgggagagaggagaaagccttgtttcaaagcattaattctaaataatcataattataagataaagttgtacacatctataaataaataaatacagcttatattataaatactatataatattgaaattataagtataatataaatatagctttaagtaaatcattacaaaaatgtcagttaacaatggaagactgtgagagagaggattaaaacaagagcaaaacagaaaactattaacaaaatggcagttagtaagtcctcagcaatcagtaattattttaatgtaaatggcttaatatcccaaataagaatgcttaaagtagctgagtgaatcaagtcactggatcttgttttcttcataattcagtcttgacgtattgttatattagttcattttcacagtgctataaagaaatacccaagactaggtaatttataaaggaaagaagtttaattgactcacagttccatatggctgtgctgggggaggtcaagtaacttacaatcatggcagaaagcaacggagaagtaagtaccttcttcacaaggcagcgggaaagataaaacgaagggagaagagcctcttataaaaatctccagatctcctgagaactcactcactatcaagagaaaagcctgggggaaatcacccttatgatctaatcacctcttacctagtccctgccgtgacaagtgtggattacagtcagagatgagatttgcgtggggacacagagccaaaccatactgcttgtatatttataagaattcatcaatttcttctatattatccaatttttggcacataattgtaaataaaagtcccttatgatctttta

SEQ ID NO: 417552 - DNA, 4330 bp, Homo sapiens
ggacaagaaacacaagcaaatataaaacattcaattctaagagaagttcatcagagacatccttcaggattgtgagctggattttcctctacgtgcttcagtcttctctacacaaagagctgcaaaccaggtctttgttttgcactcttatttcaagcagaatgagtgctcctaaactcctctctctgggctgtatcttcttccccttgctactttttcagcaggcccgggctcaattcccaagacagtgtgccactgttgaggctttgagaagtggtatgtgttgcccagacctgtcccctgtgtctgggcctgggacagaccgctgtggctcatcatcagggaggggcagatgtgaggcagtgactgcagactcccggccccacagccctcagtatccccatgatggcagagatgatcgggaggtctggcccttgcgcttcttcaataggacatgtcactgcaacggcaatttctcaggacacaactgtgggacgtgccgtcctggctggagaggagctgcctgtgaccagagggttctcatagtcaggagaaatcttctggacttaagtaaagaagaaaagaaccactttgtccgggccctggatatggcaaagcgcacaactcaccctttatttgtcattgccaccaggagatcagaagaaatactggggccagatggcaacacgccacaatttgagaacatttccatttataactactttgtttggacacactattactcagtcaaaaagactttccttggggtaggacaggaaagctttggtgaagtggatttctctcatgagggaccagcttttctcacatggcacaggtaccacctcctgcgtctggagaaagacatgcaggcaccgaggatgggccaattaggagaaatccagctggaaatgtggccagaccaatggtgcaacgtcttcctgaaccacaggatgtcgctcagtgcttggaagttggtttatttgacacgcctcctttttattccaactctacaaacagtttccgaaacacagtggaaggttacagtgaccccacgggaaagtatgaccctgctgttcgaagtcttcacaatttggctcatctattcctgaatggaacagggggacaaacccatttgtctccaaatgatcctatttttgtcctcctgcacaccttcacagatgcagtctttgatgaatggctgaggagatacaatgctgatatatccacatttccattggaaaatgcccctattggacataatagacaatacaacatggtgccattctggcccccagtcaccaacacagaaatgtttgttactgctccagacaacctgggatacacttatgaaattcaatggccaagtcgggagtttagtgtacctgagataattgccatagcagtagttggcgctttgttactggttgcactcatttttgggactgcttcttatctgattcgtgccagacgcagtatggatgaagctaaccagcctctcctcactgatcagtatcaatgctatgctgaagaatatgaaaaactccagaatcctaatcagtctgtggtctaacaaatgccctactctcttatgcattagtatcacaaaaccacctggttgaatataatagattgagttattaactgtattttctttcactttattaccttctttctaatacaagcatatgttagaattaaagttctaggcatacttttcaaagctgggaagaccctttcagaatcttttcaatgggttttaattttcagttctatttaaaatggtgaatgacactaaactccatgatatttaaggatagtgtgaagatctttggcatgatttaaaggttgagtatgtgaagatataagtgaactaccatgctttgtttacgtgtaaaggaaaataatgtttgatagtaaatgtccacttaaaatacatgaatgggcatttctaaaatgttaaaacataaacacatttccattcatggatatttgtcaacagatttaaagaaaaccacagttattaattaaagaaaattatgtgtagttataaaccaatgaaattttgattaaccttttcaaattaatgttccagtttgaagaccaatcaaatatattatttagtcaacatatactatttagtctcaggttcaaggctacaacaaaaatcaccatctttgtcaaactttggagagggaaaatcttcactttcttaagcaacaatggatattgcctgtgtttgccactgtgtttccctgcctctcaattcgctgaaaaaggaactacctatccttacatttcacctactaatgtctcttctaacatcttagaggtccatggagaaggcatatggagaacatgttttatactgctctataaatagtattccaatcactgtgcttaatttaaatagcattatcttatcatttatcagccttttatgtattttccaagtaaaatattaacatattatttcattggtcttcttttttatctggttctatatgaatgctattttttcccttctcttctaacatgaaatatattttctctttttgatcttgtgctatgaaacaatcttccaaagaactgtataaggtggtcataagtgaatattttaattaaaattggtaaaaataaataataacagtaataatcatgcactatagaaaatggctaaactgagattctaaattctacaaacagaaacaagtttaagttatgtatccctgattggttactgggttttcctatattcaaaaatattaaggctatatatacacaagataaacaaataaaatatatcaaagagcatgcatataacaataggatgttttacactagcattattcaatttattctcttggaatacattgcgatttgttaaaatacagtatactcacagcttttcaaagaaattactgtgtaatgtaagatgcctttttatatagaacatcaatgaaactaaatacttcactttatatttttgtagacttactaattactcatttcagaaacatttattaagcacatactagatatcaagtatttcaaggcactatagatttagagagaagaaaataagaattgtaaaattgagaaggtcatgtttgacttgtacttcaaggactgccaatggatttaccaaatatagaagcagagaagggaattttattcaaaagtgacagcatggacaagggcacagaagtttaaaagagcatggaactttttaaaatataaaataggtcagtgtgattacagtatagtttttatggaggggagtaaaaagataaattggaaataaaaccagagtgtcctatatgcaattcttaatacttggaattaattccatgggaaataggaaacagggagagtcataatcaagctgtatatttataaatatagtagtgatggtgctgttcacaaataacgttgatgagaaataatttggaatggttaaaagcaaagaaactcattaatatggaatagattgtgggagagaggagaaagccttgtttcaaagcattaattctaaataatcataattataagataaagttgtacacatctataaataaataaatacagcttatattataaatactatataatattgaaattataagtataatataaatatagctttaagtaaatcattacaaaaatgtcagttaacaatggaagactgtgagagagaggattaaaacaagagcaaaacagaaaactattaacaaaatggcagttagtaagtcctcagcaatcagtaattattttaatgtaaatggcttaatatcccaaataagaatgcttaaagtagctgagtgaatcaagtcactggatcttgttttcttcataattcagtcttgacgtattgttatattagttcattttcacagtgctataaagaaatacccaagactaggtaatttataaaggaaagaagtttaattgactcacagttccatatggctgtgctgggggaggtcaagtaacttacaatcatggcagaaagcaacggagaagtaagtaccttcttcacaaggcagcgggaaagataaaacgaagggagaagagcctcttataaaaatctccagatctcctgagaactcactcactatcaagagaaaagcctgggggaaatcacccttatgatctaatcacctcttacctagtccctgccgtgacaagtgtggattacagtcagagatgagatttgcgtggggacacagagccaaaccatactgcttgtatatttataagaattcatcaatttcttctatattatccaatttttggcacataattgtaaataaaagtcccttatgatctttta

SEQ ID NO: 417553 - DNA, 4388 bp, Homo sapiens
ggacaagaaacacaagcaaatataaaacattcaattctaagagaagttcatcagagacatccttcaggattgtgagctggattttcctctacgtgcttcagtcttctctacacaaagagctgcaaaccaggtctttgttttgcactcttatttcaagcagaatgagtgctcctaaactcctctctctgggctgtatcttcttccccttgctactttttcagcaggcccgggctcaattcccaagacagtgtgccactgttgaggctttgagaagtggtatgtgttgcccagacctgtcccctgtgtctgggcctgggacagaccgctgtggctcatcatcagggaggggcagatgtgaggcagtgactgcagactcccggccccacagccctcagtatccccatgatggcagagatgatcgggaggtctggcccttgcgcttcttcaataggacatgtcactgcaacggcaatttctcaggacacaactgtgggacgtgccgtcctggctggagaggagctgcctgtgaccagagggttctcatagtcaggagaaatcttctggacttaagtaaagaagaaaagaaccactttgtccgggccctggatatggcaaagcgcacaactcaccctttatttgtcattgccaccaggagatcagaagaaatactggggccagatggcaacacgccacaatttgagaacatttccatttataactactttgtttggacacactattactcagtcaaaaagactttccttggggtaggacaggaaagctttggtgaagtggatttctctcatgagggaccagcttttctcacatggcacaggtaccacctcctgcgtctggagaaagacatgcaggaaatgttgcaagagccttctttctcccttccttactggaattttgcaacggggaaaaatgtctgtgatatctgcacggatgacttgatgggatccagaagcaactttgattccactctaataagcccaaactctgtcttttctcaatggcgagtggtctgtgactccttggaagattatgataccctgggaacactttgtaacagcaccgaggatgggccaattaggagaaatccagctggaaatgtggccagaccaatggtgcaacgtcttcctgaaccacaggatgtcgctcagtgcttggaagttggtttatttgacacgcctcctttttattccaactctacaaacagtttccgaaacacagtggaaggttacagtgaccccacgggaaagtatgaccctgctgttcgaagtcttcacaatttggctcatctattcctgaatggaacagggggacaaacccatttgtctccaaatgatcctatttttgtcctcctgcacaccttcacagatgcagtctttgatgaatggctgaggagatacaatgctggtcgggagtttagtgtacctgagataattgccatagcagtagttggcgctttgttactggttgcactcatttttgggactgcttcttatctgattcgtgccagacgcagtatggatgaagctaaccagcctctcctcactgatcagtatcaatgctatgctgaagaatatgaaaaactccagaatcctaatcagtctgtggtctaacaaatgccctactctcttatgcattagtatcacaaaaccacctggttgaatataatagattgagttattaactgtattttctttcactttattaccttctttctaatacaagcatatgttagaattaaagttctaggcatacttttcaaagctgggaagaccctttcagaatcttttcaatgggttttaattttcagttctatttaaaatggtgaatgacactaaactccatgatatttaaggatagtgtgaagatctttggcatgatttaaaggttgagtatgtgaagatataagtgaactaccatgctttgtttacgtgtaaaggaaaataatgtttgatagtaaatgtccacttaaaatacatgaatgggcatttctaaaatgttaaaacataaacacatttccattcatggatatttgtcaacagatttaaagaaaaccacagttattaattaaagaaaattatgtgtagttataaaccaatgaaattttgattaaccttttcaaattaatgttccagtttgaagaccaatcaaatatattatttagtcaacatatactatttagtctcaggttcaaggctacaacaaaaatcaccatctttgtcaaactttggagagggaaaatcttcactttcttaagcaacaatggatattgcctgtgtttgccactgtgtttccctgcctctcaattcgctgaaaaaggaactacctatccttacatttcacctactaatgtctcttctaacatcttagaggtccatggagaaggcatatggagaacatgttttatactgctctataaatagtattccaatcactgtgcttaatttaaatagcattatcttatcatttatcagccttttatgtattttccaagtaaaatattaacatattatttcattggtcttcttttttatctggttctatatgaatgctattttttcccttctcttctaacatgaaatatattttctctttttgatcttgtgctatgaaacaatcttccaaagaactgtataaggtggtcataagtgaatattttaattaaaattggtaaaaataaataataacagtaataatcatgcactatagaaaatggctaaactgagattctaaattctacaaacagaaacaagtttaagttatgtatccctgattggttactgggttttcctatattcaaaaatattaaggctatatatacacaagataaacaaataaaatatatcaaagagcatgcatataacaataggatgttttacactagcattattcaatttattctcttggaatacattgcgatttgttaaaatacagtatactcacagcttttcaaagaaattactgtgtaatgtaagatgcctttttatatagaacatcaatgaaactaaatacttcactttatatttttgtagacttactaattactcatttcagaaacatttattaagcacatactagatatcaagtatttcaaggcactatagatttagagagaagaaaataagaattgtaaaattgagaaggtcatgtttgacttgtacttcaaggactgccaatggatttaccaaatatagaagcagagaagggaattttattcaaaagtgacagcatggacaagggcacagaagtttaaaagagcatggaactttttaaaatataaaataggtcagtgtgattacagtatagtttttatggaggggagtaaaaagataaattggaaataaaaccagagtgtcctatatgcaattcttaatacttggaattaattccatgggaaataggaaacagggagagtcataatcaagctgtatatttataaatatagtagtgatggtgctgttcacaaataacgttgatgagaaataatttggaatggttaaaagcaaagaaactcattaatatggaatagattgtgggagagaggagaaagccttgtttcaaagcattaattctaaataatcataattataagataaagttgtacacatctataaataaataaatacagcttatattataaatactatataatattgaaattataagtataatataaatatagctttaagtaaatcattacaaaaatgtcagttaacaatggaagactgtgagagagaggattaaaacaagagcaaaacagaaaactattaacaaaatggcagttagtaagtcctcagcaatcagtaattattttaatgtaaatggcttaatatcccaaataagaatgcttaaagtagctgagtgaatcaagtcactggatcttgttttcttcataattcagtcttgacgtattgttatattagttcattttcacagtgctataaagaaatacccaagactaggtaatttataaaggaaagaagtttaattgactcacagttccatatggctgtgctgggggaggtcaagtaacttacaatcatggcagaaagcaacggagaagtaagtaccttcttcacaaggcagcgggaaagataaaacgaagggagaagagcctcttataaaaatctccagatctcctgagaactcactcactatcaagagaaaagcctgggggaaatcacccttatgatctaatcacctcttacctagtccctgccgtgacaagtgtggattacagtcagagatgagatttgcgtggggacacagagccaaaccatactgcttgtatatttataagaattcatcaatttcttctatattatccaatttttggcacataattgtaaataaaagtcccttatgatctttta

SEQ ID NO: 417554 - DNA, 3632 bp, Homo sapiens
ctccctcccaccatctctcttctttaaggctcctatcatattatctatccctagtatcacagttctttgtttgttactgcccttcacaaagtttcattatttctcacattaattgctgaaaaagttgaaaaatgtgtgttggttgacatatgtatcactttccaaagaaatgcaccgaggatgggccaattaggagaaatccagctggaaatgtggccagaccaatggtgcaacgtcttcctgaaccacaggatgtcgctcagtgcttggaagttggtttatttgacacgcctcctttttattccaactctacaaacagtttccgaaacacagtggaaggttacagtgaccccacgggaaagtatgaccctgctgttcgaagtcttcacaatttggctcatctattcctgaatggaacagggggacaaacccatttgtctccaaatgatcctatttttgtcctcctgcacaccttcacagatgcagtctttgatgaatggctgaggagatacaatgctgatatatccacatttccattggaaaatgcccctattggacataatagacaatacaacatggtgccattctggcccccagtcaccaacacagaaatgtttgttactgctccagacaacctgggatacacttatgaaattcaatggccaagtcgggagtttagtgtacctgagataattgccatagcagtagttggcgctttgttactggttgcactcatttttgggactgcttcttatctgattcgtgccagacgcagtatggatgaagctaaccagcctctcctcactgatcagtatcaatgctatgctgaagaatatgaaaaactccagaatcctaatcagtctgtggtctaacaaatgccctactctcttatgcattagtatcacaaaaccacctggttgaatataatagattgagttattaactgtattttctttcactttattaccttctttctaatacaagcatatgttagaattaaagttctaggcatacttttcaaagctgggaagaccctttcagaatcttttcaatgggttttaattttcagttctatttaaaatggtgaatgacactaaactccatgatatttaaggatagtgtgaagatctttggcatgatttaaaggttgagtatgtgaagatataagtgaactaccatgctttgtttacgtgtaaaggaaaataatgtttgatagtaaatgtccacttaaaatacatgaatgggcatttctaaaatgttaaaacataaacacatttccattcatggatatttgtcaacagatttaaagaaaaccacagttattaattaaagaaaattatgtgtagttataaaccaatgaaattttgattaaccttttcaaattaatgttccagtttgaagaccaatcaaatatattatttagtcaacatatactatttagtctcaggttcaaggctacaacaaaaatcaccatctttgtcaaactttggagagggaaaatcttcactttcttaagcaacaatggatattgcctgtgtttgccactgtgtttccctgcctctcaattcgctgaaaaaggaactacctatccttacatttcacctactaatgtctcttctaacatcttagaggtccatggagaaggcatatggagaacatgttttatactgctctataaatagtattccaatcactgtgcttaatttaaatagcattatcttatcatttatcagccttttatgtattttccaagtaaaatattaacatattatttcattggtcttcttttttatctggttctatatgaatgctattttttcccttctcttctaacatgaaatatattttctctttttgatcttgtgctatgaaacaatcttccaaagaactgtataaggtggtcataagtgaatattttaattaaaattggtaaaaataaataataacagtaataatcatgcactatagaaaatggctaaactgagattctaaattctacaaacagaaacaagtttaagttatgtatccctgattggttactgggttttcctatattcaaaaatattaaggctatatatacacaagataaacaaataaaatatatcaaagagcatgcatataacaataggatgttttacactagcattattcaatttattctcttggaatacattgcgatttgttaaaatacagtatactcacagcttttcaaagaaattactgtgtaatgtaagatgcctttttatatagaacatcaatgaaactaaatacttcactttatatttttgtagacttactaattactcatttcagaaacatttattaagcacatactagatatcaagtatttcaaggcactatagatttagagagaagaaaataagaattgtaaaattgagaaggtcatgtttgacttgtacttcaaggactgccaatggatttaccaaatatagaagcagagaagggaattttattcaaaagtgacagcatggacaagggcacagaagtttaaaagagcatggaactttttaaaatataaaataggtcagtgtgattacagtatagtttttatggaggggagtaaaaagataaattggaaataaaaccagagtgtcctatatgcaattcttaatacttggaattaattccatgggaaataggaaacagggagagtcataatcaagctgtatatttataaatatagtagtgatggtgctgttcacaaataacgttgatgagaaataatttggaatggttaaaagcaaagaaactcattaatatggaatagattgtgggagagaggagaaagccttgtttcaaagcattaattctaaataatcataattataagataaagttgtacacatctataaataaataaatacagcttatattataaatactatataatattgaaattataagtataatataaatatagctttaagtaaatcattacaaaaatgtcagttaacaatggaagactgtgagagagaggattaaaacaagagcaaaacagaaaactattaacaaaatggcagttagtaagtcctcagcaatcagtaattattttaatgtaaatggcttaatatcccaaataagaatgcttaaagtagctgagtgaatcaagtcactggatcttgttttcttcataattcagtcttgacgtattgttatattagttcattttcacagtgctataaagaaatacccaagactaggtaatttataaaggaaagaagtttaattgactcacagttccatatggctgtgctgggggaggtcaagtaacttacaatcatggcagaaagcaacggagaagtaagtaccttcttcacaaggcagcgggaaagataaaacgaagggagaagagcctcttataaaaatctccagatctcctgagaactcactcactatcaagagaaaagcctgggggaaatcacccttatgatctaatcacctcttacctagtccctgccgtgacaagtgtggattacagtcagagatgagatttgcgtggggacacagagccaaaccatactgcttgtatatttataagaattcatcaatttcttctatattatccaatttttggcacataattgtaaataaaagtcccttatgatctttta

SEQ ID NO: 417555 - DNA, 1478 bp, Homo sapiens
ggacaagaaacacaagcaaatataaaacattcaattctaagagaagttcatcagagacatccttcaggattgtgagctggattttcctctacgtgcttcagtcttctctacacaaagagctgcaaaccaggtctttgttttgcactcttatttcaagcagaatgagtgctcctaaactcctctctctgggctgtatcttcttccccttgctactttttcagcaggcccgggctcaattcccaagacagtgtgccactgttgaggctttgagaagtggtatgtgttgcccagacctgtcccctgtgtctgggcctgggacagaccgctgtggctcatcatcagggaggggcagatgtgaggcagtgactgcagactcccggccccacagccctcagtatccccatgatggcagagatgatcgggaggtctggcccttgcgcttcttcaataggacatgtcactgcaacggcaatttctcaggacacaactgtgggacgtgccgtcctggctggagaggagctgcctgtgaccagagggttctcatagtcaggagaaatcttctggacttaagtaaagaagaaaagaaccactttgtccgggccctggatatggcaaagcgcacaactcaccctttatttgtcattgccaccaggagatcagaagaaatactggggccagatggcaacacgccacaatttgagaacatttccatttataactactttgtttggacacactattactcagtcaaaaagactttccttggggtaggacaggaaagctttggtgaagtggatttctctcatgagggaccagcttttctcacatggcacaggtaccacctcctgcgtctggagaaagacatgcaggaaatgttgcaagagccttctttctcccttccttactggaattttgcaacggggaaaaatgtctgtgatatctgcacggatgacttgatgggatccagaagcaactttgattccactctaataagcccaaactctgtcttttctcaatggcgagtggtctgtgactccttggaagattatgataccctgggaacactttgtaacagtaagttccaaatgatagcttggagtcagaatttctttttagataaagagattaaatatgttgcctgaaaggcccttcattctactagagaattcagactaaaatctacttttattatagagtaacagtgtaccaggcattcattaaacacctagaatgttcaaggtactctagaagttgctccaggggaaacagaaagtgcctacacatttttacactgcctttcttgagtagtttggtcaatatcttgctaactttcttattttggaaatgtctagttgtataaactaatcctcttagttttcttagcactacttagaagtcatgtgtcttgtgttggaatttcacagaaaatgtttcctaagaaaatgtgaaaaataggcaaaaagttggaaatgccctgg

SEQ ID NO: 417556 - DNA, 344 bp, Homo sapiens
cgaaacgctgggctgatcgagccgtcggcgagcccaacgtgaaactgcagtacgacgttgatcagatctgacatgattccttcctgttctgaactgtggggtgtgcacatctctgcttgagtcaggtttgagtagaggcttagagacagttgggtgagaacaaccaaaatcttatcatggtctcagtcataatcattagggggaactctagccaaatggtttaacttctgcctgtggaactggggattgggtgggcaggaaaaggtgatatccattctttctgataactagatggtgctgagaagcttttgaataaaaactttgctaaatgagaaaaaaaaaaa

SEQ ID NO: 417557 - DNA, 4182 bp, Homo sapiens
ggcacgagggtggggtcgagagcgggatccgaggctggcgggttttggcagtagctgtggctgcggctgccgggcctggggacgcgggcggccgaggccgccgtcgcagcctcctcgtctcgccggctatggctgcgctcggccggcccttcagcggcctccctctgagcggcggctcggacttcctgcagccgccgcagccggccttccccggccgggccttcccgccgggggctgacggcgccgagttggccccgcggccgggacctcgcgcagtccctagcagtcccgctgggagtgcggcgcgcggacgtgtttctgttcactgtaaaaagaaacacaagcgagaggaggaggaggatgatgattgtccagtaagaaagaaaaggataactgaagcagagctctgtgctggtcctaatgactggattctttgtgcacatcaggatgtagaggggcatggagtaaatcccagtgttagtggcctttccatacctgggatattagatgttatttgtgaagaaatggatcagacaactggagaaccacagtgtgaagttgcccgaaggaagcttcaggagattgaggacaggataattgatgaagatgaagaagttgaagctgacagaaatgttaaccatctccccagtcttgtcctttctgataccatgaaaacaggtttgaagagggaatttgatgaagtttttacaaagaaaatgattgagtctatgagccgtccttccatggagcttgttctctggaaacccctccctgaactcctttctgataagccaaagccatcctctaatactaagaactatacaggagagagccaagctaagcatgtagctgctggcactgccttccctcagagaactgaactgttttcggaacctcggccaacagggatgtctctttataatagtttggagacagctactagcacagaagaagagatggaactctagaaaccaatttctacactaaagttgtcaaatgttagaagaatcctgtgttcagttatgagactctttgcatagtatagggacttgaaagttttatgagacgggtgtaataatatctccacctgtgatttgggggtgggactcttattttgggtagccatttattgacttcacctttttgccaaggacgtttgtctcaagggaaaagcagttttctgtggggcttattaaaggaatgttggtttacattgtcttcaaagacaagtatagaagctgtatgtgtaagggtgacttaaatcatatgtcacattgtctaaactattcagacacttggagaatattctccttgaattaaaaaagatgattaagaaggatgctcctacaactgtatcctgacagttaagtcacagcttaatgtgtagatatgagctgtttacagtggtgactatatataattggggagaagaagggaagagagcagcagtagcttaagcctgttgctaagaaatttaatttcttagcaacttgtaatttagttatcaattcaatatagctctgttgattaaatagccgatagtattgtggctctcctctttgactatgaaaatatagagaaagttttttctttaaggcttttttgccttgtgccactgttgctccttggtttcccttgcgtaattgataagcccagttattcagtaatgtttacaaattaattgactttgatagttaaaagattatgaggtaacccatctgcaatttgcctgtgggagaagcatcctttagttcatcttaaggaagtgctttatcagctaaacccaacattgataactttggtaatttttttaaaaaggcctcagctccccgccgccgccgccgccgccgccgccgagccggtttcctttttccggcgctccgggtgcgagagacaggtcgggccccctaggcagcgagccgcagcgcaatcccggcgctcgcccaaggaccctggaagctaccgttaccccgccgggcagcgtgggcgccatgagcagctcgggactgaattcggagaaggtagctgctctgatacagaaactgaattccgacccccagttcgtacttgcccagaatgtcgggaccacccacgacctgctggacatctgtctgaagcgggccacggtgcagcgcgcgcagcatgtgttccagcacgccgtgccccaggagggcaagccaatcaccaaccagaagagctcagggcgatgctggatcttttcttgtctgaatgttatgaggcttccattcatgaaaaagttaaatattgaagaatttgagtttagccaatcttacctgtttttttgggacaaggttgaacgctgttatttcttcttgagtgcttttgtggacacagcccagagaaaggagcctgaggatgggaggctggtgcagtttttgcttatgaaccctgcaaatgatggtggccaatgggatatgcttgttaatattgttgaaaaatatggtgttatccctaagaaatgcttccctgaatcttatacaacagaggcaaccagaaggatgaatgatattctgaatcacaagatgagagaattctgtatacgactgcggaacctggtacacagtggagcaaccaaaggagaaatctcggccacacaggacgtcatgatggaggagatattccgagtggtgtgcatctgtttgggtaatccaccagagacattcacctgggaatatcgagacaaagataaaaattatcagaaaattggccccataacacccttggagttttacagggaacatgtcaagccactcttcaatatggaagataagatttgtttagtgaatgaccctaggccccagcacaagtacaacaaactttacacagtggaatacttaagcaatatggttggagggagaaaaactctatacaacaaccagcccattgacttcctgaaaaagatggttgctgcctccatcaaagatggagaggctgtgtggtttggctgtgatgttggaaaacacttcaatagcaagctgggcctcagtgacatgaatctctatgaccatgagttagtgtttggtgtctccttgaagaacatgaataaagcggagaggctgacttttggtgagtcacttatgacccacgccatgaccttcactgctgtctcagagaaggatgatcaggatggtgctttcacaaaatggagagtggagaattcatggggtgaagaccatggccacaaaggttacctgtgcatgacagatgagtggttctctgagtatgtctacgaagtggtggtggacaggaagcatgtccctgaagaggtgctagctgtgttagagcaggaacccattatcctgccagcatgggaccccatgggagctttggctgagtgatactgccctccagctctttcctccttccatggaacctgacgtagctgcaaaggacagatccagggactgaagccaaagttatgcaagggactgtgtgttgccacaggacacagtcagatttccagtctccaccaggaacctcttcagaaagtgtgctttatgctgaaacagaatactgttaaaggaaaaaaaagaggggggaagatcaggtcatactatctactctcctcatctctaacagctcaggatctcttagcattttaattagatgtaattgtttgtctttaactgtcaaaaagtttggttctgtgtctgtgttttaataagacgagaggacgagcgattgaggtgtatggagagaaaacagacctaatgctccttgttcctagagtagagtggagggagggtggcctaagagttgagctctcggaactgcatgctgctggacagtatcactgtctttcctagatggcagtcactgaattccattttttcaaggtaatttcttgtgcctctaatagcccaagaatgggaggttgatcagatctgacatgattccttcctgttctgaactgtggggtgtgcacatctctgcttgagtcaggtttgagtagaggcttagagacagttgggtgagaacaaccaaaatcttatcatggtctcagtcataatcattagggggaactctagccaaatggtttaacttctgcctgtggaactggggattgggtgggcaggaaaaggtgatatccattctttctgataactagatggtgctgagaagcttttgaataaaaactttgctaaatgagaaaaaaaaaaa

SEQ ID NO: 417558 - DNA, 896 bp, Homo sapiens
ctgccctccaggctcccaatggggtcccatgctggcaggataatgggttcccatgggagctttggctgagtgatactgccctccagctctttcctccttccatggaacctgacgtagctgcaaaggacagatccagggactgaagccaaagttatgcaagggactgtgtgttgccacaggacacagtcagatttccagtctccaccaggaacctcttcagaaagtgtgctttatgctgaaacagaatactgttaaaggaaaaaaaagaggggggaagatcaggtcatactatctactctcctcatctctaacagctcaggatctcttagcattttaattagatgtaattgtttgtctttaactgtcaaaaagtttggttctgtgtctgtgttttaataagacgagaggacgagcgattgaggtgtatggagagaaaacagacctaatgctccttgttcctagagtagagtggagggagggtggcctaagagttgagctctcggaactgcatgctgctggacagtatcactgtctttcctagatggcagtcactgaattccattttttcaaggtaatttcttgtgcctctaatagcccaagaatgggaggttgatcagatctgacatgattccttcctgttctgaactgtggggtgtgcacatctctgcttgagtcaggtttgagtagaggcttagagacagttgggtgagaacaaccaaaatcttatcatggtctcagtcataatcattagggggaactctagccaaatggtttaacttctgcctgtggaactggggattgggtgggcaggaaaaggtgatatccattctttctgataactagatggtgctgagaagcttttgaataaaaactttgctaaatgagaaaaaaaaaaa

SEQ ID NO: 417559 - DNA, 478 bp, Homo sapiens
ctaaggatcccgtgatccccatacagagtacgagacccccctagagtagagtggagggagggtggcctaagagttgagctctcggaactgcatgctgctggacagtatcactgtctttcctagatggcagtcactgaattccattttttcaaggtaatttcttgtgcctctaatagcccaagaatgggaggttgatcagatctgacatgattccttcctgttctgaactgtggggtgtgcacatctctgcttgagtcaggtttgagtagaggcttagagacagttgggtgagaacaaccaaaatcttatcatggtctcagtcataatcattagggggaactctagccaaatggtttaacttctgcctgtggaactggggattgggtgggcaggaaaaggtgatatccattctttctgataactagatggtgctgagaagcttttgaataaaaactttgctaaatgagaaaaaaaaaaa

SEQ ID NO: 417560 - DNA, 1045 bp, Homo sapiens
aggtagatgcacctcctaattgtgtctcttacgcgaattagaataagcaaggacctctctcacatgtattttgccaccttgtgtttctttgttacttaacaatgtggctgtagtacttagcttgtaggcagagatgatgagcttgatggaaacatgaacctagaggagagctgtgtgttgcttgacattcctggttttgtgccctaattaatgtgttcttgatcttgatagatttgtttagtgaatgaccctaggccccagcacaagtacaacaaactttacacagtggaatacttaagcaatatggttggagggagaaaaactctatacaacaaccagcccattgacttcctgaaaaagatggttgctgcctccatcaaagatggagaggctgtgtggtttggctgtgatgttggaaaacacttcaatagcaagctgggcctcagtgacatgaatctgtgagtgcaggaaatttaaaatggaaagtcatttgtgggttgttgctgttggagtgtgctgttggtacaaaatgactctgccgaggttcatccaaagatgaaggttgacctaagggcgcgtctctttctttgcatcctttagagtttgaggactcatagcagaaactccacatacttaaacactctaacccaggacatcaaaatcccactttctatctgagtggaaatcgttgggcgttcctaaaaagccatcctctatgagaaagacactttaaaaaaataattgactattgcggaaatgtgttcagtgcatttgggagtgtaatgaaagattttccagagcccccgtttgctatgttactttggtaactttgtattttgtcattgtgacaagtgggactaatttgcatgcatactttatagcattcctcctggtcatttatgacaatgaaggttaatttgtaaactaaatcatataggattccttgactgttcaccattctctattttagggttacttataaatagttgttacttgtaggaagttgagtaaatatcttgatagagaaatctgctaaaaaaaagaa

SEQ ID NO: 417561 - DNA, 2428 bp, Homo sapiens
agccccgacggcgctgactcagcaacgcgaggggggagttttgtccctccgcggaccccgtttcgcctcagctccccgccgccgccgccgccgccgccgccgagccggtttcctttttccggcgctccgggtgcgagagacaggtcgggccccctaggcagcgagccgcagcgcaatcccggcgctcgcccaaggaccctggaagctaccgttaccccgccgggcagcgtgggcgccatgagcagctcgggactgaattcggagaaggtagctgctctgatacagaaactgaattccgacccccagttcgtacttgcccagaatgtcgggaccacccacgacctgctggacatctgtctgaagcgggccacggtgcagcgcgcgcagcatgtgttccagcacgccgtgccccaggagggcaagccaatcaccaaccagaagagctcagggcgatgctggatcttttcttgtctgaatgttatgaggcttccattcatgaaaaagttaaatattgaagaatttgagtttagccaatcttacctgtttttttgggacaaggttgaacgctgttatttcttcttgagtgcttttgtggacacagcccagagaaaggagcctgaggatgggaggctggtgcagtttttgcttatgaaccctgcaaatgatggtggccaatgggatatgcttgttaatattgttgaaaaatatggtgttatccctaagaaatgcttccctgaatcttatacaacagaggcaaccagaaggatgaatgatattctgaatcacaagatgagagaattctgtatacgactgcggaacctggtacacagtggagcaaccaaaggagaaatctcggccacacaggacgtcatgatggaggagatattccgagtggtgtgcatctgtttgggtaatccaccagagacattcacctgggaatatcgagacaaagataaaaattatcagaaaattggccccataacacccttggagttttacagggaacatgtcaagccactcttcaatatggaagataagatttgtttagtgaatgaccctaggccccagcacaagtacaacaaactttacacagtggaatacttaagcaatatggttggagggagaaaaactctatacaacaaccagcccattgacttcctgaaaaagatggttgctgcctccatcaaagatggagaggctgtgtggtttggctgtgatgttggaaaacacttcaatagcaagctgggcctcagtgacatgaatctctatgaccatgagttagtgtttggtgtctccttgaagaacatgaataaagcggagaggctgacttttggtgagtcacttatgacccacgccatgaccttcactgctgtctcagagaaggatgatcaggatggtgctttcacaaaatggagagtggagaattcatggggtgaagaccatggccacaaaggttacctgtgcatgacagatgagtggttctctgagtatgtctacgaagtggtggtggacaggaagcatgtccctgaagaggtgctagctgtgttagagcaggaacccattatcctgccagcatgggaccccatgggagctttggctgagtgatactgccctccagctctttcctccttccatggaacctgacgtagctgcaaaggacagatccagggactgaagccaaagttatgcaagggactgtgtgttgccacaggacacagtcagatttccagtctccaccaggaacctcttcagaaagtgtgctttatgctgaaacagaatactgttaaaggaaaaaaaagaggggggaagatcaggtcatactatctactctcctcatctctaacagctcaggatctcttagcattttaattagatgtaattgtttgtctttaactgtcaaaaagtttggttctgtgtctgtgttttaataagacgagaggacgagcgattgaggtgtatggagagaaaacagacctaatgctccttgttcctagagtagagtggagggagggtggcctaagagttgagctctcggaactgcatgctgctggacagtatcactgtctttcctagatggcagtcactgaattccattttttcaaggtaatttcttgtgcctctaatagcccaagaatgggaggttgatcagatctgacatgattccttcctgttctgaactgtggggtgtgcacatctctgcttgagtcaggtttgagtagaggcttagagacagttgggtgagaacaaccaaaatcttatcatggtctcagtcataatcattagggggaactctagccaaatggtttaacttctgcctgtggaactggggattgggtgggcaggaaaaggtgatatccattctttctgataactagatggtgctgagaagcttttgaataaaaactttgctaaatgagaaaaaaaaaaa

SEQ ID NO: 417562 - DNA, 4133 bp, Homo sapiens
ggcacgagggtggggtcgagagcgggatccgaggctggcgggttttggcagtagctgtggctgcggctgccgggcctggggacgcgggcggccgaggccgccgtcgcagcctcctcgtctcgccggctatggctgcgctcggccggcccttcagcggcctccctctgagcggcggctcggacttcctgcagccgccgcagccggccttccccggccgggccttcccgccgggggctgacggcgccgagttggccccgcggccgggacctcgcgcagtccctagcagtcccgctgggagtgcggcgcgcggacgtgtttctgttcactgtaaaaagaaacacaagcgagaggaggaggaggatgatgattgtccagtaagaaagaaaaggataactgaagcagagctctgtgctggtcctaatgactggattctttgtgcacatcaggatgtagaggggcatggagtaaatcccagtgttagtggcctttccatacctgggatattagatgttatttgtgaagaaatggatcagacaactggagaaccacagtgtgaagttgcccgaaggaagcttcaggagattgaggacaggataattgatgaagatgaagaagttgaagctgacagaaatgttaaccatctccccagtcttgtcctttctgataccatgaaaacaggtttgaagagggaatttgatgaagtttttacaaagaaaatgattgagtctatgagccgtccttccatggagcttgttctctggaaacccctccctgaactcctttctgataagccaaagccatcctctaatactaagaactatacaggagagagccaagctaagcatgtagctgctggcactgccttccctcagagaactgaactgttttcggaacctcggccaacagggatgtctctttataatagtttggagacagctactagcacagaagaagagatggaactctagaaaccaatttctacactaaagttgtcaaatgttagaagaatcctgtgttcagttatgagactctttgcatagtatagggacttgaaagttttatgagacgggtgtaataatatctccacctgtgatttgggggtgggactcttattttgggtagccatttattgacttcacctttttgccaaggacgtttgtctcaagggaaaagcagttttctgtggggcttattaaaggaatgttggtttacattgtcttcaaagacaagtatagaagctgtatgtgtaagggtgacttaaatcatatgtcacattgtctaaactattcagacacttggagaatattctccttgaattaaaaaagatgattaagaaggatgctcctacaactgtatcctgacagttaagtcacagcttaatgtgtagatatgagctgtttacagtggtgactatatataattggggagaagaagggaagagagcagcagtagcttaagcctgttgctaagaaatttaatttcttagcaacttgtaatttagttatcaattcaatatagctctgttgattaaatagccgatagtattgtggctctcctctttgactatgaaaatatagagaaagttttttctttaaggcttttttgccttgtgccactgttgctccttggtttcccttgcgtaattgataagcccagttattcagtaatgtttacaaattaattgactttgatagttaaaagattatgaggtaacccatctgcaatttgcctgtgggagaagcatcctttagttcatcttaaggaagtgctttatcagctaaacccaacattgataactttggtaatttttttaaaaaggcctcagctccccgccgccgccgccgccgccgccgccgagccggtttcctttttccggcgctccgggtgcgagagacaggtcgggccccctaggcagcgagccgcagcgcaatcccggcgctcgcccaaggaccctggaagctaccgttaccccgccgggcagcgtgggcgccatgagcagctcgggactgaattcggagaaggtagctgctctgatacagaaactgaattccgacccccagttcgtacttgcccagaatgtcgggaccacccacgacctgctggacatctgtctgaagcgggccacggtgcagcgcgcgcagcatgtgttccagcacgccgtgccccaggagggcaagccaatcaccaaccagaagagctcagggcgatgctggatcttttcttgtctgaatgttatgaggcttccattcatgaaaaagttaaagttgaacgctgttatttcttcttgagtgcttttgtggacacagcccagagaaaggagcctgaggatgggaggctggtgcagtttttgcttatgaaccctgcaaatgatggtggccaatgggatatgcttgttaatattgttgaaaaatatggtgttatccctaagaaatgcttccctgaatcttatacaacagaggcaaccagaaggatgaatgatattctgaatcacaagatgagagaattctgtatacgactgcggaacctggtacacagtggagcaaccaaaggagaaatctcggccacacaggacgtcatgatggaggagatattccgagtggtgtgcatctgtttgggtaatccaccagagacattcacctgggaatatcgagacaaagataaaaattatcagaaaattggccccataacacccttggagttttacagggaacatgtcaagccactcttcaatatggaagataagatttgtttagtgaatgaccctaggccccagcacaagtacaacaaactttacacagtggaatacttaagcaatatggttggagggagaaaaactctatacaacaaccagcccattgacttcctgaaaaagatggttgctgcctccatcaaagatggagaggctgtgtggtttggctgtgatgttggaaaacacttcaatagcaagctgggcctcagtgacatgaatctctatgaccatgagttagtgtttggtgtctccttgaagaacatgaataaagcggagaggctgacttttggtgagtcacttatgacccacgccatgaccttcactgctgtctcagagaaggatgatcaggatggtgctttcacaaaatggagagtggagaattcatggggtgaagaccatggccacaaaggttacctgtgcatgacagatgagtggttctctgagtatgtctacgaagtggtggtggacaggaagcatgtccctgaagaggtgctagctgtgttagagcaggaacccattatcctgccagcatgggaccccatgggagctttggctgagtgatactgccctccagctctttcctccttccatggaacctgacgtagctgcaaaggacagatccagggactgaagccaaagttatgcaagggactgtgtgttgccacaggacacagtcagatttccagtctccaccaggaacctcttcagaaagtgtgctttatgctgaaacagaatactgttaaaggaaaaaaaagaggggggaagatcaggtcatactatctactctcctcatctctaacagctcaggatctcttagcattttaattagatgtaattgtttgtctttaactgtcaaaaagtttggttctgtgtctgtgttttaataagacgagaggacgagcgattgaggtgtatggagagaaaacagacctaatgctccttgttcctagagtagagtggagggagggtggcctaagagttgagctctcggaactgcatgctgctggacagtatcactgtctttcctagatggcagtcactgaattccattttttcaaggtaatttcttgtgcctctaatagcccaagaatgggaggttgatcagatctgacatgattccttcctgttctgaactgtggggtgtgcacatctctgcttgagtcaggtttgagtagaggcttagagacagttgggtgagaacaaccaaaatcttatcatggtctcagtcataatcattagggggaactctagccaaatggtttaacttctgcctgtggaactggggattgggtgggcaggaaaaggtgatatccattctttctgataactagatggtgctgagaagcttttgaataaaaactttgctaaatgagaaaaaaaaaaa

SEQ ID NO: 417563 - DNA, 3683 bp, Homo sapiens
ggcacgagggtggggtcgagagcgggatccgaggctggcgggttttggcagtagctgtggctgcggctgccgggcctggggacgcgggcggccgaggccgccgtcgcagcctcctcgtctcgccggctatggctgcgctcggccggcccttcagcggcctccctctgagcggcggctcggacttcctgcagccgccgcagccggccttccccggccgggccttcccgccgggggctgacggcgccgagttggccccgcggccgggacctcgcgcagtccctagcagtcccgctgggagtgcggcgcgcggacgtgtttctgttcactgtaaaaagaaacacaagcgagaggaggaggaggatgatgattgtccagtaagaaagaaaaggataactgaagcagagctctgtgctggtcctaatgactggattctttgtgcacatcaggatgtagaggggcatggagtaaatcccagtgttagtggcctttccatacctgggatattagatgttatttgtgaagaaatggatcagacaactggagaaccacagtgtgaagttgcccgaaggaagcttcaggagattgaggacaggataattgatgaagatgaagaagttgaagctgacagaaatgttaaccatctccccagtcttgtcctttctgataccatgaaaacaggtttgaagagggaatttgatgaagtttttacaaagaaaatgattgagtctatgagccgtccttccatggagcttgttctctggaaacccctccctgaactcctttctgataagccaaagccatcctctaatactaagaactatacaggagagagccaagctaagcatgtagctgctggcactgccttccctcagagaactgaactgttttcggaacctcggccaacagggatgtctctttataatagtttggagacagctactagcacagaagaagagatggaactctagaaaccaatttctacactaaagttgtcaaatgttagaagaatcctgtgttcagttatgagactctttgcatagtatagggacttgaaagttttatgagacgggtgtaataatatctccacctgtgatttgggggtgggactcttattttgggtagccatttattgacttcacctttttgccaaggacgtttgtctcaagggaaaagcagttttctgtggggcttattaaaggaatgttggtttacattgtcttcaaagacaagtatagaagctgtatgtgtaagggtgacttaaatcatatgtcacattgtctaaactattcagacacttggagaatattctccttgaattaaaaaagatgattaagaaggatgctcctacaactgtatcctgacagttaagtcacagcttaatgtgtagatatgagctgtttacagtggtgactatatataattggggagaagaagggaagagagcagcagtagcttaagcctgttgctaagaaatttaatttcttagcaacttgtaatttagttatcaattcaatatagctctgttgattaaatagccgatagtattgtggctctcctctttgactatgaaaatatagagaaagttttttctttaaggcttttttgccttgtgccactgttgctccttggtttcccttgcgtaattgataagcccagttattcagtaatgtttacaaattaattgactttgatagttaaaagattatgaggtaacccatctgcaatttgcctgtgggagaagcatcctttagttcatcttaaggaagtgctttatcagctaaacccaacattgataactttggtaatttttttaaaaaggcctcagctccccgccgccgccgccgccgccgccgccgagccggtttcctttttccggcgctccgggtgcgagagacaggtcgggccccctaggcagcgagccgcagcgcaatcccggcgctcgcccaaggaccctggaagctaccgttaccccgccgggcagcgtgggcgccatgagcagctcggagaggcaaccagaaggatgaatgatattctgaatcacaagatgagagaattctgtatacgactgcggaacctggtacacagtggagcaaccaaaggagaaatctcggccacacaggacgtcatgatggaggagatattccgagtggtgtgcatctgtttgggtaatccaccagagacattcacctgggaatatcgagacaaagataaaaattatcagaaaattggccccataacacccttggagttttacagggaacatgtcaagccactcttcaatatggaagataagatttgtttagtgaatgaccctaggccccagcacaagtacaacaaactttacacagtggaatacttaagcaatatggttggagggagaaaaactctatacaacaaccagcccattgacttcctgaaaaagatggttgctgcctccatcaaagatggagaggctgtgtggtttggctgtgatgttggaaaacacttcaatagcaagctgggcctcagtgacatgaatctctatgaccatgagttagtgtttggtgtctccttgaagaacatgaataaagcggagaggctgacttttggtgagtcacttatgacccacgccatgaccttcactgctgtctcagagaaggatgatcaggatggtgctttcacaaaatggagagtggagaattcatggggtgaagaccatggccacaaaggttacctgtgcatgacagatgagtggttctctgagtatgtctacgaagtggtggtggacaggaagcatgtccctgaagaggtgctagctgtgttagagcaggaacccattatcctgccagcatgggaccccatgggagctttggctgagtgatactgccctccagctctttcctccttccatggaacctgacgtagctgcaaaggacagatccagggactgaagccaaagttatgcaagggactgtgtgttgccacaggacacagtcagatttccagtctccaccaggaacctcttcagaaagtgtgctttatgctgaaacagaatactgttaaaggaaaaaaaagaggggggaagatcaggtcatactatctactctcctcatctctaacagctcaggatctcttagcattttaattagatgtaattgtttgtctttaactgtcaaaaagtttggttctgtgtctgtgttttaataagacgagaggacgagcgattgaggtgtatggagagaaaacagacctaatgctccttgttcctagagtagagtggagggagggtggcctaagagttgagctctcggaactgcatgctgctggacagtatcactgtctttcctagatggcagtcactgaattccattttttcaaggtaatttcttgtgcctctaatagcccaagaatgggaggttgatcagatctgacatgattccttcctgttctgaactgtggggtgtgcacatctctgcttgagtcaggtttgagtagaggcttagagacagttgggtgagaacaaccaaaatcttatcatggtctcagtcataatcattagggggaactctagccaaatggtttaacttctgcctgtggaactggggattgggtgggcaggaaaaggtgatatccattctttctgataactagatggtgctgagaagcttttgaataaaaactttgctaaatgagaaaaaaaaaaa

SEQ ID NO: 417564 - DNA, 1919 bp, Homo sapiens
cgcctacacttcctaccctacaaccttccttactctactctaggaacaaggaagatcaggtcatactatctactctcctcatctctaacagctcaggatctcttagcattttaattagatgtaattgttgtcttaactgtcaaaaagtttggttctgtgtctgccaatgggatatgcttgttaatatgttgaaaaatatggtgttatccctaagaaatgcttccctgaatcttatacaacagaggcaaccagaaggatgaatgatattctgaatcacaagatgagagaattctgtatacgactgcggaacctggtacacagtggagcaaccaaaggagaaatctcggccacacaggacgtcatgatggaggagatattccgagtggtgtgcatctgtttgggtaatccaccagagacattcacctgggaatatcgagacaaagataaaaattatcagaaaattggccccataacacccttggagttttacagggaacatgtcaagccactcttcaatatggaagataagatttgtttagtgaatgaccctaggccccagcacaagtacaacaaactttacacagtggaatacttaagcaatatggttggagggagaaaaactctatacaacaaccagcccattgacttcctgaaaaagatggttgctgcctccatcaaagatggagaggctgtgtggtttggctgtgatgttggaaaacacttcaatagcaagctgggcctcagtgacatgaatctctatgaccatgagttagtgtttggtgtctccttgaagaacatgaataaagcggagaggctgacttttggtgagtcacttatgacccacgccatgaccttcactgctgtctcagagaaggatgatcaggatggtgctttcacaaaatggagagtggagaattcatggggtgaagaccatggccacaaaggttacctgtgcatgacagatgagtggttctctgagtatgtctacgaagtggtggtggacaggaagcatgtccctgaagaggtgctagctgtgttagagcaggaacccattatcctgccagcatgggaccccatgggagctttggctgagtgatactgccctccagctctttcctccttccatggaacctgacgtagctgcaaaggacagatccagggactgaagccaaagttatgcaagggactgtgtgttgccacaggacacagtcagatttccagtctccaccaggaacctcttcagaaagtgtgctttatgctgaaacagaatactgttaaaggaaaaaaaagaggggggaagatcaggtcatactatctactctcctcatctctaacagctcaggatctcttagcattttaattagatgtaattgtttgtctttaactgtcaaaaagtttggttctgtgtctgtgttttaataagacgagaggacgagcgattgaggtgtatggagagaaaacagacctaatgctccttgttcctagagtagagtggagggagggtggcctaagagttgagctctcggaactgcatgctgctggacagtatcactgtctttcctagatggcagtcactgaattccattttttcaaggtaatttcttgtgcctctaatagcccaagaatgggaggttgatcagatctgacatgattccttcctgttctgaactgtggggtgtgcacatctctgcttgagtcaggtttgagtagaggcttagagacagttgggtgagaacaaccaaaatcttatcatggtctcagtcataatcattagggggaactctagccaaatggtttaacttctgcctgtggaactggggattgggtgggcaggaaaaggtgatatccattctttctgataactagatggtgctgagaagcttttgaataaaaactttgctaaatgagaaaaaaaaaaa

SEQ ID NO: 417565 - DNA, 1621 bp, Homo sapiens
aggtagatgcacctcctaattgtgtctcttacgcgaattagaataagcaaggacctctctcacatgtattttgccaccttgtgtttctttgttacttaacaatgtggctgtagtacttagcttgtaggcagagatgatgagcttgatggaaacatgaacctagaggagagctgtgtgttgcttgacattcctggttttgtgccctaattaatgtgttcttgatcttgatagatttgtttagtgaatgaccctaggccccagcacaagtacaacaaactttacacagtggaatacttaagcaatatggttggagggagaaaaactctatacaacaaccagcccattgacttcctgaaaaagatggttgctgcctccatcaaagatggagaggctgtgtggtttggctgtgatgttggaaaacacttcaatagcaagctgggcctcagtgacatgaatctctatgaccatgagttagtgtttggtgtctccttgaagaacatgaataaagcggagaggctgacttttggtgagtcacttatgacccacgccatgaccttcactgctgtctcagagaaggatgatcaggatggtgctttcacaaaatggagagtggagaattcatggggtgaagaccatggccacaaaggttacctgtgcatgacagatgagtggttctctgagtatgtctacgaagtggtggtggacaggaagcatgtccctgaagaggtgctagctgtgttagagcaggaacccattatcctgccagcatgggaccccatgggagctttggctgagtgatactgccctccagctctttcctccttccatggaacctgacgtagctgcaaaggacagatccagggactgaagccaaagttatgcaagggactgtgtgttgccacaggacacagtcagatttccagtctccaccaggaacctcttcagaaagtgtgctttatgctgaaacagaatactgttaaaggaaaaaaaagaggggggaagatcaggtcatactatctactctcctcatctctaacagctcaggatctcttagcattttaattagatgtaattgtttgtctttaactgtcaaaaagtttggttctgtgtctgtgttttaataagacgagaggacgagcgattgaggtgtatggagagaaaacagacctaatgctccttgttcctagagtagagtggagggagggtggcctaagagttgagctctcggaactgcatgctgctggacagtatcactgtctttcctagatggcagtcactgaattccattttttcaaggtaatttcttgtgcctctaatagcccaagaatgggaggttgatcagatctgacatgattccttcctgttctgaactgtggggtgtgcacatctctgcttgagtcaggtttgagtagaggcttagagacagttgggtgagaacaaccaaaatcttatcatggtctcagtcataatcattagggggaactctagccaaatggtttaacttctgcctgtggaactggggattgggtgggcaggaaaaggtgatatccattctttctgataactagatggtgctgagaagcttttgaataaaaactttgctaaatgagaaaaaaaaaaa

SEQ ID NO: 417566 - DNA, 3222 bp, Homo sapiens
ggcacgagggtggggtcgagagcgggatccgaggctggcgggttttggcagtagctgtggctgcggctgccgggcctggggacgcgggcggccgaggccgccgtcgcagcctcctcgtctcgccggctatggctgcgctcggccggcccttcagcggcctccctctgagcggcggctcggacttcctgcagccgccgcagccggccttccccggccgggccttcccgccgggggctgacggcgccgagttggccccgcggccgggacctcgcgcagtccctagcagtcccgctgggagtgcggcgcgcggacgtgtttctgttcactgtaaaaagaaacacaagcgagaggaggaggaggatgatgattgtccagtaagaaagaaaaggataactgaagcagagctctgtgctggtcctaatgactggattctttgtgcacatcaggatgtagaggggcatggagtaaatcccagtgttagtggcctttccatacctgggatattagatgttatttgtgaagaaatggatcagacaactggagaaccacagtgtgaagttgcccgaaggaagcttcaggagattgaggacaggataattgatgaagatgaagaagttgaagctgacagaaatgttaaccatctccccagtcttgtcctttctgataccatgaaaacaggtttgaagagggaatttgatgaagtttttacaaagaaaatgattgagtctatgagccgtccttccatggagcttgttctctggaaacccctccctgaactcctttctgataagccaaagccatcctctaatactaagaactatacaggagagagccaagctaagcatgtagctgctggcactgccttccctcagagaactgaactgttttcggaacctcggccaacagggatgtctctttataatagtttggagacagctactagcacagaagaagagatggaactctagaaaccaatttctacactaaagttgtcaaatgttagaagaatcctgtgttcagttatgagactctttgcatagtatagggacttgaaagttttatgagacgggtgtaataatatctccacctgtgatttgggggtgggactcttattttgggtagccatttattgacttcacctttttgccaaggacgtttgtctcaagggaaaagcagttttctgtggggcttattaaaggaatgttggtttacattgtcttcaaagacaagtatagaagctgtatgtgtaagggtgacttaaatcatatgtcacattgtctaaactattcagacacttggagaatattctccttgaattaaaaaagatgattaagaaggatgctcctacaactgtatcctgacagttaagtcacagcttaatgtgtagatatgagctgtttacagtggtgactatatataattggggagaagaagggaagagagcagcagtagcttaagcctgttgctaagaaatttaatttcttagcaacttgtaatttagttatcaattcaatatagctctgttgattaaatagccgatagtattgtggctctcctctttgactatgaaaatatagagaaagttttttctttaaggcttttttgccttgtgccactgttgctccttggtttcccttgcgtaattgataagcccagttattcagtaatgtttacaaattaattgactttgatagttaaaagattatgaggtaacccatctgcaatttgcctgtgggagaagcatcctttagttcatcttaaggaagtgctttatcagctaaacccaacattgataactttggtaatttttttaaaaaggcctcagctccccgccgccgccgccgccgccgccgccgagccggtttcctttttccggcgctccgggtgcgagagacaggtcgggccccctaggcagcgagccgcagcgcaatcccggcgctcgcccaaggaccctggaagctaccgttaccccgccgggcagcgtgggcgccatgagcagctcgggactgaattcggagaaggtagctgctctgatacagaaactgaattccgacccccagttcgtacttgcccagaatgtcgggaccacccacgacctgctggacatctgtctgaagcgggccacggtgcagcgcgcgcagcatgtgttccagcacgccgtgccccaggagggcaagccaatcaccaaccagaagagctcagggcgatgctggatcttttcttgtctgaatgttatgaggcttccattcatgaaaaagttaaatattgaagaatttgagtttagccaatcttacctgtttttttgggacaaggttgaacgctgttatttcttcttgagtgcttttgtggacacagcccagagaaaggagcctgaggatgggaggctggtgcagtttttgcttatgaaccctgcaaatgatggtggccaatgggatatgcttgttaatattgttgaaaaatatggtgttatccctaagaaatgcttccctgaatcttatacaacagaggcaaccagaaggatgaatgatattctgaatcacaagatgagagaattctgtatacgactgcggaacctggtacacagtggagcaaccaaaggagaaatctcggccacacaggacgtcatgatggaggagatattccgagtggtgtgcatctgtttgggtaatccaccagagacattcacctgggaatatcgagacaaagataaaaattatcagaaaattggccccataacacccttggagttttacagggaacatgtcaagccactcttcaatatggaagataaggttggtgaatggcactggtagtcactggctgtttactttcaaatggctgttaaccacagggaattgtataagattcttggttagcatgtatgagtatcaaactagacagcaaacaaacatttttccccacttcctctgaagtattttatgcagctaatgaagttggtggtgccaggatttatcagcttttccacaatgttcctcttcagagactttttaaactgtaagccagcagtcattttaattcccacatgcgcccctgtataggaccagaatcattctcaagtgcaaaacaatgaaagtgtgttgggtatttcttatcgtggattcagagcacttttgcactgaggtcccctcggggaactctcctgttgaagggagtaatcttagtttttcctgttccctttaggtcttcctcatctgcctagta

SEQ ID NO: 417567 - DNA, 768 bp, Homo sapiens
gctcggtaccccttatgttctgacccaccaagggactgtgtgttgccacaggacacagtcagatttccagtctccaccaggaacctcttcagaaagtgtgctttatgctgaaacagaatactgttaaaggaaaaaaaagaggggggaagatcaggtcatactatctactctcctcatctctaacagctcaggatctcttagcattttaattagatgtaattgtttgtctttaactgtcaaaaagtttggttctgtgtctgtgttttaataagacgagaggacgagcgattgaggtgtatggagagaaaacagacctaatgctccttgttcctagagtagagtggagggagggtggcctaagagttgagctctcggaactgcatgctgctggacagtatcactgtctttcctagatggcagtcactgaattccattttttcaaggtaatttcttgtgcctctaatagcccaagaatgggaggttgatcagatctgacatgattccttcctgttctgaactgtggggtgtgcacatctctgcttgagtcaggtttgagtagaggcttagagacagttgggtgagaacaaccaaaatcttatcatggtctcagtcataatcattagggggaactctagccaaatggtttaacttctgcctgtggaactggggattgggtgggcaggaaaaggtgatatccattctttctgataactagatggtgctgagaagcttttgaataaaaactttgctaaatgagaaaaaaaaaaa

SEQ ID NO: 417568 - DNA, 820 bp, Homo sapiens
gggggccccgagggatccaggtcctgtggcaactgacgtagctgcaaaggacagatccagggactgaagccaaagttatgcaagggactgtgtgttgccacaggacacagtcagatttccagtctccaccaggaacctcttcagaaagtgtgctttatgctgaaacagaatactgttaaaggaaaaaaaagaggggggaagatcaggtcatactatctactctcctcatctctaacagctcaggatctcttagcattttaattagatgtaattgtttgtctttaactgtcaaaaagtttggttctgtgtctgtgttttaataagacgagaggacgagcgattgaggtgtatggagagaaaacagacctaatgctccttgttcctagagtagagtggagggagggtggcctaagagttgagctctcggaactgcatgctgctggacagtatcactgtctttcctagatggcagtcactgaattccattttttcaaggtaatttcttgtgcctctaatagcccaagaatgggaggttgatcagatctgacatgattccttcctgttctgaactgtggggtgtgcacatctctgcttgagtcaggtttgagtagaggcttagagacagttgggtgagaacaaccaaaatcttatcatggtctcagtcataatcattagggggaactctagccaaatggtttaacttctgcctgtggaactggggattgggtgggcaggaaaaggtgatatccattctttctgataactagatggtgctgagaagcttttgaataaaaactttgctaaatgagaaaaaaaaaaa

SEQ ID NO: 417569 - DNA, 976 bp, Homo sapiens
  misc_feature (286)..(286): n is a, c, g, or t
  misc_feature (319)..(319): n is a, c, g, or t
aactctgtcttccagggtaaaaataataaggttgaatcattttattaaaaatactttttaagaaaataactatgaacatctgaatattaaagatataaaaatgcacataattcatatttcaggtggtatttgcattcagtgccttactggtattctcagaacattttaatgatttctaacatttcttaacagtcatagatatatacattttcattttttgtacttgaatattctaaataaaactgacatttactcttgacaaataaaacatatatttactaaaaanaaaaaaaaaaaacctcgtgccgaattcgggagnctaggaatactgttaaaggaaaaaaaagaggggggaagatcaggtcatactatctactctcctcatctctaacagctcaggatctcttagcattttaattagatgtaattgtttgtctttaactgtcaaaaagtttggttctgtgtctgtgttttaataagacgagaggacgagcgattgaggtgtatggagagaaaacagacctaatgctccttgttcctagagtagagtggagggagggtggcctaagagttgagctctcggaactgcatgctgctggacagtatcactgtctttcctagatggcagtcactgaattccattttttcaaggtaatttcttgtgcctctaatagcccaagaatgggaggttgatcagatctgacatgattccttcctgttctgaactgtggggtgtgcacatctctgcttgagtcaggtttgagtagaggcttagagacagttgggtgagaacaaccaaaatcttatcatggtctcagtcataatcattagggggaactctagccaaatggtttaacttctgcctgtggaactggggattgggtgggcaggaaaaggtgatatccattctttctgataactagatggtgctgagaagcttttgaataaaaactttgctaaatgagaaaaaaaaaaa

SEQ ID NO: 417570 - DNA, 2728 bp, Homo sapiens
ggcacgagggtggggtcgagagcgggatccgaggctggcgggttttggcagtagctgtggctgcggctgccgggcctggggacgcgggcggccgaggccgccgtcgcagcctcctcgtctcgccggctatggctgcgctcggccggcccttcagcggcctccctctgagcggcggctcggacttcctgcagccgccgcagccggccttccccggccgggccttcccgccgggggctgacggcgccgagttggccccgcggccgggacctcgcgcagtccctagcagtcccgctgggagtgcggcgcgcggacgtgtttctgttcactgtaaaaagaaacacaagcgagaggaggaggaggatgatgattgtccagtaagaaagaaaaggataactgaagcagagctctgtgctggtcctaatgactggattctttgtgcacatcaggatgtagaggggcatggagtaaatcccagtgttagtggcctttccatacctgggatattagatgttatttgtgaagaaatggatcagacaactggagaaccacagtgtgaagttgcccgaaggaagcttcaggagattgaggacaggataattgatgaagatgaagaagttgaagctgacagaaatgttaaccatctccccagtcttgtcctttctgataccatgaaaacaggtttgaagagggaatttgatgaagtttttacaaagaaaatgattgagtctatgagccgtccttccatggagcttgttctctggaaacccctccctgaactcctttctgataagccaaagccatcctctaatactaagaactatacaggagagagccaagctaagcatgtagctgctggcactgccttccctcagagaactgaactgttttcggaacctcggccaacagggatgtctctttataatagtttggagacagctactagcacagaagaagagatggaactctagaaaccaatttctacactaaagttgtcaaatgttagaagaatcctgtgttcagttatgagactctttgcatagtatagggacttgaaagttttatgagacgggtgtaataatatctccacctgtgatttgggggtgggactcttattttgggtagccatttattgacttcacctttttgccaaggacgtttgtctcaagggaaaagcagttttctgtggggcttattaaaggaatgttggtttacattgtcttcaaagacaagtatagaagctgtatgtgtaagggtgacttaaatcatatgtcacattgtctaaactattcagacacttggagaatattctccttgaattaaaaaagatgattaagaaggatgctcctacaactgtatcctgacagttaagtcacagcttaatgtgtagatatgagctgtttacagtggtgactatatataattggggagaagaagggaagagagcagcagtagcttaagcctgttgctaagaaatttaatttcttagcaacttgtaatttagttatcaattcaatatagctctgttgattaaatagccgatagtattgtggctctcctctttgactatgaaaatatagagaaagttttttctttaaggcttttttgccttgtgccactgttgctccttggtttcccttgcgtaattgataagcccagttattcagtaatgtttacaaattaattgactttgatagttaaaagattatgaggtaacccatctgcaatttgcctgtgggagaagcatcctttagttcatcttaaggaagtgctttatcagctaaacccaacattgataactttggtaatttttttaaaaaggcctcagctccccgccgccgccgccgccgccgccgccgagccggtttcctttttccggcgctccgggtgcgagagacaggtcgggccccctaggcagcgagccgcagcgcaatcccggcgctcgcccaaggaccctggaagctaccgttaccccgccgggcagcgtgggcgccatgagcagctcgggactgaattcggagaaggtagctgctctgatacagaaactgaattccgacccccagttcgtacttgcccagaatgtcgggaccacccacgacctgctggacatctgtctgaagcgggccacggtgcagcgcgcgcagcatgtgttccagcacgccgtgccccaggagggcaagccaatcaccaaccagaagagctcagggcgatgctggatcttttcttgtctgaatgttatgaggcttccattcatgaaaaagttaaatattgaagaatttgagtttagccaatcttacctgtttttttgggacaaggttgaacgctgttatttcttcttgagtgcttttgtggacacagcccagagaaaggagcctgaggatgggaggctggtgcagtttttgcttatgaaccctgcaaatgatggtggccaatgggatatgcttgttaatattgttgaaaaatatggtgttatccctaagaaatgcttccctgaatcttatacaacagaggcaaccagaaggatgaatgatattctgaatcacaagatgaggagaattctgttacgactgcggactgctccctgggggccaccgacggggaactcggccccggcgtctgggcgcggaatcggtgggtgcctgttggtatccccggcttccctggggtccgccgtttttcgaaggcctaacctgggttcggctggcctatggaatttttgtgcccccctctg

SEQ ID NO: 417571 - DNA, 1904 bp, Homo sapiens
ggctaggtacgaggccggggttaatcggccgagggttgaacgctgttatttcttcttgagtgcttttgtggacacagcccagagaaaggagcctgaggatgggaggctggtgcagtttttgcttatgaaccctgcaaatgatggtggccaatgggatatgcttgttaatattgttgaaaaatatggtgttatccctaagaaatgcttccctgaatcttatacaacagaggcaaccagaaggatgaatgatattctgaatcacaagatgagagaattctgtatacgactgcggaacctggtacacagtggagcaaccaaaggagaaatctcggccacacaggacgtcatgatggaggagatattccgagtggtgtgcatctgtttgggtaatccaccagagacattcacctgggaatatcgagacaaagataaaaattatcagaaaattggccccataacacccttggagttttacagggaacatgtcaagccactcttcaatatggaagataagatttgtttagtgaatgaccctaggccccagcacaagtacaacaaactttacacagtggaatacttaagcaatatggttggagggagaaaaactctatacaacaaccagcccattgacttcctgaaaaagatggttgctgcctccatcaaagatggagaggctgtgtggtttggctgtgatgttggaaaacacttcaatagcaagctgggcctcagtgacatgaatctctatgaccatgagttagtgtttggtgtctccttgaagaacatgaataaagcggagaggctgacttttggtgagtcacttatgacccacgccatgaccttcactgctgtctcagagaaggatgatcaggatggtgctttcacaaaatggagagtggagaattcatggggtgaagaccatggccacaaaggttacctgtgcatgacagatgagtggttctctgagtatgtctacgaagtggtggtggacaggaagcatgtccctgaagaggtgctagctgtgttagagcaggaacccattatcctgccagcatgggaccccatgggagctttggctgagtgatactgccctccagctctttcctccttccatggaacctgacgtagctgcaaaggacagatccagggactgaagccaaagttatgcaagggactgtgtgttgccacaggacacagtcagatttccagtctccaccaggaacctcttcagaaagtgtgctttatgctgaaacagaatactgttaaaggaaaaaaaagaggggggaagatcaggtcatactatctactctcctcatctctaacagctcaggatctcttagcattttaattagatgtaattgtttgtctttaactgtcaaaaagtttggttctgtgtctgtgttttaataagacgagaggacgagcgattgaggtgtatggagagaaaacagacctaatgctccttgttcctagagtagagtggagggagggtggcctaagagttgagctctcggaactgcatgctgctggacagtatcactgtctttcctagatggcagtcactgaattccattttttcaaggtaatttcttgtgcctctaatagcccaagaatgggaggttgatcagatctgacatgattccttcctgttctgaactgtggggtgtgcacatctctgcttgagtcaggtttgagtagaggcttagagacagttgggtgagaacaaccaaaatcttatcatggtctcagtcataatcattagggggaactctagccaaatggtttaacttctgcctgtggaactggggattgggtgggcaggaaaaggtgatatccattctttctgataactagatggtgctgagaagcttttgaataaaaactttgctaaatgagaaaaaaaaaaa

SEQ ID NO: 417572 - DNA, 1843 bp, Homo sapiens
tgtaggacagcaatgaaatgcatacagctttttcttccctcgctcaaaaaaaagtttaaacacacaaacttacaatctcatcagcacacactctcttgtgacaaatgattcagacaaaaatatggtgttatccctaagaaatgcttccctgaatcttatacaacagaggcaaccagaaggatgaatgatattctgaatcacaagatgagagaattctgtatacgactgcggaacctggtacacagtggagcaaccaaaggagaaatctcggccacacaggacgtcatgatggaggagatattccgagtggtgtgcatctgtttgggtaatccaccagagacattcacctgggaatatcgagacaaagataaaaattatcagaaaattggccccataacacccttggagttttacagggaacatgtcaagccactcttcaatatggaagataagatttgtttagtgaatgaccctaggccccagcacaagtacaacaaactttacacagtggaatacttaagcaatatggttggagggagaaaaactctatacaacaaccagcccattgacttcctgaaaaagatggttgctgcctccatcaaagatggagaggctgtgtggtttggctgtgatgttggaaaacacttcaatagcaagctgggcctcagtgacatgaatctctatgaccatgagttagtgtttggtgtctccttgaagaacatgaataaagcggagaggctgacttttggtgagtcacttatgacccacgccatgaccttcactgctgtctcagagaaggatgatcaggatggtgctttcacaaaatggagagtggagaattcatggggtgaagaccatggccacaaaggttacctgtgcatgacagatgagtggttctctgagtatgtctacgaagtggtggtggacaggaagcatgtccctgaagaggtgctagctgtgttagagcaggaacccattatcctgccagcatgggaccccatgggagctttggctgagtgatactgccctccagctctttcctccttccatggaacctgacgtagctgcaaaggacagatccagggactgaagccaaagttatgcaagggactgtgtgttgccacaggacacagtcagatttccagtctccaccaggaacctcttcagaaagtgtgctttatgctgaaacagaatactgttaaaggaaaaaaaagaggggggaagatcaggtcatactatctactctcctcatctctaacagctcaggatctcttagcattttaattagatgtaattgtttgtctttaactgtcaaaaagtttggttctgtgtctgtgttttaataagacgagaggacgagcgattgaggtgtatggagagaaaacagacctaatgctccttgttcctagagtagagtggagggagggtggcctaagagttgagctctcggaactgcatgctgctggacagtatcactgtctttcctagatggcagtcactgaattccattttttcaaggtaatttcttgtgcctctaatagcccaagaatgggaggttgatcagatctgacatgattccttcctgttctgaactgtggggtgtgcacatctctgcttgagtcaggtttgagtagaggcttagagacagttgggtgagaacaaccaaaatcttatcatggtctcagtcataatcattagggggaactctagccaaatggtttaacttctgcctgtggaactggggattgggtgggcaggaaaaggtgatatccattctttctgataactagatggtgctgagaagcttttgaataaaaactttgctaaatgagaaaaaaaaaaa

SEQ ID NO: 417573 - DNA, 3606 bp, Homo sapiens
ggcacgagggtggggtcgagagcgggatccgaggctggcgggttttggcagtagctgtggctgcggctgccgggcctggggacgcgggcggccgaggccgccgtcgcagcctcctcgtctcgccggctatggctgcgctcggccggcccttcagcggcctccctctgagcggcggctcggacttcctgcagccgccgcagccggccttccccggccgggccttcccgccgggggctgacggcgccgagttggccccgcggccgggacctcgcgcagtccctagcagtcccgctgggagtgcggcgcgcggacgtgtttctgttcactgtaaaaagaaacacaagcgagaggaggaggaggatgatgattgtccagtaagaaagaaaaggataactgaagcagagctctgtgctggtcctaatgactggattctttgtgcacatcaggatgtagaggggcatggagtaaatcccagtgttagtggcctttccatacctgggatattagatgttatttgtgaagaaatggatcagacaactggagaaccacagtgtgaagttgcccgaaggaagcttcaggagattgaggacaggataattgatgaagatgaagaagttgaagctgacagaaatgttaaccatctccccagtcttgtcctttctgataccatgaaaacaggtttgaagagggaatttgatgaagtttttacaaagaaaatgattgagtctatgagccgtccttccatggagcttgttctctggaaacccctccctgaactcctttctgataagccaaagccatcctctaatactaagaactatacaggagagagccaagctaagcatgtagctgctggcactgccttccctcagagaactgaactgttttcggaacctcggccaacagggatgtctctttataatagtttggagacagctactagcacagaagaagagatggaactctagaaaccaatttctacactaaagttgtcaaatgttagaagaatcctgtgttcagttatgagactctttgcatagtatagggacttgaaagttttatgagacgggtgtaataatatctccacctgtgatttgggggtgggactcttattttgggtagccatttattgacttcacctttttgccaaggacgtttgtctcaagggaaaagcagttttctgtggggcttattaaaggaatgttggtttacattgtcttcaaagacaagtatagaagctgtatgtgtaagggtgacttaaatcatatgtcacattgtctaaactattcagacacttggagaatattctccttgaattaaaaaagatgattaagaaggatgctcctacaactgtatcctgacagttaagtcacagcttaatgtgtagatatgagctgtttacagtggtgactatatataattggggagaagaagggaagagagcagcagtagcttaagcctgttgctaagaaatttaatttcttagcaacttgtaatttagttatcaattcaatatagctctgttgattaaatagccgatagtattgtggctctcctctttgactatgaaaatatagagaaagttttttctttaaggcttttttgccttgtgccactgttgctccttggtttcccttgcgtaattgataagcccagttattcagtaatgtttacaaattaattgactttgatagttaaaagattatgaggtaacccatctgcaatttgcctgtgggagaagcatcctttagttcatcttaaggaagtgctttatcagctaaacccaacattgataactttggtaatttttttaaaaaggcctcagctccccgccgccgccgccgccgccgccgccgagccggtttcctttttccggcgctccgggtgcgagagacaggtcgggccccctaggcagcgagccgcagcgcaatcccggcgctcgcccaaggaccctggaagctaccgttaccccgccgggcagcgtgggcgccatgagcagctcgggactgaattcggagaaggtagctgctctgatacagaaactgaattccgacccccagttcgtacttgcccagaatgtcgggaccacccacgacctgctggacatctgtctgaagcgggccacggtgcagcgcgcgcagcatgtgttccagcacgccgtgccccaggagggcaagccaatcaccaaccagaagagctcagggcgatgctggatcttttcttgtctgaatgttatgaggcttccattcatgaaaaagttaaatattgaagaatttgagtttagccaatcttacctgtttttttgggacaaggttgaacgctgttatttcttcttgagtgcttttgtggacacagcccagagaaaggagcctgaggatgggaggctggtgcagtttttgcttatgaaccctgcaaatgatggtggccaatgggatatgcttgttaatattgttgaaaaatatggtgttatccctaagaaatgcttccctgaatcttatacaacagaggcaaccagaaggatgaatgatattctgaatcacaagatgagagaattctgtatacgactgcggaacctggtacacagtggagcaaccaaaggagaaatctcggccacacaggacgtcatgatggaggagatattccgagtggtgtgcatctgtttgggtaatccaccagagacattcacctgggaatatcgagacaaagataaaaattatcagaaaattggccccataacacccttggagttttacagggaacatgtcaagccactcttcaatatggaagataagatttgtttagtgaatgaccctaggccccagcacaagtacaacaaactttacacagtggaatacttaagcaatatggttggagggagaaaaactctatacaacaaccagcccattgacttcctgaaaaagatggttgctgcctccatcaaagatggagaggctgtgtggtttggctgtgatgttggaaaacacttcaatagcaagctgggcctcagtgacatgaatctgtgagtgcaggaaatttaaaatggaaagtcatttgtgggttgttgctgttggagtgtgctgttggtacaaaatgactctgccgaggttcatccaaagatgaaggttgacctaagggcgcgtctctttctttgcatcctttagagtttgaggactcatagcagaaactccacatacttaaacactctaacccaggacatcaaaatcccactttctatctgagtggaaatcgttgggcgttcctaaaaagccatcctctatgagaaagacactttaaaaaaataattgactattgcggaaatgtgttcagtgcatttgggagtgtaatgaaagattttccagagcccccgtttgctatgttactttggtaactttgtattttgtcattgtgacaagtgggactaatttgcatgcatactttatagcattcctcctggtcatttatgacaatgaaggttaatttgtaaactaaatcatataggattccttgactgttcaccattctctattttagggttacttataaatagttgttacttgtaggaagttgagtaaatatcttgatagagaaatctgctaaaaaaaagaa

SEQ ID NO: 417574 - DNA, 3003 bp, Homo sapiens
ggcacgagggtggggtcgagagcgggatccgaggctggcgggttttggcagtagctgtggctgcggctgccgggcctggggacgcgggcggccgaggccgccgtcgcagcctcctcgtctcgccggctatggctgcgctcggccggcccttcagcggcctccctctgagcggcggctcggacttcctgcagccgccgcagccggccttccccggccgggccttcccgccgggggctgacggcgccgagttggccccgcggccgggacctcgcgcagtccctagcagtcccgctgggagtgcggcgcgcggacgtgtttctgttcactgtaaaaagaaacacaagcgagaggaggaggaggatgatgattgtccagtaagaaagaaaaggataactgaagcagagctctgtgctggtcctaatgactggattctttgtgcacatcaggatgtagaggggcatggagtaaatcccagtgttagtggcctttccatacctgggatattagatgttatttgtgaagaaatggatcagacaactggagaaccacagtgtgaagttgcccgaaggaagcttcaggagattgaggacaggataattgatgaagatgaagaagttgaagctgacagaaatgttaaccatctccccagtcttgtcctttctgataccatgaaaacaggtttgaagagggaatttgatgaagtttttacaaagaaaatgattgagtctatgagccgtccttccatggagcttgttctctggaaacccctccctgaactcctttctgataagccaaagccatcctctaatactaagaactatacaggagagagccaagctaagcatgtagctgctggcactgccttccctcagagaactgaactgttttcggaacctcggccaacagggatgtctctttataatagtttggagacagctactagcacagaagaagagatggaactctagaaaccaatttctacactaaagttgtcaaatgttagaagaatcctgtgttcagttatgagactctttgcatagtatagggacttgaaagttttatgagacgggtgtaataatatctccacctgtgatttgggggtgggactcttattttgggtagccatttattgacttcacctttttgccaaggacgtttgtctcaagggaaaagcagttttctgtggggcttattaaaggaatgttggtttacattgtcttcaaagacaagtatagaagctgtatgtgtaagggtgacttaaatcatatgtcacattgtctaaactattcagacacttggagaatattctccttgaattaaaaaagatgattaagaaggatgctcctacaactgtatcctgacagttaagtcacagcttaatgtgtagatatgagctgtttacagtggtgactatatataattggggagaagaagggaagagagcagcagtagcttaagcctgttgctaagaaatttaatttcttagcaacttgtaatttagttatcaattcaatatagctctgttgattaaatagccgatagtattgtggctctcctctttgactatgaaaatatagagaaagttttttctttaaggcttttttgccttgtgccactgttgctccttggtttcccttgcgtaattgataagcccagttattcagtaatgtttacaaattaattgactttgatagttaaaagattatgaggtaacccatctgcaatttgcctgtgggagaagcatcctttagttcatcttaaggaagtgctttatcagctaaacccaacattgataactttggtaatttttttaaaaaggcctcagctccccgccgccgccgccgccgccgccgccgagccggtttcctttttccggcgctccgggtgcgagagacaggtcgggccccctaggcagcgagccgcagcgcaatcccggcgctcgcccaaggaccctggaagctaccgttaccccgccgggcagcgtgggcgccatgagcagctcgggactgaattcggagaaggtagctgctctgatacagaaactgaattccgacccccagttcgtacttgcccagaatgtcgggaccacccacgacctgctggacatctgtctgaagcgggccacggtgcagcgcgcgcagcatgtgttccagcacgccgtgccccaggagggcaagccaatcaccaaccagaagagctcagggcgatgctggatcttttcttgtctgaatgttatgaggcttccattcatgaaaaagttaaatattgaagaatttgagtttagccaatcttacctgtttttttgggacaaggttgaacgctgttatttcttcttgagtgcttttgtggacacagcccagagaaaggagcctgaggatgggaggctggtgcagtttttgcttatgaaccctgcaaatgatggtggccaatgggatatgcttgttaatattgttgaaaaatatggtgttatccctaagaaatgcttccctgaatcttatacaacagaggcaaccagaaggatgaatgatattctgaatcacaagatggagagaattctggtatacgactgcgcgaagcctgtgttccccagtgggtgccaacaagtggggaactctcgggccccaggggcggtcctgctgcgggccggatttccgagggggcgtgagccttgtgggcgtaatcccccgggcacttccctgtggcatattgggcgcagatttacattatctcgacaatggtccccgaaaaaacccctggggttatacgggggactgtctggcgacctttaatatgggagaacaaatttgtgtgaagttcaagagtgcaggcagatattacaaatatacgggagataagaaatatgggggagaggaagaatataaaccaaggttgttgtaagagcagccgcaataaaagaggatgtagagttggaaggaataaagagacgatcataatcatatgattgagactaaagatggaaggatctaaatggaagtaccaggt

SEQ ID NO: 417575 - DNA, 2683 bp, Homo sapiens
ggcacgagggtggggtcgagagcgggatccgaggctggcgggttttggcagtagctgtggctgcggctgccgggcctggggacgcgggcggccgaggccgccgtcgcagcctcctcgtctcgccggctatggctgcgctcggccggcccttcagcggcctccctctgagcggcggctcggacttcctgcagccgccgcagccggccttccccggccgggccttcccgccgggggctgacggcgccgagttggccccgcggccgggacctcgcgcagtccctagcagtcccgctgggagtgcggcgcgcggacgtgtttctgttcactgtaaaaagaaacacaagcgagaggaggaggaggatgatgattgtccagtaagaaagaaaaggataactgaagcagagctctgtgctggtcctaatgactggattctttgtgcacatcaggatgtagaggggcatggagtaaatcccagtgttagtggcctttccatacctgggatattagatgttatttgtgaagaaatggatcagacaactggagaaccacagtgtgaagttgcccgaaggaagcttcaggagattgaggacaggataattgatgaagatgaagaagttgaagctgacagaaatgttaaccatctccccagtcttgtcctttctgataccatgaaaacaggtttgaagagggaatttgatgaagtttttacaaagaaaatgattgagtctatgagccgtccttccatggagcttgttctctggaaacccctccctgaactcctttctgataagccaaagccatcctctaatactaagaactatacaggagagagccaagctaagcatgtagctgctggcactgccttccctcagagaactgaactgttttcggaacctcggccaacagggatgtctctttataatagtttggagacagctactagcacagaagaagagatggaactctagaaaccaatttctacactaaagttgtcaaatgttagaagaatcctgtgttcagttatgagactctttgcatagtatagggacttgaaagttttatgagacgggtgtaataatatctccacctgtgatttgggggtgggactcttattttgggtagccatttattgacttcacctttttgccaaggacgtttgtctcaagggaaaagcagttttctgtggggcttattaaaggaatgttggtttacattgtcttcaaagacaagtatagaagctgtatgtgtaagggtgacttaaatcatatgtcacattgtctaaactattcagacacttggagaatattctccttgaattaaaaaagatgattaagaaggatgctcctacaactgtatcctgacagttaagtcacagcttaatgtgtagatatgagctgtttacagtggtgactatatataattggggagaagaagggaagagagcagcagtagcttaagcctgttgctaagaaatttaatttcttagcaacttgtaatttagttatcaattcaatatagctctgttgattaaatagccgatagtattgtggctctcctctttgactatgaaaatatagagaaagttttttctttaaggcttttttgccttgtgccactgttgctccttggtttcccttgcgtaattgataagcccagttattcagtaatgtttacaaattaattgactttgatagttaaaagattatgaggtaacccatctgcaatttgcctgtgggagaagcatcctttagttcatcttaaggaagtgctttatcagctaaacccaacattgataactttggtaatttttttaaaaaggcctcagctccccgccgccgccgccgccgccgccgccgagccggtttcctttttccggcgctccgggtgcgagagacaggtcgggccccctaggcagcgagccgcagcgcaatcccggcgctcgcccaaggaccctggaagctaccgttaccccgccgggcagcgtgggcgccatgagcagctcgggactgaattcggagaaggtagctgctctgatacagaaactgaattccgacccccagttcgtacttgcccagaatgtcgggaccacccacgacctgctggacatctgtctgaagcgggccacggtgcagcgcgcgcagcatgtgttccagcacgccgtgccccaggagggcaagccaatcaccaaccagaagagctcagggcgatgctggatcttttcttgtctgaatgttatgaggcttccattcatgaaaaagttaaatattgaagaatttgagtttagccaatcttacctgtttttttgggacaaggttgaacgctgttatttcttcttgagtgcttttgtggacacagcccagagaaaggagcctgaggatgggaggctggtgcagtttttgcttatgaaccctgcaaatgatggtggccaatgggatatgcttgttaatattgttgaccacacctatggtgttatccctgaagaaatgcttcccctgagctcttatacgaccagaggccacccagaaggattgccatgactattctgaactcaccgcgatgcgccgcgcttctggttccggactgcggaaccctggtccccagtgggggcaccccacggggaaattctcgggcccccaggacgccgctgggggcgacttcccacggggggccctcttcggggacc

SEQ ID NO: 417576 - DNA, 2321 bp, Homo sapiens
aaaacactgactatgaaggaggaagacattgaagaaggaaagccatctatctctgtaagaggacaatgcaaaataaagcaaggctggaactggcagattatgaagcagaaaacttagcaagactccagagggcctttgcgaggaagtgggaattcatctttatgcaagcagaagcacaagtaaagattgaccggaaaaaagacaagacagaaaggaaaattttggatagtcaagaacgagccttttgggatgtccacaggcctgtgccaggctgtgtgaacacaacagaaatggatatccgaaaatgtcgacgtttgaagaatccacaaaaggttaaaaagtccgtgtatggcgtgactgaagagtcccaggcacagagcccggtgcatgtactcagccaaccaatcaggaaaacaacaaaagaggacatccggaaacagataacatttttgaacgcacagatcgacagacattgtttgaaaatgtccaaagtggctgaaagtttaattgcctacacggaacaatatgtggaatatgaccctttgataacaccagctgagccatccaacccttggatcagcgatgacgttgctttgtgggacatagagatgagcaaagagcccagccaacagcgagtaaaaagatggggcttctctttcgatgagatattgaaggaccaggtggggcgggaccagtttctacgattcctggagtccgaattcagttcagaaaacctcaggttctggctggctgtccaagatcttaagaaacaacccctacaggatgtggccaagagggtagaagaaatctggcaagagtttctggctccaggggctccaagtgcaatcaacctggattctcacagctatgagataaccagtcaaaatgtcaaagatggagggagatatacatttgaagacgcccaggagcacatctacaagctgatgaagagtgacagctatgcccgcttcctccggtcaaatgcttaccaggatttgctgctggccaagaagaagccagaaagtgagcaaggtcgtagaacttccctagaaaagttcactcgcagtgtgttgtattccaacactccactcgctaagaggccctgatcccagctcattcaggggagaacacgtcgtggggttcctgtcacgactatcacttgagattatattattatcctcactccctcgctgtctggagacggtcacaccttctggcaaattcaagaggcatgagtggaccgagagcacatccagcatttgcatcacctccctggcacctcccatagttacagccactacatccccaccgccgcctgtcatccctcacgtctctgtggccacccgggtgtcactgccagcaccaggcactgctttcacgtaaaatgtccaaatcacatcttcagcaagaaagcaacctcacggattgccccgcctcaaggtctttccaccctctttgagatcagcgttcggagaggtccccgccagcccggtggctgccctcaggtcccgtcacatgtctcaagggtccagcgttcgaggaagcactgttgtagatgacagagctttttgtttcacagctgcggggattctgctgaccatcttttagaaaattatttcataatttattctggctttgcccccttgctccttggtttattccctcatgttttactcaaaataaacatggccatgaactcaggggccattgggattctcccctctggcagccccaggtgggagctgggagggtccccagcccaggaggtggctggattgcagggctggcagcccccacgtggtggcatcctgacaggcacagtgagacccttgctgggtcaggtctcctttgtgtgtgaagctggggcagagtatgctacgaagggaccaggccaggccacagggctctcctcccagtctttatctgaaggcccagccaaagcacccctctaaaccggtcacctaggggaaatgcaaaaacctgcaaaagatccacctgtattccctgtgtgtgtgtgtcaaaatgaccatttgccaacctggctgtgaggtaatgtatgtaaagcaccgagtcaggtgcctgatacgcagtaggtgcttagcaaacggtagctaatactatcatcattgtcattgttattgtgacacccatgagcccacagacagagctgtattaagtaacctgttttgaatccagacattcactcccccacttgctatgactaccctcctttgatctatttttggtcataggtaaaaaaaaaaatctctcttgggagcatataaacaaaaaacatagaagcaaaaaagcgatcgctggta

SEQ ID NO: 417577 - DNA, 383 bp, Homo sapiens
gaaataaccattttcagttgtgatgccttaactaagaagccatcgaactataccgtgaaataaattggctcagaaccatagctcatcgaaaaaaaaaaaaaaaagccaaaatttccctctgtgaaccctggcagtcacgccggtgtgggtcgcgagctaatgttgctgtgtaggcggcttttgctgtgtgcagaaagcggccgtgctgcatgggtcctggcgatgtggcctagctggcgtgtgtgttagtcgcctctgcatgagtcccttccagcccccatcagcctcatgtgcacagtgtgatagggagaggagggaagtagctgaatccctgcggtgtcctgggtactccccgggggcaaggtcctaccggcctcctcagg

SEQ ID NO: 417578 - DNA, 2829 bp, Homo sapiens
agcggaagacatgacttgcacctccttgccttctgccatgattgtgaggcctccccagccacgtggaactgtactgacattgtgcagtggcttatgaagaacctttccattgaggacccagttgaagcaatacacttggggagccttatcgctgcccagggctacatctttccaatctcagaccatgttctcaccatgaaggatgatggcaccttttatcgtttccaggctccgtacttctggccttcgaactgctgggaacctgaaaacactgactatgaggaggaagacattgaagaaggaaagccatctatctctgtaagaggacaatgcaaaataaagcaaggctggaactggcagattatgaagcagaaaacttagcaagactccagagggcctttgcgaggaagtgggaattcatctttatgcaagcagaagcacaagtaaagattgaccggaaaaaagacaagacagaaaggaaaattttggatagtcaagaacgagccttttgggatgtccacaggcctgtgccaggctgtgtgaacacaacagaaatggatatccgaaaatgtcgacgtttgaagaatccacaaaaggttaaaaagtccgtgtatggcgtgactgaagagtcccaggcacagagcccggtgcatgtactcagccaaccaatcaggaaaacaacaaaagaggacatccggaaacagataacatttttgaacgcacagatcgacagacattgtttgaaaatgtccaaagtggctgaaagtttaattgcctacacggaacaatatgtggaatatgaccctttgataacaccagctgagccatccaacccttggatcagcgatgacgttgctttgtgggacatagagatgagcaaagagcccagccaacagcgagtaaaaagatggggcttctctttcgatgagatattgaaggaccaggtggggcgggaccagtttctacgattcctggagtccgaattcagttcagaaaacctcaggttctggctggctgtccaagatcttaagaaacaacccctacaggatgtggccaagagggtagaagaaatctggcaagagtttctggctccaggggctccaagtgcaatcaacctggattctcacagctatgagataaccagtcaaaatgtcaaagatggagggagatatacatttgaagacgcccaggagcacatctacaagctgatgaagagtgacagctatgcccgcttcctccggtcaaatgcttaccaggatttgctgctggccaagaagaagggaaagtcgctggcgggcaagcgcctcacgggcctgatgcagtcctcctgaccgttcctaccgcaggtccagggcctgggcccgcggaccccacaggcaggcggcggcgctccacatctgcggacagagtttccttacgaggagacttggtcactgtgaaggagaaagagtgagggcaatgaagggcgatggtggggagactcggtgggtgaatggggagaccagaaagaaagagtccacagagcctgggctgggcccggtggaggctcctgtttacagccctctcttctttgtacagttgtattccaacactccactcgctaagaggccctgatcccagctcattcaggggagaacacgtcgtggggttcctgtcacgactatcacttgagattatattattatcctcactccctcgctgtctggagacggtcacaccttctggcaaattcaagaggcatgagtggaccgagagcacatccagcatttgcatcacctccctggcacctcccatagttacagccactacatccccaccgccgcctgtcatccctcacgtctctgtggccacccgggtgtcactgccagcaccaggcactgctttcacgtaaaatgtccaaatcacatcttcagcaagaaagcaacctcacggattgccccgcctcaaggtctttccaccctctttgagatcagcgttcggagaggtccccgccagcccggtggctgccctcaggtcccgtcacatgtctcaagggtccagcgttcgaggaagcactgttgtagatgacagagctttttgtttcacagctgcggggattctgctgaccatcttttagaaaattatttcataatttattctggctttgcccccttgctccttggtttattccctcatgttttactcaaaataaacatggccatgaactcaggggccattgggattctcccctctggcagccccaggtgggagctgggagggtccccagcccaggaggtggctggattgcagggctggcagcccccacgtggtggcatcctgacaggcacagtgagacccttgctgggtcaggtctcctttgtgtgtgaagctggggcagagtatgctacgaagggaccaggccaggccacagggctctcctcccagtctttatctgaaggcccagccaaagcacccctctaaaccggtcacctaggggaaatgcaaaaacctgcaaaagatccacctgtattccctgtgtgtgtgtgtcaaaatgaccatttgccaacctggctgtgaggtaatgtatgtaaagcaccgagtcaggtgcctgatacgcagtaggtgcttagcaaacggtagctaatactatcatcattgtcattgttattgtgacacccatgagcccacagacagagctgtattaagtaacctgttttgaatccagacattcactcccccacttgctatgactaccctcctttgatctatttttggtcataggtaaaaaaaaaaatctctcttgggagcatataaacaaaaaacatagaagcaaaaaagcgatcgctggta

SEQ ID NO: 417579 - DNA, 1849 bp, Homo sapiens
agcggaagacatgacttgcacctccttgccttctgccatgattgtgaggcctccccagccacgtggaactgtactgacattgtgcagtggcttatgaagaacctttccattgaggacccagttgaagcaatacacttggggagccttatcgctgcccagggctacatctttccaatctcagaccatgttctcaccatgaaggatgatggcaccttttatcgtttccaggctccgtacttctggccttcgaactgctgggaacctgaaaacactgactatgaggaggaagacattgaagaaggaaagccatctatctctgtaagaggacaatgcaaaataaagcaaggctggaactggcagattatgaagcagaaaacttagcaagactccagagggcctttgcgaggaagtgggaattcatctttatgcaagcagaagcacaagtaaagattgaccggaaaaaagacaagacagaaaggaaaattttggatagtcaagaacgagccttttgggatgtccacaggcctgtgccaggctgtgtgaacacaacagaaatggatatccgaaaatgtcgacgtttgaagaatccacaaaaggttaaaaagtccgtgtatggcgtgactgaagagtcccaggcacagagcccggtgcatgtactcagccaaccaatcaggaaaacaacaaaagaggacatccggaaacagataacatttttgaacgcacagatcgacagacattgtttgaaaatgtccaaagtggctgaaagtttaattgcctacacggaacaatatgtggaatatgaccctttgataacaccagctgagccatccaacccttggatcagcgatgacgttgctttgtgggacatagagatgagcaaagagcccagccaacagcgagtaaaaagatggggcttctctttcgatgagatattgaaggaccaggtggggcgggaccagtttctacgattcctggagtccgaattcagttcagaaaacctcaggttctggctggctgtccaagatcttaagaaacaacccctacaggatgtggccaagagggtagaagaaatctggcaagagtttctggctccaggggctccaagtgcaatcaacctggattctcacagctatgagataaccagtcaaaatgtcaaagatggagggagatatacatttgaagacgcccaggagcacatctacaagctgatgaagagtgacagctatgcccgcttcctccggtcaaatgcttaccaggatttgctgctggccaagaagaagccagaaagtgagcaaggtcgtagaacttccctagaaaagttcactcgcagtgtgggatgaaaatgcaaaaaagagcaagcggctccctctgcagaaggtgcacccttgatcgcccagcctcaggcctgggcatttgatcatctgttcagggctttgaggaggagggaccctgctgccctcggggctgtgcggtttgtgcatcttctgcagcagctcagggagaagccatcgaactataccgtgaaataaattggctcagaaccatagctcatcgaaaaaaaaaaaaaaaagccaaaatttccctctgtgaaccctggcagtcacgccggtgtgggtcgcgagctaatgttgctgtgtaggcggcttttgctgtgtgcagaaagcggccgtgctgcatgggtcctggcgatgtggcctagctggcgtgtgtgttagtcgcctctgcatgagtcccttccagcccccatcagcctcatgtgcacagtgtgatagggagaggagggaagtagctgaatccctgcggtgtcctgggtactccccgggggcaaggtcctaccggcctcctcagg

SEQ ID NO: 417580 - DNA, 1480 bp, Homo sapiens
agcggaagacatgacttgcacctccttgccttctgccatgattgtgaggcctccccagccacgtggaactgtactgacattgtgcagtggcttatgaagaacctttccattgaggacccagttgaagcaatacacttggggagccttatcgctgcccagggctacatctttccaatctcagaccatgttctcaccatgaaggatgatggcaccttttatcgtttccaggctccgtacttctggccttcgaactgctgggaacctgaaaacactgactatgaggaggaagacattgaagaaggaaagccatctatctctgtaagaggacaatgcaaaataaagcaaggctggaactggcagattatgaagcagaaaacttagcaagactccagagggcctttgcgaggaagtgggaattcatctttatgcaagcagaagcacaagtaaagattgaccggaaaaaagacaagacagaaaggaaaattttggatagtcaagaacgagccttttgggatgtccacaggcctgtgccaggctgtgtgaacacaacagaaatggatatccgaaaatgtcgacgtttgaagaatccacaaaaggttaaaaagtccgtgtatggcgtgactgaagagtcccaggcacagagcccggtgcatgtactcagccaaccaatcaggaaaacaacaaaagaggacatccggaaacagataacatttttgaacgcacagatcgacagacattgtttgaaaatgtccaaagtggctgaaagtttaattgcctacacggaacaatatgtggaatatgaccctttgataacaccagctgagccatccaacccttggatcagcgatgacgttgctttgtgggacatagagatgagcaaagagcccagccaacagcgagtaaaaagatggggcttctctttcgatgagatattgaaggaccaggtggggcgggaccagtttctacgattcctggagtccgaattcagttcagaaaacctcaggttctggctggctgtccaagatcttaagaaacaacccctacaggatgtggccaagagggtagaagaaatctggcaagagtttctggctccaggggctccaagtgcaatcaacctggattctcacagctatgagataaccagtcaaaatgtcaaagatggagggagatatacatttgaagacgcccaggagcacatctacaagctgatgaagagtgacagctatgcccgcttcctccggtcaaatgcttaccaggatttgctgctggccaagaagaagccagaaagtgagcaaggtcgtagaacttccctagaaaagttcactcgcagtgtggtaagttcagtcggttttcttccctcagcttttcttttggttttggttttttctttcttcttcttttttttttttttccctttggttgttgtttcctttggggtgggagggagtccagtgctttctccctcgactcagcccttttc

SEQ ID NO: 417581 - DNA, 3124 bp, Homo sapiens
gactgtggaagcacgagcttacataagtggttaggcaagctggcgtgtggacttgtgtgggatgggtgcaggtctgcatataaatcatgttcctgggtttctgggtgtgaagcgcacaccgacggggacgagagcgcataggatggcgcttttagatacttccagtcttccgatgttgtgatcgcagtgtgagtgaagacactcaggatggctcaaggatccggggatcaaagagcagtgggggttgctgacccagaggagagttctccaaacatgatcgtttactgcaaaattgaagacatcattacaaagatgcaagatgacaagacagggggtgtgcccatcagaacagtcaagagctttctctccaaaatccccagtgtcgtcacaggtactgacattgtgcagtggcttatgaagaacctttccattgaggacccagttgaagcaatacacttggggagccttatcgctgcccagggctacatctttccaatctcagaccatgttctcaccatgaaggatgatggcaccttttatcgtttccaggctccgtacttctggccttcgaactgctgggaacctgaaaacactgactatgccatctatctctgtaagaggacaatgcaaaataaagcaaggctggaactggcagattatgaagcagaaaacttagcaagactccagagggcctttgcgaggaagtgggaattcatctttatgcaagcagaagcacaagtaaagattgaccggaaaaaagacaagacagaaaggaaaattttggatagtcaagaacgagccttttgggatgtccacaggcctgtgccaggctgtgtgaacacaacagaaatggatatccgaaaatgtcgacgtttgaagaatccacaaaaggttaaaaagtccgtgtatggcgtgactgaagagtcccaggcacagagcccggtgcatgtactcagccaaccaatcaggaaaacaacaaaagaggacatccggaaacagataacatttttgaacgcacagatcgacagacattgtttgaaaatgtccaaagtggctgaaagtttaattgcctacacggaacaatatgtggaatatgaccctttgataacaccagctgagccatccaacccttggatcagcgatgacgttgctttgtgggacatagagatgagcaaagagcccagccaacagcgagtaaaaagatggggcttctctttcgatgagatattgaaggaccaggtggggcgggaccagtttctacgattcctggagtccgaattcagttcagaaaacctcaggttctggctggctgtccaagatcttaagaaacaacccctacaggatgtggccaagagggtagaagaaatctggcaagagtttctggctccaggggctccaagtgcaatcaacctggattctcacagctatgagataaccagtcaaaatgtcaaagatggagggagatatacatttgaagacgcccaggagcacatctacaagctgatgaagagtgacagctatgcccgcttcctccggtcaaatgcttaccaggatttgctgctggccaagaagaagggaaagtcgctggcgggcaagcgcctcacgggcctgatgcagtcctcctgaccgttcctaccgcaggtccagggcctgggcccgcggaccccacaggcaggcggcggcgctccacatctgcggacagagtttccttacgaggagacttggtcactgtgaaggagaaagagtgagggcaatgaagggcgatggtggggagactcggtgggtgaatggggagaccagaaagaaagagtccacagagcctgggctgggcccggtggaggctcctgtttacagccctctcttctttgtacagttgtattccaacactccactcgctaagaggccctgatcccagctcattcaggggagaacacgtcgtggggttcctgtcacgactatcacttgagattatattattatcctcactccctcgctgtctggagacggtcacaccttctggcaaattcaagaggcatgagtggaccgagagcacatccagcatttgcatcacctccctggcacctcccatagttacagccactacatccccaccgccgcctgtcatccctcacgtctctgtggccacccgggtgtcactgccagcaccaggcactgctttcacgtaaaatgtccaaatcacatcttcagcaagaaagcaacctcacggattgccccgcctcaaggtctttccaccctctttgagatcagcgttcggagaggtccccgccagcccggtggctgccctcaggtcccgtcacatgtctcaagggtccagcgttcgaggaagcactgttgtagatgacagagctttttgtttcacagctgcggggattctgctgaccatcttttagaaaattatttcataatttattctggctttgcccccttgctccttggtttattccctcatgttttactcaaaataaacatggccatgaactcaggggccattgggattctcccctctggcagccccaggtgggagctgggagggtccccagcccaggaggtggctggattgcagggctggcagcccccacgtggtggcatcctgacaggcacagtgagacccttgctgggtcaggtctcctttgtgtgtgaagctggggcagagtatgctacgaagggaccaggccaggccacagggctctcctcccagtctttatctgaaggcccagccaaagcacccctctaaaccggtcacctaggggaaatgcaaaaacctgcaaaagatccacctgtattccctgtgtgtgtgtgtcaaaatgaccatttgccaacctggctgtgaggtaatgtatgtaaagcaccgagtcaggtgcctgatacgcagtaggtgcttagcaaacggtagctaatactatcatcattgtcattgttattgtgacacccatgagcccacagacagagctgtattaagtaacctgttttgaatccagacattcactcccccacttgctatgactaccctcctttgatctatttttggtcataggtaaaaaaaaaaatctctcttgggagcatataaacaaaaaacatagaagcaaaaaagcgatcgctggta

SEQ ID NO: 417582 - DNA, 629 bp, Homo sapiens
agcggaagacatgacttgcacctccttgccttctgccatgattgtgaggcctccccagccacgtggaactgtactgacattgtgcagtggcttatgaagaacctttccattgaggacccagttgaagcaatacacttggggagccttatcgctgcccagggctacatctttccaatctcagaccatgttctcaccatgaaggatgatggcaccttttatcgtttccaggctccgtacttctggccttcgaactgctgggaacctgaaaacactgactatgccatctatctctgtaagaggacaatgcaaaataaagcaaggctggaactggcagattatgaagcactccccactggaagaggagtcctgagaaatccagcctttggttttgctcctggagataccagcaggtggcaaagactcgttaattccccaataaccacagacaattttcccgattttcagcaacctttgaaacaagtgctgtgaaaacttagcaagactccagagggcctttgcgaggaagtgggaattcatctttatgcaagcagaagcacaagtaaagtaggtgaacttgatagagaccttttcagagaggaaaagactctggaatttggaaatggtgtgaa

SEQ ID NO: 417583 - DNA, 3178 bp, Homo sapiens
gactgtggaagcacgagcttacataagtggttaggcaagctggcgtgtggacttgtgtgggatgggtgcaggtctgcatataaatcatgttcctgggtttctgggtgtgaagcgcacaccgacggggacgagagcgcataggatggcgcttttagatacttccagtcttccgatgttgtgatcgcagtgtgagtgaagacactcaggatggctcaaggatccggggatcaaagagcagtgggggttgctgacccagaggagagttctccaaacatgatcgtttactgcaaaattgaagacatcattacaaagatgcaagatgacaagacagggggtgtgcccatcagaacagtcaagagctttctctccaaaatccccagtgtcgtcacaggtactgacattgtgcagtggcttatgaagaacctttccattgaggacccagttgaagcaatacacttggggagccttatcgctgcccagggctacatctttccaatctcagaccatgttctcaccatgaaggatgatggcaccttttatcgtttccaggctccgtacttctggccttcgaactgctgggaacctgaaaacactgactatgccatctatctctgtaagaggacaatgcaaaataaagcaaggctggaactggcagattatgaagcagaaaacttagcaagactccagagggcctttgcgaggaagtgggaattcatctttatgcaagcagaagcacaagtaaagattgaccggaaaaaagacaagacagaaaggaaaattttggatagtcaagaacgagccttttgggatgtccacaggcctgtgccaggctgtgtgaacacaacagaaatggatatccgaaaatgtcgacgtttgaagaatccacaaaaggttaaaaagtccgtgtatggcgtgactgaagagtcccaggcacagagcccggtgcatgtactcagccaaccaatcaggaaaacaacaaaagaggacatccggaaacagataacatttttgaacgcacagatcgacagacattgtttgaaaatgtccaaagtggctgaaagtttaattgcctacacggaacaatatgtggaatatgaccctttgataacaccagctgagccatccaacccttggatcagcgatgacgttgctttgtgggacatagagatgagcaaagagcccagccaacagcgagtaaaaagatggggcttctctttcgatgagatattgaaggaccaggtggggcgggaccagtttctacgattcctggagtccgaattcagttcagaaaacctcaggttctggctggctgtccaagatcttaagaaacaacccctacaggatgtggccaagagggtagaagaaatctggcaagagtttctggctccaggggctccaagtgcaatcaacctggattctcacagctatgagataaccagtcaaaatgtcaaagatggagggagatatacatttgaagacgcccaggagcacatctacaagctgatgaagagtgacagctatgcccgcttcctccggtcaaatgcttaccaggatttgctgctggccaagaagaagccagaaagtgagcaaggtcgtagaacttccctagaaaagttcactcgcagtgtgggaaagtcgctggcgggcaagcgcctcacgggcctgatgcagtcctcctgaccgttcctaccgcaggtccagggcctgggcccgcggaccccacaggcaggcggcggcgctccacatctgcggacagagtttccttacgaggagacttggtcactgtgaaggagaaagagtgagggcaatgaagggcgatggtggggagactcggtgggtgaatggggagaccagaaagaaagagtccacagagcctgggctgggcccggtggaggctcctgtttacagccctctcttctttgtacagttgtattccaacactccactcgctaagaggccctgatcccagctcattcaggggagaacacgtcgtggggttcctgtcacgactatcacttgagattatattattatcctcactccctcgctgtctggagacggtcacaccttctggcaaattcaagaggcatgagtggaccgagagcacatccagcatttgcatcacctccctggcacctcccatagttacagccactacatccccaccgccgcctgtcatccctcacgtctctgtggccacccgggtgtcactgccagcaccaggcactgctttcacgtaaaatgtccaaatcacatcttcagcaagaaagcaacctcacggattgccccgcctcaaggtctttccaccctctttgagatcagcgttcggagaggtccccgccagcccggtggctgccctcaggtcccgtcacatgtctcaagggtccagcgttcgaggaagcactgttgtagatgacagagctttttgtttcacagctgcggggattctgctgaccatcttttagaaaattatttcataatttattctggctttgcccccttgctccttggtttattccctcatgttttactcaaaataaacatggccatgaactcaggggccattgggattctcccctctggcagccccaggtgggagctgggagggtccccagcccaggaggtggctggattgcagggctggcagcccccacgtggtggcatcctgacaggcacagtgagacccttgctgggtcaggtctcctttgtgtgtgaagctggggcagagtatgctacgaagggaccaggccaggccacagggctctcctcccagtctttatctgaaggcccagccaaagcacccctctaaaccggtcacctaggggaaatgcaaaaacctgcaaaagatccacctgtattccctgtgtgtgtgtgtcaaaatgaccatttgccaacctggctgtgaggtaatgtatgtaaagcaccgagtcaggtgcctgatacgcagtaggtgcttagcaaacggtagctaatactatcatcattgtcattgttattgtgacacccatgagcccacagacagagctgtattaagtaacctgttttgaatccagacattcactcccccacttgctatgactaccctcctttgatctatttttggtcataggtaaaaaaaaaaatctctcttgggagcatataaacaaaaaacatagaagcaaaaaagcgatcgctggta

SEQ ID NO: 417584 - DNA, 1132 bp, Homo sapiens
agcggaagacatgacttgcacctccttgccttctgccatgattgtgaggcctccccagccacgtggaactgtactgacattgtgcagtggcttatgaagaacctttccattgaggacccagttgaagcaatacacttggggagccttatcgctgcccagggctacatctttccaatctcagaccatgttctcaccatgaaggatgatggcaccttttatcgtttccaggctccgtacttctggccttcgaactgctgggaacctgaaaacactgactatgaggaggaagacattgaagaaggaaagccatctatctctgtaagaggacaatgcaaaataaagcaaggctggaactggcagattatgaagcagaaaacttagcaagactccagagggcctttgcgaggaagtgggaattcatctttatgcaagcagaagcacaagtaaagattgaccggaaaaaagacaagacagaaaggaaaattttggatagtcaagaacgagccttttgggatgtccacaggcctgtgccaggctgtgtgaacacaacagaaatggatatccgaaaatgtcgacgtttgaagaatccacaaaaggttaaaaagtccgtgtatggcgtgactgaagagtcccaggcacagagcccggtgcatgtactcagccaaccaatcaggaaaacaacaaaagaggacatccggaaacaggtgaatgaattgacagcttgcactctcaggaggagacgtggccagtttaaaaaccctttcaaatgttcaactctgaagattgagcaagctttgagttcctggaaaccacagtggaacccagctgtgggtgattgaaccttttaagtgctgtgtgtgaacaagccacggaagcttgagagaaagaattctctacccagttcctccagcagttactagaaaagggcgtaaatgagtcatcccatgccttggggtaactgctgtaatggggtttcccacagtccgctgtgggagctggaggaaggagggggctcatgtcacacagtccttataattggaatgcaccagctcaggatggtctactttattgctgtgatttgaaaggaaagtttaagaataaataaagctctactcccaatgccatttcagca

SEQ ID NO: 417585 - DNA, 469 bp, Homo sapiens
taattgttgaaagacaacttgtggattatttggaatggccattgtgattctacttgtttttaattatactcttaccacattattagagggagcgtagcatagcaggtaagactacacactgaagggagacttccagggttagaacattggctctgctacttcacagctatgtgatgtggacagattagtctttgttcctcattttccatctgtaacatggggatgataactttacctacttcctagagttgatgtgaggaatacttgagcttatatatataaacagttatagcaatgccaagcatgtaataagtgaatataagagctggctgtttttatgtaatatatagctgtctcattatttagtctctctatggggggaaataggctactataattttaggcaaaataatttggctgtagagaaacaaaccaagttgttccactttactctttgaccatttatttg

SEQ ID NO: 417586 - DNA, 378 bp, Homo sapiens
ggacaggggcagctgctagacaggccctattctgggcctctctgaaaagaagagtccctgaaaagaaagggagcctcccgcttccgtggccccttagccatgccaaggggcagcaaccggctttctgctgatgctgatgagctgtggtgtgaactcacgaaggtcagctgattcacaggccctggatctctgctctccctctgctaagtgggactcgggccagcctgccatgaaggaggcggctgctgcagctctcaggaaggaacactgggcggctaaccccaccgggcggccaaccccaccgggtgtcaaccccaccgggcggccaaccccaccggacggccaaccccaccgggcgtcaaccccaccgggcggcca

SEQ ID NO: 417587 - DNA, 227 bp, Homo sapiens
tactgggctaaactccagacgctggccaccttcatagggtggagatgacagaacaggacaggagccatggggctcccggggcgggtaggggtgggtcatgttccttggcttgggggcagttacaagggtacagtggggcttgttgaagggcaaaagttctgtaagttcgtcccgacaggccaaagaaaccccagagccgtctttcgactgactacagcctggaagag

SEQ ID NO: 417588 - DNA, 255 bp, Homo sapiens
ggcaaaacagcctcttcctatctaaatgagctcattatttttcatctgtgctatttcttacagtggtgtctaaaaaacaatccaaaagtttgatccatttagtgaaatcttacatggagtatgacaatggatatttatctaatggatatttatactaataaaaaaatagtatatttgttactaactagtaagaatcagtcagcatgacattataacattggcagtgtgttgtattattacgccttgagcaattgt

SEQ ID NO: 417589 - DNA, 1804 bp, Homo sapiens
cacagttgttgcaaagtgctcagcactaagggagccagcgcacagcacagccaggaaggcgagcgagcccagccagcccagccagcccagccagcccggaggtaaggaaacggtgctcgggcagcagctctgctcggaaagaaggcacggcttctgctcttaagccaagtggtcttttcaaaggccttctttaaaatcgctcagatgggtgcttttgagtctgcgggtctggtttctgaaaacccaggctgcacgcagctgcattgcaaagtgcttttgctaattcggagggcttcacctttctcttcagaaagcaaagggcagttttcttaagtcacttgcagaaggaaatttccatgtgtatttaggaatctggtgtttatttgctgtgtggctatttaagctccagtaagcaggggaactttgcaagaacacagactatccattctgcctgaccaatttggcatggggattagcttggcacccactgtttacctgttttgcttctagtatatcagtttggaaacagataaaattggcagtaaatacgtaattccagaatgatgaacactttattaagaggcatccttaaatggagcagaaaactgctgagaatctttgtgagtccaagatgtatttgaattcagtactttgggggatttaccagagtctgtaagtccggaagctataaacgtgaatgttaaacacagcccggtcttctcttctcttgatggcacgcttgctaatctaatttgagtattgttctcttagaaggtgttaagtccaacttcaattggggttgggggaagcacacacacaaatctactattttgcaatttaaatatactcttcaggtaaaatgtggattttgttcaattttgttggcatgtgcaaagattcaaggagtgactgagagaactttggagtgaggtcagggatgggtggttagccaagacttgtaacttccagggagaatgagaagttgtaaaagtcagactggctgtctctctttctctcttcctctttctttctttctttctttccttttgctcacaacaggattacttagtgtttcaaaagtgggagagagcctccttaaatggtttacagccctttgaatgtatttggtgcagtgacatcccctgaaacttcagtctgcaaagtctcaacatggtaactttgttcttttcttttttaaaggcagatgctgcttttagtgtccctttatttattccaggaaaaatgtggacatcagctaggcacgcctagcaaagaaagtggaggctgctggtttctgtgctttaactttccatagattttaaatggataaactgcttgcccttctttcatcagaatatgagctttccccagatggaaagtcttttctaaagcaaagttgcacatgggagctctagcttggaaacaatttgctcttttttccccagtctctgccataaacacttgaatgtgcacacaactgcagagcttaatgccacaacctccaggagattggggggaggggaaagctgcccaggatgggggtgggaaagcgaaggaagatggagaaatggctgcagtttgctgcccatcagcttttctcttttaaggggcagacattgcagacgtagttttaaaaaagttccataaagcatcgccaaggcagcatgcctgtgcgacacacgcagggctttgggggtgtgttttccccgtattaacagcaagtcgttgaagcgttgagaaggtattatgatttctaatcaggcccagaacaggccaagtataggctttctgaatgaaaaaaaaa

SEQ ID NO: 417590 - DNA, 833 bp, Homo sapiens
gtgaccccggggccagaattctcgcaggcgcctgggccgggtgcccggccgtgcgtgagtgcggaacaagtctgggcgcggggaagggcgtgggtgcgggccgtgggtgggtgcggggcagggcgcggggctgtgggagggcgcgaggccgtgtgtgggtgcggggctgggtgcaggccgtgggtgggcgcggggccggggctggcggggcagggcgcaggctgctgcaaggcggcctcgtggattctggccccggacgcacgaagcgggttctactttttaaaaaaactgcgttgccttttccttcctctacgttagcatcctgtccggggtccccggcccatgtggcctttcttccagcgacagtacacttagctcagaacggattgacacccactctgtgtttccaccgggcgcgcaggctctgcaatgcggagcgcgttctctgaaggacaggccccggagtcacggctacagccacagaaagcggaaaccgagctgcagtccagaggggatccccgtacatttccagcgggctcagacacagggtcccccacaagaaagaaacaggacagaaaaagtcaggacacgtatgctgtggagagtcgaggtctcgcctagatcttgggtgtgggtagacgcagccgctggcagttttcctttccagcgtctctggggagcctggagatgtccttggtgccgatgtgacacgaagagtgattgcgccgccctgcagaggcggtggcgggacgctgcgctcgggctgggaaaggccggccccagggcgacccctccggaggcccccggagagcaggtgtgcacctcgcctcccg

SEQ ID NO: 417591 - DNA, 2031 bp, Homo sapiens
cacagttgttgcaaagtgctcagcactaagggagccagcgcacagcacagccaggaaggcgagcgagcccagccagcccagccagcccagccagcccggaggtcatttgattgcccgcctcagaacgatggatctgcatctcttcgactactcagagccagggaacttctcggacatcagctggccatgcaacagcagcgactgcatcgtggtggacacggtgatgtgtcccaacatgcccaacaaaagcgtcctgctctacacgctctccttcatttacattttcatcttcgtcatcggcatgattgccaactccgtggtggtctgggtgaatatccaggccaagaccacaggctatgacacgcactgctacatcttgaacctggccattgccgacctgtgggttgtcctcaccatcccagtctgggtggtcagtctcgtgcagcacaaccagtggcccatgggcgagctcacgtgcaaagtcacacacctcatcttctccatcaacctcttcggcagcattttcttcctcacgtgcatgagcgtggaccgctacctctccatcacctacttcaccaacacccccagcagcaggaagaagatggtacgccgtgtcgtctgcatcctggtgtggctgctggccttctgcgtgtctctgcctgacacctactacctgaagaccgtcacgtctgcgtccaacaatgagacctactgccggtccttctaccccgagcacagcatcaaggagtggctgatcggcatggagctggtctccgttgtcttgggctttgccgttcccttctccattatcgctgtcttctacttcctgctggccagagccatctcggcgtccagtgaccaggagaagcacagcagccggaagatcatcttctcctacgtggtggtcttccttgtctgctggctgccctaccacgtggcggtgctgctggacatcttctccatcctgcactacatccctttcacctgccggctggagcacgccctcttcacggccctgcatgtcacacagtgcctgtcgctggtgcactgctgcgtcaaccctgtcctctacagcttcatcaatcgcaactacaggtacgagctgatgaaggccttcatcttcaagtactcggccaaaacagggctcaccaagctcatcgatgcctccagagtctcagagacggagtactctgccttggagcagagcaccaaatgatctgccctggagaggctctgggacgggtttacttgtttttgaacagggtgatgggccctatggttttctagagcaaagcaaagtagcttcgggtcttgatgcttgagtagagtgaagaggggagcacgtgccccctgcatccattctctctttctcttgatgacgcagctgtcatttggctgtgcgtgctgacagttttgcaacaggcagagctgtgtcgcacagcagtgctgtgcgtcagagccagctgaggacaggcttgcctggacttctgtaagataggattttctgtgtttcctgaattttttatatggtgatttgtatttaaattttaagactttattttctcactattggtgtaccttataaatgtatttgaaagttaaatatattttaaatattgtttgggaggcatagtgctgacatatattcagagtgttgtagttttaaggttagcgtgacttcagttttgactaaggatgacactaattgttagctgttttgaaattatatatatataaatatatataaatatataaatatatgccagtcttggctgaaatgttttatttaccatagttttatatctgtgtggtgttttgtaccggcacgggatatggaacgaaaactgctttgtaatgcagtttgtgacattaatagtattgtaaagttacattttaaaataaacaaaaaactgttctggactgcaaatctgcacacacaacgaacagttgcatttcagagagttctctcaatttgtaagttatttttttttaataaagatttttgtttcctaaaaatgcatcaagtctcag

SEQ ID NO: 417592 - DNA, 2321 bp, Homo sapiens
ggcattggtaaactgtcatggtgctggcaggaatggctaagggtgatgggcagcgagaacaaccagaggcgctttttgtgtctttttctagttttggcctgttctcaatctggtctgggagacgaatcctgctgacctcctacctctgctggcaaaactcgagtggggtctgggaacttgaaggaaggagttttacagcttcagatctgggtatttatccaaaagacttgaaactggggtcctgaggagatacaaacacttctcagttcattaaagcactattcacagtatccaagaagtgaagtgttcaaccactgagtatgatgttggctctaagtattcatatgaggcctacgtcaaattcatacatgtcgaatatcaaattggggaagtcatttgattgcccgcctcagaacgatggatctgcatctcttcgactactcagagccagggaacttctcggacatcagctggccatgcaacagcagcgactgcatcgtggtggacacggtgatgtgtcccaacatgcccaacaaaagcgtcctgctctacacgctctccttcatttacattttcatcttcgtcatcggcatgattgccaactccgtggtggtctgggtgaatatccaggccaagaccacaggctatgacacgcactgctacatcttgaacctggccattgccgacctgtgggttgtcctcaccatcccagtctgggtggtcagtctcgtgcagcacaaccagtggcccatgggcgagctcacgtgcaaagtcacacacctcatcttctccatcaacctcttcggcagcattttcttcctcacgtgcatgagcgtggaccgctacctctccatcacctacttcaccaacacccccagcagcaggaagaagatggtacgccgtgtcgtctgcatcctggtgtggctgctggccttctgcgtgtctctgcctgacacctactacctgaagaccgtcacgtctgcgtccaacaatgagacctactgccggtccttctaccccgagcacagcatcaaggagtggctgatcggcatggagctggtctccgttgtcttgggctttgccgttcccttctccattatcgctgtcttctacttcctgctggccagagccatctcggcgtccagtgaccaggagaagcacagcagccggaagatcatcttctcctacgtggtggtcttccttgtctgctggctgccctaccacgtggcggtgctgctggacatcttctccatcctgcactacatccctttcacctgccggctggagcacgccctcttcacggccctgcatgtcacacagtgcctgtcgctggtgcactgctgcgtcaaccctgtcctctacagcttcatcaatcgcaactacaggtacgagctgatgaaggccttcatcttcaagtactcggccaaaacagggctcaccaagctcatcgatgcctccagagtctcagagacggagtactctgccttggagcagagcaccaaatgatctgccctggagaggctctgggacgggtttacttgtttttgaacagggtgatgggccctatggttttctagagcaaagcaaagtagcttcgggtcttgatgcttgagtagagtgaagaggggagcacgtgccccctgcatccattctctctttctcttgatgacgcagctgtcatttggctgtgcgtgctgacagttttgcaacaggcagagctgtgtcgcacagcagtgctgtgcgtcagagccagctgaggacaggcttgcctggacttctgtaagataggattttctgtgtttcctgaattttttatatggtgatttgtatttaaattttaagactttattttctcactattggtgtaccttataaatgtatttgaaagttaaatatattttaaatattgtttgggaggcatagtgctgacatatattcagagtgttgtagttttaaggttagcgtgacttcagttttgactaaggatgacactaattgttagctgttttgaaattatatatatataaatatatataaatatataaatatatgccagtcttggctgaaatgttttatttaccatagttttatatctgtgtggtgttttgtaccggcacgggatatggaacgaaaactgctttgtaatgcagtttgtgacattaatagtattgtaaagttacattttaaaataaacaaaaaactgttctggactgcaaatctgcacacacaacgaacagttgcatttcagagagttctctcaatttgtaagttatttttttttaataaagatttttgtttcctaaaaatgcatcaagtctcag

SEQ ID NO: 417593 - DNA, 1977 bp, Homo sapiens
cacagttgttgcaaagtgctcagcactaagggagccagcgcacagcacagccaggaaggcgagcgagcccagccagcccagccagcccagccagcccggaggtcatttgattgcccgcctcagaacgatggatctgcatctcttcgactactcagagccagggaacttctcggacatcagctggccatgcaacagcagcgactgcatcgtggtggacacggtgatgtgtcccaacatgcccaacggcatgattgccaactccgtggtggtctgggtgaatatccaggccaagaccacaggctatgacacgcactgctacatcttgaacctggccattgccgacctgtgggttgtcctcaccatcccagtctgggtggtcagtctcgtgcagcacaaccagtggcccatgggcgagctcacgtgcaaagtcacacacctcatcttctccatcaacctcttcggcagcattttcttcctcacgtgcatgagcgtggaccgctacctctccatcacctacttcaccaacacccccagcagcaggaagaagatggtacgccgtgtcgtctgcatcctggtgtggctgctggccttctgcgtgtctctgcctgacacctactacctgaagaccgtcacgtctgcgtccaacaatgagacctactgccggtccttctaccccgagcacagcatcaaggagtggctgatcggcatggagctggtctccgttgtcttgggctttgccgttcccttctccattatcgctgtcttctacttcctgctggccagagccatctcggcgtccagtgaccaggagaagcacagcagccggaagatcatcttctcctacgtggtggtcttccttgtctgctggctgccctaccacgtggcggtgctgctggacatcttctccatcctgcactacatccctttcacctgccggctggagcacgccctcttcacggccctgcatgtcacacagtgcctgtcgctggtgcactgctgcgtcaaccctgtcctctacagcttcatcaatcgcaactacaggtacgagctgatgaaggccttcatcttcaagtactcggccaaaacagggctcaccaagctcatcgatgcctccagagtctcagagacggagtactctgccttggagcagagcaccaaatgatctgccctggagaggctctgggacgggtttacttgtttttgaacagggtgatgggccctatggttttctagagcaaagcaaagtagcttcgggtcttgatgcttgagtagagtgaagaggggagcacgtgccccctgcatccattctctctttctcttgatgacgcagctgtcatttggctgtgcgtgctgacagttttgcaacaggcagagctgtgtcgcacagcagtgctgtgcgtcagagccagctgaggacaggcttgcctggacttctgtaagataggattttctgtgtttcctgaattttttatatggtgatttgtatttaaattttaagactttattttctcactattggtgtaccttataaatgtatttgaaagttaaatatattttaaatattgtttgggaggcatagtgctgacatatattcagagtgttgtagttttaaggttagcgtgacttcagttttgactaaggatgacactaattgttagctgttttgaaattatatatatataaatatatataaatatataaatatatgccagtcttggctgaaatgttttatttaccatagttttatatctgtgtggtgttttgtaccggcacgggatatggaacgaaaactgctttgtaatgcagtttgtgacattaatagtattgtaaagttacattttaaaataaacaaaaaactgttctggactgcaaatctgcacacacaacgaacagttgcatttcagagagttctctcaatttgtaagttatttttttttaataaagatttttgtttcctaaaaatgcatcaagtctcag

SEQ ID NO: 417594 - DNA, 1984 bp, Homo sapiens
gtgaccccggggccagaattctcgcaggcgcctgggccgggtgcccggccgtgcgtcatttgattgcccgcctcagaacgatggatctgcatctcttcgactactcagagccagggaacttctcggacatcagctggccatgcaacagcagcgactgcatcgtggtggacacggtgatgtgtcccaacatgcccaacaaaagcgtcctgctctacacgctctccttcatttacattttcatcttcgtcatcggcatgattgccaactccgtggtggtctgggtgaatatccaggccaagaccacaggctatgacacgcactgctacatcttgaacctggccattgccgacctgtgggttgtcctcaccatcccagtctgggtggtcagtctcgtgcagcacaaccagtggcccatgggcgagctcacgtgcaaagtcacacacctcatcttctccatcaacctcttcggcagcattttcttcctcacgtgcatgagcgtggaccgctacctctccatcacctacttcaccaacacccccagcagcaggaagaagatggtacgccgtgtcgtctgcatcctggtgtggctgctggccttctgcgtgtctctgcctgacacctactacctgaagaccgtcacgtctgcgtccaacaatgagacctactgccggtccttctaccccgagcacagcatcaaggagtggctgatcggcatggagctggtctccgttgtcttgggctttgccgttcccttctccattatcgctgtcttctacttcctgctggccagagccatctcggcgtccagtgaccaggagaagcacagcagccggaagatcatcttctcctacgtggtggtcttccttgtctgctggctgccctaccacgtggcggtgctgctggacatcttctccatcctgcactacatccctttcacctgccggctggagcacgccctcttcacggccctgcatgtcacacagtgcctgtcgctggtgcactgctgcgtcaaccctgtcctctacagcttcatcaatcgcaactacaggtacgagctgatgaaggccttcatcttcaagtactcggccaaaacagggctcaccaagctcatcgatgcctccagagtctcagagacggagtactctgccttggagcagagcaccaaatgatctgccctggagaggctctgggacgggtttacttgtttttgaacagggtgatgggccctatggttttctagagcaaagcaaagtagcttcgggtcttgatgcttgagtagagtgaagaggggagcacgtgccccctgcatccattctctctttctcttgatgacgcagctgtcatttggctgtgcgtgctgacagttttgcaacaggcagagctgtgtcgcacagcagtgctgtgcgtcagagccagctgaggacaggcttgcctggacttctgtaagataggattttctgtgtttcctgaattttttatatggtgatttgtatttaaattttaagactttattttctcactattggtgtaccttataaatgtatttgaaagttaaatatattttaaatattgtttgggaggcatagtgctgacatatattcagagtgttgtagttttaaggttagcgtgacttcagttttgactaaggatgacactaattgttagctgttttgaaattatatatatataaatatatataaatatataaatatatgccagtcttggctgaaatgttttatttaccatagttttatatctgtgtggtgttttgtaccggcacgggatatggaacgaaaactgctttgtaatgcagtttgtgacattaatagtattgtaaagttacattttaaaataaacaaaaaactgttctggactgcaaatctgcacacacaacgaacagttgcatttcagagagttctctcaatttgtaagttatttttttttaataaagatttttgtttcctaaaaatgcatcaagtctcag

SEQ ID NO: 417595 - DNA, 2240 bp, Homo sapiens
tgatttcacacactgggcacagccatgctggcggtgtcttgagaacacagccatgaaaagatggagaaagcaaacacagtttctgtcttggagcaccacatggatttagattcagagtatgatttattttgttttggagagttttattatgaattttttttctcccttctttgcaaagacattacagagctaaacccaaacagctgagcctatcagggccttggaaaagcatttttgcctgaaacttgagtttttcctaatgaagtgactttcctcttccatcttttttgtttgcttggttttctcataggtcatttgattgcccgcctcagaacgatggatctgcatctcttcgactactcagagccagggaacttctcggacatcagctggccatgcaacagcagcgactgcatcgtggtggacacggtgatgtgtcccaacatgcccaacaaaagcgtcctgctctacacgctctccttcatttacattttcatcttcgtcatcggcatgattgccaactccgtggtggtctgggtgaatatccaggccaagaccacaggctatgacacgcactgctacatcttgaacctggccattgccgacctgtgggttgtcctcaccatcccagtctgggtggtcagtctcgtgcagcacaaccagtggcccatgggcgagctcacgtgcaaagtcacacacctcatcttctccatcaacctcttcggcagcattttcttcctcacgtgcatgagcgtggaccgctacctctccatcacctacttcaccaacacccccagcagcaggaagaagatggtacgccgtgtcgtctgcatcctggtgtggctgctggccttctgcgtgtctctgcctgacacctactacctgaagaccgtcacgtctgcgtccaacaatgagacctactgccggtccttctaccccgagcacagcatcaaggagtggctgatcggcatggagctggtctccgttgtcttgggctttgccgttcccttctccattatcgctgtcttctacttcctgctggccagagccatctcggcgtccagtgaccaggagaagcacagcagccggaagatcatcttctcctacgtggtggtcttccttgtctgctggctgccctaccacgtggcggtgctgctggacatcttctccatcctgcactacatccctttcacctgccggctggagcacgccctcttcacggccctgcatgtcacacagtgcctgtcgctggtgcactgctgcgtcaaccctgtcctctacagcttcatcaatcgcaactacaggtacgagctgatgaaggccttcatcttcaagtactcggccaaaacagggctcaccaagctcatcgatgcctccagagtctcagagacggagtactctgccttggagcagagcaccaaatgatctgccctggagaggctctgggacgggtttacttgtttttgaacagggtgatgggccctatggttttctagagcaaagcaaagtagcttcgggtcttgatgcttgagtagagtgaagaggggagcacgtgccccctgcatccattctctctttctcttgatgacgcagctgtcatttggctgtgcgtgctgacagttttgcaacaggcagagctgtgtcgcacagcagtgctgtgcgtcagagccagctgaggacaggcttgcctggacttctgtaagataggattttctgtgtttcctgaattttttatatggtgatttgtatttaaattttaagactttattttctcactattggtgtaccttataaatgtatttgaaagttaaatatattttaaatattgtttgggaggcatagtgctgacatatattcagagtgttgtagttttaaggttagcgtgacttcagttttgactaaggatgacactaattgttagctgttttgaaattatatatatataaatatatataaatatataaatatatgccagtcttggctgaaatgttttatttaccatagttttatatctgtgtggtgttttgtaccggcacgggatatggaacgaaaactgctttgtaatgcagtttgtgacattaatagtattgtaaagttacattttaaaataaacaaaaaactgttctggactgcaaatctgcacacacaacgaacagttgcatttcagagagttctctcaatttgtaagttatttttttttaataaagatttttgtttcctaaaaatgcatcaagtctcag

SEQ ID NO: 417596 - DNA, 4350 bp, Homo sapiens
ggtttgtctttgtgtgtttgttctgaaggttcaagaagacgtggaagctgcgggctctgaaggaaggcaagacaagcatgcatccgccgtactctttggggcagctggtcccggagaggcctcgacccaccccagtgcttgttcctctcatctccccaccggtgtcccccagcagcctggggtctgacaatacctcgagccacaaccgaccagatgccagggacccacggagcccttatgacatcagcaatacagactacttcttccccagatagctggctgggtggcaccagcagcctggaccctgtggatgacaaaacacaaacgggctcagcaaaagatgcttctcactgccatgccagcttatctcaggggtgtgcggcctttggcttcacggaagagccttgcggaaggttctacgccaggggaaaatcagcctgctccagctgttcagctggttgaggtttcaaacctccctttccaaatgcccagcttaaaggggttagagtgaacttgggccactgtgaagagaaccatatcaagactctttggacactcacacggacactcaaaagctgggcaggttggtgggggcctcggtgtggagaagcggctggcagcccacccctcaacacctctgcacaagctgcaccctcaggcaggtgggatggatttccagccaaagcctcctccagccgccatgctcctggcccactgcatcgtttcatcttccaactcaaactcttaaaacccaagtgccttagcaaattctgtttttctaggcctggggacggcttttacttaaaccgccaaggctgggggaagaagctctctcctccctttcttccctacagttgaaaaacagctgagggtgagtgggtgaataatacagtatctcagggcctggtcgttttcaacagaattataattagttcctcattagcattttgctaaatgtgaatgatgatcctaggcatttgctgaatacagaggcaactgcattggctttgggttgcaggacctcaggtgagaagcagaggaaggagaggagaggggcacagggtctctaccatcccctgtagagtgggagctgagtgggggatcacagcctctgaaaaccaatgttctctcttctccacctcccacaaaggagagctagcagcagggagggcttctgccatttctgagatcaaaacggttttactgcagctttgtttgttgtcagctgaacctgggtaactagggaagataatattaaggaagacaatgtgaaaagaaaaatgagcctggcaagaatgcgtttaaacttggtttttaaaaaactgctgactgttttctcttgagagggtggaatatccaatattcgctgtgtcagcatagaagtaacttacttaggtgtgggggaagcaccataactttgtttagcccaaaaccaagtcaagtgaaaaaggaggaagagaaaaaatattttcctgccaggcatggtggcccacgcacttcgggaggtcgaggcaggaggatcacttgagtccagaagtttgagatcagcctgggcaatgtgataaaaccccatctctacaaaaagcataaaaattagccaagtgtggtagagtgtgcctgaagtcccagatacttggggggctgaggtgggaggatctcttgagcctgggaggtcaaggctgcagtgagccgagattgcaccactgcactccagcctgggtgacagagcaagtgagaccctgtctcaaaaaaagaaaaagaaaaagaaaaaatattttccctattagagaagagattgtggtttcattctgtattttgtttttgtcttaaaaagtggaaaaatagcctgcctcttctctactctagggaaaaaccagcgtgtgactactcccccaggtggttatggagagggtgtccggtccctgtcccagtgccgagaaggaagcctcccacgactgcccggcagggtcctagaaattccccaccctgaaagccctgagctttctgctatcaaagaggttttaaaaaaatcccatttaaaaaaaatcccttacctcggtgccttcctctttttatttagttccttgagttgattcagctctgcaagaattgaagcaggactaaatgtctagttgtaacaccatgattaaccacttcagctgacttttctgtccgagctttgaaaattcagtggtgttagtggttacccagttagctctcaagttatcagggtattccagagtggggatatgatttaaatcagccgtgtaaccatggacccaaaatttaccagaccacaaaacttttctaatactctaccctcttagaaaaaccaccaccatcaccagacaggtgcgaaaggatgaaagtgaccatgttttgtttacggttttccaggtttaagctgttactgtcttcagtaagccgtgattttcattgctgggcttgtctgtagattttagaccctattgctgcttgaggcaactcatcttaggttggcaaaaaggcaggatggccgggcgcggtggctcacgcctgtaatcctagcactttgggaggccaaggtgggaggattgcttgagctcaggagtttgagaccaacctgggtaacatagtgagacaccatctctattatgaacaataacagttaagaaaaaaaaaggcaggcaggcggttatggtggttccctcccatcccaccacataaagtttctgagacttgagaacagcaaaatgctgttaaagggaaatattaagaatgagaatctgcagtaagggtgattctgtgcccacagttcttcaattctttataccgttttacccacatgtggtgttaccaaagccgggcagaaccatgctagcggaagatgtgaaatccagatagctcattattgccaagagctaggcagctttgatctccaaattgttattgctttcatttttattgtaatggaattgctttgttttgtttttttgtttttgtattgaagagggttgttttccctttatttttcataagctaatgtaaatgaagaaaaaatgtcttctctgggctgtaggcctggctcagcgtacacaggtatacatcctaagctctctatgttctctaatctgtggtgactgaacatgtgtctcaatgcacggggcatttctacctgtgtttctgcagcacccccactgccttgagtccccagcagtgctgttatttgcctaacacctgtagccatctgccacgcagccagacgtgaaacgctgagacagagaccatttaggttaaatacgacagcttatcctgctgggtggggaaagtaaaaaatatgctggttcaaggcctaaagtaaaatgatcaataatgtttgtagcattaatgaaatattttcaagaaatgtgtccaggggtagcactggctatgttgacgaggcctttggtaactcagagagctcttggccctgatggggacttgcccttacgctttctttatcaggctctgagttcacacggagcctctggcacttccctgctgtcttgggagaaaggaaactggttgccgcggcaggttgtggaatctgttgctggaaccaggctggaagcccacctggtagtgaacagggcccagtggggcaggctgggcatgttgtggtctatgggtttgtttcctggagaatgttcaggaattgtcttcccagctgctttggtgctgagctctattatctcacagcacgtccagaaggctaacccaggtggggaggatgctgacaccagctccaggtggagttggtggtcttaatttggagatgcaggggcaacctgtgaccctttgaggcaagagccctgcacccagctgtcccgtgcagccgtgggcaggggctgcacacggaggggcaggcgggccagttcagggtccgtgccaggccctcctcagtgccctgtgaaggcctcctgtcctccgtgcggctgggcaccagcaccagggagtttctatggcaaccttagtgattattaaggaacactgtcagttttatgaacatatgctcaaatgaaattctactttaggaggaaaggattggaacagcatgtcacaaggctgttaattaacagagagaccttattggatggagatcacatctgttaaatagaatacctcaactctacgttgttttcttggagataaataatagtttcaagtttttgtttgtttgttttacctaattacctgaaagcaaataccaaaggctgatgtctgtatatggggcaaagggtcagtatatttttcagtgttttttttctaccagctattttgcatttaaagtgaacattgtgtttggaataaatactcttaaaaaataaaatt

SEQ ID NO: 417597 - DNA, 387 bp, Homo sapiens
ttttattggcaatctggtgtttttgtttgctttttttctgaatgagaaacaaaagaaatgaagagctagccatgtgttctctactctgtctcagtttgtatggctacttttccatccagagctcttgccttttggttctcaatttggttgcattcccatgaagaaaacctagtgtggcaggcagaaggatggcctcccacagatgtccacatcctgatccccagaacctctgactatgacactgtctgtggccagggaatcaagattgccaaacagctgacattaaaatagggaggtgattatagaactattcatgtggccaaaagtaaccacagaggcacttgtaagtggaagagggaggcagaacagactgtccgagctacgact

SEQ ID NO: 417598 - DNA, 374 bp, Homo sapiens
tgattaaaataatagagtttagtaatatggatgaatataagataaatatttaaaaagcagttgtatttttatagcccagcaagataaagttcaaatatgtattttttataaagatggatttacaataacatcaaaaattaaaatgcaccttgaaataataaagacatgtaaacccttttatgaagacagattttttaaagcatttttaaaaattctttttcattgacaaataattatccatatttatggggtacacagtaatgtttcaatacatataataaatagtgatcagatcagaataatcagcttatccatcatttcaaacacttatcatttctttgtgttaggaacattcaacatcctgcttctagcta

SEQ ID NO: 417599 - DNA, 522 bp, Homo sapiens
aatttccatggctaactagatttaaccagaatcccgccttccaggctcctgttcccttttattagctgctgaattttattcccttttcccaactccaggtccctcagttgtcttatatctaaatcctttgccaggtccccacaatcccagcacctgcctctgtgagctgcccccaggccctcaccttggccctggccagcctcctgtgctcctgctgtctgaaggactggcccctcccccactgctgaagccacacgtacagatcctaagcaacagggccttttgctgggacgtatgcctggattatggccaaccgggaagagagagatgtatcttaaaaagtggaggtggacttctcctacagctctgacggtaacttaaattgttgccagcttgaggcaagacaagggaatcatctagttaggggtaaccattaatttattttataaagaaaggaaatgctgaaagtcgtattagtactgagtttagttggagaatttagataagtaagtatcttttagg

SEQ ID NO: 417600 - DNA, 716 bp, Homo sapiens
  misc_feature (630)..(630): n is a, c, g, or t
  misc_feature (662)..(662): n is a, c, g, or t
  misc_feature (689)..(689): n is a, c, g, or t
tgtaaccagctgggagtcagcctgcaggacgctgtgagttggcgtgctagtgggatggcagatgaggaagaagaccccacgtttgaggaagaaaatgaagaaattggaggaggtgcagaaggtggacagggtaaaagaaagagacttttttctaaagaattgcgatgtatgatgtatggctttggggatgaccagaatccttatactgagtcagtggatattcttgaagatcttgtcatagagtttatcactgaaatgactcacaaggcaatgtcaattggaagacaaggtcgagtacaagttgaagatatcgtcttcttgattcgaaaggacccaaggaagtttgccagggttaaagacttgcttactatgaatgaagaattgaaacgagctagaaaagcatttgatgaagcaaattatggatcttgacactttttgtagtttccgaaaattaccatctggggaaaccatatataataattgtatattttctaaagtaagattctgatatctagccatgtaaatgaaagatggagaaacacaaagttttcagcctttatttttatgcctttgattttagggtgatattggtgcactccagcctgggcaatagagtgtgactctcaaaanaacaaagataatgaactggttggcatttcttntaaagagatgatagaggaaaatatagntttttggtaagaatggttatctctctt

SEQ ID NO: 417601 - DNA, 957 bp, Homo sapiens
  misc_feature (796)..(796): n is a, c, g, or t
  misc_feature (798)..(799): n is a, c, g, or t
  misc_feature (878)..(878): n is a, c, g, or t
  misc_feature (882)..(882): n is a, c, g, or t
  misc_feature (890)..(891): n is a, c, g, or t
  misc_feature (905)..(905): n is a, c, g, or t
  misc_feature (917)..(917): n is a, c, g, or t
  misc_feature (919)..(919): n is a, c, g, or t
  misc_feature (923)..(923): n is a, c, g, or t
tgtaaccagctgggagtcagcctgcaggacgctgtgagttggcgtgctagtgggatggcagatgaggaagaagaccccacgtttgaggaagaaaatgaagaaattggaggaggtgcagaaggtggacagggtaaaagaaagagacttttttctaaagaattgcgatgtatgatgtatggctttggggatgaccagaatccttatactgagtcagtggatattcttgaagatcttgtcatagagtttatcactgaaatgactcacaaggcaatgtcaattggaagacaaggtcgagtacaagttgaagatatcgtcttcttgattcgaaaggacccaaggaagtttgccagggttaaagacttgcttactatgaatgaagaattgaaacgagctagaaaagcatttgatgaagcaaattatggatcttgacactttttgtagtttccgaaaattaccatctggggaaaccatatataataattgtatattttctaaagtaagattctgatatctagccatgtaaatgaaagatggagaaacacaaagttttcagcctttatttttatgcctttgattttagggtgatattggtgcatgtaattgcctgcctttatattaccatacttgaattacttactgggttttaatgaccacacataagtcaaagtaccttgcaaaccatgccgttgttctgacttttgactatttaaaggataaagtagtatttaatgtgttaggtatgtttatgcccttgtaagctatactgtagctttttttttttttttttttgagatgnannctcactccagcctgggcgacagagcgagactccgtctcaaaaaaaaaaaagaaagcaagtttcacatgaataatgtgtntggnaaggcttnngattaaaatctttnggattataacancnggtnaagtttaggagaaccgtttcccagagagatcaag

SEQ ID NO: 417602 - DNA, 1329 bp, Homo sapiens
gggtcattaaaacccagtaagtaattcaagtatggtaatataaagacttgcttactatgaatgaagaattgaaacgagctagaaaagcatttgatgaagcaaattatggatcttgacactttttgtagtttccgaaaattaccatctggggaaaccatatataataattgtatattttctaaagtaagattctgatatctagccatgtaaatgaaagatggagaaacacaaagttttcagcctttatttttatgcctttgattttagggtgatattggtgcatgtaattgcctgcctttatattaccatacttgaattacttactgggttttaatgaccacacataagtcaaagtaccttgcaaaccatgccgttgttctgacttttgactatttaaaggataaagtagtatttaatgtgttaggtatgtttatgcccttgtaagctatactgtagctttttttttttttttttttgggaaaggggtctccattggcccccaagcgggggaaaagggggggcttttaaaaaacaaaagatatctggacagtgtgtgggattctttttaaaaggaggttggttagagggacacatattgcgtttgggaacaagtgtaaatctcttaaaagagatactccttaaattgttgagagaataacagggtatcatatctttaaaaaaacgaatacaaggggcagggaggacgggaccacagcccggtaaacaacgcaacttgggacgcccacagggggcgaacgaggaggcaggaaagaaacctcgtggaacggggaacccggtccattaaaataaaaatagcggcgggggagaggcccgtatcccaactgggggtgagcaacaggtaccgtagcgactaaagagaaacgcactctgcctgggaagaggcaaaaaaagccctatcacgtggggacactatctctcttccctctctctccccatgtagtcgatttattctttgttccccgaacgaacgacactcatactaaaccactcgcagacaagctaaagtaacaggagaaagaagaggaaagaagagaagcagagaaaggagaaaggggaagaaagagaaaaagaagagaggaaaagaagaaaagggaggaggcaggggagagacaaaaaaggagaaagaggagaaagaacgagcagggagaaaaagagaaagaacggaagactaaagaagaggaggaacgagcagagaagaaggagagagggaacgggaggagaggaagggaaagaaaggaagaaagaaaaaagagaagagaaggaaagagagagagagagagaaaaaagagagaaaggaaagacgagaga

SEQ ID NO: 417603 - DNA, 685 bp, Homo sapiens
  misc_feature (524)..(524): n is a, c, g, or t
  misc_feature (526)..(527): n is a, c, g, or t
  misc_feature (606)..(606): n is a, c, g, or t
  misc_feature (610)..(610): n is a, c, g, or t
  misc_feature (618)..(619): n is a, c, g, or t
  misc_feature (633)..(633): n is a, c, g, or t
  misc_feature (645)..(645): n is a, c, g, or t
  misc_feature (647)..(647): n is a, c, g, or t
  misc_feature (651)..(651): n is a, c, g, or t
tgtaaccagctgggagtcagcctgcaggacgctgtgagttggcgtgctagtgggatggcagatgaggaagaagaccccacgtttgaggaagaaaatgaagaaattggaggaggtgcagaaggtggacagggtaaaagaaagagacttttttctaaagaattgcgatgtatgatgtatggctttggggatgaccagaatccttatactgagtcagtggatattcttgaagatcttgtcatagagtttatcactgaaatgactcacaaggcaatgtcaattggaagacaaggtcgagtacaagttgaagatatcgtcttcttgattcgaaaggacccaaggaagtttgccagggttaaagacttgcttactatgaatgaagaattgaaacgagctagaaaagcatttgatgaagcaaattatggatcttgacactttttgtagtttccgaaaattaccatctggggaaaccatatataataattgtatattttctaaagtaagattctgatatctagccgagatgnannctcactccagcctgggcgacagagcgagactccgtctcaaaaaaaaaaaagaaagcaagtttcacatgaataatgtgtntggnaaggcttnngattaaaatctttnggattataacancnggtnaagtttaggagaaccgtttcccagagagatcaag

SEQ ID NO: 417604 - DNA, 1642 bp, Homo sapiens
tgtaaccagctgggagtcagcctgcaggacgctgtgagttggcgtgctagtgggatggcagatgaggaagaagaccccacgtttgaggaagaaaatgaagaaattggaggaggtgcagaaggtggacagggtaaaagaaagagacttttttctaaagaattgcgatgtatgatgtatggctttggggatgaccagaatccttatactgagtcagtggatattcttgaagatcttgtcatagagtttatcactgaaatgactcacaaggcaatgtcaattggaagacaaggtcgagtacaagttgaagatatcgtcttcttgattcgaaaggacccaaggaagtttgccagggttaaagacttgcttactatgaatgaagaattgaaacgagctagaaaagcatttgatgaagcaaattatggatcttgacactttttgtagtttccgaaaattaccatctggggaaaccatatataataattgtatattttctaaagtaagattctgatatctagccatgtaaatgaaagatggagaaacacaaagttttcagcctttatttttatgcctttgattttagggtgatattggtgcatgtaattgcctgcctttatattaccatacttgaattacttactgggttttaatgaccacacataagtcaaagtaccttgcaaaccatgccgttgttctgacttttgactatttaaaggataaagtagtatttaatgtgttaggtatgtttatgcccttgtaagctatactgtagctttttttttttttttttttgggaaaggggtctccattggcccccaagcgggggaaaagggggggcttttaaaaaacaaaagatatctggacagtgtgtgggattctttttaaaaggaggttggttagagggacacatattgcgtttgggaacaagtgtaaatctcttaaaagagatactccttaaattgttgagagaataacagggtatcatatctttaaaaaaacgaatacaaggggcagggaggacgggaccacagcccggtaaacaacgcaacttgggacgcccacagggggcgaacgaggaggcaggaaagaaacctcgtggaacggggaacccggtccattaaaataaaaatagcggcgggggagaggcccgtatcccaactgggggtgagcaacaggtaccgtagcgactaaagagaaacgcactctgcctgggaagaggcaaaaaaagccctatcacgtggggacactatctctcttccctctctctccccatgtagtcgatttattctttgttccccgaacgaacgacactcatactaaaccactcgcagacaagctaaagtaacaggagaaagaagaggaaagaagagaagcagagaaaggagaaaggggaagaaagagaaaaagaagagaggaaaagaagaaaagggaggaggcaggggagagacaaaaaaggagaaagaggagaaagaacgagcagggagaaaaagagaaagaacggaagactaaagaagaggaggaacgagcagagaagaaggagagagggaacgggaggagaggaagggaaagaaaggaagaaagaaaaaagagaagagaaggaaagagagagagagagagaaaaaagagagaaaggaaagacgagaga

SEQ ID NO: 417605 - DNA, 1671 bp, Homo sapiens
cacccctgctacacaccgcctccatacctttgaccggcctatggctgtactcggattgcattctcagcctccacttcaagcctgcgttccctggggaggtcattcaaccctagatccaccatatgtcatgcccaaccaatctcagttactttgcgagttcacctccatcctgagtggacgctcaagcaagactgctggagctgcagatctgggaggttcgctgcaccaccttgatgctcagtatgtacttttgaaaatataccggattgttgagatttgagaaaatctcataaagctgctgaaaagaactggccagagccgtgtgatttgagaggcggctgacgtaaggttagtgcgcggcccaggatgcccgcctggcccggggtgaatggcgctgtcgtcgcggtggtcgcgtaggcttcgcgccaggtctcgccccggatttaccctgcgaccccggccctccgcgcgcgccgcagccgccctcggttgctattggttgctcgtcctgtttgtcggcgcttctcgaagaagggggcgaagacgtgattgaatgtgtcggtgctcattagttcttctgtcagtcgatcacgaggtgccgttttcttcatttttcattggctggcggactgaggggcgggcttggcgcgccggtcgcccagacatggcggacggcagcggctggcagccgccgcgcccctgcgaggcctaccgcgccgagtggaagctctgccgcagcgccaggcacttcctacaccactactacgtccacggcgagcggccggcctgcgaacagtggcagcgcgacctggccagctgccgcgactgggaggagcgccggaacgccgaggcccaggtgctaagtgtggtggctcacacctgtaatctcagctacttgggaggctgaggcagaagaatcacttgaggataggagtttgaggttgcagtcagctatgatcgtgccactgcactccagcctgggcaacagagcaagaccccatctctaaataaatgttttaaaaataaaaataaatgttttggataaaaccccatattaataataagtattttacattattatctggcatagactgttatatatagcatattattgttgaaatacaaaacaatatgtatccgtactgtatgtgatatagtgccattttcagtaactgctgtacacacagcaactcagatgaaactcaaggaaattcttcagagcaaaaacagccaatcttgaaaacatacatgtagcaggattccatttatgtaacattggtgaaataatgtaattatagagatggaaaacagattaaaggttaccaggggtttaggttagggatggtgagggggtggttcatacgagggagtcctgtggtgttgaaaaccatctgtcagcctgactggtggttacacagggctatacatgaagttaaaattgtgtagagttaggtacacaaaggagtacagatgtaactggggaaactgagtatgttctgtagactgtaccaatgtcaatttctgcgtcctgatgctgtgctgtagtgtataaggtgttaacattgggggaggctggggcaagggtacccaggacctccctagacaacctcctatgcaacctcctgtgaatctataattacttcaaaataaaaagttgaaaacaaaaaaaag

SEQ ID NO: 417606 - DNA, 1070 bp, Homo sapiens
gccacttataatctcttaggcatagtaataactaatacattttttattgtgtttgatctaattcataaaatattttagggaagaccagaacatataaaaaacatttttacaggaattcctggttgtttcatgaaagggccgtatattcaaagtgacctccaaatacagaaggagctgagaaactaaagaatgaaggagacaaatccagcttgtcagcaaaaggtgatttattagggaacttacggacagaagcatggtcttggacagcagcaagacaggtaaatctctgtgctgttaccctcccagactaaggtggttttgacctaagggcaggtaggtaagtatgtgctctgatacaatttgggtgttgtcctctctaaatctcatgttgaattgtgatctctaaataaatgttttaaaaataaaaataaatgttttggataaaaccccatattaataataagtattttacattattatctggcatagactgttatatatagcatattattgttgaaatacaaaacaatatgtatccgtactgtatgtgatatagtgccattttcagtaactgctgtacacacagcaactcagatgaaactcaaggaaattcttcagagcaaaaacagccaatcttgaaaacatacatgtagcaggattccatttatgtaacattggtgaaataatgtaattatagagatggaaaacagattaaaggttaccaggggtttaggttagggatggtgagggggtggttcatacgagggagtcctgtggtgttgaaaaccatctgtcagcctgactggtggttacacagggctatacatgaagttaaaattgtgtagagttaggtacacaaaggagtacagatgtaactggggaaactgagtatgttctgtagactgtaccaatgtcaatttctgcgtcctgatgctgtgctgtagtgtataaggtgttaacattgggggaggctggggcaagggtacccaggacctccctagacaacctcctatgcaacctcctgtgaatctataattacttcaaaataaaaagttgaaaacaaaaaaaag

SEQ ID NO: 417607 - DNA, 865 bp, Homo sapiens
agaaaacaaatactgtaataagagcaatatctttcaaactttttggacaggtgctaagtgtggtggctcacacctgtaatctcagctacttgggaggctgaggcagaagaatcacttgaggataggagtttgaggttgcagtcagctatgatcgtgccactgcactccagcctgggcaacagagcaagaccccatctctaaataaatgttttaaaaataaaaataaatgttttggataaaaccccatattaataataagtattttacattattatctggcatagactgttatatatagcatattattgttgaaatacaaaacaatatgtatccgtactgtatgtgatatagtgccattttcagtaactgctgtacacacagcaactcagatgaaactcaaggaaattcttcagagcaaaaacagccaatcttgaaaacatacatgtagcaggattccatttatgtaacattggtgaaataatgtaattatagagatggaaaacagattaaaggttaccaggggtttaggttagggatggtgagggggtggttcatacgagggagtcctgtggtgttgaaaaccatctgtcagcctgactggtggttacacagggctatacatgaagttaaaattgtgtagagttaggtacacaaaggagtacagatgtaactggggaaactgagtatgttctgtagactgtaccaatgtcaatttctgcgtcctgatgctgtgctgtagtgtataaggtgttaacattgggggaggctggggcaagggtacccaggacctccctagacaacctcctatgcaacctcctgtgaatctataattacttcaaaataaaaagttgaaaacaaaaaaaag

SEQ ID NO: 417608 - DNA, 2469 bp, Homo sapiens
cacccctgctacacaccgcctccatacctttgaccggcctatggctgtactcggattgcattctcagcctccacttcaagcctgcgttccctggggaggtcattcaaccctagatccaccatatgtcatgcccaaccaatctcagttactttgcgagttcacctccatcctgagtggacgctcaagcaagactgctggagctgcagatctgggaggttcgctgcaccaccttgatgctcagtatgtacttttgaaaatataccggattgttgagatttgagaaaatctcataaagctgctgaaaagaactggccagagccgtgtgatttgagaggcggctgacgtaaggttagtgcgcggcccaggatgcccgcctggcccggggtgaatggcgctgtcgtcgcggtggtcgcgtaggcttcgcgccaggtctcgccccggatttaccctgcgaccccggccctccgcgcgcgccgcagccgccctcggttgctattggttgctcgtcctgtttgtcggcgcttctcgaagaagggggcgaagacgtgattgaatgtgtcggtgctcattagttcttctgtcagtcgatcacgaggtgccgttttcttcatttttcattggctggcggactgaggggcgggcttggcgcgccggtcgcccagacatggcggacggcagcggctggcagccgccgcgcccctgcgaggcctaccgcgccgagtggaagctctgccgcagcgccaggcacttcctacaccactactacgtccacggcgagcggccggcctgcgaacagtggcagcgcgacctggccagctgccgcgactgggaggagcgccggaacgccgaggcccagcaatccctctgtgagagcgagcgggcacgagtccgggctgcacggaagcacatcctggtgtgggccccgaggcagagcccccctccagactggcatctccctctgccacaggagaaggacgagtgacaagcatccctgccattggcctgtgcagcttcctcagtctgtttcaagttgctgttgcacagccctggggactgtgaccagcctacacagtctggtgggtccctgtgagctcttgctcacaggaacatggagcaggacattgctagccctacttgcccacccctcacctgcatgcaggataccctgacactgcgatgttctgcaggacaattgcaccgctttagagcttccaggaggccaagcattatggcaggtacttgtgagcagccaggtcaggctgggcatggtagcataggagatggtggtcctgaggtctaggcttctcaggtaaactgaagggtagccctgacctgtgtggacacacaggtgggtcataatgaggtagctaaacggttgtgccactgtgaatgtctttcctagtccttgggaaactgcctgccacgtcccaggtttggtgagcattgtgagtgctcacactctgctccactcgctcagttccactgcacatgcaggcaggtgtgccgagcaggtagggcttgctggcccctctgcaccagcaggcttcacttcttaggctcccaggtcggcccctggagactctggtttttaagaaatgcacacagctacagaacacacaaccttgcataaagagggtttgtggactcagctgaagaaatccaagtccaagacatatggaattaagcactccttccctcaaaatttcccctggtggttaatgtatcaaaagccatttcatctgatttcaaatagaagctgaaaattaagttcacacttgttagattttgtgtgtaacagtgttgtacctggacagtattagaaatttgtatgcttattctcttgttaagtgttttaaaatgtatgaaccaccaaaaacactatttcttgaagaggtctgtttattactaatagaatggtttctcatcctatggtggccctgttgtgtgatgctgagggctaggctgggtctgtgcccagcaccctccctgctctcttcctggacacaggcagcaagttgaatatcttttaatttgttctttggggcagaataatctatcacgttagaagggtgtccattaaagaacagtatttccctgcttgagtgtgttttctcctgtgctccctaagagcccctgtgtctgtgaacagtgggggtgggggtgggggttgtgctcacgggatcccaagagcaggagcatctaaagaggagccagcgttcccccatcatcaggggagtactgatgtgtctaaggcaaccagggtgcctccagcatggctgtggctggtttaataatgagcatttccacccagtgagggaagagaggaagactgctagagatctacaaggtttttcttactcttaaacacagggacggggcatctgaatttgcagtctgctgtaatcccagcactttgggaggccaaggtgggtggatcacttgaggtctggagtttgagaccagcctggc

SEQ ID NO: 417609 - DNA, 1535 bp, Homo sapiens
cacccctgctacacaccgcctccatacctttgaccggcctatggctgtactcggattgcattctcagcctccacttcaagcctgcgttccctggggaggtcattcaaccctagatccaccatatgtcatgcccaaccaatctcagttactttgcgagttcacctccatcctgagtggacgctcaagcaagactgctggagctgcagatctgggaggttcgctgcaccaccttgatgctcagtatgtacttttgaaaatataccggattgttgagatttgagaaaatctcataaagctgctgaaaagaactggccagagccgtgtgatttgagaggcggctgacgtaaggttagtgcgcggcccaggatgcccgcctggcccggggtgaatggcgctgtcgtcgcggtggtcgcgtaggcttcgcgccaggtctcgccccggatttaccctgcgaccccggccctccgcgcgcgccgcagccgccctcggttgctattggttgctcgtcctgtttgtcggcgcttctcgaagaagggggcgaagacgtgattgaatgtgtcggtgctcattagttcttctgtcagtcgatcacgaggtgccgttttcttcatttttcattggctggcggactgaggggcgggcttggcgcgccggtcgcccagacatggcggacggcagcggctggcagccgccgcgcccctgcgaggcctaccgcgccgagtggaagctctgccgcagcgccaggcacttcctacaccactactacgtccacggcgagcggccggcctgcgaacagtggcagcgcgacctggccagctgccgcgactgggaggagcgccggaacgccgaggcccaggtgctaagtgtggtggctcacacctgtaatctcagctacttgggaggctgaggcagaagaatcacttgaggataggagtttgaggttgcagtcagctatgatcgtgccactgcactccagcctgggcaacagagcaagaccccatctctaaataaatgttttaaaaataaaaataaatgttttggataaaaccccatattaataataagtattttacattattatctggcatagactgttatatatagcatattattgttgaaatacaaaacaatatgtatccgtactgtatgtgatatagtgccattttcagtaactgctgtacacacagcaactcagatgaaactcaaggaaattcttcagagcaaaaacagccaatcttgaaaacatacatgtagcaggattccatttatgtaacattggtgaaataatgtaattatagagatggaaaacagattaaaggttaccaggggtttaggttagggatggtgagggggtcccaagctgattcccgcactgaaagccctgtctgctggcgacattgacgagatggaggagcgcatggaaaaacggtagctgcctcaggtgctggccgacctactgttcagggaacttgcaagcggcctgtacgatggggagccttaacagaagcaggcccactcagaggagccccaggccc

SEQ ID NO: 417610 - DNA, 1790 bp, Homo sapiens
cacccctgctacacaccgcctccatacctttgaccggcctatggctgtactcggattgcattctcagcctccacttcaagcctgcgttccctggggaggtcattcaaccctagatccaccatatgtcatgcccaaccaatctcagttactttgcgagttcacctccatcctgagtggacgctcaagcaagactgctggagctgcagatctgggaggttcgctgcaccaccttgatgctcagtatgtacttttgaaaatataccggattgttgagatttgagaaaatctcataaagctgctgaaaagaactggccagagccgtgtgatttgagaggcggctgacgtaaggttagtgcgcggcccaggatgcccgcctggcccggggtgaatggcgctgtcgtcgcggtggtcgcgtaggcttcgcgccaggtctcgccccggatttaccctgcgaccccggccctccgcgcgcgccgcagccgccctcggttgctattggttgctcgtcctgtttgtcggcgcttctcgaagaagggggcgaagacgtgattgaatgtgtcggtgctcattagttcttctgtcagtcgatcacgaggtgccgttttcttcatttttcattggctggcggactgaggggcgggcttggcgcgccggtcgcccagacatggcggacggcagcggctggcaggtgagtgtgctgggtcggagccgggaaccaccggggtcttccggagggagggaacgggactggctcggggcgtagggcgcggccgccgggccccgctcaggcgccgcctctcgccgcagccgccgcgcccctgcgaggcctaccgcgccgagtggaagctctgccgcagcgccaggcacttcctacaccactactacgtccacggcgagcggccggcctgcgaacagtggcagcgcgacctggccagctgccgcgactgggaggagcgccggaacgccgaggcccaggtgctaagtgtggtggctcacacctgtaatctcagctacttgggaggctgaggcagaagaatcacttgaggataggagtttgaggttgcagtcagctatgatcgtgccactgcactccagcctgggcaacagagcaagaccccatctctaaataaatgttttaaaaataaaaataaatgttttggataaaaccccatattaataataagtattttacattattatctggcatagactgttatatatagcatattattgttgaaatacaaaacaatatgtatccgtactgtatgtgatatagtgccattttcagtaactgctgtacacacagcaactcagatgaaactcaaggaaattcttcagagcaaaaacagccaatcttgaaaacatacatgtagcaggattccatttatgtaacattggtgaaataatgtaattatagagatggaaaacagattaaaggttaccaggggtttaggttagggatggtgagggggtggttcatacgagggagtcctgtggtgttgaaaaccatctgtcagcctgactggtggttacacagggctatacatgaagttaaaattgtgtagagttaggtacacaaaggagtacagatgtaactggggaaactgagtatgttctgtagactgtaccaatgtcaatttctgcgtcctgatgctgtgctgtagtgtataaggtgttaacattgggggaggctggggcaagggtacccaggacctccctagacaacctcctatgcaacctcctgtgaatctataattacttcaaaataaaaagttgaaaacaaaaaaaag

SEQ ID NO: 417611 - DNA, 2588 bp, Homo sapiens
cacccctgctacacaccgcctccatacctttgaccggcctatggctgtactcggattgcattctcagcctccacttcaagcctgcgttccctggggaggtcattcaaccctagatccaccatatgtcatgcccaaccaatctcagttactttgcgagttcacctccatcctgagtggacgctcaagcaagactgctggagctgcagatctgggaggttcgctgcaccaccttgatgctcagtatgtacttttgaaaatataccggattgttgagatttgagaaaatctcataaagctgctgaaaagaactggccagagccgtgtgatttgagaggcggctgacgtaaggttagtgcgcggcccaggatgcccgcctggcccggggtgaatggcgctgtcgtcgcggtggtcgcgtaggcttcgcgccaggtctcgccccggatttaccctgcgaccccggccctccgcgcgcgccgcagccgccctcggttgctattggttgctcgtcctgtttgtcggcgcttctcgaagaagggggcgaagacgtgattgaatgtgtcggtgctcattagttcttctgtcagtcgatcacgaggtgccgttttcttcatttttcattggctggcggactgaggggcgggcttggcgcgccggtcgcccagacatggcggacggcagcggctggcaggtgagtgtgctgggtcggagccgggaaccaccggggtcttccggagggagggaacgggactggctcggggcgtagggcgcggccgccgggccccgctcaggcgccgcctctcgccgcagccgccgcgcccctgcgaggcctaccgcgccgagtggaagctctgccgcagcgccaggcacttcctacaccactactacgtccacggcgagcggccggcctgcgaacagtggcagcgcgacctggccagctgccgcgactgggaggagcgccggaacgccgaggcccagcaatccctctgtgagagcgagcgggcacgagtccgggctgcacggaagcacatcctggtgtgggccccgaggcagagcccccctccagactggcatctccctctgccacaggagaaggacgagtgacaagcatccctgccattggcctgtgcagcttcctcagtctgtttcaagttgctgttgcacagccctggggactgtgaccagcctacacagtctggtgggtccctgtgagctcttgctcacaggaacatggagcaggacattgctagccctacttgcccacccctcacctgcatgcaggataccctgacactgcgatgttctgcaggacaattgcaccgctttagagcttccaggaggccaagcattatggcaggtacttgtgagcagccaggtcaggctgggcatggtagcataggagatggtggtcctgaggtctaggcttctcaggtaaactgaagggtagccctgacctgtgtggacacacaggtgggtcataatgaggtagctaaacggttgtgccactgtgaatgtctttcctagtccttgggaaactgcctgccacgtcccaggtttggtgagcattgtgagtgctcacactctgctccactcgctcagttccactgcacatgcaggcaggtgtgccgagcaggtagggcttgctggcccctctgcaccagcaggcttcacttcttaggctcccaggtcggcccctggagactctggtttttaagaaatgcacacagctacagaacacacaaccttgcataaagagggtttgtggactcagctgaagaaatccaagtccaagacatatggaattaagcactccttccctcaaaatttcccctggtggttaatgtatcaaaagccatttcatctgatttcaaatagaagctgaaaattaagttcacacttgttagattttgtgtgtaacagtgttgtacctggacagtattagaaatttgtatgcttattctcttgttaagtgttttaaaatgtatgaaccaccaaaaacactatttcttgaagaggtctgtttattactaatagaatggtttctcatcctatggtggccctgttgtgtgatgctgagggctaggctgggtctgtgcccagcaccctccctgctctcttcctggacacaggcagcaagttgaatatcttttaatttgttctttggggcagaataatctatcacgttagaagggtgtccattaaagaacagtatttccctgcttgagtgtgttttctcctgtgctccctaagagcccctgtgtctgtgaacagtgggggtgggggtgggggttgtgctcacgggatcccaagagcaggagcatctaaagaggagccagcgttcccccatcatcaggggagtactgatgtgtctaaggcaaccagggtgcctccagcatggctgtggctggtttaataatgagcatttccacccagtgagggaagagaggaagactgctagagatctacaaggtttttcttactcttaaacacagggacggggcatctgaatttgcagtctgctgtaatcccagcactttgggaggccaaggtgggtggatcacttgaggtctggagtttgagaccagcctggc

SEQ ID NO: 417612 - DNA, 756 bp, Homo sapiens
gttattctggagacgactctcttaatcctccaccggtacaagaaggaacaagctataaatcgggctggaattgttcaagaggatgtgcagccaccagggttaaaagtgtggtctgatccatttggcaggaaatgagagggctgtcatcagctctgattaagaaaggagatttcttcatgctttcgattctgcatggggtacagccagtcacctcaccagagaatgacggctggagaagaaaactctgtaataccataaataagagtgcttgtaataaaagactgtgcacaaggattaatatttcccttcttaagtatcaaaagaactctggaacaaattataccattaggaaggttttcatgattcagttgattttccaaaaatgaagctatctcacccagctgggtttggaggagcaatctgcttattattctgtcgttaccacttactcaagcgagctgtgatatgaatacaagcaaccagtgggctcgggaaggtccgggtctcttctgccatcttccagataagagatttcagtaaaaaactgccatgctgagctgccttatagagctcttcgaaaatgttcgagttgataaagctctttgaggacaaggtacttcgtgcacctcatgctgaagattgcaccatgttggaaaataaatatgaagcaagtcaaactagatgcatacacttgtgtagaaatcaataatcaattaatagaagtgaaaaaatagacattaaaatgatttatttcta

SEQ ID NO: 417613 - DNA, 951 bp, Homo sapiens
agaactagtggatccccctttctgcaggaattcggcacgaggcggggtcacggcccggccgtcggtaacctggtttccgagagtgccgggcggtcggcgggtcagggcagcccggggcctgacgccatgtcccggaacctgcgcaccgcgctcattttcggcggcttcatctccctgatcggcgccgccttctatcccatctacttccggcccctaatgagattggaggagtacaagaaggaacaagctataaatcgggctggaattgttcaagaggatgtgcagccaccagggttaaaagtgtggtctgatccatttggcaggaaatgagagggctgtcatcagctctgattaagaaaggagatttcttcatgctttcgattctgcatggggtacagccagtcacctcaccagagaatgacggctggagaagaaaactctgtaataccataaataagagtgcttgtaataaaagactgtgcacaaggattaatatttcccttcttaagtatcaaaagaactctggaacaaattataccattaggaaggttttcatgattcagttgattttccaaaaatgaagctatctcacccagctgggtttggaggagcaatctgcttattattctgtcgttaccacttactcaagcgagctgtgatatgaatacaagcaaccagtgggctcgggaaggtccgggtctcttctgccatcttccagataagagatttcagtaaaaaactgccatgctgagctgccttatagagctcttcgaaaatgttcgagttgataaagctctttgaggacaaggtacttcgtgcacctcatgctgaagattgcaccatgttggaaaataaatatgaagcaagtcaaactagatgcatacacttgtgtagaaatcaataatcaattaatagaagtgaaaaaatagacattaaaatgatttatttcta

SEQ ID NO: 417614 - DNA, 736 bp, Homo sapiens
ctcgaggccaagatttcggcagaaggaacaagctataaatcgggctggaattgttcaagaggatgtgcagccaccagggttaaaagtgtggtctgatccatttggcaggaaatgagagggctgtcatcagctctgattaagaaaggagatttcttcatgctttcgattctgcatggggtacagccagtcacctcaccagagaatgacggctggagaagaaaactctgtaataccataaataagagtgcttgtaataaaagactgtgcacaaggattaatatttcccttcttaagtatcaaaagaactctggaacaaattataccattaggaaggttttcatgattcagttgattttccaaaaatgaagctatctcacccagctgggtttggaggagcaatctgcttattattctgtcgttaccacttactcaagcgagctgtgatatgaatacaagcaaccagtgggctcgggaaggtccgggtctcttctgccatcttccagataagagatttcagtaaaaaactgccatgctgagctgccttatagagctcttcgaaaatgttcgagttgataaagctctttgaggacaaggtacttcgtgcacctcatgctgaagattgcaccatgttggaaaataaatatgaagcaagtcaaactagatgcatacacttgtgtagaaatcaataatcaattaatagaagtgaaaaaatagacattaaaatgatttatttcta

SEQ ID NO: 417615 - DNA, 814 bp, Homo sapiens
gttttctaattgtcccatgtcattggcccatgtaaatacaaatatttctctctccccgccccccttctaaagaatgatttttctcttatgtttctcagagaaggaacaagctataaatcgggctggaattgttcaagaggatgtgcagccaccagggttaaaagtgtggtctgatccatttggcaggaaatgagagggctgtcatcagctctgattaagaaaggagatttcttcatgctttcgattctgcatggggtacagccagtcacctcaccagagaatgacggctggagaagaaaactctgtaataccataaataagagtgcttgtaataaaagactgtgcacaaggattaatatttcccttcttaagtatcaaaagaactctggaacaaattataccattaggaaggttttcatgattcagttgattttccaaaaatgaagctatctcacccagctgggtttggaggagcaatctgcttattattctgtcgttaccacttactcaagcgagctgtgatatgaatacaagcaaccagtgggctcgggaaggtccgggtctcttctgccatcttccagataagagatttcagtaaaaaactgccatgctgagctgccttatagagctcttcgaaaatgttcgagttgataaagctctttgaggacaaggtacttcgtgcacctcatgctgaagattgcaccatgttggaaaataaatatgaagcaagtcaaactagatgcatacacttgtgtagaaatcaataatcaattaatagaagtgaaaaaatagacattaaaatgatttatttcta

SEQ ID NO: 417616 - DNA, 1005 bp, Homo sapiens
agcgaaagcctctccacctcttccgagcggggtcacggcccggccgtcggtaacctggtttccgagagtgccgggcggtcggcgggtcagggcagcccggggcctgacgccatgtcccggaacctgcgcaccgcgctcattttcggcggcttcatctccctgatcggcgccgccttctatcccatctacttccggcccctaatgagattggaggagtacaagaaggaacaagctataaatcgggctggaattgttcaagaggatgtgcagccaccagggttaaaagtgtggtctgatccatttggcaggaaatgagagggctgtcatcagctctgattaagaaaggagatttcttcatgctttcgattctgcatggggtacagccagtcacctcaccagagaatgacggctggagaagaaaactctgtaataccataaataagagtgcttgtaataaaagactgtgcacaaggattaatatttcccttcttaagtatcaaaagaactctggaacaaattataccattaggaaggttttcatgattcagttgattttccaaaaatgaagctatctcacccagctgggtttggaggagcaatctgcttattattctgtcgttaccacttactcaagcgagctgtgatatgaatacaagcaaccagtgggctcgggaaggtccgggtctcttctgccatcttccagataagagatttcagtaaaaaactgccatgctgagctgccttatagagctcttcgaaaatgttcgagttgataaagctctttgaggacaaggtacttcgtgcacctcatgctgaagattgcaccatgttggaaaataaatatgaagcaagtcaaactagatgcatacacttgtgtagaaatcaataatcaattaatagaagtgaaaaaatagacattaaaatgatttatttctactttgcagtggtgtctttttgtaaatcatcttttgtaaagcaattaaaattatagtgccgagaagtaca

SEQ ID NO: 417617 - DNA, 510 bp, Homo sapiens
agcgaaagcctctccacctcttccgagcggggtcacggcccggccgtcggtaacctggtttccgagagtgccgggcggtcggcgggtcagggcagcccggggcctgacgccatgtcccggaacctgcgcaccgcgctcattttcggcggcttcatctccctgatcggcgccgccttctatcccatctacttccggcccctaatgagattggaggagtacaagaaggaacaagctataaatcgggctggaattgttcaagaggatgtgcagccaccagggttaaaagtgtggtctgatccatttggcaggaaatgagagggctgtcatcagctctgattaagaaaggagatttcttcatgctttcgattctgcatggggtacagccagtcacctcaccagagaatgacggctggagaagaaaactctgtaataccataaataagagtgcttgtaataaatatgatgcggccgcattccttttattgtgactgattgtgcaggacacttaat

SEQ ID NO: 417618 - DNA, 445 bp, Homo sapiens
agaaggaacaagctataaatcgggctggaattgttcaagaggatgtgcagccaccaggtaaactgaaaaaaaaaaatcaaaaccaaatcttatttgtactactgtgttgtgcgggtttgtgtgtgtttgccttggcctggagagtgggaaaatgccttttagcttagagacaagattgtgattttgctatttatttctcaacagttgccatttatagatgccacccaaggcgtcattctaatatttcactccagaatactttttgcacgtttgccaggttcctcttttccattttataagtgggcataaaaatgttaacaagtgcgtgattcgatatgagacgtgaatagctgtttggcagacttatttaccaagcacctatttaaacactcccctcatgggaaaatagtgtttacttgttagctgtttgaattgatgtggggtt

SEQ ID NO: 417619 - DNA, 430 bp, Homo sapiens
tctggaacaaattataccattaggaaggttttcatgattcagttgattttccaaaaatgaagctatctcacccagctgggtttggaggagcaatctgcttattattctgtcgttaccacttactcaagcgagctgtgatatgaatacaagcaaccagtgggctcgggaaggtccgggtctcttctgccatcttccagataagagatttcagtaaaaaactgccatgctgagctgccttatagagctcttcgaaaatgttcgagttgataaagctctttgaggacaaggtacttcgtgcacctcatgctgaagattgcaccatgttggaaaataaatatgaagcaagtcaaactagatgcatacacttgtgtagaaatcaataatcaattaatagaagtgaaaaaatagacattaaaatgatttatttcta

SEQ ID NO: 417620 - DNA, 936 bp, Homo sapiens
agcgaaagcctctccacctcttccgagcggggtcacggcccggccgtcggtaacctggtttccgagagtgccgggcggtcggcgggtcagggcagcccggggcctgacgccatgtcccggaacctgcgcaccgcgctcattttcggcggcttcatctccctgatcggcgccgccttctatcccatctacttccggcccctaatgagattggaggagtacaagaaggaacaagctataaatcgggctggaattgttcaagaggatgtgcagccaccagggttaaaagtgtggtctgatccatttggcaggaaatgagagggctgtcatcagctctgattaagaaaggagatttcttcatgctttcgattctgcatggggtacagccagtcacctcaccagagaatgacggctggagaagaaaactctgtaataccataaataagagtgcttgtaataaaagactgtgcacaaggattaatatttcccttcttaagtatcaaaagaactctggaacaaattataccattaggaaggttttcatgattcagttgattttccaaaaatgaagctatctcacccagctgggtttggaggagcaatctgcttattattctgtcgttaccacttactcaagcgagctgtgatatgaatacaagcaaccagtgggctcgggaaggtccgggtctcttctgccatcttccagataagagatttcagtaaaaaactgccatgctgagctgccttatagagctcttcgaaaatgttcgagttgataaagctctttgaggacaaggtacttcgtgcacctcatgctgaagattgcaccatgttggaaaataaatatgaagcaagtcaaactagatgcatacacttgtgtagaaatcaataatcaattaatagaagtgaaaaaatagacattaaaatgatttatttcta

SEQ ID NO: 417621 - DNA, 845 bp, Homo sapiens
agcgaaagcctctccacctcttccgagcggggtcacggcccggccgtcggtaacctggtttccgagagtgccgggcggtcggcgggtcagggcagcccggggcctgacgccatgtcccggaacctgcgcaccgcgctcattttcggcggcttcatctccctgatcggcgccgccttctatcccatctacttccggcccctaatgagattggaggagtacaagaaggaacaagctataaatcgggctggaattgttcaagaggatgtgcagccaccagggttaaaagtgtggtctgatccatttggcaggaaatgagagggctgtcatcagctctgattaagaaaggagatttcttcatgctttcgattctgcatggggtacagccagtcacctcaccagagaatgacggctggagaagaaaactctgtaataccataaataagagtgcttgtaataaaagactgtgcacaaggattaatatttcccttcttaagtatcaaaagaactctggaacaaattataccattaggaaggttttcatgattcagttgattttccaaaaatgaagctatctcacccagctgggtttggaggagcaatctgcttattattctgtcgttaccacttactcaagcgagctgtgatatgaatacaagcaaccagtgggctcgggaaggtccgggtctcttctgccatcttccagataagagatttcagtaaaaaactgccatgctgagctgccttatagagctcttcgaaaatgttcgagttgataaagctctttgaggacaaggtacttcagcatgaggtgcacgaaggtcgacgcggccgcgaatttagtagta

SEQ ID NO: 417622 - DNA, 1895 bp, Homo sapiens
  misc_feature (1094)..(1094): n is a, c, g, or t
ccacgcgtccgagaccaaggagtggaaagttctccggcagccctgagatctcaagagtgacatttgtgagaccagctaatttgattaaaattctcttggaatcagctttgctagtatcatacctgtgccagatttcatcatgggaaacagctgttacaacatagtagccactctgttgctggtcctcaactttgagaggacaagatcattgcaggatccttgtagtaactgcccagctggtacattctgtgataataacaggaatcagatttgcagtccctgtcctccaaatagtttctccagcgcaggtggacaaaggacctgtgacatatgcaggcagtgtaaaggtgttttcaggaccaggaaggagtgttcctccaccagcaatgcagagtgtgactgcactccagggtttcactgcctgggggcaggatgcagcatgtgtgaacaggattgtaaacaaggtcaagaactgacaaaaaaaggttgtaaagactgttgctttgggacatttaacgatcagaaacgtggcatctgtcgaccctggacaaactgttctttggatggaaagtctgtgcttgtgaatgggacgaaggagagggacgtggtctgtggaccatctccagccgacctctctccgggagcatcctctgtgaccccgcctgcccctgcgagagagccaggacactctccgcagatcatctccttctttcttgcgctgacgtcgactgcgttgctcttcctgctgttcttcctcacgctccgtttctctgttgttaaacggggcagaaagaaactcctgtatatattcaaacaaccatttatgagaccagtacaaactactcaagaggaagatggctgtagctgccgatttccagaagaagaagaaggaggatgtgaactgtgaaatggaagtcaatagggctgttgggactttcttgaaaagaagcaaggaaatatgagtcatccgctatcacagctttcaaaagcaagaacaccatcctacataatacccaggattcccccaacacacgttcttttctaaatgccaatgagttggcctttaaaaatgcaccactttttttttttttttngacagggtctcactctgtcacccaggctggagtgcagtggcaccaccatggctctctgcagccttgacctctgggagctcaagtgatcctcctgcctcagtctcctgagtagctggaactacaaggaagggccaccacacctgactaacttttttgttttttgtttggtaaagatggcatttcgccatgttgtacaggctggtctcaaactcctaggttcactttggcctcccaaagtgctgggattacagacatgaactgccaggcccggccaaaataatgcaccacttttaacagaacagacagatgaggacagagctggtgataaaaaaaaaaaaaaaaaagcattttctagataccacttaacaggtttgagctagtttttttgaaatccaaagaaaattatagtttaaattcaattacatagtccagtggtccaactataattataatcaaaatcaatgcaggtttgttttttggtgctaatatgacatatgacaataagccacgaggtgcagtaagtacccgactaaagtttccgtgggttctgtcatgtaacacgacatgctccaccgtcaggggggagtatgagcagagtgcctgagtttagggtcaaggacaaaaaacctcaggcctggaggaagttttggaaagagttcaagtgtctgtatatcctatggtcttctccatcctcacaccttctgcctttgtcctgctcccttttaagccaggttacattctaaaaattcttaacttttaacataatattttataccaaagccaataaatgaactgcatatg

SEQ ID NO: 417623 - DNA, 945 bp, Homo sapiens
ccacgcgtccgagaccaaggagtggaaagttctccggcagccctgagatctcaagagtgacatttgtgagaccagctaatttgattaaaattctcttggaatcagctttgctagtatcatacctgtgccagatttcatcatgggaaacagctgttacaacatagtagccactctgttgctggtcctcaactttgagaggacaagatcattgcaggatccttgtagtaactgcccagctggtacattctgtgataataacaggaatcagatttgcagtccctgtcctccaaatagtttctccagcgcaggtggacaaaggacctgtgacatatgcaggcagtgtaaaggtgttttcaggaccaggaaggagtgttcctccaccagcaatgcagagtgtgactgcactccagggtttcactgcctgggggcaggatgcagcatgtgtgaacaggattgtaaacaaggtcaagaactgacaaaaaaaggttgtaaagactgttgctttgggacatttaacgatcagaaacgtggcatctgtcgaccctggacaaacatcagagtggctgacgaatggaatcatgattcacaagaaaagtattgactattttctcggacttagctgaattctgtctttggaaagtggcttttttaaaaagctgttctttggatggaaagtctgtgcttgtgaatgggacgaaggagagggacgtggtctgtggaccatctccagccgacctctctccgggagcatcctctgtgaccccgcctgcccctgcgagagagccaggacactctccgcagatcatctccttctttcttgcgctgacgtcgactgcgttgctcttcctgctgttcttcctcacgctccgtttctctgttgttaaacggggcagaaagaaactcctgtatatattcaaacaacgtaagattaacataatcatatta

SEQ ID NO: 417624 - DNA, 1040 bp, Homo sapiens
ccacgcgtccgagaccaaggagtggaaagttctccggcagccctgagatctcaagagtgacatttgtgagaccagctaatttgattaaaattctcttggaatcagctttgctagtatcatacctgtgccagatttcatcatgggaaacagctgttacaacatagtagccactctgttgctggtcctcaactttgagaggacaagatcattgcaggatccttgtagtaactgcccagctggtacattctgtgataataacaggaatcagatttgcagtccctgtcctccaaatagtttctccagcgcaggtggacaaaggacctgtgacatatgcaggcagtgtaaaggtgttttcaggaccaggaaggagtgttcctccaccagcaatgcagagtgtgactgcactccagggtttcactgcctgggggcaggatgcagcatgtgtgaacaggattgtaaacaaggtcaagaactgacaaaaaaaggttgtaaagactgttgctttgggacatttaacgatcagaaacgtggcatctgtcgaccctggacaaactgttctttggatggaaagtctgtgcttgtgaatgggacgaaggagagggacgtggtctgtggaccatctccagccgacctctctccgggagcatcctctgtgaccccgcctgcccctgcgagagagccaggacactctccgcagatcatctccttctttcttgcgctgacgtcgactgcgttgctcttcctgctgttcttcctcacgctccgtttctctgttgttaaacggggcagaaagaaactcctgtatatattcaaacaacatggaagcagtggggataccttcacaatcctggagtcataacactgcattccaaggaaaccatcggatctcgaatctcagtaaccctcaagacgaaaataagtgctgctgaattgaaactagagctatgattgggatatggctaatattttatggtttagtgattcatgcttaagattcatgcttttttagctaatgtagaaaataaagaaaatagttctta

SEQ ID NO: 417625 - DNA, 386 bp, Homo sapiens
gtgattttcctgtctccgtctcctgagtagctgggattacaggtgccaaccaccacgcccagctaatttttgtagttttagtagagacggtttcaccatgttggccaggctggtctcaaactcctgacctcaggtgatccattcccctcggtctcccaaagtgctggaattacaggcatgacccattgcgcccggccccactgtttcctttctaatcgagtgagaaaatggtcagtatttctgtcaacaaaattcatgaggctctttgtacgcacagacttcaggcctttctctcaacaatcgccaaagctggagcatcacatggaggaacactggggtttgaaaaacaggaatgttccagaatcttctcagagtattacattttc

SEQ ID NO: 417626 - DNA, 537 bp, Homo sapiens
cattttctcttcttacaacattttttctcacggataaatgtccttctctaactttctgtaggtttctgctcaaatgcttccttatccctgaggctttccctgatcaccctctataaaaatggggtgggtgcacacaccttcactttttgtacattacaaaaactataacaggattcttgactgattttgtatattcgtaacagtgtgcagtacataaaaatccttttttaaaattgctgaactaatccatatttatcaccatctgacatactctagatttctcttcctgctggaatgaaaacttcaagaacatagaatagcgcctggcgcccagtaattgctcagtaaatactcagtgaatataaatgatctactctgaacttttagtgtgttcctttttactaaaagcttaatagtaaaagaccacatcttaatcaaaggttgttacttaccaccctcttttggcagttctattagcaaatgtccaaggtgattttttaaagacatgtaaataaatcgttttacctcttttcatgc

SEQ ID NO: 417627 - DNA, 499 bp, Homo sapiens
cacctagcctcaagtttctcctttgtaaagggactttggaattaactagaaaaactggggtagggtgcaatctgacttgtacccatatcaaaagtcaactttctgcatggtcaagtatcagataaatttaagccctctaggctttttttataatagtaaataatttttaaaaatagatgtttttgtaaaagacagactgtgaggaggaggtaagaattaaaatgaaaggctggacgcagtggctcacgcctgtaatcccagcattttgggaggccgaggtgggcggatcacgaggtcaggagaccaacaccatcctggctaacacggtgaaaccccgtctctactaaaaatacaaaaaattagcctggcgtggtggcgggcgcctgtagtcccggctacttggaaggctgaggcaggagaatggcatgaacccaggaggtggagcttgcagtgagccgagatcacgccactgcaccccagcatgggcgacagagtgaga

SEQ ID NO: 417628 - DNA, 468 bp, Homo sapiens
atactagcctgaaagtataagagcagtgatgctggcaatatggatatgccaaagagaagctgtaaagtgcttcctttaagtgaaaaggtacaagttcttgacttaataagaaaaagaatcatatgttgagactgccaagatttatggtaaggacgaatcttctatctgtgagattgtgaagaagtaaaaagaagttcgtgctggccaggcgcggtggctcacgcctgtaatcccaccaacacacacataactgcaataaaacagtattaagtaatttcaatggcctcaatggatcactgacttggacaaggtaataatgaagccaactgtcctttgttaaacaacttctaacaaaataacaaaaccttaacctatttgtttcccttcttccaactttagaaaagtcaaaaagttcatctctgttcttgccttttaaaatgtcttttattaaagaagtctgatgtgtta

SEQ ID NO: 417629 - DNA, 383 bp, Homo sapiens
caggttcctgctcttccttgctgtcctcacatcatctttctgatgctagattcacaccaatgtttcttactatattttctgtcccaggcaacattctcttccctttcctcagtggccagtggtgcagagtccccaagatttagtccatctgatcagatccaaagcagagctgggttgtctgtaaattatgaagagtacagattcctcagaaataattctagggctttaacagctaacagcacagaatttgtcttattggagatgggacagcagagggaggtagggtcaccatctgtgctggtttgcaaaatctattcccttggctcccttcttgcttggttaaatttcctggtgcctgaaagtagtcacacgttagcctgaat

SEQ ID NO: 417630 - DNA, 261 bp, Homo sapiens
ggtctagggggagaatctgttccaagcctttctcttaccttctggtgattgcaggcagtcttttgcattccttggtttgtagatacgtaatcctgccatctgtgcttccgctgtcacatgatgttctcctggtatctgtctgtgtctctgttttgtttttgttgttgcagggacaaaagtcataattgattaagggcattccctaatatcttcatcttaccttgattacatctgggatacggcagaactctttggctttaa

SEQ ID NO: 417631 - DNA, 1185 bp, Homo sapiens
tagtagagacggggtttcaccgtgttagccaggatgatctcgatctcctgacctcgtgatccacccgccttggcctcccaaagtgctgcgattacaggcgtgagccaccgtgcctggccaagaccttctttctaaagcagctttatagtgaaacattttatttagaaatctggaccttctttcttcagtttactgtaatccacattcactgagtagaatttgtattgatccctgtgacctagtttcttctagggcacccagttattctttctgtccctagtaaaatctggattgaactgtgccagatgcaggccgtacagtgttgctccagtacctccagctccagcagacacaaagagggagatcagactcagatgcttcttggcctgacggaagatctggcagcgcgtgtttgtaccaggggcctccagttcaaaaggagaaaacaaacctagctaccaggctctgcactcagtggtatccgcacttcagcgaggctgttaactgccccatgctgtcacactgtgggacacaccatctgcagcaagataaatttgaatgtgcagtgtagcatagtaaacgaaatttatgtacagcaaagggaaaacagttatcacttctttttaaaaactaaacatggatgaaaattgcgtgtcagcatcggagcatgtcagattgggagcagcaagagagatttagcccagccctcatctttcatgaatgaggaaaccaaaaccctaggattttaagacccagttgggaaaaggatgttctaaggagggttctgaaacctaaaaactcatctctgcagtgccttggtatctgttatttattttgagttagtagtaacttgaaaagtaccaagtcttaagttcctttagtgttaataacttagtagatttttaaaaattctttctcttttcttttcgggaaataccaaaatgagctccagtttacgttaaatataagtattatatggggtttcatgctctcttcatattcctaatgatgttacaatggaaatcttcaggtggaggagaatactccgactttctcaccgtgttctgagccttgtaccagagcagggagtggttgtgggaaagaagtcatggcccctcaggaggatgaaagggtggacatgcaggtgacaagagaaagcgccagagacaagaaaggggaaaacta

SEQ ID NO: 417632 - DNA, 267 bp, Homo sapiens
tcaacacaaacaccaggcaacagaataaagagcgtatctcagcaagtatttccttaaagttactaaagctgaaaatacagcatgaggctgttataaaattgttaaaaatctcagcgtacaaatgtctcccaacctttgaataacatagaaaccgagaccaatttaaaccagcccacaggcttgggcccttaaggacaataccgtggttctatttgccttccaatgtttttgtcactggaccaaatacagcaccattcacgtggaatc

SEQ ID NO: 417633 - DNA, 690 bp, Homo sapiens
cccccatctggcagggctgatgaagaggggtcactggagtgaaaatattgcccctctaccagtaaggtttgatgaggtcctaaatcgaggggattggaagatcatgaacattcttgagtagcgactttgtacccgccaccatgctacgtgattaaatatcgcagcatatttaatgcttacagtggccacataaaaattacccatgttacagatgaggaaactgagattgcagctaggaagagtgatgaaataaagttgtttattggggatattgactggctggtcgtgtaggtgcccttgtggtctgagatgtagttctggtaacttgattttgagacacaaccagaggatagcaggtttggaaactgacttaatgcacctcacaggtgtctggtgttcacgtcagtactccgacttcacaatgagaaatctgactcctccggtcctctgccattctgtgttcttgttcacttgtgttctccggtcagtgaattctgtcctaataagaaaacctaaaaggcaagtcagtcacaaccaatgtcctggtaagggcgcaatcagagaaacaggaggcgacatcgtcttgaatctgtcatcgagactgtgctatggcctgatgaatcatgcacgccccatagccaagagcactgtgtttgttacaaattgctgattaaacaacattggaataga

SEQ ID NO: 417634 - DNA, 406 bp, Homo sapiens
  misc_feature (268)..(268): n is a, c, g, or t
  misc_feature (292)..(292): n is a, c, g, or t
  misc_feature (307)..(307): n is a, c, g, or t
  misc_feature (401)..(401): n is a, c, g, or t
gcaatgtggctctggatagcaccttatggacagttgtgtccccaaggaaggatgagaatagctactgaagtcctaaagagcaagcctaactcaagccattggacacaggcattagacagaaagctggaagttgaaatggtggagtccaacttgcctggaccagcttaatggttctgctcctggtaacgtttttatccatggatgacttgcttgggtatggagagtcggcttgactacactgtgtggaagcaaagttttaaaagaagcnaaggactcagaattcattgatttnaagaaaattgcaggncagaccctggttaatcccctaaaactaagggggtttttaaatggacccaccaaccaaagccaaggccattggcaagcctttaactggctttggnaaagg

SEQ ID NO: 417635 - DNA, 695 bp, Homo sapiens
gcaatgtggctctggatagcaccttatggacagttgtgtccccaaggaaggatgagaatagctactgaagtcctaaagagcaagcctaactcaagccattggacacaggcattagacagaaagctggaagttgaaatggtggagtccaacttgcctggaccagcttaatggttctgctcctggtaatcgtgtttgtgtgatgcgtactgagtataaacgtcaggatgtcgtgcgttatatgagatcgatagcacagtaccaagattcgctcgttgcgataaccgtctctatacacaagcggtcatgtgtattagatccgtgccctattgagcatagcaccatcgctggtggcacggcatacgctatgtctcatacacgggaagccttataaggcactacgagccagtctggagacaggagtaagcaacttgtcaagcacagaggcaatagcaagtctactgaaccatatgtaggtgctcataatattgaagcgccaaacactagtagagacatagctatgtgtaacatagaatagacaagggcgtggtagccgtgctaccggaagtttcacgcagggatagtcggtccgactccacgcgtccgaagcaggccaccagttgggtaggctatgttaatataaatgtctatcaacatgtgttcaataatattggtactcgctggtatcctcagctgca

SEQ ID NO: 417636 - DNA, 4326 bp, Homo sapiens
tatgttgcccaggctagtctcaaactcttgagctcaggcactcctctcacctaggcctcccaaagtgctaggattacaggtgcgagttacaacacctggccaacctttactccttattacactaactttatcgttagtgttctactctacccacaactctggggaaactgaggctggggtagcttgctggtgcactagtaattccaaacttgaacgggagaaatgcttattggaagcactgtctttatatagtttgcaagttgtcattactttttatttttagagacatgtcttgttctgttgcccaggctggaatgcagtggcatgccaccatgcagtggcatggtgatagctcactgcagtctcaaattgctgggctcaagtaatcctcctccctgtaatcccaaagtgctgggattataggcatgcaccagcacatccagctaattttttgttggtccttcttttaaaagcaggcatttctcagaattactaaggcattaaggaattttaagaaaatctgattccagaatactttgttactgtaaatattgacactgctccttaacattttttttctgccattttaacgaaaaccgtatactacatctgcttgctcaaatgcaaaacaggactctgcctcttagactgtgttgccctggaagcctgagatggggcattctatgactaccaatattactttcactatcaaccacatgaagtgatcatatgtttcagtaccagatggtgtactgatactttatatatattctcatctgatccttacagggctcatttgagggagataactattatttccccattttatataagagaaaattgaagtttagagatgtgaagcttctttcctaataagtagtttccaggtactaattggccaattaagttttaaatccaagcaacctgacttgtcagtgtaaacagtttctagttaatcactgtgatgctgaataagtatagtgggtagcacatctgattcaactgagatctaccttcttaagaaaaaacaaatctaggaagcttacagtggctaagatgggtcatttaaatgtaggtgatttataactgcacgtaagtctatttcgtgttgctttgttatcttacctctcgataagaatggcaaataactactcttactcattgtgcatgattttctggttttatgtgactgtgttcaaattgaggaaaccagaatccagttattcaacaacaataattttctctatactatgatttatttacattttttcatatagttctctcaattatatataaagtctaggaaagtatgacttatgtgtgaatttccttacctattctttaaggctgttttgttttttaagagcctatttattgttgtactgctggttcctaaatagaacagttaagtaggccactgagcaggaaaaaatactgcaaaattttatagtcttctgagtttattactaccagaagaccttatctcagcccagatgtgtgtatctgaaaataaaaattacactatgggcatctgattaatatacttacgtcttacataaaagtaaaatgtgtctgtcctggccctatcagcctgttttttttttccttctcattctaggtagaagatgtgttacaacgttgtcgagaatatttaattaaaaaaataaatgcagagaattgtgtacgattgttgagttttgctgatctcttcagttgtgaggaattaaaacagagtgctaaaagaatggtggagcacaagttcactgctgtgtatcatcaggacgcgttcatgcagctgtcacatgacctactgatagatattctcagtagtgacaatttaaatgtagaaaaggaagaaaccgttcgagaagctgctatgctgtggctagagtataacacagaatcacgatcccagtatttgtcttctgttcttagccaaatcagaattgatgcactttcagaagtaacacagagagcttggtttcaaggtctgccacccaatgataagtcagtggtggttcaaggtctgtataagtccatgcccaagtttttcaaaccaagacttgggatgactaaagaggaaatgatgattttcattgaagcatcttcagaaaatccttgtagtctttactcttctgtctgttacagcccccaagcagaaaaagtttacaagttatgtagcccaccagctgatttgcataaggttgggaccgttgtaactcctgataatgatatctacatagcagggggtcaagttcctctgaaaaacacaaaaacaaatcacagtaaaacaagcaaacttcagactgccttcagaactgtgaattgcttttattggtttgatgcacagcaaaatacctggtttccaaagaccccaatgctttttgtccgcataaagccatctttggtttgctgtgaaggctatatctatgcaattggaggagatagcgtaggtggagaacttaatcggaggaccgtagaaagatacgacactgagaaagatgagtggacgatggtaagccctttaccttgtgcttggcaatggagtgcagcagttgtggttcatgactgcatttatgtgatgacactgaacctcatgtactgttattttccaaggtctgactcatgggtagaaatggccatgagacagactagtaggtcctttgcttcagctgcagcttttggtgataaaattttctatattggagggttgcatattgctaccaattccggcataagactcccctctggcactgtagatgggtcttcagtaactgtggaaatttatgatgtgaataaaaatgagtggaaaatggcagccaacatccctgctaagaggtactctgacccctgtgttagagctgttgtgatctcaaattctctatgtgtgtttatgcgagaaacccacttaaatgagcgagctaaatacgtcacctaccaatatgacctggaacttgaccggtggtctctgcggcagcatatatctgaacgtgtactgtgggacttggggagagattttcgatgcactgtggggaaactctatccatcctgccttgaagagtctccatggaaaccaccaacttatcttttttcaacggatgggacagaagagtttgaactggatggagaaatggttgcactaccacctgtatagtggggaagttcagggagtgcacgcctgagttatgtgctttgtcattttctttgctaaacaaaagaggctatgaaagaactaaatatgagtacataaaattctatctttgataaattttatttttatgccctacttaatatttgcatcagtataatatatatcagtgagtcttacagaaagatatgcttccataatatgaaatagattattcaataattgagaaactttatgtgtaatcatgagagtataagaatctggattatctaacattgttagccctgtgtatgtacagttcaaaaagttcatttataaaagtagtttcctgttcctagtgtgatgtatcacaaattgtgctgaggttattttagtatgtgtgtttcattcccgtgcttctgttctgaagtcctggaatacagttttcagtgtaattaattcaactgcacttaacactaatgtccgtgttggtatagaaatgtctaaatcctatactctagttgaggaagatcttccataattttatggtattacacagggaaagctatgactgcaggatcagtctaactatactattaggtgcatgtattctcttttcactaacttatacttgtctatctagaatacaggtcttccagtcagctggtcatttaccaggtgtggacttaagttgctgggcttgcagtaagaattgccagccactcattgtgcgggtctgcgtggagctttaatcagaaaaagcctccactttctgtattatgttaacattggctcatgcatataactatctgctgctgatgtagttctccatcttcaagatttagagtgggttaaccaggtcattacatcttaatttaataacaagcattactgtagagtgattgtgtatagatctgttagctgtcagggtgtgttttttttaacctgttgtgtgcgtgtgggggttaggattagtaaggtgaactgttcaggaattctctgcactagctgtgcagaagagcagataactagcgctgctctggcattaatcccaggaaccactagcagtagtgggcgccgccaatctaacatgagcacaggtgcttcatgacaaacattactagcatgttcaactgcaccatgttctggcactgtattttgaatgacattaatttattaaataaattgtatatattcaa

SEQ ID NO: 417637 - DNA, 3516 bp, Homo sapiens
cacccccttccttctgtattccccccgcgtacatctgaactaaccaagagaggtctagacgaacagagctcctgttatggtctatatcgacttaaaaaagaaagcagaaactgccctttgaaacggaaaattgtttactccacaggatccgctgaacataggatgttgccacaaaatctacctcgtgtatttttctctttcactcatgagctgcacaattgcagatttgagcacaatgtctgcagactgtgttgaaaaactctgaagaacctaattaacacaggatgacctaggagtgattctaagtctgtgtaacaagatattactcattagtgaatgtgtcagtcttggtactgaatgctgcagataacagcaagtaggttctcctttatttctgaagtattcacttgaccttccatcagtaagacggacttttctaatctgttcctggagatattaatggaatacagtcatgtccactcaagacgagaggcagatcaatactgaatatgctgtgtcattgttggaacagttgaaactgttttatgaacagcagttgtttactgacatagtgttaattgttgagggcactgaattcccttgtcataagatggttcttgcaacatgtagctcttatttcagggccatgtttatgagtggactaagtgaaagcaaacaaacccatgtacacctgaggaatgtcgatgctgccaccttacagataataataacttatgcatacacgggtaacttggcaatgaatgacagcactgtagaacagctttatgaaacagcttgcttcctacaggtagaagatgtgttacaacgttgtcgagaatatttaattaaaaaaataaatgcagagaattgtgtacgattgttgagttttgctgatctcttcagttgtgaggaattaaaacagagtgctaaaagaatggtggagcacaagttcactgctgtgtatcatcaggacgcgttcatgcagctgtcacatgacctactgatagatattctcagtagtgacaatttaaatgtagaaaaggaagaaaccgttcgagaagctgctatgctgtggctagagtataacacagaatcacgatcccagtatttgtcttctgttcttagccaaatcagaattgatgcactttcagaagtaacacagagagcttggtttcaaggtctgccacccaatgataagtcagtggtggttcaaggtctgtataagtccatgcccaagtttttcaaaccaagacttgggatgactaaagaggaaatgatgattttcattgaagcatcttcagaaaatccttgtagtctttactcttctgtctgttacagcccccaagcagaaaaagtttacaagttatgtagcccaccagctgatttgcataaggttgggaccgttgtaactcctgataatgatatctacatagcagggggtcaagttcctctgaaaaacacaaaaacaaatcacagtaaaacaagcaaacttcagactgccttcagaactgtgaattgcttttattggtttgatgcacagcaaaatacctggtttccaaagaccccaatgctttttgtccgcataaagccatctttggtttgctgtgaaggctatatctatgcaattggaggagatagcgtaggtggagaacttaatcggaggaccgtagaaagatacgacactgagaaagatgagtggacgatggtaagccctttaccttgtgcttggcaatggagtgcagcagttgtggttcatgactgcatttatgtgatgacactgaacctcatgtactgttattttccaaggtctgactcatgggtagaaatggccatgagacagactagtaggtcctttgcttcagctgcagcttttggtgataaaattttctatattggagggttgcatattgctaccaattccggcataagactcccctctggcactgtagatgggtcttcagtaactgtggaaatttatgatgtgaataaaaatgagtggaaaatggcagccaacatccctgctaagaggtactctgacccctgtgttagagctgttgtgatctcaaattctctatgtgtgtttatgcgagaaacccacttaaatgagcgagctaaatacgtcacctaccaatatgacctggaacttgaccggtggtctctgcggcagcatatatctgaacgtgtactgtgggacttggggagagattttcgatgcactgtggggaaactctatccatcctgccttgaagagtctccatggaaaccaccaacttatcttttttcaacggatgggacagaagagtttgaactggatggagaaatggttgcactaccacctgtatagtggggaagttcagggagtgcacgcctgagttatgtgctttgtcattttctttgctaaacaaaagaggctatgaaagaactaaatatgagtacataaaattctatctttgataaattttatttttatgccctacttaatatttgcatcagtataatatatatcagtgagtcttacagaaagatatgcttccataatatgaaatagattattcaataattgagaaactttatgtgtaatcatgagagtataagaatctggattatctaacattgttagccctgtgtatgtacagttcaaaaagttcatttataaaagtagtttcctgttcctagtgtgatgtatcacaaattgtgctgaggttattttagtatgtgtgtttcattcccgtgcttctgttctgaagtcctggaatacagttttcagtgtaattaattcaactgcacttaacactaatgtccgtgttggtatagaaatgtctaaatcctatactctagttgaggaagatcttccataattttatggtattacacagggaaagctatgactgcaggatcagtctaactatactattaggtgcatgtattctcttttcactaacttatacttgtctatctagaatacaggtcttccagtcagctggtcatttaccaggtgtggacttaagttgctgggcttgcagtaagaattgccagccactcattgtgcgggtctgcgtggagctttaatcagaaaaagcctccactttctgtattatgttaacattggctcatgcatataactatctgctgctgatgtagttctccatcttcaagatttagagtgggttaaccaggtcattacatcttaatttaataacaagcattactgtagagtgattgtgtatagatctgttagctgtcagggtgtgttttttttaacctgttgtgtgcgtgtgggggttaggattagtaaggtgaactgttcaggaattctctgcactagctgtgcagaagagcagataactagcgctgctctggcattaatcccaggaaccactagcagtagtgggcgccgccaatctaacatgagcacaggtgcttcatgacaaacattactagcatgttcaactgcaccatgttctggcactgtattttgaatgacattaatttattaaataaattgtatatattcaa

SEQ ID NO: 417638 - DNA, 4346 bp, Homo sapiens
ggtcgggccctgaggagcgtgcggcggcgcccgcagaggacgctgctttccgcgctggacggaccaagcgagggagggtgcgaggggaaaccggaaggaagaggcggcggcgccagccttcctcggccggaggcggaggcgagaccccaggcgaggccgcggcgggagggccacgcccccgccgccgcgccggaggggcccagtgtggacggggccaccggctggagcggatcccacacctccggaccgagggacgcggttactccacaggatccgctgaacataggatgttgccacaaaatctacctcgtgtatttttctctttcactcatgagctgcacaattgcagatttgagcacaatgtctgcagactgtgttgaaaaactctgaagaacctaattaacacaggatgacctaggagtgattctaagtctgtgtaacaagatattactcattagtgaatgtgtcagtcttggtactgaatgctgcagataacagcaagtaggttctcctttatttctgaagtattcacttgaccttccatcagtaagacggacttttctaatctgttcctggagatattaatggaatacagtcatgtccactcaagacgagaggcagatcaatactgaatatgctgtgtcattgttggaacagttgaaactgttttatgaacagcagttgtttactgacatagtgttaattgttgagggcactgaattcccttgtcataagatggttcttgcaacatgtagctcttatttcagggccatgtttatgagtggactaagtgaaagcaaacaaacccatgtacacctgaggaatgtcgatgctgccaccttacagataataataacttatgcatacacgggtaacttggcaatgaatgacagcactgtagaacagctttatgaaacagcttgcttcctacaggtagaagatgtgttacaacgttgtcgagaatatttaattaaaaaaataaatgcagagaattgtgtacgattgttgagttttgctgatctcttcagttgtgaggaattaaaacagagtgctaaaagaatggtggagcacaagttcactgctgtgtatcatcaggacgcgttcatgcagctgtcacatgacctactgatagatattctcagtagtgacaatttaaatgtagaaaaggaagaaaccgttcgagaagctgctatgctgtggctagagtataacacagaatcacgatcccagtatttgtcttctgttcttagccaaatcagaattgatgcactttcagaagtaacacagagagcttggtttcaaggtctgccacccaatgataagtcagtggtggttcaaggtctgtataagtccatgcccaagtttttcaaaccaagacttgggatgactaaagaggaaatgatgattttcattgaagcatcttcagaaaatccttgtagtctttactcttctgtctgttacagcccccaagcagaaaaagtttacaagttatgtagcccaccagctgatttgcataaggttgggaccgttgtaactcctgataatgatatctacatagcagggggtcaagttcctctgaaaaacacaaaaacaaatcacagtaaaacaagcaaacttcagactgccttcagaactgtgaattgcttttattggtttgatgcacagcaaaatacctggtttccaaagaccccaatgctttttgtccgcataaagccatctttggtttgctgtgaaggctatatctatgcaattggaggagatagcgtaggtggagaacttaatcggaggaccgtagaaagatacgacactgagaaagatgagtggacgatggtaagccctttaccttgtgcttggcaatggagtgcagcagttgtggttcatgactgcatttatgtgatgacactgaacctcatgtactgttattttccaaggtctgactcatgggtagaaatggccatgagacagactagtaggtcctttgcttcagctgcagcttttggtgataaaattttctatattggagggttgcatattgctaccaattccggcataagactcccctctggcactgtagatgggtcttcagtaactgtggaaatttatgatgtgaataaaaatgagtggaaaatggcagccaacatccctgctaagaggtactctgacccctgtgttagagctgttgtgatctcaaattctctatgtgtgtttatgcgagaaacccacttaaatgagcgagctaaatacgtcacctaccaatatgacctggaacttgaccggtggtctctgcggcagcatatatctgaacgtgtactgtgggacttggggagagattttcgatgcactgtggggaaactctatccatcctgccttgaagagtctccatggaaaccaccaacttatcttttttcaacggatgggacagaagagtttgaactggatggagaaatggttgcactaccacctgtatagtggggaagttcagggagtgcacgcctgagttatgtgctttgtcattttctttgctaaacaaaagaggctatgaaagaactaaatatgagtacataaaattctatctttgataaattttatttttatgccctacttaatatttgcatcagtataatatatatcagtgagtcttacagaaagatatgcttccataatatgaaatagattattcaataattgagaaactttatgtgtaatcatgagagtataagaatctggattatctaacattgttagccctgtgtatgtacagttcaaaaagttcatttataaaagtagtttcctgttcctagtgtgatgtatcacaaattgtgctgaggttattttagtatgtgtgtttcattcccgtgcttctgttctgaagtcctggaatacagttttcagtgtaattaattcaactgcacttaacactaatgtccgtgttggtatagaaatgtctaaatcctatactctagttgaggaagatcttccataattttatggtattacacagggaaagctatgactgcaggatcagtctaactatactattaggtgcatgtattctcttttcactaacttatacttgtctatctagaatacaggtcttccagtcagctggtcatttaccaggtgtggacttaagttgctgggcttgcagtaagaattgccagccactcattgtgcgggtctgcgtggagctttaatcagaaaaagcctccactttctgtattatgttaacattggctcatgcatataactatctgctgctgatgtagttctccatcttcaagatttagagtgggttaaccaggtcattacatcttaatttaataacaagcattactgtagagtgattgtgtatagatctgttagctgtcagggtgtgttttttttaacctgttgtgtgcgtgtgggggttaggattagtaaggtgaactgttcaggaattctctgcactagctgtgcagaagagcagataactagcgctgctctggcattaatcccaggaaccactagcagtagtgggcgccgccaatctaacatgagcacaggtgcttcatgacaaacattactagcatgttcaactgcaccatgttctggcactgtattttgaatgacattaatttattaaataaattgtatatattcaatatctatttttcttttgttatgggaatggtctgctttttaaattttgattttgctaggtcaaacttagctagtaataggtggtttcttccaaattttgtttgatgaagattgagagatatgcataggctttccttaggctagtgtctttctaccctgctggcatgttagaatcatctgattctgatcatcatctttagaagcttgagatgatgcctgaacctcaccccaaacaaaatggtttctttttagagcacatcattgatcatgtttatagacttgaactgcccctccactgcctactgaatgaagtccagattccttaccacatttaaggctctctctaatttggctttaaattacctttacagccctaccttgcattgtttttccataagccttatcttctgattaggctttcgctatgctttatgcttttttatgctattcatgctactcagaatggtttcttcatcccaactttacttgcagctgtctcaagagctatttaaggcagtttttaaagaatgtttcctgataaccatgtcttaccatgaggtgaaaagtatcctttctcacatttttactaccttgtacctagatcttattaattgtactgatcattctattgactattactagttttggccaggtggggtggcttatgcctgtaatcccagcactttgggaggcctaagtgggaggaa

SEQ ID NO: 417639 - DNA, 2584 bp, Homo sapiens
ggtcgggccctgaggagcgtgcggcggcgcccgcagaggacgctgctttccgcgctggacggaccaagcgagggagggtgcgaggggaaaccggaaggaagaggcggcggcgccagccttcctcggccggaggcggaggcgagaccccaggcgaggccgcggcgggagggccacgcccccgccgccgcgccggaggggcccagtgtggacggggccaccggctggagcggatcccacacctccggaccgagggacgcggttactccacaggatccgctgaacataggatgttgccacaaaatctacctcgtgtatttttctctttcactcatgagctgcacaattgcagatttgagcacaatgtctgcagactgtgttgaaaaactctgaagaacctaattaacacaggatgacctaggagtgattctaagtctgtgtaacaagatattactcattagtgaatgtgtcagtcttggtactgaatgctgcagataacagcaagtaggttctcctttatttctgaagtattcacttgaccttccatcagtaagacggacttttctaatctgttcctggagatattaatggaatacagtcatgtccactcaagacgagaggcagatcaatactgaatatgctgtgtcattgttggaacagttgaaactgttttatgaacagcagttgtttactgacatagtgttaattgttgagggcactgaattcccttgtcataagatggttcttgcaacatgtagctcttatttcagggccatgtttatgagtggactaagtgaaagcaaacaaacccatgtacacctgaggaatgtcgatgctgccaccttacagataataataacttatgcatacacgggtaacttggcaatgaatgacagcactgtagaacagctttatgaaacagcttgcttcctacaggtagaagatgtgttacaacgttgtcgagaatatttaattaaaaaaataaatgcagagaattgtgtacgattgttgagttttgctgatctcttcagttgtgaggaattaaaacagagtgctaaaagaatggtggagcacaagttcactgctgtgtatcatcaggacgcgttcatgcagctgtcacatgacctactgatagatattctcagtagtgacaatttaaatgtagaaaaggaagaaaccgttcgagaagctgctatgctgtggctagagtataacacagaatcacgatcccagtatttgtcttctgttcttagccaaatcagaattgatgcactttcagaagtaacacagagagcttggtttcaaggtctgccacccaatgataagtcagtggtggttcaaggtctgtataagtccatgcccaagtttttcaaaccaagacttgggatgactaaagaggaaatgatgattttcattgaagcatcttcagaaaatccttgtagtctttactcttctgtctgttacagcccccaagcagaaaaagtttacaagttatgtagcccaccagctgatttgcataaggttgggaccgttgtaactcctgataatgatatctacatagcagggggtcaagttcctctgaaaaacacaaaaacaaatcacagtaaaacaagcaaacttcagactgccttcagaactgtgaattgcttttattggtttgatgcacagcaaaatacctggtttccaaagaccccaatgctttttgtccgcataaagccatctttggtttgctgtgaaggctatatctatgcaattggaggagatagcgtaggtggagaacttaatcggaggaccgtagaaagatacgacactgagaaagatgagtggacgatggtaagccctttaccttgtgcttggcaatggagtgcagcagttgtggttcatgactgcatttatgtgatgacactgaacctcatgtactgttattttccaaggtctgactcatgggtagaaatggccatgagacagactagtaggtcctttgcttcagctgcagcttttggtgataaaattttctatattggagggttgcatattgctaccaattccggcataagactcccctctggcactgtagatgggtcttcagtaactgtggaaatttatgatgtgaataaaaatgagtggaaaatggcagccaacatccctgctaagaggtactctgacccctgtgttagagctgttgtgatctcaaattctctatgtgtgtttatgcgagaaacccacttaaatgagcgagctaaatacgtcacctaccaatatgacctggaacttgaccggtggtctctgcggcagcatatatctgaacgtgtactgtgggacttggggagagattttcgatgcactgtggggaaactctatccatcctgccttgaagagtctccatggaaaccaccaacttatcttttttcaacggatgggacagaagagtttgaactggatggagaaatggttgcactaccacctgtatagtggggaagttcagggagtgcacgcctgagttatgtgctttgtcattttctttgctaaacaaaagaggctatgaaagaactaaatatgagtacataaaattctatctttgataaat

SEQ ID NO: 417640 - DNA, 3219 bp, Homo sapiens
ggtcgggccctgaggagcgtgcggcggcgcccgcagaggacgctgctttccgcgctggacggaccaagcgagggagggtgcgaggggaaaccggaaggaagaggcggcggcgccagccttcctcggccggaggcggaggcgagaccccaggcgaggccgcggcgggagggccacgcccccgccgccgcgccggaggggcccagtgtggacggggccaccggctggagcggatcccacacctccggaccgagggacgcggttactccacaggatccgctgaacataggatgttgccacaaaatctacctcgtgtatttttctctttcactcatgagctgcacaattgcagatttgagcacaatgtctgcagactgtgttgaaaaactctgaagaacctaattaacacaggatgacctaggagtgattctaagtctgtgtaacaagatattactcattagtgaatgtgtcagtcttggtactgaatgctgcagataacagcaagtaggttctcctttatttctgaagtattcacttgaccttccatcagtaagacggacttttctaatctgttcctggagatattaatggaatacagtcatgtccactcaagacgagaggcagatcaatactgaatatgctgtgtcattgttggaacagttgaaactgttttatgaacagcagttgtttactgacatagtgttaattgttgagggcactgaattcccttgtcataagatggttcttgcaacatgtagctcttatttcagggccatgtttatgagtggactaagtgaaagcaaacaaacccatgtacacctgaggaatgtcgatgctgccaccttacagataataataacttatgcatacacgggtaacttggcaatgaatgacagcactgtagaacagctttatgaaacagcttgcttcctacaggtagaagatgtgttacaacgttgtcgagaatatttaattaaaaaaataaatgcagagaattgtgtacgattgttgagttttgctgatctcttcagttgtgaggaattaaaacagagtgctaaaagaatggtggagcacaagttcactgctgtgtatcatcaggacgcgttcatgcagctgtcacatgacctactgatagatattctcagtagtgacaatttaaatgtagaaaaggaagaaaccgttcgagaagctgctatgctgtggctagagtataacacagaatcacgatcccagtatttgtcttctgttcttagccaaatcagaattgatgcactttcagaagtaacacagagagcttggtttcaaggtctgccacccaatgataagtcagtggtggttcaaggtctgtataagtccatgcccaagtttttcaaaccaagacttgggatgactaaagaggaaatgatgattttcattgaagcatcttcagaaaatccttgtagtctttactcttctgtctgttacagcccccaagcagaaaaagtttacaagttatgtagcccaccagctgatttgcataaggttgggaccgttgtaactcctgataatgatatctacatagcagggggtcaagttcctctgaaaaacacaaaaacaaatcacagtaaaacaagcaaacttcagactgccttcagaactgtgaattgcttttattggtttgatgcacagcaaaatacctggtttccaaagaccccaatgctttttgtccgcataaagccatctttggtttgctgtgaaggctatatctatgcaattggaggagatagcgtaggtggagaacttaatcggaggaccgtagaaagatacgacactgagaaagatgagtggacgatggtaagccctttaccttgtgcttggcaatggagtgcagcagttgtggttcatgactgcatttatgtgatgacactgaacctcatgtactgttattttccaaggtctgactcatgggtagaaatggccatgagacagactagtaggtcctttgcttcagctgcagcttttggtgataaaattttctatattggagggttgcatattgctaccaattccggcataagactcccctctggcactgtagatgggtcttcagtaactgtggaaatttatgatgtgaataaaaatgagtggaaaatggcagccaacatccctgctaagaggtactctgacccctgtgttagagctgttgtgatctcaaattctctatgtgtgtttatgcgagaaacccacttaaatgagcgagctaaatacgtcacctaccaatatgacctggaacttgaccggtggtctctgcggcagcatatatctgaacgtgtactgtgggacttggggagagattttcgatgcactgtggggaaactctatccatcctgccttgaagagtctccatggaaaccaccaacttatcttttttcaacggatgggacagaagagtttgaactggatggagaaatggttgcactaccacctgtatagtggggaagttcagggagtgcacgcctgagttatgtgctttgtcattttctttgctaaacaaaagaggctatgaaagaactaaatatgagtacataaaattctatctttgataaattttatttttatgccctacttaatatttgcatcagtataatatatatcagtgagtcttacagaaagatatgcttccataatatgaaatagattattcaataattgagaaactttatgtgtaatcatgagagtataagaatctggattatctaacattgttagccctgtgtatgtacagttcaaaaagttcatttataaaagtagtttcctaaaaaaaaaaaaaaaaaaatataaaaaaagataataaaaaatagaaaaaaaaaatgagtaataaaaaaaaaaaggggggggggggaaaaaaaatattccgggggggggcaattttggcaccccgttttttttaaaaagggggccccctgtgggggccgccataaaaaaacgggacgagcgggggggcttatacacacggtctggggggagaacacgccctgcgggcttctcgtggggagccgccactcggtgccggcgcagcactggcgacccaccccaagagataagagcgagcggggcaaaaagcggtgtggggtaaccgcctatctccgggcgaaatgtcggttatgtctccccagtcaactcactgatgtaacagtcatacgcgaccatcaggcacaacaccacgacgacagccaccaacac

SEQ ID NO: 417641 - DNA, 987 bp, Homo sapiens
ggtcgggccctgaggagcgtgcggcggcgcccgcagaggacgctgctttccgcgctggacggaccaagcgagggagggtgcgaggggaaaccggaaggaagaggcggcggcgccagccttcctcggccggaggcggaggcgagaccccaggcgaggccgcggcgggagggccacgcccccgccgccgcgccggaggggcccagtgtggacggggccaccggctggagcggatcccacacctccggaccgagggacgcggttactccacaggatccgctgaacataggatgttgccacaaaatctacctcgtgtatttttctctttcactcatgagctgcacaattgcagatttgagcacaatgtctgcagactgtgttgaaaaactctgaagaacctaattaacacaggatgacctaggagtgattctaagtctgtgtaacaagatattactcattagtgaatgtgtcagtcttggtactgaatgctgcagataacagcaagtaggttctcctttatttctgaagtattcacttgaccttccatcagtaagacggacttttctaatctgttcctggagatattaatggaatacagtcatgtccactcaagacgagaggcagatcaatactgaatatgctgtgtcattgttggaacagttgaaactgttttatgaacagcagttgtttactgacatagtgttaattgttgagggcactgaattcccttgtcataagatggttcttgcaacatgtagctcttatttcagggccatgtttatgagtggactaagtgaaagcaaacaaacccatgtacacctgaggaatgtcgatgctgccaccttacagataataataacttatgcatacacgggtaacttggcaatgaatgacagcactgtagaacagctttatgaaacagcttgcttcctacaggtagaagatgtgttacaacgttgtcgagaatatttaattaaaaaaataaatgca

SEQ ID NO: 417642 - DNA, 3641 bp, Homo sapiens
ggtcgggccctgaggagcgtgcggcggcgcccgcagaggacgctgctttccgcgctggacggaccaagcgagggagggtgcgaggggaaaccggaaggaagaggcggcggcgccagccttcctcggccggaggcggaggcgagaccccaggcgaggccgcggcgggagggccacgcccccgccgccgcgccggaggggcccagtgtggacggggccaccggctggagcggatcccacacctccggaccgagggacgcggttactccacaggatccgctgaacataggatgttgccacaaaatctacctcgtgtatttttctctttcactcatgagctgcacaattgcagatttgagcacaatgtctgcagactgtgttgaaaaactctgaagaacctaattaacacaggatgacctaggagtgattctaagtctgtgtaacaagatattactcattagtgaatgtgtcagtcttggtactgaatgctgcagataacagcaagtaggttctcctttatttctgaagtattcacttgaccttccatcagtaagacggacttttctaatctgttcctggagatattaatggaatacagtcatgtccactcaagacgagaggcagatcaatactgaatatgctgtgtcattgttggaacagttgaaactgttttatgaacagcagttgtttactgacatagtgttaattgttgagggcactgaattcccttgtcataagatggttcttgcaacatgtagctcttatttcagggccatgtttatgagtggactaagtgaaagcaaacaaacccatgtacacctgaggaatgtcgatgctgccaccttacagataataataacttatgcatacacgggtaacttggcaatgaatgacagcactgtagaacagctttatgaaacagcttgcttcctacaggtagaagatgtgttacaacgttgtcgagaatatttaattaaaaaaataaatgcagagaattgtgtacgattgttgagttttgctgatctcttcagttgtgaggaattaaaacagagtgctaaaagaatggtggagcacaagttcactgctgtgtatcatcaggacgcgttcatgcagctgtcacatgacctactgatagatattctcagtagtgacaatttaaatgtagaaaaggaagaaaccgttcgagaagctgctatgctgtggctagagtataacacagaatcacgatcccagtatttgtcttctgttcttagccaaatcagaattgatgcactttcagaagtaacacagagagcttggtttcaaggtctgccacccaatgataagtcagtggtggttcaaggtctgtataagtccatgcccaagtttttcaaaccaagacttgggatgactaaagaggaaatgatgattttcattgaagcatcttcagaaaatccttgtagtctttactcttctgtctgttacagcccccaagcagaaaaagtttacaagttatgtagcccaccagctgatttgcataaggttgggaccgttgtaactcctgataatgatatctacatagcagggggtcaagttcctctgaaaaacacaaaaacaaatcacagtaaaacaagcaaacttcagactgccttcagaactgtgaattgcttttattggtttgatgcacagcaaaatacctggtttccaaagaccccaatgctttttgtccgcataaagccatctttggtttgctgtgaaggctatatctatgcaattggaggagatagcgtaggtggagaacttaatcggaggaccgtagaaagatacgacactgagaaagatgagtggacgatggtaagccctttaccttgtgcttggcaatggagtgcagcagttgtggttcatgactgcatttatgtgatgacactgaacctcatgtactgttattttccaaggtctgactcatgggtagaaatggccatgagacagactagtaggtcctttgcttcagctgcagcttttggtgataaaattttctatattggagggttgcatattgctaccaattccggcataagactcccctctggcactgtagatgggtcttcagtaactgtggaaatttatgatgtgaataaaaatgagtggaaaatggcagccaacatccctgctaagaggtactctgacccctgtgttagagctgttgtgatctcaaattctctatgtgtgtttatgcgagaaacccacttaaatgagcgagctaaatacgtcacctaccaatatgacctggaacttgaccggtggtctctgcggcagcatatatctgaacgtgtactgtgggacttggggagagattttcgatgcactgtggggaaactctatccatcctgccttgaagagtctccatggaaaccaccaacttatcttttttcaacggatgggacagaagagtttgaactggatggagaaatggttgcactaccacctgtatagtggggaagttcagggagtgcacgcctgagttatgtgctttgtcattttctttgctaaacaaaagaggctatgaaagaactaaatatgagtacataaaattctatctttgataaattttatttttatgccctacttaatatttgcatcagtataatatatatcagtgagtcttacagaaagatatgcttccataatatgaaatagattattcaataattgagaaactttatgtgtaatcatgagagtataagaatctggattatctaacattgttagccctgtgtatgtacagttcaaaaagttcatttataaaagtagtttcctgttcctagtgtgatgtatcacaaattgtgctgaggttattttagtatgtgtgtttcattcccgtgcttctgttctgaagtcctggaatacagttttcagtgtaattaattcaactgcacttaacactaatgtccgtgttggtatagaaatgtctaaatcctatactctagttgaggaagatcttccataattttatggtattacacagggaaagctatgactgcaggatcagtctaactatactattaggtgcatgtattctcttttcactaacttatacttgtctatctagaatacaggtcttccagtcagctggtcatttaccaggtgtggacttaagttgctgggcttgcagtaagaattgccagccactcattgtgcgggtctgcgtggagctttaatcagaaaaagcctccactttctgtattatgttaacattggctcatgcatataactatctgctgctgatgtagttctccatcttcaagatttagagtgggttaaccaggtcattacatcttaatttaataacaagcattactgtagagtgattgtgtatagatctgttagctgtcagggtgtgttttttttaacctgttgtgtgcgtgtgggggttaggattagtaaggtgaactgttcaggaattctctgcactagctgtgcagaagagcagataactagcgctgctctggcattaatcccaggaaccactagcagtagtgggcgccgccaatctaacatgagcacaggtgcttcatgacaaacattactagcatgttcaactgcaccatgttctggcactgtattttgaatgacattaatttattaaataaattgtatatattcaa

SEQ ID NO: 417643 - DNA, 2773 bp, Homo sapiens
gctctggaaatagtcaccaggagagtgatttccatggggaaaattttaaataagaatgcacatgggacaggcaatagaaagtttgccaagttaaatttggtacataattgtgttcactccatatcccaacaaagcatgtgtgcgatcagttggtcgctcctgctgccgcctcagtatggcttgtagtaatcctgatttccaccctgccatggcaaggtggaaatcaggacgcgttcatgcagctgtcacatgacctactgatagatattctcagtagtgacaatttaaatgtagaaaaggaagaaaccgttcgagaagctgctatgctgtggctagagtataacacagaatcacgatcccagtatttgtcttctgttcttagccaaatcagaattgatgcactttcagaagtaacacagagagcttggtttcaaggtctgccacccaatgataagtcagtggtggttcaaggtctgtataagtccatgcccaagtttttcaaaccaagacttgggatgactaaagaggaaatgatgattttcattgaagcatcttcagaaaatccttgtagtctttactcttctgtctgttacagcccccaagcagaaaaagtttacaagttatgtagcccaccagctgatttgcataaggttgggaccgttgtaactcctgataatgatatctacatagcagggggtcaagttcctctgaaaaacacaaaaacaaatcacagtaaaacaagcaaacttcagactgccttcagaactgtgaattgcttttattggtttgatgcacagcaaaatacctggtttccaaagaccccaatgctttttgtccgcataaagccatctttggtttgctgtgaaggctatatctatgcaattggaggagatagcgtaggtggagaacttaatcggaggaccgtagaaagatacgacactgagaaagatgagtggacgatggtaagccctttaccttgtgcttggcaatggagtgcagcagttgtggttcatgactgcatttatgtgatgacactgaacctcatgtactgttattttccaaggtctgactcatgggtagaaatggccatgagacagactagtaggtcctttgcttcagctgcagcttttggtgataaaattttctatattggagggttgcatattgctaccaattccggcataagactcccctctggcactgtagatgggtcttcagtaactgtggaaatttatgatgtgaataaaaatgagtggaaaatggcagccaacatccctgctaagaggtactctgacccctgtgttagagctgttgtgatctcaaattctctatgtgtgtttatgcgagaaacccacttaaatgagcgagctaaatacgtcacctaccaatatgacctggaacttgaccggtggtctctgcggcagcatatatctgaacgtgtactgtgggacttggggagagattttcgatgcactgtggggaaactctatccatcctgccttgaagagtctccatggaaaccaccaacttatcttttttcaacggatgggacagaagagtttgaactggatggagaaatggttgcactaccacctgtatagtggggaagttcagggagtgcacgcctgagttatgtgctttgtcattttctttgctaaacaaaagaggctatgaaagaactaaatatgagtacataaaattctatctttgataaattttatttttatgccctacttaatatttgcatcagtataatatatatcagtgagtcttacagaaagatatgcttccataatatgaaatagattattcaataattgagaaactttatgtgtaatcatgagagtataagaatctggattatctaacattgttagccctgtgtatgtacagttcaaaaagttcatttataaaagtagtttcctgttcctagtgtgatgtatcacaaattgtgctgaggttattttagtatgtgtgtttcattcccgtgcttctgttctgaagtcctggaatacagttttcagtgtaattaattcaactgcacttaacactaatgtccgtgttggtatagaaatgtctaaatcctatactctagttgaggaagatcttccataattttatggtattacacagggaaagctatgactgcaggatcagtctaactatactattaggtgcatgtattctcttttcactaacttatacttgtctatctagaatacaggtcttccagtcagctggtcatttaccaggtgtggacttaagttgctgggcttgcagtaagaattgccagccactcattgtgcgggtctgcgtggagctttaatcagaaaaagcctccactttctgtattatgttaacattggctcatgcatataactatctgctgctgatgtagttctccatcttcaagatttagagtgggttaaccaggtcattacatcttaatttaataacaagcattactgtagagtgattgtgtatagatctgttagctgtcagggtgtgttttttttaacctgttgtgtgcgtgtgggggttaggattagtaaggtgaactgttcaggaattctctgcactagctgtgcagaagagcagataactagcgctgctctggcattaatcccaggaaccactagcagtagtgggcgccgccaatctaacatgagcacaggtgcttcatgacaaacattactagcatgttcaactgcaccatgttctggcactgtattttgaatgacattaatttattaaataaattgtatatattcaa

SEQ ID NO: 417644 - DNA, 4314 bp, Homo sapiens
ggtcgggccctgaggagcgtgcggcggcgcccgcagaggacgctgctttccgcgctggacggaccaagcgagggagggtgcgaggggaaaccggaaggaagaggcggcggcgccagccttcctcggccggaggcggaggcgagaccccaggcgaggccgcggcgggagggccacgcccccgccgccgcgccggaggggcccagtgtggacggggccaccggctggagcggatcccacacctccggaccgagggacgcggttactccacaggatccgctgaacataggatgttgccacaaaatctacctcgtgtatttttctctttcactcatgagctgcacaattgcagatttgagcacaatgtctgcagactgtgttgaaaaactctgaagaacctaattaacacaggatgacctaggagtgattctaagtctgtgtaacaagatattactcattagtgaatgtgtcagtcttggtactgaatgctgcagataacagcaagtaggttctcctttatttctgaagtattcacttgaccttccatcagtaagacggacttttctaatctgttcctggagatattaatggaatacagtcatgtccactcaagacgagaggcagatcaatactgaatatgctgtgtcattgttggaacagttgaaactgttttatgaacagcagttgtttactgacatagtgttaattgttgagggcactgaattcccttgtcataagatggttcttgcaacatgtagctcttatttcagggccatgtttatgagtggactaagtgaaagcaaacaaacccatgtacacctgaggaatgtcgatgctgccaccttacagataataataacttatgcatacacgggtaacttggcaatgaatgacagcactgtagaacagctttatgaaacagcttgcttcctacaggtagaagatgtgttacaacgttgtcgagaatatttaattaaaaaaataaatgcagagaattgtgtacgattgttgagttttgctgatctcttcagttgtgaggaattaaaacagagtgctaaaagaatggtggagcacaagttcactgctgtgtatcatcaggacgcgttcatgcagctgtcacatgacctactgatagatattctcagtagtgacaatttaaatgtagaaaaggaagaaaccgttcgagaagctgctatgctgtggctagagtataacacagaatcacgatcccagtatttgtcttctgttcttagccaaatcagaattgatgcactttcagaagtaacacagagagcttggtttcaaggtctgccacccaatgataagtcagtggtggttcaaggtctgtataagtccatgcccaagtttttcaaaccaagacttgggatgactaaagaggaaatgatgattttcattgaagcatcttcagaaaatccttgtagtctttactcttctgtctgttacagcccccaagcagaaaaagtttacaagttatgtagcccaccagctgatttgcataaggttgggaccgttgtaactcctgataatgatatctacatagcagggggtcaagttcctctgaaaaacacaaaaacaaatcacagtaaaacaagcaaacttcagactgccttcagaactgtgaattgcttttattggtttgatgcacagcaaaatacctggtttccaaagaccccaatgctttttgtccgcataaagccatctttggtttgctgtgaaggctatatctatgcaattggaggagatagcgtaggtggagaacttaatcggaggaccgtagaaagatacgacactgagaaagatgagtggacgatggtaagccctttaccttgtgcttggcaatggagtgcagcagttgtggttcatgactgcatttatgtgatgacactgaacctcatgtactgttattttccaaggtctgactcatgggtagaaatggccatgagacagactagtaggtcctttgcttcagctgcagcttttggtgataaaattttctatattggagggttgcatattgctaccaattccggcataagactcccctctggcactgtagatgggtcttcagtaactgtggaaatttatgatgtgaataaaaatgagtggaaaatggcagccaacatccctgctaagaggtactctgacccctgtgttagagctgttgtgatctcaaattctctatgtgtgtttatgcgagaaacccacttaaatgagcgagctaaatacgtcacctaccaatatgacctggaacttgaccggtggtctctgcggcagcatatatctgaacgtgtactgtgggacttggggagagattttcgatgcactgtggggaaactctatccatcctgccttgaagagtctccatggaaaccaccaacttatcttttttcaacggatgggacagaagagtttgaactggatggagaaatggttgcactaccacctgtatagtggggaagttcagggagtgcacgcctgagttatgtgctttgtcattttctttgctaaacaaaagaggctatgaaagaactaaatatgagtacataaaattctatctttgataaattttatttttatgccctacttaatatttgcatcagtataatatatatcagtgagtcttacagaaagatatgcttccataatatgaaatagattattcaataattgagaaactttatgtgtaatcatgagagtataagaatctggattatctaacattgttagccctgtgtatgtacagttcaaaaagttcatttataaaagtagtttcctgttcctagtgtgatgtatcacaaattgtgctgaggttattttagtatgtgtgtttcattcccgtgcttctgttctgaagtcctggaatacagttttcagtgtaattaattcaactgcacttaacactaatgtccgtgttggtatagaaatgtctaaatcctatactctagttgaggaagatcttccataattttatggtattacacagggaaagctatgactgcaggatcagtctaactatactattaggtgcatgtattctcttttcactaacttatacttgtctatctagaatacaggtcttccagtcagctggtcatttaccaggtgtggacttaagttgctgggcttgcagtaagaattgccagccactcattgtgcgggtctgcgtggagctttaatcagaaaaagcctccactttctgtattatgttaacattggctcatgcatataactatctgctgctgatgtagttctccatcttcaagatttagagtgggttaaccaggtcattacatcttaatttaataacaagcattactgtagagtgattgtgtatagatctgttagctggtgtgggggttaggattagtaaggtgaactgttcaggaattctctgcactagctgtgcagaagagcagataactagcgctgctctggcattaatcccaggaaccactagcagtagtgggcgccgccaatctaacatgagcacaggtgcttcatgacaaacattactagcatgttcaactgcaccatgttctggcactgtattttgaatgacattaatttattaaataaattgtatatattcaatatctatttttcttttgttatgggaatggtctgctttttaaattttgattttgctaggtcaaacttagctagtaataggtggtttcttccaaattttgtttgatgaagattgagagatatgcataggctttccttaggctagtgtctttctaccctgctggcatgttagaatcatctgattctgatcatcatctttagaagcttgagatgatgcctgaacctcaccccaaacaaaatggtttctttttagagcacatcattgatcatgtttatagacttgaactgcccctccactgcctactgaatgaagtccagattccttaccacatttaaggctctctctaatttggctttaaattacctttacagccctaccttgcattgtttttccataagccttatcttctgattaggctttcgctatgctttatgcttttttatgctattcatgctactcagaatggtttcttcatcccaactttacttgcagctgtctcaagagctatttaaggcagtttttaaagaatgtttcctgataaccatgtcttaccatgaggtgaaaagtatcctttctcacatttttactaccttgtacctagatcttattaattgtactgatcattctattgactattactagttttggccaggtggggtggcttatgcctgtaatcccagcactttgggaggcctaagtgggaggaa

SEQ ID NO: 417645 - DNA, 2842 bp, Homo sapiens
ggtcgggccctgaggagcgtgcggcggcgcccgcagaggacgctgctttccgcgctggacggaccaagcgagggagggtgcgaggggaaaccggaaggaagaggcggcggcgccagccttcctcggccggaggcggaggcgagaccccaggcgaggccgcggcgggagggccacgcccccgccgccgcgccggaggggcccagtgtggacggggccaccggctggagcggatcccacacctccggaccgagggacgcggttactccacaggatccgctgaacataggatgttgccacaaaatctacctcgtgtatttttctctttcactcatgagctgcacaattgcagatttgagcacaatgtctgcagactgtgttgaaaaactctgaagaacctaattaacacaggatgacctaggagtgattctaagtctgtgtaacaagatattactcattagtgaatgtgtcagtcttggtactgaatgctgcagataacagcaagtaggttctcctttatttctgaagtattcacttgaccttccatcagtaagacggacttttctaatctgttcctggagatattaatggaatacagtcatgtccactcaagacgagaggcagatcaatactgaatatgctgtgtcattgttggaacagttgaaactgttttatgaacagcagttgtttactgacatagtgttaattgttgagggcactgaattcccttgtcataagatggttcttgcaacatgtagctcttatttcagggccatgtttatgagtggactaagtgaaagcaaacaaacccatgtacacctgaggaatgtcgatgctgccaccttacagataataataacttatgcatacacgggtaacttggcaatgaatgacagcactgtagaacagctttatgaaacagcttgcttcctacaggtagaagatgtgttacaacgttgtcgagaatatttaattaaaaaaataaatgcagagaattgtgtacgattgttgagttttgctgatctcttcagttgtgaggaattaaaacagagtgctaaaagaatggtggagcacaagttcactgctgtgtatcatcaggacgcgttcatgcagctgtcacatgacctactgatagatattctcagtagtgacaatttaaatgtagaaaaggaagaaaccgttcgagaagctgctatgctgtggctagagtataacacagaatcacgatcccagtatttgtcttctgttcttagccaaatcagaattgatgcactttcagaagtaacacagagagcttggtttcaaggtctgccacccaatgataagtcagtggtggttcaaggtctgtataagtccatgcccaagtttttcaaaccaagacttgggatgactaaagaggaaatgatgattttcattgaagcatcttcagaaaatccttgtagtctttactcttctgtctgttacagcccccaagcagaaaaagtttacaagttatgtagcccaccagctgatttgcataaggttgggaccgttgtaactcctgataatgatatctacatagcagggggtcaagttcctctgaaaaacacaaaaacaaatcacagtaaaacaagcaaacttcagactgccttcagaactgtgaattgcttttattggtttgatgcacagcaaaatacctggtttccaaagaccccaatgctttttgtccgcataaagccatctttggtttgctgtgaaggctatatctatgcaattggaggagatagcgtaggtggagaacttaatcggaggaccgtagaaagatacgacactgagaaagatgagtggacgatggtaagccctttaccttgtgcttggcaatggagtgcagcagttgtggttcatgactgcatttatgtgatgacactgaacctcatgtactgttattttccaaggtctgactcatgggtagaaatggccatgagacagactagtaggtcctttgcttcagctgcagcttttggtgataaaattttctatattggagggttgcatattgctaccaattccggcataagactcccctctggcactgtagatgggtcttcagtaactgtggaaatttatgatgtgaataaaaatgagtggaaaatggcagccaacatccctgctaagaggtactctgacccctgtgttagagctgttgtgatctcaaattctctatgtgtgtttatgcgagaaacccacttaaatgagcgagctaaatacgtcacctaccaatatgacctggaacttgaccggtggtctctgcggcagcatatatctgaacgtgtactgtgggacttggggagagattttcgatgcactgtggggaaactctatccatcctgccttgaagagtctccatggaaaccaccaacttatcttttttcaacggatgggacagaagagtttgaactggatggagaaatggttgcactaccacctgtatagtggggaagttcagggagtgcacgcctgagttatgtgctttgtcattttctttgctaaacaaaagaggctatgaaagaactaaatatgagtacataaaattctatctttgataaattttatttttatgccctacttaatatttgcatcagtataatatatatcagtgagtcttacagaaagatatgcttccataatatgaaatagattattcaataattgagaaactttatgtgtaatcatgagagtataagaatctggattatctaacattgttagccctgtgtatgtacagttcaaaaagttcatttataaaagtagtttcctgttcctagtgtgatgtatcacaaaaaaaaaagtcgacgcggccgcgaat

SEQ ID NO: 417646 - DNA, 1448 bp, Homo sapiens
ggtcgggccctgaggagcgtgcggcggcgcccgcagaggacgctgctttccgcgctggacggaccaagcgagggagggtgcgaggggaaaccggaaggaagaggcggcggcgccagccttcctcggccggaggcggaggcgagaccccaggcgaggccgcggcgggagggccacgcccccgccgccgcgccggaggggcccagtgtggacggggccaccggctggagcggatcccacacctccggaccgagggacgcggttactccacaggatccgctgaacataggatgttgccacaaaatctacctcgtgtatttttctctttcactcatgagctgcacaattgcagatttgagcacaatgtctgcagactgtgttgaaaaactctgaagaacctaattaacacaggatgacctaggagtgattctaagtctgtgtaacaagatattactcattagtgaatgtgtcagtcttggtactgaatgctgcagataacagcaagtaggttctcctttatttctgaagtattcacttgaccttccatcagtaagacggacttttctaatctgttcctggagatattaatggaatacagtcatgtccactcaagacgagaggcagatcaatactgaatatgctgtgtcattgttggaacagttgaaactgttttatgaacagcagttgtttactgacatagtgttaattgttgagggcactgaattcccttgtcataagatggttcttgcaacatgtagctcttatttcagggccatgtttatgagtggactaagtgaaagcaaacaaacccatgtacacctgaggaatgtcgatgctgccaccttacagataataataacttatgcatacacgggtaacttggcaatgaatgacagcactgtagaacagctttatgaaacagcttgcttcctacaggtaagcatatatatatttttttagacggagtctctctctgttgcccaggctggagtgcagtggcacgatctccgctcactgcaacctccgcctcccaggttcaagtgattctcctgcctcagcctcctgagtagctgggattacaggtgctaatttttgtatttttagtacggggtttcaccatgttggtcaggctggtcttgatctcctgacctcgtgatccacctgccttggcctcccaaagtgctgggattacacgcgtgagccactgtgtccagcctacaggtaagcatttttttactcagttacatacatgagttgtagcttattggtttattatgtggtttattttgtgaggaaacattgttaaacataaccactcatgcatctgcacaggggcacgacggacaccaagcggaaagcatggtgcagcccgggcacagaaagcagaaccaggcgcaaggaacccagtaaacacagaaacggcgccaaggggccccagccaccaaacagaa

SEQ ID NO: 417647 - DNA, 406 bp, Homo sapiens
ctcgccccgcaccttccccgcctatgcccctcgctgagataggcccttccctcctccgggagcctcccgggccacgcgaccctcaacttctccagccgctccacccacgcttcctggaccgcctcctgcaggcgaggctcacatccagcactgtcccttacagtcgccatgcccctggcgacctcagtgtcccactctgtacggggacaatgcaaatccctttgcctcatagggtgcatgtgccagtgttgataaagtgctggccacaggccctgccttcccagggctcacaacactgtgtccctgacacacccgtgggctgtagtgattctcttcatggggatttgactataacccgcagtcaggaatgatttcacaccatagctcagtacatacacacatatct

SEQ ID NO: 417648 - DNA, 1181 bp, Homo sapiens
tttctctgtcagttcatattcattatacatatagatttctgaccattcagttatattgaagtcctactgtgggctgggcatggtggctcacgcctgtaaccccagcactttgggaggccaaggtgggcagatcacctgaggtcaggagttcaagaccaacagtctgggagacagagtgagactgtttcaaaaagaaaaaaaaagaaaagaaaaacagaaaaataaagtagggtaagaaggataaagaatactggtgaagggaattatgatatattgatgtcttataaaaggagggaaagcctgtctgataaggtgatatttgagcaaagaactgaaggaattgagaaagtgagccatttatacatccagggaagagcatgccaagcttcaagtgcagtgacaaattcaaaggaacttgtcatgtttaaggaatagtaaggaaattagtaaggttacactagagtgaaggaaggggcatatgataagaaaagagctcacagagatagttatggagaacagaggccttaagaccatgtgggcagtagtgaggatttggcattttattcccagtgagagaggaagccattttcatgagagatttgacaggatctcacttaaaatttaaaagtaatcaggccaggcacgatggctcatgcccggtaatcccagcaccttgggaggccaaggtgggaggactgcttgaaccctggagttcaagactagcctgggcaacatagggagagtgtgtgtctgcaaaaaaaaaaaaattctaggcatggtggtgtgttgactgtagttccagctactccagaggctgaggtgggaggattggttgagcctgggtggatgaggctgcagtgacccatgatcatgcatgggagacagagcaagaccttgtctcaagaaaggaaagaaatcactggctcttctgtaaaaaatgatctgttaagagtaattgaaaaactaaatacaagtaataaaataatctttcatttaagaaatactaccaaaattaagatggagatctagcaaaaagtcaaaagcagctgggcgtggtggctcacacctgtaatccctacaccttggggaggctgaggcgggaggatcacctgaggtcaggagttcgagaccagcctggccaacagagccaaagtctctactgaaaatacaaaaattagctt

SEQ ID NO: 417649 - DNA, 495 bp, Homo sapiens
tctatattacatttttaagaattgcttatttttcaatttttctagtatttcttgtatattctaccacaggtgaacaactcattttttgggtgacatttttagagcttgcttgaggggcactagaaagaagggcagtaatgtgatgtgaatgtttcagcttatgaaaacagctgtgctctactttaagaaatttgacatttaaaagtgtaagattgcaaaacaaattaattactagttggttatattatgtgagaattttaaaaaagggattcactaaaagttgttttcaaatacttaatccctttaaatggtatttatctaatgtgatttgatttgtgaataatcagttggcatacaacaatttaggaacagatttttggcatatgtaagggttatcagtgtgttctttgagttctctctttaccaaaagtatttggggacaaagttaaattcagtgttgttccacttatatgccacctataatggtttaactga

SEQ ID NO: 417650 - DNA, 3266 bp, Homo sapiens
  misc_feature (156)..(156): n is a, c, g, or t
ggtgatgagcccttgggttctcgctccgactgctaaattcgcttggccgggtccaccttctcgtggcctcactcgccacacggatcagaatccggagcaggcagttctctctattctgaggctcctgcggctgccgcgctgacttccctgtgtggnggagggaactctgggcaggctggttttcttggaatgtgtttacgatgttgaatgggacttgaacaggaagctggacgctgcagctggaactagcgtgccaagttatttatgattccatctgatatacataggagagaaactgatagaagaattctgatggcaactgtatgatagaagctatataaagtcaagtgtccattttctttcaactatatttgagcatacccaggatttaagtcgtggaactgaacatttatttggctgatcctcatcatgaaccgtgcttttagcaggaagaaagacaaaacatggatgcatacacctgaagctttatcaaaacatttcattccctataatgcaaagtttcttggcagtacagaagtggaacagccaaaaggaacagaagttgtgagagatgctgtaaggaaactaaagtttgcaagacatatcaagaaatctgaaggccagaaaattcctaaagtggagttgcaaatatcaatttatggagtaaaaattctagaacccaaaacaaaggaagttcaacacaattgccagcttcatagaatatctttttgtgcagatgataaaactgacaagaggatattcactttcatatgcaaagattctgagtcaaataaacatttgtgctatgtatttgacagcgaaaagtgtgctgaagagatcactttaacaattggccaagcatttgacctggcatacaggaaatttctagaatcaggaggaaaagatgttgaaacaagaaaacagatcgcagggttacaaaaaagaatccaagacttagaaacagaaaatatggaacttaaaaataaagtacaagatttggaaaaccaactgagaataactcaagtatcagcacctccagcaggcagtatgacacctaagtcgccctccactgacatctttgatatgattccattttctccaatatcacaccagtcttcgatgcctactcgcaatggcacacagccacctccagtacctagtagatctactgagattaaacgggacctgtttggagcagaaccttttgacccatttaactgtggagcagcagatttccctccagatattcaatcaaaattagatgagatgcaggaggggttcaaaatgggactaactcttgaaggcacagtattttgtctcgacccgttagacagtaggtgctgacatcaagaacaagaaatcctgattcatgttaaatgtgtttgtatacacatgtcatttattattattactttaagataggtattattcatgtgtcaatgtttttgaatattttaatattttgaaaattttctcagttaaatttcctcaccttcactattgatctgtaatttttattttaaaaacagcttactgtaaagtagatcatacttttatgttcctttctgtttctactgtagatgaatttgtaattgaaagacatattatacaaatacctgccttgtgtctgagttctatttagttagcatcttgaaatttgtattcattttccagatggctagtttattaatgatttcccaaaagccataccttaaagataactttttaaattctgaagagacatgccaatgtcaaactaaacatgttctgtttttaaaccaacaaacatgttactattcattggacagatatcattttatgtataaatactgttcacatcactgggaaaatgtaaactttaaacataatgccacaaggtcactaatttctagcaggtaaaattataaggatataaattccaataataaaccaaatgtatttagagtatttattagtaaatgcaaggtgatgttagttatgatcagttatactctaaatatttaatttgttttataaaggtagtgaaaaaatgaaaatttgctatttattaaaaaacattaaatttcattccaaatgagataagtgatattactataacatctaagcatcatctgatttgatattccctaaaaaacatttggaatatatgctatctatagattcagtatctactacccatatttactttaccaaatatatttctcctcactgcataaggactactcttctcatattttcttctttgatgaagatatttttcaccaaagtttattttgtgatgccctcttggttttgatactttaaaatctgtggcacccgttctacatgaattatcaatatttggtaaattcaatctgtatttgttttgttaaagtcaaaaatctcattttccaaaaaaaaaaaaaaacccagttacggctcagtttagtctggaacttgagcaataaaattctctggcattccattattgatgtgctgatgaaccgggacttttaaaaatatttgtgttcctatacctttaccctttacctaacagactaatttgtactcagtaaaacaaaaatttatggtcaaaatttctaacttggttccatcacatttataagataaataaattaaattaatgaaaatgtgacttagagtaggggtagccctcaaaaatagatttatcatttactcattggaattttcttcaagtgttaaaggtacattttcactaggaaaagaaatcaaatatgcttatgcaatatatatttgtgtgtttttccttaatgttatatggtatatatgagccttcttgtttagtttcttttatctgctaagttgtaccttaattagagggcaatatatgtttcataaagaagagtctttataattttgtttgtcagatagtattttggaatttgtataataaggatgtttagaagccatataagtggctttttttaacagatagaatttgtatttttattgtactttaaaaagatttatgtaataggtatatatttagtggccatttattatcaatggtaacacaatggagtactaagatggtatttgcacatttaagatatgttactttaccaatttttaatggtaatcaactctgctactggcatgatgaaatagtacataactggtcattaattatgaacatttacttctccagtgcgtttttatgaagatctggttgaaaattgtatttctatgtaaactcaacgatatgtttggttttcctgaaaataaatgattttaaataaattaaa

SEQ ID NO: 417651 - DNA, 3584 bp, Homo sapiens
agactgagctcagtagccaggcatgaaagagactgggcaagttgcaggggctaattggaaaggggctgtcggttgcacttggggtttaaacaagaggtttcttttgcaatgagaatttttaggtggctaagatcagtcttcttggcaaaaaaataaactaagcatagagtgcagttggatatgaccgaggaaattacaaaaagggctccaggagcaaagtctgagctttccttatcagtgttgcagtggaatagctgggggcctgatgctgtttgtgctgatcatactttgcaaatgcccacactttgttgctgtttgtctccttggacgaggtttgctgcaacttcaattccttgacttcggccttactttgttttcatagcagcaagaattgaagacttaagggtttgagcagatggttttctacctaaattgaataattcaattacgtattctcaactagcatggatttgggtcatggaattaaagtagaaacgtatccggcatgacttctttgtgcttatcaaaagtgatcctgataaacagatcttgctctttcatgtaaagaagtaaaagttatttatgattccatctgatatacataggagagaaactgatagaagaattctgatggcaactgtatgatagaagctatataaagtcaagtgtccattttctttcaactatatttgagcatacccaggatttaagtcgtggaactgaacatttatttggctgatcctcatcatgaaccgtgcttttagcaggaagaaagacaaaacatggatgcatacacctgaagctttatcaaaacatttcattccctataatgcaaagtttcttggcagtacagaagtggaacagccaaaaggaacagaagttgtgagagatgctgtaaggaaactaaagtttgcaagacatatcaagaaatctgaaggccagaaaattcctaaagtggagttgcaaatatcaatttatggagtaaaaattctagaacccaaaacaaaggaagttcaacacaattgccagcttcatagaatatctttttgtgcagatgataaaactgacaagaggatattcactttcatatgcaaagattctgagtcaaataaacatttgtgctatgtatttgacagcgaaaagtgtgctgaagagatcactttaacaattggccaagcatttgacctggcatacaggaaatttctagaatcaggaggaaaagatgttgaaacaagaaaacagatcgcagggttacaaaaaagaatccaagacttagaaacagaaaatatggaacttaaaaataaagtacaagatttggaaaaccaactgagaataactcaagtatcagcacctccagcaggcagtatgacacctaagtcgccctccactgacatctttgatatgattccattttctccaatatcacaccagtcttcgatgcctactcgcaatggcacacagccacctccagtacctagtagatctactgagattaaacgggacctgtttggagcagaaccttttgacccatttaactgtggagcagcagatttccctccagatattcaatcaaaattagatgagatgcaggaggggttcaaaatgggactaactcttgaaggcacagtattttgtctcgacccgttagacagtaggtgctgacatcaagaacaagaaatcctgattcatgttaaatgtgtttgtatacacatgtcatttattattattactttaagataggtattattcatgtgtcaatgtttttgaatattttaatattttgaaaattttctcagttaaatttcctcaccttcactattgatctgtaatttttattttaaaaacagcttactgtaaagtagatcatacttttatgttcctttctgtttctactgtagatgaatttgtaattgaaagacatattatacaaatacctgccttgtgtctgagttctatttagttagcatcttgaaatttgtattcattttccagatggctagtttattaatgatttcccaaaagccataccttaaagataactttttaaattctgaagagacatgccaatgtcaaactaaacatgttctgtttttaaaccaacaaacatgttactattcattggacagatatcattttatgtataaatactgttcacatcactgggaaaatgtaaactttaaacataatgccacaaggtcactaatttctagcaggtaaaattataaggatataaattccaataataaaccaaatgtatttagagtatttattagtaaatgcaaggtgatgttagttatgatcagttatactctaaatatttaatttgttttataaaggtagtgaaaaaatgaaaatttgctatttattaaaaaacattaaatttcattccaaatgagataagtgatattactataacatctaagcatcatctgatttgatattccctaaaaaacatttggaatatatgctatctatagattcagtatctactacccatatttactttaccaaatatatttctcctcactgcataaggactactcttctcatattttcttctttgatgaagatatttttcaccaaagtttattttgtgatgccctcttggttttgatactttaaaatctgtggcacccgttctacatgaattatcaatatttggtaaattcaatctgtatttgttttgttaaagtcaaaaatctcattttccaaaaaaaaaaaaaaacccagttacggctcagtttagtctggaacttgagcaataaaattctctggcattccattattgatgtgctgatgaaccgggacttttaaaaatatttgtgttcctatacctttaccctttacctaacagactaatttgtactcagtaaaacaaaaatttatggtcaaaatttctaacttggttccatcacatttataagataaataaattaaattaatgaaaatgtgacttagagtaggggtagccctcaaaaatagatttatcatttactcattggaattttcttcaagtgttaaaggtacattttcactaggaaaagaaatcaaatatgcttatgcaatatatatttgtgtgtttttccttaatgttatatggtatatatgagccttcttgtttagtttcttttatctgctaagttgtaccttaattagagggcaatatatgtttcataaagaagagtctttataattttgtttgtcagatagtattttggaatttgtataataaggatgtttagaagccatataagtggctttttttaacagatagaatttgtatttttattgtactttaaaaagatttatgtaataggtatatatttagtggccatttattatcaatggtaacacaatggagtactaagatggtatttgcacatttaagatatgttactttaccaatttttaatggtaatcaactctgctactggcatgatgaaatagtacataactggtcattaattatgaacatttacttctccagtgcgtttttatgaagatctggttgaaaattgtatttctatgtaaactcaacgatatgtttggttttcctgaaaataaatgattttaaataaattaaa

SEQ ID NO: 417652 - DNA, 3126 bp, Homo sapiens
  misc_feature (156)..(156): n is a, c, g, or t
ggtgatgagcccttgggttctcgctccgactgctaaattcgcttggccgggtccaccttctcgtggcctcactcgccacacggatcagaatccggagcaggcagttctctctattctgaggctcctgcggctgccgcgctgacttccctgtgtggnggagggaactctgggcaggctggttttcttggaatgtgtttacgatgttgaatgggacttgaacaggaagctggacgctgcagctggaactagcgtgccaagttatttatgattccatctgatatacataggagagaaactgatagaagaattctgatggcaactgtatgatagaagctatataaagtcaagtgtccattttctttcaactatatttgagcatacccaggatttaagtcgtggaactgaacatttatttggctgatcctcatcatgaaccgtgcttttagcaggaagaaagacaaaacatggatgcatacacctgaagctttatcaaaacatttcattccctataatgcaaagtttcttggcagtacagaagtggaacagccaaaaggaacagaagttgtgagagatgctgtaaggaaactaaagtttgcaagacatatcaagaaatctgaaggccagaaaattcctaaagtggagttgcaaatatcaatttatggagtaaaaattctagaacccaaaacaagctgaagagatcactttaacaattggccaagcatttgacctggcatacaggaaatttctagaatcaggaggaaaagatgttgaaacaagaaaacagatcgcagggttacaaaaaagaatccaagacttagaaacagaaaatatggaacttaaaaataaagtacaagatttggaaaaccaactgagaataactcaagtatcagcacctccagcaggcagtatgacacctaagtcgccctccactgacatctttgatatgattccattttctccaatatcacaccagtcttcgatgcctactcgcaatggcacacagccacctccagtacctagtagatctactgagattaaacgggacctgtttggagcagaaccttttgacccatttaactgtggagcagcagatttccctccagatattcaatcaaaattagatgagatgcaggaggggttcaaaatgggactaactcttgaaggcacagtattttgtctcgacccgttagacagtaggtgctgacatcaagaacaagaaatcctgattcatgttaaatgtgtttgtatacacatgtcatttattattattactttaagataggtattattcatgtgtcaatgtttttgaatattttaatattttgaaaattttctcagttaaatttcctcaccttcactattgatctgtaatttttattttaaaaacagcttactgtaaagtagatcatacttttatgttcctttctgtttctactgtagatgaatttgtaattgaaagacatattatacaaatacctgccttgtgtctgagttctatttagttagcatcttgaaatttgtattcattttccagatggctagtttattaatgatttcccaaaagccataccttaaagataactttttaaattctgaagagacatgccaatgtcaaactaaacatgttctgtttttaaaccaacaaacatgttactattcattggacagatatcattttatgtataaatactgttcacatcactgggaaaatgtaaactttaaacataatgccacaaggtcactaatttctagcaggtaaaattataaggatataaattccaataataaaccaaatgtatttagagtatttattagtaaatgcaaggtgatgttagttatgatcagttatactctaaatatttaatttgttttataaaggtagtgaaaaaatgaaaatttgctatttattaaaaaacattaaatttcattccaaatgagataagtgatattactataacatctaagcatcatctgatttgatattccctaaaaaacatttggaatatatgctatctatagattcagtatctactacccatatttactttaccaaatatatttctcctcactgcataaggactactcttctcatattttcttctttgatgaagatatttttcaccaaagtttattttgtgatgccctcttggttttgatactttaaaatctgtggcacccgttctacatgaattatcaatatttggtaaattcaatctgtatttgttttgttaaagtcaaaaatctcattttccaaaaaaaaaaaaaaacccagttacggctcagtttagtctggaacttgagcaataaaattctctggcattccattattgatgtgctgatgaaccgggacttttaaaaatatttgtgttcctatacctttaccctttacctaacagactaatttgtactcagtaaaacaaaaatttatggtcaaaatttctaacttggttccatcacatttataagataaataaattaaattaatgaaaatgtgacttagagtaggggtagccctcaaaaatagatttatcatttactcattggaattttcttcaagtgttaaaggtacattttcactaggaaaagaaatcaaatatgcttatgcaatatatatttgtgtgtttttccttaatgttatatggtatatatgagccttcttgtttagtttcttttatctgctaagttgtaccttaattagagggcaatatatgtttcataaagaagagtctttataattttgtttgtcagatagtattttggaatttgtataataaggatgtttagaagccatataagtggctttttttaacagatagaatttgtatttttattgtactttaaaaagatttatgtaataggtatatatttagtggccatttattatcaatggtaacacaatggagtactaagatggtatttgcacatttaagatatgttactttaccaatttttaatggtaatcaactctgctactggcatgatgaaatagtacataactggtcattaattatgaacatttacttctccagtgcgtttttatgaagatctggttgaaaattgtatttctatgtaaactcaacgatatgtttggttttcctgaaaataaatgattttaaataaattaaa

SEQ ID NO: 417653 - DNA, 2550 bp, Homo sapiens
cgacaagcagtccggcaagaagcgtggattcggcttcgtgtatttccagaatcacgacgcggcagacaaggccgcggggtcaagttccatccgattcagggccatcgcgtgggctgaagagatcactttaacaattggccaagcatttgacctggcatacaggaaatttctagaatcaggaggaaaagatgttgaaacaagaaaacagatcgcagggttacaaaaaagaatccaagacttagaaacagaaaatatggaacttaaaaataaagtacaagatttggaaaaccaactgagaataactcaagtatcagcacctccagcaggcagtatgacacctaagtcgccctccactgacatctttgatatgattccattttctccaatatcacaccagtcttcgatgcctactcgcaatggcacacagccacctccagtacctagtagatctactgagattaaacgggacctgtttggagcagaaccttttgacccatttaactgtggagcagcagatttccctccagatattcaatcaaaattagatgagatgcaggaggggttcaaaatgggactaactcttgaaggcacagtattttgtctcgacccgttagacagtaggtgctgacatcaagaacaagaaatcctgattcatgttaaatgtgtttgtatacacatgtcatttattattattactttaagataggtattattcatgtgtcaatgtttttgaatattttaatattttgaaaattttctcagttaaatttcctcaccttcactattgatctgtaatttttattttaaaaacagcttactgtaaagtagatcatacttttatgttcctttctgtttctactgtagatgaatttgtaattgaaagacatattatacaaatacctgccttgtgtctgagttctatttagttagcatcttgaaatttgtattcattttccagatggctagtttattaatgatttcccaaaagccataccttaaagataactttttaaattctgaagagacatgccaatgtcaaactaaacatgttctgtttttaaaccaacaaacatgttactattcattggacagatatcattttatgtataaatactgttcacatcactgggaaaatgtaaactttaaacataatgccacaaggtcactaatttctagcaggtaaaattataaggatataaattccaataataaaccaaatgtatttagagtatttattagtaaatgcaaggtgatgttagttatgatcagttatactctaaatatttaatttgttttataaaggtagtgaaaaaatgaaaatttgctatttattaaaaaacattaaatttcattccaaatgagataagtgatattactataacatctaagcatcatctgatttgatattccctaaaaaacatttggaatatatgctatctatagattcagtatctactacccatatttactttaccaaatatatttctcctcactgcataaggactactcttctcatattttcttctttgatgaagatatttttcaccaaagtttattttgtgatgccctcttggttttgatactttaaaatctgtggcacccgttctacatgaattatcaatatttggtaaattcaatctgtatttgttttgttaaagtcaaaaatctcattttccaaaaaaaaaaaaaaacccagttacggctcagtttagtctggaacttgagcaataaaattctctggcattccattattgatgtgctgatgaaccgggacttttaaaaatatttgtgttcctatacctttaccctttacctaacagactaatttgtactcagtaaaacaaaaatttatggtcaaaatttctaacttggttccatcacatttataagataaataaattaaattaatgaaaatgtgacttagagtaggggtagccctcaaaaatagatttatcatttactcattggaattttcttcaagtgttaaaggtacattttcactaggaaaagaaatcaaatatgcttatgcaatatatatttgtgtgtttttccttaatgttatatggtatatatgagccttcttgtttagtttcttttatctgctaagttgtaccttaattagagggcaatatatgtttcataaagaagagtctttataattttgtttgtcagatagtattttggaatttgtataataaggatgtttagaagccatataagtggctttttttaacagatagaatttgtatttttattgtactttaaaaagatttatgtaataggtatatatttagtggccatttattatcaatggtaacacaatggagtactaagatggtatttgcacatttaagatatgttactttaccaatttttaatggtaatcaactctgctactggcatgatgaaatagtacataactggtcattaattatgaacatttacttctccagtgcgtttttatgaagatctggttgaaaattgtatttctatgtaaactcaacgatatgtttggttttcctgaaaataaatgattttaaataaattaaa

SEQ ID NO: 417654 - DNA, 2137 bp, Homo sapiens
cagcaagtcaacatttgacatatagttatttattagttgatcaaagcatgaatatttcaactttagtgcatagtcttttttattcactgattttattttgctgtaagcatttcagatattaattattttattctgttttacaggaggggttcaaaatgggactaactcttgaaggcacagtattttgtctcgacccgttagacagtaggtgctgacatcaagaacaagaaatcctgattcatgttaaatgtgtttgtatacacatgtcatttattattattactttaagataggtattattcatgtgtcaatgtttttgaatattttaatattttgaaaattttctcagttaaatttcctcaccttcactattgatctgtaatttttattttaaaaacagcttactgtaaagtagatcatacttttatgttcctttctgtttctactgtagatgaatttgtaattgaaagacatattatacaaatacctgccttgtgtctgagttctatttagttagcatcttgaaatttgtattcattttccagatggctagtttattaatgatttcccaaaagccataccttaaagataactttttaaattctgaagagacatgccaatgtcaaactaaacatgttctgtttttaaaccaacaaacatgttactattcattggacagatatcattttatgtataaatactgttcacatcactgggaaaatgtaaactttaaacataatgccacaaggtcactaatttctagcaggtaaaattataaggatataaattccaataataaaccaaatgtatttagagtatttattagtaaatgcaaggtgatgttagttatgatcagttatactctaaatatttaatttgttttataaaggtagtgaaaaaatgaaaatttgctatttattaaaaaacattaaatttcattccaaatgagataagtgatattactataacatctaagcatcatctgatttgatattccctaaaaaacatttggaatatatgctatctatagattcagtatctactacccatatttactttaccaaatatatttctcctcactgcataaggactactcttctcatattttcttctttgatgaagatatttttcaccaaagtttattttgtgatgccctcttggttttgatactttaaaatctgtggcacccgttctacatgaattatcaatatttggtaaattcaatctgtatttgttttgttaaagtcaaaaatctcattttccaaaaaaaaaaaaaaacccagttacggctcagtttagtctggaacttgagcaataaaattctctggcattccattattgatgtgctgatgaaccgggacttttaaaaatatttgtgttcctatacctttaccctttacctaacagactaatttgtactcagtaaaacaaaaatttatggtcaaaatttctaacttggttccatcacatttataagataaataaattaaattaatgaaaatgtgacttagagtaggggtagccctcaaaaatagatttatcatttactcattggaattttcttcaagtgttaaaggtacattttcactaggaaaagaaatcaaatatgcttatgcaatatatatttgtgtgtttttccttaatgttatatggtatatatgagccttcttgtttagtttcttttatctgctaagttgtaccttaattagagggcaatatatgtttcataaagaagagtctttataattttgtttgtcagatagtattttggaatttgtataataaggatgtttagaagccatataagtggctttttttaacagatagaatttgtatttttattgtactttaaaaagatttatgtaataggtatatatttagtggccatttattatcaatggtaacacaatggagtactaagatggtatttgcacatttaagatatgttactttaccaatttttaatggtaatcaactctgctactggcatgatgaaatagtacataactggtcattaattatgaacatttacttctccagtgcgtttttatgaagatctggttgaaaattgtatttctatgtaaactcaacgatatgtttggttttcctgaaaataaatgattttaaataaattaaa

SEQ ID NO: 417655 - DNA, 1453 bp, Homo sapiens
  misc_feature (156)..(156): n is a, c, g, or t
ggtgatgagcccttgggttctcgctccgactgctaaattcgcttggccgggtccaccttctcgtggcctcactcgccacacggatcagaatccggagcaggcagttctctctattctgaggctcctgcggctgccgcgctgacttccctgtgtggnggagggaactctgggcaggctggttttcttggaatgtgtttacgatgttgaatgggacttgaacaggaagctggacgctgcagctggaactagcgtgccaagttatttatgattccatctgatatacataggagagaaactgatagaagaattctgatggcaactgtatgatagaagctatataaagtcaagtgtccattttctttcaactatatttgagcatacccaggatttaagtcgtggaactgaacatttatttggctgatcctcatcatgaaccgtgcttttagcaggaagaaagacaaaacatggatgcatacacctgaagctttatcaaaacatttcattccctataatgcaaagtttcttggcagtacagaagtggaacagccaaaaggaacagaagttgtgagagatgctgtaaggaaactaaagtttgcaagacatatcaagaaatctgaaggccagaaaattcctaaagtggagttgcaaatatcaatttatggagtaaaaattctagaacccaaaacaaaggaagttcaacacaattgccagcttcatagaatatctttttgtgcagatgataaaactgacaagaggatattcactttcatatgcaaagattctgagtcaaataaacatttgtgctatgtatttgacagcgaaaagtgtgctgaagagatcactttaacaattggccaagcatttgacctggcatacaggaaatttctagaatcaggaggaaaagatgttgaaacaagaaaacagatcgcagggttacaaaaaagaatccaagacttagaaacagaaaatatggaacttaaaaataaagtacaagatttggaaaaccaactgagaataactcaagtatcagcacctccagcaggcagtatgacacctaagtcgccctccactgacatctttgatatgattccattttctccaatatcacaccagtcttcgatgcctactcgcaatggcacacagccacctccagtacctagtagatctactgagattaaacgggacctgtttggagcagaaccttttgacccatttaactgtggagcagcagatttccctccagatattcaatcaaaattagatgagatgcagggtttcatcatgttgtccagactgggcttgaactgctgggctcaagcgatctacccacttagacctcccaaagtgcttggaccacaggcatgagccaccatacttggccatgattgtttcttttagtccaatatttacttgcaaggtcactttaacaaaagtaaaataatattttcttcat

SEQ ID NO: 417656 - DNA, 700 bp, Homo sapiens
  misc_feature (8)..(8): n is a, c, g, or t
  misc_feature (10)..(10): n is a, c, g, or t
  misc_feature (17)..(17): n is a, c, g, or t
ccgaccgnanatataangaggtgcaatatcaatttatggagtaaaaattctagaacccaaaacaaaggaagttcaacacaattgccagcttcatagaatatctttttgtgcagatgataaaactgacaagaggatattcactttcatatgcaaagattctgagtcaaataaacatttgtgctatgtatttgacagcgaaaagtgtgctgaagagatcactttaacaattggccaagcatttgacctggcatacaggaaatttctagaatcaggaggaaaagatgttgaaacaagaaaacagatcgcagggttacaaaaaagaatccaagacttagaaacagaaaatatggaacttaaaaataaagtacaagatttggaaaaccaactgagaataactcaagtatcagcacctccagcaggcagtatgacacctaagtcgccctccactgacatctttgatatgattccattttctccaatatcacaccagtcttcgatgcctactcgcaatggcacacagccacctccagtacctagtagatctactgagattaaacgggacctgtttggagcagaaccttttgacccatttaactgtggagcagcagatttccctccagatattcaatcaaaattagatgagatgcagtttatatatggtagaatccagacagacaccaattatatgaagctgattgag

SEQ ID NO: 417657 - DNA, 3431 bp, Homo sapiens
  misc_feature (156)..(156): n is a, c, g, or t
ggtgatgagcccttgggttctcgctccgactgctaaattcgcttggccgggtccaccttctcgtggcctcactcgccacacggatcagaatccggagcaggcagttctctctattctgaggctcctgcggctgccgcgctgacttccctgtgtggnggagggaactctgggcaggctggttttcttggaatgtgtttacgatgttgaatgggacttgaacaggaagctggacgctgcagctggaactagcgtgccaagttatttatgattccatctgatatacataggagagaaactgatagaagaattctgatggcaactgtatgatagaagctatataaagtcaagtgtccattttctttcaactatatttgagcatacccaggatttaagtcgtggaactgaacatttatttggctgatcctcatcatgaaccgtgcttttagcaggaagaaagacaaaacatggatgcatacacctgaagctttatcaaaacatttcattccctataatgcaaagtttcttggcagtacagaagtggaacagccaaaaggaacagaagttgtgagagatgctgtaaggaaactaaagtttgcaagacatatcaagaaatctgaaggccagaaaattcctaaagtggagttgcaaatatcaatttatggagtaaaaattctagaacccaaaacaaaggaagttcaacacaattgccagcttcatagaatatctttttgtgcagatgataaaactgacaagaggatattcactttcatatgcaaagattctgagtcaaataaacatttgtgctatgtatttgacagcgaaaagtgtgctgaagagatcactttaacaattggccaagcatttgacctggcatacaggaaatttctagaatcaggaggaaaagatgttgaaacaagaaaacagatcgcagggttacaaaaaagaatccaagacttagaaacagaaaatatggaacttaaaaataaagtacaagatttggaaaaccaactgagaataactcaagtatcagcacctccagcaggcagtatgacacctaagtcgccctccactgacatctttgatatgattccattttctccaatatcacaccagtcttcgatgcctactcgcaatggcacacagccacctccagtacctagtagatctactgagattaaacgggacctgtttggagcagaaccttttgacccatttaactgtggagcagcagatttccctccagatattcaatcaaaattagatgagatgcaggaggggttcaaaatgggactaactcttgaaggcacagtattttgtctcgacccgttagacagtaggtgctgacatcaagaacaagaaatcctgattcatgttaaatgtgtttgtatacacatgtcatttattattattactttaagataggtattattcatgtgtcaatgtttttgaatattttaatattttgaaaattttctcagttaaatttcctcaccttcactattgatctgtaatttttattttaaaaacagcttactgtaaagtagatcatacttttatgttcctttctgtttctactgtagatgaatttgtaattgaaagacatattatacaaatacctgccttgtgtctgagttctatttagttagcatcttgaaatttgtattcattttccagatggctagtttattaatgatttcccaaaagccataccttaaagataactttttaaattctgaagagacatgccaatgtcaaactaaacatgttctgtttttaaaccaacaaacatgttactattcattggacagatatcattttatgtataaatactgttcacatcactgggaaaatgtaaactttaaacataatgccacaaggtcactaatttctagcaggtaaaattataaggatataaattccaataataaaccaaatgtatttagagtatttattagtaaatgcaaggtgatgttagttatgatcagttatactctaaatatttaatttgttttataaaggtagtgaaaaaatgaaaatttgctatttattaaaaaacattaaatttcattccaaatgagataagtgatattactataacatctaagcatcatctgatttgatattccctaaaaaacatttggaatatatgctatctatagattcagtatctactacccatatttactttaccaaatatatttctcctcactgcataaggactactcttctcatattttcttctttgatgaagatatttttcaccaaagtttattttgtgatgccctcttggttttgatactttaaaatctgtggcacccgttctacatgaattatcaatatttggtaaattcaatctgtatttgttttgttaaagtcaaaaatctcattttccaaaaaaaaaaaaaaacccagttacggctcagtttagtctggaacttgagcaataaaattctctggcattccattattgatgtgctgatgaaccgggacttttaaaaatatttgtgttcctatacctttaccctttacctaacagactaatttgtactcagtaaaacaaaaatttatggtcaaaatttctaacttggttccatcacatttataagataaataaattaaattaatgaaaatgtgacttagagtaggggtagccctcaaaaatagatttatcatttactcattggaattttcttcaagtgttaaaggtacattttcactaggaaaagaaatcaaatatgcttatgcaatatatatttgtgtgtttttccttaatgttatatggtatatatgagccttcttgtttagtttcttttatctgctaagttgtaccttaattagagggcaatatatgtttcataaagaagagtctttataattttgtttgtcagatagtattttggaatttgtataataaggatgtttagaagccatataagtggctttttttaacagatagaatttgtatttttattgtactttaaaaagatttatgtaataggtatatatttagtggccatttattatcaatggtaacacaatggagtactaagatggtatttgcacatttaagatatgttactttaccaatttttaatggtaatcaactctgctactggcatgatgaaatagtacataactggtcattaattatgaacatttacttctccagtgcgtttttatgaagatctggttgaaaattgtatttctatgtaaactcaacgatatgtttggttttcctgaaaataaatgattttaaataaattaaaaaaaaaacacacagcaacacctaacacaatgacacacaaacaaagggggcggaaaaatccgggccaatcgcccaccttttaaggcccacggctaaaaacagcgcgaaccgggaaaaaccggtttcaacccggcggtggccccataggaaaaaataacctcgttta

SEQ ID NO: 417658 - DNA, 3491 bp, Homo sapiens
  misc_feature (156)..(156): n is a, c, g, or t
ggtgatgagcccttgggttctcgctccgactgctaaattcgcttggccgggtccaccttctcgtggcctcactcgccacacggatcagaatccggagcaggcagttctctctattctgaggctcctgcggctgccgcgctgacttccctgtgtggnggagggaactctgggcaggctggttttcttggaatgtgtttacgatgttgaatgggacttgaacaggaagctggacgctgcagctggaactagcgtgccaagttatttatgattccatctgatatacataggagagaaactgatagaagaattctgatggcaactgtatgatagaagctatataaagtcaagtgtccattttctttcaactatatttgagcatacccaggatttaagtcgtggaactgaacatttatttggctgatcctcatcatgaaccgtgcttttagcaggaagaaagacaaaacatggatgcatacacctgaagctttatcaaaacatttcattccctataatgcaaagtttcttggcagtacagaagtggaacagccaaaaggaacagaagttgtgagagatgctgtaaggaaactaaagtttgcaagacatatcaagaaatctgaaggccagaaaattcctaaagtggagttgcaaatatcaatttatggagtaaaaattctagaacccaaaacaaaggaagttcaacacaattgccagcttcatagaatatctttttgtgcagatgataaaactgacaagaggatattcactttcatatgcaaagattctgagtcaaataaacatttgtgctatgtatttgacagcgaaaagtgtgctgaagagatcactttaacaattggccaagcatttgacctggcatacaggaaatttctagaatcaggaggaaaagatgttgaaacaagaaaacagatcgcagggttacaaaaaagaatccaagacttagaaacagaaaatatggaacttaaaaataaagtacaagatttggaaaaccaactgagaataactcaagtatcagcacctccactgctgcacaatatgtctgatcatgaacaacatgtgtttcagagatgctcatcctctttctggcgtagtaatggtgattcatctccctgtctcaatatttcttccatctctgtcactcctatcaactcgcctgattccagactatcactgggactgttaataccaccaccttctaaatgtggctttcccaagccagtcagtgagagcagcatcccaagacctcatgcaggcagtatgacacctaagtcgccctccactgacatctttgatatgattccattttctccaatatcacaccagtcttcgatgcctactcgcaatggcacacagccacctccagtacctagtagatctactgagattaaacgggacctgtttggagcagaaccttttgacccatttaactgtggagcagcagatttccctccagatattcaatcaaaattagatgagatgcaggaggggttcaaaatgggactaactcttgaaggcacagtattttgtctcgacccgttagacagtaggtgctgacatcaagaacaagaaatcctgattcatgttaaatgtgtttgtatacacatgtcatttattattattactttaagataggtattattcatgtgtcaatgtttttgaatattttaatattttgaaaattttctcagttaaatttcctcaccttcactattgatctgtaatttttattttaaaaacagcttactgtaaagtagatcatacttttatgttcctttctgtttctactgtagatgaatttgtaattgaaagacatattatacaaatacctgccttgtgtctgagttctatttagttagcatcttgaaatttgtattcattttccagatggctagtttattaatgatttcccaaaagccataccttaaagataactttttaaattctgaagagacatgccaatgtcaaactaaacatgttctgtttttaaaccaacaaacatgttactattcattggacagatatcattttatgtataaatactgttcacatcactgggaaaatgtaaactttaaacataatgccacaaggtcactaatttctagcaggtaaaattataaggatataaattccaataataaaccaaatgtatttagagtatttattagtaaatgcaaggtgatgttagttatgatcagttatactctaaatatttaatttgttttataaaggtagtgaaaaaatgaaaatttgctatttattaaaaaacattaaatttcattccaaatgagataagtgatattactataacatctaagcatcatctgatttgatattccctaaaaaacatttggaatatatgctatctatagattcagtatctactacccatatttactttaccaaatatatttctcctcactgcataaggactactcttctcatattttcttctttgatgaagatatttttcaccaaagtttattttgtgatgccctcttggttttgatactttaaaatctgtggcacccgttctacatgaattatcaatatttggtaaattcaatctgtatttgttttgttaaagtcaaaaatctcattttccaaaaaaaaaaaaaaacccagttacggctcagtttagtctggaacttgagcaataaaattctctggcattccattattgatgtgctgatgaaccgggacttttaaaaatatttgtgttcctatacctttaccctttacctaacagactaatttgtactcagtaaaacaaaaatttatggtcaaaatttctaacttggttccatcacatttataagataaataaattaaattaatgaaaatgtgacttagagtaggggtagccctcaaaaatagatttatcatttactcattggaattttcttcaagtgttaaaggtacattttcactaggaaaagaaatcaaatatgcttatgcaatatatatttgtgtgtttttccttaatgttatatggtatatatgagccttcttgtttagtttcttttatctgctaagttgtaccttaattagagggcaatatatgtttcataaagaagagtctttataattttgtttgtcagatagtattttggaatttgtataataaggatgtttagaagccatataagtggctttttttaacagatagaatttgtatttttattgtactttaaaaagatttatgtaataggtatatatttagtggccatttattatcaatggtaacacaatggagtactaagatggtatttgcacatttaagatatgttactttaccaatttttaatggtaatcaactctgctactggcatgatgaaatagtacataactggtcattaattatgaacatttacttctccagtgcgtttttatgaagatctggttgaaaattgtatttctatgtaaactcaacgatatgtttggttttcctgaaaataaatgattttaaataaattaaa

SEQ ID NO: 417659 - DNA, 1180 bp, Homo sapiens
  misc_feature (156)..(156): n is a, c, g, or t
ggtgatgagcccttgggttctcgctccgactgctaaattcgcttggccgggtccaccttctcgtggcctcactcgccacacggatcagaatccggagcaggcagttctctctattctgaggctcctgcggctgccgcgctgacttccctgtgtggnggagggaactctgggcaggctggttttcttggaatgtgtttacgatgttgaatgggacttgaacaggaagctggacgctgcagctggaactagcgtgccaagttatttatgattccatctgatatacataggagagaaactgatagaagaattctgatggcaactgtatgatagaagctatataaagtcaagtgtccattttctttcaactatatttgagcatacccaggatttaagtcgtggaactgaacatttatttggctgatcctcatcatgaaccgtgcttttagcaggaagaaagacaaaacatggatgcatacacctgaagctttatcaaaacatttcattccctataatgcaaagtttcttggcagtacagaagtggaacagccaaaaggaacagaagttgtgagagatgctgtaaggaaactaaagtttgcaagacatatcaagaaatctgaaggccagaaaattcctaaagtggagttgcaaatatcaatttatggagtaaaaattctagaacccaaaacaaaggaagttcaacacaattgccagcttcatagaatatctttttgtgcagatgataaaactgacaagaggatattcactttcatatgcaaagattctgagtcaaataaacatttgtgctatgtatttgacagcgaaaagtgtgctgaagagatcactttaacaattggccaagcatttgacctggcatacaggaaatttctagaatcaggaggaaaagatgttgaaacaagaaaacagatcgcagggttacaaaaaagaatccaagacttagaaacagaaaatatggaacttaaaaataaagtacaagatttggaaaaccaactgagaataactcaagtatcagcacctccagcaggcagtatgacacctaagtcgccctccactgacatctttgatatgattccattttctccaatatcacaccagtcttcgatgcctaccctttccaaaacacaaaatcactggcaagcgttctagatcgcgagcggccgct

SEQ ID NO: 417660 - DNA, 411 bp, Homo sapiens
ttgctttaggccttctaggatgtatggctgtttgtcatgcagcaacagataaccagaccaccacttaacagagggagcagtatcagtgatgcagcatcatccacacccaccaaacaactcactggaatgactgacctgttgtttaggaaaagtgaggatgcaaaagaaacttcagaaggttttacccagtaggattcaaagctatccaatgactatactactccctctacaacagaagtagtgagagtaaagacttgatatttatcttcaactaagctgccactgtcctttggactaaatctttgtgtatcacatcaatattttaataactcaaatctagatgtgccacctctatctcaggacaacctaattcttgagcacaaacatcattcctaacaataactcagtaac

SEQ ID NO: 417661 - DNA, 784 bp, Homo sapiens
atttggcagagcctcgccaatttggggcgcacctccccttcctgggatgctctcagaaggcaaaccaattcccagaagagagggaaaaacagccacaacagagagaacctttgctgtccctgtttggaaagagattgggatttcctggagagggcttgcttctactgcaggtttgtttaaaagctcaacatctattctggaagagaacaacgcagactccaggaagatggtggggcgtgtcattttggaatgtgtcttgctgctcttctcatcaaaggtaaagtcctcttcttcaccttttaacctagagtagctgtgcaactttctttgaccaatcaaatatggtggaagtgatgttgcgtgacttccagatataagtcttaaagagatttttcactttctgctttcactctcttggaatgttgccctgagatcaccacaccatgaagaagtctggggcgaaaggccatgtggagtgagaggctcagcttcccagatgatctcactgagcacagcccccagccacctgccagctcaatgcaacctggtgatggacccaagcaaataccagcagaagaatcacctggtcaacccacagaatcatgagaaatactaatttgttgttgtcttaagccacagggtgaagactatatttgctcacataaattgtgtccttataacagaaaaagcttcttagggctggtgcggtggcttattcctgtaatcccagcactttgggaggcggacgcaagcagatcacttgagttcaggagttctagaccag

SEQ ID NO: 417662 - DNA, 373 bp, Homo sapiens
atttggcagagcctcgccaatttggggcgcacctccccttcctgggatgctctcagaaggcaaaccaattcccagaagagagggaaaaacagccacaacagagagaacctttgctgtccctgtttggaaagagattgggatttcctggagagggcttgcttctactgcaggtttgtttaaaagctcaacatctattctggaagagaacaacgcagactccaggaagatggtgggaaacagataattgtcatccagactcttcaattagttacattttctttcttttttcttcttaatgaatgagaggcaaataaatctttggcattcccagtgcctctgaagtgtaaactccaccagatcatctagatgcaca

SEQ ID NO: 417663 - DNA, 402 bp, Homo sapiens
gtgcatgatactcaggaaggaacatggcctgagcacggaggtgaagggtggactgagggccctgggaagaccatctgcagtgacagtggggaggaggctagcgaggctctggacagttgcagtggggagccacaggaaccaccaagtgagggagggaccgaacaaaagccagtcatggtagaggctaggtggaaagcagggagcctcacaccctactggccagaagatcctcttagcgagcctctaacaggaagggtagcttctcttcaccctttgccagcaccaggggtctagaccaccggttcccttttgccatgttcccctcctccctcctttcctgcgtcatcccatctctgcctaccccccatgtatctatcttttggtttgttttttttttttctt

SEQ ID NO: 417664 - DNA, 716 bp, Homo sapiens
gaatgaaaaaaaaaaaaagaaaaaaaaaaaaaaagtcttgaatgtcctagtgttctagtgtttgcataattgcttttcatccctgctctctgctaattgcttttaaggatctctgctacatcctgcatttcccatcattgttggattttattgacttctcttagaaagccagcctgatatataaaattctattatcttgggacctttgcctgtgatgctgttatgcttttagggaagacagtggttggttccatgaaaatggacctgtctggaatacactggaatttcataatctatccagaaaaagataaagcccagatgataaataccagaaccttttgctcctgtctctttggcgaaaacaagtggtgtttggcttgctctggtgaaggggtcatgggctgtcacagaattcgaaaaagatattttgatattcaggccgggcacagtggctcacgcctgtaatcccagcactttgggcggccaaggcgggtggatcacgaggtcaagagattgagaccatcctggccaacatggtgaaaccctgtctctactgaaaatacaaaaattagctggacatggtggcacacacctgtaatctcagctacttgggaggctgaggcaggagaatcgcttgaacccaggaggcggaggttgcattgagccaagatcacaccactgtactccagcttggcgatagagcgaggctccatctc

SEQ ID NO: 417665 - DNA, 438 bp, Homo sapiens
gttgtttttaaggattaaatgagatattacatgtaatgtgctcatcccagtgcccagcacacaagaaatgttcaataaaataggaggcataattgtcctgtttgaatactagataacccttttaatggatattctacaattatgaatctaaggtgctttggaggagcctaggcaatctattccaaaattaaatgtaaggaaggtacatgagtaagggatggagtaggccctggaccaacactagagctccaaatttcctaaaaagcttgagcttcttttactgtggccacgcctataatgggaataaatctggttcttcaaacagtccctcccctctctaagctctgctgggagtagagacatcagcaggctggttctgtgtttagctcctccccatcttgactctcatcccattcctctttcctactaccaattcag

SEQ ID NO: 417666 - DNA, 479 bp, Homo sapiens
cccatagctaggtgttgccagggtttttcaaatttcttcctggaggggaagttgatgagtacagcttattcctagctccactgttagcacctcacaggtgttcttgtactgcatttcctcttgattgaggaacagttttttattgcatccatctttttgaacttttggtgtacagacatgactattaactccagaatttgcacagctgtctcaacctgcccttacaacatctaatatgttagcagtatacctactagcatgcagtgtgtgccctcaattccctattgcatttgtgtttatgtgagtttcagtcttttaatccatgtaagggatatagagaagggcatacccaggccgggtgcagtggctcacgcttctaatcccaccactttgtgatgccaaggtgggcagatcacgaggtcaggagttcgagaccagcctgaccaacatactgaagccctgtctctactaaaaataca

SEQ ID NO: 417667 - DNA, 4473 bp, Homo sapiens
ctgcagtggatggtaaagtcacgggtcattagcgagctacaggaggcctgctgggacatggtatctgccatggcggcgactgcggcaaagcgagagcctcggagacgccgctgccgccagcacagccggagacctgagccgacactgggggcagtccgcgagccccgcactctctcgatgagtcggagaagtcccgttgtatcagagtaagatggacggtagctttgattgtgattgtggtgagctggagccacctgatcactaacaaaagacatcttctgttaaccaacagccgccagggcttcctgttgaaataaatatatagcaacaaaggaaaaaaagaagcaaaacggaaatagtgcttaccagcaccttagaatgatgctgctcaggaccagtccaacactgaatgtatctgcactgtgaggagaatgttcatagaagcctgttgtgtgcatatttattcacatttttgttaaatgttaaatcgtttagcacggtaatctgagtgcacagtatgtcatttcattccgtttgagtttcttgttttcgttaaatgtctgcagagttgctgcccctttcttgaactatgagtactgcaatctttttaattctcaatatgaatagagctttttgagctttaaatctaaggggaactcgacaggcctgtttggcatatgcaatgaacatcaagaaaccatcttgctgtggaagcataattatttttcttctccctttttgaaagatctttccttttgatgccagttttcttccttgtttacacaagttcaatttgaaaggaaaaggcaatagtaagggtttcaaaatggcagagaaatttgaaagtctcatgaacattcatggttttgatctgggttctaggtatatggacttaaaaccattgggttgtggaggcaatggcttggttttttctgctgtagacaatgactgtgacaaaagagtagccatcaagaaaattgtccttactgatccccagagtgtcaaacatgctctacgtgaaatcaaaattattagaagacttgaccatgataacattgtgaaagtgtttgagattcttggtcccagtggaagccaattaacagacgatgtgggctctcttacggaactgaacagtgtttacattgttcaggagtacatggagacagacttggctaatgtgctggagcagggccctttactggaagagcatgccaggcttttcatgtatcagctgctacgggggctcaagtatattcactctgcaaatgtactgcacagagatctcaaaccagctaatcttttcattaatacggaagacttggtgctgaagataggtgactttggtcttgcacggatcatggatcctcattattcccataagggtcatctttctgaaggattggttactaaatggtacagatctccacgtcttttactttctcctaataattatactaaagccattgacatgtgggctgcaggctgcatctttgctgaaatgctgactggtaaaaccctttttgcaggtgcacatgaacttgaacagatgcagctgattttagaatctattcctgttgtacatgaggaagatcgtcaggagcttctcagcgtaattccagtttacattagaaatgacatgactgagccacacaaacctttaactcagctgcttccaggaattagtcgagaagcactggatttcctggaacaaattttgacatttagccccatggatcggttaacagcagaagaagcactctcccatccttacatgagcatatattcttttccaatggatgagccaatttcaagccatccttttcatattgaagatgaagttgatgatattttgcttatggatgaaactcacagtcacatttataactgggaaaggtatcatgattgtcagttttcagagcatgattggcctgtacataacaactttgatattgatgaagttcagcttgatccaagagctctgtccgatgtcactgatgaagaagaagtacaagttgatccccgaaaatatttggatggagatcgggaaaagtatctggaggatcctgcttttgataccaattactctactgagccttgttggcaatactcagatcatcatgaaaacaaatattgtgatctggagtgtagccatacttgtaactacaaaacgaggtcatcatcatatttagataacttagtttggagagagagtgaagttaaccattactatgaacccaagcttattatagatctttccaattggaaagaacaaagcaaagaaaaatctgataagaaaggcaaatcaaaatgtgaaaggaatggattggttaaagcccagatagcgctagaggaagcatcacagcaactggctggaaaagaaagggaaaagaatcagggatttgattttgattcctttattgcaggaactattcagcttagttcccagcatgagcctactgatgttgttgataaattaaatgacttgaatagctcagtgtcccaactagaattgaaaagtttgatatcaaagtcagtaagccaagaaaaacaggaaaaaggaatggcaaatctggctcaattagaagccttgtaccagtcttcttgggacagccagtttgtgagtggtggggaggactgttttttcataaatcagttttgtgaggtaaggaaggatgaacaagttgagaaggaaaacacttacactagttacttggacaagttctttagcaggaaagaagatactgaaatgctagaaactgagccagtagaggatgggaagcttggggagagaggacatgaggaaggatttctgaacaacagtggggagttcctctttaacaagcagctcgagtccataggcatcccacagtttcacagtccagttgggtcaccacttaagtcaatacaggccacattaacaccttctgctatgaaatcttcccctcaaattcctcatcaaacatacagcagcattctgaaacatctgaactaaaacactcagcagacatttatctttgtattcttcatgaaatgtgttttgtctttttttattactagtgtttaagtcattttttacttgaatcagatggtgtcatttagtaaggattttatgagttcttgttttttaaaatccagactttctttttctacatgtgagatagttttcattttaactggcatgtcatttgcacacaaaaataaagactagagcaaaataatgcaacgcaggaggagaaaagaaatgcactaagacaagaacattctctcatagaacattgatctgttttacaggaaacaaaccttgccttgaaatttacacagtgagactgtacataattgcatgaaaatagctatttttttcctaagacatttttcattcatgaatattttcaagtttttcatactgtacacatttcttaaaacacatgataccagcagcaactgaaaatgaatgccgaatttggtacacatgtgttatctacctcaaggtaacaagagtatgtggcaaaacatataccacccatagtgcttcacaaaatgcacttctatttagccagcgtttattgtagtaaactattcttaataaaactcactcactgtttataaatgttctggtatgcattctttatagtgaagtgttaatacatcacatcttatttattttagcaaatcagtatattttctgtatttaattataaaaaattaacttagtttttaaaatttatttgcaaatatactttttccatttggcactatggtttgttgcctacctagctgcatctataatgtcagcttatcctaaggctgtccacgtacttaatttacttaagtgttcattttaagtaacgtgctcactgtgtataggaatttgtattttggaggtgcttgatctatctacaaagaaaaattaattaggaattactttattataaaatgctcctagaagtcttaattgtgtttattttttaaaaaaacaaatgttagacttgtgtgcatggaagtaattaaggtacatcattattgtagtttgaaagttgtacatgataagacattttgtttttactgtatgtttttactgaatgatctattccccatcccaaggcaagcatgaataaaattaggttaaacgtagcatgtggcatcgcagtctcttagaatttgtttcatctattttattttattgaatactgtctgtatctttggttatcctgtttgaagaaaaaggacaaataaaacatggccagcaaatacagctcctgtttcactcttgggttaatgaaaattttctgctagaatgaaaattactaccagaatcactttgaattatggccataaattgctagtctgaaaggctgagaaggttcaagtcttttgacttaaaccatcacatattagaatggaataaagctttataatatttcaaaactgttaggtaaaatgtgtagttgaaactttgaactgtgcagtcagaaa

SEQ ID NO: 417668 - DNA, 4456 bp, Homo sapiens
accgcgaagccccgccccctcttcctcgccctctctcgcgggtcggggttacatggcggcgactgcggcaaagcgagagcctcggagacgccgctgccgccagcacagccggagacctgagccgacactgggggcagtccgcgagccccgcactctctcgatgagtcggagaagtcccgttgtatcagagtaagatggacggtagctttgattgtgattgtggtgagctggagccacctgatcactaacaaaagacatcttctgttaaccaacagccgccagggcttcctgttgaaataaatatatagcaacaaaggaaaaaaagaagcaaaacggaaatagtgcttaccagcaccttagaatgatgctgctcaggaccagtccaacactgaatgtatctgcactgtgaggagaatgttcatagaagcctgttgtgtgcatatttattcacatttttgttaaatgttaaatcgtttagcacggtaatctgagtgcacagtatgtcatttcattccgtttgagtttcttgttttcgttaaatgtctgcagagttgctgcccctttcttgaactatgagtactgcaatctttttaattctcaatatgaatagagctttttgagctttaaatctaaggggaactcgacaggcctgtttggcatatgcaatgaacatcaagaaaccatcttgctgtggaagcataattatttttcttctccctttttgaaagatctttccttttgatgccagttttcttccttgtttacacaagttcaatttgaaaggaaaaggcaatagtaagggtttcaaaatggcagagaaatttgaaagtctcatgaacattcatggttttgatctgggttctaggtatatggacttaaaaccattgggttgtggaggcaatggcttggttttttctgctgtagacaatgactgtgacaaaagagtagccatcaagaaaattgtccttactgatccccagagtgtcaaacatgctctacgtgaaatcaaaattattagaagacttgaccatgataacattgtgaaagtgtttgagattcttggtcccagtggaagccaattaacagacgatgtgggctctcttacggaactgaacagtgtttacattgttcaggagtacatggagacagacttggctaatgtgctggagcagggccctttactggaagagcatgccaggcttttcatgtatcagctgctacgggggctcaagtatattcactctgcaaatgtactgcacagagatctcaaaccagctaatcttttcattaatacggaagacttggtgctgaagataggtgactttggtcttgcacggatcatggatcctcattattcccataagggtcatctttctgaaggattggttactaaatggtacagatctccacgtcttttactttctcctaataattatactaaagccattgacatgtgggctgcaggctgcatctttgctgaaatgctgactggtaaaaccctttttgcaggtgcacatgaacttgaacagatgcagctgattttagaatctattcctgttgtacatgaggaagatcgtcaggagcttctcagcgtaattccagtttacattagaaatgacatgactgagccacacaaacctttaactcagctgcttccaggaattagtcgagaagcactggatttcctggaacaaattttgacatttagccccatggatcggttaacagcagaagaagcactctcccatccttacatgagcatatattcttttccaatggatgagccaatttcaagccatccttttcatattgaagatgaagttgatgatattttgcttatggatgaaactcacagtcacatttataactgggaaaggtatcatgattgtcagttttcagagcatgattggcctgtacataacaactttgatattgatgaagttcagcttgatccaagagctctgtccgatgtcactgatgaagaagaagtacaagttgatccccgaaaatatttggatggagatcgggaaaagtatctggaggatcctgcttttgataccaattactctactgagccttgttggcaatactcagatcatcatgaaaacaaatattgtgatctggagtgtagccatacttgtaactacaaaacgaggtcatcatcatatttagataacttagtttggagagagagtgaagttaaccattactatgaacccaagcttattatagatctttccaattggaaagaacaaagcaaagaaaaatctgataagaaaggcaaatcaaaatgtgaaaggaatggattggttaaagcccagatagcgctagaggaagcatcacagcaactggctggaaaagaaagggaaaagaatcagggatttgattttgattcctttattgcaggaactattcagcttagttcccagcatgagcctactgatgttgttgataaattaaatgacttgaatagctcagtgtcccaactagaattgaaaagtttgatatcaaagtcagtaagccaagaaaaacaggaaaaaggaatggcaaatctggctcaattagaagccttgtaccagtcttcttgggacagccagtttgtgagtggtggggaggactgttttttcataaatcagttttgtgaggtaaggaaggatgaacaagttgagaaggaaaacacttacactagttacttggacaagttctttagcaggaaagaagatactgaaatgctagaaactgagccagtagaggatgggaagcttggggagagaggacatgaggaaggatttctgaacaacagtggggagttcctctttaacaagcagctcgagtccataggcatcccacagtttcacagtccagttgggtcaccacttaagtcaatacaggccacattaacaccttctgctatgaaatcttcccctcaaattcctcatcaaacatacagcagcattctgaaacatctgaactaaaacactcagcagacatttatctttgtattcttcatgaaatgtgttttgtctttttttattactagtgtttaagtcattttttacttgaatcagatggtgtcatttagtaaggattttatgagttcttgttttttaaaatccagactttctttttctacatgtgagatagttttcattttaactggcatgtcatttgcacacaaaaataaagactagagcaaaataatgcaacgcaggaggagaaaagaaatgcactaagacaagaacattctctcatagaacattgatctgttttacaggaaacaaaccttgccttgaaatttacacagtgagactgtacataattgcatgaaaatagctatttttttcctaagacatttttcattcatgaatattttcaagtttttcatactgtacacatttcttaaaacacatgataccagcagcaactgaaaatgaatgccgaatttggtacacatgtgttatctacctcaaggtaacaagagtatgtggcaaaacatataccacccatagtgcttcacaaaatgcacttctatttagccagcgtttattgtagtaaactattcttaataaaactcactcactgtttataaatgttctggtatgcattctttatagtgaagtgttaatacatcacatcttatttattttagcaaatcagtatattttctgtatttaattataaaaaattaacttagtttttaaaatttatttgcaaatatactttttccatttggcactatggtttgttgcctacctagctgcatctataatgtcagcttatcctaaggctgtccacgtacttaatttacttaagtgttcattttaagtaacgtgctcactgtgtataggaatttgtattttggaggtgcttgatctatctacaaagaaaaattaattaggaattactttattataaaatgctcctagaagtcttaattgtgtttattttttaaaaaaacaaatgttagacttgtgtgcatggaagtaattaaggtacatcattattgtagtttgaaagttgtacatgataagacattttgtttttactgtatgtttttactgaatgatctattccccatcccaaggcaagcatgaataaaattaggttaaacgtagcatgtggcatcgcagtctcttagaatttgtttcatctattttattttattgaatactgtctgtatctttggttatcctgtttgaagaaaaaggacaaataaaacatggccagcaaatacagctcctgtttcactcttgggttaatgaaaattttctgctagaatgaaaattactaccagaatcactttgaattatggccataaattgctagtctgaaaggctgagaaggttcaagtcttttgacttaaaccatcacatattagaatggaataaagctttataatatttcaaaactgttaggtaaaatgtgtagttgaaactttgaactgtgcagtcagaaa

SEQ ID NO: 417669 - DNA, 4131 bp, Homo sapiens
ctgcagtggatggtaaagtcacgggtcattagcgagctacaggaggcctgctgggacatggtatctgccatggcggcgactgcggcaaagcgagagcctcggagacgccgctgccgccagcacagccggagacctgagccgacactgggggcagtccgcgagccccgcactctctcgatgagtcggagaagtcccgttgtatcagagtaagatggacggtagctttgattgtgattgtggtgagctggagccacctgatcactaacaaaagacatcttctgttaaccaacagccgccagggcttcctgttgaaataaatatatagcaacaaaggaaaaaaagaagcaaaacggaaatagtgcttaccagcaccttagaatgatgctgctcaggaccagtccaacactgaatgtatctgcactgtgaggagaatgttcatagaagcctgttgtgtgcatatttattcacatttttgttaaatgttaaatcgtttagcacggtaatctgagtgcacagtatgtcatttcattccgtttgagtttcttgttttcgttaaatgtctgcagagttgctgcccctttcttgaactatgagtactgcaatctttttaattctcaatatgaatagagctttttgagctttaaatctaaggggaactcgacaggcctgtttggcatatgcaatgaacatcaagaaaccatcttgctgtggaagcataattatttttcttctccctttttgaaagatctttccttttgatgccagttttcttccttgtttacacaagttcaatttgaaaggaaaaggcaatagtaagggtttcaaaatggcagagaaatttgaaagtctcatgaacattcatggttttgatctgggttctaggtatatggacttaaaaccattgggttgtggaggcaatggcttggttttttctgctgtagacaatgactgtgacaaaagagtagccatcaagaaaattgtccttactgatccccagagtgtcaaacatgctctacgtgaaatcaaaattattagaagacttgaccatgataacattgtgaaagtgtttgagattcttggtcccagtggaagccaattaacagacgatgtgggctctcttacggaactgaacagtgtttacattgttcaggagtacatggagacagacttggctaatgtgctggagcagggccctttactggaagagcatgccaggcttttcatgtatcagctgctacgggggctcaagtatattcactctgcaaatgtactgcacagagatctcaaaccagctaatcttttcattaatacggaagacttggtgctgaagataggtgactttggtcttgcacggatcatggatcctcattattcccataagggtcatctttctgaaggattggttactaaatggtacagatctccacgtcttttactttctcctaataattatactaaagccattgacatgtgggctgcaggctgcatctttgctgaaatgctgactggtaaaaccctttttgcaggtgcacatgaacttgaacagatgcagctgattttagaatctattcctgttgtacatgaggaagatcgtcaggagcttctcagcgtaattccagtttacattagaaatgacatgactgagccacacaaacctttaactcagctgcttccaggaattagtcgagaagcactggatttcctggaacaaattttgacatttagccccatggatcggttaacagcagaagaagcactctcccatccttacatgagcatatattcttttccaatggatgagccaatttcaagccatccttttcatattgaagatgaagttgatgatattttgcttatggatgaaactcacagtcacatttataactgggaaaggtatcatgattgtcagttttcagagcatgattggcctgtacataacaactttgatattgatgaagttcagcttgatccaagagctctgtccgatgtcactgatgaagaagaagtacaagttgatccccgaaaatatttggatggagatcgggaaaagtatctggaggatcctgcttttgataccaattactctactgagccttgttggcaatactcagatcatcatgaaaacaaatattgtgatctggagtgtagccatacttgtaactacaaaacgaggtcatcatcatatttagataacttagtttggagagagagtgaagttaaccattactatgaacccaagcttattatagatctttccaattggaaagaacaaagcaaagaaaaatctgataagaaaggcaaatcaaaatgtgaaaggaatggattggttaaagcccagatagcgctagaggaagcatcacagcaactggctggaaaagaaagggaaaagaatcagggatttgattttgattcctttattgcaggaactattcagcttagttcccagcatgagcctactgatgttgttgataaattaaatgacttgaatagctcagtgtcccaactagaattgaaaagtttgatatcaaagtcagtaagccaagaaaaacaggaaaaaggaatggcaaatctggctcaattagaagccttgtaccagtcttcttgggacagccagtttgtgagtggtggggaggactgttttttcataaatcagttttgtgaggtaaggaaggatgaacaagttgagaaggaaaacacttacactagttacttggacaagttctttagcaggaaagaagatactgaaatgctagaaactgagccagtagaggatgggaagcttggggagagaggacatgaggaaggatttctgaacaacagtggggagttcctctttaacaagcagctcgagtccataggcatcccacagtttcacagtccagttgggtcaccacttaagtcaatacaggccacattaacaccttctgctatgaaatcttcccctcaaattcctcatcaaacatacagcagcattctgaaacatctgaactaaaacactcagcagacatttatctttgtattcttcatgaaatgtgttttgtctttttttattactagtgtttaagtcattttttacttgaatcagatggtgtcatttagtaaggattttatgagttcttgttttttaaaatccagactttctttttctacatgtgagatagttttcattttaactggcatgtcatttgcacacaaaaataaagactagagcaaaataatgcaacgcaggaggagaaaagaaatgcactaagacaagaacattctctcatagaacattgatctgttttacaggaaacaaaccttgccttgaaatttacacagtgagactgtacataattgcatgaaaatagctatttttttcctaagacatttttcattcatgaatattttcaagtttttcatactgtacacatttcttaaaacacatgataccagcagcaactgaaaatgaatgccgaatttggtacacatgtgttatctacctcaaggtaacaagagtatgtggcaaaacatataccacccatagtgcttcacaaaatgcacttctatttagccagcgtttattgtagtaaactattcttaataaaactcactcactgtttataaatgttctggtatgcattctttatagtgaagtgttaatacatcacatcttatttattttagcaaatcagtatattttctgtatttaattataaaaaattaacttagtttttaaaatttatttgcaaatatactttttccatttggcactatggtttgttgcctacctagctgcatctataatgtcagcttatcctaaggctgtccacgtacttaatttacttaagtgttcattttaagtaacgtgctcactgtgtataggaatttgtattttggaggtgcttgatctatctacaaagaaaaattaattaggaattactttattataaaatgctcctagaagtcttaattgtgtttattttttaaaaaaacaaatgttagacttgtgtgcatggaagtaattaaggtacatcattattgtagtttgaaagttgtacatgataagacattttgtttttactgtatgtttttactgaatgatctattccccatcccaaggcaagcatgaataaaattaggttaaacgta

SEQ ID NO: 417670 - DNA, 4419 bp, Homo sapiens
ctgcagtggatggtaaagtcacgggtcattagcgagctacaggaggcctgctgggacatggtatctgccatggcggcgactgcggcaaagcgagagcctcggagacgccgctgccgccagcacagccggagacctgagccgacactgggggcagtccgcgagccccgcactctctcgatgagtcggagaagtcccgttgtatcagagtaagatggacggtagctttgattgtgattgtggtgagctggagccacctgatcactaacaaaagacatcttctgttaaccaacagccgccagggcttcctgttgaaataaatatatagcaacaaaggaaaaaaagaatccaacactgaatgtatctgcactgtgaggagaatgttcatagaagcctgttgtgtgcatatttattcacatttttgttaaatgttaaatcgtttagcacggtaatctgagtgcacagtatgtcatttcattccgtttgagtttcttgttttcgttaaatgtctgcagagttgctgcccctttcttgaactatgagtactgcaatctttttaattctcaatatgaatagagctttttgagctttaaatctaaggggaactcgacaggcctgtttggcatatgcaatgaacatcaagaaaccatcttgctgtggaagcataattatttttcttctccctttttgaaagatctttccttttgatgccagttttcttccttgtttacacaagttcaatttgaaaggaaaaggcaatagtaagggtttcaaaatggcagagaaatttgaaagtctcatgaacattcatggttttgatctgggttctaggtatatggacttaaaaccattgggttgtggaggcaatggcttggttttttctgctgtagacaatgactgtgacaaaagagtagccatcaagaaaattgtccttactgatccccagagtgtcaaacatgctctacgtgaaatcaaaattattagaagacttgaccatgataacattgtgaaagtgtttgagattcttggtcccagtggaagccaattaacagacgatgtgggctctcttacggaactgaacagtgtttacattgttcaggagtacatggagacagacttggctaatgtgctggagcagggccctttactggaagagcatgccaggcttttcatgtatcagctgctacgggggctcaagtatattcactctgcaaatgtactgcacagagatctcaaaccagctaatcttttcattaatacggaagacttggtgctgaagataggtgactttggtcttgcacggatcatggatcctcattattcccataagggtcatctttctgaaggattggttactaaatggtacagatctccacgtcttttactttctcctaataattatactaaagccattgacatgtgggctgcaggctgcatctttgctgaaatgctgactggtaaaaccctttttgcaggtgcacatgaacttgaacagatgcagctgattttagaatctattcctgttgtacatgaggaagatcgtcaggagcttctcagcgtaattccagtttacattagaaatgacatgactgagccacacaaacctttaactcagctgcttccaggaattagtcgagaagcactggatttcctggaacaaattttgacatttagccccatggatcggttaacagcagaagaagcactctcccatccttacatgagcatatattcttttccaatggatgagccaatttcaagccatccttttcatattgaagatgaagttgatgatattttgcttatggatgaaactcacagtcacatttataactgggaaaggtatcatgattgtcagttttcagagcatgattggcctgtacataacaactttgatattgatgaagttcagcttgatccaagagctctgtccgatgtcactgatgaagaagaagtacaagttgatccccgaaaatatttggatggagatcgggaaaagtatctggaggatcctgcttttgataccaattactctactgagccttgttggcaatactcagatcatcatgaaaacaaatattgtgatctggagtgtagccatacttgtaactacaaaacgaggtcatcatcatatttagataacttagtttggagagagagtgaagttaaccattactatgaacccaagcttattatagatctttccaattggaaagaacaaagcaaagaaaaatctgataagaaaggcaaatcaaaatgtgaaaggaatggattggttaaagcccagatagcgctagaggaagcatcacagcaactggctggaaaagaaagggaaaagaatcagggatttgattttgattcctttattgcaggaactattcagcttagttcccagcatgagcctactgatgttgttgataaattaaatgacttgaatagctcagtgtcccaactagaattgaaaagtttgatatcaaagtcagtaagccaagaaaaacaggaaaaaggaatggcaaatctggctcaattagaagccttgtaccagtcttcttgggacagccagtttgtgagtggtggggaggactgttttttcataaatcagttttgtgaggtaaggaaggatgaacaagttgagaaggaaaacacttacactagttacttggacaagttctttagcaggaaagaagatactgaaatgctagaaactgagccagtagaggatgggaagcttggggagagaggacatgaggaaggatttctgaacaacagtggggagttcctctttaacaagcagctcgagtccataggcatcccacagtttcacagtccagttgggtcaccacttaagtcaatacaggccacattaacaccttctgctatgaaatcttcccctcaaattcctcatcaaacatacagcagcattctgaaacatctgaactaaaacactcagcagacatttatctttgtattcttcatgaaatgtgttttgtctttttttattactagtgtttaagtcattttttacttgaatcagatggtgtcatttagtaaggattttatgagttcttgttttttaaaatccagactttctttttctacatgtgagatagttttcattttaactggcatgtcatttgcacacaaaaataaagactagagcaaaataatgcaacgcaggaggagaaaagaaatgcactaagacaagaacattctctcatagaacattgatctgttttacaggaaacaaaccttgccttgaaatttacacagtgagactgtacataattgcatgaaaatagctatttttttcctaagacatttttcattcatgaatattttcaagtttttcatactgtacacatttcttaaaacacatgataccagcagcaactgaaaatgaatgccgaatttggtacacatgtgttatctacctcaaggtaacaagagtatgtggcaaaacatataccacccatagtgcttcacaaaatgcacttctatttagccagcgtttattgtagtaaactattcttaataaaactcactcactgtttataaatgttctggtatgcattctttatagtgaagtgttaatacatcacatcttatttattttagcaaatcagtatattttctgtatttaattataaaaaattaacttagtttttaaaatttatttgcaaatatactttttccatttggcactatggtttgttgcctacctagctgcatctataatgtcagcttatcctaaggctgtccacgtacttaatttacttaagtgttcattttaagtaacgtgctcactgtgtataggaatttgtattttggaggtgcttgatctatctacaaagaaaaattaattaggaattactttattataaaatgctcctagaagtcttaattgtgtttattttttaaaaaaacaaatgttagacttgtgtgcatggaagtaattaaggtacatcattattgtagtttgaaagttgtacatgataagacattttgtttttactgtatgtttttactgaatgatctattccccatcccaaggcaagcatgaataaaattaggttaaacgtagcatgtggcatcgcagtctcttagaatttgtttcatctattttattttattgaatactgtctgtatctttggttatcctgtttgaagaaaaaggacaaataaaacatggccagcaaatacagctcctgtttcactcttgggttaatgaaaattttctgctagaatgaaaattactaccagaatcactttgaattatggccataaattgctagtctgaaaggctgagaaggttcaagtcttttgacttaaaccatcacatattagaatggaataaagctttataatatttcaaaactgttaggtaaaatgtgtagttgaaactttgaactgtgcagtcagaaa

SEQ ID NO: 417671 - DNA, 2903 bp, Homo sapiens
accgcgaagccccgccccctcttcctcgccctctctcgcgggtcggggttacatggcggcgactgcggcaaagcgagagcctcggagacgccgctgccgccagcacagccggagacctgagccgacactgggggcagtccgcgagccccgcactctctcgatgagtcggagaagtcccgttgtatcagagtaagatggacggtagctttgattgtgattgtggtgagctggagccacctgatcactaacaaaagacatcttctgttaaccaacagccgccagggcttcctgttgaaataaatatatagcaacaaaggaaaaaaagaagcaaaacggaaatagtgcttaccagcaccttagaatgatgctgctcaggaccagtccaacactgaatgtatctgcactgtgaggagaatgttcatagaagcctgttgtgtgcatatttattcacatttttgttaaatgttaaatcgtttagcacggtaatctgagtgcacagtatgtcatttcattccgtttgagtttcttgttttcgttaaatgtctgcagagttgctgcccctttcttgaactatgagtactgcaatctttttaattctcaatatgaatagagctttttgagctttaaatctaaggggaactcgacaggcctgtttggcatatgcaatgaacatcaagaaaccatcttgctgtggaagcataattatttttcttctccctttttgaaagatctttccttttgatgccagttttcttccttgtttacacaagttcaatttgaaaggaaaaggcaatagtaagggtttcaaaatggcagagaaatttgaaagtctcatgaacattcatggttttgatctgggttctaggtatatggacttaaaaccattgggttgtggaggcaatggcttggttttttctgctgtagacaatgactgtgacaaaagagtagccatcaagaaaattgtccttactgatccccagagtgtcaaacatgctctacgtgaaatcaaaattattagaagacttgaccatgataacattgtgaaagtgtttgagattcttggtcccagtggaagccaattaacagacgatgtgggctctcttacggaactgaacagtgtttacattgttcaggagtacatggagacagacttggctaatgtgctggagcagggccctttactggaagagcatgccaggcttttcatgtatcagctgctacgggggctcaagtatattcactctgcaaatgtactgcacagagatctcaaaccagctaatcttttcattaatacggaagacttggtgctgaagataggtgactttggtcttgcacggatcatggatcctcattattcccataagggtcatctttctgaaggattggttactaaatggtacagatctccacgtcttttactttctcctaataattatactaaagccattgacatgtgggctgcaggctgcatctttgctgaaatgctgactggtaaaaccctttttgcaggtgcacatgaacttgaacagatgcagctgattttagaatctattcctgttgtacatgaggaagatcgtcaggagcttctcagcgtaattccagtttacattagaaatgacatgactgagccacacaaacctttaactcagctgcttccaggaattagtcgagaagcactggatttcctggaacaaattttgacatttagccccatggatcggttaacagcagaagaagcactctcccatccttacatgagcatatattcttttccaatggatgagccaatttcaagccatccttttcatattgaagatgaagttgatgatattttgcttatggatgaaactcacagtcacatttataactgggaaaggtatcatgattgtcagttttcagagcatgattggcctgtacataacaactttgatattgatgaagttcagcttgatccaagagctctgtccgatgtcactgatgaagaagaagtacaagttgatccccgaaaatatttggatggagatcgggaaaagtatctggaggatcctgcttttgataccaattactctactgagccttgttggcaatactcagatcatcatgaaaacaaatattgtgatctggagtgtagccatacttgtaactacaaaacgaggtcatcatcatatttagataacttagtttggagagagagtgaagttaaccattactatgaacccaagcttattatagatctttccaattggaaagaacaaagcaaagaaaaatctgataagaaaggcaaatcaaaatgtgaaaggaatggattggttaaagcccagatagcgctagaggaagcatcacagcaactggctggaaaagaaagggaaaagaatcagggatttgattttgattcctttattgcaggaactattcagcttagttcccagcatgagcctactgatgttgttgataaattaaatgacttgaatagctcagtgtcccaactagaattgaaaagtttgatatcaaagtcagtaagccaagaaaaacaggaaaaaggaatggcaaatctggctcaattagaagccttgtaccagtcttcttgggacagccagtttgtgagtggtggggaggactgttttttcataaatcagttttgtgaggtaaggaaggatgaacaagttgagaaggaaaacacttacactagttacttggacaagttctttagcaggaaagaagatactgaaatgctagaaactgagccagtagaggatgggaagcttggggagagaggacatgaggaaggatttctgaacaacagtggggagttcctctttaacaagcagctcgagtccataggcatcccacagtttcacagtccagttgggtcacgtcgacgcggccgcggtcgacgcggccgc

SEQ ID NO: 417672 - DNA, 1559 bp, Homo sapiens
caatgaaccatggattaccgtaattcggagctccggtacccctttgagtggtcaactgtcctgaaacatctgaactaaaacactcagcagacatttatctttgtattcttcatgaaatgtgttttgtctttttttattactagtgtttaagtcattttttacttgaatcagatggtgtcatttagtaaggattttatgagttcttgttttttaaaatccagactttctttttctacatgtgagatagttttcattttaactggcatgtcatttgcacacaaaaataaagactagagcaaaataatgcaacgcaggaggagaaaagaaatgcactaagacaagaacattctctcatagaacattgatctgttttacaggaaacaaaccttgccttgaaatttacacagtgagactgtacataattgcatgaaaatagctatttttttcctaagacatttttcattcatgaatattttcaagtttttcatactgtacacatttcttaaaacacatgataccagcagcaactgaaaatgaatgccgaatttggtacacatgtgttatctacctcaaggtaacaagagtatgtggcaaaacatataccacccatagtgcttcacaaaatgcacttctatttagccagcgtttattgtagtaaactattcttaataaaactcactcactgtttataaatgttctggtatgcattctttatagtgaagtgttaatacatcacatcttatttattttagcaaatcagtatattttctgtatttaattataaaaaattaacttagtttttaaaatttatttgcaaatatactttttccatttggcactatggtttgttgcctacctagctgcatctataatgtcagcttatcctaaggctgtccacgtacttaatttacttaagtgttcattttaagtaacgtgctcactgtgtataggaatttgtattttggaggtgcttgatctatctacaaagaaaaattaattaggaattactttattataaaatgctcctagaagtcttaattgtgtttattttttaaaaaaacaaatgttagacttgtgtgcatggaagtaattaaggtacatcattattgtagtttgaaagttgtacatgataagacattttgtttttactgtatgtttttactgaatgatctattccccatcccaaggcaagcatgaataaaattaggttaaacgtagcatgtggcatcgcagtctcttagaatttgtttcatctattttattttattgaatactgtctgtatctttggttatcctgtttgaagaaaaaggacaaataaaacatggccagcaaatacagctcctgtttcactcttgggttaatgaaaattttctgctagaatgaaaattactaccagaatcactttgaattatggccataaattgctagtctgaaaggctgagaaggttcaagtcttttgacttaaaccatcacatattagaatggaataaagctttataatatttcaaaactgttaggtaaaatgtgtagttgaaactttgaactgtgcagtcagaaa

SEQ ID NO: 417673 - DNA, 1280 bp, Homo sapiens
ggaggcgatctagaggatccctcataggttcgcaggaggagaaaagaaatgcactaagacaagaacattctctcatagaacattgatctgttttacaggaaacaaaccttgccttgaaatttacacagtgagactgtacataattgcatgaaaatagctatttttttcctaagacatttttcattcatgaatattttcaagtttttcatactgtacacatttcttaaaacacatgataccagcagcaactgaaaatgaatgccgaatttggtacacatgtgttatctacctcaaggtaacaagagtatgtggcaaaacatataccacccatagtgcttcacaaaatgcacttctatttagccagcgtttattgtagtaaactattcttaataaaactcactcactgtttataaatgttctggtatgcattctttatagtgaagtgttaatacatcacatcttatttattttagcaaatcagtatattttctgtatttaattataaaaaattaacttagtttttaaaatttatttgcaaatatactttttccatttggcactatggtttgttgcctacctagctgcatctataatgtcagcttatcctaaggctgtccacgtacttaatttacttaagtgttcattttaagtaacgtgctcactgtgtataggaatttgtattttggaggtgcttgatctatctacaaagaaaaattaattaggaattactttattataaaatgctcctagaagtcttaattgtgtttattttttaaaaaaacaaatgttagacttgtgtgcatggaagtaattaaggtacatcattattgtagtttgaaagttgtacatgataagacattttgtttttactgtatgtttttactgaatgatctattccccatcccaaggcaagcatgaataaaattaggttaaacgtagcatgtggcatcgcagtctcttagaatttgtttcatctattttattttattgaatactgtctgtatctttggttatcctgtttgaagaaaaaggacaaataaaacatggccagcaaatacagctcctgtttcactcttgggttaatgaaaattttctgctagaatgaaaattactaccagaatcactttgaattatggccataaattgctagtctgaaaggctgagaaggttcaagtcttttgacttaaaccatcacatattagaatggaataaagctttataatatttcaaaactgttaggtaaaatgtgtagttgaaactttgaactgtgcagtcagaaa

SEQ ID NO: 417674 - DNA, 331 bp, Homo sapiens
gtgaattgctgataacatttttgtaagctatttttgattaagggtaatttgtcacttaatgaccataattaagtttaatgtaccagtagtagtttattgctaaatgcctactttgtgtcatactacaaatttgaagaaaagagtatttcctgcaatggtgactctcttctttttctcatccccccaggttgtatcagagtaagatggacggtagctttgattgtgattgtggtgagctggagccacctgatcactaacaaaagacatcttctgttaaccaacagccgccagggcttcctgttgaaataaatatatagcaacaaaggaaaaa

SEQ ID NO: 417675 - DNA, 495 bp, Homo sapiens
cactcagccagaaaatcgtttttaagttgtaaatcaggtaagttttatttctgacaaattaactttttaattgtgtagtccatttttcccttttataagatggggacctattagtacaattaagatgctcatttcctgttgtgtagtatgtagtgctaaggtaatcacttagctagtcattgaaataaatgagatcaacatttactgtttttctaaaggtaagcaattcttttctgaaaaacttttaccttttcctctgcagcactggatttcctggaacaaattttgacatttagccccatggatcggttaacagcagaagaagcactctcccatccttacatgagcatatattcttttccaatggatgagccaatttcaagccatccttttcatattgaagatgaagttgatgatattttgcttatggatgaaactcacagtcacatttataactgggaaaggtaaattgatcctaaattagaaaaataatat

SEQ ID NO: 417676 - DNA, 4553 bp, Homo sapiens
ctgcagtggatggtaaagtcacgggtcattagcgagctacaggaggcctgctgggacatggtatctgccatggcggcgactgcggcaaagcgagagcctcggagacgccgctgccgccagcacagccggagacctgagccgacactgggggcagtccgcgagccccgcactctctcgatgagtcggagaagtcccaactgactttacagtgtacatttatcagaaatgtaaaacatgactgagctttaaggaattgtctacgttaaggcaagaaggttgtatcagagtaagatggacggtagctttgattgtgattgtggtgagctggagccacctgatcactaacaaaagacatcttctgttaaccaacagccgccagggcttcctgttgaaataaatatatagcaacaaaggaaaaaaagaagcaaaacggaaatagtgcttaccagcaccttagaatgatgctgctcaggaccagtccaacactgaatgtatctgcactgtgaggagaatgttcatagaagcctgttgtgtgcatatttattcacatttttgttaaatgttaaatcgtttagcacggtaatctgagtgcacagtatgtcatttcattccgtttgagtttcttgttttcgttaaatgtctgcagagttgctgcccctttcttgaactatgagtactgcaatctttttaattctcaatatgaatagagctttttgagctttaaatctaaggggaactcgacaggcctgtttggcatatgcaatgaacatcaagaaaccatcttgctgtggaagcataattatttttcttctccctttttgaaagatctttccttttgatgccagttttcttccttgtttacacaagttcaatttgaaaggaaaaggcaatagtaagggtttcaaaatggcagagaaatttgaaagtctcatgaacattcatggttttgatctgggttctaggtatatggacttaaaaccattgggttgtggaggcaatggcttggttttttctgctgtagacaatgactgtgacaaaagagtagccatcaagaaaattgtccttactgatccccagagtgtcaaacatgctctacgtgaaatcaaaattattagaagacttgaccatgataacattgtgaaagtgtttgagattcttggtcccagtggaagccaattaacagacgatgtgggctctcttacggaactgaacagtgtttacattgttcaggagtacatggagacagacttggctaatgtgctggagcagggccctttactggaagagcatgccaggcttttcatgtatcagctgctacgggggctcaagtatattcactctgcaaatgtactgcacagagatctcaaaccagctaatcttttcattaatacggaagacttggtgctgaagataggtgactttggtcttgcacggatcatggatcctcattattcccataagggtcatctttctgaaggattggttactaaatggtacagatctccacgtcttttactttctcctaataattatactaaagccattgacatgtgggctgcaggctgcatctttgctgaaatgctgactggtaaaaccctttttgcaggtgcacatgaacttgaacagatgcagctgattttagaatctattcctgttgtacatgaggaagatcgtcaggagcttctcagcgtaattccagtttacattagaaatgacatgactgagccacacaaacctttaactcagctgcttccaggaattagtcgagaagcactggatttcctggaacaaattttgacatttagccccatggatcggttaacagcagaagaagcactctcccatccttacatgagcatatattcttttccaatggatgagccaatttcaagccatccttttcatattgaagatgaagttgatgatattttgcttatggatgaaactcacagtcacatttataactgggaaaggtatcatgattgtcagttttcagagcatgattggcctgtacataacaactttgatattgatgaagttcagcttgatccaagagctctgtccgatgtcactgatgaagaagaagtacaagttgatccccgaaaatatttggatggagatcgggaaaagtatctggaggatcctgcttttgataccaattactctactgagccttgttggcaatactcagatcatcatgaaaacaaatattgtgatctggagtgtagccatacttgtaactacaaaacgaggtcatcatcatatttagataacttagtttggagagagagtgaagttaaccattactatgaacccaagcttattatagatctttccaattggaaagaacaaagcaaagaaaaatctgataagaaaggcaaatcaaaatgtgaaaggaatggattggttaaagcccagatagcgctagaggaagcatcacagcaactggctggaaaagaaagggaaaagaatcagggatttgattttgattcctttattgcaggaactattcagcttagttcccagcatgagcctactgatgttgttgataaattaaatgacttgaatagctcagtgtcccaactagaattgaaaagtttgatatcaaagtcagtaagccaagaaaaacaggaaaaaggaatggcaaatctggctcaattagaagccttgtaccagtcttcttgggacagccagtttgtgagtggtggggaggactgttttttcataaatcagttttgtgaggtaaggaaggatgaacaagttgagaaggaaaacacttacactagttacttggacaagttctttagcaggaaagaagatactgaaatgctagaaactgagccagtagaggatgggaagcttggggagagaggacatgaggaaggatttctgaacaacagtggggagttcctctttaacaagcagctcgagtccataggcatcccacagtttcacagtccagttgggtcaccacttaagtcaatacaggccacattaacaccttctgctatgaaatcttcccctcaaattcctcatcaaacatacagcagcattctgaaacatctgaactaaaacactcagcagacatttatctttgtattcttcatgaaatgtgttttgtctttttttattactagtgtttaagtcattttttacttgaatcagatggtgtcatttagtaaggattttatgagttcttgttttttaaaatccagactttctttttctacatgtgagatagttttcattttaactggcatgtcatttgcacacaaaaataaagactagagcaaaataatgcaacgcaggaggagaaaagaaatgcactaagacaagaacattctctcatagaacattgatctgttttacaggaaacaaaccttgccttgaaatttacacagtgagactgtacataattgcatgaaaatagctatttttttcctaagacatttttcattcatgaatattttcaagtttttcatactgtacacatttcttaaaacacatgataccagcagcaactgaaaatgaatgccgaatttggtacacatgtgttatctacctcaaggtaacaagagtatgtggcaaaacatataccacccatagtgcttcacaaaatgcacttctatttagccagcgtttattgtagtaaactattcttaataaaactcactcactgtttataaatgttctggtatgcattctttatagtgaagtgttaatacatcacatcttatttattttagcaaatcagtatattttctgtatttaattataaaaaattaacttagtttttaaaatttatttgcaaatatactttttccatttggcactatggtttgttgcctacctagctgcatctataatgtcagcttatcctaaggctgtccacgtacttaatttacttaagtgttcattttaagtaacgtgctcactgtgtataggaatttgtattttggaggtgcttgatctatctacaaagaaaaattaattaggaattactttattataaaatgctcctagaagtcttaattgtgtttattttttaaaaaaacaaatgttagacttgtgtgcatggaagtaattaaggtacatcattattgtagtttgaaagttgtacatgataagacattttgtttttactgtatgtttttactgaatgatctattccccatcccaaggcaagcatgaataaaattaggttaaacgtagcatgtggcatcgcagtctcttagaatttgtttcatctattttattttattgaatactgtctgtatctttggttatcctgtttgaagaaaaaggacaaataaaacatggccagcaaatacagctcctgtttcactcttgggttaatgaaaattttctgctagaatgaaaattactaccagaatcactttgaattatggccataaattgctagtctgaaaggctgagaaggttcaagtcttttgacttaaaccatcacatattagaatggaataaagctttataatatttcaaaactgttaggtaaaatgtgtagttgaaactttgaactgtgcagtcagaaa

SEQ ID NO: 417677 - DNA, 4208 bp, Homo sapiens
ctgcagtggatggtaaagtcacgggtcattagcgagctacaggaggcctgctgggacatggtatctgccatggcggcgactgcggcaaagcgagagcctcggagacgccgctgccgccagcacagccggagacctgagccgacactgggggcagtccgcgagccccgcactctctcgatgagtcggagaagtcccgttgtatcagagtaagatggacggtagctttgattgtgattgtggtgagctggagccacctgatcactaacaaaagacatcttctgttaaccaacagccgccagggcttcctgttgaaataaatatatagcaacaaaggaaaaaaagaagcaaaacggaaatagtgcttaccagcaccttagaatgatgctgctcaggaccagtccaacactgaatgtatctgcactgtgaggagaatgttcatagaagcctgttgtgtgcatatttattcacatttttgttaaatgttaaatcgtttagcacggtaatctgagtgcacagtatgtcatttcattccgtttgagtttcttgttttcgttaaatgtctgcagagttgctgcccctttcttgaactatgagtactgcaatctttttaattctcaatatgaatagagctttttgagctttaaatctaaggggaactcgacaggcctgtttggcatatgcaatgaacatcaagaaaccatcttgctgtggaagcataattatttttcttctccctttttgaaagatctttccttttgatgccagttttcttccttgtttacacaagttcaatttgaaaggaaaaggcaatagtaagggtttcaaaatggcagagaaatttgaaagtctcatgaacattcatggttttgatctgggttctaggtatatggacttaaaaccattgggttgtggaggcaatggcttggttttttctgctgtagacaatgactgtgacaaaagagtagccatcaagaaaattgtccttactgatccccagagtgtcaaacatgctctacgtgaaatcaaaattattagaagacttgaccatgataacattgtgaaagtgtttgagattcttggtcccagtggaagccaattaacagacgatgtgggctctcttacggaactgaacagtgtttacattgttcaggagtacatggagacagacttggctaatgtgctggagcagggccctttactggaagagcatgccaggcttttcatgtatcagctgctacgggggctcaagtatattcactctgcaaatgtactgcacagagatctcaaaccagctaatcttttcattaatacggaagacttggtgctgaagataggtgactttggtcttgcacggatcatggatcctcattattcccataagggtcatctttctgaaggattggttactaaatggtacagatctccacgtcttttactttctcctaataattatactaaagccattgacatgtgggctgcaggctgcatctttgctgaaatgctgactggtaaaaccctttttgcaggtgcacatgaacttgaacagatgcagctgattttagaatctattcctgttgtacatgaggaagatcgtcaggagcttctcagcgtaattccagtttacattagaaatgacatgactgagccacacaaacctttaactcagctgcttccaggaattagtcgagaagcactggatttcctggaacaaattttgacatttagccccatggatcggttaacagcagaagaagcactctcccatccttacatgagcatatattcttttccaatggatgagccaatttcaagccatccttttcatattgaagatgaagttgatgatattttgcttatggatgaaactcacagtcacatttataactgggaaaggtatcatgattgtcagttttcagagcatgattggcctgtacataacaactttgatattgatgaagttcagcttgatccaagagctctgtccgatgtcactgatgaagaagaagtacaagttgatccccgaaaatatttggatggagatcgggaaaagtatctggaggatcctgcttttgataccaattactctactgagccttgttggcaatactcagatcatcatgaaaacaaatattgtgatctggagtgtagccatacttgtaactacaaaacgaggtcatcatcatatttagataacttagtttggagagagagtgaagttaaccattactatgaacccaagcttattatagatctttccaattggaaagaacaaagcaaagaaaaatctgataagaaaggcaaatcaaaatgtgaaaggaatggattggttaaagcccagatagcgctagaggaagcatcacagcaactggctggaaaagaaagggaaaagaatcagggatttgattttgattcctttattgcaggaactattcagcttagttcccagcatgagcctactgatgttgttgataaattaaatgacttgaatagctcagtgtcccaactagaattgaaaagtttgatatcaaagtcagtaagccaagaaaaacaggaaaaaggaatggcaaatctggctcaattagaagccttgtaccagtcttcttgggacagccagtttgtgagtggtggggaggactgttttttcataaatcagttttgtgaggtaaggaaggatgaacaagttgagaaggaaaacacttacactagttacttggacaagttctttagcaggaaagaagatactgaaatgctagaaactgagccagtagaggatgggaagcttggggagagaggacatgaggaaggatttctgaacaacagtggggagttcctctttaacaagcagctcgagtccataggcatcccacagtttcacagtccagttgggtcaccacttaagtcaatacaggccacattaacaccttctgctatgaaatcttcccctcaaattcctcatcaaacatacagcagcattctgaaacatctgaactaaaacactcagcagacatttatctttgtattcttcatgaaatgtgttttgtctttttttattactagtgtttaagtcattttttacttgaatcagatggtgtcatttagtaaggattttatgagttcttgttttttaaaatccagactttctttttctacatgtgagatagttttcattttaactggcatgtcatttgcacacaaaaataaagactagagcaaaataatgcaacgcaggaggagaaaagaaatgcactaagacaagaacattctctcatagaacattgatctgttttacaggaaacaaaccttgccttgaaatttacacagtgagactgtacataattgcatgaaaatagctatttttttcctaagacatttttcattcatgaatattttcaagtttttcatactgtacacatttcttaaaacacatgataccagcagcaactgaaaatgaatgccgaatttggtacacatgtgttatctacctcaaggtaacaagagtatgtggcaaaacatataccacccatagtgcttcacaaaatgcacttctatttagccagcgtttattgtagtaaactattcttaataaaactcactcactgtttataaatgttctggtatgcattctttatagtgaagtgttaatacatcacatcttatttattttagcaaatcagtatattttctgtatttaattataaaaaattaacttagtttttaaaatttatttgcaaatatactttttccatttggcactatggtttgttgcctacctagctgcatctataatgtcagcttatcctaaggctgtccacgtacttaatttacttaagtgttcattttaagtaacgtgctcactgtgtataggaatttgtattttggaggtgcttgatctatctacaaagaaaaattaattaggaattactttattataaaatgctcctagaagtcttaattgtgtttattttttaaaaaaacaaatgttagacttgtgtgcatggaagtaattaaggtacatcattattgtagtttgaaagttgtacatgataagacattttgtttttactgtatgtttttactgaatgatctattccccatcccaaggcaagcatgaataaaattaggttaaacgtaaaaaaaaaaaaggggggcgacaaaaatatcccgagggccaaatagcgacccgttttttcaagggccctagggcaata

SEQ ID NO: 417678 - DNA, 680 bp, Homo sapiens
cgcgtggtcgtcgccaccgcagccgcccgagaggagctgggggaggacggtggcccgcgaggctcgtcgcagacaacgcggcggcgatgtccgcgagccaggcgagtgccgcggcggcagcggcggggccttgcgcgcggcagggcggcctgggcttcggcctccctccggttccctggaagcgggcccgcgaccagcgcgggagcagcagcagaggcggaggctccagcgcgtctctctcctccccctcagcctgagccgggggaagccaggcggcccgggtgtctggaggggggggggtccgctgcccgagaatgggaattctcttcactagaatatggagactgttcaatcaccaggccctttctttgctcaccagttgtgtttggacaccacatagaagtgctggggtcttctggaatgaaggttatagattgctgccctaaccgcaccactgagcgaccgagggttgcagaatgcggaaaacgggaggaatcgctcgacttgtccattacacctctggtttatgagcctgccctccactgccacccgtctttgtgtgtgttgggggcagggggggttcttctgcctcctgaatagagatggacttctctccatttgttttacttattatatctgtgtttaaggttaagcttaaggtcatttttctactcgtgtgg

SEQ ID NO: 417679 - DNA, 917 bp, Homo sapiens
cgcgtggtcgtcgccaccgcagccgcccgagaggagctgggggaggacggtggcccgcgaggctcgtcgcagacaacgcggcggcgatgtccgcgagccaggcgagtgccgcggcggcagcggcggggccttgcgcgcggcagggcggcctgggcttcggcctccctccggttccctggaagcgggcccgcgaccagcgcgggagcagcagcagaggcggaggctccagcgcgtctctctcctccccctcagcctgagccgggggaagtcgcaaaggcaggccaaattgagatcattgagggagggggaaactcgggacccagaaatagtataaagttgctcatgcagcaatgattgataaatatgacctatgtcggtacatccaagatgtgcgtgtaatttgatattgagatagattcatatggagagatgatccggtagaagagaactatccgatgtctgtaacctaagtgaatgccggagaatttatatgtgaagagtcggaacgttggaactctaactgaagaatgtgaaaacagagaggtgagatataaatgtgagatcatgatagacgtttgaacccagaagaatgatgataaatatttgggaggcgcaaaagaatggactatgcagatcggaggcttatgagaggactagtgacagaaagacagaatgacagtgagggaataaaagatgagataaataatgcagcttaatgcggatatcatgggcactaattattaccggtgggccaatgattgtaaaagcgtctataatatatcgttgaaattgggccgcgaaagagggatcgcaaattgaattaacgccaggtataaacgtgaaggggttaacttaaggaagtgccacataagagatggtgggattggcggaagccgaagttccgcgaaaaattgccg

SEQ ID NO: 417680 - DNA, 3148 bp, Homo sapiens
cgcgtggtcgtcgccaccgcagccgcccgagaggagctgggggaggacggtggcccgcgaggctcgtcgcagacaacgcggcggcgatgtccgcgagccaggcgagtgccgcggcggcagcggcggggccttgcgcgcggcagggcggcctgggcttcggcctccctccggttccctggaagcgggcccgcgaccagcgcgggagcagcagcagaggcggaggctccagcgcgtctctctcctccccctcagcctgagccgggggaagccaggcggcccgggtgtctggaggggggggggtccgctgcccgagaatgggaattctcttcactagaatatggagactgttcaatcaccaggagcacaaagttatcattgttgggctggataatgcagggaaaactaccattctttaccaattttctatgaatgaagttgtacatacatctcctacaataggaagtaatgtagaagagatagtgattaataatacacgtttcctaatgtgggatattggtggccaagaatctcttcgttcttcctggaacacttactatactaacacagagtttgtaatagttgttgtggacagtacagacagagagaggatttctgtaactagagaagaactctataaaatgttagcgcatgaggacctaagaaaagctggattgctgatttttgctaataaacaagatgttaaagaatgcatgactgtagcagaaatctcccagtttttgaagctaacttctattaaagatcaccagtggcatatccaggcatgctgtgctctaactggcgagggattgtgccaaggacttgaatggatgatgtcacgacttaagattagatgatctctactgacctcttctcatagattttgtataaatgaagtgctggactttacctgaaagctgcaaaaattaatggtttagatatatttataataaactgatttaaactttttctataagaagaaaaattaagaccacttatttgaaaacaaagatgaagtctcaccttccagtttgctttctcattagttttttccaaagtaagttattgaagctgtgattgacatttttctcataatgaatcctctcaggacattgtgtagcctatggtaagtacaaagggagaggaagacattttgaattttaagagctttattatcagtttaaccctccctagttgaatgttattttcttcttgttccattaagtcagaatacaaatcagcacagatattcgaatgtttccaatattttaaaatgtaatgttacttatgaaaagtattttgcttaaggttgtgtgtgtattgtgtatatacctcaagttcaagttaatggcattgatttatgttccagacaaaaataacacaaataataatatccttcgttataaccacaatgagataagtattggcattagtgttcagtgccattttatactttctctctgtgttctctgtattgtactaaccaacctcccaaatcgctgagctgcttgtttaaaaaaaaaaaaaaggaaaaggaaaaagcatgacattgtgtatcgattttttgttgttgaccaaaatcacacacatggaaacatgtaattcaacagagtgggaaagctagcagattcttggcttagtattactaataggcaggattgtacaatgagcaactatcagattattcctttcagtggttcttatggcatctaaattactgaataaattattaatccattaatcagtgaatcaaattatgattacaattatcaaatgaatgctcagcattaattgaaaactgttttgtgaaacatgtctacccagaaaagtagcattctataaatactattaaacaacttagctatattatttttaagtattaaattatatgtcaagcagttaaagtgaatttcagagtaaaagtaaggcatgtttctgagcaacattgataatttcttaatttgcaaatttcttcttattttggtacttggaatatagtgtgagattttttatttctaaattttgttgtatcttctattacataaatgcattgacaattataaaatgcaagtgttttttgaatgattttaagaatttggcttaaaaattgattgatacaacgtattatttgtactaagaagtaacttgacccaaaacaccttttatgtttgcttagggtatattttttcagtgtctgaaagtcaaaggtattcctgtcacaactgtaaacaaacttatcctaaatgtgttaaaacatattcttgggtactctatttatgtatctttcatgccttgaaaatctgaaggttaatccaaactcacatgttttagcatatttgagaaaaaaaaactaccttcaatatcagccttttaaatttcatgaagattttggtgaggaataatagtatatagtttaagtattgacaaaactttgaaagtttctttctttaaaatgggaaatactcaatatctaaatccaggtcaggcatgggatatcagtatttaacattggatgttttatgttttatatttataatgttcaaaatgcaagcataacatttaatatttgtccacatggttttacaaaagtaaatcttaaattactaagcttttcccatatgttctcgtactttctcaaatccctataaagaattacttgttatctattaaaaatctcctttacccaaatctgtattatggtttcgccagacaaatattatgtgatgtagcccagaaaatccacaccttttgtcctttttatgttttaatttgaataatcatgtgcttagtcccttggtttactgccacatcagtttaacacgatatcagcacattcccttgtcatcatcaaggtgttggctcagatttattcttaattggatgtttaaagcatgtactaccttgttacagttggtttagtgtagtggattattgacatgacatcatgagaagatgtgtaattttataccacatttataaaacatgattttgttttctacccttcaaggtaaacattaaaaataaggtggtacttgtgtacttgtacataaaaccaaaattatagttgggaaaaaaataaatttatatatgaaaatgtcaaaatcattttaaaagtattattttcaaataaaatggagaagctggtgaaaag

SEQ ID NO: 417681 - DNA, 3090 bp, Homo sapiens
cgcgtggtcgtcgccaccgcagccgcccgagaggagctgggggaggacggtggcccgcgaggctcgtcgcagacaacgcggcggcgatgtccgcgagccaggcgagtgccgcggcggcagcggcggggccttgcgcgcggcagggcggcctgggcttcggcctccctccggttccctggaagcgggcccgcgaccagcgcgggagcagcagcagaggcggaggctccagcgcgtctctctcctccccctcagcctgagccgggggaagccaggcggcccgggtgtctggaggggggggggtccgctgcccgagaatgggaattctcttcactagaatatggagactgttcaatcaccaggagcacaaagttatcattgttgggctggataatgcagggaaaactaccattctttaccaattttctatgaatgaagttgtacatacatctcctacaataggaagtaatgtagaagagatagtgattaataatacacgtttcctaatgtgggatattggtggccaagaatctcttcgttcttcctggaacacttactatactaacacagagtttgtaatagttgttgtggacagtacagacagagagaggatttctgtaactagagaagaactctataaaatgttagcgcatgaggacctaagaaaagctggattgctgatttttgctaataaacaagatgttaaagaatgcatgactgtagcagaaatctcccagtttttgaagctaacttctattaaagatcaccagtggcatatccaggcatgctgtgctctaactggcgagggattgtgccaaggacttgaatggatgatgtcacgacttaagattagatgatctctactgacctcttctcatagattttgtataaatgaagtgctggactttacctgaaagctgcaaaaattaatggtttagatatatttataataaactgatttaaactttttctataagaagaaaaattaagaccacttatttgaaaacaaagatgaagtctcaccttccagtttgctttctcattagttttttccaaagtaagttattgaagctgtgattgacatttttctcataatgaatcctctcaggacattgtgtagcctatggtaagtacaaagggagaggaagacattttgaattttaagagctttattatcagtttaaccctccctagttgaatgttattttcttcttgttccattaagtcagaatacaaatcagcacagatattcgaatgtttccaatattttaaaatgtaatgttacttatgaaaagtattttgcttaaggttgtgtgtgtattgtgtatatacctcaagttcaagttaatggcattgatttatgttccagacaaaaataacacaaataataatatccttcgttataaccacaatgagataagtattggcattagtgttcagtgccattttatactttctctctgtgttctctgtattgtactaaccaacctcccaaatcgctgagctgcttgtttaaaaaaaaaaaaaaggaaaaggaaaaagcatgacattgtgtatcgattttttgttgttgaccaaaatcacacacatggaaacatgtaattcaacagagtgggaaagctagcagattcttggcttagtattactaataggcaggattgtacaatgagcaactatcagattattcctttcagtggttcttatggcatctaaattactgaataaattattaatccattaatcagtgaatcaaattatgattacaattatcaaatgaatgctcagcattaattgaaaactgttttgtgaaacatgtctacccagaaaagtagcattctataaatactattaaacaacttagctatattatttttaagtattaaattatatgtcaagcagttaaagtgaatttcagagtaaaagtaaggcatgtttctgagcaacattgataatttcttaatttgcaaatttcttcttattttggtacttggaatatagtgtgagattttttatttctaaattttgttgtatcttctattacataaatgcattgacaattataaaatgcaagtgttttttgaatgattttaagaatttggcttaaaaattgattgatacaacgtattatttgtactaagaagtaacttgacccaaaacaccttttatgtttgcttagggtatattttttcagtgtctgaaagtcaaaggtattcctgtcacaactgtaaacaaacttatcctaaatgtgttaaaacatattcttgggtactctatttatgtatctttcatgccttgaaaatctgaaggttaatccaaactcacatgttttagcatatttgagaaatagtatatagtttaagtattgacaaaactttgaaagtttctttctttaaaatgggaaatactcaatatctaaatccaggtcaggcatgggatatcagtatttaacattggatgttttatgttttatatttataatgttcaaaatgcaagcataacatttaatatttgtccacatggttttacaaaagtaaatcttaaattactaagcttttcccatatgttctcgtactttctcaaatccctataaagaattacttgttatctattaaaaatctcctttacccaaatctgtattatggtttcgccagacaaatattatgtgatgtagcccagaaaatccacaccttttgtcctttttatgttttaatttgaataatcatgtgcttagtcccttggtttactgccacatcagtttaacacgatatcagcacattcccttgtcatcatcaaggtgttggctcagatttattcttaattggatgtttaaagcatgtactaccttgttacagttggtttagtgtagtggattattgacatgacatcatgagaagatgtgtaattttataccacatttataaaacatgattttgttttctacccttcaaggtaaacattaaaaataaggtggtacttgtgtacttgtacataaaaccaaaattatagttgggaaaaaaataaatttatatatgaaaatgtcaaaatcattttaaaagtattattttcaaataaaatggagaagctggtgaaaag

SEQ ID NO: 417682 - DNA, 2543 bp, Homo sapiens
  misc_feature (2151)..(2151): n is a, c, g, or t
cgcgtggtcgtcgccaccgcagccgcccgagaggagctgggggaggacggtggcccgcgaggctcgtcgcagacaacgcggcggcgatgtccgcgagccaggcgagtgccgcggcggcagcggcggggccttgcgcgcggcagggcggcctgggcttcggcctccctccggttccctggaagcgggcccgcgaccagcgcgggagcagcagcagaggcggaggctccagcgcgtctctctcctccccctcagcctgagccgggggaagccaggcggcccgggtgtctggaggggggggggtccgctgcccgagaatgggaattctcttcactagaatatggagactgttcaatcaccaggagcacaaagttatcattgttgggctggataatgcagggaaaactaccattctttaccaattttctatgaatgaagttgtacatacatctcctacaataggaagtaatgtagaagagatagtgattaataatacacgtttcctaatgtgggatattggtggccaagaatctcttcgttcttcctggaacacttactatactaacacagagtttgtaatagttgttgtggacagtacagacagagagaggatttctgtaactagagaagaactctataaaatgttagcgcatgaggacctaagaaaagctggattgctgatttttgctaataaacaagatgttaaagaatgcatgactgtagcagaaatctcccagtttttgaagctaacttctattaaagatcaccagtggcatatccaggcatgctgtgctctaactggcgagggattgtgccaaggacttgaatggatgatgtcacgacttaagattagatgatctctactgacctcttctcatagattttgtataaatgaagtgctggactttacctgaaagctgcaaaaattaatggtttagatatatttataataaactgatttaaactttttctataagaagaaaaattaagaccacttatttgaaaacaaagatgaagtctcaccttccagtttgctttctcattagttttttccaaagtaagttattgaagctgtgattgacatttttctcataatgaatcctctcaggacattgtgtagcctatggtaagtacaaagggagaggaagacattttgaattttaagagctttattatcagtttaaccctccctagttgaatgttattttcttcttgttccattaagtcagaatacaaatcagcacagatattcgaatgtttccaatattttaaaatgtaatgttacttatgaaaagtattttgcttaaggttgtgtgtgtattgtgtatatacctcaagttcaagttaatggcattgatttatgttccagacaaaaataacacaaataataatatccttcgttataaccacaatgagataagtattggcattagtgttcagtgccattttatactttctctctgtgttctctgtattgtactaaccaacctcccaaatcgctgagctgcttgtttaaaaaaaaaaaaaaggaaaaggaaaaagcatgacattgtgtatcgattttttgttgttgaccaaaatcacacacatggaaacatgtaattcaacagagtgggaaagctagcagattcttggcttagtattactaataggcaggattgtacaatgagcaactatcagattattcctttcagtggttcttatggcatctaaattactgaataaattattaatccattaatcagtgaatcaaattatgattacaattatcaaatgaatgctcagcattaattgaaaactgttttgtgaaacatgtctacccagaaaagtagcattctataaatactattaaacaacttagctatattatttttaagtattaaattatatgtcaagcagttaaagtgaatttcagagtaaaagtaaggcatgtttctgagcaacattgataatttcttaatttgcaaatttcttcttattttggtacttggaatatagtgtgagattttttatttctaaattttgttgtatcttctattacataaatgcattgacaattataaaatgcaagtgttttttgaatgattttaagaatttggcttaaaaattgattgatacaacgtattatttgtactaagaagtaacttgaccgcnctgcaaaaaaaaaaaaaaaaaaaaaaaaaaaaaaaaaaaaaaaaaaaaaaaagggggggggcaaaaatttcccggggggggcattggccaccattttttggaaaagggggccccttaaagggagctgctattatttataaaacagagcggcgcggggcgcgagttttaaaaaaagaggtgttgaagtggatgaaaaagttggctatgtgggggatatttgtgggaagaaagacaccattttctgggggggtgggacaaaatgttggcaacatatcatataaaggaatttaaagcgccagggggaacatataaacatgtaaggtgtttatgtggtcaaaaagggatatatgtggggagaaaaaatgtgacaggagattattttagaaatttcg

SEQ ID NO: 417683 - DNA, 1921 bp, Homo sapiens
  misc_feature (1529)..(1529): n is a, c, g, or t
cgcgtggtcgtcgccaccgcagccgcccgagaggagctgggggaggacggtggcccgcgaggctcgtcgcagacaacgcggcggcgatgtccgcgagccaggcgagtgccgcggcggcagcggcggggccttgcgcgcggcagggcggcctgggcttcggcctccctccggttccctggaagcgggcccgcgaccagcgcgggagcagcagcagaggcggaggctccagcgcgtctctctcctccccctcagcctgagccgggggaagccaggcggcccgggtgtctggaggggggggggtccgctgcccgagaatgggaattctcttcactagaatatggagactgttcaatcaccaggagcacaaagttatcattgttgggctggataatgcagggaaaactaccattctttaccaattttctatgaatgaagttgtacatacatctcctacaataggaagtaatgtagaagagatagtgattaataatacacgtttcctaatgtgggatattggtggccaagaatctcttcgttcttcctggaacacttactatactaacacagagtttgtaatagttgttgtggacagtacagacagagagaggatttctgtaactagagaagaactctataaaatgttagcgcatgaggacctaagaaaagctggattgctgatttttgctaataaacaagatgttaaagaatgcatgactgtagcagaaatctcccagtttttgaagctaacttctattaaagatcaccagtggcatatccaggcatgctgtgctctaactggcgagggattgtgccaaggacttgaatggatgatgtcacgacttaagattagatgatctctactgacctcttctcatagattttgtataaatgaagtgctggactttacctgaaagctgcaaaaattaatggtttagatatatttataataaactgatttaaactttttctataagaagaaaaattaagaccacttatttgaaaacaaagatgaagtctcaccttccagtttgctttctcattagttttttccaaagtaagttattgaagctgtgattgacatttttctcataatgaatcctctcaggacattgtgtagcctatggtaagtacaaagggagaggaagacattttgaattttaagagctttattatcagtttaaccctccctagttgaatgttattttcttcttgttccattaagtcagaatacaaatcagcacagatattcgaatgtttccaatattttaaaatgtaatgttacttatgaaaagtattttgcttaaggttgtgtgtgtattgtgtatatacctcaagttcaagttaatggcattgatttatgttccagacaaaaataacacaaataataatatccttcgttataaccacaatgagataagtattggcattagtgttcagtgccattttatactttctctctgtgttctctgtattgtactaaccaacctcccaaatcgctgagctgcttgtttaaaaaaaaaaaaaaggcnctgcaaaaaaaaaaaaaaaaaaaaaaaaaaaaaaaaaaaaaaaaaaaaaaaagggggggggcaaaaatttcccggggggggcattggccaccattttttggaaaagggggccccttaaagggagctgctattatttataaaacagagcggcgcggggcgcgagttttaaaaaaagaggtgttgaagtggatgaaaaagttggctatgtgggggatatttgtgggaagaaagacaccattttctgggggggtgggacaaaatgttggcaacatatcatataaaggaatttaaagcgccagggggaacatataaacatgtaaggtgtttatgtggtcaaaaagggatatatgtggggagaaaaaatgtgacaggagattattttagaaatttcg

SEQ ID NO: 417684 - DNA, 2889 bp, Homo sapiens
cgcgtggtcgtcgccaccgcagccgcccgagaggagctgggggaggacggtggcccgcgaggctcgtcgcagacaacgcggcggcgatgtccgcgagccagagcacaaagttatcattgttgggctggataatgcagggaaaactaccattctttaccaattttctatgaatgaagttgtacatacatctcctacaataggaagtaatgtagaagagatagtgattaataatacacgtttcctaatgtgggatattggtggccaagaatctcttcgttcttcctggaacacttactatactaacacagagtttgtaatagttgttgtggacagtacagacagagagaggatttctgtaactagagaagaactctataaaatgttagcgcatgaggacctaagaaaagctggattgctgatttttgctaataaacaagatgttaaagaatgcatgactgtagcagaaatctcccagtttttgaagctaacttctattaaagatcaccagtggcatatccaggcatgctgtgctctaactggcgagggattgtgccaaggacttgaatggatgatgtcacgacttaagattagatgatctctactgacctcttctcatagattttgtataaatgaagtgctggactttacctgaaagctgcaaaaattaatggtttagatatatttataataaactgatttaaactttttctataagaagaaaaattaagaccacttatttgaaaacaaagatgaagtctcaccttccagtttgctttctcattagttttttccaaagtaagttattgaagctgtgattgacatttttctcataatgaatcctctcaggacattgtgtagcctatggtaagtacaaagggagaggaagacattttgaattttaagagctttattatcagtttaaccctccctagttgaatgttattttcttcttgttccattaagtcagaatacaaatcagcacagatattcgaatgtttccaatattttaaaatgtaatgttacttatgaaaagtattttgcttaaggttgtgtgtgtattgtgtatatacctcaagttcaagttaatggcattgatttatgttccagacaaaaataacacaaataataatatccttcgttataaccacaatgagataagtattggcattagtgttcagtgccattttatactttctctctgtgttctctgtattgtactaaccaacctcccaaatcgctgagctgcttgtttaaaaaaaaaaaaaaggaaaaggaaaaagcatgacattgtgtatcgattttttgttgttgaccaaaatcacacacatggaaacatgtaattcaacagagtgggaaagctagcagattcttggcttagtattactaataggcaggattgtacaatgagcaactatcagattattcctttcagtggttcttatggcatctaaattactgaataaattattaatccattaatcagtgaatcaaattatgattacaattatcaaatgaatgctcagcattaattgaaaactgttttgtgaaacatgtctacccagaaaagtagcattctataaatactattaaacaacttagctatattatttttaagtattaaattatatgtcaagcagttaaagtgaatttcagagtaaaagtaaggcatgtttctgagcaacattgataatttcttaatttgcaaatttcttcttattttggtacttggaatatagtgtgagattttttatttctaaattttgttgtatcttctattacataaatgcattgacaattataaaatgcaagtgttttttgaatgattttaagaatttggcttaaaaattgattgatacaacgtattatttgtactaagaagtaacttgacccaaaacaccttttatgtttgcttagggtatattttttcagtgtctgaaagtcaaaggtattcctgtcacaactgtaaacaaacttatcctaaatgtgttaaaacatattcttgggtactctatttatgtatctttcatgccttgaaaatctgaaggttaatccaaactcacatgttttagcatatttgagaaaaaaaaactaccttcaatatcagccttttaaatttcatgaagattttggtgaggaataatagtatatagtttaagtattgacaaaactttgaaagtttctttctttaaaatgggaaatactcaatatctaaatccaggtcaggcatgggatatcagtatttaacattggatgttttatgttttatatttataatgttcaaaatgcaagcataacatttaatatttgtccacatggttttacaaaagtaaatcttaaattactaagcttttcccatatgttctcgtactttctcaaatccctataaagaattacttgttatctattaaaaatctcctttacccaaatctgtattatggtttcgccagacaaatattatgtgatgtagcccagaaaatccacaccttttgtcctttttatgttttaatttgaataatcatgtgcttagtcccttggtttactgccacatcagtttaacacgatatcagcacattcccttgtcatcatcaaggtgttggctcagatttattcttaattggatgtttaaagcatgtactaccttgttacagttggtttagtgtagtggattattgacatgacatcatgagaagatgtgtaattttataccacatttataaaacatgattttgttttctacccttcaaggtaaacattaaaaataaggtggtacttgtgtacttgtacataaaaccaaaattatagttgggaaaaaaataaatttatatatgaaaatgtcaaaatcattttaaaagtattattttcaaataaaatggagaagctggtgaaaag

SEQ ID NO: 417685 - DNA, 3332 bp, Homo sapiens
cgcgtggtcgtcgccaccgcagccgcccgagaggagctgggggaggacggtggcccgcgaggctcgtcgcagacaacgcggcggcgatgtccgcgagccaggcgagtgccgcggcggcagcggcggggccttgcgcgcggcagggcggcctgggcttcggcctccctccggttccctggaagcgggcccgcgaccagcgcgggagcagcagcagaggcggaggctccagcgcgtctctctcctccccctcagcctgagccgggggaagccaggcggcccgggtgtctggaggggggggggtccgctgcccgagaatgggaattctcttcactagaatatggagactgttcaatcaccaggagcacaaagttatcattgttgggctggataatgcagggaaaactaccattctttaccaattttctatgaatgaagttgtacatacatctcctacaataggaagtaatgtagaagagatagtgattaataatacacgtttcctaatgtgggatattggtggccaagaatctcttcgttcttcctggaacacttactatactaacacagagtttgtaatagttgttgtggacagtacagacagagagaggatttctgtaactagagaagaactctataaaatgttagcgcatgagaagtaaaaagaagacctaagtagggcctagttggaaagtgaaaggagactgaatgaggagatgaccagagaagaaaggaattacagatgaagttgggagtttgagcaaggtactcagtagggtcaagaagagccaaacaggcaaaattctgcagagagacaaatggatcaaagagtgagaatgtgacctaagaaaagctggattgctgatttttgctaataaacaagatgttaaagaatgcatgactgtagcagaaatctcccagtttttgaagctaacttctattaaagatcaccagtggcatatccaggcatgctgtgctctaactggcgagggattgtgccaaggacttgaatggatgatgtcacgacttaagattagatgatctctactgacctcttctcatagattttgtataaatgaagtgctggactttacctgaaagctgcaaaaattaatggtttagatatatttataataaactgatttaaactttttctataagaagaaaaattaagaccacttatttgaaaacaaagatgaagtctcaccttccagtttgctttctcattagttttttccaaagtaagttattgaagctgtgattgacatttttctcataatgaatcctctcaggacattgtgtagcctatggtaagtacaaagggagaggaagacattttgaattttaagagctttattatcagtttaaccctccctagttgaatgttattttcttcttgttccattaagtcagaatacaaatcagcacagatattcgaatgtttccaatattttaaaatgtaatgttacttatgaaaagtattttgcttaaggttgtgtgtgtattgtgtatatacctcaagttcaagttaatggcattgatttatgttccagacaaaaataacacaaataataatatccttcgttataaccacaatgagataagtattggcattagtgttcagtgccattttatactttctctctgtgttctctgtattgtactaaccaacctcccaaatcgctgagctgcttgtttaaaaaaaaaaaaaaggaaaaggaaaaagcatgacattgtgtatcgattttttgttgttgaccaaaatcacacacatggaaacatgtaattcaacagagtgggaaagctagcagattcttggcttagtattactaataggcaggattgtacaatgagcaactatcagattattcctttcagtggttcttatggcatctaaattactgaataaattattaatccattaatcagtgaatcaaattatgattacaattatcaaatgaatgctcagcattaattgaaaactgttttgtgaaacatgtctacccagaaaagtagcattctataaatactattaaacaacttagctatattatttttaagtattaaattatatgtcaagcagttaaagtgaatttcagagtaaaagtaaggcatgtttctgagcaacattgataatttcttaatttgcaaatttcttcttattttggtacttggaatatagtgtgagattttttatttctaaattttgttgtatcttctattacataaatgcattgacaattataaaatgcaagtgttttttgaatgattttaagaatttggcttaaaaattgattgatacaacgtattatttgtactaagaagtaacttgacccaaaacaccttttatgtttgcttagggtatattttttcagtgtctgaaagtcaaaggtattcctgtcacaactgtaaacaaacttatcctaaatgtgttaaaacatattcttgggtactctatttatgtatctttcatgccttgaaaatctgaaggttaatccaaactcacatgttttagcatatttgagaaaaaaaaactaccttcaatatcagccttttaaatttcatgaagattttggtgaggaataatagtatatagtttaagtattgacaaaactttgaaagtttctttctttaaaatgggaaatactcaatatctaaatccaggtcaggcatgggatatcagtatttaacattggatgttttatgttttatatttataatgttcaaaatgcaagcataacatttaatatttgtccacatggttttacaaaagtaaatcttaaattactaagcttttcccatatgttctcgtactttctcaaatccctataaagaattacttgttatctattaaaaatctcctttacccaaatctgtattatggtttcgccagacaaatattatgtgatgtagcccagaaaatccacaccttttgtcctttttatgttttaatttgaataatcatgtgcttagtcccttggtttactgccacatcagtttaacacgatatcagcacattcccttgtcatcatcaaggtgttggctcagatttattcttaattggatgtttaaagcatgtactaccttgttacagttggtttagtgtagtggattattgacatgacatcatgagaagatgtgtaattttataccacatttataaaacatgattttgttttctacccttcaaggtaaacattaaaaataaggtggtacttgtgtacttgtacataaaaccaaaattatagttgggaaaaaaataaatttatatatgaaaatgtcaaaatcattttaaaagtattattttcaaataaaatggagaagctggtgaaaag

SEQ ID NO: 417686 - DNA, 2078 bp, Homo sapiens
  misc_feature (19)..(20): n is a, c, g, or t
accctagaggatcccccgnntggctagtacaatacagagaacacatagagaaagtataaaatggcactgaactggtatgctaatacttatctcattgtggctataacccaggatattattattgaatgttattttcttcttgttccattaagtcagaatacaaatcagcacagatattcgaatgtttccaatattttaaaatgtaatgttacttatgaaaagtattttgcttaaggttgtgtgtgtattgtgtatatacctcaagttcaagttaatggcattgatttatgttccagacaaaaataacacaaataataatatccttcgttataaccacaatgagataagtattggcattagtgttcagtgccattttatactttctctctgtgttctctgtattgtactaaccaacctcccaaatcgctgagctgcttgtttaaaaaaaaaaaaaaggaaaaggaaaaagcatgacattgtgtatcgattttttgttgttgaccaaaatcacacacatggaaacatgtaattcaacagagtgggaaagctagcagattcttggcttagtattactaataggcaggattgtacaatgagcaactatcagattattcctttcagtggttcttatggcatctaaattactgaataaattattaatccattaatcagtgaatcaaattatgattacaattatcaaatgaatgctcagcattaattgaaaactgttttgtgaaacatgtctacccagaaaagtagcattctataaatactattaaacaacttagctatattatttttaagtattaaattatatgtcaagcagttaaagtgaatttcagagtaaaagtaaggcatgtttctgagcaacattgataatttcttaatttgcaaatttcttcttattttggtacttggaatatagtgtgagattttttatttctaaattttgttgtatcttctattacataaatgcattgacaattataaaatgcaagtgttttttgaatgattttaagaatttggcttaaaaattgattgatacaacgtattatttgtactaagaagtaacttgacccaaaacaccttttatgtttgcttagggtatattttttcagtgtctgaaagtcaaaggtattcctgtcacaactgtaaacaaacttatcctaaatgtgttaaaacatattcttgggtactctatttatgtatctttcatgccttgaaaatctgaaggttaatccaaactcacatgttttagcatatttgagaaaaaaaaactaccttcaatatcagccttttaaatttcatgaagattttggtgaggaataatagtatatagtttaagtattgacaaaactttgaaagtttctttctttaaaatgggaaatactcaatatctaaatccaggtcaggcatgggatatcagtatttaacattggatgttttatgttttatatttataatgttcaaaatgcaagcataacatttaatatttgtccacatggttttacaaaagtaaatcttaaattactaagcttttcccatatgttctcgtactttctcaaatccctataaagaattacttgttatctattaaaaatctcctttacccaaatctgtattatggtttcgccagacaaatattatgtgatgtagcccagaaaatccacaccttttgtcctttttatgttttaatttgaataatcatgtgcttagtcccttggtttactgccacatcagtttaacacgatatcagcacattcccttgtcatcatcaaggtgttggctcagatttattcttaattggatgtttaaagcatgtactaccttgttacagttggtttagtgtagtggattattgacatgacatcatgagaagatgtgtaattttataccacatttataaaacatgattttgttttctacccttcaaggtaaacattaaaaataaggtggtacttgtgtacttgtacataaaaccaaaattatagttgggaaaaaaataaatttatatatgaaaatgtcaaaatcattttaaaagtattattttcaaataaaatggagaagctggtgaaaag

SEQ ID NO: 417687 - DNA, 1644 bp, Homo sapiens
gcgactcctagaggacccccaggaaaaggaaaaagcatgacattgtgtatcgattttttgttgttgaccaaaatcacacacatggaaacatgtaattcaacagagtgggaaagctagcagattcttggcttagtattactaataggcaggattgtacaatgagcaactatcagattattcctttcagtggttcttatggcatctaaattactgaataaattattaatccattaatcagtgaatcaaattatgattacaattatcaaatgaatgctcagcattaattgaaaactgttttgtgaaacatgtctacccagaaaagtagcattctataaatactattaaacaacttagctatattatttttaagtattaaattatatgtcaagcagttaaagtgaatttcagagtaaaagtaaggcatgtttctgagcaacattgataatttcttaatttgcaaatttcttcttattttggtacttggaatatagtgtgagattttttatttctaaattttgttgtatcttctattacataaatgcattgacaattataaaatgcaagtgttttttgaatgattttaagaatttggcttaaaaattgattgatacaacgtattatttgtactaagaagtaacttgacccaaaacaccttttatgtttgcttagggtatattttttcagtgtctgaaagtcaaaggtattcctgtcacaactgtaaacaaacttatcctaaatgtgttaaaacatattcttgggtactctatttatgtatctttcatgccttgaaaatctgaaggttaatccaaactcacatgttttagcatatttgagaaaaaaaaactaccttcaatatcagccttttaaatttcatgaagattttggtgaggaataatagtatatagtttaagtattgacaaaactttgaaagtttctttctttaaaatgggaaatactcaatatctaaatccaggtcaggcatgggatatcagtatttaacattggatgttttatgttttatatttataatgttcaaaatgcaagcataacatttaatatttgtccacatggttttacaaaagtaaatcttaaattactaagcttttcccatatgttctcgtactttctcaaatccctataaagaattacttgttatctattaaaaatctcctttacccaaatctgtattatggtttcgccagacaaatattatgtgatgtagcccagaaaatccacaccttttgtcctttttatgttttaatttgaataatcatgtgcttagtcccttggtttactgccacatcagtttaacacgatatcagcacattcccttgtcatcatcaaggtgttggctcagatttattcttaattggatgtttaaagcatgtactaccttgttacagttggtttagtgtagtggattattgacatgacatcatgagaagatgtgtaattttataccacatttataaaacatgattttgttttctacccttcaaggtaaacattaaaaataaggtggtacttgtgtacttgtacataaaaccaaaattatagttgggaaaaaaataaatttatatatgaaaatgtcaaaatcattttaaaagtattattttcaaataaaatggagaagctggtgaaaag

SEQ ID NO: 417688 - DNA, 972 bp, Homo sapiens
cgcgtggtcgtcgccaccgcagccgcccgagaggagctgggggaggacggtggcccgcgaggctcgtcgcagacaacgcggcggcgatgtccgcgagccaggcgagtgccgcggcggcagcggcggggccttgcgcgcggcagggcggcctgggcttcggcctccctccggttccctggaagcgggcccgcgaccagcgcgggagcagcagcagaggcggaggctccagcgcgtctctctcctccccctcagcctgagccgggggaagccaggcggcccgggtgtctggaggggggggggtccgctgcccgagaatgggaattctcttcactagaatatggagactgttcaatcaccaggagcacaaagttatcattgttgggctggataatgcagggaaaactaccattctttaccaattttctatgaatgaagttgtacatacatctcctacaataggaagtaatgtagaagagatagtgattaataatacacgtttcctaatgtgggatattggtggccaagaatctcttcgttcttcctggaacacttactatactaacacagagtttgtaatagttgttgtggacagtacagacagagagaggatttctgtaactagagaagaactctataaaatgttagcgcatgaggacctaagaaaagctggattgctgatttttgctaataaacaagatgttaaagaatgcatgactgtagcagaaatctcccagtttttgaagctaacttctattaaagatcaccagtggcatatccaggcatgctgtgctctaactggcgagggattgtgccaaggacttgaatggatgatgtcacgacttaagattagatgatctctactgacctcttctcatagattttgtataaatgaagtgctggactttacctgaaagctgcaaaaattaatggtttagatatatttataataaactgatttaaactttttctata

SEQ ID NO: 417689 - DNA, 724 bp, Homo sapiens
ggaggtcacggctgccattgattgtgccattgcactccagcctgggtgacagagtgagaccctgtctaaaaaagaggaaagacaaaaaaagcacagatgtattgtgtatgagaatatggcttcactgcagcagcccaagcactgaatattattgatttttaaatctttgttatttagctaaatgaaaaatgctctcttttagtttgctgttcatagtttgctgctcatagcttcttagttcagaatttaatcaaatgattttgttttctttatagattgtgccaaggacttgaatggatgatgtcacgacttaagattagatgatctctactgacctcttctcatagattttgtataaatgaagtgctggactttacctgaaagctgcaaaaattaatggtttagatatatttataataaactgatttaaactttttctataagaagaaaaattaagaccacttatttgaaaacaaagatgaagtctcaccttccagtttgctttctcattagttttttccaaagtaagttattgaagctgtgattgacatttttctcataatgaatcctctcaggacattgtgtagcctatggtaagtacaaagggagaggaagacattttgaattttaagagctttattatcagtttaaccctccctagttgaatgttattttcttcttgttccattaagtcagaatacaaatcagcacagatattcgaatg

SEQ ID NO: 417690 - DNA, 2514 bp, Homo sapiens
ttttttttttttgctttctgccttctaaagtgcaacagtatatatcttgtagaactgtgggaggagagaagataatttttctaccttactccatattcttacttcaaactattttgaatagaggttcactgagccattgctgatagactgtgcatagctactagctgtcacactattgtaggttttttggagagattcatagggaagtgaatgtaaccaggaataaaggctctcactttagctctgggactatgcagtggatcttgggaacaaaataagatatctaatctattttccccattctggctagattttggttgttgtgatgctcctacttcctgtataggtttttgggatcatggtgcaggctagtaataggattcagaattgcttcccttttatatcgaccatgtaagggattctaaaggagggtaaatctcaaagtgctctgaaatcatccctctaaaatctgtcctgtggtgtgctaagatgtctgttgcctttttatgttaagctaaggaacttgaatgccttacctaataactcaactagtagtaagctcattttgtaaatatgaaaatggctgtaagaagtggcattcatgtatattcaatgttagtcaatagaccatagtggcctggatgctttaacaagccaaattccgcaattttttttccttttttccccttcatacttgtatgatctcacctgaccagtgatttcttttcctcctaaccccatgctaccaccattttctggaaatcaaagagatgtggtagtaaatcatacagtacacacgatcatctgagatcaatatgagcacaaaactcatcaagtaggtctgcctggaatgtatataaaaaatgtaaataaaaatttgtaaattagtgtgaactgtatcttgcatatgagactgtgtattgttttgcattctcttcccttttgtagaaatttttctgtaaggaaatgattcagcttgttggttttagagtaaaaatagccaacagttgtggctacacagtgagatcacaggaactggaaatagggtttgtcggctttggttaatgtcagtactcatttatttagcctctcagtgcttaataagacttttctttattttttagttagccgttaggttttgtgaggttagattcctggaagcagtgaatttatacactgttatattaatagagctccgttctttgagtcatgattccaagctaaaggaaattaaaaatgtaatttaataatttcctatttttagggttgttaatttttttctacaaaaaaaccttgaaattttagatatcccaatgtgaatctaatttccatatatacagaaattagacaaataataagtctttagttcaacttaagcatatctcaaatgacttctctaaatttaaagttgatcatgataggatcataaaagacagaaaagacttaagtaatcttgtaatgacaattatttccatttttgctgaactaaaaatatttaacttcataaatatgttactacagcttccagatttaaagaaaaaaagtttcccccactctcaattaaaagttagaaccctccacttttaaaattatacaaatatttcttttttacattacacagaagccttctgtaccattttacgaatttctgtcttcataatataagtgaaaatactgtcatttcaattttctgctttaaattgtttttaataagcattccaaagtgatacagacttaagcttttaatcaatcagtcattcagttgatagacaaagttagcgatgctttatgctaggaaacttgttgacagtaacctgtgcgactttatgcagaagacaaatgctagtaattattatgcacagaggaaaaatcattttaagtatgtggtaaagcagcttcatctttcaaaattgatttgctctggtttttctttagtccattagattccagaatgtccttttactgggaatttagttatgtattaagataacctgttttcagttctttttgaaaagaagacattatttatattgaaccaccttattttaaaatttttaacttttatataccacttgtgtgattccagtgtcatgtcttgggtttgatgtcgttggacagaaaagtgtatcaattattttaaatgaatttttccccatgtttgaggcttagtctgtaaatgtgttgctgtaacagaaaatacttgggtatgcattacttgaatacttgaaaactgaaattaataagatgtattacataatgaattagatttctctgaacagtttttacactgaaaatcttcatttctggattgcagtttgaaatggaatgaagacctgaattatttgggtagaaaaaattatgatagtgcttataagaactgtaaactgttttaaactattttgtgtttgacgcatcaaacttcaagttttttgtaagtttctctcctgaaattttctttctcttctatactttatgcacttactatactactgatgtaataaaagagcagggtta

SEQ ID NO: 417691 - DNA, 1962 bp, Homo sapiens
  misc_feature (1962)..(1962): n is a, c, g, or t
ttttttttttttgctttctgccttctaaagtgcaacagtatatatcttgtagaactgtgggaggagagaagataatttttctaccttactccatattcttacttcaaactattttgaatagaggttcactgagccattgctgatagactgtgcatagctactagctgtcacactattgtaggttttttggagagattcatagggaagtgaatgtaaccaggaataaaggctctcactttagctctgggactatgcagtggatcttgggaacaaaataagatatctaatctattttccccattctggctagattttggttgttgtgatgctcctacttcctgtataggtttttgggatcatggtgcaggctagtaataggattcagaattgcttcccttttatatcgaccatgtaagggattctaaaggagggtaaatctcaaagtgctctgaaatcatccctctaaaatctgtcctgtggtgtgctaagatgtctgttgcctttttatgttaagctaaggaacttgaatgccttacctaataactcaactagtagtaagctcattttgtaaatatgaaaatggctgtaagaagtggcattcatgtatattcaatgttagtcaatagaccatagtggcctggatgctttaacaagccaaattccgcaattttttttccttttttccccttcatacttgtatgatctcacctgaccagtgatttcttttcctcctaaccccatgctaccaccattttctggaaatcaaagagatgtggtagtaaatcatacagtacacacgatcatctgagatcaatatgagcacaaaactcatcaagtaggtctgcctggaatgtatataaaaaatgtaaataaaaatttgtaaattagtgtgaactgtatcttgcatatgagactgtgtattgttttgcattctcttcccttttgtagaaatttttctgtaaggaaatgattcagcttgttggttttagagtaaaaatagccaacagttgtggctacacagtgagatcacaggaactggaaatagggtttgtcggctttggttaatgtcagtactcatttatttagcctctcagtgcttaataagacttttctttattttttagttagccgttaggttttgtgaggttagattcctggaagcagtgaatttatacactgttatattaatagagctccgttctttgagtcatgattccaagctaaaggaaattaaaaatgtaatttaataatttcctatttttagggttgttaatttttttctacaaaaaaaccttgaaattttagatatcccaatgtgaatctaatttccatatatacagaaattagacaaataataagtctttagttcaacttaagcatatctcaaatgacttctctaaatttaaagttgatcatgataggatcataaaagacagaaaagacttaagtaatcttgtaatgacaattatttccatttttgctgaactaaaaatatttaacttcataaatatgttactacagcttccagatttaaagaaaaaaagtttcccccactctcatatttgttaataaaattttattggaacacaaaaaaaaaaaaaaaaaaaaaaaaaaaaaaaaaaaaaaaaaaagaggggggggggggaaaaaaaagggggggggcttggccctttttgggaaaggcgccccaaagagaggggttaaaaaagcaaggacgggggctaacacacggcgggggggacaggccgcgggggtctcgggaggaaccgttgctgggggtgcgcaccgggggaccacccacaggataaagggcaggaaaaaacctcggtagggacacacgctgccgcgacttgctcgtataaccacacacacaaacggacacaggggcgcggagacacagactgaatcgagtagcgcacacaccacaaccagccctgcagctgcagcaggcctcttcaccgn

SEQ ID NO: 417692 - DNA, 3798 bp, Homo sapiens
ttttttttttttgctttctgccttctaaagtgcaacagtatatatcttgtagaactgtgggaggagagaagataatttttctaccttactccatattcttacttcaaactattttgaatagaggttcactgagccattgctgatagactgtgcatagctactagctgtcacactattgtaggttttttggagagattcatagggaagtgaatgtaaccaggaataaaggctctcactttagctctgggactatgcagtggatcttgggaacaaaataagatatctaatctattttccccattctggctagattttggttgttgtgatgctcctacttcctgtataggtttttgggatcatggtgcaggctagtaataggattcagaattgcttcccttttatatcgaccatgtaagggattctaaaggagggtaaatctcaaagtgctctgaaatcatccctctaaaatctgtcctgtggtgtgctaagatgtctgttgcctttttatgttaagctaaggaacttgaatgccttacctaataactcaactagtagtaagctcattttgtaaatatgaaaatggctgtaagaagtggcattcatgtatattcaatgttagtcaatagaccatagtggcctggatgctttaacaagccaaattccgcaattttttttccttttttccccttcatacttgtatgatctcacctgaccagtgatttcttttcctcctaaccccatgctaccaccattttctggaaatcaaagagatgtggtagtaaatcatacagtacacacgatcatctgagatcaatatgagcacaaaactcatcaagtaggtctgcctggaatgtatataaaaaatgtaaataaaaatttgtaaattagtgtgaactgtatcttgcatatgagactgtgtattgttttgcattctcttcccttttgtagaaatttttctgtaaggaaatgattcagcttgttggttttagagtaaaaatagccaacagttgtggctacacagtgagatcacaggaactggaaatagggtttgtcggctttggttaatgtcagtactcatttatttagcctctcagtgcttaataagacttttctttattttttagttagccgttaggttttgtgaggttagattcctggaagcagtgaatttatacactgttatattaatagagctccgttctttgagtcatgattccaagctaaaggaaattaaaaatgtaatttaataatttcctatttttagggttgttaatttttttctacaaaaaaaccttgaaattttagatatcccaatgtgaatctaatttccatatatacagaaattagacaaataataagtctttagttcaacttaagcatatctcaaatgacttctctaaatttaaagttgatcatgataggatcataaaagacagaaaagacttaagtaatcttgtaatgacaattatttccatttttgctgaactaaaaatatttaacttcataaatatgttactacagcttccagatttaaagaaaaaaagtttcccccactctcaattaaaagttagaaccctccacttttaaaattatacaaatatttcttttttacattacacagaagccttctgtaccattttacgaatttctgtcttcataatataagtgaaaatactgtcatttcaattttctgctttaaattgtttttaataagcattccaaagtgatacagacttaagcttttaatcaatcagtcattcagttgatagacaaagttagcgatgctttatgctaggaaacttgttgacagtaacctgtgcgactttatgcagaagacaaatgctagtaattattatgcacagaggaaaaatcattttaagtatgtggtaaagcagcttcatctttcaaaattgatttgctctggtttttctttagtccattagattccagaatgtccttttactgggaatttagttatgtattaagataacctgttttcagttctttttgaaaagaagacattatttatattgaaccaccttattttaaaatttttaacttttatataccacttgtgtgattccagtgtcatgtcttgggtttgatgtcgttggacagaaaagtgtatcaattattttaaatgaatttttccccatgtttgaggcttagtctgtaaatgtgttgctgtaacagaaaatacttgggtatgcattacttgaatacttgaaaactgaaattaataagatgtattacataatgaattagatttctctgaacagtttttacactgaaaatcttcatttctggattgcagtttgaaatggaatgaagacctgaattatttgggtagaaaaaattatgatagtgcttataagaactgtaaactgttttaaactattttgtgtttgacgcatcaaacttcaagttttttgtaagtttctctcctgaaattttctttctcttctatactttatgcacttactatactactgatgtaataaaagagcagggttaaaaatattgtatctgtattcattgtgaatcctgtagcttttctagttaacaaaaaatcgctttctaaaatactcttaatcccattgttttggttaacatcttacccatttgttgtatttcaaatgccattaatcattttagtacaacacctatgtttataaaaatttgaaaacattacatattgtatttaaaactaattagtgaagagtaagaaaaaaactagccaacagaattgtaggtgatgcattagttaaatttcaaaactcataataaaggaactttcagagattggttgaaacccagtggtatccctgtaaattagctcctgtgactggaaaagaccccaaaaaggcagtagaggagattagtgtttacttgctgtggttgtggtgtgctgctacttaattataggtagtgacacactgaaattcttatttgtccaataatctgaagtagtttcctatatttatctgtactaaattgactataaattgagtctgcaaagaggaaactttttgactgtactgtatttaggagcctttgtacagcttggtcaaatttccatgatatgaagtatttgagttttaaaatatactgttattaaaaggaaaaagacatggccattattccatgtgcttaaatgataatttccttattcagtttcagaagaaaaagaatgaaattgggtaactgtcattgcgttagctttatgttgaattgggaaattgtggcataaagcttaaattcgtgtttatcaaatgtgaaccatagtagtataatgctgctttgtatataatgtaagtgctacaaatagtctcagcactgaaaatgtattgatacctcttaaatgaatgcaacttttgatgtaggtgttttgctatgcctcagaaaatatctgtctgagaatttgttaatctgtttgataatgaagatacttcctgttttcttgtttcatattttcatgttcaaaatttaagttttacatttttactactgttaatttaaataaaatttgttctgtggataaaatgaggttggcagtgaagaaaattaaaaacagcctcattcatgtaactggttaagtaaaaatacattttcactatgtgttcataaacttttaatgaagctgtttgtctttcagttcaaatataagtgatgtttaggctttatttctgttaataaggctttttaccattgattaaatgaaggaatgtatctttttgaagagatttatattctgtaaataaaaattcgttgtaacaataaagttgagttctaactaca

SEQ ID NO: 417693 - DNA, 3902 bp, Homo sapiens
ttttttttttttgctttctgccttctaaagtgcaacagtatatatcttgtagaactgtgggaggagagaagataatttttctaccttactccatattcttacttcaaactattttgaatagaggttcactgagccattgctgatagactgtgcatagctactagctgtcacactattgtaggttttttggagagattcatagggaagtgaatgtaaccaggaataaaggctctcactttagctctgggactatgcagtggatcttgggaacaaaataagatatctaatctattttccccattctggctagattttggttgttgtgatgctcctacttcctgtataggtttttgggatcatggtgcaggctagtaataggattcagaattgcttcccttttatatcgaccatgtaagggattctaaaggagggtaaatctcaaagtgctctgaaatcatccctctaaaatctgtcctgtggtgtgctaagatgtctgttgcctttttatgttaagctaaggaacttgaatgccttacctaataactcaactagtagtaagctcattttgtaaatatgaaaatggctgtaagaagtggcattcatgtatattcaatgttagtcaatagaccatagtggcctggatgctttaacaagccaaattccgcaattttttttccttttttccccttcatacttgtatgatctcacctgaccagtgatttcttttcctcctaaccccatgctaccaccattttctggaaatcaaagagatgtggtagtaaatcatacagtacacacgatcatctgagatcaatatgagcacaaaactcatcaagtaggtctgcctggaatgtatataaaaaatgtaaataaaaatttgtaaattagtgtgaactgtatcttgcatatgagactgtgtattgttttgcattctcttcccttttgtagaaatttttctgtaaggaaatgattcagcttgttggttttagagtaaaaatagccaacagttgtggctacacagtgagatcacaggaactggaaatagggtttgtcggctttggttaatgtcagtactcatttatttagcctctcagtgcttaataagacttttctttattttttagttagccgttaggttttgtgaggttagattcctggaagcagtgaatttatacactgttatattaatagagctccgttctttgagtcatgattccaagctaaaggaaattaaaaatgtaatttaataatttcctatttttagggttgttaatttttttctacaaaaaaaccttgaaattttagatatcccaatgtgaatctaatttccatatatacagaaattagacaaataataagtctttagttcaacttaagcatatctcaaatgacttctctaaatttaaagttgatcatgataggatcataaaagacagaaaagacttaagtaatcttgtaatgacaattatttccatttttgctgaactaaaaatatttaacttcataaatatgttactacagcttccagatttaaagaaaaaaagtttcccccactctcaattaaaagttagaaccctccacttttaaaattatacaaatatttcttttttacattacacagaagccttctgtaccattttacgaatttctgtcttcataatataagtgaaaatactgtcatttcaattttctgctttaaattgtttttaataagcattccaaagtgatacagacttaagcttttaatcaatcagtcattcagttgatagacaaagttagcgatgctttatgctaggaaacttgttgacagtaacctgtgcgactttatgcagaagacaaatgctagtaattattatgcacagaggaaaaatcattttaagtatgtggtaaagcagcttcatctttcaaaattgatttgctctggtttttctttagtccattagattccagaatgtccttttactgggaatttagttatgtattaagataacctgttttcagttctttttgaaaagaagacattatttatattgaaccaccttattttaaaatttttaacttttatataccacttgtgtgattccagtgtcatgtcttgggtttgatgtcgttggacagaaaagtgtatcaattattttaaatgaatttttccccatgtttgaggcttagtctgtaaatgtgttgctgtaacagaaaatacttgggtatgcattacttgaatacttgaaaactgaaattaataagatgtattacataatgaattagatttctctgaacagtttttacactgaaaatcttcatttctggattgcagtttgaaatggaatgaagacctgaattatttgggtagaaaaaattatgatagtgcttataagaactgtaaactgttttaaactattttgtgtttgacgcatcaaacttcaagttttttgtaagtttctctcctgaaattttctttctcttctatactttatgcacttactatactactgatgtaataaaagagcagggttaaaaatattgtatctgtattcattgtgaatcctgtagcttttctagttaacaaaaaatcgctttctaaaatactcttaatcccattgttttggttaacatcttacccatttgttgtatttcaaatgccattaatcattttagtacaacacctatgtttataaaaatttgaaaacattacatattgtatttaaaactaattagtgaagagtaagaaaaaaactagccaacagaattgtaggtgatgcattagttaaatttcaaaactcataataaaggaactttcagagattggttgaaacccagtggtatccctgtaaattagctcctgtgactggaaaagaccccaaaaaggcagtagaggagattagtgtttacttgctgtggttgtggtgtgctgctacttaattataggtagtgacacactgaaattcttatttgtccaataatctgaagtagtttcctatatttatctgtactaaattgactataaattgagtctgcaaagaggaaactttttgactgtactgtatttaggagcctttgtacagcttggtcaaatttccatgatatgaagtatttgagttttaaaatatactgttattaaaaggaaaaagacatggccattattccatgtgcttaaatgataatttccttattcagtttcagaagaaaaagaatgaaattgggtaactgtcattgcgttagctttatgttgaattgggaaattgtggcataaagcttaaattcgtgtttatcaaatgtgaaccatagtagtataatgctgctttgtatataatgtaagtgctacaaatagtctcagcactgaaaatgtattgatacctcttaaatgaatgcaacttttgatgtaggtgttttgctatgcctcagaaaatatctgtctgagaatttgttaatctgtttgataatgaagatacttcctgttttcttgtttcatattttcatgttcaaaatttaagttttacatttttactactgttaatttaaataaaatttgttctgtggataaaatgaggttggcagtgaagaaaattaaaaacagcctcattcatgtaactggttaagtaaaaatacattttcactatgtgttcataaacttttaatgaagctgtttgtctttcagttcaaatataagtgatgtttaggctttatttctgttaataaggctttttaccattgattaaatgaaggaatgtatctttttgaagagatttatattctgtaaataaaaattcgttgtaacaataaagttgagttctaactacaaaaaaaaaaagtcgacaccgccgggaatttaggtgtagtagtcccccgggaaattcggaccggttactgaaggcgatccagttttcccaaagttgggcgtattt

SEQ ID NO: 417694 - DNA, 3356 bp, Homo sapiens
ttttttttttttgctttctgccttctaaagtgcaacagtatatatcttgtagaactgtgggaggagagaagataatttttctaccttactccatattcttacttcaaactattttgaatagaggttcactgagccattgctgatagactgtgcatagctactagctgtcacactattgtaggttttttggagagattcatagggaagtgaatgtaaccaggaataaaggctctcactttagctctgggactatgcagtggatcttgggaacaaaataagatatctaatctattttccccattctggctagattttggttgttgtgatgctcctacttcctgtataggtttttgggatcatggtgcaggctagtaataggattcagaattgcttcccttttatatcgaccatgtaagggattctaaaggagggtaaatctcaaagtgctctgaaatcatccctctaaaatctgtcctgtggtgtgctaagatgtctgttgcctttttatgttaagctaaggaacttgaatgccttacctaataactcaactagtagtaagctcattttgtaaatatgaaaatggctgtaagaagtggcattcatgtatattcaatgttagtcaatagaccatagtggcctggatgctttaacaagccaaattccgcaattttttttccttttttccccttcatacttgtatgatctcacctgaccagtgatttcttttcctcctaaccccatgctaccaccattttctggaaatcaaagagatgtggtagtaaatcatacagtacacacgatcatctgagatcaatatgagcacaaaactcatcaagtaggtctgcctggaatgtatataaaaaatgtaaataaaaatttgtaaattagtgtgaactgtatcttgcatatgagactgtgtattgttttgcattctcttcccttttgtagaaatttttctgtaaggaaatgattcagcttgttggttttagagtaaaaatagccaacagttgtggctacacagtgagatcacaggaactggaaatagggtttgtcggctttggttaatgtcagtactcatttatttagcctctcagtgcttaataagacttttctttattttttagttagccgttaggttttgtgaggttagattcctggaagcagtgaatttatacactgttatattaatagagctccgttctttgagtcatgattccaagctaaaggaaattaaaaatgtaatttaataatttcctatttttagggttgttaatttttttctacaaaaaaaccttgaaattttagatatcccaatgtgaatctaatttccatatatacagaaattagacaaataataagtctttagttcaacttaagcatatctcaaatgacttctctaaatttaaagttgatcatgataggatcataaaagacagaaaagacttaagtaatcttgtaatgacaattatttccatttttgctgaactaaaaatatttaacttcataaatatgttactacagcttccagatttaaagaaaaaaagtttcccccactctcaattaaaagttagaaccctccacttttaaaattatacaaatatttcttttttacattacacagaagccttctgtaccattttacgaatttctgtcttcataatataagtgaaaatactgtcatttcaattttctgctttaaattgtttttaataagcattccaaagtgatacagacttaagcttttaatcaatcagtcattcagttgatagacaaagttagcgatgctttatgctaggaaacttgttgacagtaacctgtgcgactttatgcagaagacaaatgctagtaattattatgcacagaggaaaaatcattttaagtatgtggtaaagcagcttcatctttcaaaattgatttgctctggtttttctttagtccattagattccagaatgtccttttactgggaatttagttatgtattaagataacctgttttcagttctttttgaaaagaagacattatttatattgaaccaccttattttaaaatttttaacttttatataccacttgtgtgattccagtgtcatgtcttgggtttgatgtcgttggacagaaaagtgtatcaattattttaaatgaatttttccccatgtttgaggcttagtctgtaaatgtgttgctgtaacagaaaatacttgggtatgcattacttgaatacttgaaaactgaaattaataagatgtattacataatgaattagatttctctgaacagtttttacactgaaaatcttcatttctggattgcagtttgaaatggaatgaagacctgaattatttgggtagaaaaaattatgatagtgcttataagaactgtaaactgttttaaactattttgtgtttgacgcatcaaacttcaagttttttgtaagtttctctcctgaaattttctttctcttctatactttatgcacttactatactactgatgtaataaaagagcagggttaaaaatattgtatctgtattcattgtgaatcctgtagcttttctagttaacaaaaaatcgctttctaaaatactcttaatcccattgttttggttaacatcttacccatttgttgtatttcaaatgccattaatcattttagtacaacacctatgtttataaaaatttgaaaacattacatattgtatttaaaactaattagtgaagagtaagaaaaaaactagccaacagaattgtaggtgatgcattagttaaatttcaaaactcataataaaggaactttcagagattggttgaaacccagtggtatccctgtaaattagctcctgtgactggaaaagaccccaaaaaggcagtagaggagattagtgtttacttgctgtggttgtggtgtgctgctacttaattataggtagtgacacactgaaattcttatttgtccaataatctgaagtagtttcctatatttatctgtactaaattgactataaattgagtctgcaaagaggaaactttttgactgtactgtatttaggagcctttgtacagcttggtcaaatttccatgatatgaagtatttgagttttaaaatatactgttattaaaaggaaaaagacatggccattattccatgtgcttaaatgataatttccttattcagtttcagaagaaaaagaatgaaattgggtaactgtcattgcgttagctttatgttgaattgggaaattgtggcataaagcttaaattcgtgtttatcaaatgtgaaccatagtagtataatgctgctttgtatataatgtaagtgctacaaatagtcagcagcgggatcctcagatcgcctgg

SEQ ID NO: 417695 - DNA, 3551 bp, Homo sapiens
ttttttttttttgctttctgccttctaaagtgcaacagtatatatcttgtagaactgtgggaggagagaagataatttttctaccttactccatattcttacttcaaactattttgaatagaggttcactgagccattgctgatagactgtgcatagctactagctgtcacactattgtaggttttttggagagattcatagggaagtgaatgtaaccaggaataaaggctctcactttagctctgggactatgcagtggatcttgggaacaaaataagatatctaatctattttccccattctggctagattttggttgttgtgatgctcctacttcctgtataggtttttgggatcatggtgcaggctagtaataggattcagaattgcttcccttttatatcgaccatgtaagggattctaaaggagggtaaatctcaaagtgctctgaaatcatccctctaaaatctgtcctgtggtgtgctaagatgtctgttgcctttttatgttaagctaaggaacttgaatgccttacctaataactcaactagtagtaagctcattttgtaaatatgaaaatggctgtaagaagtggcattcatgtatattcaatgttagtcaatagaccatagtggcctggatgctttaacaagccaaattccgcaattttttttccttttttccccttcatacttgtatgatctcacctgaccagtgatttcttttcctcctaaccccatgctaccaccattttctggaaatcaaagagatgtggtagtaaatcatacagtacacacgatcatctgagatcaatatgagcacaaaactcatcaagtaggtctgcctggaatgtatataaaaaatgtaaataaaaatttgtaaattagtgtgaactgtatcttgcatatgagactgtgtattgttttgcattctcttcccttttgtagaaatttttctgtaaggaaatgattcagcttgttggttttagagtaaaaatagccaacagttgtggctacacagtgagatcacaggaactggaaatagggtttgtcggctttggttaatgtcagtactcatttatttagcctctcagtgcttaataagacttttctttattttttagttagccgttaggttttgtgaggttagattcctggaagcagtgaatttatacactgttatattaatagagctccgttctttgagtcatgattccaagctaaaggaaattaaaaatgtaatttaataatttcctatttttagggttgttaatttttttctacaaaaaaaccttgaaattttagatatcccaatgtgaatctaatttccatatatacagaaattagacaaataataagtctttagttcaacttaagcatatctcaaatgacttctctaaatttaaagttgatcatgataggatcataaaagacagaaaagacttaagtaatcttgtaatgacaattatttccatttttgctgaactaaaaatatttaacttcataaatatgttactacagcttccagatttaaagaaaaaaagtttcccccactctcaattaaaagttagaaccctccacttttaaaattatacaaatatttcttttttacattacacagaagccttctgtaccattttacgaatttctgtcttcataatataagtgaaaatactgtcatttcaattttctgctttaaattgtttttaataagcattccaaagtgatacagacttaagcttttaatcaatcagtcattcagttgatagacaaagttagcgatgctttatgctaggaaacttgttgacagtaacctgtgcgactttatgcagaagacaaatgctagtaattattatgcacagaggaaaaatcattttaagtatgtggtaaagcagcttcatctttcaaaattgatttgctctggtttttctttagtccattagattccagaatgtccttttactgggaatttagttatgtattaagataacctgttttcagttctttttgaaaagaagacattatttatattgaaccaccttattttaaaatttttaacttttatataccacttgtgtgattccagtgtcatgtcttgggtttgatgtcgttggacagaaaagtgtatcaattattttaaatgaatttttccccatgtttgaggcttagtctgtaaatgtgttgctgtaacagaaaatacttgggtatgcattacttgaatacttgaaaactgaaattaataagatgtattacataatgaattagatttctctgaacagtttttacactgaaaatcttcatttctggattgcagtttgaaatggaatgaagacctgaattatttgggtagaaaaaattatgatagtgcttataagaactgtaaactgttttaaactattttgtgtttgacgcatcaaacttcaagttttttgtaagtttctctcctgaaattttctttctcttctatactttatgcacttactatactactgatgtaataaaagagcagggttaaaaatattgtatctgtattcattgtgaatcctgtagcttttctagttaacaaaaaatcgctttctaaaatactcttaatcccattgttttggttaacatcttacccatttgttgtatttcaaatgccattaatcattttagtacaacacctatgtttataaaaatttgaaaacattacatattgtatttaaaactaattagtgaagagtaagaaaaaaactagccaacagaattgtaggtgatgcattagttaaatttcaaaactcataataaaggaactttcagagattggttgaaacccagtggtatccctgtaaattagctcctgtgactggaaaagaccccaaaaaggcagtagaggagattagtgtttacttgctgtggttgtggtgtgctgctacttaattataggtagtgacacactgaaattcttatttgtccaataatctgaagtagtttcctatatttatctgtactaaattgactataaattgagtctgcaaagaggaaactttttgactgtactgtatttaggagcctttgtacagcttggtcaaatttccatgatatgaagtatttgagttttaaaatatactgttattaaaaggaaaaagacatggccattattccatgtgcttaaatgataatttccttattcagtttcagaagaaaaagaatgaaattgggtaactgtcattgcgttagctttatgttgaattgggaaattgtggcataaagcttaaattcgtgtttatcaaatgtgaaccatagtagtataatgctgctttgtatataatgtaagtgctacaaatagtctcagcactgaaaatgtattgatacctcttaatgatggacttgaggtagttttgtatgcgtcgaatttgtggaatgggacggtgaagaaaaacccggttgggcaattcagtacaaaggcctcacggcatcaaaccgcggtacggggagaaaaaagcctttaggaaactactttcaacacgaaagggtttggcagttttttattcttattcattgtgtcttgg

SEQ ID NO: 417696 - DNA, 1545 bp, Homo sapiens
ttggcttgtgtttttgttcctttctccttttaaaccccagacagatacgattcagctcggtacccttgcgatgaattgacctgaattatttgggtagaaaaaattatgatagtgcttataagaactgtaaactgttttaaactattttgtgtttgacgcatcaaacttcaagttttttgtaagtttctctcctgaaattttctttctcttctatactttatgcacttactatactactgatgtaataaaagagcagggttaaaaatattgtatctgtattcattgtgaatcctgtagcttttctagttaacaaaaaatcgctttctaaaatactcttaatcccattgttttggttaacatcttacccatttgttgtatttcaaatgccattaatcattttagtacaacacctatgtttataaaaatttgaaaacattacatattgtatttaaaactaattagtgaagagtaagaaaaaaactagccaacagaattgtaggtgatgcattagttaaatttcaaaactcataataaaggaactttcagagattggttgaaacccagtggtatccctgtaaattagctcctgtgactggaaaagaccccaaaaaggcagtagaggagattagtgtttacttgctgtggttgtggtgtgctgctacttaattataggtagtgacacactgaaattcttatttgtccaataatctgaagtagtttcctatatttatctgtactaaattgactataaattgagtctgcaaagaggaaactttttgactgtactgtatttaggagcctttgtacagcttggtcaaatttccatgatatgaagtatttgagttttaaaatatactgttattaaaaggaaaaagacatggccattattccatgtgcttaaatgataatttccttattcagtttcagaagaaaaagaatgaaattgggtaactgtcattgcgttagctttatgttgaattgggaaattgtggcataaagcttaaattcgtgtttatcaaatgtgaaccatagtagtataatgctgctttgtatataatgtaagtgctacaaatagtctcagcactgaaaatgtattgatacctcttaaatgaatgcaacttttgatgtaggtgttttgctatgcctcagaaaatatctgtctgagaatttgttaatctgtttgataatgaagatacttcctgttttcttgtttcatattttcatgttcaaaatttaagttttacatttttactactgttaatttaaataaaatttgttctgtggataaaatgaggttggcagtgaagaaaattaaaaacagcctcattcatgtaactggttaagtaaaaatacattttcactatgtgttcataaacttttaatgaagctgtttgtctttcagttcaaatataagtgatgtttaggctttatttctgttaataaggctttttaccattgattaaatgaaggaatgtatctttttgaagagatttatattctgtaaataaaaattcgttgtaacaataaagttgagttctaactaca

SEQ ID NO: 417697 - DNA, 3103 bp, Homo sapiens
ttttttttttttgctttctgccttctaaagtgcaacagtatatatcttgtagaactgtgggaggagagaagataatttttctaccttactccatattcttacttcaaactattttgaatagaggttcactgagccattgctgatagactgtgcatagctactagctgtcacactattgtaggttttttggagagattcatagggaagtgaatgtaaccaggaataaaggctctcactttagctctgggactatgcagtggatcttgggaacaaaataagatatctaatctattttccccattctggctagattttggttgttgtgatgctcctacttcctgtataggtttttgggatcatggtgcaggctagtaataggattcagaattgcttcccttttatatcgaccatgtaagggattctaaaggagggtaaatctcaaagtgctctgaaatcatccctctaaaatctgtcctgtggtgtgctaagatgtctgttgcctttttatgttaagctaaggaacttgaatgccttacctaataactcaactagtagtaagctcattttgtaaatatgaaaatggctgtaagaagtggcattcatgtatattcaatgttagtcaatagaccatagtggcctggatgctttaacaagccaaattccgcaattttttttccttttttccccttcatacttgtatgatctcacctgaccagtgatttcttttcctcctaaccccatgctaccaccattttctggaaatcaaagagatgtggtagtaaatcatacagtacacacgatcatctgagatcaatatgagcacaaaactcatcaagtaggtctgcctggaatgtatataaaaaatgtaaataaaaatttgtaaattagtgtgaactgtatcttgcatatgagactgtgtattgttttgcattctcttcccttttgtagaaatttttctgtaaggaaatgattcagcttgttggttttagagtaaaaatagccaacagttgtggctacacagtgagatcacaggaactggaaatagggtttgtcggctttggttaatgtcagtactcatttatttagcctctcagtgcttaataagacttttctttattttttagttagccgttaggttttgtgaggttagattcctggaagcagtgaatttatacactgttatattaatagagctccgttctttgagtcatgattccaagctaaaggaaattaaaaatgtaatttaataatttcctatttttagggttgttaatttttttctacaaaaaaaccttgaaattttagatatcccaatgtgaatctaatttccatatatacagaaattagacaaataataagtctttagttcaacttaagcatatctcaaatgacttctctaaatttaaagttgatcatgataggatcataaaagacagaaaagacttaagtaatcttgtaatgacaattatttccatttttgctgaactaaaaatatttaacttcataaatatgttactacagcttccagatttaaagaaaaaaagtttcccccactctcaattaaaagttagaaccctccacttttaaaattatacaaatatttcttttttacattacacagaagccttctgtaccattttacgaatttctgtcttcataatataagtgaaaatactgtcatttcaattttctgctttaaattgtttttaataagcattccaaagtgatacagacttaagcttttaatcaatcagtcattcagttgatagacaaagttagcgatgctttatgctaggaaacttgttgacagtaacctgtgcgactttatgcagaagacaaatgctagtaattattatgcacagaggaaaaatcattttaagtatgtggtaaagcagcttcatctttcaaaattgatttgctctggtttttctttagtccattagattccagaatgtccttttactgggaatttagttatgtattaagataacctgttttcagttctttttgaaaagaagacattatttatattgaaccaccttattttaaaatttttaacttttatataccacttgtgtgattccagtgtcatgtcttgggtttgatgtcgttggacagaaaagtgtatcaattattttaaatgaatttttccccatgtttgaggcttagtctgtaaatgtgttgctgtaacagaaaatacttgggtatgcattacttgaatacttgaaaactgaaattaataagatgtattacataatgaattagatttctctgaacagtttttacactgaaaatcttcatttctggattgcagtttgaaatggaatgaagacctgaattatttgggtagaaaaaattatgatagtgcttataagaactgtaaactgttttaaactattttgtgtttgacgcatcaaacttcaagttttttgtaagtttctctcctgaaattttctttctcttctatactttatgcacttactatactactgatgtaataaaagagcagggttaaaaatattgtatctgtattcattgtgaatcctgtagcttttctagttaacaaaaaatcgctttctaaaatactcttaatcccattgttttggttaacatcttacccatttgttgtatttcaaatgccattaatcattttagtacaacacctatgtttataaaaatttgaaaacattacatattgtatttaaaactaattagtgaagagtaagaaaaaaactagccaacagaattgtaggtgatgcattagttaaatttcaaaactcataataaaggaactttcagagattggttgaaacccagtggtatccctgtaaattagctcctgtgactggaaaagaccccaaaaaggcagtagaggagattagtgtttacttgctgtggttgtggtgtgctgctacttaattataggtagtgacacactgaaattcttatttgtccaataatctgaagtagtttcctatatttatctgtactaaattgactataaattgagtctgcaaagaggaaactttttgactgtactgtatttaggagcctttgtacagcttggtcaaatccatcgcaaagggatcctctagacgaaccc

SEQ ID NO: 417698 - DNA, 3148 bp, Homo sapiens
  misc_feature (2972)..(2973): n is a, c, g, or t
  misc_feature (2987)..(2987): n is a, c, g, or t
  misc_feature (2990)..(2990): n is a, c, g, or t
  misc_feature (3013)..(3013): n is a, c, g, or t
  misc_feature (3026)..(3026): n is a, c, g, or t
  misc_feature (3045)..(3045): n is a, c, g, or t
  misc_feature (3050)..(3050): n is a, c, g, or t
  misc_feature (3100)..(3100): n is a, c, g, or t
  misc_feature (3120)..(3120): n is a, c, g, or t
  misc_feature (3143)..(3143): n is a, c, g, or t
ttttttttttttgctttctgccttctaaagtgcaacagtatatatcttgtagaactgtgggaggagagaagataatttttctaccttactccatattcttacttcaaactattttgaatagaggttcactgagccattgctgatagactgtgcatagctactagctgtcacactattgtaggttttttggagagattcatagggaagtgaatgtaaccaggaataaaggctctcactttagctctgggactatgcagtggatcttgggaacaaaataagatatctaatctattttccccattctggctagattttggttgttgtgatgctcctacttcctgtataggtttttgggatcatggtgcaggctagtaataggattcagaattgcttcccttttatatcgaccatgtaagggattctaaaggagggtaaatctcaaagtgctctgaaatcatccctctaaaatctgtcctgtggtgtgctaagatgtctgttgcctttttatgttaagctaaggaacttgaatgccttacctaataactcaactagtagtaagctcattttgtaaatatgaaaatggctgtaagaagtggcattcatgtatattcaatgttagtcaatagaccatagtggcctggatgctttaacaagccaaattccgcaattttttttccttttttccccttcatacttgtatgatctcacctgaccagtgatttcttttcctcctaaccccatgctaccaccattttctggaaatcaaagagatgtggtagtaaatcatacagtacacacgatcatctgagatcaatatgagcacaaaactcatcaagtaggtctgcctggaatgtatataaaaaatgtaaataaaaatttgtaaattagtgtgaactgtatcttgcatatgagactgtgtattgttttgcattctcttcccttttgtagaaatttttctgtaaggaaatgattcagcttgttggttttagagtaaaaatagccaacagttgtggctacacagtgagatcacaggaactggaaatagggtttgtcggctttggttaatgtcagtactcatttatttagcctctcagtgcttaataagacttttctttattttttagttagccgttaggttttgtgaggttagattcctggaagcagtgaatttatacactgttatattaatagagctccgttctttgagtcatgattccaagctaaaggaaattaaaaatgtaatttaataatttcctatttttagggttgttaatttttttctacaaaaaaaccttgaaattttagatatcccaatgtgaatctaatttccatatatacagaaattagacaaataataagtctttagttcaacttaagcatatctcaaatgacttctctaaatttaaagttgatcatgataggatcataaaagacagaaaagacttaagtaatcttgtaatgacaattatttccatttttgctgaactaaaaatatttaacttcataaatatgttactacagcttccagatttaaagaaaaaaagtttcccccactctcaattaaaagttagaaccctccacttttaaaattatacaaatatttcttttttacattacacagaagccttctgtaccattttacgaatttctgtcttcataatataagtgaaaatactgtcatttcaattttctgctttaaattgtttttaataagcattccaaagtgatacagacttaagcttttaatcaatcagtcattcagttgatagacaaagttagcgatgctttatgctaggaaacttgttgacagtaacctgtgcgactttatgcagaagacaaatgctagtaattattatgcacagaggaaaaatcattttaagtatgtggtaaagcagcttcatctttcaaaattgatttgctctggtttttctttagtccattagattccagaatgtccttttactgggaatttagttatgtattaagataacctgttttcagttctttttgaaaagaagacattatttatattgaaccaccttattttaaaatttttaacttttatataccacttgtgtgattccagtgtcatgtcttgggtttgatgtcgttggacagaaaagtgtatcaattattttaaatgaatttttccccatgtttgaggcttagtctgtaaatgtgttgctgtaacagaaaatacttgggtatgcattacttgaatacttgaaaactgaaattaataagatgtattacataatgaattagatttctctgaacagtttttacactgaaaatcttcatttctggattgcagtttgaaatggaatgaagacctgaattatttgggtagaaaaaattatgatagtgcttataagaactgtaaactgttttaaactattttgtgtttgacgcatcaaacttcaagttttttgtaagtttctctcctgaaattttctttctcttctatactttatgcacttactatactactgatgtaataaaagagcagggttaaaaatattgtatctgtattcattgtgaatcctgtagcttttctagttaacaaaaaatcgctttctaaaatactcttaatcccattgttttggttaacatcttacccatttgttgtatttcaaatgccattaatcattttagtacaacacctatgtttataaaaatttgaaaacattacatattgtatttaaaactaattagtgaagagtaagaaaaaaactagccaacagaattgtaggtgatgcattagttaaatttcaaaactcataataaaggaactttcagagattggttgaaacccagtggtatccctgtaaattagctcctgtgactggaaaagaccccaaaaaggcagtagaggagattagtgtctgtgggtgggggtgtctatatggaggccctgatctatgcatacgagagtcttttttgcatgttatggcgaggactttgtgcgtagnnctgcgtgcattctnttnagttggttaaatcgttaaggaancgcttctgctatntattcttcgtagagaaganaatgnactgctggagtttgtgatggaatgggataagttatcggttaatggacctngagatatgtgttgattatgnaggctcaatgctacctgaaatgnttgtc

SEQ ID NO: 417699 - DNA, 6231 bp, Homo sapiens
aagcgggggcggcagcggtggtagcagctggtacctcccgccgcctctgttcggagggtcgcggggcaccgaggtgctttccggccgccctctggtcggccacccaaagccgcgggcgctgatgatgggtgaggagggggcggcaagatttcgggcgcccctgccctgaacgccctcagctgctgccgccggggccgctccagtgcctgcgaactctgaggagccgaggcgccggtgagagcaaggacgctgcaaacttgcgcagcgcgggggctgggattcacgcccagaagttcagcaggcagacagtccgaagccttcccgcagcggagagatagcttgagggtgcgcaagacggcagcctccgccctcggttcccgcccagaccgggcagaagagcttggaggagccacaaggaacgcaaaaggcggccaggacagcgtgcagcagctgggagccgccgttctcagccttaaaagttgcagagattggaggctgccccgagaggggacagaccccagctccgactgcggggggcaggagaggacggtacccaactgccacctcccttcaaccatagtagttcctctgtaccgagcgcagcgagctacagacgggggcgcggcactcggcgcggagagcgggaggctcaaggtcccagccagtgagcccagtgtgcttgagtgtctctggactcgcccctgagcttccaggtctgtttcatttagactcctgctcgcctccgtgcagttgggggaaagcaagagacttgcgcgcacgcacagtcctctggagatcaggtggaaggagccgctgggtaccaaggactgttcagagcctcttcccatctcggggagagcgaagggtgaggctgggcccggagagcagtgtaaacggcctcctccggcgggatgggagccatcgggctcctgtggctgctgccgctgctgctttccacggcagctgtgggctccgggatggggaccggccagcgcgcgggctccccagctgcggggccgccgctgcagccccgggagccactcagctactcgcgcctgcagaggaagagtctggcagttgacttcgtggtgccctcgctcttccgtgtctacgcccgggacctactgctgccaccatcctcctcggagctgaaggctggcaggcccgaggcccgcggctcgctagctctggactgcgccccgctgctcaggttgctggggccggcgccgggggtctcctggaccgccggttcaccagccccggcagaggcccggacgctgtccagggtgctgaagggcggctccgtgcgcaagctccggcgtgccaagcagttggtgctggagctgggcgaggaggcgatcttggagggttgcgtcgggccccccggggaggcggctgtggggctgctccagttcaatctcagcgagctgttcagttggtggattcgccaaggcgaagggcgactgaggatccgcctgatgcccgagaagaaggcgtcggaagtgggcagagagggaaggctgtccgcggcaattcgcgcctcccagccccgccttctcttccagatcttcgggactggtcatagctccttggaatcaccaacaaacatgccttctccttctcctgattattttacatggaatctcacctggataatgaaagactccttccctttcctgtctcatcgcagccgatatggtctggagtgcagctttgacttcccctgtgagctggagtattcccctccactgcatgacctcaggaaccagagctggtcctggcgccgcatcccctccgaggaggcctcccagatggacttgctggatgggcctggggcagagcgttctaaggagatgcccagaggctcctttctccttctcaacacctcagctgactccaagcacaccatcctgagtccgtggatgaggagcagcagtgagcactgcacactggccgtctcggtgcacaggcacctgcagccctctggaaggtacattgcccagctgctgccccacaacgaggctgcaagagagatcctcctgatgcccactccagggaagcatggttggacagtgctccagggaagaatcgggcgtccagacaacccatttcgagtggccctggaatacatctccagtggaaaccgcagcttgtctgcagtggacttctttgccctgaagaactgcagtgaaggaacatccccaggctccaagatggccctgcagagctccttcacttgttggaatgggacagtcctccagcttgggcaggcctgtgacttccaccaggactgtgcccagggagaagatgagagccagatgtgccggaaactgcctgtgggtttttactgcaactttgaagatggcttctgtggctggacccaaggcacactgtcaccccacactcctcagtggcaggtcaggaccctaaaggatgcccggttccaggaccaccaagaccatgctctattgctcagtaccactgatgtccccgcttctgaaagtgctacagtgaccagtgctacgtttcctgcaccgatcaagagctctccatgtgagctccgaatgtcctggctcattcgtggagtcttgaggggaaacgtgtccttggtgctagtggagaacaaaaccgggaaggagcaaggcaggatggtctggcatgtcgccgcctatgaaggcttgagcctgtggcagtggatggtgttgcctctcctcgatgtgtctgacaggttctggctgcagatggtcgcatggtggggacaaggatccagagccatcgtggcttttgacaatatctccatcagcctggactgctacctcaccattagcggagaggacaagatcctgcagaatacagcacccaaatcaagaaacctgtttgagagaaacccaaacaaggagctgaaacccggggaaaattcaccaagacagacccccatctttgaccctacagttcattggctgttcaccacatgtggggccagcgggccccatggccccacccaggcacagtgcaacaacgcctaccagaactccaacctgagcgtggaggtggggagcgagggccccctgaaaggcatccagatctggaaggtgccagccaccgacacctacagcatctcgggctacggagctgctggcgggaaaggcgggaagaacaccatgatgcggtcccacggcgtgtctgtgctgggcatcttcaacctggagaaggatgacatgctgtacatcctggttgggcagcagggagaggacgcctgccccagtacaaaccagttaatccagaaagtctgcattggagagaacaatgtgatagaagaagaaatccgtgtgaacagaagcgtgcatgagtgggcaggaggcggaggaggagggggtggagccacctacgtatttaagatgaaggatggagtgccggtgcccctgatcattgcagccggaggtggtggcagggcctacggggccaagacagacacgttccacccagagagactggagaataactcctcggttctagggctaaacggcaattccggagccgcaggtggtggaggtggctggaatgataacacttccttgctctgggccggaaaatctttgcaggagggtgccaccggaggacattcctgcccccaggccatgaagaagtgggggtgggagacaagagggggtttcggagggggtggaggggggtgctcctcaggtggaggaggcggaggatatataggcggcaatgcagcctcaaacaatgaccccgaaatggatggggaagatggggtttccttcatcagtccactgggcatcctgtacaccccagctttaaaagtgatggaaggccacggggaagtgaatattaagcattatctaaactgcagtcactgtgaggtagacgaatgtcacatggaccctgaaagccacaaggtcatctgcttctgtgaccacgggacggtgctggctgaggatggcgtctcctgcattgtgtcacccaccccggagccacacctgccactctcgctgatcctctctgtggtgacctctgccctcgtggccgccctggtcctggctttctccggcatcatgattgtgtaccgccggaagcaccaggagctgcaagccatgcagatggagctgcagagccctgagtacaagctgagcaagctccgcacctcgaccatcatgaccgactacaaccccaactactgctttgctggcaagacctcctccatcagtgacctgaaggaggtgccgcggaaaaacatcaccctcattcggggtctgggccatggcgcctttggggaggtgtatgaaggccaggtgtccggaatgcccaacgacccaagccccctgcaagtggctgtgaagacgctgcctgaagtgtgctctgaacaggacgaactggatttcctcatggaagccctgatcatcagcaaattcaaccaccagaacattgttcgctgcattggggtgagcctgcaatccctgccccggttcatcctgctggagctcatggcggggggagacctcaagtccttcctccgagagacccgccctcgcccgagccagccctcctccctggccatgctggaccttctgcacgtggctcgggacattgcctgtggctgtcagtatttggaggaaaaccacttcatccaccgagacattgctgccagaaactgcctcttgacctgtccaggccctggaagagtggccaagattggagacttcgggatggcccgagacatctacagggcgagctactatagaaagggaggctgtgccatgctgccagttaagtggatgcccccagaggccttcatggaaggaatattcacttctaaaacagacacatggtcctttggagtgctgctatgggaaatcttttctcttggatatatgccataccccagcaaaagcaaccaggaagttctggagtttgtcaccagtggaggccggatggacccacccaagaactgccctgggcctgtataccggataatgactcagtgctggcaacatcagcctgaagacaggcccaactttgccatcattttggagaggattgaatactgcacccaggacccggatgtaatcaacaccgctttgccgatagaatatggtccacttgtggaagaggaagagaaagtgcctgtgaggcccaaggaccctgagggggttcctcctctcctggtctctcaacaggcaaaacgggaggaggagcgcagcccagctgccccaccacctctgcctaccacctcctctggcaaggctgcaaagaaacccacagctgcagaggtctctgttcgagtccctagagggccggccgtggaagggggacacgtgaatatggcattctctcagtccaaccctccttcggagttgcacaaggtccacggatccagaaacaagcccaccagcttgtggaacccaacgtacggctcctggtttacagagaaacccaccaaaaagaataatcctatagcaaagaaggagccacacgacaggggtaacctggggctggagggaagctgtactgtcccacctaacgttgcaactgggagacttccgggggcctcactgctcctagagccctcttcgctgactgccaatatgaaggaggtacctctgttcaggctacgtcacttcccttgtgggaatgtcaattacggctaccagcaacagggcttgcccttagaagccgctactgcccctggagctggtcattacgaggataccattctgaaaagcaagaatagcatgaaccagcctgggccctgagctcggtcgcacactcacttctcttccttgggatccctaagaccgtggaggagagagaggcaatggctccttcacaaaccagagaccaaatgtcacgttttgttttgtgccaacctattttgaagtaccaccaaaaaagctgtattttgaaaatgctttagaaaggttttgagcatgggttcatcctattctttcgaaagaagaaaatatcataaaaatgagtgataaatacaaggcccagatgtggttgcataaggtttttatgcatgtttgttgtatacttccttatgcttcttttaaattgtgtgtgctctgcttcaatgtagtcagaattagctgcttctatgtttcatagttggggtcatagatgtttccttgccttgttgatgtggacatgagccatttgaggggagagggaacggaaataaaggagttatttgtaatgactaaaaatggg

SEQ ID NO: 417700 - DNA, 6994 bp, Homo sapiens
aagcgggggcggcagcggtggtagcagctggtacctcccgccgcctctgttcggagggtcgcggggcaccgaggtgctttccggccgccctctggtcggccacccaaagccgcgggcgctgatgatgggtgaggagggggcggcaagatttcgggcgcccctgccctgaacgccctcagctgctgccgccggggccgctccagtgcctgcgaactctgaggagccgaggcgccggtgagagcaaggacgctgcaaacttgcgcagcgcgggggctgggattcacgcccagaagttcagcaggcagacagtccgaagccttcccgcagcggagagatagcttgagggtgcgcaagacggcagcctccgccctcggttcccgcccagaccgggcagaagagcttggaggagccacaaggaacgcaaaaggcggccaggacagcgtgcagcagctgggagccgccgttctcagccttaaaagttgcagagattggaggctgccccgagaggggacagaccccagctccgactgcggggggcaggagaggacggtacccaactgccacctcccttcaaccatagtagttcctctgtaccgagcgcagcgagctacagacgggggcgcggcactcggcgcggagagcgggaggctcaaggtcccagccagtgagcccagtgtgcttgagtgtctctggactcgcccctgagcttccaggtctgtttcatttagactcctgctcgcctccgtgcagttgggggaaagcaagagacttgcgcgcacgcacagtcctctggagatcaggtggaaggagccgctgggtaccaaggactgttcagagcctcttcccatctcggggagagcgaagggtgaggctgggcccggagagcagtgtaaacggcctcctccggcgggatgggagccatcgggctcctgtggctgctgccgctgctgctttccacggcagctgtgggctccgggatggggaccggccagcgcgcgggctccccagctgcggggccgccgctgcagccccgggagccactcagctactcgcgcctgcagaggaagagtctggcagttgacttcgtggtgccctcgctcttccgtgtctacgcccgggacctactgctgccaccatcctcctcggagctgaaggctggcaggcccgaggcccgcggctcgctagctctggactgcgccccgctgctcaggttgctggggccggcgccgggggtctcctggaccgccggttcaccagccccggcagaggcccggacgctgtccagggtgctgaagggcggctccgtgcgcaagctccggcgtgccaagcagttggtgctggagctgggcgaggaggcgatcttggagggttgcgtcgggccccccggggaggcggctgtggggctgctccagttcaatctcagcgagctgttcagttggtggattcgccaaggcgaagggcgactgaggatccgcctgatgcccgagaagaaggcgtcggaagtgggcagagagggaaggctgtccgcggcaattcgcgcctcccagccccgccttctcttccagatcttcgggactggtcatagctccttggaatcaccaacaaacatgccttctccttctcctgattattttacatggaatctcacctggataatgaaagactccttccctttcctgtctcatcgcagccgatatggtctggagtgcagctttgacttcccctgtgagctggagtattcccctccactgcatgacctcaggaaccagagctggtcctggcgccgcatcccctccgaggaggcctcccagatggacttgctggatgggcctggggcagagcgttctaaggagatgcccagaggctcctttctccttctcaacacctcagctgactccaagcacaccatcctgagtccgtggatgaggagcagcagtgagcactgcacactggccgtctcggtgcacaggcacctgcagccctctggaaggtacattgcccagctgctgccccacaacgaggctgcaagagagatcctcctgatgcccactccagggaagcatggttggacagtgctccagggaagaatcgggcgtccagacaacccatttcgagtggccctggaatacatctccagtggaaaccgcagcttgtctgcagtggacttctttgccctgaagaactgcagtgaaggaacatccccaggctccaagatggccctgcagagctccttcacttgttggaatgggacagtcctccagcttgggcaggcctgtgacttccaccaggactgtgcccagggagaagatgagagccagatgtgccggaaactgcctgtgggtttttactgcaactttgaagatggcttctgtggctggacccaaggcacactgtcaccccacactcctcagtggcaggtcaggaccctaaaggatgcccggttccaggaccaccaagaccatgctctattgctcagtaccactgatgtccccgcttctgaaagtgctacagtgaccagtgctacgtttcctgcaccgatcaagagctctccatgtgagctccgaatgtcctggctcattcgtggagtcttgaggggaaacgtgtccttggtgctagtggagaacaaaaccgggaaggagcaaggcaggatggtctggcatgtcgccgcctatgaaggcttgagcctgtggcagtggatggtgttgcctctcctcgatgtgtctgacaggttctggctgcagatggtcgcatggtggggacaaggatccagagccatcgtggcttttgacaatatctccatcagcctggactgctacctcaccattagcggagaggacaagatcctgcagaatacagcacccaaatcaagaaacctgtttgagagaaacccaaacaaggagctgaaacccggggaaaattcaccaagacagacccccatctttgaccctacagttcattggctgttcaccacatgtggggccagcgggccccatggccccacccaggcacagtgcaacaacgcctaccagaactccaacctgagcgtggaggtggggagcgagggccccctgaaaggcatccagatctggaaggtgccagccaccgacacctacagcatctcgggctacggagctgctggcgggaaaggcgggaagaacaccatgatgcggtcccacggcgtgtctgtgctgggcatcttcaacctggagaaggatgacatgctgtacatcctggttgggcagcagggagaggacgcctgccccagtacaaaccagttaatccagaaagtctgcattggagagaacaatgtgatagaagaagaaatccgtgtgaacagaagcgtgcatgagtgggcaggaggcggaggaggagggggtggagccacctacgtatttaagatgaaggatggagtgccggtgcccctgatcattgcagccggaggtggtggcagggcctacggggccaagacagacacgttccacccagagagactggagaataactcctcggttctagggctaaacggcaattccggagccgcaggtggtggaggtggctggaatgataacacttccttgctctgggccggaaaatctttgcaggagggtgccaccggaggacattcctgcccccaggccatgaagaagtgggggtgggagacaagagggggtttcggagggggtggaggggggtgctcctcaggtggaggaggcggaggatatataggcggcaatgcagcctcaaacaatgaccccgaaatggatggggaagatggggtttccttcatcagtccactgggcatcctgtacaccccagctttaaaagtgatggaaggccacggggaagtgaatattaagcattatctaaactgcagtcactgtgaggtagacgaatgtcacatggaccctgaaagccacaaggtcatctgcttctgtgaccacgggacggtgctggctgaggatggcgtctcctgcattgtgtcacccaccccggagccacacctgccactctcgctgatcctctctgtggtgacctctgccctcgtggccgccctggtcctggctttctccggcatcatgattgtgtaccgccggaagcaccaggagctgcaagccatgcagatggagctgcagagccctgagtacaagctgagcaagctccgcacctcgaccatcatgaccgactacaaccccaactactgctttgctggcaagacctcctccatcagtgacctgaaggaggtgccgcggaaaaacatcaccctcattcggggtctgggccatggcgcctttggggaggtgtatgaaggccaggtgtccggaatgcccaacgacccaagccccctgcaagtggctgtgaagacgctgcctgaagtgtgctctgaacaggacgaactggatttcctcatggaagccctgatcatcagcaaattcaaccaccagaacattgttcgctgcattggggtgagcctgcaatccctgccccggttcatcctgctggagctcatggcggggggagacctcaagtccttcctccgagagacccgccctcgcccgagccagccctcctccctggccatgctggaccttctgcacgtggctcgggacattgcctgtggctgtcagtatttggaggaaaaccacttcatccaccgagacattgctgccagaaactgcctcttgacctgtccaggccctggaagagtggccaagattggagacttcgggatggcccgagacatctacagggcgagctactatagaaagggaggctgtgccatgctgccagttaagtggatgcccccagaggccttcatggaaggaatattcacttctaaaacagacacatggtcctttggagtgctgctatgggaaatcttttctcttggatatatgccataccccagcaaaagcaaccaggaagttctggagtttgtcaccagtggaggccggatggacccacccaagaactgccctgggcctgtataccggataatgactcagtgctggcaacatcagcctgaagacaggcccaactttgccatcattttggagaggattgaatactgcacccaggacccggatgtaatcaacaccgctttgccgatagaatatggtccacttgtggaagaggaagagaaagtgcctgtgaggcccaaggaccctgagggggttcctcctctcctggtctctcaacaggcaaaacgggaggaggagcgcagcccagctgccccaccacctctgcctaccacctcctctggcaaggctgcaaagaaacccacagctgcagaggtctctgttcgagtccctagagggccggccgtggaagggggacacgtgaatatggcattctctcagtccaaccctccttcggagttgcacagggtccacggatccagaaataagcccaccagcttgtggaacccaacgtacggctcctggtttacagagaaacccaccaaaaagaataatcctatagcaaagaaggagccacacgagaggggtaacctggggctggagggaagctgtactgtcccacctaacgttgcaactgggagacttccgggggcctcactgctcctagagccctcttcgctgactgccaatatgaaggaggtacctctgttcaggctacgtcacttcccttgtgggaatgtcaattacggctaccagcaacagggcttgcccttagaagccgctactgcccctggagctggtcattacgaggataccattctgaaaagcaagaatagcatgaaccagcctgggccctgagctcggtcgcacactcacttctcttccttgggatccctaagaccgtggaggagagagaggcaatcaatggctcctttcacaaaccagagaccaaatgtcacgttttgttttgtgccaacctattttgaagtaccaccaaaaaagctgtattttgaaaatgctttagaaaggttttgagcatgggttcatcctattctttcgaaagaagaaaatatcataaaaatgagtgataaatacaaggccagatgtggttgcataaggtttttatgcatgtttgttgtactctgttcgagtccctagagggccggccgtggaagggggacacgtgaatatggcattctctcagtccaaccctccttcggagttgcacaaggtccacggatccagaaacaagcccaccagcttgtggaacccaacgtacggctcctggtttacagagaaacccaccaaaaagaataatcctatagcaaagaaggagccacacgacaggggtaacctggggctggagggaagctgtactgtcccacctaacgttgcaactgggagacttccgggggcctcactgctcctagagccctcttcgctgactgccaatatgaaggaggtacctctgttcaggctacgtcacttcccttgtgggaatgtcaattacggctaccagcaacagggcttgcccttagaagccgctactgcccctggagctggtcattacgaggataccattctgaaaagcaagaatagcatgaaccagcctgggccctgagctcggtcgcacactcacttctcttccttgggatccctaagaccgtggaggagagagaggcaatggctccttcacaaaccagagaccaaatgtcacgttttgttttgtgccaacctattttgaagtaccaccaaaaaagctgtattttgaaaatgctttagaaaggttttgagcatgggttcatcctattctttcgaaagaagaaaatatcataaaaatgagtgataaatacaaggcccagatgtggttgcataaggtttttatgcatgtttgttgtatacttccttatgcttcttttaaattgtgtgtgctctgcttcaatgtagtcagaattagctgcttctatgtttcatagttggggtcatagatgtttccttgccttgttgatgtggacatgagccatttgaggggagagggaacggaaataaaggagttatttgtaatgactaaaaatggg

SEQ ID NO: 417701 - DNA, 2589 bp, Homo sapiens
gtgattccgtcctgcgcggttgttctctggagcagcgttcttttatctccgtccgccttctctcctacctaagtgcgtgccgccacccgatggaagattcgatggacatggacatgagccccctgaggccccagaactatcttttcggttgtgaactaaaggccgacaaagattatcactttaaggtggataatgatgaaaatgagcaccagttatctttaagaacggtcagtttaggggctggtgcaaaggatgagttgcacattgttgaagcagaggcaatgaattacgaaggcagtccaattaaagtaacactggcaactttgaaaatgtctgtacagccaacggtttcccttgggggctttgaaataacaccaccagtggtcttaaggttgaagtgtggttcagggccagtgcatattagtggacagcacttagtagtgtaccgccggaagcaccaggagctgcaagccatgcagatggagctgcagagccctgagtacaagctgagcaagctccgcacctcgaccatcatgaccgactacaaccccaactactgctttgctggcaagacctcctccatcagtgacctgaaggaggtgccgcggaaaaacatcaccctcattcggggtctgggccatggcgcctttggggaggtgtatgaaggccaggtgtccggaatgcccaacgacccaagccccctgcaagtggctgtgaagacgctgcctgaagtgtgctctgaacaggacgaactggatttcctcatggaagccctgatcatcagcaaattcaaccaccagaacattgttcgctgcattggggtgagcctgcaatccctgccccggttcatcctgctggagctcatggcggggggagacctcaagtccttcctccgagagacccgccctcgcccgagccagccctcctccctggccatgctggaccttctgcacgtggctcgggacattgcctgtggctgtcagtatttggaggaaaaccacttcatccaccgagacattgctgccagaaactgcctcttgacctgtccaggccctggaagagtggccaagattggagacttcgggatggcccgagacatctacagggcgagctactatagaaagggaggctgtgccatgctgccagttaagtggatgcccccagaggccttcatggaaggaatattcacttctaaaacagacacatggtcctttggagtgctgctatgggaaatcttttctcttggatatatgccataccccagcaaaagcaaccaggaagttctggagtttgtcaccagtggaggccggatggacccacccaagaactgccctgggcctgtataccggataatgactcagtgctggcaacatcagcctgaagacaggcccaactttgccatcattttggagaggattgaatactgcacccaggacccggatgtaatcaacaccgctttgccgatagaatatggtccacttgtggaagaggaagagaaagtgcctgtgaggcccaaggaccctgagggggttcctcctctcctggtctctcaacaggcaaaacgggaggaggagcgcagcccagctgccccaccacctctgcctaccacctcctctggcaaggctgcaaagaaacccacagctgcagaggtctctgttcgagtccctagagggccggccgtggaagggggacacgtgaatatggcattctctcagtccaaccctccttcggagttgcacaaggtccacggatccagaaacaagcccaccagcttgtggaacccaacgtacggctcctggtttacagagaaacccaccaaaaagaataatcctatagcaaagaaggagccacacgacaggggtaacctggggctggagggaagctgtactgtcccacctaacgttgcaactgggagacttccgggggcctcactgctcctagagccctcttcgctgactgccaatatgaaggaggtacctctgttcaggctacgtcacttcccttgtgggaatgtcaattacggctaccagcaacagggcttgcccttagaagccgctactgcccctggagctggtcattacgaggataccattctgaaaagcaagaatagcatgaaccagcctgggccctgagctcggtcgcacactcacttctcttccttgggatccctaagaccgtggaggagagagaggcaatggctccttcacaaaccagagaccaaatgtcacgttttgttttgtgccaacctattttgaagtaccaccaaaaaagctgtattttgaaaatgctttagaaaggttttgagcatgggttcatcctattctttcgaaagaagaaaatatcataaaaatgagtgataaatacaaggcccagatgtggttgcataaggtttttatgcatgtttgttgtatacttccttatgcttcttttaaattgtgtgtgctctgcttcaatgtagtcagaattagctgcttctatgtttcatagttggggtcatagatgtttccttgccttgttgatgtggacatgagccatttgaggggagagggaacggaaataaaggagttatttgtaatgactaaaaatggg

SEQ ID NO: 417702 - DNA, 2784 bp, Homo sapiens
cctccgcaagccgtctttctctagagttgtatatatagaacatcctggagtccaccatgaacggacagttggatctaagtgggaagctaatcatcaaagctcaacttggggaggatattcggcgaattcctattcataatgaagatattacttatgatgaattagtgctaatgatgcaacgagttttcagaggaaaacttctgagtaatgatgaagtaacaataaagtataaagatgaagatggagatcttataacaatttttgatagttctgacctttcctttgcaattcagtgcagtaggatactgaaactgacattatttgttaatggccagccaagaccccttgaatcaagtcaggtgaaatatctccgtcgagaactgatagaacttcgaaataaagtgaatcgtttattggatagcttggaaccacctggagaaccaggaccttccaccaatattcctgaaaatgatactgtggatggtagggaagaaaagtctgcttctgattcttctggaaaacagtctactcaggttatggcagcaagtatgtctgcttttgatcctttaaaaaaccaagatgaaatcaataaaaatgttatgtcagcgtttggcttaacagatgatcaggtttcagtgtaccgccggaagcaccaggagctgcaagccatgcagatggagctgcagagccctgagtacaagctgagcaagctccgcacctcgaccatcatgaccgactacaaccccaactactgctttgctggcaagacctcctccatcagtgacctgaaggaggtgccgcggaaaaacatcaccctcattcggggtctgggccatggcgcctttggggaggtgtatgaaggccaggtgtccggaatgcccaacgacccaagccccctgcaagtggctgtgaagacgctgcctgaagtgtgctctgaacaggacgaactggatttcctcatggaagccctgatcatcagcaaattcaaccaccagaacattgttcgctgcattggggtgagcctgcaatccctgccccggttcatcctgctggagctcatggcggggggagacctcaagtccttcctccgagagacccgccctcgcccgagccagccctcctccctggccatgctggaccttctgcacgtggctcgggacattgcctgtggctgtcagtatttggaggaaaaccacttcatccaccgagacattgctgccagaaactgcctcttgacctgtccaggccctggaagagtggccaagattggagacttcgggatggcccgagacatctacagggcgagctactatagaaagggaggctgtgccatgctgccagttaagtggatgcccccagaggccttcatggaaggaatattcacttctaaaacagacacatggtcctttggagtgctgctatgggaaatcttttctcttggatatatgccataccccagcaaaagcaaccaggaagttctggagtttgtcaccagtggaggccggatggacccacccaagaactgccctgggcctgtataccggataatgactcagtgctggcaacatcagcctgaagacaggcccaactttgccatcattttggagaggattgaatactgcacccaggacccggatgtaatcaacaccgctttgccgatagaatatggtccacttgtggaagaggaagagaaagtgcctgtgaggcccaaggaccctgagggggttcctcctctcctggtctctcaacaggcaaaacgggaggaggagcgcagcccagctgccccaccacctctgcctaccacctcctctggcaaggctgcaaagaaacccacagctgcagaggtctctgttcgagtccctagagggccggccgtggaagggggacacgtgaatatggcattctctcagtccaaccctccttcggagttgcacaaggtccacggatccagaaacaagcccaccagcttgtggaacccaacgtacggctcctggtttacagagaaacccaccaaaaagaataatcctatagcaaagaaggagccacacgacaggggtaacctggggctggagggaagctgtactgtcccacctaacgttgcaactgggagacttccgggggcctcactgctcctagagccctcttcgctgactgccaatatgaaggaggtacctctgttcaggctacgtcacttcccttgtgggaatgtcaattacggctaccagcaacagggcttgcccttagaagccgctactgcccctggagctggtcattacgaggataccattctgaaaagcaagaatagcatgaaccagcctgggccctgagctcggtcgcacactcacttctcttccttgggatccctaagaccgtggaggagagagaggcaatggctccttcacaaaccagagaccaaatgtcacgttttgttttgtgccaacctattttgaagtaccaccaaaaaagctgtattttgaaaatgctttagaaaggttttgagcatgggttcatcctattctttcgaaagaagaaaatatcataaaaatgagtgataaatacaaggcccagatgtggttgcataaggtttttatgcatgtttgttgtatacttccttatgcttcttttaaattgtgtgtgctctgcttcaatgtagtcagaattagctgcttctatgtttcatagttggggtcatagatgtttccttgccttgttgatgtggacatgagccatttgaggggagagggaacggaaataaaggagttatttgtaatgactaaaaatggg

SEQ ID NO: 417703 - DNA, 2818 bp, Homo sapiens
cgcgccatggccggcctcaactccctggaggcggtgaaacgcaagatccaggccctgcagcagcaggcggacgaggcggaagaccgcgcgcagggcctgcagcgggagctggacggcgagcgcgagcggcgcgagaaagctgaaggtgatgtggccgccctcaaccgacgcatccagctcgttgaggaggagttggacagggctcaggaacgactggccacggccctgcagaagctggaggaggcagaaaaagctgcagatgagagtgagagaggaatgaaggtgatagaaaaccgggccatgaaggatgaggagaagatggagattcaggagatgcagctcaaagaggccaagcacattgcggaagaggctgaccgcaaatacgaggaggtagctcgtaagctggtcatcctggagggtgagctggagagggcagaggagcgtgcggaggtgtctgaactaaaatgtggtgacctggaagaagaactcaagaatgttactaacaatctgaaatctctggaggctgcatctgaaaagtattctgaaaaggaggacaaatatgaagaagaaattaaacttctgtctgacaaactgaaagaggctgagacccgtgctgaatttgcagagagaacggttgcaaaactggaaaagacaattgatgacctggaagtgtaccgccggaagcaccaggagctgcaagccatgcagatggagctgcagagccctgagtacaagctgagcaagctccgcacctcgaccatcatgaccgactacaaccccaactactgctttgctggcaagacctcctccatcagtgacctgaaggaggtgccgcggaaaaacatcaccctcattcggggtctgggccatggcgcctttggggaggtgtatgaaggccaggtgtccggaatgcccaacgacccaagccccctgcaagtggctgtgaagacgctgcctgaagtgtgctctgaacaggacgaactggatttcctcatggaagccctgatcatcagcaaattcaaccaccagaacattgttcgctgcattggggtgagcctgcaatccctgccccggttcatcctgctggagctcatggcggggggagacctcaagtccttcctccgagagacccgccctcgcccgagccagccctcctccctggccatgctggaccttctgcacgtggctcgggacattgcctgtggctgtcagtatttggaggaaaaccacttcatccaccgagacattgctgccagaaactgcctcttgacctgtccaggccctggaagagtggccaagattggagacttcgggatggcccgagacatctacagggcgagctactatagaaagggaggctgtgccatgctgccagttaagtggatgcccccagaggccttcatggaaggaatattcacttctaaaacagacacatggtcctttggagtgctgctatgggaaatcttttctcttggatatatgccataccccagcaaaagcaaccaggaagttctggagtttgtcaccagtggaggccggatggacccacccaagaactgccctgggcctgtataccggataatgactcagtgctggcaacatcagcctgaagacaggcccaactttgccatcattttggagaggattgaatactgcacccaggacccggatgtaatcaacaccgctttgccgatagaatatggtccacttgtggaagaggaagagaaagtgcctgtgaggcccaaggaccctgagggggttcctcctctcctggtctctcaacaggcaaaacgggaggaggagcgcagcccagctgccccaccacctctgcctaccacctcctctggcaaggctgcaaagaaacccacagctgcagaggtctctgttcgagtccctagagggccggccgtggaagggggacacgtgaatatggcattctctcagtccaaccctccttcggagttgcacaaggtccacggatccagaaacaagcccaccagcttgtggaacccaacgtacggctcctggtttacagagaaacccaccaaaaagaataatcctatagcaaagaaggagccacacgacaggggtaacctggggctggagggaagctgtactgtcccacctaacgttgcaactgggagacttccgggggcctcactgctcctagagccctcttcgctgactgccaatatgaaggaggtacctctgttcaggctacgtcacttcccttgtgggaatgtcaattacggctaccagcaacagggcttgcccttagaagccgctactgcccctggagctggtcattacgaggataccattctgaaaagcaagaatagcatgaaccagcctgggccctgagctcggtcgcacactcacttctcttccttgggatccctaagaccgtggaggagagagaggcaatggctccttcacaaaccagagaccaaatgtcacgttttgttttgtgccaacctattttgaagtaccaccaaaaaagctgtattttgaaaatgctttagaaaggttttgagcatgggttcatcctattctttcgaaagaagaaaatatcataaaaatgagtgataaatacaaggcccagatgtggttgcataaggtttttatgcatgtttgttgtatacttccttatgcttcttttaaattgtgtgtgctctgcttcaatgtagtcagaattagctgcttctatgtttcatagttggggtcatagatgtttccttgccttgttgatgtggacatgagccatttgaggggagagggaacggaaataaaggagttatttgtaatgactaaaaatggg

SEQ ID NO: 417704 - DNA, 2485 bp, Homo sapiens
cgagaagttgagggagaaaggcgggcccgggaacaggctgaggctgaggtggcctccttgaaccgtaggatccagctggttgaagaagagctggaccgtgctcaggagcgtgcggaggtgtctgaactaaaatgtggtgacctggaagaagaactcaagaatgttactaacaatctgaaatctctggaggctgcatctgaaaagtattctgaaaaggaggacaaatatgaagaagaaattaaacttctgtctgacaaactgaaagaggctgagacccgtgctgaatttgcagagagaacggttgcaaaactggaaaagacaattgatgacctggaagtgtaccgccggaagcaccaggagctgcaagccatgcagatggagctgcagagccctgagtacaagctgagcaagctccgcacctcgaccatcatgaccgactacaaccccaactactgctttgctggcaagacctcctccatcagtgacctgaaggaggtgccgcggaaaaacatcaccctcattcggggtctgggccatggcgcctttggggaggtgtatgaaggccaggtgtccggaatgcccaacgacccaagccccctgcaagtggctgtgaagacgctgcctgaagtgtgctctgaacaggacgaactggatttcctcatggaagccctgatcatcagcaaattcaaccaccagaacattgttcgctgcattggggtgagcctgcaatccctgccccggttcatcctgctggagctcatggcggggggagacctcaagtccttcctccgagagacccgccctcgcccgagccagccctcctccctggccatgctggaccttctgcacgtggctcgggacattgcctgtggctgtcagtatttggaggaaaaccacttcatccaccgagacattgctgccagaaactgcctcttgacctgtccaggccctggaagagtggccaagattggagacttcgggatggcccgagacatctacagggcgagctactatagaaagggaggctgtgccatgctgccagttaagtggatgcccccagaggccttcatggaaggaatattcacttctaaaacagacacatggtcctttggagtgctgctatgggaaatcttttctcttggatatatgccataccccagcaaaagcaaccaggaagttctggagtttgtcaccagtggaggccggatggacccacccaagaactgccctgggcctgtataccggataatgactcagtgctggcaacatcagcctgaagacaggcccaactttgccatcattttggagaggattgaatactgcacccaggacccggatgtaatcaacaccgctttgccgatagaatatggtccacttgtggaagaggaagagaaagtgcctgtgaggcccaaggaccctgagggggttcctcctctcctggtctctcaacaggcaaaacgggaggaggagcgcagcccagctgccccaccacctctgcctaccacctcctctggcaaggctgcaaagaaacccacagctgcagaggtctctgttcgagtccctagagggccggccgtggaagggggacacgtgaatatggcattctctcagtccaaccctccttcggagttgcacaaggtccacggatccagaaacaagcccaccagcttgtggaacccaacgtacggctcctggtttacagagaaacccaccaaaaagaataatcctatagcaaagaaggagccacacgacaggggtaacctggggctggagggaagctgtactgtcccacctaacgttgcaactgggagacttccgggggcctcactgctcctagagccctcttcgctgactgccaatatgaaggaggtacctctgttcaggctacgtcacttcccttgtgggaatgtcaattacggctaccagcaacagggcttgcccttagaagccgctactgcccctggagctggtcattacgaggataccattctgaaaagcaagaatagcatgaaccagcctgggccctgagctcggtcgcacactcacttctcttccttgggatccctaagaccgtggaggagagagaggcaatggctccttcacaaaccagagaccaaatgtcacgttttgttttgtgccaacctattttgaagtaccaccaaaaaagctgtattttgaaaatgctttagaaaggttttgagcatgggttcatcctattctttcgaaagaagaaaatatcataaaaatgagtgataaatacaaggcccagatgtggttgcataaggtttttatgcatgtttgttgtatacttccttatgcttcttttaaattgtgtgtgctctgcttcaatgtagtcagaattagctgcttctatgtttcatagttggggtcatagatgtttccttgccttgttgatgtggacatgagccatttgaggggagagggaacggaaataaaggagttatttgtaatgactaaaaatggg

SEQ ID NO: 417705 - DNA, 251 bp, Homo sapiens
ccaagattggagacttcgggatggcccgagacatctacaggtgagtaaagactgcctcacccctccgggcctgtctcttccacctcagcccctcaagaatggggtgtggctgcttgtcccttacatcatctcctggtaccctgtcaactttctacctaaaatttcactaagttccttttcaggctatgggaaaccttaattagtgaccatgcccgaaggcctaaatctgggatcacacttcctgcagtaat

SEQ ID NO: 417706 - DNA, 2619 bp, Homo sapiens
cctccgcaagccgtctttctctagagttgtatatatagaacatcctggagtccaccatgaacggacagttggatctaagtgggaagctaatcatcaaagctcaacttggggaggatattcggcgaattcctattcataatgaagatattacttatgatgaattagtgctaatgatgcaacgagttttcagaggaaaacttctgagtaatgatgaagtaacaataaagtataaagatgaagatggagatcttataacaatttttgatagttctgacctttcctttgcaattcagtgcagtaggatactgaaactgacattatttgttaatggccagccaagaccccttgaatcaagtcaggtgaaatatctccgtcgagaactgatagaacttcgaaataaagtgaatcgtttattggatagcttggaaccacctggagaaccaggaccttccaccaatattcctgaaaatgtgtaccgccggaagcaccaggagctgcaagccatgcagatggagctgcagagccctgagtacaagctgagcaagctccgcacctcgaccatcatgaccgactacaaccccaactactgctttgctggcaagacctcctccatcagtgacctgaaggaggtgccgcggaaaaacatcaccctcattcggggtctgggccatggcgcctttggggaggtgtatgaaggccaggtgtccggaatgcccaacgacccaagccccctgcaagtggctgtgaagacgctgcctgaagtgtgctctgaacaggacgaactggatttcctcatggaagccctgatcatcagcaaattcaaccaccagaacattgttcgctgcattggggtgagcctgcaatccctgccccggttcatcctgctggagctcatggcggggggagacctcaagtccttcctccgagagacccgccctcgcccgagccagccctcctccctggccatgctggaccttctgcacgtggctcgggacattgcctgtggctgtcagtatttggaggaaaaccacttcatccaccgagacattgctgccagaaactgcctcttgacctgtccaggccctggaagagtggccaagattggagacttcgggatggcccgagacatctacagggcgagctactatagaaagggaggctgtgccatgctgccagttaagtggatgcccccagaggccttcatggaaggaatattcacttctaaaacagacacatggtcctttggagtgctgctatgggaaatcttttctcttggatatatgccataccccagcaaaagcaaccaggaagttctggagtttgtcaccagtggaggccggatggacccacccaagaactgccctgggcctgtataccggataatgactcagtgctggcaacatcagcctgaagacaggcccaactttgccatcattttggagaggattgaatactgcacccaggacccggatgtaatcaacaccgctttgccgatagaatatggtccacttgtggaagaggaagagaaagtgcctgtgaggcccaaggaccctgagggggttcctcctctcctggtctctcaacaggcaaaacgggaggaggagcgcagcccagctgccccaccacctctgcctaccacctcctctggcaaggctgcaaagaaacccacagctgcagaggtctctgttcgagtccctagagggccggccgtggaagggggacacgtgaatatggcattctctcagtccaaccctccttcggagttgcacaaggtccacggatccagaaacaagcccaccagcttgtggaacccaacgtacggctcctggtttacagagaaacccaccaaaaagaataatcctatagcaaagaaggagccacacgacaggggtaacctggggctggagggaagctgtactgtcccacctaacgttgcaactgggagacttccgggggcctcactgctcctagagccctcttcgctgactgccaatatgaaggaggtacctctgttcaggctacgtcacttcccttgtgggaatgtcaattacggctaccagcaacagggcttgcccttagaagccgctactgcccctggagctggtcattacgaggataccattctgaaaagcaagaatagcatgaaccagcctgggccctgagctcggtcgcacactcacttctcttccttgggatccctaagaccgtggaggagagagaggcaatggctccttcacaaaccagagaccaaatgtcacgttttgttttgtgccaacctattttgaagtaccaccaaaaaagctgtattttgaaaatgctttagaaaggttttgagcatgggttcatcctattctttcgaaagaagaaaatatcataaaaatgagtgataaatacaaggcccagatgtggttgcataaggtttttatgcatgtttgttgtatacttccttatgcttcttttaaattgtgtgtgctctgcttcaatgtagtcagaattagctgcttctatgtttcatagttggggtcatagatgtttccttgccttgttgatgtggacatgagccatttgaggggagagggaacggaaataaaggagttatttgtaatgactaaaaatggg

SEQ ID NO: 417707 - DNA, 2743 bp, Homo sapiens
ctctcagccaggcggattgaaggatggaattccaacgaggctcccccgcctcgtcccaccttggctgaaggtgatgtggccgccctcaaccgacgcatccagctcgttgaggaggagttggacagggctcaggaacgactggccacggccctgcagaagctggaggaggcagaaaaagctgcagatgagagtgagagaggaatgaaggtgatagaaaaccgggccatgaaggatgaggagaagatggagattcaggagatgcagctcaaagaggccaagcacattgcggaagaggctgaccgcaaatacgaggaggtagctcgtaagctggtcatcctggagggtgagctggagagggcagaggagcgtgcggaggtgtctgaactaaaatgtggtgacctggaagaagaactcaagaatgttactaacaatctgaaatctctggaggctgcatctgaaaagtattctgaaaaggaggacaaatatgaagaagaaattaaacttctgtctgacaaactgaaagaggctgagacccgtgctgaatttgcagagagaacggttgcaaaactggaaaagacaattgatgacctggaagtgtaccgccggaagcaccaggagctgcaagccatgcagatggagctgcagagccctgagtacaagctgagcaagctccgcacctcgaccatcatgaccgactacaaccccaactactgctttgctggcaagacctcctccatcagtgacctgaaggaggtgccgcggaaaaacatcaccctcattcggggtctgggccatggcgcctttggggaggtgtatgaaggccaggtgtccggaatgcccaacgacccaagccccctgcaagtggctgtgaagacgctgcctgaagtgtgctctgaacaggacgaactggatttcctcatggaagccctgatcatcagcaaattcaaccaccagaacattgttcgctgcattggggtgagcctgcaatccctgccccggttcatcctgctggagctcatggcggggggagacctcaagtccttcctccgagagacccgccctcgcccgagccagccctcctccctggccatgctggaccttctgcacgtggctcgggacattgcctgtggctgtcagtatttggaggaaaaccacttcatccaccgagacattgctgccagaaactgcctcttgacctgtccaggccctggaagagtggccaagattggagacttcgggatggcccgagacatctacagggcgagctactatagaaagggaggctgtgccatgctgccagttaagtggatgcccccagaggccttcatggaaggaatattcacttctaaaacagacacatggtcctttggagtgctgctatgggaaatcttttctcttggatatatgccataccccagcaaaagcaaccaggaagttctggagtttgtcaccagtggaggccggatggacccacccaagaactgccctgggcctgtataccggataatgactcagtgctggcaacatcagcctgaagacaggcccaactttgccatcattttggagaggattgaatactgcacccaggacccggatgtaatcaacaccgctttgccgatagaatatggtccacttgtggaagaggaagagaaagtgcctgtgaggcccaaggaccctgagggggttcctcctctcctggtctctcaacaggcaaaacgggaggaggagcgcagcccagctgccccaccacctctgcctaccacctcctctggcaaggctgcaaagaaacccacagctgcagaggtctctgttcgagtccctagagggccggccgtggaagggggacacgtgaatatggcattctctcagtccaaccctccttcggagttgcacaaggtccacggatccagaaacaagcccaccagcttgtggaacccaacgtacggctcctggtttacagagaaacccaccaaaaagaataatcctatagcaaagaaggagccacacgacaggggtaacctggggctggagggaagctgtactgtcccacctaacgttgcaactgggagacttccgggggcctcactgctcctagagccctcttcgctgactgccaatatgaaggaggtacctctgttcaggctacgtcacttcccttgtgggaatgtcaattacggctaccagcaacagggcttgcccttagaagccgctactgcccctggagctggtcattacgaggataccattctgaaaagcaagaatagcatgaaccagcctgggccctgagctcggtcgcacactcacttctcttccttgggatccctaagaccgtggaggagagagaggcaatggctccttcacaaaccagagaccaaatgtcacgttttgttttgtgccaacctattttgaagtaccaccaaaaaagctgtattttgaaaatgctttagaaaggttttgagcatgggttcatcctattctttcgaaagaagaaaatatcataaaaatgagtgataaatacaaggcccagatgtggttgcataaggtttttatgcatgtttgttgtatacttccttatgcttcttttaaattgtgtgtgctctgcttcaatgtagtcagaattagctgcttctatgtttcatagttggggtcatagatgtttccttgccttgttgatgtggacatgagccatttgaggggagagggaacggaaataaaggagttatttgtaatgactaaaaatggg

SEQ ID NO: 417708 - DNA, 1320 bp, Homo sapiens
cagtttttggttaaaagaacccggaaagagaaggactatgggggaactgatggcgttcctgttacctctcatcattgtgttaatggtgaagcacagcgattcccggacgcactctctgagatattttcgcctgggcgtttcggatcccatccatggggtccctgaatttatttcggttgggtacgtggactcgcaccctatcaccacatatgacagtgtcactcggcagaaggagccacgggccccatggatggcagagaacctcgcgcctgatcactgggagaggtacactcagctgctgaggggctggcagcagatgttcaaggtggaactgaagcgcctacagaggcactacaatcactcagggtctcacacttaccagagaatgattggctgtgagctgctggaggatggaagcaccacaggatttctgcagtatgcatatgacgggcaggatttcctgatcttcaataaagacaccctctcctggctggctgtagataatgtggctcacaccatcaagcaggcatgggaggccaatcagcatgagttgctgtatcaaaagaattggctggaagaagaatgtattgcctggctaaagagattcctggagtatgggaaagacaccctacaaagaacagagcccccactggtcagagtaaatcgcaaagaaacttttccaggggttacagctctcttctgcaaagctcatggcttttaccccccagaaatttacatgacatggatgaaaaacggggaagaaattgtccaagaaattgattatggagacattcttcccagtggggatggaacctatcaggcgtgggcatcaattgagcttgatcctcagagcagcaacctttactcctgtcatgtggagcactgcggtgtccacatggttcttcaggtcccccaggaatcagaaactatccctcttgtgatgaaagctgtctctgggtccattgtccttgtcattgtgctggctggagttggtgttctagtctggagaagaaggccccgagagcaaaatggagccatctaccttccaacaccagatcgatgattgcagatccctcttttccagttctccttcctctaggagccatgttatcctctgtcccccatagagtcaagcctagtgcttgaaggtcctgacgacacccacaacatacatgagagtaatgggattgagcatttatggcagcaacagaggagccacaaaatgttctttgttctttggctccaaaaagactgtcagctttcagtctcttttgatggactgttttatcagagttgactttaaatacagcttgtctcatg

SEQ ID NO: 417709 - DNA, 1185 bp, Homo sapiens
cagtttttggttaaaagaacccggaaagagaaggactatgggggaactgatggcgttcctgttacctctcatcattgtgttaatggtgaagcacagcgattcccggacgcactctctgagatattttcgcctgggcgtttcggatcccatccatggggtccctgaatttatttcggttgggtacgtggactcgcaccctatcaccacatatgacagtgtcactcggcagaaggagccacgggccccatggatggcagagaacctcgcgcctgatcactgggagaggtacactcagctgctgaggggctggcagcagatgttcaaggtggaactgaagcgcctacagaggcactacaatcactcagataatgtggctcacaccatcaagcaggcatgggaggccaatcagcatgagttgctgtatcaaaagaattggctggaagaagaatgtattgcctggctaaagagattcctggagtatgggaaagacaccctacaaagaacagagcccccactggtcagagtaaatcgcaaagaaacttttccaggggttacagctctcttctgcaaagctcatggcttttaccccccagaaatttacatgacatggatgaaaaacggggaagaaattgtccaagaaattgattatggagacattcttcccagtggggatggaacctatcaggcgtgggcatcaattgagcttgatcctcagagcagcaacctttactcctgtcatgtggagcactgcggtgtccacatggttcttcaggtcccccaggaatcagaaactatccctcttgtgatgaaagctgtctctgggtccattgtccttgtcattgtgctggctggagttggtgttctagtctggagaagaaggccccgagagcaaaatggagccatctaccttccaacaccagatcgatgattgcagatccctcttttccagttctccttcctctaggagccatgttatcctctgtcccccatagagtcaagcctagtgcttgaaggtcctgacgacacccacaacatacatgagagtaatgggattgagcatttatggcagcaacagaggagccacaaaatgttctttgttctttggctccaaaaagactgtcagctttcagtctcttttgatggactgttttatcagagttgactttaaatacagcttgtctcatg

SEQ ID NO: 417710 - DNA, 586 bp, Homo sapiens
cagtttttggttaaaagaacccggaaagagaaggactatgggggaactgatggcgttcctgttacctctcatcattgtgttaatggtgaagcacagcgattcccgtgagtatcccacgtcctcttctctcctaactccaaagtcgaggcagcctagaaggcacagcttttcttcctaaaacttgtggtgaaaaatatagaagccaggggcagaaacgtgtatgtattacactcagactccaggagcaatggattgcctgaacagtttcccagttcatatttgtaggattttgatgtcaccaccttctgagggagggggagccgttctagaaagactctggaacttcctcactttccctctgagcatggcctcctttcttttctgctcatattttttcttttacttttgtttctcctcttttctaacttccagagtctcatgaggatgtagtcagagtttcaggggcattaacagtggagtagatccattgttcaggtttatttatgtttttcctcaacacaagccctacctgtaataaaagatccaagaaagataaaaccatggctctgggtttgtttactgactg

SEQ ID NO: 417711 - DNA, 2059 bp, Homo sapiens
cagtttttggttaaaagaacccggaaagagaaggactatgggggaactgatggcgttcctgttacctctcatcattgtgttaatggtgaagcacagcgattcccggacgcactctctgagatattttcgcctgggcgtttcggatcccatccatggggtccctgaatttatttcggttgggtacgtggactcgcaccctatcaccacatatgacagtgtcactcggcagaaggagccacgggccccatggatggcagagaacctcgcgcctgatcactgggagaggtacactcagctgctgaggggctggcagcagatgttcaaggtggaactgaagcgcctacagaggcactacaatcactcagggtctcacacttaccagagaatgattggctgtgagctgctggaggatggaagcaccacaggatttctgcagtatgcatatgacgggcaggatttcctgatcttcaataaagacaccctctcctggctggctgtagataatgtggctcacaccatcaagcaggcatgggaggccaatcagcatgagttgctgtatcaaaagaattggctggaagaagaatgtattgcctggctaaagagattcctggagtatgggaaagacaccctacaaagaacagaatcagaaactatccctcttgtgatgaaagctgtctctgggtccattgtccttgtcattgtgctggctggagttggtgttctagtctggagaagaaggccccgagagcaaaatggagccatctaccttccaacaccagatcgatgattgcagatccctcttttccagttctccttcctctaggagccatgttatcctctgtcccccatagagtcaagcctagtgcttgaaggtcctgacgacacccacaacatacatgagagtaatgggattgagcatttatggcagcaacagaggagccacaaaatgttctttgttctttggctccaaaaagactgtcagctttcagtctcttttgatggactgttttatcagagttgactttaaatacagcttgtctcatgacacaacgcttccctacattctatttgtcaatgatgatttgcaactagttggagattctcagagcaggaaggaatcttttcaaccagagcaggaactgtcttctgcaatgccttggacttgagcctccagcctccacttgaacaccatgtgaagggaacctcagtacttcataaaatggcctttctcattcatctttcatgggaacatttattgtacaagcgctttgaatatcatgggcaccatgactgtgaccctacaggtaggattggatcactccatgagagtagccggcaggtttctacaatggcctgggaatggactgattatttttatacattttctggcctgagagaaagccaaagtcccctgctgttcacagcaaccctgcctgggagcttggaatcttggtaatctgcccggttggatctatggaggtagtctcaccctttttgtcttttgtgggaaattaagagaaataattatcagacatatcatcacctccagtggaactacagagacctggacccagctgcactattttaatgtaaaaataacagtatggccaggtgcagtggctcacgcctgtaatcccatcactttgagcagccaaggcgggcggatcacgaggtcaggagattaagaccatcctggccaatatggtgaaaccctgtctctactaaaatacaaaaaattagctgggcatggtgttgcgtgcctgtagtcccagctacttgggaggctgagacaggggaattgcttgaacccgggaggcagagattgcagtgagccgagatcacgccactgcactccagcctggcgacagagtgagactctatctcaaaataataataataataataataataatagtatatttggtgtcaggagagggctcaattctcatttctgcctttcctgtgctggctcatggtagctgggcatgacttgccttcctacataggttgtcttcatacatatgcactgggaatcaataaaagcccatggtgagaatga

SEQ ID NO: 417712 - DNA, 1044 bp, Homo sapiens
cagtttttggttaaaagaacccggaaagagaaggactatgggggaactgatggcgttcctgttacctctcatcattgtgttaatggtgaagcacagcgattcccggacgcactctctgagatattttcgcctgggcgtttcggatcccatccatggggtccctgaatttatttcggttgggtacgtggactcgcaccctatcaccacatatgacagtgtcactcggcagaaggagccacgggccccatggatggcagagaacctcgcgcctgatcactgggagaggtacactcagctgctgaggggctggcagcagatgttcaaggtggaactgaagcgcctacagaggcactacaatcactcagggtctcacacttaccagagaatgattggctgtgagctgctggaggatggaagcaccacaggatttctgcagtatgcatatgacgggcaggatttcctgatcttcaataaagacaccctctcctggctggctgtagataatgtggctcacaccatcaagcaggcatgggaggccaatcagcatgagttgctgtatcaaaagaattggctggaagaagaatgtattgcctggctaaagagattcctggagtatgggaaagacaccctacaaagaacagaatcagaaactatccctcttgtgatgaaagctgtctctgggtccattgtccttgtcattgtgctggctggagttggtgttctagtctggagaagaaggccccgagagcaaaatggagccatctaccttccaacaccagatcgatgattgcagatccctcttttccagttctccttcctctaggagccatgttatcctctgtcccccatagagtcaagcctagtgcttgaaggtcctgacgacacccacaacatacatgagagtaatgggattgagcatttatggcagcaacagaggagccacaaaatgttctttgttctttggctccaaaaagactgtcagctttcagtctcttttgatggactgttttatcagagttgactttaaatacagcttgtctcatg

SEQ ID NO: 417713 - DNA, 1120 bp, Homo sapiens
cttggcagtgctggaaggagcaagaaacaggaagaaaaagagggacgcactctctgagatattttcgcctgggcgtttcggatcccatccatggggtccctgaatttatttcggttgggtacgtggactcgcaccctatcaccacatatgacagtgtcactcggcagaaggagccacgggccccatggatggcagagaacctcgcgcctgatcactgggagaggtacactcagctgctgaggggctggcagcagatgttcaaggtggaactgaagcgcctacagaggcactacaatcactcagggtctcacacttaccagagaatgattggctgtgagctgctggaggatggaagcaccacaggatttctgcagtatgcatatgacgggcaggatttcctgatcttcaataaagacaccctctcctggctggctgtagataatgtggctcacaccatcaagcaggcatgggaggccaatcagcatgagttgctgtatcaaaagaattggctggaagaagaatgtattgcctggctaaagagattcctggagtatgggaaagacaccctacaaagaacagagcccccactggtcagagtaaatcgcaaagaaacttttccaggggttacagctctcttctgcaaagctcatggcttttaccccccagaaatttacatgacatggatgaaaaacggggaagaaattgtccaagaaattgattatggagacattcttcccagtggggatggaacctatcaggcgtgggcatcaattgagcttgatcctcagagcagcaacctttactcctgtcatgtggagcactgcggtgtccacatggttcttcaggtcccccagggtaaggacggggatcgtggctgtctagggagagagcctggagaaaggggtgagcaggaaaccatgctcgctgccagggaggggaggatagatcactgcctcactcagtgtgccttagaatgggtcttttaaataagtggttctcacactttttggaaccaggacgccttcatactattaaaaaattattgaggaccccagagagcttttgctgatgtgggttatatctattgctatttactacattacaaattaaaaatttaaaa

SEQ ID NO: 417714 - DNA, 1029 bp, Homo sapiens
ctagttgcaaatcatcattgacaaatagaatgtagggaagcgttgtgtcatgagacaagcagtatttaaagtcaactctgagtaaaacagtccatcaaaagagactgaaagctgacagtcttttaggagacaaagaacgaagaacatattgtggctcctctgttacttcataaaatggcctttctcattcatctttcatgggaacatttattgtacaagcgctttgaatatcatgggcaccatgactgtgaccctacaggtaggattggatcactccatgagagtagccggcaggtttctacaatggcctgggaatggactgattatttttatacattttctggcctgagagaaagccaaagtcccctgctgttcacagcaaccctgcctgggagcttggaatcttggtaatctgcccggttggatctatggaggtagtctcaccctttttgtcttttgtgggaaattaagagaaataattatcagacatatcatcacctccagtggaactacagagacctggacccagctgcactattttaatgtaaaaataacagtatggccaggtgcagtggctcacgcctgtaatcccatcactttgagcagccaaggcgggcggatcacgaggtcaggagattaagaccatcctggccaatatggtgaaaccctgtctctactaaaatacaaaaaattagctgggcatggtgttgcgtgcctgtagtcccagctacttgggaggctgagacaggggaattgcttgaacccgggaggcagagattgcagtgagccgagatcacgccactgcactccagcctggcgacagagtgagactctatctcaaaataataataataataataataataataataataataataacagtatatttggtgtcaggagagggctcaattctcatttctgcctttcctgtgctggctcatggtagctgggcatgacttgccttcctacataggttgtcttcatacatatgcactgggaatcaataaaagcccatggtgagaatga

SEQ ID NO: 417715 - DNA, 395 bp, Homo sapiens
gtcattgtgctggctggagttggtgttctagtctggagaagaaggccccgaggtgagaggcacatggaagggatccagggggctgcagactctcctgcatctctccagttttattttctgcacctgctgctccctcctccattcagaaatggcttggctctcaggctgggatcacagaaggacctgggacaaccctcccaccatgtaggggacacaaagcatggataaagcttacagggagagtggtctcttttcataggtgatgcctgacatcaacaaactagtacatctgtccaggggaactgtccccctagaagttgggtcagagaagatatggggatcttgatttgtctttttccaaaccatctttttattattaattactattgacttct

SEQ ID NO: 417716 - DNA, 2074 bp, Homo sapiens
cagtttttggttaaaagaacccggaaagagaaggactatgggggaactgatggcgttcctgttacctctcatcattgtgttaatggtgaagcacagcgattcccggacgcactctctgagatattttcgcctgggcgtttcggatcccatccatggggtccctgaatttatttcggttgggtacgtggactcgcaccctatcaccacatatgacagtgtcactcggcagaaggagccacgggccccatggatggcagagaacctcgcgcctgatcactgggagaggtacactcagctgctgaggggctggcagcagatgttcaaggtggaactgaagcgcctacagaggcactacaatcactcagggtctcacacttaccagagaatgattggctgtgagctgctggaggatggaagcaccacaggatttctgcagtatgcatatgacgggcaggatttcctgatcttcaataaagacaccctctcctggctggctgtagataatgtggctcacaccatcaagcaggcatgggaggccaatcagcatgagttgctgtatcaaaagaattggctggaagaagaatgtattgcctggctaaagagattcctggagtatgggaaagacaccctacaaagaacagaatcagaaactatccctcttgtgatgaaagctgtctctgggtccattgtccttgtcattgtgctggctggagttggtgttctagtctggagaagaaggccccgagagcaaaatggagccatctaccttccaacaccagatcgatgattgcagatccctcttttccagttctccttcctctaggagccatgttatcctctgtcccccatagagtcaagcctagtgcttgaaggtcctgacgacacccacaacatacatgagagtaatgggattgagcatttatggcagcaacagaggagccacaaaatgttctttgttctttggctccaaaaagactgtcagctttcagtctcttttgatggactgttttatcagagttgactttaaatacagcttgtctcatgacacaacgcttccctacattctatttgtcaatgatgatttgcaactagttggagattctcagagcaggaaggaatcttttcaaccagagcaggaactgtcttctgcaatgccttggacttgagcctccagcctccacttgaacaccatgtgaagggaacctcagtacttcataaaatggcctttctcattcatctttcatgggaacatttattgtacaagcgctttgaatatcatgggcaccatgactgtgaccctacaggtaggattggatcactccatgagagtagccggcaggtttctacaatggcctgggaatggactgattatttttatacattttctggcctgagagaaagccaaagtcccctgctgttcacagcaaccctgcctgggagcttggaatcttggtaatctgcccggttggatctatggaggtagtctcaccctttttgtcttttgtgggaaattaagagaaataattatcagacatatcatcacctccagtggaactacagagacctggacccagctgcactattttaatgtaaaaataacagtatggccaggtgcagtggctcacgcctgtaatcccatcactttgagcagccaaggcgggcggatcacgaggtcaggagattaagaccatcctggccaatatggtgaaaccctgtctctactaaaatacaaaaaattagctgggcatggtgttgcgtgcctgtagtcccagctacttgggaggctgagacaggggaattgcttgaacccgggaggcagagattgcagtgagccgagatcacgccactgcactccagcctggcgacagagtgagactctatctcaaaataataataataataataataataataataataataataacagtatatttggtgtcaggagagggctcaattctcatttctgcctttcctgtgctggctcatggtagctgggcatgacttgccttcctacataggttgtcttcatacatatgcactgggaatcaataaaagcccatggtgagaatga

SEQ ID NO: 417717 - DNA, 1618 bp, Homo sapiens
cagtttttggttaaaagaacccggaaagagaaggactatgggggaactgatggcgttcctgttacctctcatcattgtgttaatggtgaagcacagcgattcccggacgcactctctgagatattttcgcctgggcgtttcggatcccatccatggggtccctgaatttatttcggttgggtacgtggactcgcaccctatcaccacatatgacagtgtcactcggcagaaggagccacgggccccatggatggcagagaacctcgcgcctgatcactgggagaggtacactcagctgctgaggggctggcagcagatgttcaaggtggaactgaagcgcctacagaggcactacaatcactcagggtctcacacttaccagagaatgattggctgtgagctgctggaggatggaagcaccacaggatttctgcagtatgcatatgacgggcaggatttcctgatcttcaataaagacaccctctcctggctggctgtagataatgtggctcacaccatcaagcaggcatgggaggccaatcagcatgagttgctgtatcaaaagaattggctggaagaagaatgtattgcctggctaaagagattcctggagtatgggaaagacaccctacaaagaacaggtaaagagaaagagaaggcctcattcccacattgcctgaacaactgtttttatacgtaactcttttaatctaggttatatccactgtatcctgaaagccatctctttagttggcctattgtgatctcatggctagagcccccacgaaaactttccctggttacttttgagcagcatcttgacaagatttgacagttccccttgtcttgacagagtggagtacctccaagggcaccttgtttttagggatctattgaggcaaattcttccattccgtcaatgataagctgggaaattctttgggagatagagcaattcttacaaactgtttagttaacaaagggctcacacaccaccagtaggagtaaaaatctggatttaccaagacaaacagaaggtctctgctttactaaaggattaatgaggttgggcatgatggctcatgcctgtaatcctagcactttgggaggctgaggcaggaggattgcttaaggccaggagtttaagactggcctgggtaacattgtgagaccctgtctctattaaaaaaaaaattagctgagcatggtggcacatgactgtagtcccagatactcaggaggctgaggtgggaggatctcttgagcctggaaggtcaaggctgcagtgagccatgatcatgatcagcctgggtcacagagcaagaccctatttaaaaaaaaaaaaaagtattaatgataagattcctttcagcaaagagctcctcttataccttaaagatatgattcagttggtcaacttttagttcatatagaacttttcatgtatggtcttgttattcaaaattaatcacacctgtatgatgctacaggaaactcctagatacaatgtgtgtgggaagagtatgggaagctcccctctccaggcctctgtctacattcagtgtcctaatggattttcaaccttttggtcaaaacacactcctaaaaaaacaaacaa

SEQ ID NO: 417718 - DNA, 2288 bp, Homo sapiens
cttggcagtgctggaaggagcaagaaacaggaagaaaaagagggacgcactctctgagatattttcgcctgggcgtttcggatcccatccatggggtccctgaatttatttcggttgggtacgtggactcgcaccctatcaccacatatgacagtgtcactcggcagaaggagccacgggccccatggatggcagagaacctcgcgcctgatcactgggagaggtacactcagctgctgaggggctggcagcagatgttcaaggtggaactgaagcgcctacagaggcactacaatcactcagggtctcacacttaccagagaatgattggctgtgagctgctggaggatggaagcaccacaggatttctgcagtatgcatatgacgggcaggatttcctgatcttcaataaagacaccctctcctggctggctgtagataatgtggctcacaccatcaagcaggcatgggaggccaatcagcatgagttgctgtatcaaaagaattggctggaagaagaatgtattgcctggctaaagagattcctggagtatgggaaagacaccctacaaagaacagagcccccactggtcagagtaaatcgcaaagaaacttttccaggggttacagctctcttctgcaaagctcatggcttttaccccccagaaatttacatgacatggatgaaaaacggggaagaaattgtccaagaaattgattatggagacattcttcccagtggggatggaacctatcaggcgtgggcatcaattgagcttgatcctcagagcagcaacctttactcctgtcatgtggagcactgcggtgtccacatggttcttcaggtcccccaggaatcagaaactatccctcttgtgatgaaagctgtctctgggtccattgtccttgtcattgtgctggctggagttggtgttctagtctggagaagaaggccccgagagcaaaatggagccatctaccttccaacaccagatcgatgattgcagatccctcttttccagttctccttcctctaggagccatgttatcctctgtcccccatagagtcaagcctagtgcttgaaggtcctgacgacacccacaacatacatgagagtaatgggattgagcatttatggcagcaacagaggagccacaaaatgttctttgttctttggctccaaaaagactgtcagctttcagtctcttttgatggactgttttatcagagttgactttaaatacagcttgtctcatgacacaacgcttccctacattctatttgtcaatgatgatttgcaactagttggagattctcagagcaggaaggaatcttttcaaccagagcaggaactgtcttctgcaatgccttggacttgagcctccagcctccacttgaacaccatgtgaagggaacctcagtacttcataaaatggcctttctcattcatctttcatgggaacatttattgtacaagcgctttgaatatcatgggcaccatgactgtgaccctacaggtaggattggatcactccatgagagtagccggcaggtttctacaatggcctgggaatggactgattatttttatacattttctggcctgagagaaagccaaagtcccctgctgttcacagcaaccctgcctgggagcttggaatcttggtaatctgcccggttggatctatggaggtagtctcaccctttttgtcttttgtgggaaattaagagaaataattatcagacatatcatcacctccagtggaactacagagacctggacccagctgcactattttaatgtaaaaataacagtatggccaggtgcagtggctcacgcctgtaatcccatcactttgagcagccaaggcgggcggatcacgaggtcaggagattaagaccatcctggccaatatggtgaaaccctgtctctactaaaatacaaaaaattagctgggcatggtgttgcgtgcctgtagtcccagctacttgggaggctgagacaggggaattgcttgaacccgggaggcagagattgcagtgagccgagatcacgccactgcactccagcctggcgacagagtgagactctatctcaaaataataataataataataataataataataataataataacagtatatttggtgtcaggagagggctcaattctcatttctgcctttcctgtgctggctcatggtagctgggcatgacttgccttcctacataggttgtcttcatacatatgcactgggaatcaataaaagcccatggtgagaatga

SEQ ID NO: 417719 - DNA, 804 bp, Homo sapiens
cagtttttggttaaaagaacccggaaagagaaggactatgggggaactgatggcgttcctgttacctctcatcattgtgttaatggtgaagcacagcgattcccggacgcactctctgagatattttcgcctgggcgtttcggatcccatccatggggtccctgaatttatttcggttgggtacgtggactcgcaccctatcaccacatatgacagtgtcactcggcagaaggagccacgggccccatggatggcagagaacctcgcgcctgatcactgggagaggtacactcagctgctgaggggctggcagcagatgttcaaggtggaactgaagcgcctacagaggcactacaatcactcaggtgtgcatgcggcagagacagacgcttcccccatcccaccccaacccgcagagacccctgggctggcctccaataagcggatgctgaattgcacctgctgtagctttggcaaagcctgaggaatcaggttggtggagttcagggcctcccatctgcctgtgcatcttctggactgtccctctctcccccaggagcactctgtcatttgccccacccactcttccccatctctgtatccgtatctgcatcccatttccactcaggcttctgatatgcatctccttttccattctaaatttgcccattctgcgtctcacttcctggtagccaggcctagtgacttgcttatgagtatcgacagtaactttcccaggggtatttctggctcctgcatctctctccctccttctcgcagtctctaatcactagtgaattcgct

SEQ ID NO: 417720 - DNA, 334 bp, Homo sapiens
acatctgcagccatatatgaggtccctcatgagacttagcaacaaggtgtgttttaatgtgacagtgtgtctgatgtgtccccagcacattgggaccagtacacagtgttatttgtacatctgctgagtaacattgagtgtgtgggtaactaaagccctcagtaattattttacttaatgttttcaagcttaattctgatcttgtacttgcatgatttattattccttgtgctaaattcttcaatgttcttgccttgattgatctttcattatctatcacttaactaaaatattaaattctttaattaagtcatgtttaaatgaggacttgttt

SEQ ID NO: 417721 - DNA, 2491 bp, Homo sapiens
agctggccctggctgtgagagtcagatctgtccccaaggctccaggtcagaacttggacccaggtgccttctgaggcaccgccaaggacacatcccagcgccttaggcacctgtaggctagaatgacaccttccaggccagccccagaggccctcagggctccccctccaagccgggagggcaggcaggcacaggccccgctcactacctcagcacccagtgcagccccaggctcccggacgtgctcggcccggtggcctcttgtgtgacaggccctctgccatgtctgtccgcagagccgggtggggagcctccgtgtgggtcctcctctgtccctttgcagctcgcattcgccagagcggagcgcagcccttgtttccttctttcctcttcagctctgacttaaaaacacactatgttccaaatcgttgtgggatcggaaactagaactgcttgtttccaggagagaccaccttttcatattttttttaaaaggaatttgtgcttcaaaagaaactccaaaaaataaatttattgttagtctagcatatgctcattgaaattgacttatgttttattttaaaaaatcatgtaggatctggtacatggggcgggcaaaagggtatcatcagcttaagaagtaaagaagtgagccttccatttgtgtgggtgataacatctttttcctagatcgtacctcaaaattcaggctctccatgaaaacaaagataatctgaataaaaattgtgtgttgggaaatgtatcaagtgaccttcagttaagaaaagcacaggctgtttattagcacaacttgcttcattaaataattcgtggctttttctgccactggggttcttttcgttttgaattcagcttgtgtttggttcctcggtcttgtaccccttcagttcgccggcgacgtaatggtgataccctttgttttttgtatcataccttttgtgaattgtgacaaccatcccgtaatcattgtggcctcagcagaagttttgaacaatctttgcagccactgttggggtgtgtaccagcagcctggaagtgaccagcagagctgacaaaagcaccccctgctctgcccacctccgcagagtcctgtcctcatcagaaacggtatcgcggatgctcctcaggtaggcgtaggcagacttcattgtgtgttagcagtgacagtgatgtctgtacctatctgtgagtgagacccattcatgacacactagaaatgtgtacattcttttgttttccatcacgggtataggtcttctgccatgaaagagaactatcaaggaaattcctgaaaacaagatttgtaaattcgatttgaccctcccaaattcagggctgctctttgcagtggtccctggcccagcaggtggccggcgtggctcctgttggctcatgccagtgttgtgctggaccctcgagtatgtgactgtcacccttgtccaagactggtttttaacagtcttgatttgtcattttgatgctttgaatactataaggaaaatgccacgaataccatataaataccacaccaatctgttgaacatatctgtgttttctgacatgggacctgcagaatagtatttcttttaaatcctgcaactttattatctagtagaattccaagtaggtctgcttagacacatattcagtgaagattgtattgtgtgtgatattatcctatctttaataaagtcctactactgaaaaacagggatttgcaatgaaaatcatagctaaataggcaggtttagaaagttcaaaatattggaagtgctagaaggctgcaacttgtaaaattgtactccccaagttcagtaggatagtagagaagtcgtgctaagttgatttcattgaaatgtcacgtctcacatcctgtggtccaaaggtactagtttgttttgtggaataattttctgttcacttgctgataagaaatttagcagtcagaagtaatttttaattaataacctttctttttaaaagttgctttatggtttacaagtaatactgatgcaaaaaggatttgttaacctaaattaagtagcacgcactttgtttacatgcttcagtatattgtggggttggtcccttctcacgaacccaggacctgtgcttggggaacattttgccatcatgctgttctcttgtaccaaggatcagtgaaagtgttttatcttttttatgtagtttgtattgactggattttataactgtaagaaaacagaaacagagtgttgtattttgatctgaaatttgtgtatgctaaagtaattttgttttatgtattggaagttcacttaaaaacttgaaatattttctagaagggtaccacacaaaaggaatcatctttaagctgtttaattaacctaataaaataatttgatggggaaggcattctaattgtttctgatttttagagtggttcctgctaaatcatcattatcaatacagcttgatttgatttaagaat

SEQ ID NO: 417722 - DNA, 325 bp, Homo sapiens
tgtatggatgtaccataatttatgtaaccagttttttattgttggttatttaaattgttttcaatattttgcccttacaatcaatactgtaatgaatatctttgggtatatctgttgaacacctatgtgaattatgtggaataaattctcataagtagaatttcttgttcaaaaggttttttttttaattgtataaatattgccaaatgcaatagaggtttttaccagttaacacttccaactaataatgtgtgaataaactttttcttaaataaaactgattctacaaaccgagtcttaggagaaaataaaatttataaataat

SEQ ID NO: 417723 - DNA, 473 bp, Homo sapiens
ggacactcatctgtgccccacgtccagatccctggaggcagctgaccaatgatgggcggtgacccggtaaccgaggcggcaaggaggccaggtagtcccggcacctctcactctgcagagaccagcggcttcgtgggaggcctgtgggtcacacgtaggggctagagccagcctgcatcctgcccaccgggctccacttggagatcagcaggagggccagtgtgggacccctgctgccacctctcctgggcctgtgtcctttctggaaattaagaaggtgtgctccagagccaagaggagcaataagaaacctcgtgtgccagcttctgagggtggcagtgccagaccccacctgccagcggtgctgcccctttctcagacccccatgcccagtgcaggcagggccctggaaagggtcagctctccctgacagagaccagcagagtgaaggactgagcactggccaggctcaa

SEQ ID NO: 417724 - DNA, 178 bp, Homo sapiens
cattgcaagtatgtgtggtacagtaaaatgttgctaattgtatctgcgctgataagatgccatttgctctaggtcagtttcctaccccctcccccaactattcctagccagtggtagcatgcttcttacttccaaatatatgtgtgtgtgtgtgtgtgtgtgtgtgtgtgtgtgtgcc

SEQ ID NO: 417725 - DNA, 5262 bp, Homo sapiens
ggctcctgaggcgcacagcgccgagcgcggcgccgcgcacccgcgcgccggacgccagtgaccgcgatggtgaactccagtcgcgtgcagcctcagcagcccggggacgccaagcggccgcccgcgccccgcgcgccggacccgggccggctgatggctggctgcgcggccgtgggcgccagcctcgccgccccgggcggcctctgcgagcagcggggcctggagatcgagatgcagcgcatccggcaggcggccgcgcgggaccccccggccggagccgcggcctccccttctcctccgctctcgtcgtgctcccggcaggcgtggagccgcgataaccccggcttcgaggccgaggaggaggaggaggaggtggaaggggaagaaggcggaatggtggtggagatggacgtagagtggcgcccgggcagccggaggtcggccgcctcctcggccgtgagctccgtgggcgcgcggagccgggggcttgggggctaccacggcgcgggccacccgagcgggaggcggcgccggcgagaggaccagggcccgccgtgccccagcccagtcggcggcggggacccgctgcatcgccacctccccctggaagggcagccgccccgagtggcctgggcggagaggctggttcgcgggctgcgaggtctctggggaacaagactcatggaggaaagcagcactaaccgagagaaataccttaaaagtgttttacgggaactggtcacatacctcctttttctcatagtcttgtgcatcttgacctacggcatgatgagctccaatgtgtactactacacccggatgatgtcacagctcttcctagacacccccgtgtccaaaacggagaaaactaactttaaaactctgtcttccatggaagacttctggaagttcacagaaggctccttattggatgggctgtactggaagatgcagcccagcaaccagactgaagctgacaaccgaagtttcatcttctatgagaacctgctgttaggggttccacgaatacggcaactccgagtcagaaatggatcctgctctatcccccaggacttgagagatgaaattaaagagtgctatgatgtctactctgtcagtagtgaagatagggctccctttgggccccgaaatggaaccgcttggatctacacaagtgaaaaagacttgaatggtagtagccactggggaatcattgcaacttatagtggagctggctattatctggatttgtcaagaacaagagaggaaacagctgcacaagttgctagcctcaagaaaaatgtctggctggaccgaggaaccagggcaacttttattgacttctcagtgtacaacgccaacattaacctgttctgtgtggtcaggttattggttgaattcccagcaacaggtggtgtgattccatcttggcaatttcagcctttaaagctgatccgatatgtcacaacttttgatttcttcctggcagcctgtgagattatcttttgtttctttatcttttactatgtggtggaagagatattggaaattcgcattcacaaactacactatttcaggagtttctggaattgtctggatgttgtgatcgttgtgctgtcagtggtagctataggaattaacatatacagaacatcaaatgtggaggtgctactacagtttctggaagatcaaaatactttccccaactttgagcatctggcatattggcagatacagttcaacaatatagctgctgtcacagtattttttgtctggattaagctcttcaaattcatcaattttaacaggaccatgagccagctctcgacaaccatgtctcgatgtgccaaagacctgtttggctttgctattatgttcttcattattttcctagcgtatgctcagttggcataccttgtctttggcactcaggtcgatgacttcagtactttccaagagtgtatcttcactcaattccgtatcattttgggcgatatcaactttgcagagattgaggaagctaatcgagttttgggaccaatttatttcactacatttgtgttctttatgttcttcattcttttgaatatgtttttggctatcatcaatgatacttactctgaagtgaaatctgacttggcacagcagaaagctgaaatggaactctcagatcttatcagaaagggctaccataaagctttggtcaaactaaaactgaaaaaaaataccgtggatgacatttcagagagtctgcggcaaggaggaggcaagttaaactttgacgaacttcgacaagatctcaaagggaagggccatactgatgcagagattgaggcaatattcacaaagtacgaccaagatggagaccaagaactgaccgaacatgaacatcagcagatgagagacgacttggagaaagagagggaggacctggatttggatcacagttctttaccacgtcccatgagcagccgaagtttccctcgaagcctggatgactctgaggaggatgacgatgaagatagcggacatagctccagaaggaggggaagcatttctagtggcgtttcttacgaagagtttcaagtcctggtgagacgagtggaccggatggagcattccatcggcagcatagtgtccaagattgacgccgtgatcgtgaagctagagattatggagcgagccaaactgaagaggagggaggtgctgggaaggctgttggatggggtggccgaggatgaaaggctgggtcgtgacagtgaaatccatagggaacagatggaacggctagtacgtgaagagttggaacgctgggaatccgatgatgcagcttcccagatcagtcatggtttaggcacgccagtgggactaaatggtcaacctcgccccagaagctcccgcccatcttcctcccaatctacagaaggcatggaaggtgcaggtggaaatgggagttctaatgtccacgtatgatatgtgtgtttcagtatgtgtgtttctaataagtgaggaagtggctgtcctgaattgctgtaacaagcacactatttatatgccctgaccaccataggatgctagtctttgtgaccgattgctaatcttctgcactttaatttattttatataaactttacccatggttcaaagatttttttttctttttctcatataagaaatctaggtgtaaatattgagtacagaaaaaaaatcttcatgatgtgtattgagcggtacgcccagttgccaccatgactgagtcttctcagttgacaatgaagtagccttttaaagctagaaaactgtcaaagggcttctgagtttcatttccagtcacaaaaatcagtattgttatttttttccaagagtgtgaaggaaaatggggcattcctttccactctggcatagttcatgagcttaatacatagctttcttttaagaaaggagccttttttttcaactagcttcctggggtaaacttttctaaaagataaaatggaaaggaactccaaactatgatagaatctgtgtgaatggttaagatgaatgttaaatactatgcttttttgtaagttgatcgtatctgatgtctgtgggactaactgtatcacttaatttttaccttattttggctctaatttgaataagctgagtaaaaccaccaaagatcagttataggataaaatggcatctctaaccataacacaggagaattggaaggagccctaagttgtcactcagtttaatttcttttaatggttagtttagcctaaagatttatctgcatattctttttcccatgtggctctactcatttgcaactgaatttaatgttataactcatctagtgagaccaacttactaaatttttagtatgcactgaaagtttttatccaacaattatgttcattttaagcaaaattttaagaaagttttgaaattcataaagcatttggttttaaactattttaagaatatagtactcggtcaggtatgacggctcacgcctgtaatcccagcactttgggaggccgaaacaggcgaatcacttgagcccaggagttcaagaccaacatgggcaatgtggcgaaactccatctctacaaaaaatgcaaaaataaaaaatatagtactcaagtattcttgatcctgtgtttcaaaactagaatttgtaatgcaaatggagctcagtctaataaaaaagaggttttggtattaaaagttcatacattagacagtatcagccaaaatttgagttagcaacactgttttctttacgagagggtctcacccaaatttatggggagaaatctatttctcaaaaaaaaaaatcttcttttacagaaatgttgagtaaggtgacattttgagcgctaataagcaaaagagcatgcagtgctgttgaataaccctcacttggagaaccaagagaatcctgtcgtttaatgctatattttaatttcacaagttgttcatttaactggtagaatgtcagtccaatctccaatgagaacatgagcaaatagacctttccaggttgaaagtgaaacatactgggtttctgtaagtttttcctcatggcttcatctctatctttactttctcttgaatatgctacacaaagttctttattactacatactaaagtttgcattccagggatattgactgtacatatttatgtatatgtaccatgttgttacatgtaaacaaacttcaatttgaagtgcagctattatgtggtatccatgtgtatcgaccatgtgccatatatcaattatggtcactagaaagtctctttatgatactttttattgtactgtttttcatttcacttgcaaaattttgcagaattcctcctttctacccataaattacatatatttttcttctttagtcatggagaactccccccctcatctcttccctattatctttccctgtgtactggtattattaaaaagacattacatacgcaagtctttctcgacaatcaagaatgttattaatgtgtaatactgagcactttacttcttaataaaaacttgatatagtagcaaaaaaaaaaacaaggggggggtcaaatttcctcgggcccactagcctcccgttttgccaggcccaaggagtctttaacaagcgccccttaaggtcgacggaaggcttgtctcggaccctcggctcatggacaccacaataagcggaaaaagtttgacacctggcttggttaaacgaaaacggaagaacaagacaacacaccaataa

SEQ ID NO: 417726 - DNA, 5195 bp, Homo sapiens
ggctcctgaggcgcacagcgccgagcgcggcgccgcgcacccgcgcgccggacgccagtgaccgcgatggtgaactccagtcgcgtgcagcctcagcagcccggggacgccaagcggccgcccgcgccccgcgcgccggacccgggccggctgatggctggctgcgcggccgtgggcgccagcctcgccgccccgggcggcctctgcgagcagcggggcctggagatcgagatgcagcgcatccggcaggcggccgcgcgggaccccccggccggagccgcggcctccccttctcctccgctctcgtcgtgctcccggcaggcgtggagccgcgataaccccggcttcgaggccgaggaggaggaggaggaggtggaaggggaagaaggcggaatggtggtggagatggacgtagagtggcgcccgggcagccggaggtcggccgcctcctcggccgtgagctccgtgggcgcgcggagccgggggcttgggggctaccacggcgcgggccacccgagcgggaggcggcgccggcgagaggaccagggcccgccgtgccccagcccagtcggcggcggggacccgctgcatcgccacctccccctggaagggcagccgccccgagtggcctgggcggagaggctggttcgcgggctgcgaggtctctggggaacaagactcatggaggaaagcagcactaaccgagagaaataccttaaaagtgttttacgggaactggtcacatacctcctttttctcatagtcttgtgcatcttgacctacggcatgatgagctccaatgtgtactactacacccggatgatgtcacagctcttcctagacacccccgtgtccaaaacggagaaaactaactttaaaactctgtcttccatggaagacttctggaagttcacagaaggctccttattggatgggctgtactggaagatgcagcccagcaaccagactgaagctgacaaccgaagtttcatcttctatgagaacctgctgttaggggttccacgaatacggcaactccgagtcagaaatggatcctgctctatcccccaggacttgagagatgaaattaaagagtgctatgatgtctactctgtcagtagtgaagatagggctccctttgggccccgaaatggaaccgcttggatctacacaagtgaaaaagacttgaatggtagtagccactggggaatcattgcaacttatagtggagctggctattatctggatttgtcaagaacaagagaggaaacagctgcacaagttgctagcctcaagaaaaatgtctggctggaccgaggaaccagggcaacttttattgacttctcagtgtacaacgccaacattaacctgttctgtgtggtcaggttattggttgaattcccagcaacaggtggtgtgattccatcttggcaatttcagcctttaaagctgatccgatatgtcacaacttttgatttcttcctggcagcctgtgagattatcttttgtttctttatcttttactatgtggtggaagagatattggaaattcgcattcacaaactacactatttcaggagtttctggaattgtctggatgttgtgatcgttgtgctgtcagtggtagctataggaattaacatatacagaacatcaaatgtggaggtgctactacagtttctggaagatcaaaatactttccccaactttgagcatctggcatattggcagatacagttcaacaatatagctgctgtcacagtattttttgtctggattaagctcttcaaattcatcaattttaacaggaccatgagccagctctcgacaaccatgtctcgatgtgccaaagacctgtttggctttgctattatgttcttcattattttcctagcgtatgctcagttggcataccttgtctttggcactcaggtcgatgacttcagtactttccaagagtgtatcttcactcaattccgtatcattttgggcgatatcaactttgcagagattgaggaagctaatcgagttttgggaccaatttatttcactacatttgtgttctttatgttcttcattcttttgaatatgtttttggctatcatcaatgatacttactctgaagtgaaatctgacttggcacagcagaaagctgaaatggaactctcagatcttatcagaaagggctaccataaagctttggtcaaactaaaactgaaaaaaaataccgtggatgacatttcagagagtctgcggcaaggaggaggcaagttaaactttgacgaacttcgacaagatctcaaagggaagggccatactgatgcagagattgaggcaatattcacaaagtacgaccaagatggagaccaagaactgaccgaacatgaacatcagcagatgagagacgacttggagaaagagagggaggacctggatttggatcacagttctttaccacgtcccatgagcagccgaagtttccctcgaagcctggatgactctgaggaggatgacgatgaagatagcggacatagctccagaaggaggggaagcatttctagtggcgtttcttacgaagagtttcaagtcctggtgagacgagtggaccggatggagcattccatcggcagcatagtgtccaagattgacgccgtgatcgtgaagctagagattatggagcgagccaaactgaagaggagggaggtgctgggaaggctgttggatggggtggccgaggatgaaaggctgggtcgtgacagtgaaatccatagggaacagatggaacggctagtacgtgaagagttggaacgctgggaatccgatgatgcagcttcccagatcagtcatggtttaggcacgccagtgggactaaatggtcaacctcgccccagaagctcccgcccatcttcctcccaatctacagaaggcatggaaggtgcaggtggaaatgggagttctaatgtccacgtatgatatgtgtgtttcagtatgtgtgtttctaataagtgaggaagtggctgtcctgaattgctgtaacaagcacactatttatatgccctgaccaccataggatgctagtctttgtgaccgattgctaatcttctgcactttaatttattttatataaactttacccatggttcaaagatttttttttctttttctcatataagaaatctaggtgtaaatattgagtacagaaaaaaaatcttcatgatgtgtattgagcggtacgcccagttgccaccatgactgagtcttctcagttgacaatgaagtagccttttaaagctagaaaactgtcaaagggcttctgagtttcatttccagtcacaaaaatcagtattgttatttttttccaagagtgtgaaggaaaatggggcattcctttccactctggcatagttcatgagcttaatacatagctttcttttaagaaaggagccttttttttcaactagcttcctggggtaaacttttctaaaagataaaatggaaaggaactccaaactatgatagaatctgtgtgaatggttaagatgaatgttaaatactatgcttttttgtaagttgatcgtatctgatgtctgtgggactaactgtatcacttaatttttaccttattttggctctaatttgaataagctgagtaaaaccaccaaagatcagttataggataaaatggcatctctaaccataacacaggagaattggaaggagccctaagttgtcactcagtttaatttcttttaatggttagtttagcctaaagatttatctgcatattctttttcccatgtggctctactcatttgcaactgaatttaatgttataactcatctagtgagaccaacttactaaatttttagtatgcactgaaagtttttatccaacaattatgttcattttaagcaaaattttaagaaagttttgaaattcataaagcatttggttttaaactattttaagaatatagtactcggtcaggtatgacggctcacgcctgtaatcccagcactttgggaggccgaaacaggcgaatcacttgagcccaggagttcaagaccaacatgggcaatgtggcgaaactccatctctacaaaaaatgcaaaaataaaaaatatagtactcaagtattcttgatcctgtgtttcaaaactagaatttgtaatgcaaatggagctcagtctaataaaaaagaggttttggtattaaaagttcatacattagacagtatcagccaaaatttgagttagcaacactgttttctttacgagagggtctcacccaaatttatggggagaaatctatttctcaaaaaaaaaaatcttcttttacagaaatgttgagtaaggtgacattttgagcgctaataagcaaaagagcatgcagtgctgttgaataaccctcacttggagaaccaagagaatcctgtcgtttaatgctatattttaatttcacaagttgttcatttaactggtagaatgtcagtccaatctccaatgagaacatgagcaaatagacctttccaggttgaaagtgaaacatactgggtttctgtaagtttttcctcatggcttcatctctatctttactttctcttgaatatgctacacaaagttctttattactacatactaaagtttgcattccagggatattgactgtacatatttatgtatatgtaccatgttgttacatgtaaacaaacttcaatttgaagtgcagctattatgtggtatccatgtgtatcgaccatgtgccatatatcaattatggtcactagaaagtctctttatgatactttttattgtactgtttttcatttcacttgcaaaattttgcagaattcctcctttctacccataaattacatatatttttcttctttagtcatggagaactccccccctcatctcttccctattatctttccctgtgtactggtattattaaaaagacattacatacgcaagtctttctcgacaatcaagaatgttattaatgtgtaatactgagcactttacttcttaataacattccctattatctttccctgtgtactggtatttatttaaaaagacattacatacgcaagtctttctcgacaatcaagaatgttattaatgtgtaatactgagcactttacttcttaataaaacttgatatagttaagtgctcagtacacacatta

SEQ ID NO: 417727 - DNA, 3143 bp, Homo sapiens
ggctcctgaggcgcacagcgccgagcgcggcgccgcgcacccgcgcgccggacgccagtgaccgcgatggtgaactccagtcgcgtgcagcctcagcagcccggggacgccaagcggccgcccgcgccccgcgcgccggacccgggccggctgatggctggctgcgcggccgtgggcgccagcctcgccgccccgggcggcctctgcgagcagcggggcctggagatcgagatgcagcgcatccggcaggcggccgcgcgggaccccccggccggagccgcggcctccccttctcctccgctctcgtcgtgctcccggcaggcgtggagccgcgataaccccggcttcgaggccgaggaggaggaggaggaggtggaaggggaagaaggcggaatggtggtggagatggacgtagagtggcgcccgggcagccggaggtcggccgcctcctcggccgtgagctccgtgggcgcgcggagccgggggcttgggggctaccacggcgcgggccacccgagcgggaggcggcgccggcgagaggaccagggcccgccgtgccccagcccagtcggcggcggggacccgctgcatcgccacctccccctggaagggcagccgccccgagtggcctgggcggagaggctggttcgcgggctgcgaggtctctggggaacaagactcatggaggaaagcagcactaaccgagagaaataccttaaaagtgttttacgggaactggtcacatacctcctttttctcatagtcttgtgcatcttgacctacggcatgatgagctccaatgtgtactactacacccggatgatgtcacagctcttcctagacacccccgtgtccaaaacggagaaaactaactttaaaactctgtcttccatggaagacttctggaagttcacagaaggctccttattggatgggctgtactggaagatgcagcccagcaaccagactgaagctgacaaccgaagtttcatcttctatgagaacctgctgttaggggttccacgaatacggcaactccgagtcagaaatggatcctgctctatcccccaggacttgagagatgaaattaaagagtgctatgatgtctactctgtcagtagtgaagatagggctccctttgggccccgaaatggaaccgcttggatctacacaagtgaaaaagacttgaatggtagtagccactggggaatcattgcaacttatagtggagctggctattatctggatttgtcaagaacaagagaggaaacagctgcacaagttgctagcctcaagaaaaatgtctggctggaccgaggaaccagggcaacttttattgacttctcagtgtacaacgccaacattaacctgttctgtgtggtcaggttattggttgaattcccagcaacaggtggtgtgattccatcttggcaatttcagcctttaaagctgatccgatatgtcacaacttttgatttcttcctggcagcctgtgagattatcttttgtttctttatcttttactatgtggtggaagagatattggaaattcgcattcacaaactacactatttcaggagtttctggaattgtctggatgttgtgatcgttgtgctgtcagtggtagctataggaattaacatatacagaacatcaaatgtggaggtgctactacagtttctggaagatcaaaatactttccccaactttgagcatctggcatattggcagatacagttcaacaatatagctgctgtcacagtattttttgtctggattaagctcttcaaattcatcaattttaacaggaccatgagccagctctcgacaaccatgtctcgatgtgccaaagacctgtttggctttgctattatgttcttcattattttcctagcgtatgctcagttggcataccttgtctttggcactcaggtcgatgacttcagtactttccaagagtgtatcttcactcaattccgtatcattttgggcgatatcaactttgcagagattgaggaagctaatcgagttttgggaccaatttatttcactacatttgtgttctttatgttcttcattcttttgaatatgtttttggctatcatcaatgatacttactctgaagtgaaatctgacttggcacagcagaaagctgaaatggaactctcagatcttatcagaaagggctaccataaagctttggtcaaactaaaactgaaaaaaaataccgtggatgacatttcagagagtctgcggcaaggaggaggcaagttaaactttgacgaacttcgacaagatctcaaagggaagggccatactgatgcagagattgaggcaatattcacaaagtacgaccaagatggagaccaagaactgaccgaacatgaacatcagcagatgagagacgacttggagaaagagagggaggacctggatttggatcacagttctttaccacgtcccatgagcagccgaagtttccctcgaagcctggatgactctgaggaggatgacgatgaagatagcggacatagctccagaaggaggggaagcatttctagtggcgtttcttacgaagagtttcaagtcctggtgagacgagtggaccggatggagcattccatcggcagcatagtgtccaagattgacgccgtgatcgtgaagctagagattatggagcgagccaaactgaagaggagggaggtgctgggaaggctgttggatggggtggccgaggatgaaaggctgggtcgtgacagtgaaatccatagggaacagatggaacggctagtacgtgaagagttggaacgctgggaatccgatgatgcagcttcccagatcagtcatggtttaggcacgccagtgggactaaatggtcaacctcgccccagaagctcccgcccatcttcctcccaatctacagaaggcatggaaggtgcaggtggaaatgggagttctaatgtccacgtatgatatgtgtgtttcagtatgtgtgtttctaataagtgaggaagtggctgtcctgaattgctgtaacaagcacactatttatatgccctgaccaccataggatgctagtctttgtgaccgattgctaatcttctgcactttaatttattttatataaactttacccatggttc

SEQ ID NO: 417728 - DNA, 1694 bp, Homo sapiens
ggctcctgaggcgcacagcgccgagcgcggcgccgcgcacccgcgcgccggacgccagtgaccgcgatggtgaactccagtcgcgtgcagcctcagcagcccggggacgccaagcggccgcccgcgccccgcgcgccggacccgggccggctgatggctggctgcgcggccgtgggcgccagcctcgccgccccgggcggcctctgcgagcagcggggcctggagatcgagatgcagcgcatccggcaggcggccgcgcgggaccccccggccggagccgcggcctccccttctcctccgctctcgtcgtgctcccggcaggcgtggagccgcgataaccccggcttcgaggccgaggaggaggaggaggaggtggaaggggaagaaggcggaatggtggtggagatggacgtagagtggcgcccgggcagccggaggtcggccgcctcctcggccgtgagctccgtgggcgcgcggagccgggggcttgggggctaccacggcgcgggccacccgagcgggaggcggcgccggcgagaggaccagggcccgccgtgccccagcccagtcggcggcggggacccgctgcatcgccacctccccctggaagggcagccgccccgagtggcctgggcggagaggctggttcgcgggctgcgaggtctctggggaacaagactcatggaggaaagcagcactaaccgagagaaataccttaaaagtgttttacgggaactggtcacatacctcctttttctcatagtcttgtgcatcttgacctacggcatgatgagctccaatgtgtactactacacccggatgatgtcacagctcttcctagacacccccgtgtccaaaacggagaaaactaactttaaaactctgtcttccatggaagacttctggaagttcacagaaggctccttattggatgggctgtactggaagatgcagcccagcaaccagactgaagctgacaaccgaagtttcatcttctatgagaacctgctgttaggggttccacgaatacggcaactccgagtcagaaatggatcctgctctatcccccaggacttgagagatgaaattaaagagtgctatgatgtctactctgtcagtagtgaagatagggctccctttgggccccgaaatggaaccgcttggatctacacaagtgaaaaagacttgaatggtagtagccactggggaatcattgcaacttatagtggagctggctattatctggatttgtcaagaacaagagaggaaacagctgcacaagttgctagcctcaagaaaaatgtctggctggaccgaggaaccagggcaacttttattgacttctcagtgtacaacgccaacattaacctgttctgtgtggtcagacaaacgtgcagatatctgatagcccttttcgttgcactcaagaggaagcaagatcattagttgaatcggtatcatcttcaccaaataaagaaagtaatgaagaagagcaagtgtggcacttccttggcaagtgattgaaacatctgaaattctgctgtcaagattcccatctctaaggactccaagactctttttccccaagtgctagagacaagggggtctatgagcatttactgacttcctgttaaaacttcattttttcaaactttttgagctatgcaatatataaataaacagtaagaatttta

SEQ ID NO: 417729 - DNA, 459 bp, Homo sapiens
aaatttttttggcccaagcacattctcccttccccttgttccctaaacccgcgattaaaatgtaccaattacatatatttttcttctttagtcatggagaactccccccctcatctcttccctattatctttccctgtgtactggtattattaaaaagacattacatacgcaagtctttctcgacaatcaagaatgttattaatgtgtaatactgagcactttacttcttaataaaaacttgatatagtagcaaaaaaaaaaacaaggggggggtcaaatttcctcgggcccactagcctcccgttttgccaggcccaaggagtctttaacaagcgccccttaaggtcgacggaaggcttgtctcggaccctcggctcatggacaccacaataagcggaaaaagtttgacacctggcttggttaaacgaaaacggaagaacaagacaacacaccaataa

SEQ ID NO: 417730 - DNA, 3910 bp, Homo sapiens
aattgtagatagcataaaacctactgttttaaccatgcttaagtgtacaattcagtggcattaagtacattcacagtgttgtgcagccatcgccattatgctgcattattttcagaactttttcattattctaaactgaaactttgtatccattgaacactaactcccaattcccccagtccctggtaacctccattctactttctgtcactgtgagtttgactattctaagtacctaatttaagtggaatcatacagtatttgtccttttgtgtcaggcttatttcactttgcatgatgttttcaaggttcatccatgttgtaacctgtcagaatttaatttcttttcaggatgaaataatgttttattatatacagtcacaccattttgtttatccattcatctattgatgtcttctctctcttacagctcttcaaattcatcaattttaacaggaccatgagccagctctcgacaaccatgtctcgatgtgccaaagacctgtttggctttgctattatgttcttcattattttcctagcgtatgctcagttggcataccttgtctttggcactcaggtcgatgacttcagtactttccaagagtgtatcttcactcaattccgtatcattttgggcgatatcaactttgcagagattgaggaagctaatcgagttttgggaccaatttatttcactacatttgtgttctttatgttcttcattcttttgaatatgtttttggctatcatcaatgatacttactctgaagtgaaatctgacttggcacagcagaaagctgaaatggaactctcagatcttatcagaaagggctaccataaagctttggtcaaactaaaactgaaaaaaaataccgtggatgacatttcagagagtctgcggcaaggaggaggcaagttaaactttgacgaacttcgacaagatctcaaagggaagggccatactgatgcagagattgaggcaatattcacaaagtacgaccaagatggagaccaagaactgaccgaacatgaacatcagcagatgagagacgacttggagaaagagagggaggacctggatttggatcacagttctttaccacgtcccatgagcagccgaagtttccctcgaagcctggatgactctgaggaggatgacgatgaagatagcggacatagctccagaaggaggggaagcatttctagtggcgtttcttacgaagagtttcaagtcctggtgagacgagtggaccggatggagcattccatcggcagcatagtgtccaagattgacgccgtgatcgtgaagctagagattatggagcgagccaaactgaagaggagggaggtgctgggaaggctgttggatggggtggccgaggatgaaaggctgggtcgtgacagtgaaatccatagggaacagatggaacggctagtacgtgaagagttggaacgctgggaatccgatgatgcagcttcccagatcagtcatggtttaggcacgccagtgggactaaatggtcaacctcgccccagaagctcccgcccatcttcctcccaatctacagaaggcatggaaggtgcaggtggaaatgggagttctaatgtccacgtatgatatgtgtgtttcagtatgtgtgtttctaataagtgaggaagtggctgtcctgaattgctgtaacaagcacactatttatatgccctgaccaccataggatgctagtctttgtgaccgattgctaatcttctgcactttaatttattttatataaactttacccatggttcaaagatttttttttctttttctcatataagaaatctaggtgtaaatattgagtacagaaaaaaaatcttcatgatgtgtattgagcggtacgcccagttgccaccatgactgagtcttctcagttgacaatgaagtagccttttaaagctagaaaactgtcaaagggcttctgagtttcatttccagtcacaaaaatcagtattgttatttttttccaagagtgtgaaggaaaatggggcattcctttccactctggcatagttcatgagcttaatacatagctttcttttaagaaaggagccttttttttcaactagcttcctggggtaaacttttctaaaagataaaatggaaaggaactccaaactatgatagaatctgtgtgaatggttaagatgaatgttaaatactatgcttttttgtaagttgatcgtatctgatgtctgtgggactaactgtatcacttaatttttaccttattttggctctaatttgaataagctgagtaaaaccaccaaagatcagttataggataaaatggcatctctaaccataacacaggagaattggaaggagccctaagttgtcactcagtttaatttcttttaatggttagtttagcctaaagatttatctgcatattctttttcccatgtggctctactcatttgcaactgaatttaatgttataactcatctagtgagaccaacttactaaatttttagtatgcactgaaagtttttatccaacaattatgttcattttaagcaaaattttaagaaagttttgaaattcataaagcatttggttttaaactattttaagaatatagtactcggtcaggtatgacggctcacgcctgtaatcccagcactttgggaggccgaaacaggcgaatcacttgagcccaggagttcaagaccaacatgggcaatgtggcgaaactccatctctacaaaaaatgcaaaaataaaaaatatagtactcaagtattcttgatcctgtgtttcaaaactagaatttgtaatgcaaatggagctcagtctaataaaaaagaggttttggtattaaaagttcatacattagacagtatcagccaaaatttgagttagcaacactgttttctttacgagagggtctcacccaaatttatggggagaaatctatttctcaaaaaaaaaaatcttcttttacagaaatgttgagtaaggtgacattttgagcgctaataagcaaaagagcatgcagtgctgttgaataaccctcacttggagaaccaagagaatcctgtcgtttaatgctatattttaatttcacaagttgttcatttaactggtagaatgtcagtccaatctccaatgagaacatgagcaaatagacctttccaggttgaaagtgaaacatactgggtttctgtaagtttttcctcatggcttcatctctatctttactttctcttgaatatgctacacaaagttctttattactacatactaaagtttgcattccagggatattgactgtacatatttatgtatatgtaccatgttgttacatgtaaacaaacttcaatttgaagtgcagctattatgtggtatccatgtgtatcgaccatgtgccatatatcaattatggtcactagaaagtctctttatgatactttttattgtactgtttttcatttcacttgcaaaattttgcagaattcctcctttctacccataaattacatatatttttcttctttagtcatggagaactccccccctcatctcttccctattatctttccctgtgtactggtattattaaaaagacattacatacgcaagtctttctcgacaatcaagaatgttattaatgtgtaatactgagcactttacttcttaataaaaacttgatatagtagcaaaaaaaaaaacaaggggggggtcaaatttcctcgggcccactagcctcccgttttgccaggcccaaggagtctttaacaagcgccccttaaggtcgacggaaggcttgtctcggaccctcggctcatggacaccacaataagcggaaaaagtttgacacctggcttggttaaacgaaaacggaagaacaagacaacacaccaataa

SEQ ID NO: 417731 - DNA, 2157 bp, Homo sapiens
ggctcctgaggcgcacagcgccgagcgcggcgccgcgcacccgcgcgccggacgccagtgaccgcgatggtgaactccagtcgcgtgcagcctcagcagcccggggacgccaagcggccgcccgcgccccgcgcgccggacccgggccggctgatggctggctgcgcggccgtgggcgccagcctcgccgccccgggcggcctctgcgagcagcggggcctggagatcgagatgcagcgcatccggcaggcggccgcgcgggaccccccggccggagccgcggcctccccttctcctccgctctcgtcgtgctcccggcaggcgtggagccgcgataaccccggcttcgaggccgaggaggaggaggaggaggtggaaggggaagaaggcggaatggtggtggagatggacgtagagtggcgcccgggcagccggaggtcggccgcctcctcggccgtgagctccgtgggcgcgcggagccgggggcttgggggctaccacggcgcgggccacccgagcgggaggcggcgccggcgagaggaccagggcccgccgtgccccagcccagtcggcggcggggacccgctgcatcgccacctccccctggaagggcagccgccccgagtggcctgggcggagaggctggttcgcgggctgcgaggtctctggggaacaagactcatggaggaaagcagcactaaccgagagaaataccttaaaagtgttttacgggaactggtcacatacctcctttttctcatagtcttgtgcatcttgacctacggcatgatgagctccaatgtgtactactacacccggatgatgtcacagctcttcctagacacccccgtgtccaaaacggagaaaactaactttaaaactctgtcttccatggaagacttctggaagttcacagaaggctccttattggatgggctgtactggaagatgcagcccagcaaccagactgaagctgacaaccgaagtttcatcttctatgagaacctgctgttaggggttccacgaatacggcaactccgagtcagaaatggatcctgctctatcccccaggacttgagagatgaaattaaagagtgctatgatgtctactctgtcagtagtgaagatagggctccctttgggccccgaaatggaaccgcttggatctacacaagtgaaaaagacttgaatggtagtagccactggggaatcattgcaacttatagtggagctggctattatctggatttgtcaagaacaagagaggaaacagctgcacaagttgctagcctcaagaaaaatgtctggctggaccgaggaaccagggcaacttttattgacttctcagtgtacaacgccaacattaacctgttctgtgtggtcaggttattggttgaattcccagcaacaggtggtgtgattccatcttggcaatttcagcctttaaagctgatccgatatgtcacaacttttgatttcttcctggcagcctgtgagattatcttttgtttctttatcttttactatgtggtggaagagatattggaaattcgcattcacaaactacactatttcaggagtttctggaattgtctggatgttgtgatcgttgtgctgtcagtggtagctataggaattaacatatacagaacatcaaatgtggaggtgctactacagtttctggaagatcaaaatactttccccaactttgagcatctggcatattggcagatacagttcaacaatatagctgctgtcacagtattttttgtctggattaaggtaatttataaatttcatgttctacattttaaataatattttctttaaaaaaaatgagttccacaaaatcatggaatacttgaatttgaaattcaagtgaccagccaaagctgctcaatatttactttgagacagggtctcactctgtcacccaggctggagtgcagtggtatgattacagctcattgcagcctcgacttcccaggcccaagcgatcctcccaccttatcctccgaagtcactgggagtgcctatgatcccagctacttgggaatctgaggcaggagaattgcttgaacccaggaagcagaggttgcggtgagctgaatcatgccactgcactccagcctgggcaacagagcagcacttcgtctc

SEQ ID NO: 417732 - DNA, 2443 bp, Homo sapiens
agcgggagggccggccggtttggcggcggctgcggagggtatctgaggctcggctgccaagccgaacgggctctggctcctcccagtggccggccggggcggaagcaggaggcgggggcagcgtgcgcgctgctggtcttctctcccgcggcgctggggcccgcgctccgctgctgttgctccattcggcgcttttctggcggctggctcctctccgctgccggctgctcctcgaccaggcctccttctcaacctcagcccgcggcgccgacccttccggcaccctcccgccccgtctcgtactgtcgccgtcaccgccgcggctccggccctggccccgatggctctgtgcaacggagactccaagctggagaatgctggaggagaccttaaggatggccaccaccactatgaaggagctgttgtcattctggatgctggtgctcagtacgggaaagtcatagaccgaagagtgagggaactgttcgtgcagtctgaaattttccccttggaaacaccagcatttgctataaaggaacaaggattccgtgctattatcatctctggaggacctaattctgtgtatgctgaagatgctccctggtttgatccagcaatattcactattggcaagcctgttcttggaatttgctatggtatgcagatgatgaataaggtatttggaggtactgtgcacaaaaaaagtgtcagagaagatggagttttcaacattagtgtggataatacatgttcattattcaggggccttcagaaggaagaagttgttttgcttacacatggagatagtgtagacaaagtagctgatggattcaaggttgtggcacgttctggaaacatagtagcaggcatagcaaatgaatctaaaaagttatatggagcacagttccaccctgaagttggccttacagaaaatggaaaagtaatactgaagaatttcctttatgatatagctggatgcagtggaaccttcaccgtgcagaacagagaacttgagtgtattcgagagatcaaagagagagtaggcacgtcaaaagttttggttttactcagtggtggagtagactcaacagtttgtacagctttgctaaatcgtgctttgaaccaagaacaagtcattgctgtgcacattgataatggctttatgagaaaacgagaaagccagtctgttgaagaggccctcaaaaagcttggaattcaggtcaaagtgataaatgctgctcattctttctacaatggaacaacaaccctaccaatatcagatgaagatagaaccccacggaaaagaattagcaaaacgttaaatatgaccacaagtcctgaagagaaaagaaaaatcattggggatacttttgttaagattgccaatgaagtaattggagaaatgaacttgaaaccagaggaggttttccttgcccaaggtactttacggcctgatctaattgaaagtgcatcccttgttgcaagtggcaaagctgaactcatcaaaacccatcacaatgacacagagctcatcagaaagttgagagaggagggaaaagtaatagaacctctgaaagattttcataaagatgaagtgagaattttgggcagagaacttggacttccagaagagttagtttccaggcatccatttccaggtcctggcctggcaatcagagtaatatgtgctgaagaaccttatatttgtaaggactttcctgaaaccaacaatattttgaaaatagtagctgatttttctgcaagtgttaaaaagccacataccctattacagagagtcaaagcctgcacaacagaagaggatcaggagaagctgatgcaaattaccagtctgcattcactgaatgccttcttgctgccaattaaaactgtaggtgtgcagggtgactgtcgttcctacagttacgtgtgtggaatctccagtaaagatgaacctgactgggaatcacttatttttctggctaggcttatacctcgcatgtgtcacaacgttaacagagttgtttatatatttggcccaccagttaaagaacctcctacagatgttactcccactttcttgacaacaggggtgctcagtactttacgccaagctgattttgaggcccataacattctcagggagtctgggtatgctgggaaaatcagccagatgccggtgattttgacaccattacattttgatcgggacccacttcaaaagcagccttcatgccagagatctgtggttattcgaacctttattactagtgacttcatgactggtatacctgcaacacctggcaatgagatccctgtagaggtggtattaaagatggtcactgagattaagaagattcctggtatttctcgaattatgtatgacttaacatcaaagcccccaggaactactgagtgggagtaataaacttcttgttctattaaa

SEQ ID NO: 417733 - DNA, 3094 bp, Homo sapiens
agcgggagggccggccggtttggcggcggctgcggagggtatctgaggctcggctgccaagccgaacgggctctggctcctcccagtggccggccggggcggaagcaggaggcgggggcagcgtgcgcgctgctggtcttctctcccgcggcgctggggcccgcgctccgctgctgttgctccattcggcgcttttctggcggctggctcctctccgctgccggctgctcctcgaccaggcctccttctcaacctcagcccgcggcgccgacccttccggcaccctcccgccccgtctcgtactgtcgccgtcaccgccgcggctccggccctggccccgatggctctgtgcaacggagactccaagctggagaatgctggaggagaccttaaggatggccaccaccactatgaaggagctgttgtcattctggatgctggtgctcagtacgggaaagtcatagaccgaagagtgagggaactgttcgtgcagtctgaaattttccccttggaaacaccagcatttgctataaaggaacaaggattccgtgctattatcatctctggaggacctaattctgtgtatgctgaagatgctccctggtttgatccagcaatattcactattggcaagcctgttcttggaatttgctatggtatgcagatgatgaataaggtatttggaggtactgtgcacaaaaaaagtgtcagagaagatggagttttcaacattagtgtggataatacatgttcattattcaggggccttcagaaggaagaagttgttttgcttacacatggagatagtgtagacaaagtagctgatggattcaaggttgtggcacgttctggaaacatagtagcaggcatagcaaatgaatctaaaaagttatatggagcacagttccaccctgaagttggccttacagaaaatggaaaagtaatactgaagaatttcctttatgatatagctggatgcagtggaaccttcaccgtgcagaacagagaacttgagtgtattcgagagatcaaagagagagtaggcacgtcaaaagttttggttttactcagtggtggagtagactcaacagtttgtacagctttgctaaatcgtgctttgaaccaagaacaagtcattgctgtgcacattgataatggctttatgagaaaacgagaaagccagtctgttgaagaggccctcaaaaagcttggaattcaggtcaaagtgataaatgctgctcattctttctacaatggaacaacaaccctaccaatatcagatgaagatagaaccccacggaaaagaattagcaaaacgttaaatatgaccacaagtcctgaagagaaaagaaaaatcattggggatacttttgttaagattgccaatgaagtaattggagaaatgaacttgaaaccagaggaggttttccttgcccaaggtactttacggcctgatctaattgaaagtgcatcccttgttgcaagtggcaaagctgaactcatcaaaacccatcacaatgacacagagctcatcagaaagttgagagaggagggaaaagtaatagaacctctgaaagattttcataaagatgaagtgagaattttgggcagagaacttggacttccagaagagttagtttccaggcatccatttccaggtcctggcctggcaatcagagtaatatgtgctgaagaaccttatatttgtaaggactttcctgaaaccaacaatattttgaaaatagtagctgatttttctgcaagtgttaaaaagccacataccctattacagagagtcaaagcctgcacaacagaagaggatcaggagaagctgatgcaaattaccagtctgcattcactgaatgccttcttgctgccaattaaaactgtaggtgtgcagggtgactgtcgttcctacagttacgtgtgtggaatctccagtaaagatgaacctgactgggaatcacttatttttctggctaggcttatacctcgcatgtgtcacaacgttaacagagttgtttatatatttggcccaccagttaaagaacctcctacagatgttactcccactttcttgacaacaggggtgctcagtactttacgccaagctgattttgaggcccataacattctcagggagtctgggtatgctgggaaaatcagccagatgccggtgattttgacaccattacattttgatcgggacccacttcaaaagcagccttcatgccagagatctgtggttattcgaacctttattactagtgacttcatgactggtatacctgcaacacctggcaatgagatccctgtagaggtggtattaaagatggtcactgagattaagaagattcctggtatttctcgaattatgtatgacttaacatcaaagcccccaggaactactgagtgggagtaataaacttcttgttctattaaagtaccgtgtgcagtttaaattgattagaaatcattcccattattgacatgcagtactgtgaaaagagttactggagcagctacatcacatctgagttctccacagcaaaaatctacggcttaagagctgagttggggataaccaaaagggactgaagagtttgtacgggtaaataatcaaagcaccattgcctacactcagacagattgatactgcttttgcctttgcctcacttattctttatgtataaattcactgttgatgtctctgtgaatatgtatgaaggtgggtgaatttgggggtaattatgggcttctgtctccttaccagtttctaagaactgttagaaacgcccattatttaccagtgttacttactacttatatatactttttggagaatcagttttcttataagtaatcttatttctccaaagggtgaaaaagagatgaacatatcagataaaggtataggtgggctattccagccacttttgaaggacactgagggtataaaatgtaagctaccataagatggaaaagcaccaggaatttgttgatgtacttttgaattttatttcacagccttgggaggaagaaactatgagtggtctcagatgtctatgaatggtcttaaaatgttttcaaacca

SEQ ID NO: 417734 - DNA, 2598 bp, Homo sapiens
agcgggagggccggccggtttggcggcggctgcggagggtatctgaggctcggctgccaagccgaacgggctctggctcctcccagtggccggccggggcggaagcaggaggcgggggcagcgtgcgcgctgctggtcttctctcccgcggcgctggggcccgcgctccgctgctgttgctccattcggcgcttttctggcggctggctcctctccgctgccggctgctcctcgaccaggcctccttctcaacctcagcccgcggcgccgacccttccggcaccctcccgccccgtctcgtactgtcgccgtcaccgccgcggctccggccctggccccgatggctctgtgcaacggagactccaagctggagaatgctggaggagaccttaaggatggccaccaccactatgaaggagctgttgtcattctggatgctggtgctcagtacgggaaagtcatagaccgaagagtgagggaactgttcgtgcagtctgaaattttccccttggaaacaccagcatttgctataaaggaacaaggattccgtgctattatcatctctggaggacctaattctgtgtatgctgaagatgctccctggtttgatccagcaatattcactattggcaagcctgttcttggaatttgctatggtatgcagatgatgaataaggtatttggaggtactgtgcacaaaaaaagtgtcagagaagatggagttttcaacattagtgtggataatacatgttcattattcaggggccttcagaaggaagaagttgttttgcttacacatggagatagtgtagacaaagtagctgatggattcaaggttgtggcacgttctggaaacatagtagcaggcatagcaaatgaatctaaaaagttatatggagcacagttccaccctgaagttggccttacagaaaatggaaaagtaatactgaagaatttcctttatgatatagctggatgcagtggaaccttcaccgtgcagaacagagaacttgagtgtattcgagagatcaaagagagagtaggcacgtcaaaagttttggttttactcagtggtggagtagactcaacagtttgtacagctttgctaaatcgtgctttgaaccaagaacaagtcattgctgtgcacattgataatggctttatgagaaaacgagaaagccagtctgttgaagaggccctcaaaaagcttggaattcaggtcaaagtgataaatgctgctcattctttctacaatggaacaacaaccctaccaatatcagatgaagatagaaccccacggaaaagaattagcaaaacgttaaatatgaccacaagtcctgaagagaaaagaaaaatcattggggatacttttgttaagattgccaatgaagtaattggagaaatgaacttgaaaccagaggaggttttccttgcccaaggtactttacggcctgatctaattgaaagtgcatcccttgttgcaagtggcaaagctgaactcatcaaaacccatcacaatgacacagagctcatcagaaagttgagagaggagggaaaagtaatagaacctctgaaagattttcataaagatgaagtgagaattttgggcagagaacttggacttccagaagagttagtttccaggcatccatttccaggtcctggcctggcaatcagagtaatatgtgctgaagaaccttatatttgtaaggactttcctgaaaccaacaatattttgaaaatagtagctgatttttctgcaagtgttaaaaagccacataccctattacagagagtcaaagcctgcacaacagaagaggatcaggagaagctgatgcaaattaccagtctgcattcactgaatgccttcttgctgccaattaaaactgtaggtgtgcagggtgactgtcgttcctacagttacgtgtgtggaatctccagtaaagatgaacctgactgggaatcacttatttttctggctaggcttatacctcgcatgtgtcacaacgttaacagagttgtttatatatttggcccaccagttaaagaacctcctacagatgttactcccactttcttgacaacaggggtgctcagtactttacgccaagctgattttgaggcccataacattctcagggagtctgggtatgctgggaaaatcagccagatgccggtgattttgacaccattacattttgatcgggacccacttcaaaagcagccttcatgccagagatctgtggttattcgaacctttattactagtgacttcatgactggtatacctgcaacacctggcaatgagatccctgtagaggtggtattaaagatggtcactgagattaagaagattcctggtatttctcgaattatgtatgacttaacatcaaagcccccaggaactactgagtgggagtaataaacttcttgttctattaaaaaaaaaataatctttatttttctttctttcactttttttattatctctttaatttcatcttatattgtttgcatattcatctcttcgccttgcttctacctatctcttactttttttcttactgcttctgttctttcccatatttactccttctt

SEQ ID NO: 417735 - DNA, 3144 bp, Homo sapiens
agcgggagggccggccggtttggcggcggctgcggagggtatctgaggctcggctgccaagccgaacgggctctggctcctcccagtggccggccggggcggaagcaggaggcgggggcagcgtgcgcgctgctggtcttctctcccgcggcgctggggcccgcgctccgctgctgttgctccattcggcgcttttctggcggctggctcctctccgctgccggctgctcctcgaccaggcctccttctcaacctcagcccgcggcgccgacccttccggcaccctcccgccccgtctcgtactgtcgccgtcaccgccgcggctccggccctggccccgatggctctgtgcaacggagactccaagctggagaatgctggaggagaccttaaggatggccaccaccactatgaaggagctgttgtcattctggatgctggtgctcagtacgggaaagtcatagaccgaagagtgagggaactgttcgtgcagtctgaaattttccccttggaaacaccagcatttgctataaaggaacaaggattccgtgctattatcatctctggaggacctaattctgtgtatgctgaagatgctccctggtttgatccagcaatattcactattggcaagcctgttcttggaatttgctatggtatgcagatgatgaataaggtatttggaggtactgtgcacaaaaaaagtgtcagagaagatggagttttcaacattagtgtggataatacatgttcattattcaggggccttcagaaggaagaagttgttttgcttacacatggagatagtgtagacaaagtagctgatggattcaaggttgtggcacgttctggaaacatagtagcaggcatagcaaatgaatctaaaaagttatatggagcacagttccaccctgaagttggccttacagaaaatggaaaagtaatactgaagaatttcctttatgatatagctggatgcagtggaaccttcaccgtgcagaacagagaacttgagtgtattcgagagatcaaagagagagtaggcacgtcaaaagttttggttttactcagtggtggagtagactcaacagtttgtacagctttgctaaatcgtgctttgaaccaagaacaagtcattgctgtgcacattgataatggctttatgagaaaacgagaaagccagtctgttgaagaggccctcaaaaagcttggaattcaggtcaaagtgataaatgctgctcattctttctacaatggaacaacaaccctaccaatatcagatgaagatagaaccccacggaaaagaattagcaaaacgttaaatatgaccacaagtcctgaagagaaaagaaaaatcattggggatacttttgttaagattgccaatgaagtaattggagaaatgaacttgaaaccagaggaggttttccttgcccaaggtactttacggcctgatctaattgaaagtgcatcccttgttgcaagtggcaaagctgaactcatcaaaacccatcacaatgacacagagctcatcagaaagttgagagaggagggaaaagtaatagaacctctgaaagattttcataaagatgaagtgagaattttgggcagagaacttggacttccagaagagttagtttccaggcatccatttccaggtcctggcctggcaatcagagtaatatgtgctgaagaaccttatatttgtaaggactttcctgaaaccaacaatattttgaaaatagtagctgatttttctgcaagtgttaaaaagccacataccctattacagagagtcaaagcctgcacaacagaagaggatcaggagaagctgatgcaaattaccagtctgcattcactgaatgccttcttgctgccaattaaaactgtaggtgtgcagggtgactgtcgttcctacagttacgtgtgtggaatctccagtaaagatgaacctgactgggaatcacttatttttctggctaggcttatacctcgcatgtgtcacaacgttaacagagttgtttatatatttggcccaccagttaaagaacctcctacagatgttactcccactttcttgacaacaggggtgctcagtactttacgccaagctgattttgaggcccataacattctcagggagtctgggtatgctgggaaaatcagccagatgccggtgattttgacaccattacattttgatcgggacccacttcaaaagcagccttcatgccagagatctgtggttattcgaacctttattactagtgacttcatgactggtatacctgcaacacctggcaatgagatccctgtagaggtggtattaaagatggtcactgagattaagaagattcctggtatttctcgaattatgtatgacttaacatcaaagcccccaggaactactgagtgggagtaataaacttcttgttctattaaaaaaaaaaaaaaaaaaaaaaaaaaaaaaggggggggcgccgcacaaagaaaatattcccccgggagggggcccaaagtttttacggcgtaacccgacttttctggatacacaagggggcccctaagaggggagccgtattaaataaggccagaagcacacggggccgcgcgtttaaccaaagggtgctggacaggggcggaaacaactgccctagctggggaatcctgggggaagaggaaccctacacttcggggcgggggacccatcagttggggccaacactctccctctaacaggagagatttttaaagaggcctctggagggggaaccttattaaacaccttcttcagcggtggttctttacggggtgtggtaaaacccccacggggggccagtaatgacctgcgtcggcttgagacgcaaactttggggctcacacggaggttagtgcgattgtgcggaacacttttttttcacccggggacgcctgtggtcgaaaaaaaacaggcgaggcactacccagaacctgacacgcactcaacgagccagtcagctgagacggcagacatcgactgacagaatccaaaccgacagcactagactcccaaaatgactgagacaccatacgactgcgactacggcacgtcgacgcaccgacaacacgcagtgcaccatcaccagcgcacaacaacgtgccacc

SEQ ID NO: 417736 - DNA, 2146 bp, Homo sapiens
agcgggagggccggccggtttggcggcggctgcggagggtatctgaggctcggctgccaagccgaacgggctctggctcctcccagtggccggccggggcggaagcaggaggcgggggcagcgtgcgcgctgctggtcttctctcccgcggcgctggggcccgcgctccgctgctgttgctccattcggcgcttttctggcggctggctcctctccgctgccggctgctcctcgaccaggcctccttctcaacctcagcccgcggcgccgacccttccggcaccctcccgccccgtctcgtactgtcgccgtcaccgccgcggctccggccctggccccgatggctctgtgcaacggagactccaagatgatgaataaggtatttggaggtactgtgcacaaaaaaagtgtcagagaagatggagttttcaacattagtgtggataatacatgttcattattcaggggccttcagaaggaagaagttgttttgcttacacatggagatagtgtagacaaagtagctgatggattcaaggttgtggcacgttctggaaacatagtagcaggcatagcaaatgaatctaaaaagttatatggagcacagttccaccctgaagttggccttacagaaaatggaaaagtaatactgaagaatttcctttatgatatagctggatgcagtggaaccttcaccgtgcagaacagagaacttgagtgtattcgagagatcaaagagagagtaggcacgtcaaaagttttggttttactcagtggtggagtagactcaacagtttgtacagctttgctaaatcgtgctttgaaccaagaacaagtcattgctgtgcacattgataatggctttatgagaaaacgagaaagccagtctgttgaagaggccctcaaaaagcttggaattcaggtcaaagtgataaatgctgctcattctttctacaatggaacaacaaccctaccaatatcagatgaagatagaaccccacggaaaagaattagcaaaacgttaaatatgaccacaagtcctgaagagaaaagaaaaatcattggggatacttttgttaagattgccaatgaagtaattggagaaatgaacttgaaaccagaggaggttttccttgcccaaggtactttacggcctgatctaattgaaagtgcatcccttgttgcaagtggcaaagctgaactcatcaaaacccatcacaatgacacagagctcatcagaaagttgagagaggagggaaaagtaatagaacctctgaaagattttcataaagatgaagtgagaattttgggcagagaacttggacttccagaagagttagtttccaggcatccatttccaggtcctggcctggcaatcagagtaatatgtgctgaagaaccttatatttgtaaggactttcctgaaaccaacaatattttgaaaatagtagctgatttttctgcaagtgttaaaaagccacataccctattacagagagtcaaagcctgcacaacagaagaggatcaggagaagctgatgcaaattaccagtctgcattcactgaatgccttcttgctgccaattaaaactgtaggtgtgcagggtgactgtcgttcctacagttacgtgtgtggaatctccagtaaagatgaacctgactgggaatcacttatttttctggctaggcttatacctcgcatgtgtcacaacgttaacagagttgtttatatatttggcccaccagttaaagaacctcctacagatgttactcccactttcttgacaacaggggtgctcagtactttacgccaagctgattttgaggcccataacattctcagggagtctgggtatgctgggaaaatcagccagatgccggtgattttgacaccattacattttgatcgggacccacttcaaaagcagccttcatgccagagatctgtggttattcgaacctttattactagtgacttcatgactggtatacctgcaacacctggcaatgagatccctgtagaggtggtattaaagatggtcactgagattaagaagattcctggtatttctcgaattatgtatgacttaacatcaaagcccccaggaactactgagtgggagtaataaacttcttgttctattaaa

SEQ ID NO: 417737 - DNA, 2543 bp, Homo sapiens
agcgggagggccggccggtttggcggcggctgcggagggtatctgaggctcggctgccaagccgaacgggctctggctcctcccagtggccggccggggcggaagcaggaggcgggggcagcgtgcgcgctgctggtcttctctcccgcggcgctggggcccgcgctccgctgctgttgctccattcggcgcttttctggcggctggctcctctccgctgccggctgctcctcgaccaggcctccttctcaacctcagcccgcggcgccgacccttccggcaccctcccgccccgtctcgtactgtcgccgtcaccgccgcggctccggccctggccccgatggctctgtgcaacggagactccaagaatctgatcatgatacaacaaagagatccagtgtgggacattctacaaaaagctggtctgatctttaaaaaaggtcaatgccataaaagactataaaaagctggagaatgctggaggagaccttaaggatggccaccaccactatgaaggagctgttgtcattctggatgctggtgctcagtacgggaaagtcatagaccgaagagtgagggaactgttcgtgcagtctgaaattttccccttggaaacaccagcatttgctataaaggaacaaggattccgtgctattatcatctctggaggacctaattctgtgtatgctgaagatgctccctggtttgatccagcaatattcactattggcaagcctgttcttggaatttgctatggtatgcagatgatgaataaggtatttggaggtactgtgcacaaaaaaagtgtcagagaagatggagttttcaacattagtgtggataatacatgttcattattcaggggccttcagaaggaagaagttgttttgcttacacatggagatagtgtagacaaagtagctgatggattcaaggttgtggcacgttctggaaacatagtagcaggcatagcaaatgaatctaaaaagttatatggagcacagttccaccctgaagttggccttacagaaaatggaaaagtaatactgaagaatttcctttatgatatagctggatgcagtggaaccttcaccgtgcagaacagagaacttgagtgtattcgagagatcaaagagagagtaggcacgtcaaaagttttggttttactcagtggtggagtagactcaacagtttgtacagctttgctaaatcgtgctttgaaccaagaacaagtcattgctgtgcacattgataatggctttatgagaaaacgagaaagccagtctgttgaagaggccctcaaaaagcttggaattcaggtcaaagtgataaatgctgctcattctttctacaatggaacaacaaccctaccaatatcagatgaagatagaaccccacggaaaagaattagcaaaacgttaaatatgaccacaagtcctgaagagaaaagaaaaatcattggggatacttttgttaagattgccaatgaagtaattggagaaatgaacttgaaaccagaggaggttttccttgcccaaggtactttacggcctgatctaattgaaagtgcatcccttgttgcaagtggcaaagctgaactcatcaaaacccatcacaatgacacagagctcatcagaaagttgagagaggagggaaaagtaatagaacctctgaaagattttcataaagatgaagtgagaattttgggcagagaacttggacttccagaagagttagtttccaggcatccatttccaggtcctggcctggcaatcagagtaatatgtgctgaagaaccttatatttgtaaggactttcctgaaaccaacaatattttgaaaatagtagctgatttttctgcaagtgttaaaaagccacataccctattacagagagtcaaagcctgcacaacagaagaggatcaggagaagctgatgcaaattaccagtctgcattcactgaatgccttcttgctgccaattaaaactgtaggtgtgcagggtgactgtcgttcctacagttacgtgtgtggaatctccagtaaagatgaacctgactgggaatcacttatttttctggctaggcttatacctcgcatgtgtcacaacgttaacagagttgtttatatatttggcccaccagttaaagaacctcctacagatgttactcccactttcttgacaacaggggtgctcagtactttacgccaagctgattttgaggcccataacattctcagggagtctgggtatgctgggaaaatcagccagatgccggtgattttgacaccattacattttgatcgggacccacttcaaaagcagccttcatgccagagatctgtggttattcgaacctttattactagtgacttcatgactggtatacctgcaacacctggcaatgagatccctgtagaggtggtattaaagatggtcactgagattaagaagattcctggtatttctcgaattatgtatgacttaacatcaaagcccccaggaactactgagtgggagtaataaacttcttgttctattaaa

SEQ ID NO: 417738 - DNA, 3029 bp, Homo sapiens
agcgggagggccggccggtttggcggcggctgcggagggtatctgaggctcggctgccaagccgaacgggctctggctcctcccagtggccggccggggcggaagcaggaggcgggggcagcgtgcgcgctgctggtcttctctcccgcggcgctggggcccgcgctccgctgctgttgctccattcggcgcttttctggcggctggctcctctccgctgccggctgctcctcgaccaggcctccttctcaacctcagcccgcggcgccgacccttccggcaccctcccgccccgtctcgtactgtcgccgtcaccgccgcggctccggccctggccccgatggctctgtgcaacggagactccaagctggagaatgctggaggagaccttaaggatggccaccaccactatgaaggagctgttgtcattctggatgctggtgctcagtacgggaaagtcatagaccgaagagtgagggaactgttcgtgcagtctgaaattttccccttggaaacaccagcatttgctataaaggaacaaggattccgtgctattatcatctctggaggacctaattctgtgtatgctgaagatgctccctggtttgatccagcaatattcactattggcaagcctgttcttggaatttgctatggtatgcagatgatgaataaggtatttggaggtactgtgcacaaaaaaagtgtcagagaagatggagttttcaacattagtgtggataatacatgttcattattcaggggccttcagaaggaagaagttgttttgcttacacatggagatagtgtagacaaagtagctgatggattcaaggttgtggcacgttctggaaacatagtagcaggcatagcaaatgaatctaaaaagttatatggagcacagttccaccctgaagttggccttacagaaaatggaaaagtaatactgaagaatttcctttatgatatagctggatgcagtggaaccttcaccgtgcagaacagagaacttgagtgtattcgagagatcaaagagagagtaggcacgtcaaaagttttggttttactcagtggtggagtagactcaacagtttgtacagctttgctaaatcgtgctttgaaccaagaacaagtcattgctgtgcacattgataatggctttatgagaaaacgagaaagccagtctgttgaagaggccctcaaaaagcttggaattcaggtcaaagtgataaatgctgctcattctttctacaatggaacaacaaccctaccaatatcagatgaagatagaaccccacggaaaagaattagcaaaacgttaaatatgaccacaagtcctgaagagaaaagaaaaatcattggggatacttttgttaagattgccaatgaagtaattggagaaatgaacttgaaaccagaggaggttttccttgcccaaggtactttacggcctgatctaattgaaagtgcatcccttgttgcaagtggcaaagctgaactcatcaaaacccatcacaatgacacagagctcatcagaaagttgagagaggagggaaaagtaatagaacctctgaaagattttcataaagatgaagtgagaattttgggcagagaacttggacttccagaagagttagtttccaggcatccatttccaggtcctggcctggcaatcagagtaatatgtgctgaagaaccttatatttgtaaggactttcctgaaaccaacaatattttgaaaatagtagctgatttttctgcaagtgttaaaaagccacataccctattacagagagtcaaagcctgcacaacagaagaggatcaggagaagctgatgcaaattaccagtctgcattcactgaatgccttcttgctgccaattaaaactgtaggtgtgcagggtgactgtcgttcctacagttacgtgtgtggaatctccagtaaagatgaacctgactgggaatcacttatttttctggctaggcttatacctcgcatgtgtcacaacgttaacagagttgtttatatatttggcccaccagttaaagaacctcctacagatgttactcccactttcttgacaacaggggtgctcagtactttacgccaagctgattttgaggcccataacattctcagggagtctgggtatgctgggaaaatcagccagatgccggtgattttgacaccattatattactagtgacttcatgactggtatacctgcaacacctggcaatgagatccctgtagaggtggtattaaagatggtcactgagattaagaagattcctggtatttctcgaattatgtatgacttaacatcaaagcccccaggaactactgagtgggagtaataaacttcttgttctattaaagtaccgtgtgcagtttaaattgattagaaatcattcccattattgacatgcagtactgtgaaaagagttactggagcagctacatcacatctgagttctccacagcaaaaatctacggcttaagagctgagttggggataaccaaaagggactgaagagtttgtacgggtaaataatcaaagcaccattgcctacactcagacagattgatactgcttttgcctttgcctcacttattctttatgtataaattcactgttgatgtctctgtgaatatgtatgaaggtgggtgaatttgggggtaattatgggcttctgtctccttaccagtttctaagaactgttagaaacgcccattatttaccagtgttacttactacttatatatactttttggagaatcagttttcttataagtaatcttatttctccaaagggtgaaaaagagatgaacatatcagataaaggtataggtgggctattccagccacttttgaaggacactgagggtataaaatgtaagctaccataagatggaaaagcaccaggaatttgttgatgtacttttgaattttatttcacagccttgggaggaagaaactatgagtggtctcagatgtctatgaatggtcttaaaatgttttcaaacca

SEQ ID NO: 417739 - DNA, 1401 bp, Homo sapiens
  misc_feature (109)..(109): n is a, c, g, or t
  misc_feature (247)..(247): n is a, c, g, or t
  misc_feature (255)..(255): n is a, c, g, or t
  misc_feature (269)..(269): n is a, c, g, or t
  misc_feature (271)..(271): n is a, c, g, or t
ccccgagcaggtggcctactcagcttttgtggcgcgagtgcgaaccggggcttcgaggtggtatatatgccgagcccattgacgagtactgtgtgcagcagctcacggnctttagatgggagagcctggtctcagttaccaaggagggtctggcgctgcctgaggatgaggaggagaagaagaagatggaagagagcaaggcaaagtttaagaacctctgcaagctcatgaacagacatcttgatangaagattnagaaggtgacaatntncaatagacttatgtctcacaagtcctgaagagaaaagaaaaatcattggggatacttttgttaagattgccaatgaagtaattggagaaatgaacttgaaaccagaggaggttttccttgcccaaggtactttacggcctgatctaattgaaagtgcatcccttgttgcaagtggcaaagctgaactcatcaaaacccatcacaatgacacagagctcatcagaaagttgagagaggagggaaaagtaatagaacctctgaaagattttcataaagatgaagtgagaattttgggcagagaacttggacttccagaagagttagtttccaggcatccatttccaggtcctggcctggcaatcagagtaatatgtgctgaagaaccttatatttgtaaggactttcctgaaaccaacaatattttgaaaatagtagctgatttttctgcaagtgttaaaaagccacataccctattacagagagtcaaagcctgcacaacagaagaggatcaggagaagctgatgcaaattaccagtctgcattcactgaatgccttcttgctgccaattaaaactgtaggtgtgcagggtgactgtcgttcctacagttacgtgtgtggaatctccagtaaagatgaacctgactgggaatcacttatttttctggctaggcttatacctcgcatgtgtcacaacgttaacagagttgtttatatatttggcccaccagttaaagaacctcctacagatgttactcccactttcttgacaacaggggtgctcagtactttacgccaagctgattttgaggcccataacattctcagggagtctgggtatgctgggaaaatcagccagatgccggtgattttgacaccattacattttgatcgggacccacttcaaaagcagccttcatgccagagatctgtggttattcgaacctttattactagtgacttcatgactggtatacctgcaacacctggcaatgagatccctgtagaggtggtattaaagatggtcactgagattaagaagattcctggtatttctcgaattatgtatgacttaacatcaaagcccccaggaactactgagtgggagtaataaacttcttgttctattaaa

SEQ ID NO: 417740 - DNA, 1589 bp, Homo sapiens
agcgggagggccggccggtttggcggcggctgcggagggtatctgaggctcggctgccaagccgaacgggctctggctcctcccagtggccggccggggcggaagcaggaggcgggggcagcgtgcgcgctgctggtcttctctcccgcggcgctggggcccgcgctccgctgctgttgctccattcggcgcttttctggcggctggctcctctccgctgccggctgctcctcgaccaggcctccttctcaacctcagcccgcggcgccgacccttccggcaccctcccgccccgtctcgtactgtcgccgtcaccgccgcggctccggccctggccccgatggctctgtgcaacggagactccaagctggagaatgctggaggagaccttaaggatggccaccaccactatgaaggagctgttgtcattctggatgctggtgctcagtacgggaaagtcatagaccgaagagtgagggaactgttcgtgcagtctgaaattttccccttggaaacaccagcatttgctataaaggaacaaggattccgtgctattatcatctctggaggacctaattctgtgtatgctgaagatgctccctggtttgatccagcaatattcactattggcaagcctgttcttggaatttgctatggtatgcagatgatgaataaggtatttggaggtactgtgcacaaaaaaagtgtcagagaagatggagttttcaacattagtgtggataatacatgttcattattcaggggccttcagaaggaagaagttgttttgcttacacatggagatagtgtagacaaagtagctgatggattcaaggttgtggcacgttctggaaacatagtagcaggcatagcaaatgaatctaaaaagttatatggagcacagttccaccctgaagttggccttacagaaaatggaaaagtaatactgaagaatttcctttatgatatagctggatgcagtggaaccttcaccgtgcagaacagagaacttgagtgtattcgagagatcaaagagagagtaggcacgtcaaaagttttggttttactcagtggtggagtagactcaacagtttgtacagctttgctaaatcgtgctttgaaccaagaacaagtcattgctgtgcacattgataatggctttatgagaaaacgagaaagccagtctgttgaagaggccctcaaaaagcttggaattcaggtcaaagtgataaatgctgctcattctttctacaatggaacaacaaccctaccaatatcagatgaagatagaaccccacggaaaagaattagcaaaacgttaaatatgaccacaagtcctgaagagaaaagaaaaatcattggggatacttttgttaagattgccaatgaagtaattggagaaatgaacttgaaaccagaggaggttttccttgcccaaggtactttacggcctgatctaattgaaagtgcatcccttgttgcaagtggcaaagctgaactcatcaaaacccatcacaatgacacagagctcatcagaaagttgagagaggagggagagacttggacttcagggaggtagtttcaggctc

SEQ ID NO: 417741 - DNA, 711 bp, Homo sapiens
atctagaggatcccgtagaatatataacaactctgttaaaagccacataccctattacagagagtcaaagcctgcacaacagaagaggatcaggagaagctgatgcaaattaccagtctgcattcactgaatgccttcttgctgccaattaaaactgtaggtgtgcagggtgactgtcgttcctacagttacgtgtgtggaatctccagtaaagatgaacctgactgggaatcacttatttttctggctaggcttatacctcgcatgtgtcacaacgttaacagagttgtttatatatttggcccaccagttaaagaacctcctacagatgttactcccactttcttgacaacaggggtgctcagtactttacgccaagctgattttgaggcccataacattctcagggagtctgggtatgctgggaaaatcagccagatgccggtgattttgacaccattacattttgatcgggacccacttcaaaagcagccttcatgccagagatctgtggttattcgaacctttattactagtgacttcatgactggtatacctgcaacacctggcaatgagatccctgtagaggtggtattaaagatggtcactgagattaagaagattcctggtatttctcgaattatgtatgacttaacatcaaagcccccaggaactactgagtgggagtaataaacttcttgttctattaaa

SEQ ID NO: 417742 - DNA, 3894 bp, Homo sapiens
  misc_feature (1057)..(1057): n is a, c, g, or t
ttgtaatctgacgacagtacactgcagttgtctccgaggtgaacctccggagccttggcacagctcgcttctaaagcttggaaatgacccgccacacctgaagcctgcaggtgctgaggccacattcgatcagacccaagctttgggagaccgctggggaaatttcccacttcctctcctgagaccaggaactcagcagagaaactttgtggaaaatgaactgaaggatgccacccagggagagtatctcctgagatcccatcatgcaggccttcccacaagggcccggcagcatgacaaggtgaaggcagagtatgtgcatctcaaccacccgctcaccctcgtgaccagagagcgcgatttggccgtgaaggagaaacaccagctccaagccaagctggagaacctagaacaggtcctgaagcatatgcgagaggcggctgaacggcggcagcagctgcagttggagcatgaccaggccctggctgttctcagtgccaagcagcaggaaattgaccttctgcagaagcctcagaaaaccaacctccagtgtccgcactttaggaagtgtcccatgctttcacagttgacgatgacgttcgttagcactcttggtttcaagcgacagaaaacccaaacaggaaattgtttttgtgcccatcactgaaaatgtggcttcagacatggctagatccagggctcaaatctgctggcctcagacccagtagaatccaaggcctccccgacatcaccaggacttggctgctctctgccctcctctggatcagcttcagccttggtttccctgtggagacccccagccactccagccctgaccctcctggtggcaaagtggctgcagcctcacctcctcccaagccaaagtccaatagaaaggggcttccctctcccgcagcattctcaggcagaggcccattgccctccgtaggccccacaccacccaggtcaccagtcgctgagggttcagactgtgcttggcacaggggaggtccagaccccagccagtccagaggttcttcccaggagaggagctccngacgctggaggaagaggcctgaggaacaggcctgttacccagaggatccgctatccaggaggctcaggttgaggctaagaaggagcatgaaggcgcagtgcggctgctagagtccaaggttcgagagctggaagagaaatgccggactcaaagtgagcagttcaacctgctgtcccgggacctggagaagttccggcagcacgctggcaagattgacctgctgggtggcagcgcggtggcccccctggacatctccacggcccccagcaagcctttcccacagttcatgaatggcctagccacctccctcggcaaaggtcaggagagcgctattggaggcagctctgcgatcggtgaatatatccggccccttccgcagcctggtgacaggccggagcctctgtccgccaagcccaccttcctgtcgagatccggtagcgcaagatgcagatctgagtcagacatggagaatgaacggaattccaatacctccaagcagagatactcggggaaggtccacctctgtgttgcccgctatagttacaaccccttcgatggaccgaacgagaaccccgaagctgagctgcccctcacggcgggaaaatacctctacgtctatggagacatggatgaggatgggttctatgaaggagagctcctcgatggccagaggggtctggtgccctccaacttcgtggactttgtgcaggacaacgagtcgcggttggcaagcacgctggggaacgagcaggatcagaacttcatcaaccattccggcatcggcctggagggagagcacatcctggacctccactccccaacccacatagatgcgggcatcaccgacaacagtgccgggaccctggacgtgaacatcgacgacatcggagaagacatcgtgccttaccctagaaaaatcaccctcatcaaacaactcgccaaaagtgttattgtgggctgggagcccccggcggtgccaccaggatggggaacggtgagcagctacaacgtcctggtggacaaggagacacgcatgaacctcacgctggggagcagaactaaagccctcatcgagaagctcaacatggcagcctgcacctaccgcatctccgtgcagtgcgtcaccagcaggggcagctcggatgagctgcagtgcacgctgctggtgggcaaggacgtggtggtggccccctcccacctgcgggtggacaacatcacgcagatctccgcccagctctcctggctacccaccaacagcaactacagccacgtcatcttcctcaacgaggaggagttcgacatcgtcaaggccgccaggtacaagtaccagttcttcaatctcaggcccaacatggcctataaggtgaaggttctggccaaaccccaccagatgccgtggcagctcccgctggagcaaagggagaagaaggaggcctttgtggagttctccacgttgcctgcaggacccccagcacccccacaagatgttaccgtccaggctggggtgacccccgccaccatccgggtctcctggagaccacctgtgctgacgcccaccgggctgtccaatggcgcaaacgttaccggctacggcgtgtatgccaaagggcagagggtggctgaagtcatcttccccacggcagacagcacggccgtggagcttgtgcggctgcggagcctggaggccaagggcgtgaccgtgcggaccctctccgcccagggcgagtccgtggactctgcagttgctgccgttccccccgagctcctggtgcctcctaccccccacccgagacctgcaccccaatcaaagccattagcaagttctggagtccccgaaaccaaagacgagcacctgggtccccacgccaggatggatgaggcctgggagcagagccgtgcacctggccctgtgcatgggcacatgctggagccgcccgtgggccccggaaggcggtcgccctcacccagccgcatcctgccacagccacagggcaccccggtgtccaccaccgtcgccaaggccatggcccgggaggccgcgcagagggtggccgagagcagcaggttagagaaaaggagcgtcttcctagagagaagcagcgcggggcagtacgccgcctcagacgaggaggacgcctatgactctccagacttcaagaggaggggcgcctcggtggacgacttcctgaaaggctctgaacttggcaagcagatggtctcctaacagagctggaattagattgaaccgaggcctgaagaagacctgtttccacgcctttccccatgtgccacgttctcctcacctatccaggagtgaatcatcaccttccctgcaatctgctcaggttacaaacccggaggaaaggctggagcacttgttctctgggtgaaggacccatacccccactggtttttgagatcggcattcagcgctgtcttatggcagccacagccccaggtggccccagagcccttgacatgtggccacctggggctgagtgtgactgaggccctgaatttttacttctataaaattagttccagattagtttacattctaattagtttacatgtaaacagccacacgtggctggtggccaccagtgctgacgcccagctctggatgaccacacctgctacaagagatgacttttctagagaagagtagaaacacagcggcagaaacacagctctgcacttccgagggcctcccactccttctgatgagactgcagaggaagtctgtttggccaagcatgctattaacacgttttcctgcttgttttgttttttaacagagcaaacaggtctgtttctattaaaatttaaaaagcgtt

SEQ ID NO: 417743 - DNA, 6588 bp, Homo sapiens
  misc_feature (3436)..(3436): n is a, c, g, or t
ttgtaatctgacgacagtacactgcagttgtctccgaggtgaacctccggagccttggcacagctcgcttctaaagcttggaaatgacccgccacacctgaagcctgcaggtgctgaggccacattcgatcagacccaagctttgggagaccgctggggaaatttcccacttcctctcctgagaccaggaactcagcagagaaactttgtggaaaatgaactgaaggatgccacccagggagagtatctcctgagatcccatcatgcaggccttcccacaagggcccggcagcatgacaaggtgaaggcagagtatgtgcatctcaaccacccgctcaccctcgtgaccagagagcgcgatttggccgtgaaggagaaacaccagctccaagccaagctggagaacctagaacaggtcctgaagcatatgcgagaggcggctgaacggcggcagcagctgcagttggagcatgaccaggccctggctgttctcagtgccaagcagcaggaaattgaccttctgcagaagtccaaggttcgagagctggaagagaaatgccggactcaaagtgagcagttcaacctgctgtcccgggacctggagaagttccggcagcacgctggcaagattgacctgctgggtggcagcgcggtggcccccctggacatctccacggcccccagcaagcctttcccacagttcatgaatggcctagccacctccctcggcaaaggtcaggagagcgctattggaggcagctctgcgatcggtgaatatatccggccccttccgcagcctggtgacaggccggagcctctgtccgccaagcccaccttcctgtcgagatccggtagcgcaagatgcagatctgagtcagacatggagaatgaacggaattccaatacctccaagcagagatactcggggaaggtccacctctgtgttgcccgctatagttacaaccccttcgatggaccgaacgagaaccccgaagctgagctgcccctcacggcgggaaaatacctctacgtctatggagacatggatgaggatgggttctatgaaggagagctcctcgatggccagaggggtctggtgccctccaacttcgtggactttgtgcaggacaacgagtcgcggttggcaagcacgctggggaacgagcaggatcagaacttcatcaaccattccggcatcggcctggagggagagcacatcctggacctccactccccaacccacatagatgcgggcatcaccgacaacagtgccgggaccctggacgtgaacatcgacgacatcggagaagacatcgtgccttaccctagaaaaatcaccctcatcaaacaactcgccaaaagtgttattgtgggctgggagcccccggcggtgccaccaggatggggaacggtgagcagctacaacgtcctggtggacaaggagacacgcatgaacctcacgctggggagcagaactaaagccctcatcgagaagctcaacatggcagcctgcacctaccgcatctccgtgcagtgcgtcaccagcaggggcagctcggatgagctgcagtgcacgctgctggtgggcaaggacgtggtggtggccccctcccacctgcgggtggacaacatcacgcagatctccgcccagctctcctggctacccaccaacagcaactacagccacgtcatcttcctcaacgaggaggagttcgacatcgtcaaggccgccaggtacaagtaccagttcttcaatctcaggcccaacatggcctataaggtgaaggttctggccaaaccccaccagatgccgtggcagctcccgctggagcaaagggagaagaaggaggcctttgtggagttctccacgttgcctgcaggacccccagcacccccacaagatgttaccgtccaggctggggtgacccccgccaccatccgggtctcctggagaccacctgtgctgacgcccaccgggctgtccaatggcgcaaacgttaccggctacggcgtgtatgccaaagggcagagggtggctgaagtcatcttccccacggcagacagcacggccgtggagcttgtgcggctgcggagcctggaggccaagggcgtgaccgtgcggaccctctccgcccagggcgagtccgtggactctgcagttgctgccgttccccccgagctcctggtgcctcctaccccccacccgagacctgcaccccaatcaaagccattagcaagttctggagtccccgaaaccaaagacgagcacctgggtccccacgccaggatggatgaggcctgggagcagagccgtgcacctggccctgtgcatgggcacatgctggagccgcccgtgggccccggaaggcggtcgccctcacccagccgcatcctgccacagccacagggcaccccggtgtccaccaccgtcgccaaggccatggcccgggaggccgcgcagagggtggccgagagcagcaggttagagaaaaggagcgtcttcctagagagaagcagcgcggggcagtacgccgcctcagacgaggaggacgcctatgactctccagacttcaagaggaggggcgcctcggtggacgacttcctgaaaggctctgaacttggcaagcagccgcactgttgccatggagacgagtaccacacagagagcagccgggggtctgacctctcagacatcatggaggaggacgaggaggagctgtattctgaaatgcagctggaagatgggggaaggaggcggcccagcggcacgtcccacaatgccctcaagattttagggaacccagcctctgcaggacgggtggatcacatgggccggaggtttccccgtggcagcgctggtcctcagaggtcccggcccgtgacagtcccatccatcgacgattacgggcgagaccgcctttctccagacttctatgaagagtcagaaactgaccctggtgccgaagagctcccggcccggatctttgtggctctctttgactacgacccgctcaccatgtccccaaacccagatgctgcagaggaggagcttccctttaaagaaggccagatcatcaaggtttatggtgataaagacgctgatggattctaccgtggggaaacctgtgcccggcttggccttattccttgtaacatggtctctgagatacaagcagatgatgaggagatgatggatcagcttcttagacagggctttctccctctgaatacacctgtggagaaaatagagagaagcaggagaagtggcaggcgtcattcggtatcgacgcggagaatggtggccctgtatgactacgaccccagagaaagctcgcccaacgtcgatgtcgaggccgaacttacattttgcacaggagatattattacagtttttggtgaaattgatgaagatggattttattatggggagctgaangggcagaaaggccttgtgccctcaaacttcttggaagaagtgcctgatgacgtagaagtctatctttctgatgctccatcccactactctcaagatacgccaatgcgctcaaaggcaaaaaggaagaagagtgttcatttcacaccttaatcaggcaatgtagccttcacgtaagtgagcaactgaagataccgataaagataccaacttaagctaccttaaccgggccagtgtggtagacttaaggcttcattgtggggttaaaaaaaaaaaaagatacaaagaaatatgtctcaaaaaactattggacctaaataattagaatattacttggtctcagttgtaaagcaactgaatttatagtgaagcaaatcatctttaataatcatttcctactatttgcattaagaatatttgaaaggccaacattgggaacatatttcttaacaagctaactgtgtgtttacatagagagagctgcatattgcattgttagccactcttggaaaaagcacaacctaacaaacatgtttactataggaagctttactttagaaacttaacccaaggtcaagcagatgagtagtgaacacaggtgatcgagtgttggctctgaacactccaaacactggctcgagtggccagaacgtgttttccttaagtaaccctgcctctaccttacgagagagctatgctcctcctcaaagcacaatcatcctgtgacagaagttgctgcaacacgcgtttgttgttggtataccaatgcaatactaagttgatgaagcacgcagctcaaatgatcacattagatggaatagatggtatcttcaggtgtactttgggatgctttactaggtgttttccattagaattagaccttgattttaaatccaagcaagcttgaagccccttggcttacagcatttgcctgctgaatactaaacactcacatggcaagagttgctctggagaggtagggccagaggaatgctgctgcactgccaactcaggcacatgcttagctgtaaagggaagcgaggtgaagtcgtcctgcagcgtattagagtaaaagtctacccctctgaagcactattaagcgcttaacgtatatttaaatactaccatgtgctatctactgaggaagattcatgttcaattatttggaaataatgcaagcatccactaagggcctttaagctttctttgattataattaaggttcattttagtttttttttttctttcaaccagtgtgccatctccaatatttctatagtataccaaccaccccaggaatgcactttaacaatatcaggattttatataaccaaatagtttcaaatacaacaaaattccctttatgaactttcgctttttaagactactgatgggtactcggccaactttactatcaacctaatttcagatcatgtctcccctgcccttagtcttcatttatgaagtgaattattacctgccttagctttgccaaagcaacggccaccccgcactccctcgagacagagaaacggaacccacacatttatgtctggggcctctctctggcgtgctgtgggagaggacctttgcttctcatggcatacttcaacaactgaaagaacaaatgaacccccctgacctttcctggtgggaaacggggacagtacgatgttaccaagtgaattctgttgttggcgctcacacactcaataaactgtaacactgtacctactaggttcctcctgagggttcaggtacagcaaggagagctccatcccccacagtccatctccattcggggtcacctacgtcatctatgggttctggtagtcctgggagaggcagggaaatgtcctcgaaaaagaaaaaggggctgctttccaaaggcaagaaactgctgaaaaagctgggtgcagtgaaatgattcatgtgcttccggacaactgccaaatctatgtaattttctttaattccaaactagggctttcatgactcaagtacttcctaaaaaaacccaatcttctcccctgacaccagtagagaaatgcacttttgcactaccaaccactttaaaccaaccacgagaacaaagaggagcggttgctctctgtcaccgctggcagtctgctctcattgtccaagctctgatttgggaggtgggaggggacgtcttattaacaaacgggggcgcatagctatcacctgtagctccctccctacctgtaattccagtctttgtgcatttgtcatctgcccttaaaggaatgattttcaacctttctcccttctcaaaatgcttgcctcataatgcataactttcactttgactctggtcttgaaattcctagtttaattcgccttgatgttctgccttataaatgcacaatgatttgtactgtctaataaaaacagtgtatactttgtatgtgtcgtgcattcagtggtcttcatcctgacacagtggttcgagatcaagttgtacaggctgtgcattttaagatactagtttcagtctttcaaagccagccaggctacacacagaaaatgtttactcaatcattcaaaaaagagaaaaggagagaaagtaactttgtttggtaaagcaccagtactccaaccttccagaaagccgattatcttcattgcttttaatgttctattctgtggcatatggttttctgttactttcgttgtcaaaatgccatacccaaatacacagcaatgaatggcacacaagtaatccacataatgcataagccacaccaaaaccagactcaatttaaatctgctccaaatgagtccatacccatcttcatcattggcatttgaacaaaagacttacttacaaagttgctggcagatgtatttgatggttactcttttgtaattcttgtccacttgtaaattgtttttactctttatacatacttttcagactgcctttcttttgtaatttatggacggtttataaatgaatgacaaagctttccccattgtgtcttcaaaaacgctattataaattgtaatataatagtatgtggtagatttattattaaaggaaatccatgtgtggttaagctctgtgtgggtgtgtgcatgtgcacagttagtgtaaaatattttctagaaataaaatttgttattttatacaa

SEQ ID NO: 417744 - DNA, 7156 bp, Homo sapiens
  misc_feature (3487)..(3487): n is a, c, g, or t
ttgtaatctgacgacagtacactgcagttgtctccgaggtgaacctccggagccttggcacagctcgcttctaaagcttggaaatgacccgccacacctgaagcctgcaggtgctgaggccacattcgatcagacccaagctttgggagaccgctggggaaatttcccacttcctctcctgagaccaggaactcagcagagaaactttgtggaaaatgaactgaaggatgccacccagggagagtatctcctgagatcccatcatgcaggccttcccacaagggcccggcagcatgacaaggtgaaggcagagtatgtgcatctcaaccacccgctcaccctcgtgaccagagagcgcgatttggccgtgaaggagaaacaccagctccaagccaagctggagaacctagaacaggtcctgaagcatatgcgagaggcggctgaacggcggcagcagctgcagttggagcatgaccaggccctggctgttctcagtgccaagcagcaggaaattgaccttctgcagaaggctcaggttgaggctaagaaggagcatgaaggcgcagtgcggctgctagagtccaaggttcgagagctggaagagaaatgccggactcaaagtgagcagttcaacctgctgtcccgggacctggagaagttccggcagcacgctggcaagattgacctgctgggtggcagcgcggtggcccccctggacatctccacggcccccagcaagcctttcccacagttcatgaatggcctagccacctccctcggcaaaggtcaggagagcgctattggaggcagctctgcgatcggtgaatatatccggccccttccgcagcctggtgacaggccggagcctctgtccgccaagcccaccttcctgtcgagatccggtagcgcaagatgcagatctgagtcagacatggagaatgaacggaattccaatacctccaagcagagatactcggggaaggtccacctctgtgttgcccgctatagttacaaccccttcgatggaccgaacgagaaccccgaagctgagctgcccctcacggcgggaaaatacctctacgtctatggagacatggatgaggatgggttctatgaaggagagctcctcgatggccagaggggtctggtgccctccaacttcgtggactttgtgcaggacaacgagtcgcggttggcaagcacgctggggaacgagcaggatcagaacttcatcaaccattccggcatcggcctggagggagagcacatcctggacctccactccccaacccacatagatgcgggcatcaccgacaacagtgccgggaccctggacgtgaacatcgacgacatcggagaagacatcgtgccttaccctagaaaaatcaccctcatcaaacaactcgccaaaagtgttattgtgggctgggagcccccggcggtgccaccaggatggggaacggtgagcagctacaacgtcctggtggacaaggagacacgcatgaacctcacgctggggagcagaactaaagccctcatcgagaagctcaacatggcagcctgcacctaccgcatctccgtgcagtgcgtcaccagcaggggcagctcggatgagctgcagtgcacgctgctggtgggcaaggacgtggtggtggccccctcccacctgcgggtggacaacatcacgcagatctccgcccagctctcctggctacccaccaacagcaactacagccacgtcatcttcctcaacgaggaggagttcgacatcgtcaaggccgccaggtacaagtaccagttcttcaatctcaggcccaacatggcctataaggtgaaggttctggccaaaccccaccagatgccgtggcagctcccgctggagcaaagggagaagaaggaggcctttgtggagttctccacgttgcctgcaggacccccagcacccccacaagatgttaccgtccaggctggggtgacccccgccaccatccgggtctcctggagaccacctgtgctgacgcccaccgggctgtccaatggcgcaaacgttaccggctacggcgtgtatgccaaagggcagagggtggctgaagtcatcttccccacggcagacagcacggccgtggagcttgtgcggctgcggagcctggaggccaagggcgtgaccgtgcggaccctctccgcccagggcgagtccgtggactctgcagttgctgccgttccccccgagctcctggtgcctcctaccccccacccgagacctgcaccccaatcaaagccattagcaagttctggagtccccgaaaccaaagacgagcacctgggtccccacgccaggatggatgaggcctgggagcagagccgtgcacctggccctgtgcatgggcacatgctggagccgcccgtgggccccggaaggcggtcgccctcacccagccgcatcctgccacagccacagggcaccccggtgtccaccaccgtcgccaaggccatggcccgggaggccgcgcagagggtggccgagagcagcaggttagagaaaaggagcgtcttcctagagagaagcagcgcggggcagtacgccgcctcagacgaggaggacgcctatgactctccagacttcaagaggaggggcgcctcggtggacgacttcctgaaaggctctgaacttggcaagcagccgcactgttgccatggagacgagtaccacacagagagcagccgggggtctgacctctcagacatcatggaggaggacgaggaggagctgtattctgaaatgcagctggaagatgggggaaggaggcggcccagcggcacgtcccacaatgccctcaagattttagggaacccagcctctgcaggacgggtggatcacatgggccggaggtttccccgtggcagcgctggtcctcagaggtcccggcccgtgacagtcccatccatcgacgattacgggcgagaccgcctttctccagacttctatgaagagtcagaaactgaccctggtgccgaagagctcccggcccggatctttgtggctctctttgactacgacccgctcaccatgtccccaaacccagatgctgcagaggaggagcttccctttaaagaaggccagatcatcaaggtttatggtgataaagacgctgatggattctaccgtggggaaacctgtgcccggcttggccttattccttgtaacatggtctctgagatacaagcagatgatgaggagatgatggatcagcttcttagacagggctttctccctctgaatacacctgtggagaaaatagagagaagcaggagaagtggcaggcgtcattcggtatcgacgcggagaatggtggccctgtatgactacgaccccagagaaagctcgcccaacgtcgatgtcgaggccgaacttacattttgcacaggagatattattacagtttttggtgaaattgatgaagatggattttattatggggagctgaangggcagaaaggccttgtgccctcaaacttcttggaagaagtgcctgatgacgtagaagtctatctttctgatgctccatcccactactctcaagatacgccaatgcgctcaaaggcaaaaagggtaagcaaacctatttagcctttttaatctctgtcccgttctgccatatgtggtctaatacaatctttgcactgatatttttatatcttgggccgaaaagcgtaaatacaccctgaattttttttctctgccctgaagccatgggagttgtacctaaaaattcttaattctaaatcttactcattttacaaaaaaagaccctttcaattctaatcaatcaatctgcctttactcacaaagaaatgtcccatcctacattatagaagcacatttcagtttgatcaagagtgaaaaggggatggctcctcttcagatttggtgggcaatggaggttatttgccctctgttaggactttagtctcttcacaaggatccaagggcttctcaagcatattgaactattagactacattcatgtttagtatctcatttttattttatttcatcactgcaagtttttctatattatatttttatatatatatttttatttctttgctcatctgcttggaaacagaagaagagtgttcatttcacaccttaatcaggcaatgtagccttcacgtaagtgagcaactgaagataccgataaagataccaacttaagctaccttaaccgggccagtgtggtagacttaaggcttcattgtggggttaaaaaaaaaaaaagatacaaagaaatatgtctcaaaaaactattggacctaaataattagaatattacttggtctcagttgtaaagcaactgaatttatagtgaagcaaatcatctttaataatcatttcctactatttgcattaagaatatttgaaaggccaacattgggaacatatttcttaacaagctaactgtgtgtttacatagagagagctgcatattgcattgttagccactcttggaaaaagcacaacctaacaaacatgtttactataggaagctttactttagaaacttaacccaaggtcaagcagatgagtagtgaacacaggtgatcgagtgttggctctgaacactccaaacactggctcgagtggccagaacgtgttttccttaagtaaccctgcctctaccttacgagagagctatgctcctcctcaaagcacaatcatcctgtgacagaagttgctgcaacacgcgtttgttgttggtataccaatgcaatactaagttgatgaagcacgcagctcaaatgatcacattagatggaatagatggtatcttcaggtgtactttgggatgctttactaggtgttttccattagaattagaccttgattttaaatccaagcaagcttgaagccccttggcttacagcatttgcctgctgaatactaaacactcacatggcaagagttgctctggagaggtagggccagaggaatgctgctgcactgccaactcaggcacatgcttagctgtaaagggaagcgaggtgaagtcgtcctgcagcgtattagagtaaaagtctacccctctgaagcactattaagcgcttaacgtatatttaaatactaccatgtgctatctactgaggaagattcatgttcaattatttggaaataatgcaagcatccactaagggcctttaagctttctttgattataattaaggttcattttagtttttttttttctttcaaccagtgtgccatctccaatatttctatagtataccaaccaccccaggaatgcactttaacaatatcaggattttatataaccaaatagtttcaaatacaacaaaattccctttatgaactttcgctttttaagactactgatgggtactcggccaactttactatcaacctaatttcagatcatgtctcccctgcccttagtcttcatttatgaagtgaattattacctgccttagctttgccaaagcaacggccaccccgcactccctcgagacagagaaacggaacccacacatttatgtctggggcctctctctggcgtgctgtgggagaggacctttgcttctcatggcatacttcaacaactgaaagaacaaatgaacccccctgacctttcctggtgggaaacggggacagtacgatgttaccaagtgaattctgttgttggcgctcacacactcaataaactgtaacactgtacctactaggttcctcctgagggttcaggtacagcaaggagagctccatcccccacagtccatctccattcggggtcacctacgtcatctatgggttctggtagtcctgggagaggcagggaaatgtcctcgaaaaagaaaaaggggctgctttccaaaggcaagaaactgctgaaaaagctgggtgcagtgaaatgattcatgtgcttccggacaactgccaaatctatgtaattttctttaattccaaactagggctttcatgactcaagtacttcctaaaaaaacccaatcttctcccctgacaccagtagagaaatgcacttttgcactaccaaccactttaaaccaaccacgagaacaaagaggagcggttgctctctgtcaccgctggcagtctgctctcattgtccaagctctgatttgggaggtgggaggggacgtcttattaacaaacgggggcgcatagctatcacctgtagctccctccctacctgtaattccagtctttgtgcatttgtcatctgcccttaaaggaatgattttcaacctttctcccttctcaaaatgcttgcctcataatgcataactttcactttgactctggtcttgaaattcctagtttaattcgccttgatgttctgccttataaatgcacaatgatttgtactgtctaataaaaacagtgtatactttgtatgtgtcgtgcattcagtggtcttcatcctgacacagtggttcgagatcaagttgtacaggctgtgcattttaagatactagtttcagtctttcaaagccagccaggctacacacagaaaatgtttactcaatcattcaaaaaagagaaaaggagagaaagtaactttgtttggtaaagcaccagtactccaaccttccagaaagccgattatcttcattgcttttaatgttctattctgtggcatatggttttctgttactttcgttgtcaaaatgccatacccaaatacacagcaatgaatggcacacaagtaatccacataatgcataagccacaccaaaaccagactcaatttaaatctgctccaaatgagtccatacccatcttcatcattggcatttgaacaaaagacttacttacaaagttgctggcagatgtatttgatggttactcttttgtaattcttgtccacttgtaaattgtttttactctttatacatacttttcagactgcctttcttttgtaatttatggacggtttataaatgaatgacaaagctttccccattgtgtcttcaaaaacgctattataaattgtaatataatagtatgtggtagatttattattaaaggaaatccatgtgtggttaagctctgtgtgggtgtgtgcatgtgcacagttagtgtaaaatattttctagaaataaaatttgttattttatacaa

SEQ ID NO: 417745 - DNA, 7252 bp, Homo sapiens
  misc_feature (3583)..(3583): n is a, c, g, or t
ttgtgtctacttcttcccgcagcttggaaatgacccgccacacctgaagcctgcaggtgctgaggccacattcgatcagacccaagctttgggagaccgctggggaaatttcccacttcctctcctgagaccaggaactcagcagagaaactttgtggaaaatgaactgaaggatgccacccagggagagtatctcctgagatcccatcatgcaggccttcccacaagggcccggcagcatgacaaggtgaaggcagagtatgtgcatctcaaccacccgctcaccctcgtgaccagagagcgcgatttggccgtgaaggagaaacaccagctccaagccaagctggagaacctagaacaggtcctgaagcatatgcgagaggcggctgaacggcggcagcagctgcagttggagcatgaccaggccctggctgttctcagtgccaagcagcaggaaattgaccttctgcagaaggctcaggttgaggctaagaaggagcatgaaggcgcagtgcggctgctagagaacaccttggacagcatgcaggtattctagagaatagcatcttccctgcccggcgtgcttggcgatgcttttcccgtgagtggacgcggccatgagtcctgggcctgctctgacctgcctctgcttcctgaactgcagcttctgacgcagtccaaggttcgagagctggaagagaaatgccggactcaaagtgagcagttcaacctgctgtcccgggacctggagaagttccggcagcacgctggcaagattgacctgctgggtggcagcgcggtggcccccctggacatctccacggcccccagcaagcctttcccacagttcatgaatggcctagccacctccctcggcaaaggtcaggagagcgctattggaggcagctctgcgatcggtgaatatatccggccccttccgcagcctggtgacaggccggagcctctgtccgccaagcccaccttcctgtcgagatccggtagcgcaagatgcagatctgagtcagacatggagaatgaacggaattccaatacctccaagcagagatactcggggaaggtccacctctgtgttgcccgctatagttacaaccccttcgatggaccgaacgagaaccccgaagctgagctgcccctcacggcgggaaaatacctctacgtctatggagacatggatgaggatgggttctatgaaggagagctcctcgatggccagaggggtctggtgccctccaacttcgtggactttgtgcaggacaacgagtcgcggttggcaagcacgctggggaacgagcaggatcagaacttcatcaaccattccggcatcggcctggagggagagcacatcctggacctccactccccaacccacatagatgcgggcatcaccgacaacagtgccgggaccctggacgtgaacatcgacgacatcggagaagacatcgtgccttaccctagaaaaatcaccctcatcaaacaactcgccaaaagtgttattgtgggctgggagcccccggcggtgccaccaggatggggaacggtgagcagctacaacgtcctggtggacaaggagacacgcatgaacctcacgctggggagcagaactaaagccctcatcgagaagctcaacatggcagcctgcacctaccgcatctccgtgcagtgcgtcaccagcaggggcagctcggatgagctgcagtgcacgctgctggtgggcaaggacgtggtggtggccccctcccacctgcgggtggacaacatcacgcagatctccgcccagctctcctggctacccaccaacagcaactacagccacgtcatcttcctcaacgaggaggagttcgacatcgtcaaggccgccaggtacaagtaccagttcttcaatctcaggcccaacatggcctataaggtgaaggttctggccaaaccccaccagatgccgtggcagctcccgctggagcaaagggagaagaaggaggcctttgtggagttctccacgttgcctgcaggacccccagcacccccacaagatgttaccgtccaggctggggtgacccccgccaccatccgggtctcctggagaccacctgtgctgacgcccaccgggctgtccaatggcgcaaacgttaccggctacggcgtgtatgccaaagggcagagggtggctgaagtcatcttccccacggcagacagcacggccgtggagcttgtgcggctgcggagcctggaggccaagggcgtgaccgtgcggaccctctccgcccagggcgagtccgtggactctgcagttgctgccgttccccccgagctcctggtgcctcctaccccccacccgagacctgcaccccaatcaaagccattagcaagttctggagtccccgaaaccaaagacgagcacctgggtccccacgccaggatggatgaggcctgggagcagagccgtgcacctggccctgtgcatgggcacatgctggagccgcccgtgggccccggaaggcggtcgccctcacccagccgcatcctgccacagccacagggcaccccggtgtccaccaccgtcgccaaggccatggcccgggaggccgcgcagagggtggccgagagcagcaggttagagaaaaggagcgtcttcctagagagaagcagcgcggggcagtacgccgcctcagacgaggaggacgcctatgactctccagacttcaagaggaggggcgcctcggtggacgacttcctgaaaggctctgaacttggcaagcagccgcactgttgccatggagacgagtaccacacagagagcagccgggggtctgacctctcagacatcatggaggaggacgaggaggagctgtattctgaaatgcagctggaagatgggggaaggaggcggcccagcggcacgtcccacaatgccctcaagattttagggaacccagcctctgcaggacgggtggatcacatgggccggaggtttccccgtggcagcgctggtcctcagaggtcccggcccgtgacagtcccatccatcgacgattacgggcgagaccgcctttctccagacttctatgaagagtcagaaactgaccctggtgccgaagagctcccggcccggatctttgtggctctctttgactacgacccgctcaccatgtccccaaacccagatgctgcagaggaggagcttccctttaaagaaggccagatcatcaaggtttatggtgataaagacgctgatggattctaccgtggggaaacctgtgcccggcttggccttattccttgtaacatggtctctgagatacaagcagatgatgaggagatgatggatcagcttcttagacagggctttctccctctgaatacacctgtggagaaaatagagagaagcaggagaagtggcaggcgtcattcggtatcgacgcggagaatggtggccctgtatgactacgaccccagagaaagctcgcccaacgtcgatgtcgaggccgaacttacattttgcacaggagatattattacagtttttggtgaaattgatgaagatggattttattatggggagctgaangggcagaaaggccttgtgccctcaaacttcttggaagaagtgcctgatgacgtagaagtctatctttctgatgctccatcccactactctcaagatacgccaatgcgctcaaaggcaaaaagggtaagcaaacctatttagcctttttaatctctgtcccgttctgccatatgtggtctaatacaatctttgcactgatatttttatatcttgggccgaaaagcgtaaatacaccctgaattttttttctctgccctgaagccatgggagttgtacctaaaaattcttaattctaaatcttactcattttacaaaaaaagaccctttcaattctaatcaatcaatctgcctttactcacaaagaaatgtcccatcctacattatagaagcacatttcagtttgatcaagagtgaaaaggggatggctcctcttcagatttggtgggcaatggaggttatttgccctctgttaggactttagtctcttcacaaggatccaagggcttctcaagcatattgaactattagactacattcatgtttagtatctcatttttattttatttcatcactgcaagtttttctatattatatttttatatatatatttttatttctttgctcatctgcttggaaacagaagaagagtgttcatttcacaccttaatcaggcaatgtagccttcacgtaagtgagcaactgaagataccgataaagataccaacttaagctaccttaaccgggccagtgtggtagacttaaggcttcattgtggggttaaaaaaaaaaaaagatacaaagaaatatgtctcaaaaaactattggacctaaataattagaatattacttggtctcagttgtaaagcaactgaatttatagtgaagcaaatcatctttaataatcatttcctactatttgcattaagaatatttgaaaggccaacattgggaacatatttcttaacaagctaactgtgtgtttacatagagagagctgcatattgcattgttagccactcttggaaaaagcacaacctaacaaacatgtttactataggaagctttactttagaaacttaacccaaggtcaagcagatgagtagtgaacacaggtgatcgagtgttggctctgaacactccaaacactggctcgagtggccagaacgtgttttccttaagtaaccctgcctctaccttacgagagagctatgctcctcctcaaagcacaatcatcctgtgacagaagttgctgcaacacgcgtttgttgttggtataccaatgcaatactaagttgatgaagcacgcagctcaaatgatcacattagatggaatagatggtatcttcaggtgtactttgggatgctttactaggtgttttccattagaattagaccttgattttaaatccaagcaagcttgaagccccttggcttacagcatttgcctgctgaatactaaacactcacatggcaagagttgctctggagaggtagggccagaggaatgctgctgcactgccaactcaggcacatgcttagctgtaaagggaagcgaggtgaagtcgtcctgcagcgtattagagtaaaagtctacccctctgaagcactattaagcgcttaacgtatatttaaatactaccatgtgctatctactgaggaagattcatgttcaattatttggaaataatgcaagcatccactaagggcctttaagctttctttgattataattaaggttcattttagtttttttttttctttcaaccagtgtgccatctccaatatttctatagtataccaaccaccccaggaatgcactttaacaatatcaggattttatataaccaaatagtttcaaatacaacaaaattccctttatgaactttcgctttttaagactactgatgggtactcggccaactttactatcaacctaatttcagatcatgtctcccctgcccttagtcttcatttatgaagtgaattattacctgccttagctttgccaaagcaacggccaccccgcactccctcgagacagagaaacggaacccacacatttatgtctggggcctctctctggcgtgctgtgggagaggacctttgcttctcatggcatacttcaacaactgaaagaacaaatgaacccccctgacctttcctggtgggaaacggggacagtacgatgttaccaagtgaattctgttgttggcgctcacacactcaataaactgtaacactgtacctactaggttcctcctgagggttcaggtacagcaaggagagctccatcccccacagtccatctccattcggggtcacctacgtcatctatgggttctggtagtcctgggagaggcagggaaatgtcctcgaaaaagaaaaaggggctgctttccaaaggcaagaaactgctgaaaaagctgggtgcagtgaaatgattcatgtgcttccggacaactgccaaatctatgtaattttctttaattccaaactagggctttcatgactcaagtacttcctaaaaaaacccaatcttctcccctgacaccagtagagaaatgcacttttgcactaccaaccactttaaaccaaccacgagaacaaagaggagcggttgctctctgtcaccgctggcagtctgctctcattgtccaagctctgatttgggaggtgggaggggacgtcttattaacaaacgggggcgcatagctatcacctgtagctccctccctacctgtaattccagtctttgtgcatttgtcatctgcccttaaaggaatgattttcaacctttctcccttctcaaaatgcttgcctcataatgcataactttcactttgactctggtcttgaaattcctagtttaattcgccttgatgttctgccttataaatgcacaatgatttgtactgtctaataaaaacagtgtatactttgtatgtgtcgtgcattcagtggtcttcatcctgacacagtggttcgagatcaagttgtacaggctgtgcattttaagatactagtttcagtctttcaaagccagccaggctacacacagaaaatgtttactcaatcattcaaaaaagagaaaaggagagaaagtaactttgtttggtaaagcaccagtactccaaccttccagaaagccgattatcttcattgcttttaatgttctattctgtggcatatggttttctgttactttcgttgtcaaaatgccatacccaaatacacagcaatgaatggcacacaagtaatccacataatgcataagccacaccaaaaccagactcaatttaaatctgctccaaatgagtccatacccatcttcatcattggcatttgaacaaaagacttacttacaaagttgctggcagatgtatttgatggttactcttttgtaattcttgtccacttgtaaattgtttttactctttatacatacttttcagactgcctttcttttgtaatttatggacggtttataaatgaatgacaaagctttccccattgtgtcttcaaaaacgctattataaattgtaatataatagtatgtggtagatttattattaaaggaaatccatgtgtggttaagctctgtgtgggtgtgtgcatgtgcacagttagtgtaaaatattttctagaaataaaatttgttattttatacaa

SEQ ID NO: 417746 - DNA, 3475 bp, Homo sapiens
ttgtaatctgacgacagtacactgcagttgtctccgaggtgaacctccggagccttggcacagctcgcttctaaagcttggaaatgacccgccacacctgaagcctgcaggtgctgaggccacattcgatcagacccaagctttgggagaccgctggggaaatttcccacttcctctcctgagaccaggaactcagcagagaaactttgtggaaaatgaactgaaggatgccacccagggagagtatctcctgagatcccatcatgcaggccttcccacaagggcccggcagcatgacaaggtgaaggcagagtatgtgcatctcaaccacccgctcaccctcgtgaccagagagcgcgatttggccgtgaaggagaaacaccagctccaagccaagctggagaacctagaacaggtcctgaagcatatgcgagaggcggctgaacggcggcagcagctgcagttggagcatgaccaggccctggctgttctcagtgccaagcagcaggaaattgaccttctgcagaaggctcaggttgaggctaagaaggagcatgaaggcgcagtgcggctgctagagtccaaggttcgagagctggaagagaaatgccggactcaaagtgagcagttcaacctgctgtcccgggacctggagaagttccggcagcacgctggcaagattgacctgctgggtggcagcgcggtggcccccctggacatctccacggcccccagcaagcctttcccacagttcatgaatggcctagccacctccctcggcaaaggtcaggagagcgctattggaggcagctctgcgatcggtgaatatatccggccccttccgcagcctggtgacaggccggagcctctgtccgccaagcccaccttcctgtcgagatccggtagcgcaagatgcagatctgagtcagacatggagaatgaacggaattccaatacctccaagcagagatactcggggaaggtccacctctgtgttgcccgctatagttacaaccccttcgatggaccgaacgagaaccccgaagctgagctgcccctcacggcgggaaaatacctctacgtctatggagacatggatgaggatgggttctatgaaggagagctcctcgatggccagaggggtctggtgccctccaacttcgtggactttgtgcaggacaacgagtcgcggttggcaagcacgctggggaacgagcaggatcagaacttcatcaaccattccggcatcggcctggagggagagcacatcctggacctccactccccaacccacatagatgcgggcatcaccgacaacagtgccgggaccctggacgtgaacatcgacgacatcggagaagacatcgtgccttaccctagaaaaatcaccctcatcaaacaactcgccaaaagtgttattgtgggctgggagcccccggcggtgccaccaggatggggaacggtgagcagctacaacgtcctggtggacaaggagacacgcatgaacctcacgctggggagcagaactaaagccctcatcgagaagctcaacatggcagcctgcacctaccgcatctccgtgcagtgcgtcaccagcaggggcagctcggatgagctgcagtgcacgctgctggtgggcaaggacgtggtggtggccccctcccacctgcgggtggacaacatcacgcagatctccgcccagctctcctggctacccaccaacagcaactacagccacgtcatcttcctcaacgaggaggagttcgacatcgtcaaggccgccaggtacaagtaccagttcttcaatctcaggcccaacatggcctataaggtgaaggttctggccaaaccccaccagatgccgtggcagctcccgctggagcaaagggagaagaaggaggcctttgtggagttctccacgttgcctgcaggacccccagcacccccacaagatgttaccgtccaggctggggtgacccccgccaccatccgggtctcctggagaccacctgtgctgacgcccaccgggctgtccaatggcgcaaacgttaccggctacggcgtgtatgccaaagggcagagggtggctgaagtcatcttccccacggcagacagcacggccgtggagcttgtgcggctgcggagcctggaggccaagggcgtgaccgtgcggaccctctccgcccagggcgagtccgtggactctgcagttgctgccgttccccccgagctcctggtgcctcctaccccccacccgagacctgcaccccaatcaaagccattagcaagttctggagtccccgaaaccaaagacgagcacctgggtccccacgccaggatggatgaggcctgggagcagagccgtgcacctggccctgtgcatgggcacatgctggagccgcccgtgggccccggaaggcggtcgccctcacccagccgcatcctgccacagccacagggcaccccggtgtccaccaccgtcgccaaggccatggcccgggaggccgcgcagagggtggccgagagcagcaggttagagaaaaggagcgtcttcctagagagaagcagcgcggggcagtacgccgcctcagacgaggaggacgcctatgactctccagacttcaagaggaggggcgcctcggtggacgacttcctgaaaggctctgaacttggcaagcagggaaactgaggcccacagaattgagaatttttgtccatgattacgcagatggtctcctaacagagctggaattagattgaaccgaggcctgaagaagacctgtttccacgcctttccccatgtgccacgttctcctcacctatccaggagtgaatcatcaccttccctgcaatctgctcaggttacaaacccggaggaaaggctggagcacttgttctctgggtgaaggacccatacccccactggtttttgagatcggcattcagcgctgtcttatggcagccacagccccaggtggccccagagcccttgacatgtggccacctggggctgagtgtgactgaggccctgaatttttacttctataaaattagttccagattagtttacattctaattagtttacatgtaaacagccacacgtggctggtggccaccagtgctgacgcccagctctggatgaccacacctgctacaagagatgacttttctagagaagagtagaaacacagcggcagaaacacagctctgcacttccgagggcctcccactccttctgatgagactgcagaggaagtctgtttggccaagcatgctattaacacgttttcctgcttgttttgttttttaacagagcaaacaggtctgtttctattaaaatttaaaaagcgttaatatttagcagcattgttttatgttgtattcataacataataatataacaatatattaattgttaatatatattgttaataatataataatataacataaaataagtgatacttattttcc

SEQ ID NO: 417747 - DNA, 3450 bp, Homo sapiens
ttgtaatctgacgacagtacactgcagttgtctccgaggtgaacctccggagccttggcacagctcgcttctaaagcttggaaatgacccgccacacctgaagcctgcaggtgctgaggccacattcgatcagacccaagctttgggagaccgctggggaaatttcccacttcctctcctgagaccaggaactcagcagagaaactttgtggaaaatgaactgaaggatgccacccagggagagtatctcctgagatcccatcatgcaggccttcccacaagggcccggcagcatgacaaggtgaaggcagagtatgtgcatctcaaccacccgctcaccctcgtgaccagagagcgcgatttggccgtgaaggagaaacaccagctccaagccaagctggagaacctagaacaggtcctgaagcatatgcgagaggcggctgaacggcggcagcagctgcagttggagcatgaccaggccctggctgttctcagtgccaagcagcaggaaattgaccttctgcagaaggctcaggttgaggctaagaaggagcatgaaggcgcagtgcggctgctagagtccaaggttcgagagctggaagagaaatgccggactcaaagtgagcagttcaacctgctgtcccgggacctggagaagttccggcagcacgctggcaagattgacctgctgggtggcagcgcggtggcccccctggacatctccacggcccccagcaagcctttcccacagttcatgaatggcctagccacctccctcggcaaaggtcaggagagcgctattggaggcagctctgcgatcggtgaatatatccggccccttccgcagcctggtgacaggccggagcctctgtccgccaagcccaccttcctgtcgagatccggtagcgcaagatgcagatctgagtcagacatggagaatgaacggaattccaatacctccaagcagagatactcggggaaggtccacctctgtgttgcccgctatagttacaaccccttcgatggaccgaacgagaaccccgaagctgagctgcccctcacggcgggaaaatacctctacgtctatggagacatggatgaggatgggttctatgaaggagagctcctcgatggccagaggggtctggtgccctccaacttcgtggactttgtgcaggacaacgagtcgcggttggcaagcacgctggggaacgagcaggatcagaacttcatcaaccattccggcatcggcctggagggagagcacatcctggacctccactccccaacccacatagatgcgggcatcaccgacaacagtgccgggaccctggacgtgaacatcgacgacatcggagaagacatcgtgccttaccctagaaaaatcaccctcatcaaacaactcgccaaaagtgttattgtgggctgggagcccccggcggtgccaccaggatggggaacggtgagcagctacaacgtcctggtggacaaggagacacgcatgaacctcacgctggggagcagaactaaagccctcatcgagaagctcaacatggcagcctgcacctaccgcatctccgtgcagtgcgtcaccagcaggggcagctcggatgagctgcagtgcacgctgctggtgggcaaggacgtggtggtggccccctcccacctgcgggtggacaacatcacgcagatctccgcccagctctcctggctacccaccaacagcaactacagccacgtcatcttcctcaacgaggaggagttcgacatcgtcaaggccgccaggtacaagtaccagttcttcaatctcaggcccaacatggcctataaggtgaaggttctggccaaaccccaccagatgccgtggcagctcccgctggagcaaagggagaagaaggaggcctttgtggagttctccacgttgcctgcaggacccccagcacccccacaagatgttaccgtccaggctggggtgacccccgccaccatccgggtctcctggagaccacctgtgctgacgcccaccgggctgtccaatggcgcaaacgttaccggctacggcgtgtatgccaaagggcagagggtggctgaagtcatcttccccacggcagacagcacggccgtggagcttgtgcggctgcggagcctggaggccaagggcgtgaccgtgcggaccctctccgcccagggcgagtccgtggactctgcagttgctgccgttccccccgagctcctggtgcctcctaccccccacccgagacctgcaccccaatcaaagccattagcaagttctggagtccccgaaaccaaagacgagcacctgggtccccacgccaggatggatgaggcctgggagcagagccgtgcacctggccctgtgcatgggcacatgctggagccgcccgtgggccccgcatcctgccacagccacagggcaccccggtgtccaccaccgtcgccaaggccatggcccgggaggccgcgcagagggtggccgagagcagcaggttagagaaaaggagcgtcttcctagagagaagcagcgcggggcagtacgccgcctcagacgaggaggacgcctatgactctccagacttcaagaggaggggcgcctcggtggacgacttcctgaaaggctctgaacttggcaagcagggaaactgaggcccacagaattgagaatttttgtccatgattacgcagatggtctcctaacagagctggaattagattgaaccgaggcctgaagaagacctgtttccacgcctttccccatgtgccacgttctcctcacctatccaggagtgaatcatcaccttccctgcaatctgctcaggttacaaacccggaggaaaggctggagcacttgttctctgggtgaaggacccatacccccactggtttttgagatcggcattcagcgctgtcttatggcagccacagccccaggtggccccagagcccttgacatgtggccacctggggctgagtgtgactgaggccctgaatttttacttctataaaattagttccagattagtttacattctaattagtttacatgtaaacagccacacgtggctggtggccaccagtgctgacgcccagctctggatgaccacacctgctacaagagatgacttttctagagaagagtagaaacacagcggcagaaacacagctctgcacttccgagggcctcccactccttctgatgagactgcagaggaagtctgtttggccaagcatgctattaacacgttttcctgcttgttttgttttttaacagagcaaacaggtctgtttctattaaaatttaaaaagcgttaatatttagcagcattgttttatgttgtattcataacataataatataacaatatattaattgttaatatatattgttaataatataataatataacataaaataagtgatacttattttcc

SEQ ID NO: 417748 - DNA, 809 bp, Homo sapiens
ttgtaatctgacgacagtacactgcagttgtctccgaggtgaacctccggagccttggcacagctcgcttctaaagcttggaaatgacccgccacacctgaagcctgcaggtgctgaggccacattcgatcagacccaagctttgggagaccgctggggaaatttcccacttcctctcctgagaccaggaactcagcagagaaactttgtggaaaatgaactgaaggatgccacccagggagagtatctcctgagatcccatcatgcaggccttcccacaagggcccggcagcatgacaaggtgaaggcagagtatgtgcatctcaaccacccgctcaccctcgtgaccagagagcgcgatttggccgtgaaggagaaacaccagctccaagccaagctggagaacctagaacaggtcctgaaggatgttaaacacagctgagctgtgcagtggcaggcacaccgctcctgaatggaaatggagtctgcctacgttaaagaccagaggtggctacagtgggtttcaaacttcaggaattttaagctgctcctcagacgtttaatgacctttgttataaagaggatagctaaaccagaaccttgctctatcagggggtacaggtaactggatgttcctcatgcattcctgatgagctgagctctccttcaatatttagccagtgggttgatttgctattgatgccactgagttaagctgaatgaattttttcaccaagtgttaaaatttgattggattatcattctggaaaacatttttttacaaaaataaaaaaataatcatctccagt

SEQ ID NO: 417749 - DNA, 129 bp, Homo sapiens
gtttctggtgctaaggcaactagactgaaaggatttcatttaaccctcaatgtaaaaccaggttatataattgtaggtagataggggaatttggcagagagataatcgtgtacaattatttgttctttt

SEQ ID NO: 417750 - DNA, 406 bp, Homo sapiens
agatgttgtacaacagtgaatgtactaaatgcaatcaaaatggttattttgtgttatgtgaattttcacatgaaaaagacagtatttctatgcatattctgggtcatacagctaattgaaaatcatgcatctattttttccagtattcctgaagaagggagcatatggctctaattgttgctgacagatacctggagaactccaacatggataatgacacagctgtaagaatcattttaaaaagtagagccggaaactcaatgggaccatacctgaagcctgcattccttagacttaatcagttcaagacagcacaaagcctatatttttatggatacttctgaatcagaacaaggaacccacgaaggtctataaatccagtctgcattaaactagtaactccaaa

SEQ ID NO: 417751 - DNA, 308 bp, Homo sapiens
  misc_feature (38)..(38): n is a, c, g, or t
tacaaacgctaccaacaaatacacagggagagaggganataactcatgttcactgaaagggagcatatggctctaattgttgctgacagatacctggagaactccaacatggataatgacacagctgtaagaatcattttaaaaagtagagccggaaactcaatgggaccatacctgaagcctgcattccttagacttaatcagttcaagacagcacaaagcctatatttttatggatacttctgaatcagaacaaggaacccacgaaggtctataaatccagtctgcattaaactagtaactccaaa

SEQ ID NO: 417752 - DNA, 2889 bp, Homo sapiens
  misc_feature (1123)..(1124): n is a, c, g, or t
  misc_feature (1149)..(1149): n is a, c, g, or t
gtcgcatacacactggcacagacacaagcaggacacacgcagacacacgcacactcgcgcgcatcctcccgccagcctgcccgcctgctcgccggcgcccggagcccgctctggccgcttgctttttgctgagaaagcttcctgccctggaagatggcacccttccccatccagacaccttgggaatgaattatgagggagccaggagtgagagagagaaccacgctgctgatgactccgagggaggggccctggacatgtgctgcagtgagaggctaccgggtctcccccagccgatagtgatggaggcactggacgaggctgaagggctccaggactcacagagagagatgccgccaccccctcctccctcgccgccctcagatccagctcagaagccaccacctcgaggcgctgggagccactccctcactgtcaggagcagcctgtgcctgttcgctgcctcacagttcctgcttgcctgtggggtgctctggttcagcggttatggccacatctggtcacagaacgccacaaacctcgtctcctctttgctgacgctcctgaaacagctggaacccacggcctggcttgactctgggacgtggggagtccccagtctgctgctggtctttctgtccgtgggcctggtcctcgttaccaccctggtgtggcacctcctgaggacacccccagagccacccaccccactgccccctgaggacaggcgccagtcagtgagccgccagccctccttcacctactcagagtggatggaggagaagatcgaggatgacttcctggacctcgacccggtgcccgagactcctgtgtttgattgtgtgatggacatcaagcctgaggctgaccccacctcactcaccgtcaagtccatgggtctgcaggagaggaggggttccaatgtctccctgaccctggacatgtgcactccgggctgcaacgaggagggctttggctatctcatgtccccacgtgaggagtccgcccgcgagtacctgctcagcgcctcccgtgtcctccaagcagaagagcttcatgaaaaggccctggaccctttcctgctgcaggcggaattctttgaaatccccatgaactttgtggnnccgaaagagtacgacatccctgggnggtgcggaagaaccggtacaaaaccatacttcccaaccctcacagcagagtgtgtctgacctcaccagaccctgacgaccctctgagttcctacatcaatgccaactacatccggggctatggtggggaggagaaggtgtacatcgccactcagggacccatcgtcagcacggtcgccgacttctggcgcatggtgtggcaggagcacacgcccatcattgtcatgatcaccaacatcgaggagatgaacgagaaatgcaccgagtattggccggaggagcaggtggcgtacgacggtgttgagatcactgtgcagaaagtcattcacacggaggattaccggctgcgactcatctccctcaagagtgggactgaggagcgaggcctgaagcattactggttcacatcctggcccgaccagaagaccccagaccgggcccccccactcctgcacctggtgcgggaggtggaggaggcagcccagcaggaggggccccactgtgcccccatcatcgtccactgcagtgcagggattgggaggaccggctgcttcattgccaccagcatctgctgccagcagctgcggcaggagggtgtggtggacatcctgaagaccacgtgccagctccgtcaggacaggggcggcatgatccagacatgcgagcagtaccagtttgtgcaccacgtcatgagcctctacgaaaagcagctgtcccaccagtccccagaatgactgcgcttctcctacaaggttctctgggcactgcccagcctgagtctcggccctcacccagggccctgcctcgggtcctgggcctgctccccgcttcctccccttcagtcagctccctctgtcctctgtcagcctggcctgacccctaccctccagcattgctcttcctactgtacatattggggagtggggggcagggtcgggaagggacatgccaggccaggcctggggccccggggcctgacccacaccacgcagaccccgggctccagtttttaacgatggttccatcaatacctgatccagaatgtttccgtgctacactttgtgtcctgctgcaatgtgttctgtctgtccatccatctctgccctctgtaccggacactgtgtctcctcagccaggaaggggtaatgagctccagcccctaagcaaccggacttgcctgcctcggcctcacccgcacttctcccaaaaggcagatgacggggagttaggcatggggagctccagaaggtcaccagagagctttcagctgagggagagttctctaggttggagtgggcatcacagccagggtggcctctgggtgtcagatgctctcaggagggtgcccagcctgtgaggcactggcaaggtagggggcagatggggcatggagaacccagaggatctaggccctgttggggaggggaggggagctcaaggtttgggtggggactcagcccagatctacgtgagacatttttctgtgtcactgtgggaaagccttcccagaagtctcactgcgtgttgctctgcgtgtgttcccatgtccatgcgtgtgttgagagcccatcaggagggcatgcatgactctttggcaacatgtattatcttggagccacgtgtttttattgctgactttaaatatttatcccacggcagacagagacatttggtgtctttttataattcgctcgtggtcattgaatagagcaataaacggagcattttgagcaaaactaac

SEQ ID NO: 417753 - DNA, 678 bp, Homo sapiens
gtaaggatggcacaggcctcacaagtgtctggagagagggtgggtggaggccagcctcccacttcctccccaggatggccacctggaaggcaggaggataaggggcctccctggtgttcctcaggagctccaagccctcaaggctgggataaggggaaggctggaattctgagccaccgcaccagcatctgagacctcacaccctgcctccctacctaagaatccaggggcaggggcctccccgacccctgagctcccagccgtacagggttctcctgagaactcctgtctgtggaggcctttctaggagactactcttttgatgtacatatttgtgaggtcctctctggaaagggctttctcttggttcccttcagtcagcttttctccaaggagagtcctgaggcctccccgggcacgcagcaccggggccctgctctcagctgcccggtctggaccttagaggttcaggagcctccatgcagggccaggttgaggctgcaggtgagctctgctgggggaacacgggggaagggggccggctccatactcagcctgctcccctgtgccccagcttgcctgtggggtgctctggttcagcggttatggccacatctggtcacagaacgccacaaacctcgtctcctctttgctgacgctcctgaaacagctggaacc

SEQ ID NO: 417754 - DNA, 2705 bp, Homo sapiens
  misc_feature (939)..(940): n is a, c, g, or t
  misc_feature (965)..(965): n is a, c, g, or t
atcccagattgagaggcagccacagccaccccaaaagggaggcacgccctgcctgtggacagggcggagtcatcgccgcaaaggaccatctaccacaggtctcccccagccgatagtgatggaggcactggacgaggctgaagggctccaggactcacagagagagatgccgccaccccctcctccctcgccgccctcagatccagctcagaagccaccacctcgaggcgctgggagccactccctcactgtcaggagcagcctgtgcctgttcgctgcctcacagttcctgcttgcctgtggggtgctctggttcagcggttatggccacatctggtcacagaacgccacaaacctcgtctcctctttgctgacgctcctgaaacagctggaacccacggcctggcttgactctgggacgtggggagtccccagtctgctgctggtctttctgtccgtgggcctggtcctcgttaccaccctggtgtggcacctcctgaggacacccccagagccacccaccccactgccccctgaggacaggcgccagtcagtgagccgccagccctccttcacctactcagagtggatggaggagaagatcgaggatgacttcctggacctcgacccggtgcccgagactcctgtgtttgattgtgtgatggacatcaagcctgaggctgaccccacctcactcaccgtcaagtccatgggtctgcaggagaggaggggttccaatgtctccctgaccctggacatgtgcactccgggctgcaacgaggagggctttggctatctcatgtccccacgtgaggagtccgcccgcgagtacctgctcagcgcctcccgtgtcctccaagcagaagagcttcatgaaaaggccctggaccctttcctgctgcaggcggaattctttgaaatccccatgaactttgtggnnccgaaagagtacgacatccctgggnggtgcggaagaaccggtacaaaaccatacttcccaaccctcacagcagagtgtgtctgacctcaccagaccctgacgaccctctgagttcctacatcaatgccaactacatccggggctatggtggggaggagaaggtgtacatcgccactcagggacccatcgtcagcacggtcgccgacttctggcgcatggtgtggcaggagcacacgcccatcattgtcatgatcaccaacatcgaggagatgaacgagaaatgcaccgagtattggccggaggagcaggtggcgtacgacggtgttgagatcactgtgcagaaagtcattcacacggaggattaccggctgcgactcatctccctcaagagtgggactgaggagcgaggcctgaagcattactggttcacatcctggcccgaccagaagaccccagaccgggcccccccactcctgcacctggtgcgggaggtggaggaggcagcccagcaggaggggccccactgtgcccccatcatcgtccactgcagtgcagggattgggaggaccggctgcttcattgccaccagcatctgctgccagcagctgcggcaggagggtgtggtggacatcctgaagaccacgtgccagctccgtcaggacaggggcggcatgatccagacatgcgagcagtaccagtttgtgcaccacgtcatgagcctctacgaaaagcagctgtcccaccagtccccagaatgactgcgcttctcctacaaggttctctgggcactgcccagcctgagtctcggccctcacccagggccctgcctcgggtcctgggcctgctccccgcttcctccccttcagtcagctccctctgtcctctgtcagcctggcctgacccctaccctccagcattgctcttcctactgtacatattggggagtggggggcagggtcgggaagggacatgccaggccaggcctggggccccggggcctgacccacaccacgcagaccccgggctccagtttttaacgatggttccatcaatacctgatccagaatgtttccgtgctacactttgtgtcctgctgcaatgtgttctgtctgtccatccatctctgccctctgtaccggacactgtgtctcctcagccaggaaggggtaatgagctccagcccctaagcaaccggacttgcctgcctcggcctcacccgcacttctcccaaaaggcagatgacggggagttaggcatggggagctccagaaggtcaccagagagctttcagctgagggagagttctctaggttggagtgggcatcacagccagggtggcctctgggtgtcagatgctctcaggagggtgcccagcctgtgaggcactggcaaggtagggggcagatggggcatggagaacccagaggatctaggccctgttggggaggggaggggagctcaaggtttgggtggggactcagcccagatctacgtgagacatttttctgtgtcactgtgggaaagccttcccagaagtctcactgcgtgttgctctgcgtgtgttcccatgtccatgcgtgtgttgagagcccatcaggagggcatgcatgactctttggcaacatgtattatcttggagccacgtgtttttattgctgactttaaatatttatcccacggcagacagagacatttggtgtctttttataattcgctcgtggtcattgaatagagcaataaacggagcattttgagcaaaactaac

SEQ ID NO: 417755 - DNA, 2801 bp, Homo sapiens
  misc_feature (1035)..(1036): n is a, c, g, or t
  misc_feature (1061)..(1061): n is a, c, g, or t
gtcgcatacacactggcacagacacaagcaggacacacgcagacacacgcacactcgcgcgcatcctcccgccagcctgcccgcctgctcgccggcgcccggagcccgctctggccggagtgagagagagaaccacgctgctgatgactccgagggaggggccctggacatgtgctgcagtgagaggctaccgggtctcccccagccgatagtgatggaggcactggacgaggctgaagggctccaggactcacagagagagatgccgccaccccctcctccctcgccgccctcagatccagctcagaagccaccacctcgaggcgctgggagccactccctcactgtcaggagcagcctgtgcctgttcgctgcctcacagttcctgcttgcctgtggggtgctctggttcagcggttatggccacatctggtcacagaacgccacaaacctcgtctcctctttgctgacgctcctgaaacagctggaacccacggcctggcttgactctgggacgtggggagtccccagtctgctgctggtctttctgtccgtgggcctggtcctcgttaccaccctggtgtggcacctcctgaggacacccccagagccacccaccccactgccccctgaggacaggcgccagtcagtgagccgccagccctccttcacctactcagagtggatggaggagaagatcgaggatgacttcctggacctcgacccggtgcccgagactcctgtgtttgattgtgtgatggacatcaagcctgaggctgaccccacctcactcaccgtcaagtccatgggtctgcaggagaggaggggttccaatgtctccctgaccctggacatgtgcactccgggctgcaacgaggagggctttggctatctcatgtccccacgtgaggagtccgcccgcgagtacctgctcagcgcctcccgtgtcctccaagcagaagagcttcatgaaaaggccctggaccctttcctgctgcaggcggaattctttgaaatccccatgaactttgtggnnccgaaagagtacgacatccctgggnggtgcggaagaaccggtacaaaaccatacttcccaaccctcacagcagagtgtgtctgacctcaccagaccctgacgaccctctgagttcctacatcaatgccaactacatccggggctatggtggggaggagaaggtgtacatcgccactcagggacccatcgtcagcacggtcgccgacttctggcgcatggtgtggcaggagcacacgcccatcattgtcatgatcaccaacatcgaggagatgaacgagaaatgcaccgagtattggccggaggagcaggtggcgtacgacggtgttgagatcactgtgcagaaagtcattcacacggaggattaccggctgcgactcatctccctcaagagtgggactgaggagcgaggcctgaagcattactggttcacatcctggcccgaccagaagaccccagaccgggcccccccactcctgcacctggtgcgggaggtggaggaggcagcccagcaggaggggccccactgtgcccccatcatcgtccactgcagtgcagggattgggaggaccggctgcttcattgccaccagcatctgctgccagcagctgcggcaggagggtgtggtggacatcctgaagaccacgtgccagctccgtcaggacaggggcggcatgatccagacatgcgagcagtaccagtttgtgcaccacgtcatgagcctctacgaaaagcagctgtcccaccagtccccagaatgactgcgcttctcctacaaggttctctgggcactgcccagcctgagtctcggccctcacccagggccctgcctcgggtcctgggcctgctccccgcttcctccccttcagtcagctccctctgtcctctgtcagcctggcctgacccctaccctccagcattgctcttcctactgtacatattggggagtggggggcagggtcgggaagggacatgccaggccaggcctggggccccggggcctgacccacaccacgcagaccccgggctccagtttttaacgatggttccatcaatacctgatccagaatgtttccgtgctacactttgtgtcctgctgcaatgtgttctgtctgtccatccatctctgccctctgtaccggacactgtgtctcctcagccaggaaggggtaatgagctccagcccctaagcaaccggacttgcctgcctcggcctcacccgcacttctcccaaaaggcagatgacggggagttaggcatggggagctccagaaggtcaccagagagctttcagctgagggagagttctctaggttggagtgggcatcacagccagggtggcctctgggtgtcagatgctctcaggagggtgcccagcctgtgaggcactggcaaggtagggggcagatggggcatggagaacccagaggatctaggccctgttggggaggggaggggagctcaaggtttgggtggggactcagcccagatctacgtgagacatttttctgtgtcactgtgggaaagccttcccagaagtctcactgcgtgttgctctgcgtgtgttcccatgtccatgcgtgtgttgagagcccatcaggagggcatgcatgactctttggcaacatgtattatcttggagccacgtgtttttattgctgactttaaatatttatcccacggcagacagagacatttggtgtctttttataattcgctcgtggtcattgaatagagcaataaacggagcattttgagcaaaactaac

SEQ ID NO: 417756 - DNA, 2322 bp, Homo sapiens
catctgtccatccatccatccctgcctctgtgcatgcatctgtccattcatccctgcctctgtgtatgcatctgtccatccatccatccccacctctgtgcatgcatctgtccatccatccccgcctctgtgcatgcatctgtccgtccatccatccctgcctctgtgcatgcatctgtccgtccattcatccctgcctctgtgcatgcatctgtccattcatccatccctgactctgtgcatgcatctgtccatccatccatccttgcctctatgcatgcatttgtccgtccatccatccctgcctctgtgcatgcatccatacctgcctctgtgcatgcatctgtcagtctatcaatccccgatcccttctttgtaatggtgttgagcgctcacaactccctcatcctaagacgctcgttggatccattccctcccctcaccccatgctgctctctgccctcccttcccggtcaagttctccagccagtggtctcaactcaatcttcacttcccccgctcctctcacacctatccccactgcattctaaattcttccccaacgcgctgggcctacaggcactaaaaaggtcactttgtccctggatgaccaaacacaggccaatgtaacttactgggcttgttttgccccagccacagctgaccacttcctccttcactcttgttgttgatcacctttgggcttagtctttctccatctctgttgagtccttctcccctgccacctactccttcatgctggggttctctgtagctctgtacctgacagtcacgttccaccctttcctcccagaagctcgccaacccccgtggactgctggctctcaaggcggccgctagcccagcaccgacagcagctgacaatgcacactatgcggcccaaggcaggtcctgtgctgagaggcatgggtgaatggctcatttcatcggcaagcccacgccaccagcaggcgccgttctcctcgcatttctcaggcgaggaacctgagacaatgaggttaaggaagttgttcattacaagtggaagaaccctgacttacttgaattcaactttgaagcccacattctctttttctgtgtgtgtgacagggtctcactttgtcacccaggccgcagtgcagtggtgtgaacacagctcattgcagtctcaacctccctgactcaagcaatcctcctgccttagcctcctgagtagctgggactacaagcatgtgccaccacgcccagccgaagcccatatgtgaatgttgaggcacacagcctccccagcctctgccttaccaagccctccacagggcctaggcaccctccctggctgcccccttcccccgtcactcaggctccccagcagccaatgtagttaatatggggctgcaaagagctgggcctggcctcaggcgggaccacctccccggcattgccatccctgctgcagagctcccatgcgatcagcctcctctccagctgagaccacatcctcactcagcttctaggctgttcctgctccccattcccctcagcacatggcccctgagaaactgcttgcacaagaatttccctctggagccccacctctggggaacctgacctcagacagaggagaccaagctctagggcaggatcctccacctcccttgccccaccggtgtggccagcccagagcgctgcagactcccgcccagacctgcacttgtgcctgccttctgccagcctgctcctcctcctcccactctcacacctgcattaacagcaccaggacgccatcctccaagggccccagcctcatctcccctgtcaccaggatccagccagatctcaatccttgcccatcctaactgaacctccctcagatccgtccactgcccccttccccaggaccacactccaccatctcttgcctggaccctgcgagaacttcctgcctccctgcctctatcctaccccctgccccccgctgaagctgatgatagttccggaatgcaaaaccccttaatgattcccccattgatcaaagtcttccacatgctttcaaggtccttggtgatccaggacctgccgccttctgcagtctccctactgatgccatagttttggcttctggcctcatatgtcccgggtcatttctctggtcactggctcctcttacccctgactcagctggctcactgctttcccattggatctcaaccctgtgtacctggggagagcggaactctgtatgtcttgtcttgtgctagtaggcactcagtgtgtatgtgtggatattcatatatatatatatatatatttgaaaaaaagttt

SEQ ID NO: 417757 - DNA, 1989 bp, Homo sapiens
catctgtccatccatccatccctgcctctgtgcatgcatctgtccattcatccctgcctctgtgtatgcatctgtccatccatccatccccacctctgtgcatgcatctgtccatccatccccgcctctgtgcatgcatctgtccgtccatccatccctgcctctgtgcatgcatctgtccgtccattcatccctgcctctgtgcatgcatctgtccattcatccatccctgactctgtgcatgcatctgtccatccatccatccttgcctctatgcatgcatttgtccgtccatccatccctgcctctgtgcatgcatccatacctgcctctgtgcatgcatctgtcagtctatcaatccccgatcccttctttgtaatggtgttgagcgctcacaactccctcatcctaagacgctcgttggatccattccctcccctcaccccatgctgctctctgccctcccttcccggtcaagttctccagccagtggtctcaactcaatcttcacttcccccgctcctctcacacctatccccactgcattctaaattcttccccaacgcgctgggcctacaggcactaaaaaggtcactttgtccctggatgaccaaacacaggccaatgtaacttactgggcttgttttgccccagccacagctgaccacttcctccttcactcttgttgttgatcacctttgggcttagtctttctccatctctgttgagtccttctcccctgccacctactccttcatgctggggttctctgtagctctgtacctgacagtcacgttccaccctttcctcccagaagctcgccaacccccgtggactgctggctctcaaggcggccgctagcccagcaccgacagcagctgacaatgcacactatgcggcccaaggcaggtcctgtgctgagaggcatgggtgaatggctcatttcatcggcaagcccacgccaccagcaggcgccgttctcctcgcatttctcaggcgaggaacctgagacaatgaggttaaggaagttgttcattacaagtggaagaaccctgacttacttgaattcaactttgaagcccacattctctttttctgtgtgtgtgacagggtctcactttgtcacccaggccgcagtgcagtggtgtgaacacagctcattgcagtctcaacctccctgactcaagcaatcctcctgccttagcctcctgagtagctgggactacaagcatgtgccaccacgcccagccgaagcccatatgtgaatgttgaggcacacagcctccccagcctctgccttaccaagccctccacagggcctaggcaccctccctggctgcccccttcccccgtcactcaggctccccagcagccaatgtagttaatatggggctgcaaagagctgggcctggcctcaggcgggaccacctccccggcattgccatccctgctgcagagctcccatgcgatcagcctcctctccagctgagaccacatcctcactcagcttctaggctgttcctgctccccattcccctcagcacatggcccctgagaaactgcttgcacaagaatttccctctggagccccacctctggggaacctgacctcagacagaggagaccaagctctagggcaggatcctccacctcccttgccccaccggtgtggccagcccagagcgctgcagactcccgcccagacctgcacttgtgcctgccttctgccagcctgctcctcctcctcccactctcacacctgcattaacagcaccaggacgccatcctccaagggccccagcctcatctcccctgtcaccaggatccagccagatctcaatccttgcccatcctaactgaacctccctcagatccgtccactgcccccttccccaggaccacactccaccatctcttgcctggaccctactgagagatcgtgccccacagagagagcgtcgacgctctctctgtggggctcaaaacctc

SEQ ID NO: 417758 - DNA, 1988 bp, Homo sapiens
catctgtccatccatccatccctgcctctgtgcatgcatctgtccattcatccctgcctctgtgtatgcatctgtccatccatccatccccacctctgtgcatgcatctgtccatccatccccgcctctgtgcatgcatctgtccgtccatccatccctgcctctgtgcatgcatctgtccgtccattcatccctgcctctgtgcatgcatctgtccattcatccatccctgactctgtgcatgcatctgtccatccatccatccttgcctctatgcatgcatttgtccgtccatccatccctgcctctgtgcatgcatccatacctgcctctgtgcatgcatctgtcagtctatcaatccccgatcccttctttgtaatggtgttgagcgctcacaactccctcatcctaagacgctcgttggatccattccctcccctcaccccatgctgctctctgccctcccttcccggtcaagttctccagccagtggtctcaactcaatcttcacttcccccgctcctctcacacctatccccactgcattctaaattcttccccaacgcgctgggcctacaggcactaaaaaggtcactttgtccctggatgaccaaacacaggccaatgtaacttactgggcttgttttgccccagccacagctgaccacttcctccttcactcttgttgttgatcacctttgggcttagtctttctccatctctgttgagtccttctcccctgccacctactccttcatgctggggttctctgtagctctgtacctgacagtcacgttccaccctttcctcccagaagctcgccaacccccgtggactgctggctctcaaggcggccgctagcccagcaccgacagcagctgacaatgcacactatgcggcccaaggcaggtcctgtgctgagaggcatgggtgaatggctcatttcatcggcaagcccacgccaccagcaggcgccgttctcctcgcatttctcaggcgaggaacctgagacaatgaggttaaggaagttgttcattacaagtggaagaaccctgacttacttgaattcaactttgaagcccacattctctttttctgtgtgtgtgacagggtctcactttgtcacccaggccgcagtgcagtggtgtgaacacagctcattgcagtctcaacctccctgactcaagcaatcctcctgccttagcctcctgagtagctgggactacaagcatgtgccaccacgcccagccgaagcccatatgtgaatgttgaggcacacagcctccccagcctctgccttaccaagccctccacagggcctaggcaccctccctggctgcccccttcccccgtcactcaggctccccagcagccaatgtagttaatatggggctgcaaagagctgggcctggcctcaggcgggaccacctccccggcattgccatccctgctgcagagctcccatgcgatcagcctcctctccagctgagaccacatcctcactcagcttctaggctgttcctgctccccattcccctcagcacatggcccctgagaaactgcttgcacaagaatttccctctggagccccacctctggggaacctgacctcagacagaggagaccaagctctagggcaggatcctccacctcccttgccccaccggtgtggccagcccagagcgctgcagactcccgcccagacctgcacttgtgcctgccttctgccagcctgctcctcctcctcccactctcacacctgcattaacagcaccaggacgccatcctccaagggccccagcctcatctcccctgtcaccaggatccagccagatctcaatccttgcccatcctaactgaacctccctcagatccgtccactgcccccttccccaggaccacactccaccatctcttgcctggaccctgcgagaacttcctgcctccctgccttccaggtttctccccttcacatgcatgcacccagg

SEQ ID NO: 417759 - DNA, 458 bp, Homo sapiens
aaaagaatcacacatgcctctctcccatcagcactaacatttgttatggataataacactttcaatcacaactatttttggaaaacaggtttatcttaaaccttccctccccccactgaaaatactctcccaaggacacagactcctacaaaccacagcccattaatccaactatggaatgggaacattttcttcccactaacttttttttaagttgtttttaagagttagtgtaaaagcccgaggtacaaggttaaggagcactttaacttaggtgattggcataagagggaggccatgtctctcaagacctcaagcctctgaccctgtatgaagtaagccacaagagaggcccagattttgtttgtttcttgtttttctttttttaatttttgtgtttttttaacacagtctcactctgtcgcccaggctagagtgcagtggcgcgatctcggctc

SEQ ID NO: 417760 - DNA, 322 bp, Homo sapiens
gaaaaaagggaggcagccagtattaatgtacatccaaggaaactgtgccccaggggtcttgtgtgtatttctgagaagaggggtgagaaaaggcactgtgtcaacatttgcttctgcctgaacgtgcacctcccagtgctcctccatcaattaggagaactgtcttgaagaatgctgcctcagcttctgaagagaagaccccaggacatgcattaatgagaggaggggagtcacagctgcagaagaataaagctctctgagggagcctggggcccccagtgaggcctggagcttgttgacagagcagcaggagacccctgct

SEQ ID NO: 417761 - DNA, 472 bp, Homo sapiens
acatcttttacaattaggaagaatcataataagctatcatttttattaatcaagtattggcaattttgtaaggttcaaccccatatactccattgacccattacaggttatccacggaaaacggaacattttggaggtttttaatctcttgagattgatgtaagggcaactgtcccttggtgaagataacttggtgacacaataatcttcactgaatggatcaagggtatgtcatttttcaggttcttgtttgttaccataatgagaggccaggagaactgggttctagctttacccttccgacggtaaatatctggagattgaaacattttaagtcactttggttcttaacttcttttcaatcaaaaaacaaaacaaaacctacccctctgtcagtaaatatctggagattgaaacattttaagtcactttggttcttaactttttttcaatcaaaaaacaaaacagaaca

SEQ ID NO: 417762 - DNA, 389 bp, Homo sapiens
gattagaagaaagggggaaactggtaaaaacgtacatttaatataatcctgaccttctcaatccaaataacagtccaaaaatagccatttttcatccatctcagaatcctattaatatgacagaaatgacttaagaagaaagaataaattcctaatactgtaggaaaataggatagttctgtactagtagatcagaagttttgagaaactcctggaagatagaaagcaagtagaatctgtgatcagggtatccgcagagaaatactacaatccaaagtctgcaggaaagagtacagaaattttaagcatgggcttgcaactacagtatgtgggagtagacagagtgcatcattctgggaaattgataatgtcctgactctaatacaaat

SEQ ID NO: 417763 - DNA, 329 bp, Homo sapiens
aatcaggaacaatacaaggatgtttgctctcaccacaactctttaacattggacaagaggttctagtcataactattaagccaaaaagaaaagatataatatgtatatgattgggaagaaagagtaagactatatctattcccagattatataatttgcatatagaaacttctaaggaattcacttttaaatgtatatgtgtgtgtgtatatatatatatgaaccaataaacaagttcagccaagttgctgatacaagatcagtatacaaaaatcagttgtatttatctgcaccagaaatgaacaacctaaaaaataaaattgagaaag

SEQ ID NO: 417764 - DNA, 432 bp, Homo sapiens
atgtagtcagaatttacacatcaacatttccatataaagtacaataaagcttaagtagagttgagtccatcattaaatgtgttctatggggatctaaacaaagataaataagatgtccataatctagaagacatactttactgcaaaatgtcactgctaatcattaatatgtgatttgcttttctgctcaaagtactatgtatgaatattttagccaaagcctaatcctagcagaatattagcaccttgggaagacagacctcttttaatagctcataagtgaatttaattttttatttttttgagatggagtctcgctctgtcacccaggctgaggcgggagaattgcttgtacctgggaggcggaggttctattgagccgagattggccacggcactctagcctgggcaacagagcaagagtgtctctca

SEQ ID NO: 417765 - DNA, 2947 bp, Homo sapiens
acttttacttttgacgaccaccatgactgagatcactgctgaaggaaatgcatctacaaccacaactgtgatagacagcaaaaatggatctgtgcccaaatcccccggaaaagtgctgaagaggacagtcacagaagacatagtgacgacgttcagctcccctgcagcctggcttctggtcattgccctgataatcacgtggtcagctgttgccatcgttatgtttgatttagtggattacaaaaacttttcagcaagctctattgccaagattggctcagatcctttaaaactggtacgtgatgctatggaggaaaccacggactggatctatggcttcttttctttgttatctgacatcatctcatctgaagatgaagaagatgatgatggtgacgaagatactgataaaggagaaatagatgagcctcccttgagaaaaaaagaaatacacaaagataagactgaaaaacaagagaaacctgaaaggaaaatacaaactaaagttacacacaaagaaaaagaaaaaggaaaagaaaaagtaagagaaaaagaaaaacctgaaaagaaagcaactcacaaggaaaaaattgagaaaaaagaaaaaccagaaacaaagacagtggcgaaagaacagaagaaagctaagactgcagaaaagagtgaagaaaagactaaaaaggaagtgaaaggtggaaaacaggagaaagtgaagcaaacagctgcaaaagtaaaagaagtacagaaaacaccatcaaaacccaaagaaaaggaggacaaagagaaagcagctgtgtcaaagcatgaacagaaagatcagtatgcattctgtcgatatatgattgacatatttgtccatggggatttaaaaccaggacaaagcccagccattccacctcccttaccgacagaacaagcttccagacccactccggcatcacctgcccttgaagaaaaagaaggggaaaagaagaaggctgagaagaaagttacttctgaaacaaaaaagaaagaaaaagaagatatcaaaaagaaaagtgagaaggaaactgccattgatgtggaaaaaaaagagccgggaaaagcttctgaaaccaaacaagggactgtaaaaattgcagcacaagcagcagctaagaaggatgaaaagaaggaagattccaagaaaacaaaaaaacctgcagaagtagaacaacccaagggaaaaaagcaggaaaagaaagaaaaacatgtggaaccagcaaagtcaccaaagaaagaacactcagttccaagtgacaaacaagtaaaagcaaaaactgaacgagccaaagaggagattggtgcggtttcaagtaaaaaagctgtacctggaaagaaggaagagaaaacaaccaagacagtggagcaagaaattagaaaagaaaaatctgggaagacttcttcaattctgaaagataaagaacctattaaagggaaagaagagaaagttccagcttccctaaaggaaaaagaacctgaaactaaaaaagatgaaaagatgtccaaagcaggcaaagaagtcaagcctaaacctccacaactacaaggaaaaaaggaagagaagccagagccccaaattaaaaaagaagcaaaaccagctatatctgaaaaagtgcaaatacacaaacaagacatagtgaaaccagaaaagactgtttctcatggtaaaccagaagaaaaagttctcaagcaggtaaaagctgtcacaatagaaaaaacagccaagcccaaaccaacaaaaaaagctgaacatcgagaaagagaacctccatctataaaaacagacaaaccaaaaccaactccaaaaggaacatcagaagtcacagaatcaggaaagaagaaaactgaaatatctgaaaaagaaagtaaagaaaaagcagacatgaagcatcttagagaagaaaaagtctcaacaagaaaagaaagtcttcaattacacaatgtgacaaaagcagaaaaacctgcaagagtatcaaaagatgttgaagatgtaccagcttcaaagaaagctaaagaaggaactgaagatgtgtctcccacaaagcagaaaagtcccatcagtttcttccagtgtgtctacttggatgggtacaatggctatggatttcagtttcctttcactcctgcagaccgccctggagagagctctggtcaagcaaattctccaggacagaagcaacaaggacagtaaacacacatgtatgacccttacaagtgctttaagattttaaaaatgtgatgttttgtccacagtagttcaggcaattaagaatatgcaacccagagaatttctgtgaaaacattttgctctttggcctggtgtggacggaaagggtggccaaatggattgagtgatgagcagacatgtttaagggtctaagtctcaagaatctgttatgtgtgtttgctgcggtgggagggggtgcttgtatttatcttatttccagtcactataaggttgtacacaaactaatttaaagtttacttaataatggtatctttaaaataattgacacaattgcaaaatgaattcctggcttcagttagctattatttttttaatgacaacatagactgtgctctaagtttaaaagatggggaagcttatataaaagtgacccttttgcatcatatgggtatctaaacttaatttacccaataagttgatgcttaatgattttattttatttttgtctattttctattttagttgtggctttgctctaagaatgggtaatagttgtactacagactgctataaatttcttgtgatactcttttagagctcaaaatatctctgagctttagacatggtaaggtggagagtaaatgcttgataaatctttaagatatgtcttgaatgataattaggacattcagtccagtggaaatacaccattcaattagtcaggtctggtgaatttcc

SEQ ID NO: 417766 - DNA, 3666 bp, Homo sapiens
  misc_feature (29)..(29): n is a, c, g, or t
  misc_feature (43)..(43): n is a, c, g, or t
  misc_feature (126)..(126): n is a, c, g, or t
  misc_feature (149)..(149): n is a, c, g, or t
  misc_feature (175)..(175): n is a, c, g, or t
cttcagatagattatatctggagtgaagnatcctgccacctangtatctggcatagtattctgtgtagtgggatgagcagagaacaaaaacaaaataatccagtgagaaaagcccgtaaataaacnttcagaccagagatctattctcnagcttattttaagctcaacttaaaangaagaactgttctctgattcttttcgccttcaatacacttaatgatttaactccaccctccttcaaaagaaacagcatttcctacttttatactgtctatatgattgatttgcacagctcatctggccagaagagctgagacatccgttcccctacaagaaactctccccgggtggaacaagatggattatcaagtgtcaagtccaatctatgacatcaattattatacatcggagccctgccaaaaaatcaatgtgaagcaaatcgcagcccgcctcctgcctccgctctactcactggtgttcatctttggttttgtgggcaacatgctggtcatcctcatcctgataaactgcaaaaggctgaagagcatgactgacatctacctgctcaacctggccatctctgacctgtttttccttcttactgtccccttctgggctcactatgctgccgcccagtgggactttggaaatacaatgtgtcaactcttgacagggctctattttataggcttcttctctggaatcttcttcatcatcctcctgacaatcgataggtacctggctgtcgtccatgctgtgtttgctttaaaagccaggacggtcacctttggggtggtgacaagtgtgatcacttgggtggtggctgtgtttgcgtctctcccaggaatcatctttaccagatctcaaaaagaaggtcttcattacacctgcagctctcattttccatacagtcagtatcaattctggaagaatttccagacattaaagatagtcatcttggggctggtcctgccgctgcttgtcatggtcatctgctactcgggaatcctaaaaactctgcttcggtgtcgaaatgagaagaagaggcacagggctgtgaggcttatcttcaccatcatgattgtttattttctcttctgggctccctacaacattgtccttctcctgaacaccttccaggaattctttggcctgaataattgcagtagctctaacaggttggaccaagctatgcaggtgacagagactcttgggatgacgcactgctgcatcaaccccatcatctatgcctttgtcggggagaagttcagaaactacctcttagtcttcttccaaaagcacattgccaaacgcttctgcaaatgctgttctattttccagcaagaggctcccgagcgagcaagctcagtttacacccgatccactggggagcaggaaatatctgtgggcttgtgacacggactcaagtgggctggtgacccagtcagagttgtgcacatggcttagttttcatacacagcctgggctgggggtggggtgggagaggtcttttttaaaaggaagttactgttatagagggtctaagattcatccatttatttggcatctgtttaaagtagattagatcttttaagcccatcaattatagaaagccaaatcaaaatatgttgatgaaaaatagcaacctttttatctccccttcacatgcatcaagttattgacaaactctcccttcactccgaaagttccttatgtatatttaaaagaaagcctcagagaattgctgattcttgagtttagtgatctgaacagaaataccaaaattatttcagaaatgtacaactttttacctagtacaaggcaacatataggttgtaaatgtgtttaaaacaggtctttgtcttgctatggggagaaaagacatgaatatgattagtaaagaaatgacacttttcatgtgtgatttcccctccaaggtatggttaataagtttcactgacttagaaccaggcgagagacttgtggcctgggagagctggggaagcttcttaaatgagaaggaatttgagttggatcatctattgctggcaaagacagaagcctcactgcaagcactgcatgggcaagcttggctgtagaaggagacagagctggttgggaagacatggggaggaaggacaaggctagatcatgaagaaccttgacggcattgctccgtctaagtcatgagctgagcagggagatcctggttggtgttgcagaaggtttactctgtggccaaaggagggtcaggaaggatgagcatttagggcaaggagaccaccaacagccctcaggtcagggtgaggatggcctctgctaagctcaaggcgtgaggatgggaaggagggaggtattcgtaaggatgggaaggagggaggtattcgtgcagcatatgaggatgcagagtcagcagaactggggtggatttggtttggaagtgagggtcagagaggagtcagagagaatccctagtcttcaagcagattggagaaacccttgaaaagacatcaagcacagaaggaggaggaggaggtttaggtcaagaagaagatggattggtgtaaaaggatgggtctggtttgcagagcttgaacacagtctcacccagactccaggctgtctttcactgaatgcttctgacttcatagatttccttcccatcccagctgaaatactgaggggtctccaggaggagactagatttatgaatacacgaggtatgaggtctaggaacatacttcagctcacacatgagatctaggtgaggattgattacctagtagtcatttcatgggttgttgggaggattctatgaggcaaccacaggcagcatttagcacatactacacattcaataagcatcaaactcttagttactcattcagggatagcactgagcaaagcattgagcaaaggggtcccatataggtgagggaagcctgaaaaactaagatgctgcctgcccagtgcacacaagtgtaggtatcattttctgcatttaaccgtcaataggcaaaggggggaagggacatattcatttggaaataagctgccttgagccttaaaacccacaaaagtacaatttaccagcctccgtatttcagactgaatgggggtggggggggcgccttaggtacttattccagatgccttctccagacaaaccagaagcaacagaaaaaatcgtctctccctccctttgaaatgaatataccccttagtgtttgggtatattcatttcaaagggagagagagaggtttttttctgttctttctcatatgattgtgcacatacttgagactgttttgaatttgggggatggctaaaaccatcatagtacaggtaaggtgagggaatagtaagtggtgagaactactcagggaatgaaggtgtcagaataataagaggtgctactgactttctcagcctctgaatatgaacggtgagcattgtggctgtcagcaggaagcaacgaagggaaatgtctttccttttgctcttaagttgtggagagtgcaacagtagcataggaccctaccctctgggccaagtcaaagacattctgacatcttagtatttgcatattcttatgtatgtgaaagttacaaattgcttgaaagaaaatatgcatctaataaaaaacaccttctaaaataattcat

SEQ ID NO: 417767 - DNA, 2942 bp, Homo sapiens
  misc_feature (29)..(29): n is a, c, g, or t
  misc_feature (43)..(43): n is a, c, g, or t
  misc_feature (126)..(126): n is a, c, g, or t
  misc_feature (149)..(149): n is a, c, g, or t
  misc_feature (175)..(175): n is a, c, g, or t
cttcagatagattatatctggagtgaagnatcctgccacctangtatctggcatagtattctgtgtagtgggatgagcagagaacaaaaacaaaataatccagtgagaaaagcccgtaaataaacnttcagaccagagatctattctcnagcttattttaagctcaacttaaaangaagaactgttctctgattcttttcgccttcaatacacttaatgatttaactccaccctccttcaaaagaaacagcatttcctacttttatactgtctatatgattgatttgcacagctcatctggccagaagagctgagacatccgttcccctacaagaaactctccccgggtggaacaagatggattatcaagtgtcaagtccaatctatgacatcaattattatacatcggagccctgccaaaaaatcaatgtgaagcaaatcgcagcccgcctcctgcctccgctctactcactggtgttcatctttggttttgtgggcaacatgctggtcatcctcatcctgataaactgcaaaaggctgaagagcatgactgacatctacctgctcaacctggccatctctgacctgtttttccttcttactgtccccttctgggctcactatgctgccgcccagtgggactttggaaatacaatgtgtcaactcttgacagggctctattttataggcttcttctctggaatcttcttcatcatcctcctgacaatcgataggtacctggctgtcgtccatgctgtgtttgctttaaaagccaggacggtcacctttggggtggtgacaagtgtgatcacttgggtggtggctgtgtttgcgtctctcccaggaatcatctttaccagatctcaaaaagaaggtcttcattacacctgcagctctcattttccatacagtcagtatcaattctggaagaatttccagacattaaagatagtcatcttggggctggtcctgccgctgcttgtcatggtcatctgctactcgggaatcctaaaaactctgcttcggtgtcgaaatgagaagaagaggcacagggctgtgaggcttatcttcaccatcatgattgtttattttctcttctgggctccctacaacattgtccttctcctgaacaccttccaggaattctttggcctgaataattgcagtagctctaacaggttggaccaagctatgcaggtgacagagactcttgggatgacgcactgctgcatcaaccccatcatctatgcctttgtcggggagaagttcagaaactacctcttagtcttcttccaaaagcacattgccaaacgcttctgcaaatgctgttctattttccagcaagaggctcccgagcgagcaagctcagtttacacccgatccactggggagcaggaaatatctgtgggcttgtgacacggactcaagtgggctggtgacccagtcagagttgtgcacatggcttagttttcatacacagcctgggctgggggtggggtgggagaggtcttttttaaaaggaagttactgttatagagggtctaagattcatccatttatttggcatctgtttaaagtagattagatcttttaagcccatcaattatagaaagccaaatcaaaatatgttgatgaaaaatagcaacctttttatctccccttcacatgcatcaagttattgacaaactctcccttcactccgaaagttccttatgtatatttaaaagaaagcctcagagaattgctgattcttgagtttagtgatctgaacagaaataccaaaattatttcagaaatgtacaactttttacctagtacaaggcaacatataggttgtaaatgtgtttaaaacaggtctttgtcttgctatggggagaaaagacatgaatatgattagtaaagaaatgacacttttcatgtgtgatttcccctccaaggtatggttaataagtttcactgacttagaaccaggcgagagacttgtggcctgggagagctggggaagcttcttaaatgagaaggaatttgagttggatcatctattgctggcaaagacagaagcctcactgcaagcactgcatgggcaagcttggctgtagaaggagacagagctggttgggaagacatggggaggaaggacaaggctagatcatgaagaaccttgacggcattgctccgtctaagtcatgagctgagcagggagatcctggttggtgttgcagaaggtttactctgtggccaaaggagggtcaggaaggatgagcatttagggcaaggagaccaccaacagccctcaggtcagggtgaggatggcctctgctaagctcaaggcgtgaggatgggaaggagggaggtattcgtaaggatgggaaggagggaggtattcgtgcagcatatgaggatgcagagtcagcagaactggggtggatttggtttggaagtgagggtcagagaggagtcagagagaatccctagtcttcaagcagattggagaaacccttgaaaagacatcaagcacagaaggagagagagagaggtttttttctgttctttctcatatgattgtgcacatacttgagactgttttgaatttgggggatggctaaaaccatcatagtacaggtaaggtgagggaatagtaagtggtgagaactactcagggaatgaaggtgtcagaataataagaggtgctactgactttctcagcctctgaatatgaacggtgagcattgtggctgtcagcaggaagcaacgaagggaaatgtctttccttttgctcttaagttgtggagagtgcaacagtagcataggaccctaccctctgggccaagtcaaagacattctgacatcttagtatttgcatattcttatgtatgtgaaagttacaaattgcttgaaagaaaatatgcatctaataaaaaacaccttctaaaataattcat

SEQ ID NO: 417768 - DNA, 6774 bp, Homo sapiens
ttttctaagtaggccaggaacatttaatatttttcaataaattaatatataaaatatatacattagtgccaaatggaacatatattttgaaatatgaaacccaagtaaaatgctcaggaatctggagtagaatccaggtatctgccaaaggaaactttggacgagttgtcttttgaagaagggaaacaatgctgggtctcttatcttcacggactgtttttgcttgtcaaacttctaacatcacttcagccgagtttcgtatttgacttccaacctcatggccatttgacctgccaactactatttttctttgaggcttttaacaccccacccaagtattttgctttccagattgtgtgcgtttccttttcacttcaccttaaagtcagcctgggtttacaacatcggcttaaggcgcaccctctaaggtttcagacagacccagggcaccgcggtgatgacctgaagctgatatctctcggcaaagccaaggtatccgggaggttctccgcgttgtgccaggatttccatccaacccgagagtctcagggcagaggccaggcccccagcgtccgactcccaggggtcccagccccctcccctggctgaccatgcgggctgggacctcccagccggaaaacaccgccctttcctgtcgcctactccttccccaggccgacgactcgcggaggaggaagagacggaggccgatttaagaaaattagcattcattaacccggttcacgctcgggccccggcggaggggaggggcgcgccgggcggcggcgctggcggtggccgggtgaccggcgggcgcaggtgccaccgcggcctgaattttactctctcgggccggcagctgcgccacttgcgcctcgtcgcgcgtctggggcagccgccaccggcttgccccagctttaggcaaatccttttgaaagaccctgagggagaagaaacgcctccctctgggtaggagaacctgtagcgtctgctgttcgtcgcgtgtccagttgctcagccgggagctccggcatcttcagggcgctcattccactctccgggttttggctgcagctctgaggggagcgagctagaaactgacagaacgcgaccctccccctccgcgcccaccggagcccgggctgagagggacctggggagctgcggcctggccggggcggcgcactcaggtggcctcgcttccctgcgggtcaccgcccgccactcgcacagctaggtcggcctgttgggatcgggagaggtgggcgcacgagttttagtgcgggagtccggggtgcgggcggagtcctattgtccccgtgcacccgggcggcagcacctccgggtccctctttaaaccgagcgtccggcgacctttctttgtgcttagggagtcgaaagcggcatcttctccgagagaagtcgcctactggggggtggcgctggggaggtaacaatgggcgcccattgtcctccgagggtccaacggtgaccccccccgctgcgcacgcgcccggccaccggttggccccgggccagggcacaggtaccgcggccgggagggtcggccccgctgcccgcgccctccgccccgccccagtgagtccccgcgccgccggccccgccccgcgccgccccgccctccgcaggttcagtcctcgcgtccggccgccccgcgctcagtcgcgcgcaccttctctcgcggccgggggaccgcagcgcggggctagcccggagacccggccaccggcctggggcgccttcacgccgtctcggagcggataatgcggtgagcaggcaccacgccggcagactcggctggatctgcgcacagcggcagggattgcgtgcgcccgcgggaggcccggggcagcggctgggatcctcagcggcggccggtttgtcctggttgtggtcaagactggatgatgtaactggctctctaggaagcctcacttggccgtaacctcaggaaggttctctttgaccccatctcatttcgaagccacttctgaagccacttgagaaaaatgatgtgacagttcctatcaaaaaggattcagaaacatataccatctgtgaagaaagtggccctttctcccgcttgcaaaatagacattctcaaattccaaaatgccagccaagaccccaatttacctgaaagcagccaataacaagaaaggaaagaaatttaaactgagggacattctgtctcctgatatgatcagtcccccgcttggagactttcgccacaccatccacattggcaaagagggccagcacgatgtctttggagatatttcctttcttcaagggaactacgagcttttacctggaaaccaggagaaagcacacctgggccagttccctgggcataatgagttcttccgggccaacagcacctcggactctgtgttcacagaaacgccctccccggtgctcaaaaatgccatctccctcccgaccattggaggatcccaagctctcatgttgcccttattgtcaccagtgacatttaattccaaacaggagtccttcgggccagcaaagctgcccaggcttagctgcgagcccgtcatggaggaaaaagctcaggagaaaagcagtctgttggagaatgggacagtccaccagggagacacctcgtggggctccagcggttctgcatctcagtccagccaaggcagagacagccactcctccagcctgtccgaacagtaccccgactggccagccgaggacatgtttgaccatcccaccccatgcgagctcatcaagggaaagactaagtcagaggagtccctctctgaccttacaggttccctcctctccctgcagcttgatcttgggccctcacttttggatgaggtgctgaatgtaatggataaaaataagtaacaagatgccaacttttttcctttggggtaaaaggtacaaaaacaaactaaccacagttgaagagaagggcttccggagctgtatttgcagttttgtgttgggttttctaaaataatattcttacaaagtatttttttacctgttatgccctgtttgcaaaaacaatttagaaaaaaacaacaaagcaaaacctatcttggcaaaaaaaggaagtgagtcagagcccattttcaggaggcattggtgatgttcggctcacatattgtttgcagacacacaagaaatctggcttggccaggattggcactagctatgaagggctgagcgagtcacattaaggaacttcacggaactttatagcactccgacattttctgagcaagaggaagtcaaaatttatttaacacctaagcctttttgtagactcttttctatatattgcttaggctcaccatagcgaattctccagtgttaaaacttttctgttttcacatttgaactttatgggttttggggattttcttgtagttcttatatatccctatatattatatctatattgcaaaattttgactgtcagctacatgttggtaagacacaggcaaagtattactgtaactaagttatttttaaagttaaaatatatttttacgtgcctttggctttttattgcagagtctacattttatagattctacatcagatgttgtcacttatttccattgggattccattgtaagctgtgtatgtgcgtgtttggaaaagtgtattcatacttagtttttttttcttcatctgttatcatacttttaacagcaaccaataacggattgtaaagtgtaaaggcacaggttactcatgatgcttctgcagagactgtgggctacaccacatatgttatttggaaatataggtattttagtacagtacatacttgcattacataggtacttcaagcaacacaataaaaagtaaatgataaagtgaacttgcttgtttatagtaataaacaagaccataagagaataagtatagctagagaaattgcttctctgaaatgtacatgagcccttaaggtaagagatgatttccatctactctcattttgattacttccttatggtttgagaggctagaaactgagcctctctacttttggaaaaatgaacatgtgaggtcagatttttttttttttttttaagtcagcactgatgccaccctctcaggggtcatttctgagcatcttcctgacttgaacaccttctacagcaaactcttgcaagtccagtttcatccctgtaaggcaaatgtcttttcacgcagaaagtgccatatagacgagataaaggcagctaaaacgagggcagtagagagcacttacccgaccccaaggtgccagagatgccctgaggatggtggttaaggaaacaggagcaggaaatgtacacacagattcctgtccctttgccaactactccttccccatcaaagaaaaacacttgcacacagtaactaccagctccttctctcaaacttgtatttctcctggaaatgtatctcagaaatgacctcctctcccaaccacttcaacgattctttctttgggtttggggttcttgcagttctatcatctaaaataacctttggactgcaggtaaaatgcaattaggacaactaaccaagtagacgaaacaagttcccctaggcaggggtgtccaatattttagcttccctggaccgcattggaagaattttcttgggccacatgtaaaacacactaacactaaccatagttgatgagcttaaaaaaataaaaatagaaaattgcaaaaaaaaaaaaaaaaaatctcagactgttttaagaaagtttaaaaatttgtgttggacttcatgcgggccacaggttggacaagcttgccctagggcattgtgtgctttccgtaacttctcagttgtatttcgttatccatgactctccagtgttttttctgttggaccacacccgtcacagttcacagttccaaacagaaatttcccagcctattctaaatcttgttaatgacgaagagtccaatgtatctcattatttgtagccaattttagactcttttcaatacctcccccccattttaattagtattgatcatattcagtctttcattttactcttcatctgtagcgtgacctcaaggtaaagatgaaactatttcatgaaaaggggaggagtatggctgtgcattagctctactccctctctggtaagtactggggagagaacagccctgccagtactgggtttgatagattctaaatattaatcacacatcctgcctacagttagccattttagtttctgggagttctttcatgtacattttcttccattaattgaattaggtataattgagatggcaataaatatgcccgtattagaaagaggaaacaaagctacatgcggcttatgattttgttgagtcacttctcccgaggcagcctttccaatgcctggtcccttcccctgagagcaggtggactgctggtggtggctttctttcctgcagagaggcactttagacccatacctgctgtgagctgaattgatgttctcatcctgtgaaccttctcccactttaacctaatttatctttacttgtttaaagataaggaaacccaagatgtactttatttgcaaactcaaagcaaatggcgagccacctgtgacccagtaaccagaaaagaaaccatgccatttgtgtaagtagagacacttcttgttgaggtaggcaaggctcttgtgagcgatttttttcccctagtgagacctaacaaaagacaagctatatcatttctgcctgaaattatctgcttgaaaagatcaaaatatcaggatacttagctcttcacaaatatgaagtcattatcacatttcactgagccagaaatcactgttaacagcacacacaaaagactacactggttgaacagcaaagagaaacccgggtctccagaatcacagtttagtccttctatattactgcaagtgacctgttttttctgaaggctccccgcaaatgaagtcctggaatggaaaaaatccataagtccataaattaacttgataaatattttagaacagacaaaagaaaatattgagtgatgtagttctaatcctcctaatatggaacctggcaagactgaatcattttactgtgaaatatataaacacaatagaatgagccaacatgatggtttctctccagtaagagtttttcttttggaaatgaggttaacctagccccaaatctagcaattctcataaaatccgattttagaattagcctcccagattaatctgaatgattgacttattttttcttaggcaagtcagtaagccacccactagacagccatatccagcaaaataagagaagtttccagatgccaaatgataagccaccatcaacccagcggggaagccttctggttggtttggctgtatgagattcaggaaggccagaatacccaaaattattcacacgacgttaacttattggtactggctaagcaatacatgtatttcctaaaggaggagatggtcttttggttgatttatggacacacttgtttcatctgactgtaaatatattgcatgctttattctgatggtgcactatttcatccagcaagcttttcatctgagaatgtttaatgttgaccttattcttagagcaagtagatctaaatatttttcagctgagttattagggagtcattattctgtggtacaatgctgcaaaaagcatcatgtggaagaatgggaactatgcttactttatgaagtgatgtataacacaatgaaatctgttttacaactac

SEQ ID NO: 417769 - DNA, 4727 bp, Homo sapiens
ttttctaagtaggccaggaacatttaatatttttcaataaattaatatataaaatatatacattagtgccaaatggaacatatattttgaaatatgaaacccaagtaaaatgctcaggaatctggagtagaatccaggtatctgccaaaggaaactttggacgagttgtcttttgaagaagggaaacaatgctgggtctcttatcttcacggactgtttttgcttgtcaaacttctaacatcacttcagccgagtttcgtatttgacttccaacctcatggccatttgacctgccaactactatttttctttgaggcttttaacaccccacccaagtattttgctttccagattgtgtgcgtttccttttcacttcaccttaaagtcagcctgggtttacaacatcggcttaaggcgcaccctctaaggtttcagacagacccagggcaccgcggtgatgacctgaagctgatatctctcggcaaagccaaggtatccgggaggttctccgcgttgtgccaggatttccatccaacccgagagtctcagggcagaggccaggcccccagcgtccgactcccaggggtcccagccccctcccctggctgaccatgcgggctgggacctcccagccggaaaacaccgccctttcctgtcgcctactccttccccaggccgacgactcgcggaggaggaagagacggaggccgatttaagaaaattagcattcattaacccggttcacgctcgggccccggcggaggggaggggcgcgccgggcggcggcgctggcggtggccgggtgaccggcgggcgcaggtgccaccgcggcctgaattttactctctcgggccggcagctgcgccacttgcgcctcgtcgcgcgtctggggcagccgccaccggcttgccccagctttaggcaaatccttttgaaagaccctgagggagaagaaacgcctccctctgggtaggagaacctgtagcgtctgctgttcgtcgcgtgtccagttgctcagccgggagctccggcatcttcagggcgctcattccactctccgggttttggctgcagctctgaggggagcgagctagaaactgacagaacgcgaccctccccctccgcgcccaccggagcccgggctgagagggacctggggagctgcggcctggccggggcggcgcactcaggtggcctcgcttccctgcgggtcaccgcccgccactcgcacagctaggtcggcctgttgggatcgggagaggtgggcgcacgagttttagtgcgggagtccggggtgcgggcggagtcctattgtccccgtgcacccgggcggcagcacctccgggtccctctttaaaccgagcgtccggcgacctttctttgtgcttagggagtcgaaagcggcatcttctccgagagaagtcgcctactggggggtggcgctggggaggtaacaatgggcgcccattgtcctccgagggtccaacggtgaccccccccgctgcgcacgcgcccggccaccggttggccccgggccagggcacaggtaccgcggccgggagggtcggccccgctgcccgcgccctccgccccgccccagtgagtccccgcgccgccggccccgccccgcgccgccccgccctccgcaggttcagtcctcgcgtccggccgccccgcgctcagtcgcgcgcaccttctctcgcggccgggggaccgcagcgcggggctagcccggagacccggccaccggcctggggcgccttcacgccgtctcggagcggataatgcggtgagcaggcaccacgccggcagactcggctggatctgcgcacagcggcagggattgcgtgcgcccgcgggaggcccggggcagcggctgggatcctcagcggcggccggtttgtcctggttgtggtcaagactggatgatgtaactggctctctaggaagcctcacttggccgtaacctcaggaaggttctctttgaccccatctcatttcgaagccacttctgaagccacttgagaaaaatgatgtgacagttcctatcaaaaaggattcagaaacatataccatctgtgaagaaagtggccctttctcccgcttgcaaaatagacattctcaaattccaaaatgccagccaagaccccaatttacctgaaagcagccaataacaagaaaggaaagaaatttaaactgagggacattctgtctcctgatatgatcagtcccccgcttggagactttcgccacaccatccacattggcaaagagggccagcacgatgtctttggagatatttcctttcttcaagggaactacgagcttttacctggaaaccaggagaaagcacacctgggccagttccctgggcataatgagttcttccgggccaacagcacctcggactctgtgttcacagaaacgccctccccggtgctcaaaaatgccatctccctcccgaccattggaggatcccaagctctcatgttgcccttattgtcaccagtgacatttaattccaaacaggagtccttcgggccagcaaagctgcccaggcttagctgcgagcccgtcatggaggaaaaagctcaggagaaaagcagtctgttggagaatgggacagtccaccagggagacacctcgtggggctccagcggttctgcatctcagtccagccaaggcagagacagccactcctccagcctgtccgaacagtaccccgactggccagccgaggacatgtttgaccatcccaccccatgcgagctcatcaagggaaagactaagtcagaggagtccctctctgaccttacaggttccctcctctccctgcagcttgatcttgggccctcacttttggatgaggtgctgaatgtaatggataaaaataagtaacaagatgccaacttttttcctttggggtaaaaggtacaaaaacaaactaaccacagttgaagagaagggcttccggagctgtatttgcagttttgtgttgggttttctaaaataatattcttacaaagtatttttttacctgttatgccctgtttgcaaaaacaatttagaaaaaaacaacaaagcaaaacctatcttggcaaaaaaaggaagtgagtcagagcccattttcaggaggcattggtgatgttcggctcacatattgtttgcagacacacaagaaatctggcttggccaggattggcactagctatgaagggctgagcgagtcacattaaggaacttcacggaactttatagcactccgacattttctgagcaagaggaagtcaaaatttatttaacacctaagcctttttgtagactcttttctatatattgcttaggctcaccatagcgaattctccagtgttaaaacttttctgttttcacatttgaactttatgggttttggggattttcttgtagttcttatatatccctatatattatatctatattgcaaaattttgactgtcagctacatgttggtaagacacaggcaaagtattactgtaactaagttatttttaaagttaaaatatatttttacgtgcctttggctttttattgcagagtctacattttatagattctacatcagatgttgtcacttatttccattgggattccattgtaagctgtgtatgtgcgtgtttggaaaagtgtattcatacttagtttttttttcttcatctgttatcatacttttaacagcaaccaataacggattgtaaagtgtaaaggcacaggttactcatgatgcttctgcagagactgtgggctacaccacatatgttatttggaaatataggtattttagtacagtacatacttgcattacataggtacttcaagcaacacaataaaaagtaaatgataaagtgaacttgcttgtttatagtaataaacaagaccataagagaataagtatagctagagaaattgcttctctgaaatgtacatgagcccttaaggtaagagatgatttccatctactctcattttgattacttccttatggtttgagaggctagaaactgagcctctctacttttggaaaaatgaacatgtgaggtcagatttttttttttttttttaagtcagcactgatgccaccctctcaggggtcatttctgagcatcttcctgacttgaacaccttctacagcaaactcttgcaagtccagtttcatccctgtaaggcaaatgtcttttcacgcagaaagtgccatatagacgagataaaggcagctaaaacgagggcagtagagagcacttacccgaccccaaggtgccagagatgccctgaggatggtggttaaggaaacaggagcaggaaatgtacacacagattcctgtccctttgccaactactccttccccatcaaagaaaaacacttgcacacagtaactaccagctccttctctcaaacttgtatttctcctggaaatgtatctcagaaatgacctcctctcccaaccacttcaacgattctttctttgggtttggggttcttgcagttctatcatctaaaataacctttggactgcaggtaaaatgcaattaggacaactaaccaagtagacgaaacaagttcccctaggcaggggtgtccaatattttagcttccctggaccgcattggaagaattttcttgggccacatgtaaaacacactaacactaaccatagttgatgagcttaaaaaaataaaaatagaaaattgca

SEQ ID NO: 417770 - DNA, 4605 bp, Homo sapiens
ttttctaagtaggccaggaacatttaatatttttcaataaattaatatataaaatatatacattagtgccaaatggaacatatattttgaaatatgaaacccaagtaaaatgctcaggaatctggagtagaatccaggtatctgccaaaggaaactttggacgagttgtcttttgaagaagggaaacaatgctgggtctcttatcttcacggactgtttttgcttgtcaaacttctaacatcacttcagccgagtttcgtatttgacttccaacctcatggccatttgacctgccaactactatttttctttgaggcttttaacaccccacccaagtattttgctttccagattgtgtgcgtttccttttcacttcaccttaaagtcagcctgggtttacaacatcggcttaaggcgcaccctctaaggtttcagacagacccagggcaccgcggtgatgacctgaagctgatatctctcggcaaagccaaggtatccgggaggttctccgcgttgtgccaggatttccatccaacccgagagtctcagggcagaggccaggcccccagcgtccgactcccaggggtcccagccccctcccctggctgaccatgcgggctgggacctcccagccggaaaacaccgccctttcctgtcgcctactccttccccaggccgacgactcgcggaggaggaagagacggaggccgatttaagaaaattagcattcattaacccggttcacgctcgggccccggcggaggggaggggcgcgccgggcggcggcgctggcggtggccgggtgaccggcgggcgcaggtgccaccgcggcctgaattttactctctcgggccggcagctgcgccacttgcgcctcgtcgcgcgtctggggcagccgccaccggcttgccccagctttaggcaaatccttttgaaagaccctgagggagaagaaacgcctccctctgggtaggagaacctgtagcgtctgctgttcgtcgcgtgtccagttgctcagccgggagctccggcatcttcagggcgctcattccactctccgggttttggctgcagctctgaggggagcgagctagaaactgacagaacgcgaccctccccctccgcgcccaccggagcccgggctgagagggacctggggagctgcggcctggccggggcggcgcactcaggtggcctcgcttccctgcgggtcaccgcccgccactcgcacagctaggtcggcctgttgggatcgggagaggtgggcgcacgagttttagtgcgggagtccggggtgcgggcggagtcctattgtccccgtgcacccgggcggcagcacctccgggtccctctttaaaccgagcgtccggcgacctttctttgtgcttagggagtcgaaagcggcatcttctccgagagaagtcgcctactggggggtggcgctggggaggtaacaatgggcgcccattgtcctccgagggtccaacggtgaccccccccgctgcgcacgcgcccggccaccggttggccccgggccagggcacaggtaccgcggccgggagggtcggccccgctgcccgcgccctccgccccgccccagtgagtccccgcgccgccggccccgccccgcgccgccccgccctccgcaggttcagtcctcgcgtccggccgccccgcgctcagtcgcgcgcaccttctctcgcggccgggggaccgcagcgcggggctagcccggagacccggccaccggcctggggcgccttcacgccgtctcggagcggataatgcggtgagcaggcaccacgccggcagactcggctggatctgcgcacagcggcagggattgcgtgcgcccgcgggaggcccggggcagcggctgggatcctcagcggcggccggtttgtcctggttgtggtcaagactggatgatgtaactggctctctaggaagcctcacttggccgtaacctcaggaaggttctctttgaccccatctcatttcgaagccacttctgaagccacttgagaaaaatgatgtgacagttcctatcaaaaaggattcagaaacatataccatctgtgaagaaagtggccctttctcccgcttgcaaaatagacattctcaaattccaaaatgccagccaagaccccaatttacctgaaagcagccaataacaagaaaggaaagaaatttaaactgagggacattctgtctcctgatatgatcagtcccccgcttggagactttcgccacaccatccacattggcaaagagggccagcacgatgtctttggagatatttcctttcttcaagggaactacgagcttttacctggaaaccaggagaaagcacacctgggccagttccctgggcataatgagttcttccgggccaacagcacctcggactctgtgttcacagaaacgccctccccggtgctcaaaaatgccatctccctcccgaccattggaggatcccaagctctcatgttgcccttattgtcaccagtgacatttaattccaaacaggagtccttcgggccagcaaagctgcccaggcttagctgcgagcccgtcatggaggaaaaagctcaggagaaaagcagtctgttggagaatgggacagtccaccagggagacacctcgtggggctccagcggttctgcatctcagtccagccaaggcagagacagccactcctccagcctgtccgaacagtaccccgactggccagccgaggacatgtttgaccatcccaccccatgcgagctcatcaagggaaagactaagtcagaggagtccctctctgaccttacaggttccctcctctccctgcagcttgatcttgggccctcacttttggatgaggtgctgaatgtaatggataaaaataagtaacaagatgccaacttttttcctttggggtaaaaggtacaaaaacaaactaaccacagttgaagagaagggcttccggagctgtatttgcagttttgtgttgggttttctaaaataatattcttacaaagtatttttttacctgttatgccctgtttgcaaaaacaatttagaaaaaaacaacaaagcaaaacctatcttggcaaaaaaaggaagtgagtcagagcccattttcaggaggcattggtgatgttcggctcacatattgtttgcagacacacaagaaatctggcttggccaggattggcactagctatgaagggctgagcgagtcacattaaggaacttcacggaactttatagcactccgacattttctgagcaagaggaagtcaaaatttatttaacacctaagcctttttgtagactcttttctatatattgcttaggctcaccatagcgaattctccagtgttaaaacttttctgttttcacatttgaactttatgggttttggggattttcttgtagttcttatatatccctatatattatatctatattgcaaaattttgactgtcagctacatgttggtaagacacaggcaaagtattactgtaactaagttatttttaaagttaaaatatatttttacgtgcctttggctttttattgcagagtctacattttatagattctacatcagatgttgtcacttatttccattgggattccattgtaagctgtgtatgtgcgtgtttggaaaagtgtattcatacttagtttttttttcttcatctgttatcatacttttaacagcaaccaataacggattgtaaagtgtaaaggcacaggttactcatgatgcttctgcagagactgtgggctacaccacatatgttatttggaaatataggtattttagtacagtacatacttgcattacataggtacttcaagcaacacaataaaaagtaaatgataaagtgaacttgcttgtttatagtaataaacaagaccataagagaataagtatagctagagaaattgcttctctgaaatgtacatgagcccttaaggtaagagatgatttccatctactctcattttgattacttccttatggtttgagaggctagaaactgagcctctctacttttggaaaaatgaacatgtgaggtcagacttaatactttaatatattgaaaagtaagcattgatgtcaacccatctcaagagagtcaaatcatgaagatcttccatgactttgaacaacattctaaaagaaacattttgtaaagtaagaaaaaaccggtgaagcaaaggtatatacacaaaaagtgcataagaaacagaaaaaaggaagaaacacacagatagagacacagagaataactgactccaagaggtacgaaagagacaagagaatgatcggaaagaaccaaggagcaggatccaggaagaccagcagacagtggaccaagagatagaacagaacgtctagagagaagagatagagataagaagaagaagaataagagagtcagaaaggtgagatccgtagggtgacaagtacagctctaaagcagagagccaaagggaagtcaagataataccaaaaagagtaggaggagaaagacacagcgagtagagataaatagcagatagtaaaagagacgaactgatattcgcgtgctctatcaatagggg

SEQ ID NO: 417771 - DNA, 6092 bp, Homo sapiens
ttttctaagtaggccaggaacatttaatatttttcaataaattaatatataaaatatatacattagtgccaaatggaacatatattttgaaatatgaaacccaagtaaaatgctcaggaatctggagtagaatccaggtatctgccaaaggaaactttggacgagttgtcttttgaagaagggaaacaatgctgggtctcttatcttcacggactgtttttgcttgtcaaacttctaacatcacttcagccgagtttcgtatttgacttccaacctcatggccatttgacctgccaactactatttttctttgaggcttttaacaccccacccaagtattttgctttccagattgtgtgcgtttccttttcacttcaccttaaagtcagcctgggtttacaacatcggcttaaggcgcaccctctaaggtttcagacagacccagggcaccgcggtgatgacctgaagctgatatctctcggcaaagccaaggtatccgggaggttctccgcgttgtgccaggatttccatccaacccgagagtctcagggcagaggccaggcccccagcgtccgactcccaggggtcccagccccctcccctggctgaccatgcgggctgggacctcccagccggaaaacaccgccctttcctgtcgcctactccttccccaggccgacgactcgcggaggaggaagagacggaggccgatttaagaaaattagcattcattaacccggttcacgctcgggccccggcggaggggaggggcgcgccgggcggcggcgctggcggtggccgggtgaccggcgggcgcaggtgccaccgcggcctgaattttactctctcgggccggcagctgcgccacttgcgcctcgtcgcgcgtctggggcagccgccaccggcttgccccagctttaggcaaatccttttgaaagaccctgagggagaagaaacgcctccctctgggtaggagaacctgtagcgtctgctgttcgtcgcgtgtccagttgctcagccgggagctccggcatcttcagggcgctcattccactctccgggttttggctgcagctctgaggggagcgagctagaaactgacagaacgcgaccctccccctccgcgcccaccggagcccgggctgagagggacctggggagctgcggcctggccggggcggcgcactcaggtggcctcgcttccctgcgggtcaccgcccgccactcgcacagctaggtcggcctgttgggatcgggagaggtgggcgcacgagttttagtgcgggagtccggggtgcgggcggagtcctattgtccccgtgcacccgggcggcagcacctccgggtccctctttaaaccgagcgtccggcgacctttctttgtgcttagggagtcgaaagcggcatcttctccgagagaagtcgcctactggggggtggcgctggggaggtaacaatgggcgcccattgtcctccgagggtccaacggtgaccccccccgctgcgcacgcgcccggccaccggttggccccgggccagggcacaggtaccgcggccgggagggtcggccccgctgcccgcgccctccgccccgccccagtgagtccccgcgccgccggccccgccccgcgccgccccgccctccgcaggttcagtcctcgcgtccggccgccccgcgctcagtcgcgcgcaccttctctcgcggccgggggaccgcagcgcggggctagcccggagacccggccaccggcctggggcgccttcacgccgtctcggagcggataatgcggtgagcaggcaccacgccggcagactcggctggatctgcgcacagcggcagggattgcgtgcgcccgcgggaggcccggggcagcggctgggatcctcagcggcggccggtttgtcctggttgtggtcaagactggatgatgtaactggctctctaggaagcctcacttggccgtaacctcaggaaggttctctttgaccccatctcatttcgaagccacttctgaagccacttgagaaaaatgatgtgacagttcctatcaaaaaggattcagaaacatataccatctgtgaagaaagtggccctttctcccgcttgcaaaatagacattctcaaattccaaaatgccagccaagaccccaatttacctgaaagcagccaataacaagaaaggaaagaaatttaaactgagggacattctgtctcctgatatgatcagtcccccgcttggagactttcgccacaccatccacattggcaaagagggccagcacgatgtctttggagatatttcctttcttcaagggaactacgagcttttacctggaaaccaggagaaagcacacctgggccagttccctgggcataatgagttcttccgggccaacagcacctcggactctgtgttcacagaaacgccctccccggtgctcaaaaatgccatctccctcccgaccattggaggatcccaagctctcatgttgcccttattgtcaccagtgacatttaattccaaactatgaagggctgagcgagtcacattaaggaacttcacggaactttatagcactccgacattttctgagcaagaggaagtcaaaatttatttaacacctaagcctttttgtagactcttttctatatattgcttaggctcaccatagcgaattctccagtgttaaaacttttctgttttcacatttgaactttatgggttttggggattttcttgtagttcttatatatccctatatattatatctatattgcaaaattttgactgtcagctacatgttggtaagacacaggcaaagtattactgtaactaagttatttttaaagttaaaatatatttttacgtgcctttggctttttattgcagagtctacattttatagattctacatcagatgttgtcacttatttccattgggattccattgtaagctgtgtatgtgcgtgtttggaaaagtgtattcatacttagtttttttttcttcatctgttatcatacttttaacagcaaccaataacggattgtaaagtgtaaaggcacaggttactcatgatgcttctgcagagactgtgggctacaccacatatgttatttggaaatataggtattttagtacagtacatacttgcattacataggtacttcaagcaacacaataaaaagtaaatgataaagtgaacttgcttgtttatagtaataaacaagaccataagagaataagtatagctagagaaattgcttctctgaaatgtacatgagcccttaaggtaagagatgatttccatctactctcattttgattacttccttatggtttgagaggctagaaactgagcctctctacttttggaaaaatgaacatgtgaggtcagatttttttttttttttttaagtcagcactgatgccaccctctcaggggtcatttctgagcatcttcctgacttgaacaccttctacagcaaactcttgcaagtccagtttcatccctgtaaggcaaatgtcttttcacgcagaaagtgccatatagacgagataaaggcagctaaaacgagggcagtagagagcacttacccgaccccaaggtgccagagatgccctgaggatggtggttaaggaaacaggagcaggaaatgtacacacagattcctgtccctttgccaactactccttccccatcaaagaaaaacacttgcacacagtaactaccagctccttctctcaaacttgtatttctcctggaaatgtatctcagaaatgacctcctctcccaaccacttcaacgattctttctttgggtttggggttcttgcagttctatcatctaaaataacctttggactgcaggtaaaatgcaattaggacaactaaccaagtagacgaaacaagttcccctaggcaggggtgtccaatattttagcttccctggaccgcattggaagaattttcttgggccacatgtaaaacacactaacactaaccatagttgatgagcttaaaaaaataaaaatagaaaattgcaaaaaaaaaaaaaaaaaatctcagactgttttaagaaagtttaaaaatttgtgttggacttcatgcgggccacaggttggacaagcttgccctagggcattgtgtgctttccgtaacttctcagttgtatttcgttatccatgactctccagtgttttttctgttggaccacacccgtcacagttcacagttccaaacagaaatttcccagcctattctaaatcttgttaatgacgaagagtccaatgtatctcattatttgtagccaattttagactcttttcaatacctcccccccattttaattagtattgatcatattcagtctttcattttactcttcatctgtagcgtgacctcaaggtaaagatgaaactatttcatgaaaaggggaggagtatggctgtgcattagctctactccctctctggtaagtactggggagagaacagccctgccagtactgggtttgatagattctaaatattaatcacacatcctgcctacagttagccattttagtttctgggagttctttcatgtacattttcttccattaattgaattaggtataattgagatggcaataaatatgcccgtattagaaagaggaaacaaagctacatgcggcttatgattttgttgagtcacttctcccgaggcagcctttccaatgcctggtcccttcccctgagagcaggtggactgctggtggtggctttctttcctgcagagaggcactttagacccatacctgctgtgagctgaattgatgttctcatcctgtgaaccttctcccactttaacctaatttatctttacttgtttaaagataaggaaacccaagatgtactttatttgcaaactcaaagcaaatggcgagccacctgtgacccagtaaccagaaaagaaaccatgccatttgtgtaagtagagacacttcttgttgaggtaggcaaggctcttgtgagcgatttttttcccctagtgagacctaacaaaagacaagctatatcatttctgcctgaaattatctgcttgaaaagatcaaaatatcaggatacttagctcttcacaaatatgaagtcattatcacatttcactgagccagaaatcactgttaacagcacacacaaaagactacactggttgaacagcaaagagaaacccgggtctccagaatcacagtttagtccttctatattactgcaagtgacctgttttttctgaaggctccccgcaaatgaagtcctggaatggaaaaaatccataagtccataaattaacttgataaatattttagaacagacaaaagaaaatattgagtgatgtagttctaatcctcctaatatggaacctggcaagactgaatcattttactgtgaaatatataaacacaatagaatgagccaacatgatggtttctctccagtaagagtttttcttttggaaatgaggttaacctagccccaaatctagcaattctcataaaatccgattttagaattagcctcccagattaatctgaatgattgacttattttttcttaggcaagtcagtaagccacccactagacagccatatccagcaaaataagagaagtttccagatgccaaatgataagccaccatcaacccagcggggaagccttctggttggtttggctgtatgagattcaggaaggccagaatacccaaaattattcacacgacgttaacttattggtactggctaagcaatacatgtatttcctaaaggaggagatggtcttttggttgatttatggacacacttgtttcatctgactgtaaatatattgcatgctttattctgatggtgcactatttcatccagcaagcttttcatctgagaatgtttaatgttgaccttattcttagagcaagtagatctaaatatttttcagctgagttattagggagtcattattctgtggtacaatgctgcaaaaagcatcatgtggaagaatgggaactatgcttactttatgaagtgatgtataacacaatgaaatctgttttacaactac

SEQ ID NO: 417772 - DNA, 445 bp, Homo sapiens
ctgtatgagattcaggaaggccagaatacccaaaattattcacacgacgttaacttattggtactggctaagcaatacatgtatttcctaaaggaggagatggtcttttggttgatttatggacacacttgtttcatctgactgtaaatatattgcatgctttattctgatggtgcactatttcatccagcaagcttttcatctgagaatgtttaatgttgaccttattcttagagcaagtagatctaaatatttttcagctgagttattagggagtcattattctgtggtacaatgctgcaaaaagcatcatgtggaagaatgggaactatgcttactttatgaagtgatgtataacacaatgaaatctgttttacaactactgtgctgcatttaattatcttccatttttgctgttaaaaaaaaaaaatccgttaatgatgtc

SEQ ID NO: 417773 - DNA, 3879 bp, Homo sapiens
ttttctaagtaggccaggaacatttaatatttttcaataaattaatatataaaatatatacattagtgccaaatggaacatatattttgaaatatgaaacccaagtaaaatgctcaggaatctggagtagaatccaggtatctgccaaaggaaactttggacgagttgtcttttgaagaagggaaacaatgctgggtctcttatcttcacggactgtttttgcttgtcaaacttctaacatcacttcagccgagtttcgtatttgacttccaacctcatggccatttgacctgccaactactatttttctttgaggcttttaacaccccacccaagtattttgctttccagattgtgtgcgtttccttttcacttcaccttaaagtcagcctgggtttacaacatcggcttaaggcgcaccctctaaggtttcagacagacccagggcaccgcggtgatgacctgaagctgatatctctcggcaaagccaaggtatccgggaggttctccgcgttgtgccaggatttccatccaacccgagagtctcagggcagaggccaggcccccagcgtccgactcccaggggtcccagccccctcccctggctgaccatgcgggctgggacctcccagccggaaaacaccgccctttcctgtcgcctactccttccccaggccgacgactcgcggaggaggaagagacggaggccgatttaagaaaattagcattcattaacccggttcacgctcgggccccggcggaggggaggggcgcgccgggcggcggcgctggcggtggccgggtgaccggcgggcgcaggtgccaccgcggcctgaattttactctctcgggccggcagctgcgccacttgcgcctcgtcgcgcgtctggggcagccgccaccggcttgccccagctttaggcaaatccttttgaaagaccctgagggagaagaaacgcctccctctgggtaggagaacctgtagcgtctgctgttcgtcgcgtgtccagttgctcagccgggagctccggcatcttcagggcgctcattccactctccgggttttggctgcagctctgaggggagcgagctagaaactgacagaacgcgaccctccccctccgcgcccaccggagcccgggctgagagggacctggggagctgcggcctggccggggcggcgcactcaggtggcctcgcttccctgcgggtcaccgcccgccactcgcacagctaggtcggcctgttgggatcgggagaggtgggcgcacgagttttagtgcgggagtccggggtgcgggcggagtcctattgtccccgtgcacccgggcggcagcacctccgggtccctctttaaaccgagcgtccggcgacctttctttgtgcttagggagtcgaaagcggcatcttctccgagagaagtcgcctactggggggtggcgctggggaggtaacaatgggcgcccattgtcctccgagggtccaacggtgaccccccccgctgcgcacgcgcccggccaccggttggccccgggccagggcacaggtaccgcggccgggagggtcggccccgctgcccgcgccctccgccccgccccagtgagtccccgcgccgccggccccgccccgcgccgccccgccctccgcaggttcagtcctcgcgtccggccgccccgcgctcagtcgcgcgcaccttctctcgcggccgggggaccgcagcgcggggctagcccggagacccggccaccggcctggggcgccttcacgccgtctcggagcggataatgcggtgagcaggcaccacgccggcagactcggctggatctgcgcacagcggcagggattgcgtgcgcccgcgggaggcccggggcagcggctgggatcctcagcggcggccggtttgtcctggttgtggtcaagactggatgatgtaactggctctctaggaagcctcacttggccgtaacctcaggaaggttctctttgaccccatctcatttcgaagccacttctgaagccacttgagaaaaatgatgtgacagttcctatcaaaaaggattcagaaacatataccatctgtgaagaaagtggccctttctcccgcttgcaaaatagacattctcaaattccaaaatgccagccaagaccccaatttacctgaaagcagccaataacaagaaaggaaagaaatttaaactgagggacattctgtctcctgatatgatcagtcccccgcttggagactttcgccacaccatccacattggcaaagagggccagcacgatgtctttggagatatttcctttcttcaagggaactacgagcttttacctggaaaccaggagaaagcacacctgggccagttccctgggcataatgagttcttccgggccaacagcacctcggactctgtgttcacagaaacgccctccccggtgctcaaaaatgccatctccctcccgaccattggaggatcccaagctctcatgttgcccttattgtcaccagtgacatttaattccaaacaggagtccttcgggccagcaaagctgcccaggcttagctgcgagcccgtcatggaggaaaaagctcaggagaaaagcagtctgttggagaatgggacagtccaccagggagacacctcgtggggctccagcggttctgcatctcagtccagccaaggcagagacagccactcctccagcctgtccgaacagtaccccgactggccagccgaggacatgtttgaccatcccaccccatgcgagctcatcaagggaaagactaagtcagaggagtccctctctgaccttacaggttccctcctctccctgcagcttgatcttgggccctcacttttggatgaggtgctgaatgtaatggataaaaataagtaacaagatgccaacttttttcctttggggtaaaaggtacaaaaacaaactaaccacagttgaagagaagggcttccggagctgtatttgcagttttgtgttgggttttctaaaataatattcttacaaagtatttttttacctgttatgccctgtttgcaaaaacaatttagaaaaaaacaacaaagcaaaacctatcttggcaaaaaaaggaagtgagtcagagcccattttcaggaggcattggtgatgttcggctcacatattgtttgcagacacacaagaaatctggcttggccaggattggcactagctatgaagggctgagcgagtcacattaaggaacttcacggaactttatagcactccgacattttctgagcaagaggaagtcaaaatttatttaacacctaagcctttttgtagactcttttctatatattgcttaggctcaccatagcgaattctccagtgttaaaacttttctgttttcacatttgaactttatgggttttggggattttcttgtagttcttatatatccctatatattatatctatattgcaaaattttgactgtcagctacatgttggtaagacacaggcaaagtattactgtaactaagttatttttaaagttaaaatatatttttacgtgcctttggctttttattgcagagtctacattttatagattctacatcagatgttgtcacttatttccattgggattccattgtaagctgtgtatgtgcgtgtttggaaaagtgtattcatacttagtttttttttcttcatctgttatcatacttttaacagcaaccaataacggattgtaaagtgtaaaggcacaggttactcatgatgcttctgcagagactgtgggctacaccacatatgttatttggaaatataggtattttagtacagtacatacttgcattacataggtacttcaagcaacacaataaaaagtaaatgata

SEQ ID NO: 417774 - DNA, 6752 bp, Homo sapiens
ttttctaagtaggccaggaacatttaatatttttcaataaattaatatataaaatatatacattagtgccaaatggaacatatattttgaaatatgaaacccaagtaaaatgctcaggaatctggagtagaatccaggtatctgccaaaggaaactttggacgagttgtcttttgaagaagggaaacaatgctgggtctcttatcttcacggactgtttttgcttgtcaaacttctaacatcacttcagccgagtttcgtatttgacttccaacctcatggccatttgacctgccaactactatttttctttgaggcttttaacaccccacccaagtattttgctttccagattgtgtgcgtttccttttcacttcaccttaaagtcagcctgggtttacaacatcggcttaaggcgcaccctctaaggtttcagacagacccagggcaccgcggtgatgacctgaagctgatatctctcggcaaagccaaggtatccgggaggttctccgcgttgtgccaggatttccatccaacccgagagtctcagggcagaggccaggcccccagcgtccgactcccaggggtcccagccccctcccctggctgaccatgcgggctgggacctcccagccggaaaacaccgccctttcctgtcgcctactccttccccaggccgacgactcgcggaggaggaagagacggaggccgatttaagaaaattagcattcattaacccggttcacgctcgggccccggcggaggggaggggcgcgccgggcggcggcgctggcggtggccgggtgaccggcgggcgcaggtgccaccgcggcctgaattttactctctcgggccggcagctgcgccacttgcgcctcgtcgcgcgtctggggcagccgccaccggcttgccccagctttaggcaaatccttttgaaagaccctgagggagaagaaacgcctccctctgggtaggagaacctgtagcgtctgctgttcgtcgcgtgtccagttgctcagccgggagctccggcatcttcagggcgctcattccactctccgggttttggctgcagctctgaggggagcgagctagaaactgacagaacgcgaccctccccctccgcgcccaccggagcccgggctgagagggacctggggagctgcggcctggccggggcggcgcactcaggtggcctcgcttccctgcgggtcaccgcccgccactcgcacagctaggtcggcctgttgggatcgggagaggtgggcgcacgagttttagtgcgggagtccggggtgcgggcggagtcctattgtccccgtgcacccgggcggcagcacctccgggtccctctttaaaccgagcgtccggcgacctttctttgtgcttagggagtcgaaagcggcatcttctccgagagaagtcgcctactggggggtggcgctggggaggtaacaatgggcgcccattgtcctccgagggtccaacggtgaccccccccgctgcgcacgcgcccggccaccggttggccccgggccagggcacaggtaccgcggccgggagggtcggccccgctgcccgcgccctccgccccgccccagtgagtccccgcgccgccggccccgccccgcgccgccccgccctccgcaggttcagtcctcgcgtccggccgccccgcgctcagtcgcgcgcaccttctctcgcggccgggggaccgcagcgcggggctagcccggagacccggccaccggcctggggcgccttcacgccgtctcggagcggataatgcggtgagcaggcaccacgccggcagactcggctggatctgcgcacagcggcagggattgcgtgcgcccgcgggaggcccggggcagcggctgggatcctcagcggcggccgactggatgatgtaactggctctctaggaagcctcacttggccgtaacctcaggaaggttctctttgaccccatctcatttcgaagccacttctgaagccacttgagaaaaatgatgtgacagttcctatcaaaaaggattcagaaacatataccatctgtgaagaaagtggccctttctcccgcttgcaaaatagacattctcaaattccaaaatgccagccaagaccccaatttacctgaaagcagccaataacaagaaaggaaagaaatttaaactgagggacattctgtctcctgatatgatcagtcccccgcttggagactttcgccacaccatccacattggcaaagagggccagcacgatgtctttggagatatttcctttcttcaagggaactacgagcttttacctggaaaccaggagaaagcacacctgggccagttccctgggcataatgagttcttccgggccaacagcacctcggactctgtgttcacagaaacgccctccccggtgctcaaaaatgccatctccctcccgaccattggaggatcccaagctctcatgttgcccttattgtcaccagtgacatttaattccaaacaggagtccttcgggccagcaaagctgcccaggcttagctgcgagcccgtcatggaggaaaaagctcaggagaaaagcagtctgttggagaatgggacagtccaccagggagacacctcgtggggctccagcggttctgcatctcagtccagccaaggcagagacagccactcctccagcctgtccgaacagtaccccgactggccagccgaggacatgtttgaccatcccaccccatgcgagctcatcaagggaaagactaagtcagaggagtccctctctgaccttacaggttccctcctctccctgcagcttgatcttgggccctcacttttggatgaggtgctgaatgtaatggataaaaataagtaacaagatgccaacttttttcctttggggtaaaaggtacaaaaacaaactaaccacagttgaagagaagggcttccggagctgtatttgcagttttgtgttgggttttctaaaataatattcttacaaagtatttttttacctgttatgccctgtttgcaaaaacaatttagaaaaaaacaacaaagcaaaacctatcttggcaaaaaaaggaagtgagtcagagcccattttcaggaggcattggtgatgttcggctcacatattgtttgcagacacacaagaaatctggcttggccaggattggcactagctatgaagggctgagcgagtcacattaaggaacttcacggaactttatagcactccgacattttctgagcaagaggaagtcaaaatttatttaacacctaagcctttttgtagactcttttctatatattgcttaggctcaccatagcgaattctccagtgttaaaacttttctgttttcacatttgaactttatgggttttggggattttcttgtagttcttatatatccctatatattatatctatattgcaaaattttgactgtcagctacatgttggtaagacacaggcaaagtattactgtaactaagttatttttaaagttaaaatatatttttacgtgcctttggctttttattgcagagtctacattttatagattctacatcagatgttgtcacttatttccattgggattccattgtaagctgtgtatgtgcgtgtttggaaaagtgtattcatacttagtttttttttcttcatctgttatcatacttttaacagcaaccaataacggattgtaaagtgtaaaggcacaggttactcatgatgcttctgcagagactgtgggctacaccacatatgttatttggaaatataggtattttagtacagtacatacttgcattacataggtacttcaagcaacacaataaaaagtaaatgataaagtgaacttgcttgtttatagtaataaacaagaccataagagaataagtatagctagagaaattgcttctctgaaatgtacatgagcccttaaggtaagagatgatttccatctactctcattttgattacttccttatggtttgagaggctagaaactgagcctctctacttttggaaaaatgaacatgtgaggtcagatttttttttttttttttaagtcagcactgatgccaccctctcaggggtcatttctgagcatcttcctgacttgaacaccttctacagcaaactcttgcaagtccagtttcatccctgtaaggcaaatgtcttttcacgcagaaagtgccatatagacgagataaaggcagctaaaacgagggcagtagagagcacttacccgaccccaaggtgccagagatgccctgaggatggtggttaaggaaacaggagcaggaaatgtacacacagattcctgtccctttgccaactactccttccccatcaaagaaaaacacttgcacacagtaactaccagctccttctctcaaacttgtatttctcctggaaatgtatctcagaaatgacctcctctcccaaccacttcaacgattctttctttgggtttggggttcttgcagttctatcatctaaaataacctttggactgcaggtaaaatgcaattaggacaactaaccaagtagacgaaacaagttcccctaggcaggggtgtccaatattttagcttccctggaccgcattggaagaattttcttgggccacatgtaaaacacactaacactaaccatagttgatgagcttaaaaaaataaaaatagaaaattgcaaaaaaaaaaaaaaaaaatctcagactgttttaagaaagtttaaaaatttgtgttggacttcatgcgggccacaggttggacaagcttgccctagggcattgtgtgctttccgtaacttctcagttgtatttcgttatccatgactctccagtgttttttctgttggaccacacccgtcacagttcacagttccaaacagaaatttcccagcctattctaaatcttgttaatgacgaagagtccaatgtatctcattatttgtagccaattttagactcttttcaatacctcccccccattttaattagtattgatcatattcagtctttcattttactcttcatctgtagcgtgacctcaaggtaaagatgaaactatttcatgaaaaggggaggagtatggctgtgcattagctctactccctctctggtaagtactggggagagaacagccctgccagtactgggtttgatagattctaaatattaatcacacatcctgcctacagttagccattttagtttctgggagttctttcatgtacattttcttccattaattgaattaggtataattgagatggcaataaatatgcccgtattagaaagaggaaacaaagctacatgcggcttatgattttgttgagtcacttctcccgaggcagcctttccaatgcctggtcccttcccctgagagcaggtggactgctggtggtggctttctttcctgcagagaggcactttagacccatacctgctgtgagctgaattgatgttctcatcctgtgaaccttctcccactttaacctaatttatctttacttgtttaaagataaggaaacccaagatgtactttatttgcaaactcaaagcaaatggcgagccacctgtgacccagtaaccagaaaagaaaccatgccatttgtgtaagtagagacacttcttgttgaggtaggcaaggctcttgtgagcgatttttttcccctagtgagacctaacaaaagacaagctatatcatttctgcctgaaattatctgcttgaaaagatcaaaatatcaggatacttagctcttcacaaatatgaagtcattatcacatttcactgagccagaaatcactgttaacagcacacacaaaagactacactggttgaacagcaaagagaaacccgggtctccagaatcacagtttagtccttctatattactgcaagtgacctgttttttctgaaggctccccgcaaatgaagtcctggaatggaaaaaatccataagtccataaattaacttgataaatattttagaacagacaaaagaaaatattgagtgatgtagttctaatcctcctaatatggaacctggcaagactgaatcattttactgtgaaatatataaacacaatagaatgagccaacatgatggtttctctccagtaagagtttttcttttggaaatgaggttaacctagccccaaatctagcaattctcataaaatccgattttagaattagcctcccagattaatctgaatgattgacttattttttcttaggcaagtcagtaagccacccactagacagccatatccagcaaaataagagaagtttccagatgccaaatgataagccaccatcaacccagcggggaagccttctggttggtttggctgtatgagattcaggaaggccagaatacccaaaattattcacacgacgttaacttattggtactggctaagcaatacatgtatttcctaaaggaggagatggtcttttggttgatttatggacacacttgtttcatctgactgtaaatatattgcatgctttattctgatggtgcactatttcatccagcaagcttttcatctgagaatgtttaatgttgaccttattcttagagcaagtagatctaaatatttttcagctgagttattagggagtcattattctgtggtacaatgctgcaaaaagcatcatgtggaagaatgggaactatgcttactttatgaagtgatgtataacacaatgaaatctgttttacaactac

SEQ ID NO: 417775 - DNA, 3567 bp, Homo sapiens
ttttctaagtaggccaggaacatttaatatttttcaataaattaatatataaaatatatacattagtgccaaatggaacatatattttgaaatatgaaacccaagtaaaatgctcaggaatctggagtagaatccaggtatctgccaaaggaaactttggacgagttgtcttttgaagaagggaaacaatgctgggtctcttatcttcacggactgtttttgcttgtcaaacttctaacatcacttcagccgagtttcgtatttgacttccaacctcatggccatttgacctgccaactactatttttctttgaggcttttaacaccccacccaagtattttgctttccagattgtgtgcgtttccttttcacttcaccttaaagtcagcctgggtttacaacatcggcttaaggcgcaccctctaaggtttcagacagacccagggcaccgcggtgatgacctgaagctgatatctctcggcaaagccaaggtatccgggaggttctccgcgttgtgccaggatttccatccaacccgagagtctcagggcagaggccaggcccccagcgtccgactcccaggggtcccagccccctcccctggctgaccatgcgggctgggacctcccagccggaaaacaccgccctttcctgtcgcctactccttccccaggccgacgactcgcggaggaggaagagacggaggccgatttaagaaaattagcattcattaacccggttcacgctcgggccccggcggaggggaggggcgcgccgggcggcggcgctggcggtggccgggtgaccggcgggcgcaggtgccaccgcggcctgaattttactctctcgggccggcagctgcgccacttgcgcctcgtcgcgcgtctggggcagccgccaccggcttgccccagctttaggcaaatccttttgaaagaccctgagggagaagaaacgcctccctctgggtaggagaacctgtagcgtctgctgttcgtcgcgtgtccagttgctcagccgggagctccggcatcttcagggcgctcattccactctccgggttttggctgcagctctgaggggagcgagctagaaactgacagaacgcgaccctccccctccgcgcccaccggagcccgggctgagagggacctggggagctgcggcctggccggggcggcgcactcaggtggcctcgcttccctgcgggtcaccgcccgccactcgcacagctaggtcggcctgttgggatcgggagaggtgggcgcacgagttttagtgcgggagtccggggtgcgggcggagtcctattgtccccgtgcacccgggcggcagcacctccgggtccctctttaaaccgagcgtccggcgacctttctttgtgcttagggagtcgaaagcggcatcttctccgagagaagtcgcctactggggggtggcgctggggaggtaacaatgggcgcccattgtcctccgagggtccaacggtgaccccccccgctgcgcacgcgcccggccaccggttggccccgggccagggcacaggtaccgcggccgggagggtcggccccgctgcccgcgccctccgccccgccccagtgagtccccgcgccgccggccccgccccgcgccgccccgccctccgcaggttcagtcctcgcgtccggccgccccgcgctcagtcgcgcgcaccttctctcgcggccgggggaccgcagcgcggggctagcccggagacccggccaccggcctggggcgccttcacgccgtctcggagcggataatgcggtgagcaggcaccacgccggcagactcggctggatctgcgcacagcggcagggattgcgtgcgcccgcgggaggcccggggcagcggctgggatcctcagcggcggccggtttgtcctggttgtggtcaagactggatgatgtaactggctctctaggaagcctcacttggccgtaacctcaggaaggttctctttgaccccatctcatttcgaagccacttctgaagccacttgagaaaaatgatgtgacagttcctatcaaaaaggattcagaaacatataccatctgtgaagaaagtggccctttctcccgcttgcaaaatagacattctcaaattccaaaatgccagccaagaccccaatttacctgaaagcagccaataacaagaaaggaaagaaatttaaactgagggacattctgtctcctgatatgatcagtcccccgcttggagactttcgccacaccatccacattggcaaagagggccagcacgatgtctttggagatatttcctttcttcaagggaactacgagcttttacctggaaaccaggagaaagcacacctgggccagttccctgggcataatgagttcttccgggccaacagcacctcggactctgtgttcacagaaacgccctccccggtgctcaaaaatgccatctccctcccgaccattggaggatcccaagctctcatgttgcccttattgtcaccagtgacatttaattccaaacaggagtccttcgggccagcaaagctgcccaggcttagctgcgagcccgtcatggaggaaaaagctcaggagaaaagcagtctgttggagaatgggacagtccaccagggagacacctcgtggggctccagcggttctgcatctcagtccagccaaggcagagacagccactcctccagcctgtccgaacagtaccccgactggccagccgaggacatgtttgaccatcccaccccatgcgagctcatcaagggaaagactaagtcagaggagtccctctctgaccttacaggttccctcctctccctgcagcttgatcttgggccctcacttttggatgaggtgctgaatgtaatggataaaaataagtaacaagatgccaacttttttcctttggggtaaaaggtacaaaaacaaactaaccacagttgaagagaagggcttccggagctgtatttgcagttttgtgttgggttttctaaaataatattcttacaaagtatttttttacctgttatgccctgtttgcaaaaacaatttagaaaaaaacaacaaagcaaaacctatcttggcaaaaaaaggaagtgagtcagagcccattttcaggaggcattggtgatgttcggctcacatattgtttgcagacacacaagaaatctggcttggccaggattggcactagctatgaagggctgagcgagtcacattaaggaacttcacggaactttatagcactccgacattttctgagcaagaggaagtcaaaatttatttaacacctaagcctttttgtagactcttttctatatattgcttaggctcaccatagcgaattctccagtgttaaaacttttctgttttcacatttgaactttatgggttttggggattttcttgtagttcttatatatccctatatattatatctatattgcaaaattttgactgtcagctacatgttggtaagacacaggcaaagtattactgtaactaagttatttttaaagttaaaatatatttttacgtgcctttggcttttta

SEQ ID NO: 417776 - DNA, 777 bp, Homo sapiens
aaaaaaaaaaaaaaggagggacaagaggcaccagaagctcctgtccaggtctgggcctccctcgggtcactcagttctcccccattcattcattcattcactcactcactcactcactcattcccacactctgcagccactgacttcagctagccatgctggatgctaagacatagagtcccggccatcaaggccagtccatctcagtggcatctagacatgcacagagatgaccagggagcccctaagggacagagaggcacaccctgcctcctgatcccatctgggggctgcatgaaggaggggcacaggtgtggccttgaaggctgggtaaggggctgggagggctttaggggcattccagggggcaggcacagaactggaggctctgccgggcacacccacaggagagcaatggctggagggtgacatggactgcagggtgtggccgcggcagcccagctcttaaggggacagcctgggaaaacagacttagggacaatgatcttgagccatgaaatgatgtccaatgccccttgtgccacctgacatcagcctgattaatgaacaaacagaagaggaagcaggggacctgtgtgtccctctctctgcttttctgtctttctctgtgccccctctcttatgtctctcacgctgtctcttgtccttgtttttaactctgacacgccgtgggaacttggctcacttcctagggggaagctgtctggactggcccagagatgggcaccaccatttcccaataaacacaagataaaa

SEQ ID NO: 417777 - DNA, 990 bp, Homo sapiens
aaaaaaaaaaaaaaggagggacaagaggcaccagaagctcctgtccaggtctgggcctccctcgggtcactcagttctcccccattcattcattcattcactcactcactcactcactcattcccacactctgcagccactgacttcagctagccatgctggatgctaagacatagagtcccggccatcaaggccagtccatctcagtggcatctagacatgcacagagatgaccagggagcccctaagggacagagaggcacaccctgcctcctgatcccatctgggggctgcatgaaggaggggcacaggtgtggccttgaaggctgggtaaggggctgggagggctttaggggcattccagggggcaggcacagaactggaggctctgccgggcacacccacaggagagcaatggctggagggtgacatggactgcagggtgtggccgcggcagcccagctcttaaggggacagcctgggaaaacagacttagggacaatgatcttgagccatgaaatgatgtccaatgccccttgtgccacctgacatcagcctgattaatgaacaaacagaagaggaagcaggggacctgtgtgtccctctctctgcttttctgtctttctctgtgccccctctcttatgtctctcacgctgtctcttgtccttgtttttaactctgacacgccgtgggaacttggctcacttcctagggggaagctgtctggactggcccagagatgggcaccaccatttcccaataaacacaagataaaatcagagagctggcgtcagttccgcggctggactcagtggggaaaagggcaaaaagcagcagaaataagagcagggaaagaacaggggctgggtgcgatgggtcccatctgtaatcccagcgctttgggaggcctaggtgggaggatcgcttgagcccagaagttcaagaccagcctgggcaacatacggagacccccatttctaaaagtttta

SEQ ID NO: 417778 - DNA, 4529 bp, Homo sapiens
  misc_feature (35)..(35): n is a, c, g, or t
  misc_feature (38)..(38): n is a, c, g, or t
  misc_feature (2407)..(2407): n is a, c, g, or t
cgaggagaccaagccgctgctggggggcgacgtcnccngagcacgaagatgggcgccgtgcctgccgccgggtcttctgctttgaacgggatgaggtacaaatgctgcaggagggcgacattcaggtctgtgtcatccggcacccgcggacctttctcagcaagatcctcacctcgaaattcctgaggcgctgggagccgcaccacctaacgctggccgacaacagcctggcgtccgccacgccaactgggtacatggaaaactcagtctcctacagcgcaattgaagacgttcagctgctgtcctgggagaatgccccgaagtactgtttacagctcacgattcctgggggaactgtcttactgcaggctgccaatagctacctgcgagaccagtggttccattctctgcaatggaagaaaaagatttacaaatataagaaagtgctgagtaacccaagccgctgggaagttgtcttgaaagagatccggaccctggtggacatggccctgacatcccccctgcaggatgactccatcaaccaggccccactggaaatcgtctcgaaactgctctcagagaacacaaacttgaccacccaggagcatgaaaacatcattgtggcaatcgctcctttgctggaaaacaaccacccaccaccagatctctgtgaattcttttgcaagcactgcagagagcggccccggtccatggtggtcatcgaggtgttcacccccgtggtgcagcgaatcctcaagcataacatggactttgggaagtgcccgcgactgaggctgtttactcaggagtacatccttgccttgaacgagctcaacgcggggatggaagtggtgaagaagttcattcagagcatgcacggcccacagggcactgcccccacccccgggtcctgcccaacctggtggccgtgtgcctggctgccatctactcctgctatgaagagttcatcaacagccgcgacaattccccaagcctgaaggaaatccggaacggctgccagcagccgtgcgaccggaagcccactttacctctgcgccttctgcaccccagcccggacctggtgtctcaggaagccacgctgtctgaggcccggctcaagtcggtggtcgtggcctccagtgagatccacgtggaggtggaacgcaccagcactgccaagccggcgctgacggccagcgcaggcaacgacagcgagcccaacctcatcgactgcctcatggtcagccccgcctgcagcaccatgagcatcgagctgggcccccaggccgaccgcacgctcggctgctacgtggaaatcctcaagctgctgtcagactatgatgactggagaccgtctctggccagtttgcttcaacccattccattccccaaagaagctctcgcacatgagaagttcaccaaggaactgaagtacgtgattcagaggttcgccgaagaccccaggcaagaggtccactcatgcctgctgagcgtgcgggccggcaaagatggctggttccagctctacagccccggaggggtggcctgcgacgatgacggggagctgttcgccagcatggtgcacatcctcatgggctcctgttacaagaccaaaaaattcctgctctccctggcagaaaacaagctgggtccctgcatgctcctggcactgagggggaaccagaccatggtggagatcctgtgcttgatgctggaatacaacatcatcgacaacaacgacacccaactgcagatcatctcaaccctggagagcacagacgtggggaagcgcatgtacgagcagctgtgtgaccggcagcgggagctgaaggagctgcaaaggaaaggcgggcccaccaggctaacactgccctccaagtccacagacgctgacttggctcgtttgctgagctccggctccttcggaaacctggagaacctcagtttggccttcaccaatgtaaccagtgcctgcgccgagcacctcatcaaactgccttcgctcaagcagctgaacctgtggtccactcagtttggagacgctggccttcggctcctgtcggaacacctcaccatgctccaggtgctgaacctgtgcgagaccccggtcacagacgctggcctgctggccctgagctccatgaagagtctctgcagtttaaacatgaacagcaccaagctctcagctgacacctacgaagatctgaaggccaagcttcccaatttgaaggaagtggacgtccgctacaccgaagcctggtgaagctcccagctcaaggcaggaagacgtttgcaaccgcgacaaaataactcttgactaacagccgcagagcagccggtcctggggtcccaccctggtgccctggctgtgagatagatggggagtctttctgggggcggagggggnagggggtggggagggggcccacaagcacgcccagcccccgccgaattcttttagcttcgtaattggaacctttgacctgatctaaagtggactttgtagcaacaagaggagcatcagcgggtcggggaggggtttgggggtgggctggggggtgggggaccctttgtggattttctttgcctttgtgtttgatgccgtcgtgtgggaaaagtcaactccgatgccaccattgcgggccggacgaaggatgctttcttcctagaggctccgagctgagctgcgaactcgccccccgcccttgggacaagaagacccagtcacatcactgcacccgtcctgtgtcctcaccattgctatgcaaagtgattcttgttgtacataagatttaaataatgcacctatttaagacatgttgacaaattgcgggtctgggacccgcctcttatttatgaagtctttgaccgtcccccccgcccgaccccaccgccctcccgcccccacctggcgtgtagtactgtataaaccagtcagctgtcgggttagtggtagtattattgttatttttttaaaggaaacaaacagacaacaaaaagaagaaaaaaaaaaagaacctccttggaaaaattaattgctttttcgtaatggattctctatgctaatgctctctcgtctgtctgtctgtctgcccactcccccacccaccactgtgcgtttctgatttccaaatgtctccaactccctcacgaggtggggctcaggctggaggaggagggattaagatccccttgctccactaaggcccaagctctttctctcggcaccttttagacttgaatgggaggctgctaacccgccctctccagtccaccccggtaaaagagctgttccccacccccagggagctcctgtccctgtcagcctttgctgtcccctgtccccaacggagactctgtcacccctgggctccccctgccatcgtgtgcttcacgtggccccatgcatgcccgcctctctgcatggtctcttgggaaaagagagatgtgtcgcctccgccagtccgactgccctccccaccccacccccgccaccccccacatgtgaccactgcaacgaagacactccttctgtccccacctgctccgaagacaaaccaacctccgtttcttttataaacagtcggctttttcttaataagccctcactgtacagaacagcccgttgatggtttatttggggtccccctctccccccagcccttttttctgttggtttagcacaaatacttccctcctccggcacctccaaacctaccccacagtcagtgtacttgttttatatatatttaatcttattcaatggaaaccatgcttttgtcgttttatactttgctaggtagactttattacccccccactatgccctcatttttttaaaaaaggaaaaaaaaaagaaactgggttccagtcttaattcattttccgtgccaggttttatttcgtgtgtgtgtgagtgtgttctgttttgtgttttgttttttgttgttgttttcagttgtttggttttcttttctttcccccctccggtcccatacttcacagcactctggtgcgggaagaagcagaagcaaaaaaaataaaaataaaaaaataaataaaaataaaaaaaataaaaaaggaaaaaaaaaaagaagaaacaagacatgccacctttcccctcgcactgttgcttttcctgatggttaatactactgtcacgtagctgtgtacaaagagatgtgaaatactttcaggcaaaaataaactgtaagtgactcatcaatgtctggcctttgtgtggtttctcggcgcccagcgggagaaggtccaaggagggggcgaagcccaggcgggaaatctgaggctcaagacagtgccgggatgccctcgccaccttctgtgcgcacttcctgaggaccagggctcagcatcctggctgctgttggccactggggccggagctgtcttcattgcaggggggctgttgtgttcattgccagacattgaacagcatccttggcttctacccagcagtagcaccccttcctcatttatgacaaccagagtgtctccagatgttgccacgt

SEQ ID NO: 417779 - DNA, 949 bp, Homo sapiens
  misc_feature (823)..(823): n is a, c, g, or t
aggggagtaaaataatacggctaggtcgaggctggtgttaatctccctggcagaaaacaagctgggtccctgcatgctcctggcactgagggggaaccagaccatggtggagatcctgtgcttgatgctggaatacaacatcatcgacaacaacgacacccaactgcagatcatctcaaccctggagagcacagacgtggggaagcgcatgtacgagcagctgtgtgaccggcagcgggagctgaaggagctgcaaaggaaaggcgggcccaccaggctaacactgccctccaagtccacagacgctgacttggctcgtttgctgagctccggctccttcggaaacctggagaacctcagtttggccttcaccaatgtaaccagtgcctgcgccgagcacctcatcaaactgccttcgctcaagcagctgaacctgtggtccactcagtttggagacgctggccttcggctcctgtcggaacacctcaccatgctccaggtgctgaacctgtgcgagaccccggtcacagacgctggcctgctggccctgagctccatgaagagtctctgcagtttaaacatgaacagcaccaagctctcagctgacacctacgaagatctgaaggccaagcttcccaatttgaaggaagtggacgtccgctacaccgaagcctggtgaagctcccagctcaaggcaggaagacgtttgcaaccgcgacaaaataactcttgactaacagccgcagagcagccggtcctggggtcccaccctggtgccctggctgtgagatagatggggagtctttctgggggcggagggggnagggggtggggagggggcccacaagcacgcccagcccccgccgaatttttagggtcgaattgacttgggttggtgccgctgtggaaagcaatcgagcacatggggcggggaggaggttcaaagcca

SEQ ID NO: 417780 - DNA, 636 bp, Homo sapiens
agagaagaaggagagagagttaagcagagttagagtagggagagtagagtgtggatgggttccgatgtgtggtatcctgtcgtttgaaactgccgggtcccatacttcacagcactctggtgcgggaagaagcagaagcaaaaaaaataaaaataaaaaaataaataaaaataaaaaaaataaaaaaggaaaaaaaaaaagaagaaacaagacatgccacctttcccctcgcactgttgcttttcctgatggttaatactactgtcacgtagctgtgtacaaagagatgtgaaatactttcaggcaaaaataaactgtaagtgactcatcaatgtctggcctttgtgtggtttctcggcgcccagcgggagaaggtccaaggagggggcgaagcccaggcgggaaatctgaggctcaagacagtgccgggatgccctcgccaccttctgtgcgcacttcctgaggaccagggctcagcatcctggctgctgttggccactggggccggagctgtcttcattgcaggggggctgttgtgttcattgccagacattgaacagcatccttggcttctacccagcagtagcaccccttcctcatttatgacaaccagagtgtctccagatgttgccacgt

SEQ ID NO: 417781 - DNA, 465 bp, Homo sapiens
ggctgcaggaattcggcacgagaaaaaaagaagaaacaagacatgccacctttcccctcgcactgttgcttttcctgatggttaatactactgtcacgtagctgtgtacaaagagatgtgaaatactttcaggcaaaaataaactgtaagtgactcatcaatgtctggcctttgtgtggtttctcggcgcccagcgggagaaggtccaaggagggggcgaagcccaggcgggaaatctgaggctcaagacagtgccgggatgccctcgccaccttctgtgcgcacttcctgaggaccagggctcagcatcctggctgctgttggccactggggccggagctgtcttcattgcaggggggctgttgtgttcattgccagacattgaacagcatccttggcttctacccagcagtagcaccccttcctcatttatgacaaccagagtgtctccagatgttgccacgt

SEQ ID NO: 417782 - DNA, 4356 bp, Homo sapiens
  misc_feature (2234)..(2234): n is a, c, g, or t
agcgggtgtacgcgcgcgagccccagaggctgcggcagcagcagagcagcagagcagcagcccctgcctggcgcgacgtgcttccagtgcattctgagtcactcctctcctggcaaggggcacattcctgctgacgacttgtctcccgtggaggagcaacaggctctgctttccctggcctgagaaccctggcatatgtgcttgcctctgctgacagttgccagagcgatggcaagtgttgcccagaaaaagatttacaaatataagaaagtgctgagtaacccaagccgctgggaagttgtcttgaaagagatccggaccctggtggacatggccctgacatcccccctgcaggatgactccatcaaccaggccccactggaaatcgtctcgaaactgctctcagagaacacaaacttgaccacccaggagcatgaaaacatcattgtggcaatcgctcctttgctggaaaacaaccacccaccaccagatctctgtgaattcttttgcaagcactgcagagagcggccccggtccatggtggtcatcgaggtgttcacccccgtggtgcagcgaatcctcaagcataacatggactttgggaagtgcccgcgactgaggctgtttactcaggagtacatccttgccttgaacgagctcaacgcggggatggaagtggtgaagaagttcattcagagcatgcacggcccacagggcactgcccccacccccgggtcctgcccaacctggtggccgtgtgcctggctgccatctactcctgctatgaagagttcatcaacagccgcgacaattccccaagcctgaaggaaatccggaacggctgccagcagccgtgcgaccggaagcccactttacctctgcgccttctgcaccccagcccggacctggtgtctcaggaagccacgctgtctgaggcccggctcaagtcggtggtcgtggcctccagtgagatccacgtggaggtggaacgcaccagcactgccaagccggcgctgacggccagcgcaggcaacgacagcgagcccaacctcatcgactgcctcatggtcagccccgcctgcagcaccatgagcatcgagctgggcccccaggccgaccgcacgctcggctgctacgtggaaatcctcaagctgctgtcagactatgatgactggagaccgtctctggccagtttgcttcaacccattccattccccaaagaagctctcgcacatgagaagttcaccaaggaactgaagtacgtgattcagaggttcgccgaagaccccaggcaagaggtccactcatgcctgctgagcgtgcgggccggcaaagatggctggttccagctctacagccccggaggggtggcctgcgacgatgacggggagctgttcgccagcatggtgcacatcctcatgggctcctgttacaagaccaaaaaattcctgctctccctggcagaaaacaagctgggtccctgcatgctcctggcactgagggggaaccagaccatggtggagatcctgtgcttgatgctggaatacaacatcatcgacaacaacgacacccaactgcagatcatctcaaccctggagagcacagacgtggggaagcgcatgtacgagcagctgtgtgaccggcagcgggagctgaaggagctgcaaaggaaaggcgggcccaccaggctaacactgccctccaagtccacagacgctgacttggctcgtttgctgagctccggctccttcggaaacctggagaacctcagtttggccttcaccaatgtaaccagtgcctgcgccgagcacctcatcaaactgccttcgctcaagcagctgaacctgtggtccactcagtttggagacgctggccttcggctcctgtcggaacacctcaccatgctccaggtgctgaacctgtgcgagaccccggtcacagacgctggcctgctggccctgagctccatgaagagtctctgcagtttaaacatgaacagcaccaagctctcagctgacacctacgaagatctgaaggccaagcttcccaatttgaaggaagtggacgtccgctacaccgaagcctggtgaagctcccagctcaaggcaggaagacgtttgcaaccgcgacaaaataactcttgactaacagccgcagagcagccggtcctggggtcccaccctggtgccctggctgtgagatagatggggagtctttctgggggcggagggggnagggggtggggagggggcccacaagcacgcccagcccccgccgaattcttttagcttcgtaattggaacctttgacctgatctaaagtggactttgtagcaacaagaggagcatcagcgggtcggggaggggtttgggggtgggctggggggtgggggaccctttgtggattttctttgcctttgtgtttgatgccgtcgtgtgggaaaagtcaactccgatgccaccattgcgggccggacgaaggatgctttcttcctagaggctccgagctgagctgcgaactcgccccccgcccttgggacaagaagacccagtcacatcactgcacccgtcctgtgtcctcaccattgctatgcaaagtgattcttgttgtacataagatttaaataatgcacctatttaagacatgttgacaaattgcgggtctgggacccgcctcttatttatgaagtctttgaccgtcccccccgcccgaccccaccgccctcccgcccccacctggcgtgtagtactgtataaaccagtcagctgtcgggttagtggtagtattattgttatttttttaaaggaaacaaacagacaacaaaaagaagaaaaaaaaaaagaacctccttggaaaaattaattgctttttcgtaatggattctctatgctaatgctctctcgtctgtctgtctgtctgcccactcccccacccaccactgtgcgtttctgatttccaaatgtctccaactccctcacgaggtggggctcaggctggaggaggagggattaagatccccttgctccactaaggcccaagctctttctctcggcaccttttagacttgaatgggaggctgctaacccgccctctccagtccaccccggtaaaagagctgttccccacccccagggagctcctgtccctgtcagcctttgctgtcccctgtccccaacggagactctgtcacccctgggctccccctgccatcgtgtgcttcacgtggccccatgcatgcccgcctctctgcatggtctcttgggaaaagagagatgtgtcgcctccgccagtccgactgccctccccaccccacccccgccaccccccacatgtgaccactgcaacgaagacactccttctgtccccacctgctccgaagacaaaccaacctccgtttcttttataaacagtcggctttttcttaataagccctcactgtacagaacagcccgttgatggtttatttggggtccccctctccccccagcccttttttctgttggtttagcacaaatacttccctcctccggcacctccaaacctaccccacagtcagtgtacttgttttatatatatttaatcttattcaatggaaaccatgcttttgtcgttttatactttgctaggtagactttattacccccccactatgccctcatttttttaaaaaaggaaaaaaaaaagaaactgggttccagtcttaattcattttccgtgccaggttttatttcgtgtgtgtgtgagtgtgttctgttttgtgttttgttttttgttgttgttttcagttgtttggttttcttttctttcccccctccggtcccatacttcacagcactctggtgcgggaagaagcagaagcaaaaaaaataaaaataaaaaaataaataaaaataaaaaaaataaaaaaggaaaaaaaaaaagaagaaacaagacatgccacctttcccctcgcactgttgcttttcctgatggttaatactactgtcacgtagctgtgtacaaagagatgtgaaatactttcaggcaaaaataaactgtaagtgactcatcaatgtctggcctttgtgtggtttctcggcgcccagcgggagaaggtccaaggagggggcgaagcccaggcgggaaatctgaggctcaagacagtgccgggatgccctcgccaccttctgtgcgcacttcctgaggaccagggctcagcatcctggctgctgttggccactggggccggagctgtcttcattgcaggggggctgttgtgttcattgccagacattgaacagcatccttggcttctacccagcagtagcaccccttcctcatttatgacaaccagagtgtctccagatgttgccacgt

SEQ ID NO: 417783 - DNA, 2681 bp, Homo sapiens
  misc_feature (559)..(559): n is a, c, g, or t
ggcatgtgctgtaggccagcgggagctgaaggagctggacgctgacttggctcgtttgctgagctccggctccttcggaaacctggagaacctcagtttggccttcaccaatgtaaccagtgcctgcgccgagcacctcatcaaactgccttcgctcaagcagctgaacctgtggtccactcagtttggagacgctggccttcggctcctgtcggaacacctcaccatgctccaggtgctgaacctgtgcgagaccccggtcacagacgctggcctgctggccctgagctccatgaagagtctctgcagtttaaacatgaacagcaccaagctctcagctgacacctacgaagatctgaaggccaagcttcccaatttgaaggaagtggacgtccgctacaccgaagcctggtgaagctcccagctcaaggcaggaagacgtttgcaaccgcgacaaaataactcttgactaacagccgcagagcagccggtcctggggtcccaccctggtgccctggctgtgagatagatggggagtctttctgggggcggagggggnagggggtggggagggggcccacaagcacgcccagcccccgccgaattcttttagcttcgtaattggaacctttgacctgatctaaagtggactttgtagcaacaagaggagcatcagcgggtcggggaggggtttgggggtgggctggggggtgggggaccctttgtggattttctttgcctttgtgtttgatgccgtcgtgtgggaaaagtcaactccgatgccaccattgcgggccggacgaaggatgctttcttcctagaggctccgagctgagctgcgaactcgccccccgcccttgggacaagaagacccagtcacatcactgcacccgtcctgtgtcctcaccattgctatgcaaagtgattcttgttgtacataagatttaaataatgcacctatttaagacatgttgacaaattgcgggtctgggacccgcctcttatttatgaagtctttgaccgtcccccccgcccgaccccaccgccctcccgcccccacctggcgtgtagtactgtataaaccagtcagctgtcgggttagtggtagtattattgttatttttttaaaggaaacaaacagacaacaaaaagaagaaaaaaaaaaagaacctccttggaaaaattaattgctttttcgtaatggattctctatgctaatgctctctcgtctgtctgtctgtctgcccactcccccacccaccactgtgcgtttctgatttccaaatgtctccaactccctcacgaggtggggctcaggctggaggaggagggattaagatccccttgctccactaaggcccaagctctttctctcggcaccttttagacttgaatgggaggctgctaacccgccctctccagtccaccccggtaaaagagctgttccccacccccagggagctcctgtccctgtcagcctttgctgtcccctgtccccaacggagactctgtcacccctgggctccccctgccatcgtgtgcttcacgtggccccatgcatgcccgcctctctgcatggtctcttgggaaaagagagatgtgtcgcctccgccagtccgactgccctccccaccccacccccgccaccccccacatgtgaccactgcaacgaagacactccttctgtccccacctgctccgaagacaaaccaacctccgtttcttttataaacagtcggctttttcttaataagccctcactgtacagaacagcccgttgatggtttatttggggtccccctctccccccagcccttttttctgttggtttagcacaaatacttccctcctccggcacctccaaacctaccccacagtcagtgtacttgttttatatatatttaatcttattcaatggaaaccatgcttttgtcgttttatactttgctaggtagactttattacccccccactatgccctcatttttttaaaaaaggaaaaaaaaaagaaactgggttccagtcttaattcattttccgtgccaggttttatttcgtgtgtgtgtgagtgtgttctgttttgtgttttgttttttgttgttgttttcagttgtttggttttcttttctttcccccctccggtcccatacttcacagcactctggtgcgggaagaagcagaagcaaaaaaaataaaaataaaaaaataaataaaaataaaaaaaataaaaaaggaaaaaaaaaaagaagaaacaagacatgccacctttcccctcgcactgttgcttttcctgatggttaatactactgtcacgtagctgtgtacaaagagatgtgaaatactttcaggcaaaaataaactgtaagtgactcatcaatgtctggcctttgtgtggtttctcggcgcccagcgggagaaggtccaaggagggggcgaagcccaggcgggaaatctgaggctcaagacagtgccgggatgccctcgccaccttctgtgcgcacttcctgaggaccagggctcagcatcctggctgctgttggccactggggccggagctgtcttcattgcaggggggctgttgtgttcattgccagacattgaacagcatccttggcttctacccagcagtagcaccccttcctcatttatgacaaccagagtgtctccagatgttgccacgt

SEQ ID NO: 417784 - DNA, 4479 bp, Homo sapiens
  misc_feature (35)..(35): n is a, c, g, or t
  misc_feature (38)..(38): n is a, c, g, or t
  misc_feature (2407)..(2407): n is a, c, g, or t
cgaggagaccaagccgctgctggggggcgacgtcnccngagcacgaagatgggcgccgtgcctgccgccgggtcttctgctttgaacgggatgaggtacaaatgctgcaggagggcgacattcaggtctgtgtcatccggcacccgcggacctttctcagcaagatcctcacctcgaaattcctgaggcgctgggagccgcaccacctaacgctggccgacaacagcctggcgtccgccacgccaactgggtacatggaaaactcagtctcctacagcgcaattgaagacgttcagctgctgtcctgggagaatgccccgaagtactgtttacagctcacgattcctgggggaactgtcttactgcaggctgccaatagctacctgcgagaccagtggttccattctctgcaatggaagaaaaagatttacaaatataagaaagtgctgagtaacccaagccgctgggaagttgtcttgaaagagatccggaccctggtggacatggccctgacatcccccctgcaggatgactccatcaaccaggccccactggaaatcgtctcgaaactgctctcagagaacacaaacttgaccacccaggagcatgaaaacatcattgtggcaatcgctcctttgctggaaaacaaccacccaccaccagatctctgtgaattcttttgcaagcactgcagagagcggccccggtccatggtggtcatcgaggtgttcacccccgtggtgcagcgaatcctcaagcataacatggactttgggaagtgcccgcgactgaggctgtttactcaggagtacatccttgccttgaacgagctcaacgcggggatggaagtggtgaagaagttcattcagagcatgcacggcccacagggcactgcccccacccccgggtcctgcccaacctggtggccgtgtgcctggctgccatctactcctgctatgaagagttcatcaacagccgcgacaattccccaagcctgaaggaaatccggaacggctgccagcagccgtgcgaccggaagcccactttacctctgcgccttctgcaccccagcccggacctggtgtctcaggaagccacgctgtctgaggcccggctcaagtcggtggtcgtggcctccagtgagatccacgtggaggtggaacgcaccagcactgccaagccggcgctgacggccagcgcaggcaacgacagcgagcccaacctcatcgactgcctcatggtcagccccgcctgcagcaccatgagcatcgagctgggcccccaggccgaccgcacgctcggctgctacgtggaaatcctcaagctgctgtcagactatgatgactggagaccgtctctggccagtttgcttcaacccattccattccccaaagaagctctcgcacatgagaagttcaccaaggaactgaagtacgtgattcagaggttcgccgaagaccccaggcaagaggtccactcatgcctgctgagcgtgcgggccggcaaagatggctggttccagctctacagccccggaggggtggcctgcgacgatgacggggagctgttcgccagcatggtgcacatcctcatgggctcctgttacaagaccaaaaaattcctgctctccctggcagaaaacaagctgggtccctgcatgctcctggcactgagggggaaccagaccatggtggagatcctgtgcttgatgctggaatacaacatcatcgacaacaacgacacccaactgcagatcatctcaaccctggagagcacagacgtggggaagcgcatgtacgagcagctgtgtgaccggcagcgggagctgaaggagctgcaaaggaaaggcgggcccaccaggctaacactgccctccaagtccacagacgctgacttggctcgtttgctgagctccggctccttcggaaacctggagaacctcagtttggccttcaccaatgtaaccagtgcctgcgccgagcacctcatcaaactgccttcgctcaagcagctgaacctgtggtccactcagtttggagacgctggccttcggctcctgtcggaacacctcaccatgctccaggtgctgaacctgtgcgagaccccggtcacagacgctggcctgctggccctgagctccatgaagagtctctgcagtttaaacatgaacagcaccaagctctcagctgacacctacgaagatctgaaggccaagcttcccaatttgaaggaagtggacgtccgctacaccgaagcctggtgaagctcccagctcaaggcaggaagacgtttgcaaccgcgacaaaataactcttgactaacagccgcagagcagccggtcctggggtcccaccctggtgccctggctgtgagatagatggggagtctttctgggggcggagggggnagggggtggggagggggcccacaagcacgcccagcccccgccgaattcttttagcttcgtaattggaacctttgacctgatctaaagtggactttgtagcaacaagaggagcatcagcgggtcggggaggggtttgggggtgggctggggggtgggggaccctttgtggattttctttgcctttgtgtttgatgccgtcgtgtgggaaaagtcaactccgatgccaccattgcgggccggacgaaggatgctttcttcctagaggctccgagctgagctgcgaactcgccccccgcccttgggacaagaagacccagtcacatcactgcacccgtcctgtgtcctcaccattgctatgcaaagtgattcttgttgtacataagatttaaataatgcacctatttaagacatgttgacaaattgcgggtctgggacccgcctcttatttatgaagtctttgaccgtcccccccgcccgaccccaccgccctcccgcccccacctggcgtgtagtactgtataaaccagtcagctgtcgggttagtggtagtattattgttatttttttaaaggaaacaaacagacaacaaaaagaagaaaaaaaaaaagaacctccttggaaaaattaattgctttttcgtaatggattctctatgctaatgctctctcgtctgtctgtctgtctgcccactcccccacccaccactgtgcgtttctgatttccaaatgtctccaactccctcacgaggtggggctcaggctggaggaggagggattaagatccccttgctccactaaggcccaagctctttctctcggcaccttttagacttgaatgggaggctgctaacccgccctctccagtccaccccggtaaaagagctgttccccacccccagggagctcctgtccctgtcagcctttgctgtcccctgtccccaacggagactctgtcacccctgggctccccctgccatcgtgtgcttcacgtggccccatgcatgcccgcctctctgcatggtctcttgggaaaagagagatgtgtcgcctccgccagtccgactgccctccccaccccacccccgccaccccccacatgtgaccactgcaacgaagacactccttctgtccccacctgctccgaagacaaaccaacctccgtttcttttataaacagtcggctttttcttaataagccccccagcccttttttctgttggtttagcacaaatacttccctcctccggcacctccaaacctaccccacagtcagtgtacttgttttatatatatttaatcttattcaatggaaaccatgcttttgtcgttttatactttgctaggtagactttattacccccccactatgccctcatttttttaaaaaaggaaaaaaaaaagaaactgggttccagtcttaattcattttccgtgccaggttttatttcgtgtgtgtgtgagtgtgttctgttttgtgttttgttttttgttgttgttttcagttgtttggttttcttttctttcccccctccggtcccatacttcacagcactctggtgcgggaagaagcagaagcaaaaaaaataaaaataaaaaaataaataaaaataaaaaaaataaaaaaggaaaaaaaaaaagaagaaacaagacatgccacctttcccctcgcactgttgcttttcctgatggttaatactactgtcacgtagctgtgtacaaagagatgtgaaatactttcaggcaaaaataaactgtaagtgactcatcaatgtctggcctttgtgtggtttctcggcgcccagcgggagaaggtccaaggagggggcgaagcccaggcgggaaatctgaggctcaagacagtgccgggatgccctcgccaccttctgtgcgcacttcctgaggaccagggctcagcatcctggctgctgttggccactggggccggagctgtcttcattgcaggggggctgttgtgttcattgccagacattgaacagcatccttggcttctacccagcagtagcaccccttcctcatttatgacaaccagagtgtctccagatgttgccacgt

SEQ ID NO: 417785 - DNA, 4434 bp, Homo sapiens
  misc_feature (35)..(35): n is a, c, g, or t
  misc_feature (38)..(38): n is a, c, g, or t
  misc_feature (2407)..(2407): n is a, c, g, or t
cgaggagaccaagccgctgctggggggcgacgtcnccngagcacgaagatgggcgccgtgcctgccgccgggtcttctgctttgaacgggatgaggtacaaatgctgcaggagggcgacattcaggtctgtgtcatccggcacccgcggacctttctcagcaagatcctcacctcgaaattcctgaggcgctgggagccgcaccacctaacgctggccgacaacagcctggcgtccgccacgccaactgggtacatggaaaactcagtctcctacagcgcaattgaagacgttcagctgctgtcctgggagaatgccccgaagtactgtttacagctcacgattcctgggggaactgtcttactgcaggctgccaatagctacctgcgagaccagtggttccattctctgcaatggaagaaaaagatttacaaatataagaaagtgctgagtaacccaagccgctgggaagttgtcttgaaagagatccggaccctggtggacatggccctgacatcccccctgcaggatgactccatcaaccaggccccactggaaatcgtctcgaaactgctctcagagaacacaaacttgaccacccaggagcatgaaaacatcattgtggcaatcgctcctttgctggaaaacaaccacccaccaccagatctctgtgaattcttttgcaagcactgcagagagcggccccggtccatggtggtcatcgaggtgttcacccccgtggtgcagcgaatcctcaagcataacatggactttgggaagtgcccgcgactgaggctgtttactcaggagtacatccttgccttgaacgagctcaacgcggggatggaagtggtgaagaagttcattcagagcatgcacggcccacagggcactgcccccacccccgggtcctgcccaacctggtggccgtgtgcctggctgccatctactcctgctatgaagagttcatcaacagccgcgacaattccccaagcctgaaggaaatccggaacggctgccagcagccgtgcgaccggaagcccactttacctctgcgccttctgcaccccagcccggacctggtgtctcaggaagccacgctgtctgaggcccggctcaagtcggtggtcgtggcctccagtgagatccacgtggaggtggaacgcaccagcactgccaagccggcgctgacggccagcgcaggcaacgacagcgagcccaacctcatcgactgcctcatggtcagccccgcctgcagcaccatgagcatcgagctgggcccccaggccgaccgcacgctcggctgctacgtggaaatcctcaagctgctgtcagactatgatgactggagaccgtctctggccagtttgcttcaacccattccattccccaaagaagctctcgcacatgagaagttcaccaaggaactgaagtacgtgattcagaggttcgccgaagaccccaggcaagaggtccactcatgcctgctgagcgtgcgggccggcaaagatggctggttccagctctacagccccggaggggtggcctgcgacgatgacggggagctgttcgccagcatggtgcacatcctcatgggctcctgttacaagaccaaaaaattcctgctctccctggcagaaaacaagctgggtccctgcatgctcctggcactgagggggaaccagaccatggtggagatcctgtgcttgatgctggaatacaacatcatcgacaacaacgacacccaactgcagatcatctcaaccctggagagcacagacgtggggaagcgcatgtacgagcagctgtgtgaccggcagcgggagctgaaggagctgcaaaggaaaggcgggcccaccaggctaacactgccctccaagtccacagacgctgacttggctcgtttgctgagctccggctccttcggaaacctggagaacctcagtttggccttcaccaatgtaaccagtgcctgcgccgagcacctcatcaaactgccttcgctcaagcagctgaacctgtggtccactcagtttggagacgctggccttcggctcctgtcggaacacctcaccatgctccaggtgctgaacctgtgcgagaccccggtcacagacgctggcctgctggccctgagctccatgaagagtctctgcagtttaaacatgaacagcaccaagctctcagctgacacctacgaagatctgaaggccaagcttcccaatttgaaggaagtggacgtccgctacaccgaagcctggtgaagctcccagctcaaggcaggaagacgtttgcaaccgcgacaaaataactcttgactaacagccgcagagcagccggtcctggggtcccaccctggtgccctggctgtgagatagatggggagtctttctgggggcggagggggnagggggtggggagggggcccacaagcacgcccagcccccgccgaattcttttagcttcgtaattggaacctttgacctgatctaaagtggactttgtagcaacaagaggagcatcagcgggtcggggaggggtttgggggtgggctggggggtgggggaccctttgtggattttctttgcctttgtgtttgatgccgtcgtgtgggaaaagtcaactccgatgccaccattgcgggccggacgaaggatgctttcttcctagaggctccgagctgagctgcgaactcgccccccgcccttgggacaagaagacccagtcacatcactgcacccgtcctgtgtcctcaccattgctatgcaaagtgattcttgttgtacataagatttaaataatgcacgcccccacctggcgtgtagtactgtataaaccagtcagctgtcgggttagtggtagtattattgttatttttttaaaggaaacaaacagacaacaaaaagaagaaaaaaaaaaagaacctccttggaaaaattaattgctttttcgtaatggattctctatgctaatgctctctcgtctgtctgtctgtctgcccactcccccacccaccactgtgcgtttctgatttccaaatgtctccaactccctcacgaggtggggctcaggctggaggaggagggattaagatccccttgctccactaaggcccaagctctttctctcggcaccttttagacttgaatgggaggctgctaacccgccctctccagtccaccccggtaaaagagctgttccccacccccagggagctcctgtccctgtcagcctttgctgtcccctgtccccaacggagactctgtcacccctgggctccccctgccatcgtgtgcttcacgtggccccatgcatgcccgcctctctgcatggtctcttgggaaaagagagatgtgtcgcctccgccagtccgactgccctccccaccccacccccgccaccccccacatgtgaccactgcaacgaagacactccttctgtccccacctgctccgaagacaaaccaacctccgtttcttttataaacagtcggctttttcttaataagccctcactgtacagaacagcccgttgatggtttatttggggtccccctctccccccagcccttttttctgttggtttagcacaaatacttccctcctccggcacctccaaacctaccccacagtcagtgtacttgttttatatatatttaatcttattcaatggaaaccatgcttttgtcgttttatactttgctaggtagactttattacccccccactatgccctcatttttttaaaaaaggaaaaaaaaaagaaactgggttccagtcttaattcattttccgtgccaggttttatttcgtgtgtgtgtgagtgtgttctgttttgtgttttgttttttgttgttgttttcagttgtttggttttcttttctttcccccctccggtcccatacttcacagcactctggtgcgggaagaagcagaagcaaaaaaaataaaaataaaaaaataaataaaaataaaaaaaataaaaaaggaaaaaaaaaaagaagaaacaagacatgccacctttcccctcgcactgttgcttttcctgatggttaatactactgtcacgtagctgtgtacaaagagatgtgaaatactttcaggcaaaaataaactgtaagtgactcatcaatgtctggcctttgtgtggtttctcggcgcccagcgggagaaggtccaaggagggggcgaagcccaggcgggaaatctgaggctcaagacagtgccgggatgccctcgccaccttctgtgcgcacttcctgaggaccagggctcagcatcctggctgctgttggccactggggccggagctgtcttcattgcaggggggctgttgtgttcattgccagacattgaacagcatccttggcttctacccagcagtagcaccccttcctcatttatgacaaccagagtgtctccagatgttgccacgt

SEQ ID NO: 417786 - DNA, 1904 bp, Homo sapiens
cacgaggccaagggcggggggcgagttcgcagctcagctcggagcctctaggaagaaagcatccttcgtccggcccgcaatggtggcaagaagacccagtcacatcactgcacccgtcctgtgtcctcaccattgctatgcaaagtgattcttgttgtacataagatttaaataatgcacctatttaagacatgttgacaaattgcgggtctgggacccgcctcttatttatgaagtctttgaccgtcccccccgcccgaccccaccgccctcccgcccccacctggcgtgtagtactgtataaaccagtcagctgtcgggttagtggtagtattattgttatttttttaaaggaaacaaacagacaacaaaaagaagaaaaaaaaaaagaacctccttggaaaaattaattgctttttcgtaatggattctctatgctaatgctctctcgtctgtctgtctgtctgcccactcccccacccaccactgtgcgtttctgatttccaaatgtctccaactccctcacgaggtggggctcaggctggaggaggagggattaagatccccttgctccactaaggcccaagctctttctctcggcaccttttagacttgaatgggaggctgctaacccgccctctccagtccaccccggtaaaagagctgttccccacccccagggagctcctgtccctgtcagcctttgctgtcccctgtccccaacggagactctgtcacccctgggctccccctgccatcgtgtgcttcacgtggccccatgcatgcccgcctctctgcatggtctcttgggaaaagagagatgtgtcgcctccgccagtccgactgccctccccaccccacccccgccaccccccacatgtgaccactgcaacgaagacactccttctgtccccacctgctccgaagacaaaccaacctccgtttcttttataaacagtcggctttttcttaataagccctcactgtacagaacagcccgttgatggtttatttggggtccccctctccccccagcccttttttctgttggtttagcacaaatacttccctcctccggcacctccaaacctaccccacagtcagtgtacttgttttatatatatttaatcttattcaatggaaaccatgcttttgtcgttttatactttgctaggtagactttattacccccccactatgccctcatttttttaaaaaaggaaaaaaaaaagaaactgggttccagtcttaattcattttccgtgccaggttttatttcgtgtgtgtgtgagtgtgttctgttttgtgttttgttttttgttgttgttttcagttgtttggttttcttttctttcccccctccggtcccatacttcacagcactctggtgcgggaagaagcagaagcaaaaaaaataaaaataaaaaaataaataaaaataaaaaaaataaaaaaggaaaaaaaaaaagaagaaacaagacatgccacctttcccctcgcactgttgcttttcctgatggttaatactactgtcacgtagctgtgtacaaagagatgtgaaatactttcaggcaaaaataaactgtaagtgactcatcaatgtctggcctttgtgtggtttctcggcgcccagcgggagaaggtccaaggagggggcgaagcccaggcgggaaatctgaggctcaagacagtgccgggatgccctcgccaccttctgtgcgcacttcctgaggaccagggctcagcatcctggctgctgttggccactggggccggagctgtcttcattgcaggggggctgttgtgttcattgccagacattgaacagcatccttggcttctacccagcagtagcaccccttcctcatttatgacaaccagagtgtctccagatgttgccacgt

SEQ ID NO: 417787 - DNA, 3331 bp, Homo sapiens
  misc_feature (35)..(35): n is a, c, g, or t
  misc_feature (38)..(38): n is a, c, g, or t
cgaggagaccaagccgctgctggggggcgacgtcnccngagcacgaagatgggcgccgtgcctgccgccgggtcttctgctttgaacgggatgaggtacaaatgctgcaggagggcgacattcaggtctgtgtcatccggcacccgcggacctttctcagcaagatcctcacctcgaaattcctgaggcgctgggagccgcaccacctaacgctggccgacaacagcctggcgtccgccacgccaactgggtacatggaaaactcagtctcctacagcgcaattgaagacgttcagctgctgtcctgggagaatgccccgaagtactgtttacagctcacgattcctgggggaactgtcttactgcaggctgccaatagctacctgcgagaccagtggttccattctctgcaatggaagaaaaagatttacaaatataagaaagtgctgagtaacccaagccgctgggaagttgtcttgaaagagatccggaccctggtggacatggccctgacatcccccctgcaggatgactccatcaaccaggccccactggaaatcgtctcgaaactgctctcagagaacacaaacttgaccacccaggagcatgaaaacatcattgtggcaatcgctcctttgctggaaaacaaccacccaccaccagatctctgtgaattcttttgcaagcactgcagagagcggccccggtccatggtggtcatcgaggtgttcacccccgtggtgcagcgaatcctcaagcataacatggactttgggaagtgcccgcgactgaggctgtttactcaggagtacatccttgccttgaacgagctcaacgcggggatggaagtggtgaagaagttcattcagagcatgcacggcccacagggcactgcccccacccccgggtcctgcccaacctggtggccgtgtgcctggctgccatctactcctgctatgaagagttcatcaacagccgcgacaattccccaagcctgaaggaaatccggaacggctgccagcagccgtgcgaccggaagcccactttacctctgcgccttctgcaccccagcccggacctggtgtctcaggaagccacgctgtctgaggcccggctcaagtcggtggtcgtggcctccagtgagatccacgtggaggtggaacgcaccagcactgccaagccggcgctgacggccagcgcaggcaacgacagcgagcccaacctcatcgactgcctcatggtcagccccgcctgcagcaccatgagcatcgagctgggcccccaggccgaccgcacgctcggctgctacgtggaaatcctcaagctgctgtcagactatgatgactggagaccgtctctggccagtttgcttcaacccattccattccccaaagaagctctcgcacatgagaagttcaccaaggaactgaagtacgtgattcagaggttcgccgaagaccccaggcaagaggtccactcatgcctgctgagcgtgcgggccggcaaagatggctggttccagctctacagccccggaggggtggcctgcgacgatgacggggagctgttcgccagcatggtgcacatcctcatgggctcctgttacaagaccaaaaaattcctgctctccctggcagaaaacaagctgggtccctgcatgctcctggcactgagggggaaccagaccatggtggagatcctgtgcttgatgctggaatacaacatcatcgacaacaacgacacccaactgcagatcatctcaaccctggagagcacagacgtggggaagcgcatgtacgagcagctgtgtgaccggcagcgggagctgaaggagctgcaaaggaaaggcgggcccaccaggctaacactgccctccaagtccacagacgctgacttggctcgtttgctgagctccggctccttcggaaacctggagaacctcagtttggccttcaccaatgtaaccagtgcctgcgccgagcacctcatcaaactgccttcgctcaagcagctgaacctgtggtccactcagtttggagacgctggccttcggctcctgtcggaacacctcaccatgctccaggtgctgaacctgtgcgagaccccggtcacagacgctggcctgctggccctgagctccatgaagagtctctgcagtttaaacatgaacagcaccaagctctcagctgacacctacgaagatctgaaggccaagcttcccaatttgaaggaagtggacgtccgctacaccgaagcctggtgaagctcccagctcaaggcaggaagacccccgccaccccccacatgtgaccactgcaacgaagacactccttctgtccccacctgctccgaagacaaaccaacctccgtttcttttataaacagtcggctttttcttaataagccctcactgtacagaacagcccgttgatggtttatttggggtccccctctccccccagcccttttttctgttggtttagcacaaatacttccctcctccggcacctccaaacctaccccacagtcagtgtacttgttttatatatatttaatcttattcaatggaaaccatgcttttgtcgttttatactttgctaggtagactttattacccccccactatgccctcatttttttaaaaaaggaaaaaaaaaagaaactgggttccagtcttaattcattttccgtgccaggttttatttcgtgtgtgtgtgagtgtgttctgttttgtgttttgttttttgttgttgttttcagttgtttggttttcttttctttcccccctccggtcccatacttcacagcactctggtgcgggaagaagcagaagcaaaaaaaataaaaataaaaaaataaataaaaataaaaaaaataaaaaaggaaaaaaaaaaagaagaaacaagacatgccacctttcccctcgcactgttgcttttcctgatggttaatactactgtcacgtagctgtgtacaaagagatgtgaaatactttcaggcaaaaataaactgtaagtgactcatcaatgtctggcctttgtgtggtttctcggcgcccagcgggagaaggtccaaggagggggcgaagcccaggcgggaaatctgaggctcaagacagtgccgggatgccctcgccaccttctgtgcgcacttcctgaggaccagggctcagcatcctggctgctgttggccactggggccggagctgtcttcattgcaggggggctgttgtgttcattgccagacattgaacagcatccttggcttctacccagcagtagcaccccttcctcatttatgacaaccagagtgtctccagatgttgccacgt

SEQ ID NO: 417788 - DNA, 536 bp, Homo sapiens
  misc_feature (35)..(35): n is a, c, g, or t
  misc_feature (38)..(38): n is a, c, g, or t
  misc_feature (525)..(525): n is a, c, g, or t
cgaggagaccaagccgctgctggggggcgacgtcnccngagcacgaagatgggcgccgtgcctgccgccgggtcttctgctttgaacgggatgaggtacaaatgctgcaggagggcgacattcaggtctgtgtcatccggcacccgcggacctttctcagcaagatcctcacctcgaaattcctgaggcgctgggagccgcaccacctaacgctggccgacaacagcctggcgtccgccacgccaactgggtacatggaaaactcagtctcctacagcgcaattgaagacgttcagctgctgtcctgggagaatgccccgaagtactgtttacagctcacgattcctgggggaactgtcttactgcaggctgccaatagctacctgcgagaccagtggttccattctctgcaatggaagaaaaagatttacaaatataagaaagtgctgagtaacccaagccgctgggaagttgtcttgaaagagatccggaccctggtggacatggccctgtgaaatagggatnttagatcacct

SEQ ID NO: 417789 - DNA, 3481 bp, Homo sapiens
  misc_feature (35)..(35): n is a, c, g, or t
  misc_feature (38)..(38): n is a, c, g, or t
  misc_feature (2407)..(2407): n is a, c, g, or t
cgaggagaccaagccgctgctggggggcgacgtcnccngagcacgaagatgggcgccgtgcctgccgccgggtcttctgctttgaacgggatgaggtacaaatgctgcaggagggcgacattcaggtctgtgtcatccggcacccgcggacctttctcagcaagatcctcacctcgaaattcctgaggcgctgggagccgcaccacctaacgctggccgacaacagcctggcgtccgccacgccaactgggtacatggaaaactcagtctcctacagcgcaattgaagacgttcagctgctgtcctgggagaatgccccgaagtactgtttacagctcacgattcctgggggaactgtcttactgcaggctgccaatagctacctgcgagaccagtggttccattctctgcaatggaagaaaaagatttacaaatataagaaagtgctgagtaacccaagccgctgggaagttgtcttgaaagagatccggaccctggtggacatggccctgacatcccccctgcaggatgactccatcaaccaggccccactggaaatcgtctcgaaactgctctcagagaacacaaacttgaccacccaggagcatgaaaacatcattgtggcaatcgctcctttgctggaaaacaaccacccaccaccagatctctgtgaattcttttgcaagcactgcagagagcggccccggtccatggtggtcatcgaggtgttcacccccgtggtgcagcgaatcctcaagcataacatggactttgggaagtgcccgcgactgaggctgtttactcaggagtacatccttgccttgaacgagctcaacgcggggatggaagtggtgaagaagttcattcagagcatgcacggcccacagggcactgcccccacccccgggtcctgcccaacctggtggccgtgtgcctggctgccatctactcctgctatgaagagttcatcaacagccgcgacaattccccaagcctgaaggaaatccggaacggctgccagcagccgtgcgaccggaagcccactttacctctgcgccttctgcaccccagcccggacctggtgtctcaggaagccacgctgtctgaggcccggctcaagtcggtggtcgtggcctccagtgagatccacgtggaggtggaacgcaccagcactgccaagccggcgctgacggccagcgcaggcaacgacagcgagcccaacctcatcgactgcctcatggtcagccccgcctgcagcaccatgagcatcgagctgggcccccaggccgaccgcacgctcggctgctacgtggaaatcctcaagctgctgtcagactatgatgactggagaccgtctctggccagtttgcttcaacccattccattccccaaagaagctctcgcacatgagaagttcaccaaggaactgaagtacgtgattcagaggttcgccgaagaccccaggcaagaggtccactcatgcctgctgagcgtgcgggccggcaaagatggctggttccagctctacagccccggaggggtggcctgcgacgatgacggggagctgttcgccagcatggtgcacatcctcatgggctcctgttacaagaccaaaaaattcctgctctccctggcagaaaacaagctgggtccctgcatgctcctggcactgagggggaaccagaccatggtggagatcctgtgcttgatgctggaatacaacatcatcgacaacaacgacacccaactgcagatcatctcaaccctggagagcacagacgtggggaagcgcatgtacgagcagctgtgtgaccggcagcgggagctgaaggagctgcaaaggaaaggcgggcccaccaggctaacactgccctccaagtccacagacgctgacttggctcgtttgctgagctccggctccttcggaaacctggagaacctcagtttggccttcaccaatgtaaccagtgcctgcgccgagcacctcatcaaactgccttcgctcaagcagctgaacctgtggtccactcagtttggagacgctggccttcggctcctgtcggaacacctcaccatgctccaggtgctgaacctgtgcgagaccccggtcacagacgctggcctgctggccctgagctccatgaagagtctctgcagtttaaacatgaacagcaccaagctctcagctgacacctacgaagatctgaaggccaagcttcccaatttgaaggaagtggacgtccgctacaccgaagcctggtgaagctcccagctcaaggcaggaagacgtttgcaaccgcgacaaaataactcttgactaacagccgcagagcagccggtcctggggtcccaccctggtgccctggctgtgagatagatggggagtctttctgggggcggagggggnagggggtggggagggggcccacaagcacgcccagcccccgccgaattcttttagcttcgtaattggaacctttgacctgatctaaagtggactttgtagcaacaagaggagcatcagcgggtcggggaggggtttgggggtgggctggggggtgggggaccctttgtggattttctttgcctttgtgtttgatgccgtcgtgtgggaaaagtcaactccgatgccaccattgcgggccggacgaaggatgctttcttcctagaggctccgagctgagctgcgaactcgccccccgcccttgggacaagaagacccagtcacatcactgcacccgtcctgtgtcctcaccattgctatgcaaagtgattcttgttgtacataagatttaaataatgcacctatttaagacatgttgacaaattgcgggtctgggacccgcctcttatttatgaagtctttgaccgtcccccccgcccgaccccaccgccctcccgcccccacctggcgtgtagtactgtataaaccagtcagctgtcgggttagtggtagtattattgttatttttttaaaggaaacaaacagacaacaaaaagaagaaaaaaaaaaagaacctccttggaaaaattaattgctttttcgtaatggattctctatgctaatgctctctcgtctgtctgtctgtctgcccactcccccacccaccactgtgcgtttctgatttccaaatgtctccaactccctcacgaggtggggctcaggctggaggaggagggattaagatccccttgctccactaaggcccaagctctttctctcggcaccttttagacttgaatgggaggctgctaacccgccctctccagtccaccccggtaaaagagctgttccccacccccagggagctcctgtccctgtcagcctttgctgtcccctgtccccaacggagactctgtcacccctgggctccccctgccatcgtgtgcttcacgtggccccatgcatgcccgcctctctgcatggtctcttgggaaaagagagatgtgtcgcctccgcaccccaagggtggccaggtac

SEQ ID NO: 417790 - DNA, 3775 bp, Homo sapiens
  misc_feature (35)..(35): n is a, c, g, or t
  misc_feature (38)..(38): n is a, c, g, or t
  misc_feature (2407)..(2407): n is a, c, g, or t
cgaggagaccaagccgctgctggggggcgacgtcnccngagcacgaagatgggcgccgtgcctgccgccgggtcttctgctttgaacgggatgaggtacaaatgctgcaggagggcgacattcaggtctgtgtcatccggcacccgcggacctttctcagcaagatcctcacctcgaaattcctgaggcgctgggagccgcaccacctaacgctggccgacaacagcctggcgtccgccacgccaactgggtacatggaaaactcagtctcctacagcgcaattgaagacgttcagctgctgtcctgggagaatgccccgaagtactgtttacagctcacgattcctgggggaactgtcttactgcaggctgccaatagctacctgcgagaccagtggttccattctctgcaatggaagaaaaagatttacaaatataagaaagtgctgagtaacccaagccgctgggaagttgtcttgaaagagatccggaccctggtggacatggccctgacatcccccctgcaggatgactccatcaaccaggccccactggaaatcgtctcgaaactgctctcagagaacacaaacttgaccacccaggagcatgaaaacatcattgtggcaatcgctcctttgctggaaaacaaccacccaccaccagatctctgtgaattcttttgcaagcactgcagagagcggccccggtccatggtggtcatcgaggtgttcacccccgtggtgcagcgaatcctcaagcataacatggactttgggaagtgcccgcgactgaggctgtttactcaggagtacatccttgccttgaacgagctcaacgcggggatggaagtggtgaagaagttcattcagagcatgcacggcccacagggcactgcccccacccccgggtcctgcccaacctggtggccgtgtgcctggctgccatctactcctgctatgaagagttcatcaacagccgcgacaattccccaagcctgaaggaaatccggaacggctgccagcagccgtgcgaccggaagcccactttacctctgcgccttctgcaccccagcccggacctggtgtctcaggaagccacgctgtctgaggcccggctcaagtcggtggtcgtggcctccagtgagatccacgtggaggtggaacgcaccagcactgccaagccggcgctgacggccagcgcaggcaacgacagcgagcccaacctcatcgactgcctcatggtcagccccgcctgcagcaccatgagcatcgagctgggcccccaggccgaccgcacgctcggctgctacgtggaaatcctcaagctgctgtcagactatgatgactggagaccgtctctggccagtttgcttcaacccattccattccccaaagaagctctcgcacatgagaagttcaccaaggaactgaagtacgtgattcagaggttcgccgaagaccccaggcaagaggtccactcatgcctgctgagcgtgcgggccggcaaagatggctggttccagctctacagccccggaggggtggcctgcgacgatgacggggagctgttcgccagcatggtgcacatcctcatgggctcctgttacaagaccaaaaaattcctgctctccctggcagaaaacaagctgggtccctgcatgctcctggcactgagggggaaccagaccatggtggagatcctgtgcttgatgctggaatacaacatcatcgacaacaacgacacccaactgcagatcatctcaaccctggagagcacagacgtggggaagcgcatgtacgagcagctgtgtgaccggcagcgggagctgaaggagctgcaaaggaaaggcgggcccaccaggctaacactgccctccaagtccacagacgctgacttggctcgtttgctgagctccggctccttcggaaacctggagaacctcagtttggccttcaccaatgtaaccagtgcctgcgccgagcacctcatcaaactgccttcgctcaagcagctgaacctgtggtccactcagtttggagacgctggccttcggctcctgtcggaacacctcaccatgctccaggtgctgaacctgtgcgagaccccggtcacagacgctggcctgctggccctgagctccatgaagagtctctgcagtttaaacatgaacagcaccaagctctcagctgacacctacgaagatctgaaggccaagcttcccaatttgaaggaagtggacgtccgctacaccgaagcctggtgaagctcccagctcaaggcaggaagacgtttgcaaccgcgacaaaataactcttgactaacagccgcagagcagccggtcctggggtcccaccctggtgccctggctgtgagatagatggggagtctttctgggggcggagggggnagggggtggggagggggcccacaagcacgcccagcccccgccgaattcttttagcttcgtaattggaacctttgacctgatctaaagtggactttgtagcaacaagaggagcatcagcgggtcggggaggggtttgggggtgggctggggggtgggggaccctttgtggattttctttgcctttgtgtttgatgccgtcgtgtgggaaaagtcaactccgatgccaccattgcgggccggacgaaggatgctttcttcctagaggctccgagctgagctgcgaactcgccccccgcccttgggacaagaagacccagtcacatcactgcacccgtcctgtgtcctcaccattgctatgcaaagtgattcttgttgtacataagatttaaataatgcacctatttaagacatgttgacaaattgcgggtctgggacccgcctcttatttatgaagtctttgaccgtcccccccgcccgaccccaccgccctcccccccagcccttttttctgttggtttagcacaaatacttccctcctccggcacctccaaacctaccccacagtcagtgtacttgttttatatatatttaatcttattcaatggaaaccatgcttttgtcgttttatactttgctaggtagactttattacccccccactatgccctcatttttttaaaaaaggaaaaaaaaaagaaactgggttccagtcttaattcattttccgtgccaggttttatttcgtgtgtgtgtgagtgtgttctgttttgtgttttgttttttgttgttgttttcagttgtttggttttcttttctttcccccctccggtcccatacttcacagcactctggtgcgggaagaagcagaagcaaaaaaaataaaaataaaaaaataaataaaaataaaaaaaataaaaaaggaaaaaaaaaaagaagaaacaagacatgccacctttcccctcgcactgttgcttttcctgatggttaatactactgtcacgtagctgtgtacaaagagatgtgaaatactttcaggcaaaaataaactgtaagtgactcatcaatgtctggcctttgtgtggtttctcggcgcccagcgggagaaggtccaaggagggggcgaagcccaggcgggaaatctgaggctcaagacagtgccgggatgccctcgccaccttctgtgcgcacttcctgaggaccagggctcagcatcctggctgctgttggccactggggccggagctgtcttcattgcaggggggctgttgtgttcattgccagacattgaacagcatccttggcttctacccagcagtagcaccccttcctcatttatgacaaccagagtgtctccagatgttgccacgt

SEQ ID NO: 417791 - DNA, 363 bp, Homo sapiens
gaccctggtggacatggccctgacatcccccctgcaggatgactccatcaaccaggccccactggaaatcgtctcgaaactgctctcagaggtaaaacccctcccctggacccctttacattgtttgcctttccctccaccgatcaccggctccatgccaagcagcaggcgcaggcagagctccgtgtgggctgtgttgttgccctgctgccgaaggaggtgagcagttgcccacccagccgtgtgtgggagttgggagagggaggcttgccccagctgcttgcagctgtgctgtctggggattgtaggcaccgaagaggaggtgttgccccgtgcagtgagagccagtagtcccatccccat

SEQ ID NO: 417792 - DNA, 185 bp, Homo sapiens
aaaaggttaatgaaattcttcatgactttttggaagaaaattcagtttgggtttctgccaatgtctggaaactttcccagtatgtccaactaacctgaatgatacaagccacttaaaaaaatcaatactataactaagacttcaaccaaatgggttctgaaaaggtgtcttcatttaaatgagta

SEQ ID NO: 417793 - DNA, 428 bp, Homo sapiens
atattgacaataaccaataaaaatacagtaattaaaatagcatattccttaaaacattcagataatttcactagttttcaattaaaaaaaagatgaacctaaaattttgtaatgatactctattttctgtggacatgaaacaaatataaataactggcaatgtaatgaaatctgtatatatatttcagaaataaagttataaatacagtaatagaagaggctttgaaatactaatgtcctagcttcagcctggtgatttacaactgtagtgttgattaagcttttgtagaatgtaactaaaatttcatttagttgtttaacaaataactagcaaaggggaaaatttatgattggaagcattttcatttaaattgaaaagcaatttaaaataaggcctatggctataataaaattagtcatagaaatgt

SEQ ID NO: 417794 - DNA, 633 bp, Homo sapiens
aggagagcccgtttataaacgttgaccaaagtgccagaactcgtgggcgctgtgtctgtggcaagaccccgagctgtggagaccgaaagagctgcataaattccagctttattacctgatctcactttgtcactcaggttggagtgcagtggcacaatcacagttcattgcagcctcaacctcctgggctcaggctgcctggagttgggagaggagcaatacaacacccctgtagccaccaccactgggacagcactgggtcagacctgaagccggcacagcgctgtgactgcccaagacccccactgtaacaacaacccagctgccacctatttcactcaaggccccagggctctccaattagcaggtagtgaagccagccaggcttctgtccttcccttcagtgcagtaagctcccctggtccctagatgcattcaaaggtgctgtctgagagccagggctctcagtcataaaccttataaatctacctggtgttctgttctaccatcgctgagctggcactgaatccacccggcaaatcccttcccactctcccctcccctctccccaggcagggtagtctgttcccacctacgacgtcatcacagtctcatgcggattactgccagctc

SEQ ID NO: 417795 - DNA, 407 bp, Homo sapiens
tttttagtaaaacaaagggtaaaatttaataaaaaggcacaaacacattttgtgtatattgtgaaaataccatctatttcctccaaaagcttataaattgatatgagtatcataaacctgtttatttttctcctggactaagtattgttcaacgtttaatgtgtattatgtacagggaggtaatgtgggaccagattttctggttgggaaaggagatgagtactggttttagtacaataagtttccatgcttgtgtagcacaactggagatgccttcatgtaacagacatatgaagaggttgagagagtaggctggagattggaagctatccaagtaaaattgaagcctaggatttgatgagtttgtgtatttgataaagaatagtgtaagagttgtaactggaaac

SEQ ID NO: 417796 - DNA, 213 bp, Homo sapiens
  misc_feature (33)..(33): n is a, c, g, or t
  misc_feature (181)..(181): n is a, c, g, or t
attcatggcccacaaaggagagagaagacctcngatctcttgtgccatgctcactatgctatgtgaaatttgctatgttagaccttgacatcctggatggtggggatgatgactggtttctctgcacagccctgggccagtatcctgcccagcccttaggagtcctcatggaatgagctcngctcccgcgatgctcctgtttgtccactgagg

SEQ ID NO: 417797 - DNA, 561 bp, Homo sapiens
cgcctttccagaccgaaccaatgttcatcttgcacatgttggttgatgtctcatgtctccctaaaatgtataaaaccaaactgtggtctgaccaccttgggcacatgttgtcaggacctcctgagcctgtatcatgggtgtgtgtcctcaaccttggcaaaataaactttctaaattaactgagacctgtctcaggtttttgaggttcacaattaatagtcaatgacgtgagagagaagccctcctcctctcccggttgtggacctttctgtattatcttgcacccaactcagaccagaaggcacagaagaccccatgactcttctaccctccgtgttcaatatgcctctcccgaaaggaacacagccccacctaattggatgtgtgggcctgtgtggacagtgttgaagccccactaagcttcccagacgttatctatataaatgacccctaaacctctccacttgggagcaccaacttccattctttggaatctgtgtacccaggtggcctttctcaagcattgtgtgcaaataaattacatttaaccatattccatat

SEQ ID NO: 417798 - DNA, 829 bp, Homo sapiens
ctgagcacaagctgtctccacaaagccaaccaaagaggcaacattcacaggctgacaaagcatccctaaagcaggaaagaaaagaagcccctgaggctgctgcccggagaaggagaaggctttcaacattcataccagtctgttggggcattgtgcagaccacagagggagagtaactgatggaatactctctgaagttcacacttgggcgaagctgcatgtttaacatcaggagtgggaggaaagtgtaagttacaaaataaacaaataaaaagacagatataaaaataagaaggaaatgcagtgtcagtgtggtaacaccagggactggtgatgtctgttgcatattaggcttctggtgaactcaattaattatttccaagcagaatttttgtgaatttatagtttacatatagtttgcatgtcatttattttttaatgtaagcagtaggaagagtcatttcttgaaagtacaaatgacttttgtttggaaacactttaaaaatggtaacagtgactaaagatcatcaaatgatatctaaaatatggattaactataatacatctgttctccctgggcagacggttagttaatcctttataaattaattacaatgacatcattggagatctcacaaatggattgtacaagaatataccagctctgacttaatgtggccctgagatctgagccttttctctttacttatctattaacctcgtctctacacttgctccccatccctacgtatgcatctttctacccattcagcactcaccaaggagctcactaatttcttcactgtatttacctctgtcatcacctccc

SEQ ID NO: 417799 - DNA, 347 bp, Homo sapiens
  misc_feature (248)..(248): n is a, c, g, or t
ctgagcacaagctgtctccacaaagccaaccaaagaggcaacattcacaggctgacaaagcatccctaaagcaggaaagaaaagaagcccctgaggctgctgcccggagaaggagaaggctttcaacattcataccagtctgttggggcattgtgcagaccacagagggagagtaactgatggaatactctctgaagttcacacttgggcgaagctgcatgtttaacatcaggagtgggaggaaaaanccatttggtctagcgtggtttaggcagtaccagaagggatggggcagacggtacacttctataaattaaagaaccttgccagtgatgtatttattaaag

SEQ ID NO: 417800 - DNA, 412 bp, Homo sapiens
  misc_feature (1)..(1): n is a, c, g, or t
  misc_feature (139)..(139): n is a, c, g, or t
  misc_feature (156)..(156): n is a, c, g, or t
  misc_feature (400)..(400): n is a, c, g, or t
ngagagtatataaagctttatttttaagatataaaaacaatactagtttgaaactactttgttttatttttagtttttctgaaattaatatatgtaaaaaaattcataattttgtagataagagtgtgagcacaaactntgcaatggggtacctcnctcaactgtatggttcaaggcgctgtgtagttgatacaacggtgaagaaaataaatcttgggcccccaaatcctcagctaaagggaaagtcaagctgggaactgcttagggaaaacagcctcccattttgttcagaatcaaaataattgattttgttcattttgctcactctaattgcctcctttggaaaggctaatcagaaactcaaaagaatgcagccatttgtctcttatctacctatganctggaagccccc

SEQ ID NO: 417801 - DNA, 1083 bp, Homo sapiens
atgggcaaaggcttccctggaatctcccacactgtctgctccctataaaaggcaggcagatgggccagaggagcagagaggctgagaccaacccagaaaccaccacctctcacgccaaagctcacaccttcagcctccaacatgaaggtctccgcagcacttctgtggctgctgctcatagcagctgccttcagcccccaggggctcgctgggccagcttctgtcccaaccacctgctgctttaacctggccaataggaagataccccttcagcgactagagagctacaggagaatcaccagtggcaaatgtccccagaaagctgtgatcttcaagaccaaactggccaaggatatctgtgccgaccccaagaagaagtgggtgcaggattccatgaagtatctggaccaaaaatctccaactccaaagccataaataatcaccatttttgaaaccaaaccagagcctgagtgttgcctaatttgttttcccttcttacaatgcattctgaggtaacctcattatcagtccaaagggcatgggttttattatatatatatatattttttttttaaaaaaaaacgtattgcatttaatttattgaggctttaaaacttatcctccatgaatatcagttatttttaaactgtaaagctttgtgcagattctttaccccctgggagccccaattcgatcccctgtcacgtgtgggcaatgttccccctctcctctcttcctccctggaatcttgtaaaggtcctggcaaagatgatcagtatgaaaatgtcattgttcttgtgaacccaaagtgtgactcattaaatggaagtaaatgttgttttaggaatacataaagtatgtgcatattttattatagtcactagttgtaatttttttgtgggaaatccacactgagctgagggggacaaagatggctgtggccaagaggggcttggttaagggggtgggaactatgtccctgggaaatgagtttttggcttagctggtcttcattgaaatgcagggtgaaactgacaaacccattccagccctctattcccattttcaacagtatttcccaga

SEQ ID NO: 417802 - DNA, 826 bp, Homo sapiens
gcattttttcaagttttatgatttatttaacttgtggaacaaaaataaaccagaaaccaccacctctcacgccaaagctcacaccttcagcctccaacatgaaggtctccgcagcacttctgtggctgctgctcatagcagctgccttcagcccccaggggctcgctgggccagcttctgtcccaaccacctgctgctttaacctggccaataggaagataccccttcagcgactagagagctacaggagaatcaccagtggcaaatgtccccagaaagctgtgatcttcaagaccaaactggccaaggatatctgtgccgaccccaagaagaagtgggtgcaggattccatgaagtatctggaccaaaaatctccaactccaaagccataaataatcaccatttttgaaaccaaaccagagcctgagtgttgcctaatttgttttcccttcttacaatgcattctgaggtaacctcattatcagtccaaagggcatgggttttattatatatatatatattttttttttaaaaaaaaacgtattgcatttaatttattgaggctttaaaacttatcctccatgaatatcagttatttttaaactgtaaagctttgtgcagattctttaccccctgggagccccaattcgatcccctgtcacgtgtgggcaatgttccccctctcctctcttcctccctggaatcttgtaaaggtcctggcaaagatgatcagtatgaaaatgtcattgttcttgtgaacccaaagtgtgactcattaaatggaagtaaatgttgttttaggaatacataaagtatgtgcatattt

SEQ ID NO: 417803 - DNA, 869 bp, Homo sapiens
atgggcaaaggcttccctggaatctcccacactgtctgctccctataaaaggcaggcagatgggccagaggagcagagaggctgagaccaacccagaaaccaccacctctcacgccaaagctcacaccttcagcctccaacatgaaggtctccgcagcacttctgtggctgctgctcatagcagctgccttcagcccccaggggctcgctgggccagcttctgtcccaaccacctgctgctttaacctggccaataggaagataccccttcagcgactagagagctacaggagaatcaccagtggcaaatgtccccagaaagctgtgatcttcaagaccaaactggccaaggatatctgtgccgaccccaagaagaagtgggtgcaggattccatgaagtatctggaccaaaaatctccaactccaaagccataaataatcaccatttttgaaaccaaaccagagcctgagtgttgcctaatttgttttcccttcttacaatgcattctgaggtaacctcattatcagtccaaagggcatgggttttattatatatatatatattttttttttaaaaaaaaacgtattgcatttaatttattgaggctttaaaacttatcctccatgaatatcagttatttttaaactgtaaagctttgtgcagattctttaccccctgggagccccaattcgatcccctgtcacgtgtgggcaatgttccccctctcctctcttcctccctggaatcttgtaaaggtcctggcaaagatgatcagtatgaaaatgtcattgttcttgtgaacccaaagtgtgactcattaaatggaagtaaatgttgttttaggaatacataaagtatgtgcatattt

SEQ ID NO: 417804 - DNA, 289 bp, Homo sapiens
atttcagtttttttctaaacctaatgcaaagtagtaatatcacggatttggtagacatttttcttatcacaatgcttatttctacaccttcacagcattttcctatgcttaccactttaaggagatcagaattactgtctcagtttggctggggctgctcagtccaaaatttggaactgagatgagttacagatttcagtttagttagagtttctgaattgcatcagaacagctgggtctacttccagagtggtccctcctgaggtttattttgactcatggttctaca

SEQ ID NO: 417805 - DNA, 517 bp, Homo sapiens
tagcagcacaattcacaattgcaaaattgtggaaccaacccaaatacccatcaatcaatgaatggataaagaaacatatatatatatgatggaatactacacagccataaaaaggaatgaattaacaccattttcagtgacctgaatgagattggagactattattctaagtgaagtgactcaggaatggaaaaccaaacatcgtatgttctcactgatatgtgggggctaagctatgagaatgcaaaggcataagaatgataaaatggactttggggacttggggggaagagtgggagaggggcaagagataaaagactacaaatatggtgcagtttatacataggtgatggggtgcaccaaaatctcacagatcaccactaaagaatttactcatgtaaccaaataccaccggtaccccaacaacttatggacaaataaaataaataaataaaaatatctaaaagggcataattgaattgtttgtaacacaaagaataaatgcttgaggtgatgg

SEQ ID NO: 417806 - DNA, 162 bp, Homo sapiens
atcagtggtctaccacagcttaagtaacgggtcatatttggagtatcacacatctcagtcttgtagaaattaggaacagcaattaggagtcatgcacatataagagatgtaatcccaccctttgactatagcctactcttgtcttttacagaaaagactgtg

SEQ ID NO: 417807 - DNA, 435 bp, Homo sapiens
  misc_feature (1)..(1): n is a, c, g, or t
  misc_feature (47)..(47): n is a, c, g, or t
  misc_feature (74)..(74): n is a, c, g, or t
ngttcaagaccagcctgaccaacacgtgaagccccatctctactaanaatacaaaaattagccgggcctggtgnatcctcctgagtagctgggattacaggtgtatgctaccacacttggctacattttgtatttttggtagagaagaggtttcaccatgttggccagactggtctcgaactcccaacctcaggtgattcgcctgcctcggcctcacaaagtgctggtatgcatctgttcttatgccagaactacactgttttgactatgtagttttgtaggaagttttgaaatcagaaagtatgaatcctccagctttgtgcatcttttcaaagactgctttggctatttggggtcctttaatattccatatgaattttcagatgggtttttctgtttctgtaaaaaatgtgattgggactttggtaaggggcg

SEQ ID NO: 417808 - DNA, 430 bp, Homo sapiens
ttttttacatggagtcttgctgtcttgcccaggctggagtgcagtggcatgatcttggctcacggcaacctctgcctcccgggttcaagcgattctcttgcctcagcctcctgagtagctgggattacaggcgcaccaccacacccagctaatttttgtatttttagtagagacggggtttcaccatgttggccaggctggtctccagctcctgacctcaggtgatccaccctcctcagcttcccacagtgctgagattacaggtgtgagccaccgggcccggacttacccagcttttctaatttatttcccctgatagcttggcttcttcaaacgccactacaaggaaatgctggaggacaagcctgaagacactgccacattcagtggggacgatttcagctgtgtggccccaaatgtgcctttgtcc

SEQ ID NO: 417809 - DNA, 3486 bp, Homo sapiens
  misc_feature (1389)..(1389): n is a, c, g, or t
atgaccttcggcactgtgcttcttctgagtgtcctggcttcttatcatggattcaacctggatgtggaggagcctacgatcttccaggaggatgcaggcggctttgggcagagcgtggtgcagttcggtggatctcgactcgtggtgggagcacccctggaggtggtggcggccaaccagacgggacggctgtatgactgcgcagctgccaccggcatgtgccagcccatcccgctgcacatccgccctgaggccgtgaacatgtccttgggcctgaccctggcagcctccaccaacggctcccggctcctggcctgtggcccgaccctgcacagagtctgtggggagaactcatactcaaagggttcctgcctcctgctgggctcgcgctgggagatcatccagacagtccccgacgccacgccagagtgtccacatcaagagatggacatcgtcttcctgattgacggctctggaagcattgaccaaaatgactttaaccagatgaagggctttgtccaagctgtcatgggccagtttgagggcactgacaccctgtttgcactgatgcagtactcaaacctcctgaagatccacttcaccttcacccaattccggaccagcccgagccagcagagcctggtggatcccatcgtccaactgaaaggcctgacgttcacggccacgggcatcctgacagtggtgacacagctatttcatcataagaatggggcccgaaaaagtgccaagaagatcctcattgtcatcacagatgggcagaagtacaaagaccccctggaatacagtgatgtcatcccccaggcagagaaggctggcatcatccgctacgctatcggggtgggacacgctttccagggacccactgccaggcaggagctgaataccatcagctcagcgcctccgcaggaccacgtgttcaaggtggacaactttgcagcccttggcagcatccagaagcagctgcaggagaagatctatgcagttgagggaacccagtccagggcaagcagctccttccagcacgagatgtcccaagaaggcttcagcacagccctcacaatggatggcctcttcctgggggctgtggggagctttagctggtctggaggtgccttcctgtatcccccaaatatgagccccaccttcatcaacatgtctcaggagaatgtggacatgagggactcttacctgggttactccaccgagctagccctgtggaagggggtacagaacctggtcctgggggccccccgctaccagcataccgggaaggctgtcatcttcacccaggtgtccaggcaatggaggaagaaggccgaagtcacagggacgcagatcggctcctacttcggggcctccctctgctcngtggatgtggacagcgatggcagcaccgacctgatcctcattggggccccccattactatgagcagacccgagggggccaggtgtccgtgtgtcccttgcctagggggcagagggtgcagtggcagtgtgacgctgttctccgtggtgagcagggccacccctggggccgctttggggcagccctgacagtgttgggggatgtgaatgaggacaagctgatagacgtggccattggggccccgggagagcaggagaaccggggtgctgtctacctgtttcacggagcctcagaatccggcatcagcccctcccacagccagcggattgccagctcccagctctcccccaggctgcagtattttgggcaggcgctgagtgggggtcaggacctcacccaggatggactgatggacctggccgtgggggcccggggccaggtgctcctgctcaggagtctgccggtgctgaaagtgggggtggccatgagattcagccctgtggaggtggccaaggctgtgtaccggtgctgggaagagaagcccagtgccctggaagctggggacgccaccgtctgtctcaccatccagaaaagctcactggaccagctaggtgacatccaaagctctgtcaggtttgatctggcactggacccaggtcgtctgacttctcgtgccattttcaatgaaaccaagaaccccactttgactcgaagaaaaaccctgggactggggattcactgtgaaaccctgaagctgcttttgccagattgtgtggaggatgtggtgagccccatcattctgcacctcaacttctcactggtgagagagcccatcccctccccccagaacctgcgtcctgtgctggccgtgggctcacaagacctcttcactgcttctctccccttcgagaagaactgtgggcaagatggcctctgtgaaggggacctgggtgtcaccctcagcttctcaggcctgcagaccctgaccgtggggagctccctggagctcaacgtgattgtgactgtgtggaacgcaggtgaggattcctacggaaccgtggtcagcctctactatccagcagggctgtcgcaccgacgggtgtcaggagcccagaagcagccccatcagagtgccctgcgcctggcatgtgagacagtgcccactgaggatgagggcctaagaagcagccgctgcagtgtcaaccaccccatcttccatgagggctctaacggcaccttcatagtcacattcgatgtctcctacaaggccaccctgggagacaggatgcttatgagggccagtgcaagcagtgagaacaataaggcttcaagcagcaaggccaccttccagctggagctcccggtgaagtatgcagtctacaccatgatcagcaggcaggaagaatccaccaagtacttcaactttgcaacctccgatgagaagaaaatgaaagaggctgagcatcgataccgtgtgaataacctcagccagcgagatctggccatcagcattaacttctgggttcctgtcctgctgaacggggtggctgtgtgggatgtggtcatggaggccccatctcagagtctcccctgtgtttcagagagaaaacctccccagcattctgacttcctgacccagatttcaagaagtcccatgctggactgctccattgctgactgcctgcagttccgctgtgacgtcccctccttcagcgtccaggaggagctggatttcaccctgaagggcaatctcagtttcggctgggtccgcgagacattgcagaagaaggtgttggtcgtgagtgtggctgaaattacgttcgacacatccgtgtactcccagcttccaggacaggaggcatttatgagagctcagatggagatggtgctagaagaagacgaggtctacaatgccattcccatcatcatgggcagctctgtgggggctctgctactgctggcgctcatcacagccacactgtacaagcttggcttcttcaaacgccactacaaggaaatgctggaggacaagcctgaagacactgccacattcagtggggacgatttcagctgtgtggccccaaatgtgcctttgtcc

SEQ ID NO: 417810 - DNA, 130 bp, Homo sapiens
ttgacgttaaaagacagaaataaacggtagctaatgtcacgaaatgggaagtgatacactgactgagaatgttacattcaagccacactggatcggagaaacaacctgttcattcctacctctaggcctt

SEQ ID NO: 417811 - DNA, 357 bp, Homo sapiens
cctctcaggaaaacacctagacattatgtaatgtatttgaagattaatgtaccctttaaccagcagttgtgtacctaggtacaaactttgcaagcacacacgcatgtatgttccaaaaagcacatacaaaaacactcctaacagcattatttgtaataataaaatataagaaattacctaaatatccatcgactgccattggtagtatggttatacaatggaattctacacagcaatgaaaaggagctagagctacatgcaacaacatggatacaactcacaaacgtaagacttagtggaaaaagctagacacaaagttaacaccttctatatgtggttccagttatataaaaccaa

SEQ ID NO: 417812 - DNA, 372 bp, Homo sapiens
ggactcacaacacctaacccacagtggaaacaacaaaattccccattaaacacctacttctctcttccaacatgttccttgcctgtcaaccgcacaccttctccttatctccccacaagacagaatctaaatatcttgcttgatgctctgagcagtccagtccacaccttcagcttcaaaccccatactgaaaaacacagggctggggtcagcaaatgcctgcctggcctgacagctggtgtggttctgaagctccacaactttggcctaatcatctctctcaggggttctcctctcccctgtccttggggaggaaacaagacaagtcaaccccagtgtgaacaatgtcaagtttcattcctttactgtttc

SEQ ID NO: 417813 - DNA, 744 bp, Homo sapiens
gggaaaagccagtgagccccggtaattggacgagggggggtggggagaagcgtggactgggcagcctgtgggtaattggaggttcattgagaattgagtctttggaaacactaagaaaatcaaatttttaaaagttatttatggcctgggaaacaatttgcatttgtccccaaatacgcttagctgtgtgccgcttagaacgatgcgaaaccatccctctgtgtaagcccgtgccgtgtgactcgaagcctagcgccctccctgcgaagcatcagacgccacccagccctggggggaggcccacgcctgctggaccaacgcgggttctggggtgcacagcgccaggttaacgctgaagcctgccccgctgagcccaggagccgggaggcctgcgggctgacccagaatccgatcatgcacctgtcctcatgccagcggctttggctggggttggtctgaagcctgcacgcggcagttctttgttaaagatctgagggactcctcagtcctggggcgtcgccgcctgcagcctcttccaagccctgcgtccagcgagcgtcacagcacaacctgcaaaaacggagctgggctgcagctggggctggcatggactttcatttcagagattcggtttttaagaagatgcatgcctaatgtgttcttttttttttccaatgatttgtaatatacattttatgactggaaacttttttgtacaacactccaataaacattttgatttta

SEQ ID NO: 417814 - DNA, 471 bp, Homo sapiens
ggtgttgaacagctccccaaatgctctctggtcaaccggcttcctcagtcgaagacacaggtcccttcaatactggcttctggggagaagatgagtgcagaaaccacagctgcattaaacgcgtgcgtcgcaagttcctgtgactgttttggaacccagaacagaatgtgtagctcacaggcgggctcatggggacatggaagtggaatggaaggctctagaaatagacactgttgttgctcagcccctccctggtggggaggtgggggcagccatctacctgccggctgcctccaggctggccctgatcatggccgaccttccttccttccttcctgcagggggacccgaggaccacctcaagaggctgctacgtgatgtgaacccacactcctcacccgtagctgtacctcacccgtagctgtacctcacccgtagctgtacctcacccgtagctgtaactcacccgta

SEQ ID NO: 417815 - DNA, 107 bp, Homo sapiens
actagttctagatcgcgagcggcgccttttttttccaatgatttgtaatatacattttatgactggaaacttttttgtacaacactccaataaacattttgatttta

SEQ ID NO: 417816 - DNA, 4633 bp, Homo sapiens
gcctggtggcgaattcggcacgaggatgagcccgccgagcccgggccgccgtcgggagcagcgcaggccgcgagccgccgccaccatggccacgccgctgcccggccgcgcgggcgggcccgccacgccgctgtcgcccacgcgcctgtcgcggctgcaggagaaggaggagctgcgcgagctcaacgaccgcctggcgcactacatcgaccgcgtccgcgcgctggagctggagaacgaccggctcctgctcaagatctcagagaaggaggaggtgaccacgcgcgaggtgagtggcatcaaggcgctgtacgagtcggagctggccgatgcccggagagtcctggatgagacggctcgagagcgtgcccggctgcagatagagattgggaagctgagggcagagttggacgaggtcaacaagagcgccaagaagagggagggcgagcttacggtggcccagggccgtgtgaaggacctggagtccctgttccaccggagcgaggtggagctggcagctgccctcagcgacaagcgcggcctggagagtgacgtggctgagctgcgggcccagctggccaaggccgaggacggtcatgcagtggccaaaaagcagctggagaaggagacgctgatgcgtgtggacctggagaaccgctgccagagcctgcaggaggagctggacttccggaagagtgtgttcgaggaggaggtgcgggagacgcggcggcggcacgagcggcgcctggtggaggtggacagcagccggcagcaggagtacgacttcaagatggcacaggcgctggaggagctgcggagccagcacgacgagcaagtgcggctctacaagctggagctggagcagacctaccaggccaagctggacagcgccaagctgagctctgaccagaacgacaaggcggccagtgcggctcgcgaggagctgaaggaggcccgcatgcgcctggagtccctcagctaccagctctccggcctccagaagcaggccagtgccgctgaagatcgcattcgggagctggaggaggccatggccggggagcgggacaagttccggaagatgctggacgccaaggagcaggagatgacggagatgcgggacgtgatgcagcagcagctggccgagtaccaggagctgctggacgtgaagctggccctggacatggagatcaacgcctaccggaagctcctggagggcgaggaggagaggctgaagctgtcccccagcccatcctcgcgcgtcaccgtctcacgagccacctcgagcagcagcggcagcttgtccgccaccgggcgcctgggccgcagtaagcggaagcggctggaggtggaggagcccttgggcagcggcccaagcgtcctgggcacgggcacgggtggcagcggtggcttccacctggcccagcaggcctcggcctcgggtagcgtcagcatcgaggagatcgacctggagggcaagtttgtgcagctcaagaacaactcggacaaggatcagtctctggggaactggagaatcaagaggcaggtcttggagggggaggagatcgcctacaagttcacgcccaagtacatcctgcgcgccggccagatggtcacggtgtgggcagctggtgcgggggtggcccacagccccccctcgacgctggtgtggaagggccagagcagctggggcacgggcgagagcttccgcaccgtcctggttaacgcggatggcgaggaagtggccatgaggactgtgaagaagtcctcggtgatgcgtgagaatgagaatggggaggaagaggaggaggaagccgagtttggcgaggaggatcttttccaccaacagggggacccgaggaccacctcaagaggctgctacgtgatgtgaacccacactcctcatccacacacctttctttacccagagccactgaaaactatttttatatcattggctttctttagttcttgatacatttctagagaatttctaagcgaactgccagaacgtgtgggtgggtctcccccagccctccctcctggcgggtctcctccagcctcacttcgctgccacttcgccgctgccccggagacttttcaatcccaccccactcctcatctcaccatttggtcaaattggaagcccagggccaggacccggaggtttagaagatgcttgggcttggagggaggagggccggcgaggctagcgaggggacaggagacggccctgctgcggacggagcgcggaaactgcgtaggaattcagtggtggtgggtttttttaaggctttctacaaaaccaaattcagaatccaggcgtcgacctggtggggcccggggccaagcctgcattctggctgcccagcttcggacagcgggaactcctcaggcagccacgcagcgggtgtgggccagcatggggatggcgtggcccccagggcgggttttcactccgctgcctgggcttccagattcccgttctggcagcgcaccggccgggtttctcggaccgttgactttatttgggggagttttcccgcagttcagttcctgactgtgcaaggccaacagggcaggggaggggaagacctggggaaggaagaatgaggacagtcccgtcgtaagacctgtcacaacaataagcagggaggggagatgtggaggggacacatctggttgccttggaggcagaagctgtgagtttcagaacagctgtctgcagggaacgccaccatgttgaccctctggaggagagcgctgtggagcccctcccgtgttccagctccgtctgccctgtgcctatatatacacatgcgtctatccatactgtgcttttatctgtgattttctcgctgaaaccatgtttctcagacaggccaaggccacctgactcctatcacgacgcacccaagcccctcagtccagcttcccaatgcctggcaccccccttcggcaatagctcaccgtttacaccctccctcatagatacacagaagttatttttttaatggatatttatttttttacattggtcagtacacaggtcaggagctcacgccagggccttgaggacaggctgaccctcctccccggggtggcgtggggctggggcaccctccgacggcagagcctccttcagaaagtgcagctcaagtcttaaagacaccaaaactgagccatgggcacgcgccgtctccgggccatggcgttcactgcagggcgggggcggcaccgctcccctgtgactgcatcccgcctccctggggacctgcctgtggcaggaaggaatggggggccccagccccaggccgggaaggagccagcggccgacaaagcagaaacacccgctgctccacgtagcccctgctcgctgtccttgctctcagaagtcccggtcccatgtagatagaggggggcgcatcttaccaaagcatttcctcctggaggctacgccgctgtgctcccagtcaggcggctggtagggagctttgcctgccccggggataccctctgccagccgctggaagtgggaatgctggcgacagactgtgtcctctttcccaccttcatagcaggaatcacccggacccgactggctgggcttcgtgctagcgagggttctgggggtgggtcttggtgatcttgtcctatggggagtctgcagtggtctcagccacatcctatgtattttggctctggaggagcaaagctgtatcctggagttggtctgtgatttgccgacagccttgcaggctgggctcagggacaaagtcccccccaaaacccgcaggtcctcatgtccagacgctgcccagtcctgtcctgaaaacagcacgccccaggcccacagaaccccccaccctacatttgccttgggtggagctgggggtggtcctaggactgcgggtgcccttagctgaagggggtggggagaagcgtggactgggcagcctgtgggtaattggaggttcattgagaattgagtctttggaaacactaagaaaatcaaatttttaaaagttatttatggcctgggaaacaatttgcatttgtccccaaatacgcttagctgtgtgccgcttagaacgatgcgaaaccatccctctgtgtaagcccgtgccgtgtgactcgaagcctagcgccctccctgcgaagcatcagacgccacccagccctggggggaggcccacgcctgctggaccaacgcgggttctggggtgcacagcgccaggttaacgctgaagcctgccccgctgagcccaggagccgggaggcctgcgggctgacccagaatccgatcatgcacctgtcctcatgccagcggctttggctggggttggtctgaagcctgcacgcggcagttctttgttaaagatctgagggactcctcagtcctggggcgtcgccgcctgcagcctcttccaagccctgcgtccagcgagcgtcacagcacaacctgcaaaaacggagctgggctgcagctggggctggcatggactttcatttcagagattcggtttttaagaagatgcatgcctaatgtgttcttttttttttccaatgatttgtaatatacattttatgactggaaacttttttgtacaacactccaataaacattttgatttta

SEQ ID NO: 417817 - DNA, 2929 bp, Homo sapiens
cggacgcgtgggtcgacccacgcgtcgggcggaagtggccatgaggactgtgaagaagtcctcggtgatgcgtgagaatgagaatggggaggaagaggaggaggaagccgagtttggcgaggaggatcttttccaccaacagggggacccgaggaccacctcaagaggctgctacgtgatgtgaacccacactcctcatccacacacctttctttacccagagccactgaaaactatttttatatcattggctttctttagttcttgatacatttctagagaatttctaagcgaactgccagaacgtgtgggtgggtctcccccagccctccctcctggcgggtctcctccagcctcacttcgctgccacttcgccgctgccccggagacttttcaatcccaccccactcctcatctcaccatttggtcaaattggaagcccagggccaggacccggaggtttagaagatgcttgggcttggagggaggagggccggcgaggctagcgaggggacaggagacggccctgctgcggacggagcgcggaaactgcgtaggaattcagtggtggtgggtttttttaaggctttctacaaaaccaaattcagaatccaggcgtcgacctggtggggcccggggccaagcctgcattctggctgcccagcttcggacagcgggaactcctcaggcagccacgcagcgggtgtgggccagcatggggatggcgtggcccccagggcgggttttcactccgctgcctgggcttccagattcccgttctggcagcgcaccggccgggtttctcggaccgttgactttatttgggggagttttcccgcagttcagttcctgactgtgcaaggccaacagggcaggggaggggaagacctggggaaggaagaatgaggacagtcccgtcgtaagacctgtcacaacaataagcagggaggggagatgtggaggggacacatctggttgccttggaggcagaagctgtgagtttcagaacagctgtctgcagggaacgccaccatgttgaccctctggaggagagcgctgtggagcccctcccgtgttccagctccgtctgccctgtgcctatatatacacatgcgtctatccatactgtgcttttatctgtgattttctcgctgaaaccatgtttctcagacaggccaaggccacctgactcctatcacgacgcacccaagcccctcagtccagcttcccaatgcctggcaccccccttcggcaatagctcaccgtttacaccctccctcatagatacacagaagttatttttttaatggatatttatttttttacattggtcagtacacaggtcaggagctcacgccagggccttgaggacaggctgaccctcctccccggggtggcgtggggctggggcaccctccgacggcagagcctccttcagaaagtgcagctcaagtcttaaagacaccaaaactgagccatgggcacgcgccgtctccgggccatggcgttcactgcagggcgggggcggcaccgctcccctgtgactgcatcccgcctccctggggacctgcctgtggcaggaaggaatggggggccccagccccaggccgggaaggagccagcggccgacaaagcagaaacacccgctgctccacgtagcccctgctcgctgtccttgctctcagaagtcccggtcccatgtagatagaggggggcgcatcttaccaaagcatttcctcctggaggctacgccgctgtgctcccagtcaggcggctggtagggagctttgcctgccccggggataccctctgccagccgctggaagtgggaatgctggcgacagactgtgtcctctttcccaccttcatagcaggaatcacccggacccgactggctgggcttcgtgctagcgagggttctgggggtgggtcttggtgatcttgtcctatggggagtctgcagtggtctcagccacatcctatgtattttggctctggaggagcaaagctgtatcctggagttggtctgtgatttgccgacagccttgcaggctgggctcagggacaaagtcccccccaaaacccgcaggtcctcatgtccagacgctgcccagtcctgtcctgaaaacagcacgccccaggcccacagaaccccccaccctacatttgccttgggtggagctgggggtggtcctaggactgcgggtgcccttagctgaagggggtggggagaagcgtggactgggcagcctgtgggtaattggaggttcattgagaattgagtctttggaaacactaagaaaatcaaatttttaaaagttatttatggcctgggaaacaatttgcatttgtccccaaatacgcttagctgtgtgccgcttagaacgatgcgaaaccatccctctgtgtaagcccgtgccgtgtgactcgaagcctagcgccctccctgcgaagcatcagacgccacccagccctggggggaggcccacgcctgctggaccaacgcgggttctggggtgcacagcgccaggttaacgctgaagcctgccccgctgagcccaggagccgggaggcctgcgggctgacccagaatccgatcatgcacctgtcctcatgccagcggctttggctggggttggtctgaagcctgcacgcggcagttctttgttaaagatctgagggactcctcagtcctggggcgtcgccgcctgcagcctcttccaagccctgcgtccagcgagcgtcacagcacaacctgcaaaaacggagctgggctgcagctggggctggcatggactttcatttcagagattcggtttttaagaagatgcatgcctaatgtgttcttttttttttccaatgatttgtaatatacattttatgactggaaacttttttgtacaacactccaataaacattttgatttta

SEQ ID NO: 417818 - DNA, 3571 bp, Homo sapiens
catcttgcagccggcggcgcggattgaatgagcccgccgagcccgggccgccgtcgggagcagcgcaggccgcgagccgccgccaccatggccacgccgctgcccggccgcgcgggcgggcccgccacgccgctgtcgcccacgcgcctgtcgcggctgcaggagaaggaggagctgcgcgagctcaacgaccgcctggcgcactacatcgaccgcgtccgcgcgctggagctggagaacgaccggctcctgctcaagatctcagagaaggaggaggtgaccacgcgcgaggtgagtggcatcaaggcgctgtacgagtcggagctggccgatgcccggagagtcctggatgagacggctcgagagcgtgcccggctgcagatagagattgggaagctgagggcagagttggacgaggtcaacaagagcgccaagaagagggagggcgagcttacggtggcccagggccgtgtgaaggacctggagtccctgttccaccggagcgaggtggagctggcagctgccctcagcgacaagcgcggcctggagagtgacgtggctgagctgcgggcccagctggccaaggccgaggacggtcatgcagtggccaaaaagcagctggagaaggagacgctgatgcgtgtggacctggagaaccgctgccagagcctgcaggaggagctggacttccggaagagtgtgttcgaggaggaggtgcgggagacgcggcggcggcacgagcggcgcctggtggaggtggacagcagccggcagcaggagtacgacttcaagatggcacaggcgctggaggagctgcggagccagcacgacgagcaagtgcggctctacaagctggagctggagcagacctaccaggccaagctggacagcgccaagctgagctctgaccagaacgacaaggcggccagtgcggctcgcgaggagctgaaggaggcccgcatgcgcctggagtccctcagctaccagctctccagcctcacttcgctgccacttcgccgctgccccggagacttttcaatcccaccccactcctcatctcaccatttggtcaaattggaagcccagggccaggacccggaggtttagaagatgcttgggcttggagggaggagggccggcgaggctagcgaggggacaggagacggccctgctgcggacggagcgcggaaactgcgtaggaattcagtggtggtgggtttttttaaggctttctacaaaaccaaattcagaatccaggcgtcgacctggtggggcccggggccaagcctgcattctggctgcccagcttcggacagcgggaactcctcaggcagccacgcagcgggtgtgggccagcatggggatggcgtggcccccagggcgggttttcactccgctgcctgggcttccagattcccgttctggcagcgcaccggccgggtttctcggaccgttgactttatttgggggagttttcccgcagttcagttcctgactgtgcaaggccaacagggcaggggaggggaagacctggggaaggaagaatgaggacagtcccgtcgtaagacctgtcacaacaataagcagggaggggagatgtggaggggacacatctggttgccttggaggcagaagctgtgagtttcagaacagctgtctgcagggaacgccaccatgttgaccctctggaggagagcgctgtggagcccctcccgtgttccagctccgtctgccctgtgcctatatatacacatgcgtctatccatactgtgcttttatctgtgattttctcgctgaaaccatgtttctcagacaggccaaggccacctgactcctatcacgacgcacccaagcccctcagtccagcttcccaatgcctggcaccccccttcggcaatagctcaccgtttacaccctccctcatagatacacagaagttatttttttaatggatatttatttttttacattggtcagtacacaggtcaggagctcacgccagggccttgaggacaggctgaccctcctccccggggtggcgtggggctggggcaccctccgacggcagagcctccttcagaaagtgcagctcaagtcttaaagacaccaaaactgagccatgggcacgcgccgtctccgggccatggcgttcactgcagggcgggggcggcaccgctcccctgtgactgcatcccgcctccctggggacctgcctgtggcaggaaggaatggggggccccagccccaggccgggaaggagccagcggccgacaaagcagaaacacccgctgctccacgtagcccctgctcgctgtccttgctctcagaagtcccggtcccatgtagatagaggggggcgcatcttaccaaagcatttcctcctggaggctacgccgctgtgctcccagtcaggcggctggtagggagctttgcctgccccggggataccctctgccagccgctggaagtgggaatgctggcgacagactgtgtcctctttcccaccttcatagcaggaatcacccggacccgactggctgggcttcgtgctagcgagggttctgggggtgggtcttggtgatcttgtcctatggggagtctgcagtggtctcagccacatcctatgtattttggctctggaggagcaaagctgtatcctggagttggtctgtgatttgccgacagccttgcaggctgggctcagggacaaagtcccccccaaaacccgcaggtcctcatgtccagacgctgcccagtcctgtcctgaaaacagcacgccccaggcccacagaaccccccaccctacatttgccttgggtggagctgggggtggtcctaggactgcgggtgcccttagctgaagggggtggggagaagcgtggactgggcagcctgtgggtaattggaggttcattgagaattgagtctttggaaacactaagaaaatcaaatttttaaaagttatttatggcctgggaaacaatttgcatttgtccccaaatacgcttagctgtgtgccgcttagaacgatgcgaaaccatccctctgtgtaagcccgtgccgtgtgactcgaagcctagcgccctccctgcgaagcatcagacgccacccagccctggggggaggcccacgcctgctggaccaacgcgggttctggggtgcacagcgccaggttaacgctgaagcctgccccgctgagcccaggagccgggaggcctgcgggctgacccagaatccgatcatgcacctgtcctcatgccagcggctttggctggggttggtctgaagcctgcacgcggcagttctttgttaaagatctgagggactcctcagtcctggggcgtcgccgcctgcagcctcttccaagccctgcgtccagcgagcgtcacagcacaacctgcaaaaacggagctgggctgcagctggggctggcatggactttcatttcagagattcggtttttaagaagatgcatgcctaatgtgttcttttttttttccaatgatttgtaatatacattttatgactggaaacttttttgtacaacactccaataaacattttgatttta

SEQ ID NO: 417819 - DNA, 3128 bp, Homo sapiens
ggtgttgaacagctccccaaatgctctctggtcaaccggcttcctcagtcgaagacacaggtcccttcaatactggcttctggggagaagatgagtgcagaaaccacagctgcattaaacgcgtgcgtcgcaagttcctgtgactgttttggaacccagaacagaatgtgtagctcacaggcgggctcatggggacatggaagtggaatggaaggctctagaaatagacactgttgttgctcagcccctccctggtggggaggtgggggcagccatctacctgccggctgcctccaggctggccctgatcatggccgaccttccttccttccttcctgcagggggacccgaggaccacctcaagaggctgctacgtgatgtgaacccacactcctcatccacacacctttctttacccagagccactgaaaactatttttatatcattggctttctttagttcttgatacatttctagagaatttctaagcgaactgccagaacgtgtgggtgggtctcccccagccctccctcctggcgggtctcctccagcctcacttcgctgccacttcgccgctgccccggagacttttcaatcccaccccactcctcatctcaccatttggtcaaattggaagcccagggccaggacccggaggtttagaagatgcttgggcttggagggaggagggccggcgaggctagcgaggggacaggagacggccctgctgcggacggagcgcggaaactgcgtaggaattcagtggtggtgggtttttttaaggctttctacaaaaccaaattcagaatccaggcgtcgacctggtggggcccggggccaagcctgcattctggctgcccagcttcggacagcgggaactcctcaggcagccacgcagcgggtgtgggccagcatggggatggcgtggcccccagggcgggttttcactccgctgcctgggcttccagattcccgttctggcagcgcaccggccgggtttctcggaccgttgactttatttgggggagttttcccgcagttcagttcctgactgtgcaaggccaacagggcaggggaggggaagacctggggaaggaagaatgaggacagtcccgtcgtaagacctgtcacaacaataagcagggaggggagatgtggaggggacacatctggttgccttggaggcagaagctgtgagtttcagaacagctgtctgcagggaacgccaccatgttgaccctctggaggagagcgctgtggagcccctcccgtgttccagctccgtctgccctgtgcctatatatacacatgcgtctatccatactgtgcttttatctgtgattttctcgctgaaaccatgtttctcagacaggccaaggccacctgactcctatcacgacgcacccaagcccctcagtccagcttcccaatgcctggcaccccccttcggcaatagctcaccgtttacaccctccctcatagatacacagaagttatttttttaatggatatttatttttttacattggtcagtacacaggtcaggagctcacgccagggccttgaggacaggctgaccctcctccccggggtggcgtggggctggggcaccctccgacggcagagcctccttcagaaagtgcagctcaagtcttaaagacaccaaaactgagccatgggcacgcgccgtctccgggccatggcgttcactgcagggcgggggcggcaccgctcccctgtgactgcatcccgcctccctggggacctgcctgtggcaggaaggaatggggggccccagccccaggccgggaaggagccagcggccgacaaagcagaaacacccgctgctccacgtagcccctgctcgctgtccttgctctcagaagtcccggtcccatgtagatagaggggggcgcatcttaccaaagcatttcctcctggaggctacgccgctgtgctcccagtcaggcggctggtagggagctttgcctgccccggggataccctctgccagccgctggaagtgggaatgctggcgacagactgtgtcctctttcccaccttcatagcaggaatcacccggacccgactggctgggcttcgtgctagcgagggttctgggggtgggtcttggtgatcttgtcctatggggagtctgcagtggtctcagccacatcctatgtattttggctctggaggagcaaagctgtatcctggagttggtctgtgatttgccgacagccttgcaggctgggctcagggacaaagtcccccccaaaacccgcaggtcctcatgtccagacgctgcccagtcctgtcctgaaaacagcacgccccaggcccacagaaccccccaccctacatttgccttgggtggagctgggggtggtcctaggactgcgggtgcccttagctgaagggggtggggagaagcgtggactgggcagcctgtgggtaattggaggttcattgagaattgagtctttggaaacactaagaaaatcaaatttttaaaagttatttatggcctgggaaacaatttgcatttgtccccaaatacgcttagctgtgtgccgcttagaacgatgcgaaaccatccctctgtgtaagcccgtgccgtgtgactcgaagcctagcgccctccctgcgaagcatcagacgccacccagccctggggggaggcccacgcctgctggaccaacgcgggttctggggtgcacagcgccaggttaacgctgaagcctgccccgctgagcccaggagccgggaggcctgcgggctgacccagaatccgatcatgcacctgtcctcatgccagcggctttggctggggttggtctgaagcctgcacgcggcagttctttgttaaagatctgagggactcctcagtcctggggcgtcgccgcctgcagcctcttccaagccctgcgtccagcgagcgtcacagcacaacctgcaaaaacggagctgggctgcagctggggctggcatggactttcatttcagagattcggtttttaagaagatgcatgcctaatgtgttcttttttttttccaatgatttgtaatatacattttatgactggaaacttttttgtacaacactccaataaacattttgatttta

SEQ ID NO: 417820 - DNA, 4421 bp, Homo sapiens
catcttgcagccggcggcgcggattgaatgagcccgccgagcccgggccgccgtcgggagcagcgcaggccgcgagccgccgccaccatggccacgccgctgcccggccgcgcgggcgggcccgccacgccgctgtcgcccacgcgcctgtcgcggctgcaggagaaggaggagctgcgcgagctcaacgaccgcctggcgcactacatcgaccgcgtccgcgcgctggagctggagaacgaccggctcctgctcaagatctcagagaaggaggaggtgaccacgcgcgaggtgagtggcatcaaggcgctgtacgagtcggagctggccgatgcccggagagtcctggatgagacggctcgagagcgtgcccggctgcagatagagattgggaagctgagggcagagttggacgaggtcaacaagagcgccaagaagagggagggcgagcttacggtggcccagggccgtgtgaaggacctggagtccctgttccaccggagcgaggtggagctggcagctgccctcagcgacaagcgcggcctggagagtgacgtggctgagctgcgggcccagctggccaaggccgaggacggtcatgcagtggccaaaaagcagctggagaaggagacgctgatgcgtgtggacctggagaaccgctgccagagcctgcaggaggagctggacttccggaagagtgtgttcgaggaggaggtgcgggagacgcggcggcggcacgagcggcgcctggtggaggtggacagcagccggcagcaggagtacgacttcaagatggcacaggcgctggaggagctgcggagccagcacgacgagcaagtgcggctctacaagctggagctggagcagacctaccaggccaagctggacagcgccaagctgagctctgaccagaacgacaaggcggccagtgcggctcgcgaggagctgaaggaggcccgcatgcgcctggagtccctcagctaccagctctccggcctccagaagcaggccagtgccgctgaagatcgcattcgggagctggaggaggccatggccggggagcgggacaagttccggaagatgctggacgccaaggagcaggagatgacggagatgcgggacgtgatgcagcagcagctggccgagtaccaggagctgctggacgtgaagctggccctggacatggagatcaacgcctaccggaagctcctggagggcgaggaggagaggctgaagctgtcccccagcccatcctcgcgcgtcaccgtctcacgagccacctcgagcagcagcggcagcttgtccgccaccgggcgcctgggccgcagtaagcggaagcggctggaggtggaggagcccttgggcagcggcccaagcgtcctgggcacgggcacgggtggcagcggtggcttccacctggcccagcaggcctcggcctcgggtagcgtcagcatcgaggagatcgacctggagggcaagtttgtgcagctcaagaacaactcggacaaggatcagtctctggggaactggagaatcaagaggcaggtcttggagggggaggagatcgcctacaagttcacgcccaagtacatcctgcgcgccggccagatggtcacggtgtgggcagctggtgcgggggtggcccacagccccccctcgacgctggtgtggaagggccagagcagctggggcacgggcgagagcttccgcaccgtcctggttaacgcggatggcgaggaagtggccatgaggactgtgaagaagtcctcggtgatgcgtgagaatgagaatggggaggaagaggaggaggaagccgagtttggcgaggaggatcttttccaccaacagggggacccgaggaccacctcaagaggctgctacgtgatgtgaacccacactcctcatccacacacctttctttacccagagccactgaaaactatttttatatcattggctttctttagttcttgatacatttctagagaatttctaagcgaactgccagaacgtgtgggtgggtctcccccagccctccctcctggcgggtctcctccagcctcacttcgctgccacttcgccgctgccccggagacttttcaatcccaccccactcctcatctcaccatttggtcaaattggaagcccagggccaggacccggaggtttagaagatgcttgggcttggagggaggagggccggcgaggctagcgaggggacaggagacggccctgctgcggacggagcgcggaaactgcgtaggaattcagtggtggtgggtttttttaaggctttctacaaaaccaaattcagaatccaggcgtcgacctggtggggcccggggccaagcctgcattctggctgcccagcttcggacagcgggaactcctcaggcagccacgcagcgggtgtgggccagcatggggatggcgtggcccccagggcgggttttcactccgctgcctgggcttccagattcccgttctggcagcgcaccggccgggtttctcggaccgttgactttatttgggggagttttcccgcagttcagttcctgactgtgcaaggccaacagggcaggggaggggaagacctggggaaggaagaatgaggacagtcccgtcgtaagacctgtcacaacaataagcagggaggggagatgtggaggggacacatctggttgccttggaggcagaagctgtgagtttcagaacagctgtctgcagggaacgccaccatgttgaccctctggaggagagcgctgtggagcccctcccgtgttccagctccgtctgccctgtgcctatatatacacatgcgtctatccatactgtgcttttatctgtgattttctcgctgaaaccatgtttctcagacaggccaaggccacctgactcctatcacgacgcacccaagcccctcagtccagcttcccaatgcctggcaccccccttcggcaatagctcaccgtttacaccctccctcatagatacacagaagttatttttttaatggatatttatttttttacattggtcagtacacaggtcaggagctcacgccagggccttgaggacaggctgaccctcctccccaggccgggaaggagccagcggccgacaaagcagaaacacccgctgctccacgtagcccctgctcgctgtccttgctctcagaagtcccggtcccatgtagatagaggggggcgcatcttaccaaagcatttcctcctggaggctacgccgctgtgctcccagtcaggcggctggtagggagctttgcctgccccggggataccctctgccagccgctggaagtgggaatgctggcgacagactgtgtcctctttcccaccttcatagcaggaatcacccggacccgactggctgggcttcgtgctagcgagggttctgggggtgggtcttggtgatcttgtcctatggggagtctgcagtggtctcagccacatcctatgtattttggctctggaggagcaaagctgtatcctggagttggtctgtgatttgccgacagccttgcaggctgggctcagggacaaagtcccccccaaaacccgcaggtcctcatgtccagacgctgcccagtcctgtcctgaaaacagcacgccccaggcccacagaaccccccaccctacatttgccttgggtggagctgggggtggtcctaggactgcgggtgcccttagctgaagggggtggggagaagcgtggactgggcagcctgtgggtaattggaggttcattgagaattgagtctttggaaacactaagaaaatcaaatttttaaaagttatttatggcctgggaaacaatttgcatttgtccccaaatacgcttagctgtgtgccgcttagaacgatgcgaaaccatccctctgtgtaagcccgtgccgtgtgactcgaagcctagcgccctccctgcgaagcatcagacgccacccagccctggggggaggcccacgcctgctggaccaacgcgggttctggggtgcacagcgccaggttaacgctgaagcctgccccgctgagcccaggagccgggaggcctgcgggctgacccagaatccgatcatgcacctgtcctcatgccagcggctttggctggggttggtctgaagcctgcacgcggcagttctttgttaaagatctgagggactcctcagtcctggggcgtcgccgcctgcagcctcttccaagccctgcgtccagcgagcgtcacagcacaacctgcaaaaacggagctgggctgcagctggggctggcatggactttcatttcagagattcggtttttaagaagatgcatgcctaatgtgttcttttttttttccaatgatttgtaatatacattttatgactggaaacttttttgtacaacactccaataaacattttgatttta

SEQ ID NO: 417821 - DNA, 4589 bp, Homo sapiens
catcttgcagccggcggcgcggattgaatgagcccgccgagcccgggccgccgtcgggagcagcgcaggccgcgagccgccgccaccatggccacgccgctgcccggccgcgcgggcgggcccgccacgccgctgtcgcccacgcgcctgtcgcggctgcaggagaaggaggagctgcgcgagctcaacgaccgcctggcgcactacatcgaccgcgtccgcgcgctggagctggagaacgaccggctcctgctcaagatctcagagaaggaggaggtgaccacgcgcgaggtgagtggcatcaaggcgctgtacgagtcggagctggccgatgcccggagagtcctggatgagacggctcgagagcgtgcccggctgcagatagagattgggaagctgagggcagagttggacgaggtcaacaagagcgccaagaagagggagggcgagcttacggtggcccagggccgtgtgaaggacctggagtccctgttccaccggagcgaggtggagctggcagctgccctcagcgacaagcgcggcctggagagtgacgtggctgagctgcgggcccagctggccaaggccgaggacggtcatgcagtggccaaaaagcagctggagaaggagacgctgatgcgtgtggacctggagaaccgctgccagagcctgcaggaggagctggacttccggaagagtgtgttcgaggaggaggtgcgggagacgcggcggcggcacgagcggcgcctggtggaggtggacagcagccggcagcaggagtacgacttcaagatggcacaggcgctggaggagctgcggagccagcacgacgagcaagtgcggctctacaagctggagctggagcagacctaccaggccaagctggacagcgccaagctgagctctgaccagaacgacaaggcggccagtgcggctcgcgaggagctgaaggaggcccgcatgcgcctggagtccctcagctaccagctctccggcctccagaagcaggccagtgccgctgaagatcgcattcgggagctggaggaggccatggccggggagcgggacaagttccggaagatgctggacgccaaggagcaggagatgacggagatgcgggacgtgatgcagcagcagctggccgagtaccaggagctgctggacgtgaagctggccctggacatggagatcaacgcctaccggaagctcctggagggcgaggaggagaggctgaagctgtcccccagcccatcctcgcgcgtcaccgtctcacgagccacctcgagcagcagcggcagcttgtccgccaccgggcgcctgggccgcagtaagcggaagcggctggaggtggaggagcccttgggcagcggcccaagcgtcctgggcacgggcacgggtggcagcggtggcttccacctggcccagcaggcctcggcctcgggtagcgtcagcatcgaggagatcgacctggagggcaagtttgtgcagctcaagaacaactcggacaaggatcagtctctggggaactggagaatcaagaggcaggtcttggagggggaggagatcgcctacaagttcacgcccaagtacatcctgcgcgccggccagatggtcacggtgtgggcagctggtgcgggggtggcccacagccccccctcgacgctggtgtggaagggccagagcagctggggcacgggcgagagcttccgcaccgtcctggttaacgcggatggcgaggaagtggccatgaggactgtgaagaagtcctcggtgatgcgtgagaatgagaatggggaggaagaggaggaggaagccgagtttggcgaggaggatcttttccaccaacagggggacccgaggaccacctcaagaggctgctacgtgatgtgaacccacactcctcatccacacacctttctttacccagagccactgaaaactatttttatatcattggctttctttagttcttgatacatttctagagaatttctaagcgaactgccagaacgtgtgggtgggtctcccccagccctccctcctggcgggtctcctccagcctcacttcgctgccacttcgccgctgccccggagacttttcaatcccaccccactcctcatctcaccatttggtcaaattggaagcccagggccaggacccggaggtttagaagatgcttgggcttggagggaggagggccggcgaggctagcgaggggacaggagacggccctgctgcggacggagcgcggaaactgcgtaggaattcagtggtggtgggtttttttaaggctttctacaaaaccaaattcagaatccaggcgtcgacctggtggggcccggggccaagcctgcattctggctgcccagcttcggacagcgggaactcctcaggcagccacgcagcgggtgtgggccagcatggggatggcgtggcccccagggcgggttttcactccgctgcctgggcttccagattcccgttctggcagcgcaccggccgggtttctcggaccgttgactttatttgggggagttttcccgcagttcagttcctgactgtgcaaggccaacagggcaggggaggggaagacctggggaaggaagaatgaggacagtcccgtcgtaagacctgtcacaacaataagcagggaggggagatgtggaggggacacatctggttgccttggaggcagaagctgtgagtttcagaacagctgtctgcagggaacgccaccatgttgaccctctggaggagagcgctgtggagcccctcccgtgttccagctccgtctgccctgtgcctatatatacacatgcgtctatccatactgtgcttttatctgtgattttctcgctgaaaccatgtttctcagacaggccaaggccacctgactcctatcacgacgcacccaagcccctcagtccagcttcccaatgcctggcaccccccttcggcaatagctcaccgtttacaccctccctcatagatacacagaagttatttttttaatggatatttatttttttacattggtcagtacacaggtcaggagctcacgccagggccttgaggacaggctgaccctcctccccggggtggcgtggggctggggcaccctccgacggcagagcctccttcagaaagtgcagctcaagtcttaaagacaccaaaactgagccatgggcacgcgccgtctccgggccatggcgttcactgcagggcgggggcggcaccgctcccctgtgactgcatcccgcctccctggggacctgcctgtggcaggaaggaatggggggccccagccccaggccgggaaggagccagcggccgacaaagcagaaacacccgctgctccacgtagcccctgctcgctgtccttgctctcagaagtcccggtcccatgtagatagaggggggcgcatcttaccaaagcatttcctcctggaggctacgccgctgtgctcccagtcagccgctggaagtgggaatgctggcgacagactgtgtcctctttcccaccttcatagcaggaatcacccggacccgactggctgggcttcgtgctagcgagggttctgggggtgggtcttggtgatcttgtcctatggggagtctgcagtggtctcagccacatcctatgtattttggctctggaggagcaaagctgtatcctggagttggtctgtgatttgccgacagccttgcaggctgggctcagggacaaagtcccccccaaaacccgcaggtcctcatgtccagacgctgcccagtcctgtcctgaaaacagcacgccccaggcccacagaaccccccaccctacatttgccttgggtggagctgggggtggtcctaggactgcgggtgcccttagctgaagggggtggggagaagcgtggactgggcagcctgtgggtaattggaggttcattgagaattgagtctttggaaacactaagaaaatcaaatttttaaaagttatttatggcctgggaaacaatttgcatttgtccccaaatacgcttagctgtgtgccgcttagaacgatgcgaaaccatccctctgtgtaagcccgtgccgtgtgactcgaagcctagcgccctccctgcgaagcatcagacgccacccagccctggggggaggcccacgcctgctggaccaacgcgggttctggggtgcacagcgccaggttaacgctgaagcctgccccgctgagcccaggagccgggaggcctgcgggctgacccagaatccgatcatgcacctgtcctcatgccagcggctttggctggggttggtctgaagcctgcacgcggcagttctttgttaaagatctgagggactcctcagtcctggggcgtcgccgcctgcagcctcttccaagccctgcgtccagcgagcgtcacagcacaacctgcaaaaacggagctgggctgcagctggggctggcatggactttcatttcagagattcggtttttaagaagatgcatgcctaatgtgttcttttttttttccaatgatttgtaatatacattttatgactggaaacttttttgtacaacactccaataaacattttgatttta

SEQ ID NO: 417822 - DNA, 1883 bp, Homo sapiens
tagctagtagagctgggttaatcggccgaggccagctccgtctgccctgtgcctatatatacacatgcgtctatccatactgtgcttttatctgtgattttctcgctgaaaccatgtttctcagacaggccaaggccacctgactcctatcacgacgcacccaagcccctcagtccagcttcccaatgcctggcaccccccttcggcaatagctcaccgtttacaccctccctcatagatacacagaagttatttttttaatggatatttatttttttacattggtcagtacacaggtcaggagctcacgccagggccttgaggacaggctgaccctcctccccggggtggcgtggggctggggcaccctccgacggcagagcctccttcagaaagtgcagctcaagtcttaaagacaccaaaactgagccatgggcacgcgccgtctccgggccatggcgttcactgcagggcgggggcggcaccgctcccctgtgactgcatcccgcctccctggggacctgcctgtggcaggaaggaatggggggccccagccccaggccgggaaggagccagcggccgacaaagcagaaacacccgctgctccacgtagcccctgctcgctgtccttgctctcagaagtcccggtcccatgtagatagaggggggcgcatcttaccaaagcatttcctcctggaggctacgccgctgtgctcccagtcaggcggctggtagggagctttgcctgccccggggataccctctgccagccgctggaagtgggaatgctggcgacagactgtgtcctctttcccaccttcatagcaggaatcacccggacccgactggctgggcttcgtgctagcgagggttctgggggtgggtcttggtgatcttgtcctatggggagtctgcagtggtctcagccacatcctatgtattttggctctggaggagcaaagctgtatcctggagttggtctgtgatttgccgacagccttgcaggctgggctcagggacaaagtcccccccaaaacccgcaggtcctcatgtccagacgctgcccagtcctgtcctgaaaacagcacgccccaggcccacagaaccccccaccctacatttgccttgggtggagctgggggtggtcctaggactgcgggtgcccttagctgaagggggtggggagaagcgtggactgggcagcctgtgggtaattggaggttcattgagaattgagtctttggaaacactaagaaaatcaaatttttaaaagttatttatggcctgggaaacaatttgcatttgtccccaaatacgcttagctgtgtgccgcttagaacgatgcgaaaccatccctctgtgtaagcccgtgccgtgtgactcgaagcctagcgccctccctgcgaagcatcagacgccacccagccctggggggaggcccacgcctgctggaccaacgcgggttctggggtgcacagcgccaggttaacgctgaagcctgccccgctgagcccaggagccgggaggcctgcgggctgacccagaatccgatcatgcacctgtcctcatgccagcggctttggctggggttggtctgaagcctgcacgcggcagttctttgttaaagatctgagggactcctcagtcctggggcgtcgccgcctgcagcctcttccaagccctgcgtccagcgagcgtcacagcacaacctgcaaaaacggagctgggctgcagctggggctggcatggactttcatttcagagattcggtttttaagaagatgcatgcctaatgtgttcttttttttttccaatgatttgtaatatacattttatgactggaaacttttttgtacaacactccaataaacattttgatttta

SEQ ID NO: 417823 - DNA, 1670 bp, Homo sapiens
tagctagtagagctgggttaatcggccgaggagaagttatttttttaatggatatttatttttttacattggtcagtacacaggtcaggagctcacgccagggccttgaggacaggctgaccctcctccccggggtggcgtggggctggggcaccctccgacggcagagcctccttcagaaagtgcagctcaagtcttaaagacaccaaaactgagccatgggcacgcgccgtctccgggccatggcgttcactgcagggcgggggcggcaccgctcccctgtgactgcatcccgcctccctggggacctgcctgtggcaggaaggaatggggggccccagccccaggccgggaaggagccagcggccgacaaagcagaaacacccgctgctccacgtagcccctgctcgctgtccttgctctcagaagtcccggtcccatgtagatagaggggggcgcatcttaccaaagcatttcctcctggaggctacgccgctgtgctcccagtcaggcggctggtagggagctttgcctgccccggggataccctctgccagccgctggaagtgggaatgctggcgacagactgtgtcctctttcccaccttcatagcaggaatcacccggacccgactggctgggcttcgtgctagcgagggttctgggggtgggtcttggtgatcttgtcctatggggagtctgcagtggtctcagccacatcctatgtattttggctctggaggagcaaagctgtatcctggagttggtctgtgatttgccgacagccttgcaggctgggctcagggacaaagtcccccccaaaacccgcaggtcctcatgtccagacgctgcccagtcctgtcctgaaaacagcacgccccaggcccacagaaccccccaccctacatttgccttgggtggagctgggggtggtcctaggactgcgggtgcccttagctgaagggggtggggagaagcgtggactgggcagcctgtgggtaattggaggttcattgagaattgagtctttggaaacactaagaaaatcaaatttttaaaagttatttatggcctgggaaacaatttgcatttgtccccaaatacgcttagctgtgtgccgcttagaacgatgcgaaaccatccctctgtgtaagcccgtgccgtgtgactcgaagcctagcgccctccctgcgaagcatcagacgccacccagccctggggggaggcccacgcctgctggaccaacgcgggttctggggtgcacagcgccaggttaacgctgaagcctgccccgctgagcccaggagccgggaggcctgcgggctgacccagaatccgatcatgcacctgtcctcatgccagcggctttggctggggttggtctgaagcctgcacgcggcagttctttgttaaagatctgagggactcctcagtcctggggcgtcgccgcctgcagcctcttccaagccctgcgtccagcgagcgtcacagcacaacctgcaaaaacggagctgggctgcagctggggctggcatggactttcatttcagagattcggtttttaagaagatgcatgcctaatgtgttcttttttttttccaatgatttgtaatatacattttatgactggaaacttttttgtacaacactccaataaacattttgatttta

SEQ ID NO: 417824 - DNA, 4731 bp, Homo sapiens
catcttgcagccggcggcgcggattgaatgagcccgccgagcccgggccgccgtcgggagcagcgcaggccgcgagccgccgccaccatggccacgccgctgcccggccgcgcgggcgggcccgccacgccgctgtcgcccacgcgcctgtcgcggctgcaggagaaggaggagctgcgcgagctcaacgaccgcctggcgcactacatcgaccgcgtccgcgcgctggagctggagaacgaccggctcctgctcaagatctcagagaaggaggaggtgaccacgcgcgaggtgagtggcatcaaggcgctgtacgagtcggagctggccgatgcccggagagtcctggatgagacggctcgagagcgtgcccggctgcagatagagattgggaagctgagggcagagttggacgaggtcaacaagagcgccaagaagagggagggcgagcttacggtggcccagggccgtgtgaaggacctggagtccctgttccaccggagcgaggtggagctggcagctgccctcagcgacaagcgcggcctggagagtgacgtggctgagctgcgggcccagctggccaaggccgaggacggtcatgcagtggccaaaaagcagctggagaaggagacgctgatgcgtgtggacctggagaaccgctgccagagcctgcaggaggagctggacttccggaagagtgtgttcgaggaggaggtgcgggagacgcggcggcggcacgagcggcgcctggtggaggtggacagcagccggcagcaggagtacgacttcaagatggcacaggcgctggaggagctgcggagccagcacgacgagcaagtgcggctctacaagctggagctggagcagacctaccaggccaagctggacagcgccaagctgagctctgaccagaacgacaaggcggccagtgcggctcgcgaggagctgaaggaggcccgcatgcgcctggagtccctcagctaccagctctccggcctccagaagcaggccagtgccgctgaagatcgcattcgggagctggaggaggccatggccggggagcgggacaagttccggaagatgctggacgccaaggagcaggagatgacggagatgcgggacgtgatgcagcagcagctggccgagtaccaggagctgctggacgtgaagctggccctggacatggagatcaacgcctaccggaagctcctggagggcgaggaggagaggctgaagctgtcccccagcccatcctcgcgcgtcaccgtctcacgagccacctcgagcagcagcggcagcttgtccgccaccgggcgcctgggccgcagtaagcggaagcggctggaggtggaggagcccttgggcagcggcccaagcgtcctgggcacgggcacgggtggcagcggtggcttccacctggcccagcaggcctcggcctcgggtagcgtcagcatcgaggagatcgacctggagggcaagtttgtgcagctcaagaacaactcggacaaggatcagtctctggggaactggagaatcaagaggcaggtcttggagggggaggagatcgcctacaagttcacgcccaagtacatcctgcgcgccggccagatggtcacggtgtgggcagctggtgcgggggtggcccacagccccccctcgacgctggtgtggaagggccagagcagctggggcacgggcgagagcttccgcaccgtcctggttaacgcggatggcgaggaagtggccatgaggactgtgaagaagtcctcggtgatgcgtgagaatgagaatggggaggaagaggaggaggaagccgagtttggcgaggaggatcttttccaccaacagggggacccgaggaccacctcaagaggctgctacgtgatgtgaacccacactcctcatccacacacctttctttacccagagccactgaaaactatttttatatcattggctttctttagttcttgatacatttctagagaatttctaagcgaactgccagaacgtgtgggtgggtctcccccagccctccctcctggcgggtctcctccagcctcacttcgctgccacttcgccgctgccccggagacttttcaatcccaccccactcctcatctcaccatttggtcaaattggaagcccagggccaggacccggaggtttagaagatgcttgggcttggagggaggagggccggcgaggctagcgaggggacaggagacggccctgctgcggacggagcgcggaaactgcgtaggaattcagtggtggtgggtttttttaaggctttctacaaaaccaaattcagaatccaggcgtcgacctggtggggcccggggccaagcctgcattctggctgcccagcttcggacagcgggaactcctcaggcagccacgcagcgggtgtgggccagcatggggatggcgtggcccccagggcgggttttcactccgctgcctgggcttccagattcccgttctggcagcgcaccggccgggtttctcggaccgttgactttatttgggggagttttcccgcagttcagttcctgactgtgcaaggccaacagggcaggggaggggaagacctggggaaggaagaatgaggacagtcccgtcgtaagacctgtcacaacaataagcagggaggggagatgtggaggggacacatctggttgccttggaggcagaagctgtgagtttcagaacagctgtctgcagggaacgccaccatgttgaccctctggaggagagcgctgtggagcccctcccgtgttccagctccgtctgccctgtgcctatatatacacatgcgtctatccatactgtgcttttatctgtgattttctcgctgaaaccatgtttctcagacaggccaaggccacctgactcctatcacgacgcacccaagcccctcagtccagcttcccaatgcctggcaccccccttcggcaatagctcaccgtttacaccctccctcatagatacacagaagttatttttttaatggatatttatttttttacattggtcagtacacaggtcaggagctcacgccagggccttgaggacaggctgaccctcctccccggggtggcgtggggctggggcaccctccgacggcagagcctccttcagaaagtgcagctcaagtcttaaagacaccaaaactgagccatgggcacgcgccgtctccgggccatggcgttcactgcagggcgggggcggcaccgctcccctgtgactgcatcccgcctccctggggacctgcctgtggcaggaaggaatggggggccccagccccaggccgggaaggagccagcggccgacaaagcagaaacacccgctgctccacgtagcccctgctcgctgtccttgctctcagaagtcccggtcccatgtagatagaggggggcgcatcttaccaaagcatttcctcctggaggctacgccgctgtgctcccagtcaggcggctggtagggagctttgcctgccccggggataccctctgccagccgctggaagtgggaatgctggcgacagactgtgtcctctttcccaccttcatagcaggaatcacccggacccgactggctgggcttcgtgctagcgagggttctgggggtgggtcttggtgatcttgtcctatggggagtctgcagtggtctcagccacatcctatgtattttggctctggaggagcaaagctgtatcctggagttggtctgtgatttgccgacagccttgcaggctgggctcagggacaaagtcccccccaaaacccgcaggtcctcatgtccagacgctgcccagtcctgtcctgaaaacagcacgccccaggcccacagaaccccccaccctacatttgccttgggtggagctgggggtggtcctaggactgcgggtgcccttagctgaagggggtggggagaagcgtggactgggcagcctgtgggtaattggaggttcattgagaattgagtctttggaaacactaagaaaatcaaatttttaaaagttatttatggcctgggaaacaatttgcatttgtccccaaatacgcttagctgtgtgccgcttagaacgatgcgaaaccatccctctgtgtaagcccgtgccgtgtgactcgaagcctagcgccctccctgcgaagcatcagacgccacccagccctggggggaggcccacgcctgctggaccaacgcgggttctggggtgcacagcgccaggttaacgctgaagcctgccccgctgagcccaggagccgggaggcctgcgggctgacccagaatccgatcatgcacctgtcctcatgccagcggctttggctggggttggtctgaagcctgcacgcggcagttctttgttaaagatctgagggactcctcagtcctggggcgtcgccgcctgcagcctcttccaagccctgcgtccagcgagcgtcacagcacaacctgcaaaaacggagctgggctgcagctggggctggcatggactttcatttcagagattcggtttttaagaagatgcatgcctaatgtgttcttttttttttccaatgatttgtaatatacattttatgactggaaacttttttgtacaacactccaataaacattttgattttaaaaaccccccacaaaaaaccccggggcactaagcggggggcgaaaacgggtcccacgggcctgggccaattgtccggacccctttcttgcccacgg

SEQ ID NO: 417825 - DNA, 4688 bp, Homo sapiens
catcttgcagccggcggcgcggattgaatgagcccgccgagcccgggccgccgtcgggagcagcgcaggccgcgagccgccgccaccatggccacgccgctgcccggccgcgcgggcgggcccgccacgccgctgtcgcccacgcgcctgtcgcggctgcaggagaaggaggagctgcgcgagctcaacgaccgcctggcgcactacatcgaccgcgtccgcgcgctggagctggagaacgaccggctcctgctcaagatctcagagaaggaggaggtgaccacgcgcgaggtgagtggcatcaaggcgctgtacgagtcggagctggccgatgcccggagagtcctggatgagacggctcgagagcgtgcccggctgcagatagagattgggaagctgagggcagagttggacgaggtcaacaagagcgccaagaagagggagggcgagcttacggtggcccagggccgtgtgaaggacctggagtccctgttccaccggagcgaggtggagctggcagctgccctcagcgacaagcgcggcctggagagtgacgtggctgagctgcgggcccagctggccaaggccgaggacggtcatgcagtggccaaaaagcagctggagaaggagacgctgatgcgtgtggacctggagaaccgctgccagagcctgcaggaggagctggacttccggaagagtgtgttcgaggaggaggtgcgggagacgcggcggcggcacgagcggcgcctggtggaggtggacagcagccggcagcaggagtacgacttcaagatggcacaggcgctggaggagctgcggagccagcacgacgagcaagtgcggctctacaagctggagctggagcagacctaccaggccaagctggacagcgccaagctgagctctgaccagaacgacaaggcggccagtgcggctcgcgaggagctgaaggaggcccgcatgcgcctggagtccctcagctaccagctctccggcctccagaagcaggccagtgccgctgaagatcgcattcgggagctggaggaggccatggccggggagcgggacaagttccggaagatgctggacgccaaggagcaggagatgacggagatgcgggacgtgatgcagcagcagctggccgagtaccaggagctgctggacgtgaagctggccctggacatggagatcaacgcctaccggaagctcctggagggcgaggaggagaggctgaagctgtcccccagcccatcctcgcgcgtcaccgtctcacgagccacctcgagcagcagcggcagcttgtccgccaccgggcgcctgggccgcagtaagcggaagcggctggaggtggaggagcccttgggcagcggcccaagcgtcctgggcacgggcacgggtggcagcggtggcttccacctggcccagcaggcctcggcctcgggtagcgtcagcatcgaggagatcgacctggagggcaagtttgtgcagctcaagaacaactcggacaaggatcagtctctggggaactggagaatcaagaggcaggtcttggagggggaggagatcgcctacaagttcacgcccaagtacatcctgcgcgccggccagatggtcacggtgtgggcagctggtgcgggggtggcccacagccccccctcgacgctggtgtggaagggccagagcagctggggcacgggcgagagcttccgcaccgtcctggttaacgcggatggcgaggaagtggccatgaggactgtgaagaagtcctcggtgatgcgtgagaatgagaatggggaggaagaggaggaggaagccgagtttggcgaggaggatcttttccaccaacagggggacccgaggaccacctcaagaggctgctacgtgatgtgaacccacactcctcatccacacacctttctttacccagagccactgaaaactatttttatatcattggctttctttagttcttgatacatttctagagaatttctaagcgaactgccagaacgtgtgggtgggtctcccccagccctccctcctggcgggtctcctccagcctcacttcgctgccacttcgccgctgccccggagacttttcaatcccaccccactcctcatctcaccatttggtcaaattggaagcccagggccaggacccggaggtttagaagatgcttgggcttggagggaggagggccggcgaggctagcgaggggacaggagacggccctgctgcggacggagcgcggaaactgcgtaggaattcagtggtggtgggtttttttaaggctttctacaaaaccaaattcagaatccaggcgtcgacctggtggggcccggggccaagcctgcattctggctgcccagcttcggacagcgggaactcctcaggcagccacgcagcgggtgtgggccagcatggggatggcgtggcccccagggcgggttttcactccgctgcctgggcttccagattcccgttctggcagcgcaccggccgggtttctcggaccgttgactttatttgggggagttttcccgcagttcagttcctgactgtgcaaggccaacagggcaggggaggggaagacctggggaaggaagaatgaggacagtcccgtcgtaagacctgtcacaacaataagcagggaggggagatgtggaggggacacatctggttgccttggaggcagaagctgtgagtttcagaacagctgtctgcagggaacgccaccatgttgaccctctggaggagagcgctgtggagcccctcccgtgttccagctccgtctgccctgtgcctatatatacacatgcgtctatccatactgtgcttttatctgtgattttctcgctgaaaccatgtttctcagacaggccaaggccacctgactcctatcacgacgcacccaagcccctcagtccagcttcccaatgcctggcaccccccttcggcaatagctcaccgtttacaccctccctcatagatacacagaagttatttttttaatggatatttatttttttacattggtcagtacacaggtcaggagctcacgccagggccttgaggacaggctgaccctcctccccggggtggcgtggggctggggcaccctccgacggcagagcctccttcagaaagtgcagctcaagtcttaaagacaccaaaactgagccatgggcacgcgccgtctccgggccatggcgttcactgcagggcgggggcggcaccgctcccctgtgactgcatcccgcctccctggggacctgcctgtggcaggaaggaatggggggccccagccccaggccgggaaggagccagcggccgacaaagcagaaacacccgctgctccacgtagcccctgctcgctgtccttgctctcagaagtcccggtcccatgtagatagaggggggcgcatcttaccaaagcatttcctcctggaggctacgccgctgtgctcccagtcaggcggctggtagggagctttgcctgccccggggataccctctgccagccgctggaagtgggaatgctggcgacagactgtgtcctctttcccaccttcatagcaggaatcacccggacccgactggctgggcttcgtgctagcgagggttctgggggtgggtcttggtgatcttgtcctatggggagtctgcagtggtctcagccacatcctatgtattttggctctggaggagcaaagctgtatcctggagttggtctgtgatttgccgacagccttgcaggctgggctcagggacaaagtcccccccaaaacccgcaggtcctcatgtccagacgctgcccagtcctgtcctgaaaacagcacgccccaggcccacagaaccccccaccctacatttgccttgggtggagctgggggtggtcctaggactgcgggtgcccttagctgaagggggtggggagaagcgtggactgggcagcctgtgggtaattggaggttcattgagaattgagtctttggaaacactaagaaaatcaaatttttaaaagttatttatggcctgggaaacaatttgcatttgtccccaaatacgcttagctgtgtgccgcttagaacgatgcgaaaccatccctctgtgtaagcccgtgccgtgtgactcgaagcctagcgccctccctgcgaagcatcagacgccacccagccctggggggaggcccacgcctgctggaccaacgcgggttctggggtgcacagcgccaggttaacgctgaagcctgccccgctgagcccaggagccgggaggcctgcgggctgacccagaatccgatcatgcacctgtcctcatgccagcggctttggctggggttggtctgaagcctgcacgcggcagttctttgttaaagatctgagggactcctcagtcctggggcgtcgccgcctgcagcctcttccaagccctgcgtccagcgagcgtcacagcacaacctgcaaaaacggagctgggctgcagctggggctggcatggactttcatttcagagattcggtttttaagaagatgcatgcctaatgtgttcttcccatgtttgtacttccttctgactggaatttttgtcacccccataaccttgtttcacacacaacaaacaacaacccggggtttgcgggggaaagtaaggcggtcgctccctttgagggaggcccaggaatacg

SEQ ID NO: 417826 - DNA, 4458 bp, Homo sapiens
catcttgcagccggcggcgcggattgaatgagcccgccgagcccgggccgccgtcgggagcagcgcaggccgcgagccgccgccaccatggccacgccgctgcccggccgcgcgggcgggcccgccacgccgctgtcgcccacgcgcctgtcgcggctgcaggagaaggaggagctgcgcgagctcaacgaccgcctggcgcactacatcgaccgcgtccgcgcgctggagctggagaacgaccggctcctgctcaagatctcagagaaggaggaggtgaccacgcgcgaggtgagtggcatcaaggcgctgtacgagtcggagctggccgatgcccggagagtcctggatgagacggctcgagagcgtgcccggctgcagatagagattgggaagctgagggcagagttggacgaggtcaacaagagcgccaagaagagggagggcgagcttacggtggcccagggccgtgtgaaggacctggagtccctgttccaccggagcgaggtggagctggcagctgccctcagcgacaagcgcggcctggagagtgacgtggctgagctgcgggcccagctggccaaggccgaggacggtcatgcagtggccaaaaagcagctggagaaggagacgctgatgcgtgtggacctggagaaccgctgccagagcctgcaggaggagctggacttccggaagagtgtgttcgaggaggaggtgcgggagacgcggcggcggcacgagcggcgcctggtggaggtggacagcagccggcagcaggagtacgacttcaagatggcacaggcgctggaggagctgcggagccagcacgacgagcaagtgcggctctacaagctggagctggagcagacctaccaggccaagctggacagcgccaagctgagctctgaccagaacgacaaggcggccagtgcggctcgcgaggagctgaaggaggcccgcatgcgcctggagtccctcagctaccagctctccggcctccagaagcaggccagtgccgctgaagatcgcattcgggagctggaggaggccatggccggggagcgggacaagttccggaagatgctggacgccaaggagcaggagatgacggagatgcgggacgtgatgcagcagcagctggccgagtaccaggagctgctggacgtgaagctggccctggacatggagatcaacgcctaccggaagctcctggagggcgaggaggagaggctgaagctgtcccccagcccatcctcgcgcgtcaccgtctcacgagccacctcgagcagcagcggcagcttgtccgccaccgggcgcctgggccgcagtaagcggaagcggctggaggtggaggagcccttgggcagcggcccaagcgtcctgggcacgggcacgggtggcagcggtggcttccacctggcccagcaggcctcggcctcgggtagcgtcagcatcgaggagatcgacctggagggcaagtttgtgcagctcaagaacaactcggacaaggatcagtctctggggaactggagaatcaagaggcaggtcttggagggggaggagatcgcctacaagttcacgcccaagtacatcctgcgcgccggccagatggtcacggtgtgggcagctggtgcgggggtggcccacagccccccctcgacgctggtgtggaagggccagagcagctggggcacgggcgagagcttccgcaccgtcctggttaacgcggatggcgaggaagtggccatgaggactgtgaagaagtcctcggtgatgcgtgagaatgagaatggggaggaagaggaggaggaagccgagtttggcgaggaggatcttttccaccaacagggggacccgaggaccacctcaagaggctgctacgtgatgtgaacccacactcctcatccacacacctttctttacccagagccactgaaaactatttttatatcattggctttctttagttcttgatacatttctagagaatttctaagcgaactgccagaacgtgtgggtgggtctcccccagccctccctcctggcgggtctcctccagcctcacttcgctgccacttcgccgctgccccggagacttttcaatcccaccccactcctcatctcaccatttggtcaaattggaagcccagggccaggacccggaggtttagaagatgcttgggcttggagggaggagggccggcgaggctagcgaggggacaggagacggccctgctgcggacggagcgcggaaactgcgtaggaattcagtggtggtgggtttttttaaggctttctacaaaaccaaattcagaatccaggcgtcgacctggtggggcccggggccaagcctgcattctggctgcccagcttcggacagcgggaactcctcaggcagccacgcagcgggtgtgggccagcatggggatggcgtggcccccagggcgggttttcactccgctgcctgggcttccagattcccgttctggcagcgcaccggccgggtttctcggaccgttgactttatttgggggagttttcccgcagttcagttcctgactgtgcaaggccaacagggcaggggaggggaagacctggggaaggaagaatgaggacagtcccgtcgtaagacctgtcacaacaataagcagggaggggagatgtggaggggacacatctggttgccttggaggcagaagctgtgagtttcagaacagctgtctgcagggaacgccaccatgttgaccctctggaggagagcgctgtggagcccctcccgtgttccagctccgtctgccctgtgcctatatatacacatgcgtctatccatactgtgcttttatctgtgattttctcgctgaaaccatgtttctcagacaggccaaggccacctgactcctatcacgacgcacccaagcccctcagtccagcttcccaatgcctggcaccccccttcggcaatagctcaccgtttacaccctccctcatagatacacagaagttatttttttaatggatatttatttttttacattggtcagtacacaggtcaggagctcacgccagggccttgaggacaggctgaccctcctccccggggtggcgtggggctggggcaccctccgacggcagagcctccttcagaaagtgcagctcaagtcttaaagacaccaaaactgagccatgggcacgcgccgtctccgggccatggcgttcactgcagggcgggggcggcaccgctcccctgtgactgcatcccgcctccctggggacctgcctgtggcaggaaggaatggggggccccagccccaggccgggaaggagccagcggccgacaaagcagaaacacccgctgctccacgtagcccctgctcgctgtccttgctctcagaagtcccggtcccatgtagatagaggggggcgcatcttaccaaagcatttcctcctggaggctacgccgctgtgctcccagtcaggcggctggtagggagctttgcctgccccggggataccctctgccagccgctggaagtgggaatgctggcgacagactgtgtcctctttcccaccttcatagcaggaatcacccggacccgactggctgggcttcgtgctagcgagggttctgggggtgggtcttggtgatcttgtcctatggggagtctgcagtggtctcagccacatcctatgtattttggctctggaggagcaaagctgtatcctggagttggtctgtgatttgccgacagccttgcaggctgggctcagggacaaagtcccccccaaaacccgcaggtcctcatgtccagacgctgcccagtcctgtcctgaaaacagcacgccccaggcccacagaaccccccaccctacatttgccttgggtggagctgggggtggtcctaggactgcgggtgcccttagctgaagggggtggggagaagcgtggactgggcagcctgtgggtaattggaggttcattgagaattgagtctttggaaacactaagaaaatcaaatttttaaaagttatttatggcctgggaaacaatttgcatttgtccccaaatacgcttagctgtgtgccgcttagaacgatgcgaaaccatccctctgtgtaagcccgtgccgtgtgactcgaagcctagcgccctccctgcgaagcatcagacgccacccagccctggggggaggcccacgcctgctggaccaacgcgggttctggggtgcacagcgccaggttaacgctgaagccaagccctgcgtccagcgagcgtcacagcacaacctgcaaaaacggagctgggctgcagctggggctggcatggactttcatttcagagattcggtttttaagaagatgcatgcctaatgtgttcttttttttttccaatgatttgtaatatacattttatgactggaaacttttttgtacaacactccaataaacattttgatttta

SEQ ID NO: 417827 - DNA, 3891 bp, Homo sapiens
  misc_feature (3842)..(3842): n is a, c, g, or t
catcttgcagccggcggcgcggattgaatgagcccgccgagcccgggccgccgtcgggagcagcgcaggccgcgagccgccgccaccatggccacgccgctgcccggccgcgcgggcgggcccgccacgccgctgtcgcccacgcgcctgtcgcggctgcaggagaaggaggagctgcgcgagctcaacgaccgcctggcgcactacatcgaccgcgtccgcgcgctggagctggagaacgaccggctcctgctcaagatctcagagaaggaggaggtgaccacgcgcgaggtgagtggcatcaaggcgctgtacgagtcggagctggccgatgcccggagagtcctggatgagacggctcgagagcgtgcccggctgcagatagagattgggaagctgagggcagagttggacgaggtcaacaagagcgccaagaagagggagggcgagcttacggtggcccagggccgtgtgaaggacctggagtccctgttccaccggagcgaggtggagctggcagctgccctcagcgacaagcgcggcctggagagtgacgtggctgagctgcgggcccagctggccaaggccgaggacggtcatgcagtggccaaaaagcagctggagaaggagacgctgatgcgtgtggacctggagaaccgctgccagagcctgcaggaggagctggacttccggaagagtgtgttcgaggaggaggtgcgggagacgcggcggcggcacgagcggcgcctggtggaggtggacagcagccggcagcaggagtacgacttcaagatggcacaggcgctggaggagctgcggagccagcacgacgagcaagtgcggctctacaagctggagctggagcagacctaccaggccaagctggacagcgccaagctgagctctgaccagaacgacaaggcggccagtgcggctcgcgaggagctgaaggaggcccgcatgcgcctggagtccctcagctaccagctctccggcctccagaagcaggccagtgccgctgaagatcgcattcgggagctggaggaggccatggccggggagcgggacaagttccggaagatgctggacgccaaggagcaggagatgacggagatgcgggacgtgatgcagcagcagctggccgagtaccaggagctgctggacgtgaagctggccctggacatggagatcaacgcctaccggaagctcctggagggcgaggaggagaggctgaagctgtcccccagcccatcctcgcgcgtcaccgtctcacgagccacctcgagcagcagcggcagcttgtccgccaccgggcgcctgggccgcagtaagcggaagcggctggaggtggaggagcccttgggcagcggcccaagcgtcctgggcacgggcacgggtggcagcggtggcttccacctggcccagcaggcctcggcctcgggtagcgtcagcatcgaggagatcgacctggagggcaagtttgtgcagctcaagaacaactcggacaaggatcagtctctggggaactggagaatcaagaggcaggtcttggagggggaggagatcgcctacaagttcacgcccaagtacatcctgcgcgccggccagatggtcacggtgtgggcagctggtgcgggggtggcccacagccccccctcgacgctggtgtggaagggccagagcagctggggcacgggcgagagcttccgcaccgtcctggttaacgcggatggcgaggaagtggccatgaggactgtgaagaagtcctcggtgatgcgtgagaatgagaatggggaggaagaggaggaggaagccgagtttggcgaggaggatcttttccaccaacagggggacccgaggaccacctcaagaggctgctacgtgatgtgaacccacactcctcatccacacacctttctttacccagagccactgaaaactatttttatatcattggctttctttagttcttgatacatttctagagaatttctaagcgaactgccagaacgtgtgggtgggtctcccccagccctccctcctggcgggtctcctccagcctcacttcgctgccacttcgccgctgccccggagacttttcaatcccaccccactcctcatctcaccatttggtcaaattggaagcccagggccaggacccggaggtttagaagatgcttgggcttggagggaggagggccggcgaggctagcgaggggacaggagacggccctgctgcggacggagcgcggaaactgcgtaggaattcagtggtggtgggtttttttaaggctttctacaaaaccaaattcagaatccaggcgtcgacctggtggggcccggggccaagcctgcattctggctgcccagcttcggacagcgggaactcctcaggcagccacgcagcgggtgtgggccagcatggggatggcgtggcccccagggcgggttttcactccgctgcctgggcttccagattcccgttctggcagcgcaccggccgggtttctcggaccgttgactttatttgggggagttttcccgcagttcagttcctgactgtgcaaggccaacagggcaggggaggggaagacctggggaaggaagaatgaggacagtcccgtcgtaagacctgtcacaacaataagcagggaggggagatgtggaggggacacatctggttgccttggaggcagaagctgtgagtttcagaacagctgtctgcagggaacgccaccatgttgaccctctggaggagagcgctgtggagcccctcccgtgttccagctccgtctgccctgtgcctatatatacacatgcgtctatccatactgtgcttttatctgtgattttctcgctgaaaccatgtttctcagacaggccaaggccacctgactcctatcacgacgcacccaagcccctcagtccagcttcccaatgcctggcaccccccttcggcaatagctcaccgtttacaccctccctcatagatacacagaagttatttttttaatggatatttatttttttacattggtcagtacacaggtcaggagctcacgccagggccttgaggacaggctgaccctcctccccggggtggcgtggggctggggcaccctccgacggcagagcctccttcagaaagtgcagctcaagtcttaaagacaccaaaactgagccatgggcacgcgccgtctccgggccatggcgttcactgcagggcgggggcggcaccgctcccctgtgactgcatcccgcctccctggggacctgcctgtggcaggaaggaatggggggccccagccccaggccgggaaggagccagcggccgacaaagcagaaacacccgctgctccacgtagcccctgctcgctgtccttgctctcagaagtcccggtcccatgtagatagaggggggcgcatcttaccaaagcatttcctcctggaggctacgccgctgtgctcccagtcaggcggctggtagggagctttgcctgccccggggataccctctgccagccgctggaagtgggaatgctggcgacagactgtgtcctctttcccaccttcatagcaggaatcacccggacccgactggctgggcttcgtgctagcgagggttctgggggtgggtcttggtgatcttgtcctatggggagtctgcagtggtctcagccacatcctatgtattttggctctggaggagcaaagctgtatcctggagttggtctgtgatttgccgacagccttgcaggctgggctcagggacaaagtcccccccaaaacccgcaggtcctcatgtccagacgctgcccagtcctgtcctgaaaacagccagncaaaaaccacctattgtggtgggcgggggccaacgcgggccacaggggg

SEQ ID NO: 417828 - DNA, 1799 bp, Homo sapiens
  misc_feature (624)..(624): n is a, c, g, or t
gctaggcatcagggctgggttaaatgtacgaggcgaaaccatccctctgtgtaagccgtgccgtgtgactcgaagcctagcgccctccctgcgaagcatcagacgccacccagccctggggaggagggtcagcctgttgctcctccgcggggttgtggtgtggctaggggccagctccgagcgtgcagagctctccttgcatgaaactgacagatcaagtgattacatgacaccattagaactgaacctatggagtcatgcgccgttgttcctgcggtcctatgggcggttctacgtgctagggggctgtgggtgctggaaacccgtgtccccctggtgacttgctatcgcctgaacatcatccttgagggagccctgccctgatgtgcatggaagcgatatggcgggcgtcccagctctagcgacgccgcataggatccagcggacgtcaaagcagaaacagccgatgctccaacgttagccctcctgctcgcctgtcgcttgtcgtcatctacaattcccggatcactcacctggtatgattagagagggagtgcgacttgtcttaactcgatagatgcatttttctctcctgcgcagagtcgtatcgcgcgacattgattncctctccagatcgaaggcggctggtagggagctttgcctgccccggggataccctctgccagccgctggaagtgggaatgctggcgacagactgtgtcctctttcccaccttcatagcaggaatcacccggacccgactggctgggcttcgtgctagcgagggttctgggggtgggtcttggtgatcttgtcctatggggagtctgcagtggtctcagccacatcctatgtattttggctctggaggagcaaagctgtatcctggagttggtctgtgatttgccgacagccttgcaggctgggctcagggacaaagtcccccccaaaacccgcaggtcctcatgtccagacgctgcccagtcctgtcctgaaaacagcacgccccaggcccacagaaccccccaccctacatttgccttgggtggagctgggggtggtcctaggactgcgggtgcccttagctgaagggggtggggagaagcgtggactgggcagcctgtgggtaattggaggttcattgagaattgagtctttggaaacactaagaaaatcaaatttttaaaagttatttatggcctgggaaacaatttgcatttgtccccaaatacgcttagctgtgtgccgcttagaacgatgcgaaaccatccctctgtgtaagcccgtgccgtgtgactcgaagcctagcgccctccctgcgaagcatcagacgccacccagccctggggggaggcccacgcctgctggaccaacgcgggttctggggtgcacagcgccaggttaacgctgaagcctgccccgctgagcccaggagccgggaggcctgcgggctgacccagaatccgatcatgcacctgtcctcatgccagcggctttggctggggttggtctgaagcctgcacgcggcagttctttgttaaagatctgagggactcctcagtcctggggcgtcgccgcctgcagcctcttccaagccctgcgtccagcgagcgtcacagcacaacctgcaaaaacggagctgggctgcagctggggctggcatggactttcatttcagagattcggtttttaagaagatgcatgcctaatgtgttcttttttttttccaatgatttgtaatatacattttatgactggaaacttttttgtacaacactccaataaacattttgatttta

SEQ ID NO: 417829 - DNA, 1088 bp, Homo sapiens
aacggctaggtgcgaggctggggtgtatagcaggaatcacccggacccgactggctgggcttcgtgctagcgagggttctgggggtgggtcttggtgatcttgtcctatggggagtctgcagtggtctcagccacatcctatgtattttggctctggaggagcaaagctgtatcctggagttggtctgtgatttgccgacagccttgcaggctgggctcagggacaaagtcccccccaaaacccgcaggtcctcatgtccagacgctgcccagtcctgtcctgaaaacagcacgccccaggcccacagaaccccccaccctacatttgccttgggtggagctgggggtggtcctaggactgcgggtgcccttagctgaagggggtggggagaagcgtggactgggcagcctgtgggtaattggaggttcattgagaattgagtctttggaaacactaagaaaatcaaatttttaaaagttatttatggcctgggaaacaatttgcatttgtccccaaatacgcttagctgtgtgccgcttagaacgatgcgaaaccatccctctgtgtaagcccgtgccgtgtgactcgaagcctagcgccctccctgcgaagcatcagacgccacccagccctggggggaggcccacgcctgctggaccaacgcgggttctggggtgcacagcgccaggttaacgctgaagcctgccccgctgagcccaggagccgggaggcctgcgggctgacccagaatccgatcatgcacctgtcctcatgccagcggctttggctggggttggtctgaagcctgcacgcggcagttctttgttaaagatctgagggactcctcagtcctggggcgtcgccgcctgcagcctcttccaagccctgcgtccagcgagcgtcacagcacaacctgcaaaaacggagctgggctgcagctggggctggcatggactttcatttcagagattcggtttttaagaagatgcatgcctaatgtgttcttttttttttccaatgatttgtaatatacattttatgactggaaacttttttgtacaacactccaataaacattttgatttta

SEQ ID NO: 417830 - DNA, 2823 bp, Homo sapiens
catcttgcagccggcggcgcggattgaatgagcccgccgagcccgggccgccgtcgggagcagcgcaggccgcgagccgccgccaccatggccacgccgctgcccggccgcgcgggcgggcccgccacgccgctgtcgcccacgcgcctgtcgcggctgcaggagaaggaggagctgcgcgagctcaacgaccgcctggcgcactacatcgaccgcgtccgcgcgctggagctggagaacgaccggctcctgctcaagatctcagagaaggaggaggtgaccacgcgcgaggtgagtggcatcaaggcgctgtacgagtcggagctggccgatgcccggagagtcctggatgagacggctcgagagcgtgcccggctgcagatagagattgggaagctgagggcagagttggacgaggtcaacaagagcgccaagaagagggagggcgagcttacggtggcccagggccgtgtgaaggacctggagtccctgttccaccggagcgaggtggagctggcagctgccctcagcgacaagcgcggcctggagagtgacgtggctgagctgcgggcccagctggccaaggccgaggacggtcatgcagtggccaaaaagcagctggagaaggagacgctgatgcgtgtggacctggagaaccgctgccagagcctgcaggaggagctggacttccggaagagtgtgttcgaggaggaggtgcgggagacgcggcggcggcacgagcggcgcctggtggaggtggacagcagccggcagcaggagtacgacttcaagatggcacaggcgctggaggagctgcggagccagcacgacgagcaagtgcggctctacaagctggagctggagcagacctaccaggccaagctggacagcgccaagctgagctctgaccagaacgacaaggcggccagtgcggctcgcgaggagctgaaggaggcccgcatgcgcctggagtccctcagctaccagctctccggcctccagaagcaggccagtgccgctgaagatcgcattcgggagctggaggaggccatggccggggagcgggacaagttccggaagatgctggacgccaaggagcaggagatgacggagatgcgggacgtgatgcagcagcagctggccgagtaccaggagctgctggacgtgaagctggccctggacatggagatcaacgcctaccggaagctcctggagggcgaggaggagaggctgaagctgtcccccagcccatcctcgcgcgtcaccgtctcacgagccacctcgagcagcagcggcagcttgtccgccaccgggcgcctgggccgcagtaagcggaagcggctggaggtggaggagcccttgggcagcggcccaagcgtcctgggcacgggcacgggtggcagcggtggcttccacctggcccagcaggcctcggcctcgggtagcgtcagcatcgaggagatcgacctggagggcaagtttgtgcagctcaagaacaactcggacaaggatcagtctctggggaactggagaatcaagaggcaggtcttggagggggaggagatcgcctacaagttcacgcccaagtacatcctgcgcgccggccagatggtcacggtgtgggcagctggtgcgggggtggcccacagccccccctcgacgctggtgtggaagggccagagcagctggggcacgggcgagagcttccgcaccgtcctggttaacgcggatggcgaggaagtggccatgaggactgtgaagaagtcctcggtgatgcgtgagaatgagaatggggaggaagaggaggaggaagccgagtttggcgaggaggatcttttccaccaacagggggacccgaggaccacctcaagaggctgctacgtgatgtgaacccacactcctcatccacacacctttctttacccagagccactgaaaactatttttatatcattggctttctttagttcttgatacatttctagagaatttctaagcgaactgccagaacgtgtgggtgggtctcccccagccctccctcctggcgggtctcctccagcctcacttcgctgccacttcgccgctgccccggagacttttcaatcccaccccactcctcatctcaccatttggtcaaattggaagcccagggccaggacccggaggtttagaagatgcttgggcttggagggaggagggccggcgaggctagcgaggggacaggagacggccctgctgcggacggagcgcggaaactgcgtaggaattcagtggtggtgggtttttttaaggctttctacaaaaccaaattcagaatccaggcgtcgacctggtggggcccggggccaagcctgcattctggctgcccagcttcggacagcgggaactcctcaggcagccacgcagcgggtgtgggccagcatggggatggcgtggcccccagggcgggttttcactccgctgcctgggcttccagattcccgttctggcagcgcaccggccgggtttctcggaccgttgactttatttgggggagttttcccgcagttcagttcctgactgtgcaaggccaacagggcaggggaggggaagacctggggaaggaagaatgaggacagtcccgtcgtaagacctgtcacaacaataagcagggaggggagatgtggaggggacacatctggttgccttggaggaaaaatctttagtttatttatataggtgttagagggtaactgccttatttttacccttttaagttcagctgttttttgacaatattaattgtttaaagtacgtattgaatggttttttttatatcggttg

SEQ ID NO: 417831 - DNA, 3161 bp, Homo sapiens
catcttgcagccggcggcgcggattgaatgagcccgccgagcccgggccgccgtcgggagcagcgcaggccgcgagccgccgccaccatggccacgccgctgcccggccgcgcgggcgggcccgccacgccgctgtcgcccacgcgcctgtcgcggctgcaggagaaggaggagctgcgcgagctcaacgaccgcctggcgcactacatcgaccgcgtccgcgcgctggagctggagaacgaccggctcctgctcaagatctcagagaaggaggaggtgaccacgcgcgaggtgagtggcatcaaggcgctgtacgagtcggagctggccgatgcccggagagtcctggatgagacggctcgagagcgtgcccggctgcagatagagattgggaagctgagggcagagttggacgaggtcaacaagagcgccaagaagagggagggcgagcttacggtggcccagggccgtgtgaaggacctggagtccctgttccaccggagcgaggtggagctggcagctgccctcagcgacaagcgcggcctggagagtgacgtggctgagctgcgggcccagctggccaaggccgaggacggtcatgcagtggccaaaaagcagctggagaaggagacgctgatgcgtgtggacctggagaaccgctgccagagcctgcaggaggagctggacttccggaagagtgtgttcgaggaggaggtgcgggagacgcggcggcggcacgagcggcgcctggtggaggtggacagcagccggcagcaggagtacgacttcaagatggcacaggcgctggaggagctgcggagccagcacgacgagcaagtgcggctctacaagctggagctggagcagacctaccaggccaagctggacagcgccaagctgagctctgaccagaacgacaaggcggccagtgcggctcgcgaggagctgaaggaggcccgcatgcgcctggagtccctcagctaccagctctccggcctccagaagcaggccagtgccgctgaagatcgcattcgggagctggaggaggccatggccggggagcgggacaagttccggaagatgctggacgccaaggagcaggagatgacggagatgcgggacgtgatgcagcagcagctggccgagtaccaggagctgctggacgtgaagctggccctggacatggagatcaacgcctaccggaagctcctggagggcgaggaggagaggctgaagctgtcccccagcccatcctcgcgcgtcaccgtctcacgagccacctcgagcagcagcggcagcttgtccgccaccgggcgcctgggccgcagtaagcggaagcggctggaggtggaggagcccttgggcagcggcccaagcgtcctgggcacgggcacgggtggcagcggtggcttccacctggcccagcaggcctcggcctcgggtagcgtcagcatcgaggagatcgacctggagggcaagtttgtgcagctcaagaacaactcggacaaggatcagtctctggggaactggagaatcaagaggcaggtcttggagggggaggagatcgcctacaagttcacgcccaagtacatcctgcgcgccggccagatggtcacggtgtgggcagctggtgcgggggtggcccacagccccccctcgacgctggtgtggaagggccagagcagctggggcacgggcgagagcttccgcaccgtcctggttaacgcggatggcgaggaagtggccatgaggactgtgaagaagtcctcggtgatgcgtgagaatgagaatggggaggaagaggaggaggaagccgagtttggcgaggaggatcttttccaccaacagggggacccgaggaccacctcaagaggctgctacgtgatgtgaacccacactcctcatccacacacctttctttacccagagccactgaaaactatttttatatcattggctttctttagttcttgatacatttctagagaatttctaagcgaactgccagaacgtgtgggtgggtctcccccagccctccctcctggcgggtctcctccagcctcacttcgctgccacttcgccgctgccccggagacttttcaatcccaccccactcctcatctcaccatttggtcaaattggaagcccagggccaggacccggaggtttagaagatgcttgggcttggagggaggagggccggcgaggctagcgaggggacaggagacggccctgctgcggacggagcgcggaaactgcgtaggaattcagtggtggtgggtttttttaaggctttctacaaaaccaaattcagaatccaggcgtcgacctggtggggcccggggccaagcctgcattctggctgcccagcttcggacagcgggaactcctcaggcagccacgcagcgggtgtgggccagcatggggatggcgtggcccccagggcgggttttcactccgctgcctgggcttccagattcccgttctggcagcgcaccggccgggtttctcggaccgttgactttatttgggggagttttcccgcagttcagttcctgacttgtgcttttatctgtgattttctcgctgaaaccatgtttctcagacaggccaaggccacctgactcctatcacgacgcacccaagcccctcagtccagcttcccaatgcctggcaccccccttcggcaatagctcaccgtttacaccctccctcatagatacacagaagttatttttttaatggatatttatttttttacattggtcagtacacaggtcaggagctcacgccagggccttgaggacaggctgaccctcctccccaggccgggaaggagccagcggccgacaaagcagaaacacccgctgctccacgtagcccctgctcgctgtccttgctctcagaagtcccggtcccatgtagatagaggggggcgcatcttaccaaagcatttcctcctggaggctacgccgctgtgctcccagtcaggcggctggtagggagctttgcctgccccggggataccctctgccagccgctggaagtgggaatgctggcgacagactgtgtcctctttcccaccttcactttttgcgattaccggccattgtggttctgtcaggtcggggggcctgggctctcctcggggtccggttccc

SEQ ID NO: 417832 - DNA, 2453 bp, Homo sapiens
  misc_feature (2413)..(2413): n is a, c, g, or t
catcttgcagccggcggcgcggattgaatgagcccgccgagcccgggccgccgtcgggagcagcgcaggccgcgagccgccgccaccatggccacgccgctgcccggccgcgcgggcgggcccgccacgccgctgtcgcccacgcgcctgtcgcggctgcaggagaaggaggagctgcgcgagctcaacgaccgcctggcgcactacatcgaccgcgtccgcgcgctggagctggagaacgaccggctcctgctcaagatctcagagaaggaggaggtgaccacgcgcgaggtgagtggcatcaaggcgctgtacgagtcggagctggccgatgcccggagagtcctggatgagacggctcgagagcgtgcccggctgcagatagagattgggaagctgagggcagagttggacgaggtcaacaagagcgccaagaagagggagggcgagcttacggtggcccagggccgtgtgaaggacctggagtccctgttccaccggagcgaggtggagctggcagctgccctcagcgacaagcgcggcctggagagtgacgtggctgagctgcgggcccagctggccaaggccgaggacggtcatgcagtggccaaaaagcagctggagaaggagacgctgatgcgtgtggacctggagaaccgctgccagagcctgcaggaggagctggacttccggaagagtgtgttcgaggaggaggtgcgggagacgcggcggcggcacgagcggcgcctggtggaggtggacagcagccggcagcaggagtacgacttcaagatggcacaggcgctggaggagctgcggagccagcacgacgagcaagtgcggctctacaagctggagctggagcagacctaccaggccaagctggacagcgccaagctgagctctgaccagaacgacaaggcggccagtgcggctcgcgaggagctgaaggaggcccgcatgcgcctggagtccctcagctaccagctctccggcctccagaagcaggccagtgccgctgaagatcgcattcgggagctggaggaggccatggccggggagcgggacaagttccggaagatgctggacgccaaggagcaggagatgacggagatgcgggacgtgatgcagcagcagctggccgagtaccaggagctgctggacgtgaagctggccctggacatggagatcaacgcctaccggaagctcctggagggcgaggaggagaggctgaagctgtcccccagcccatcctcgcgcgtcaccgtctcacgagccacctcgagcagcagcggcagcttgtccgccaccgggcgcctgggccgcagtaagcggaagcggctggaggtggaggagcccttgggcagcggcccaagcgtcctgggcacgggcacgggtggcagcggtggcttccacctggcccagcaggcctcggcctcgggtagcgtcagcatcgaggagatcgacctggagggcaagtttgtgcagctcaagaacaactcggacaaggatcagtctctggggaactggagaatcaagaggcaggtcttggagggggaggagatcgcctacaagttcacgcccaagtacatcctgcgcgccggccagatggtcacggtgtgggcagctggtgcgggggtggcccacagccccccctcgacgctggtgtggaagggccagagcagctggggcacgggcgagagcttccgcaccgtcctggttaacgcggatggcgaggaagtggccatgaggactgtgaagaagtcctcggtgatgcgtgagaatgagaatggggaggaagaggaggaggaagccgagtttggcgaggaggatcttttccaccaacagggggacccgaggaccacctcaagaggctgctacgtgatgtgaacccacactcctcatccacacacctttctttacccagagccactgaaaactatttttatatcattggctttctttagttcttgatacatttctagagaatttctaagcgaactgccagaacgtgtgggtgggtctcccccagccctccctcctggcgggtctcctccagcctcacttcgctgccacttcgccgctgccccggagacttttcaatcccaccccactcccgtaccagggagtggggccagtgcgtgtgaagggggcaaagagggtatggcctaaggaagagcgctgaccctaaggaaggacatgattgctctgtaacaggagagagaaaagagaagataccagattcggggatggaaagatgagagtcccattctaatggctattttcatccattttctcaaagactgggggagttaaactggggagagggaacaggaggctgaactgggaccaaactgttttcagacctgcttggttaatgctgagactgccaatgggaggcgggaaacgctgnccccctctctaagatgcagctcctctctccaggaccccca

SEQ ID NO: 417833 - DNA, 2204 bp, Homo sapiens
catcttgcagccggcggcgcggattgaatgagcccgccgagcccgggccgccgtcgggagcagcgcaggccgcgagccgccgccaccatggccacgccgctgcccggccgcgcgggcgggcccgccacgccgctgtcgcccacgcgcctgtcgcggctgcaggagaaggaggagctgcgcgagctcaacgaccgcctggcgcactacatcgaccgcgtccgcgcgctggagctggagaacgaccggctcctgctcaagatctcagagaaggaggaggtgaccacgcgcgaggtgagtggcatcaaggcgctgtacgagtcggagctggccgatgcccggagagtcctggatgagacggctcgagagcgtgcccggctgcagatagagattgggaagctgagggcagagttggacgaggtcaacaagagcgccaagaagagggagggcgagcttacggtggcccagggccgtgtgaaggacctggagtccctgttccaccggagcgaggtggagctggcagctgccctcagcgacaagcgcggcctggagagtgacgtggctgagctgcgggcccagctggccaaggccgaggacggtcatgcagtggccaaaaagcagctggagaaggagacgctgatgcgtgtggacctggagaaccgctgccagagcctgcaggaggagctggacttccggaagagtgtgttcgaggaggaggtgcgggagacgcggcggcggcacgagcggcgcctggtggaggtggacagcagccggcagcaggagtacgacttcaagatggcacaggcgctggaggagctgcggagccagcacgacgagcaagtgcggctctacaagctggagctggagcagacctaccaggccaagctggacagcgccaagctgagctctgaccagaacgacaaggcggccagtgcggctcgcgaggagctgaaggaggcccgcatgcgcctggagtccctcagctaccagctctccggcctccagaagcaggccagtgccgctgaagatcgcattcgggagctggaggaggccatggccggggagcgggacaagttccggaagatgctggacgccaaggagcaggagatgacggagatgcgggacgtgatgcagcagcagctggccgagtaccaggagctgctggacgtgaagctggccctggacatggagatcaacgcctaccggaagctcctggagggcgaggaggagaggctgaagctgtcccccagcccatcctcgcgcgtcaccgtctcacgagccacctcgagcagcagcggcagcttgtccgccaccgggcgcctgggccgcagtaagcggaagcggctggaggtggaggagcccttgggcagcggcccaagcgtcctgggcacgggcacgggtggcagcggtggcttccacctggcccagcaggcctcggcctcgggtagcgtcagcatcgaggagatcgacctggagggcaagtttgtgcagctcaagaacaactcggacaaggatcagtctctggggaactggagaatcaagaggcaggtcttggagggggaggagatcgcctacaagttcacgcccaagtacatcctgcgcgccggccagatggtcacggtgtgggcagctggtgcgggggtggcccacagccccccctcgacgctggtgtggaagggccagagcagctggggcacgggcgagagcttccgcaccgtcctggttaacgcggatggcgaggaagtggccatgaggactgtgaagaagtcctcggtgatgcgtgagaatgagaatggggaggaagaggaggaggaagccgagtttggcgaggaggatcttttccaccaacagtgagcctccgacgctgttgcacaagctgactcttcgtcacgtgatgcgaccgggctccgccccggcggcaacacgctgtatagacgcgccgggtgcctcgtgcgcatgcgcggcaggcccttcgggacgagctggaggcagagcgtgagtacaaagtgatcggcctcggccgcacgtagtagcccccctactccccggccaagtcagggcctccctcttcccgcggagtcgcaaccacgggtagctcgtgtaggtaacggcaggtccaggcctccgcatgagcggagggccccccgcgcgaccttgaatggcccgggcgcgcgcggtcgtgtgggagttgtagtcctccgtccccg

SEQ ID NO: 417834 - DNA, 1781 bp, Homo sapiens
catcttgcagccggcggcgcggattgaatgagcccgccgagcccgggccgccgtcgggagcagcgcaggccgcgagccgccgccaccatggccacgccgctgcccggccgcgcgggcgggcccgccacgccgctgtcgcccacgcgcctgtcgcggctgcaggagaaggaggagctgcgcgagctcaacgaccgcctggcgcactacatcgaccgcgtccgcgcgctggagctggagaacgaccggctcctgctcaagatctcagagaaggaggaggtgaccacgcgcgaggtgagtggcatcaaggcgctgtacgagtcggagctggccgatgcccggagagtcctggatgagacggctcgagagcgtgcccggctgcagatagagattgggaagctgagggcagagttggacgaggtcaacaagagcgccaagaagagggagggcgagcttacggtggcccagggccgtgtgaaggacctggagtccctgttccaccggagcgaggtggagctggcagctgccctcagcgacaagcgcggcctggagagtgacgtggctgagctgcgggcccagctggccaaggccgaggacggtcatgcagtggccaaaaagcagctggagaaggagacgctgatgcgtgtggacctggagaaccgctgccagagcctgcaggaggagctggacttccggaagagtgtgttcgaggaggaggtgcgggagacgcggcggcggcacgagcggcgcctggtggaggtggacagcagccggcagcaggagtacgacttcaagatggcacaggcgctggaggagctgcggagccagcacgacgagcaagtgcggctctacaagctggagctggagcagacctaccaggccaagctggacagcgccaagctgagctctgaccagaacgacaaggcggccagtgcggctcgcgaggagctgaaggaggcccgcatgcgcctggagtccctcagctaccagctctccggcctccagaagcaggccagtgccgctgaagatcgcattcgggagctggaggaggccatggccggggagcgggacaagttccggaagatgctggacgccaaggagcaggagatgacggagatgcgggacgtgatgcagcagcagctggccgagtaccaggagctgctggacgtgaagctggccctggacatggagatcaacgcctaccggaagctcctggagggcgaggaggagaggctgaagctgtcccccagcccatcctcgcgcgtcaccgtctcacgagccacctcgagcagcagcggcagcttgtccgccaccgggcgcctgggccgcagtaagcggaagcggctggaggtggaggagcccttgggcagcggcccaagcgtcctgggcacgggcacgggtggcagcggtggcttccacctggcccagcaggcctcggcctcgggtagcgtcagcatcgaggagatcgacctggagggcaagtttgtgcagctcaagaacaactcggacaaggatcagtctctggggaactggagaatcaagaggcaggtcttggagggggaggagatcgcctacaagttcacgcccaagtacatcctgcgcgccggccagatggtcacggtgtgggcacctggtgcgggggtgctctataccacttcctttttactatcttggatatgtccctttactttattgagtacatccttctgtaagttttcatctccttttctctttatataatgcttctaattgtgcgtctcatggtattaatccctaccccacgt

SEQ ID NO: 417835 - DNA, 484 bp, Homo sapiens
  misc_feature (80)..(80): n is a, c, g, or t
ccaaatttccaccacgccaatcaatcaaaattaatcaaacgacaaaaaaaaacccccatcgcagacacagctaaatgtcncgccaagccagccgtgcgctccgcaaaagcgaatcgtcgttatcaggcggtaagagacaaattacatctctccgctcaaggaaagttataatgcttttcaagggaccagaggcttttaaggtttaaatatcgaatgaagcataaggtcccccccaaaacccgcaggtcctggggcgtcgccgcctgcagcctcttccaagccctgcgtccagcgagcgtcacagcacaacctgcaaaaacggagctgggctgcagctggggctggcatggactttcatttcagagattcggtttttaagaagatgcatgcctaatgtgttcttttttttttccaatgatttgtaatatacattttatgactggaaacttttttgtacaacactccaataaacattttgatttta

SEQ ID NO: 417836 - DNA, 401 bp, Homo sapiens
acccccaaggaaaaaggtcactggctagtgtagctagtgtaaacaggacccaggcgatgcatgggaccctgcccttttttttctagtgagcctccgacgctgttgcacaagctgactcttcgtcacgtgatgcgaccgggctccgccccggcggcaacacgctgtatagacgcgccgggtgcctcgtgcgcatgcgcggcaggcccttcgggacgagctggaggcagagcgtgagtacaaagtgatcggcctcggccgcacgtagtagcccccctactccccggccaagtcagggcctccctcttcccgcggagtcgcaaccacgggtagctcgtgtaggtaacggcaggtccaggcctccgcatgagcggagggccccccgcgcgaccttgaatggcccg

SEQ ID NO: 417837 - DNA, 4635 bp, Homo sapiens
catcttgcagccggcggcgcggattgaatgagcccgccgagcccgggccgccgtcgggagcagcgcaggccgcgagccgccgccaccatggccacgccgctgcccggccgcgcgggcgggcccgccacgccgctgtcgcccacgcgcctgtcgcggctgcaggagaaggaggagctgcgcgagctcaacgaccgcctggcgcactacatcgaccgcgtccgcgcgctggagctggagaacgaccggctcctgctcaagatctcagagaaggaggaggtgaccacgcgcgaggtgagtggcatcaaggcgctgtacgagtcggagctggccgatgcccggagagtcctggatgagacggctcgagagcgtgcccggctgcagatagagattgggaagctgagggcagagttggacgaggtcaacaagagcgccaagaagagggagggcgagcttacggtggcccagggccgtgtgaaggacctggagtccctgttccaccggagcgaggtggagctggcagctgccctcagcgacaagcgcggcctggagagtgacgtggctgagctgcgggcccagctggccaaggccgaggacggtcatgcagtggccaaaaagcagctggagaaggagacgctgatgcgtgtggacctggagaaccgctgccagagcctgcaggaggagctggacttccggaagagtgtgttcgaggaggaggtgcgggagacgcggcggcggcacgagcggcgcctggtggaggtggacagcagccggcagcaggagtacgacttcaagatggcacaggcgctggaggagctgcggagccagcacgacgagcaagtgcggctctacaagctggagctggagcagacctaccaggccaagctggacagcgccaagctgagctctgaccagaacgacaaggcggccagtgcggctcgcgaggagctgaaggaggcccgcatgcgcctggagtccctcagctaccagctctccggcctccagaagcaggccagtgccgctgaagatcgcattcgggagctggaggaggccatggccggggagcgggacaagttccggaagatgctggacgccaaggagcaggagatgacggagatgcgggacgtgatgcagcagcagctggccgagtaccaggagctgctggacgtgaagctggccctggacatggagatcaacgcctaccggaagctcctggagggcgaggaggagaggctgaagctgtcccccagcccatcctcgcgcgtcaccgtctcacgagccacctcgagcagcagcggcagcttgtccgccaccgggcgcctgggccgcagtaagcggaagcggctggaggtggaggagcccttgggcagcggcccaagcgtcctgggcacgggcacgggtggcagcggtggcttccacctggcccagcaggcctcggcctcgggtagcgtcagcatcgaggagatcgacctggagggcaagtttgtgcagctcaagaacaactcggacaaggatcagtctctggggaactggagaatcaagaggcaggtcttggagggggaggagatcgcctacaagttcacgcccaagtacatcctgcgcgccggccagatggtcacggtgtgggcagctggtgcgggggtggcccacagccccccctcgacgctggtgtggaagggccagagcagctggggcacgggcgagagcttccgcaccgtcctggttaacgcggatggcgaggaagtggccatgaggactgtgaagaagtcctcggtgatgcgtgagaatgagaatggggaggaagaggaggaggaagccgagtttggcgaggaggatcttttccaccaacagggggacccgaggaccacctcaagaggctgctacgtgatgtgaacccacactcctcatccacacacctttctttacccagagccactgaaaactatttttatatcattggctttctttagttcttgatacatttctagagaatttctaagcgaactgccagaacgtgtgggtgggtctcccccagccctccctcctggcgggtctcctccagcctcacttcgctgccacttcgccgctgccccggagacttttcaatcccaccccactcctcatctcaccatttggtcaaattggaagcccagggccaggacccggaggtttagaagatgcttgggcttggagggaggagggccggcgaggctagcgaggggacaggagacggccctgctgcggacggagcgcggaaactgcgtaggaattcagtggtggtgggtttttttaaggctttctacaaaaccaaattcagaatccaggcgtcgacctggtggggcccggggccaagcctgcattctggctgcccagcttcggacagcgggaactcctcaggcagccacgcagcgggtgtgggccagcatggggatggcgtggcccccagggcgggttttcactccgctgcctgggcttccagattcccgttctggcagcgcaccggccgggtttctcggaccgttgactttatttgggggagttttcccgcagttcagttcctgactgtgcaaggccaacagggcaggggaggggaagacctggggaaggaagaatgaggacagtcccgtcgtaagacctgtcacaacaataagcagggaggggagatgtggaggggacacatctggttgccttggaggcagaagctgtgagtttcagaacagctgtctgcagggaacgccaccatgttgaccctctggaggagagcgctgtggagcccctcccgtgttccagctccgtctgccctgtgcctatatatacacatgcgtctatccatactgtgcttttatctgtgattttctcgctgaaaccatgtttctcagacaggccaaggccacctgactcctatcacgacgcacccaagcccctcagtccagcttcccaatgcctggcaccccccttcggcaatagctcaccgtttacaccctccctcatagatacacagaagttatttttttaatggatatttatttttttacattggtcagtacacaggtcaggagctcacgccagggccttgaggacaggctgaccctcctccccggggtggcgtggggctggggcaccctccgacggcagagcctccttcagaaagtgcagctcaagtcttaaagacaccaaaactgagccatgggcacgcgccgtctccgggccatggcgttcactgcagggcgggggcggcaccgctcccctgtgactgcatcccgcctccctggggacctgcctgtggcaggaaggaatggggggccccagccccaggccgggaaggagccagcggccgacaaagcagaaacacccgctgctccacgtagcccctgctcgctgtccttgctctcagaagtcccggtcccatgtagatagaggggggcgcatcttaccaaagcatttcctcctggaggctacgccgctgtgctcccagtcaggcggctggtagggagctttgcctgccccggggataccctctgccagccgctggaagtgggaatgctggcgacagactgtgtcctctttcccaccttcatagcaggaatcacccggacccgactggctgggcttcgtgctagcgagggttctgggggtgggtcttggtgatcttgtcctatggggagtctgcagtggtctcagccacatcctatgtattttggctctggaggagcaaagctgtatcctggagttggtctgtgatttgccgacagccttgcaggctgggctcagggacaaagtcccccccaaaacccgcaggtcctcatgtccagacgctgcccagtcctgtcctgaaaacagcacgccccaggcccacagaaccccccaccctacatttgccttgggtggagctgggggtggtcctaggactgcgggtgcccttagctgaagggggtggggagaagcgtggactgggcagcctgtgggtaattggaggttcattgagaattgagtctttggaaacactaagaaaatcaaatttttaaaagttatttatggcctgggaaacaatttgcatttgtccccaaatacgcttagctgtgtgccgcttagaacgatgcgaaaccatccctctgtgtaagcccgtgccgtgtgactcgaagcctagcgccctccctgcgaagcatcagacgccacccagccctggggggaggcccacgcctgctggaccaacgcgggttctggggtgcacagcgccaggttaacgctgaagcctgccccgctgagcccaggagccgggaggcctgcgggctgacccagaatccgatcatgcacctgtcctcatgccagcggctttggctggggttggtctgaagcctgcacgcggcagttctttgttaaagatctgagggactcctcagtcctggggcgtcgccgcctgcagcctcttccaagccctgcgtccagcgagcgtcacagcacaacctgcaaaaacggagctgggctgcagctggggctggcatggactttcatttcagagattcggtttttaagaagatgcatgcctaatgtgttcttttttttttccaatgatttgtaatatacattttatgactggaaacttttttgtacaacactccaataaacattttgatttta

SEQ ID NO: 417838 - DNA, 4049 bp, Homo sapiens
tcactgtcctggtttggggctcagcttttcattattgttatcagacgctgatgcgtgtggacctggagaaccgctgccagagcctgcaggaggagctggacttccggaagagtgtgttcgaggaggaggtgcgggagacgcggcggcggcacgagcggcgcctggtggaggtggacagcagccggcagcaggagtacgacttcaagatggcacaggcgctggaggagctgcggagccagcacgacgagcaagtgcggctctacaagctggagctggagcagacctaccaggccaagctggacagcgccaagctgagctctgaccagaacgacaaggcggccagtgcggctcgcgaggagctgaaggaggcccgcatgcgcctggagtccctcagctaccagctctccggcctccagaagcaggccagtgccgctgaagatcgcattcgggagctggaggaggccatggccggggagcgggacaagttccggaagatgctggacgccaaggagcaggagatgacggagatgcgggacgtgatgcagcagcagctggccgagtaccaggagctgctggacgtgaagctggccctggacatggagatcaacgcctaccggaagctcctggagggcgaggaggagaggctgaagctgtcccccagcccatcctcgcgcgtcaccgtctcacgagccacctcgagcagcagcggcagcttgtccgccaccgggcgcctgggccgcagtaagcggaagcggctggaggtggaggagcccttgggcagcggcccaagcgtcctgggcacgggcacgggtggcagcggtggcttccacctggcccagcaggcctcggcctcgggtagcgtcagcatcgaggagatcgacctggagggcaagtttgtgcagctcaagaacaactcggacaaggatcagtctctggggaactggagaatcaagaggcaggtcttggagggggaggagatcgcctacaagttcacgcccaagtacatcctgcgcgccggccagatggtcacggtgtgggcagctggtgcgggggtggcccacagccccccctcgacgctggtgtggaagggccagagcagctggggcacgggcgagagcttccgcaccgtcctggttaacgcggatggcgaggaagtggccatgaggactgtgaagaagtcctcggtgatgcgtgagaatgagaatggggaggaagaggaggaggaagccgagtttggcgaggaggatcttttccaccaacagggggacccgaggaccacctcaagaggctgctacgtgatgtgaacccacactcctcatccacacacctttctttacccagagccactgaaaactatttttatatcattggctttctttagttcttgatacatttctagagaatttctaagcgaactgccagaacgtgtgggtgggtctcccccagccctccctcctggcgggtctcctccagcctcacttcgctgccacttcgccgctgccccggagacttttcaatcccaccccactcctcatctcaccatttggtcaaattggaagcccagggccaggacccggaggtttagaagatgcttgggcttggagggaggagggccggcgaggctagcgaggggacaggagacggccctgctgcggacggagcgcggaaactgcgtaggaattcagtggtggtgggtttttttaaggctttctacaaaaccaaattcagaatccaggcgtcgacctggtggggcccggggccaagcctgcattctggctgcccagcttcggacagcgggaactcctcaggcagccacgcagcgggtgtgggccagcatggggatggcgtggcccccagggcgggttttcactccgctgcctgggcttccagattcccgttctggcagcgcaccggccgggtttctcggaccgttgactttatttgggggagttttcccgcagttcagttcctgactgtgcaaggccaacagggcaggggaggggaagacctggggaaggaagaatgaggacagtcccgtcgtaagacctgtcacaacaataagcagggaggggagatgtggaggggacacatctggttgccttggaggcagaagctgtgagtttcagaacagctgtctgcagggaacgccaccatgttgaccctctggaggagagcgctgtggagcccctcccgtgttccagctccgtctgccctgtgcctatatatacacatgcgtctatccatactgtgcttttatctgtgattttctcgctgaaaccatgtttctcagacaggccaaggccacctgactcctatcacgacgcacccaagcccctcagtccagcttcccaatgcctggcaccccccttcggcaatagctcaccgtttacaccctccctcatagatacacagaagttatttttttaatggatatttatttttttacattggtcagtacacaggtcaggagctcacgccagggccttgaggacaggctgaccctcctccccggggtggcgtggggctggggcaccctccgacggcagagcctccttcagaaagtgcagctcaagtcttaaagacaccaaaactgagccatgggcacgcgccgtctccgggccatggcgttcactgcagggcgggggcggcaccgctcccctgtgactgcatcccgcctccctggggacctgcctgtggcaggaaggaatggggggccccagccccaggccgggaaggagccagcggccgacaaagcagaaacacccgctgctccacgtagcccctgctcgctgtccttgctctcagaagtcccggtcccatgtagatagaggggggcgcatcttaccaaagcatttcctcctggaggctacgccgctgtgctcccagtcaggcggctggtagggagctttgcctgccccggggataccctctgccagccgctggaagtgggaatgctggcgacagactgtgtcctctttcccaccttcatagcaggaatcacccggacccgactggctgggcttcgtgctagcgagggttctgggggtgggtcttggtgatcttgtcctatggggagtctgcagtggtctcagccacatcctatgtattttggctctggaggagcaaagctgtatcctggagttggtctgtgatttgccgacagccttgcaggctgggctcagggacaaagtcccccccaaaacccgcaggtcctcatgtccagacgctgcccagtcctgtcctgaaaacagcacgccccaggcccacagaaccccccaccctacatttgccttgggtggagctgggggtggtcctaggactgcgggtgcccttagctgaagggggtggggagaagcgtggactgggcagcctgtgggtaattggaggttcattgagaattgagtctttggaaacactaagaaaatcaaatttttaaaagttatttatggcctgggaaacaatttgcatttgtccccaaatacgcttagctgtgtgccgcttagaacgatgcgaaaccatccctctgtgtaagcccgtgccgtgtgactcgaagcctagcgccctccctgcgaagcatcagacgccacccagccctggggggaggcccacgcctgctggaccaacgcgggttctggggtgcacagcgccaggttaacgctgaagcctgccccgctgagcccaggagccgggaggcctgcgggctgacccagaatccgatcatgcacctgtcctcatgccagcggctttggctggggttggtctgaagcctgcacgcggcagttctttgttaaagatctgagggactcctcagtcctggggcgtcgccgcctgcagcctcttccaagccctgcgtccagcgagcgtcacagcacaacctgcaaaaacggagctgggctgcagctggggctggcatggactttcatttcagagattcggtttttaagaagatgcatgcctaatgtgttcttttttttttccaatgatttgtaatatacattttatgactggaaacttttttgtacaacactccaataaacattttgatttta

SEQ ID NO: 417839 - DNA, 3880 bp, Homo sapiens
catcttgcagccggcggcgcggattgaatgagcccgccgagcccgggccgccgtcgggagcagcgcaggccgcgagccgccgccaccatggccacgccgctgcccggccgcgcgggcgggcccgccacgccgctgtcgcccacgcgcctgtcgcggctgcaggagaaggaggagctgcgcgagctcaacgaccgcctggcgcactacatcgaccgcgtccgcgcgctggagctggagaacgaccggctcctgctcaagatctcagagaaggaggaggtgaccacgcgcgaggtgagtggcatcaaggcgctgtacgagtcggagctggccgatgcccggagagtcctggatgagacggctcgagagcgtgcccggctgcagatagagattgggaagctgagggcagagttggacgaggtcaacaagagcgccaagaagagggagggcgagcttacggtggcccagggccgtgtgaaggacctggagtccctgttccaccggagcgaggtggagctggcagctgccctcagcgacaagcgcggcctggagagtgacgtggctgagctgcgggcccagctggccaaggccgaggacggtcatgcagtggccaaaaagcagctggagaaggagacgctgatgcgtgtggacctggagaaccgctgccagagcctgcaggaggagctggacttccggaagagtgtgttcgaggaggaggtgcgggagacgcggcggcggcacgagcggcgcctggtggaggtggacagcagccggcagcaggagtacgacttcaagatggcacaggcgctggaggagctgcggagccagcacgacgagcaagtgcggctctacaagctggagctggagcagacctaccaggccaagctggacagcgccaagctgagctctgaccagaacgacaaggcggccagtgcggctcgcgaggagctgaaggaggcccgcatgcgcctggagtccctcagctaccagctctccggcctccagaagcaggccagtgccgctgaagatcgcattcgggagctggaggaggccatggccggggagcgggacaagttccggaagatgctggacgccaaggagcaggagatgacggagatgcgggacgtgatgcagcagcagctggccgagtaccaggagctgctggacgtgaagctggccctggacatggagatcaacgcctaccggaagctcctggagggcgaggaggagaggctgaagctgtcccccagcccatcctcgcgcgtcaccgtctcacgagccacctcgagcagcagcggcagcttgtccgccaccgggcgcctgggccgcagtaagcggaagcggctggaggtggaggagcccttgggcagcggcccaagcgtcctgggcacgggcacgggtggcagcggtggcttccacctggcccagcaggcctcggcctcgggtagcgtcagcatcgaggagatcgacctggagggcaagtttgtgcagctcaagaacaactcggacaaggatcagtctctggggaactggagaatcaagaggcaggtcttggagggggaggagatcgcctacaagttcacgcccaagtacatcctgcgcgccggccagatggtcacggtgtgggcagctggtgcgggggtggcccacagccccccctcgacgctggtgtggaagggccagagcagctggggcacgggcgagagcttccgcaccgtcctggttaacgcggatggcgagcgcaccggccgggtttctcggaccgttgactttatttgggggagttttcccgcagttcagttcctgactgtgcaaggccaacagggcaggggaggggaagacctggggaaggaagaatgaggacagtcccgtcgtaagacctgtcacaacaataagcagggaggggagatgtggaggggacacatctggttgccttggaggcagaagctgtgagtttcagaacagctgtctgcagggaacgccaccatgttgaccctctggaggagagcgctgtggagcccctcccgtgttccagctccgtctgccctgtgcctatatatacacatgcgtctatccatactgtgcttttatctgtgattttctcgctgaaaccatgtttctcagacaggccaaggccacctgactcctatcacgacgcacccaagcccctcagtccagcttcccaatgcctggcaccccccttcggcaatagctcaccgtttacaccctccctcatagatacacagaagttatttttttaatggatatttatttttttacattggtcagtacacaggtcaggagctcacgccagggccttgaggacaggctgaccctcctccccggggtggcgtggggctggggcaccctccgacggcagagcctccttcagaaagtgcagctcaagtcttaaagacaccaaaactgagccatgggcacgcgccgtctccgggccatggcgttcactgcagggcgggggcggcaccgctcccctgtgactgcatcccgcctccctggggacctgcctgtggcaggaaggaatggggggccccagccccaggccgggaaggagccagcggccgacaaagcagaaacacccgctgctccacgtagcccctgctcgctgtccttgctctcagaagtcccggtcccatgtagatagaggggggcgcatcttaccaaagcatttcctcctggaggctacgccgctgtgctcccagtcaggcggctggtagggagctttgcctgccccggggataccctctgccagccgctggaagtgggaatgctggcgacagactgtgtcctctttcccaccttcatagcaggaatcacccggacccgactggctgggcttcgtgctagcgagggttctgggggtgggtcttggtgatcttgtcctatggggagtctgcagtggtctcagccacatcctatgtattttggctctggaggagcaaagctgtatcctggagttggtctgtgatttgccgacagccttgcaggctgggctcagggacaaagtcccccccaaaacccgcaggtcctcatgtccagacgctgcccagtcctgtcctgaaaacagcacgccccaggcccacagaaccccccaccctacatttgccttgggtggagctgggggtggtcctaggactgcgggtgcccttagctgaagggggtggggagaagcgtggactgggcagcctgtgggtaattggaggttcattgagaattgagtctttggaaacactaagaaaatcaaatttttaaaagttatttatggcctgggaaacaatttgcatttgtccccaaatacgcttagctgtgtgccgcttagaacgatgcgaaaccatccctctgtgtaagcccgtgccgtgtgactcgaagcctagcgccctccctgcgaagcatcagacgccacccagccctggggggaggcccacgcctgctggaccaacgcgggttctggggtgcacagcgccaggttaacgctgaagcctgccccgctgagcccaggagccgggaggcctgcgggctgacccagaatccgatcatgcacctgtcctcatgccagcggctttggctggggttggtctgaagcctgcacgcggcagttctttgttaaagatctgagggactcctcagtcctggggcgtcgccgcctgcagcctcttccaagccctgcgtccagcgagcgtcacagcacaacctgcaaaaacggagctgggctgcagctggggctggcatggactttcatttcagagattcggtttttaagaagatgcatgcctaatgtgttcttttttttttccaatgatttgtaatatacattttatgactggaaacttttttgtacaacactccaataaacattttgatttta

SEQ ID NO: 417840 - DNA, 4150 bp, Homo sapiens
catcttgcagccggcggcgcggattgaatgagcccgccgagcccgggccgccgtcgggagcagcgcaggccgcgagccgccgccaccatggccacgccgctgcccggccgcgcgggcgggcccgccacgccgctgtcgcccacgcgcctgtcgcggctgcaggagaaggaggagctgcgcgagctcaacgaccgcctggcgcactacatcgaccgcgtccgcgcgctggagctggagaacgaccggctcctgctcaagatctcagagaaggaggaggtgaccacgcgcgaggtgagtggcatcaaggcgctgtacgagtcggagctggccgatgcccggagagtcctggatgagacggctcgagagcgtgcccggctgcagatagagattgggaagctgagggcagagttggacgaggtcaacaagagcgccaagaagagggagggcgagcttacggtggcccagggccgtgtgaaggacctggagtccctgttccaccggagcgaggtggagctggcagctgccctcagcgacaagcgcggcctggagagtgacgtggctgagctgcgggcccagctggccaaggccgaggacggtcatgcagtggccaaaaagcagctggagaaggagacgctgatgcgtgtggacctggagaaccgctgccagagcctgcaggaggagctggacttccggaagagtgtgttcgaggaggaggtgcgggagacgcggcggcggcacgagcggcgcctggtggaggtggacagcagccggcagcaggagtacgacttcaagatggcacaggcgctggaggagctgcggagccagcacgacgagcaagtgcggctctacaagctggagctggagcagacctaccaggccaagctggacagcgccaagctgagctctgaccagaacgacaaggcggccagtgcggctcgcgaggagctgaaggaggcccgcatgcgcctggagtccctcagctaccagctctccggcctccagaagcaggccagtgccgctgaagatcgcattcgggagctggaggaggccatggccggggagcgggacaagttccggaagatgctggacgccaaggagcaggagatgacggagatgcgggacgtgatgcagcagcagctggccgagtaccaggagctgctggacgtgaagctggccctggacatggagatcaacgcctaccggaagctcctggagggcgaggaggagaggctgaagctgtcccccagcccatcctcgcgcgtcaccgtctcacgagccacctcgagcagcagcggcagcttgtccgccaccgggcgcctgggccgcagtaagcggaagcggctggaggtggaggagcccttgggcagcggcccaagcgtcctgggcacgggcacgggtggcagcggtggcttccacctggcccagcaggcctcggcctcgggtagcgtcagcatcgaggagatcgacctggagggcaagtttgtgcagctcaagaacaactcggacaaggatcagtctctggggaactggagaatcaagaggcaggtcttggagggggaggagatcgcctacaagttcacgcccaagtacatcctgcgcgccggccagatggtcacggtgtgggcagctggtgcgggggtggcccacagccccccctcgacgctggtgtggaagggccagagcagctggggcacgggcgagagcttccgcaccgtcctggttaacgcggatggcgaggaagtggccatgaggactgtgaagaagtcctcggtgatgcgtgagaatgagaatggggaggaagaggaggaggaagccgagtttggcgaggaggatcttttccaccaacagggggacccgaggaccacctcaagaggctgctacgtgatgtgaacccacactcctcatccacacacctttctttacccagagccactgaaaactatttttatatcattggctttctttagttcttgatacatttctagagaatttctaagcgaactgccagaacgtgtgggtgggtctcccccagccctccctcctggcgggtctcctccagcctcacttcgctgccacttcgccgctgccccggagacttttcaatcccaccccactcctcatctcaccatttggtcaaattggaagcccagggccaggacccggaggtttagaagatgcttgggcttggagggaggagggccggcgaggctagcgaggggacaggagacggccctgctgcggacggagcgcggaaactgcgtaggaattcagtggtggtgggtttttttaaggctttctacaaaaccaaattcagaatccaggcgtcgacctggtggggcccggggccaagcctgcattctggctgcccagcttcggacagcgggaactcctcaggcagccacgcagcgggtgtgggccagcatggggatggcgtggcccccagggcgggttttcactccgctgcctgggcttccagattcccgttctggcagcgcaccggccgggtttctcggaccgttgactttatttgggggagttttcccgcagttcagttcctgacttgtgcttttatctgtgattttctcgctgaaaccatgtttctcagacaggccaaggccacctgactcctatcacgacgcacccaagcccctcagtccagcttcccaatgcctggcaccccccttcggcaatagctcaccgtttacaccctccctcatagatacacagaagttatttttttaatggatatttatttttttacattggtcagtacacaggtcaggagctcacgccagggccttgaggacaggctgaccctcctccccaggccgggaaggagccagcggccgacaaagcagaaacacccgctgctccacgtagcccctgctcgctgtccttgctctcagaagtcccggtcccatgtagatagaggggggcgcatcttaccaaagcatttcctcctggaggctacgccgctgtgctcccagtcaggcggctggtagggagctttgcctgccccggggataccctctgccagccgctggaagtgggaatgctggcgacagactgtgtcctctttcccaccttcatagcaggaatcacccggacccgactggctgggcttcgtgctagcgagggttctgggggtgggtcttggtgatcttgtcctatggggagtctgcagtggtctcagccacatcctatgtattttggctctggaggagcaaagctgtatcctggagttggtctgtgatttgccgacagccttgcaggctgggctcagggacaaagtcccccccaaaacccgcaggtcctcatgtccagacgctgcccagtcctgtcctgaaaacagcacgccccaggcccacagaaccccccaccctacatttgccttgggtggagctgggggtggtcctaggactgcgggtgcccttagctgaagggggtggggagaagcgtggactgggcagcctgtgggtaattggaggttcattgagaattgagtctttggaaacactaagaaaatcaaatttttaaaagttatttatggcctgggaaacaatttgcatttgtccccaaatacgcttagctgtgtgccgcttagaacgatgcgaaaccatccctctgtgtaagcccgtgccgtgtgactcgaagcctagcgccctccctgcgaagcatcagacgccacccagccctggggggaggcccacgcctgctggaccaacgcgggttctggggtgcacagcgccaggttaacgctgaagcctgccccgctgagcccaggagccgggaggcctgcgggctgacccagaatccgatcatgcacctgtcctcatgccagcggctttggctggggttggtctgaagcctgcacgcggcagttctttgttaaagatctgagggactcctcagtcctggggcgtcgccgcctgcagcctcttccaagccctgcgtccagcgagcgtcacagcacaacctgcaaaaacggagctgggctgcagctggggctggcatggactttcatttcagagattcggtttttaagaagatgcatgcctaatgtgttcttttttttttccaatgatttgtaatatacattttatgactggaaacttttttgtacaacactccaataaacattttgatttta

SEQ ID NO: 417841 - DNA, 4484 bp, Homo sapiens
catcttgcagccggcggcgcggattgaatgagcccgccgagcccgggccgccgtcgggagcagcgcaggccgcgagccgccgccaccatggccacgccgctgcccggccgcgcgggcgggcccgccacgccgctgtcgcccacgcgcctgtcgcggctgcaggagaaggaggagctgcgcgagctcaacgaccgcctggcgcactacatcgaccgcgtccgcgcgctggagctggagaacgaccggctcctgctcaagatctcagagaaggaggaggtgaccacgcgcgaggtgagtggcatcaaggcgctgtacgagtcggagctggccgatgcccggagagtcctggatgagacggctcgagagcgtgcccggctgcagatagagattgggaagctgagggcagagttggacgaggtcaacaagagcgccaagaagagggagggcgagcttacggtggcccagggccgtgtgaaggacctggagtccctgttccaccggagcgaggtggagctggcagctgccctcagcgacaagcgcggcctggagagtgacgtggctgagctgcgggcccagctggccaaggccgaggacggtcatgcagtggccaaaaagcagctggagaaggagacgctgatgcgtgtggacctggagaaccgctgccagagcctgcaggaggagctggacttccggaagagtgtgttcgaggaggaggtgcgggagacgcggcggcggcacgagcggcgcctggtggaggtggacagcagccggcagcaggagtacgacttcaagatggcacaggcgctggaggagctgcggagccagcacgacgagcaagtgcggctctacaagctggagctggagcagacctaccaggccaagctggacagcgccaagctgagctctgaccagaacgacaaggcggccagtgcggctcgcgaggagctgaaggaggcccgcatgcgcctggagtccctcagctaccagctctccggcctccagaagcaggccagtgccgctgaagatcgcattcgggagctggaggaggccatggccggggagcgggacaagttccggaagatgctggacgccaaggagcaggagatgacggagatgcgggacgtgatgcagcagcagctggccgagtaccaggagctgctggacgtgaagctggccctggacatggagatcaacgcctaccggaagctcctggagggcgaggaggagaggctgaagctgtcccccagcccatcctcgcgcgtcaccgtctcacgagccacctcgagcagcagcggcagcttgtccgccaccgggcgcctgggccgcagtaagcggaagcggctggaggtggaggagcccttgggcagcggcccaagcgtcctgggcacgggcacgggtggcagcggtggcttccacctggcccagcaggcctcggcctcgggtagcgtcagcatcgaggagatcgacctggagggcaagtttgtgcagctcaagaacaactcggacaaggatcagtctctggggaactggagaatcaagaggcaggtcttggagggggaggagatcgcctacaagttcacgcccaagtacatcctgcgcgccggccagatggtcacggtgtgggcagctggtgcgggggtggcccacagccccccctcgacgctggtgtggaagggccagagcagctggggcacgggcgagagcttccgcaccgtcctggttaacgcggatggcgaggaagtggccatgaggactgtgaagaagtcctcggtgatgcgtgagaatgagaatggggaggaagaggaggaggaagccgagtttggcgaggaggatcttttccaccaacagggggacccgaggaccacctcaagaggctgctacgtgatgtgaacccacactcctcatccacacacctttctttacccagagccactgaaaactatttttatatcattggctttctttagttcttgatacatttctagagaatttctaagcgaactgccagaacgtgtgggtgggtctcccccagccctccctcctggcgggtctcctccagcctcacttcgctgccacttcgccgctgccccggagacttttcaatcccaccccactcctcatctcaccatttggtcaaattggaagcccagggccaggacccggaggtttagaagatgcttgggcttggagggaggagggccggcgaggctagcgaggggacaggagacggccctgctgcggacggagcgcggaaactgcgtaggaattcagtggtggtgggtttttttaaggctttctacaaaaccaaattcagaatccaggcgtcgacctggtggggcccggggccaagcctgcattctggctgcccagcttcggacagcgggaactcctcaggcagccacgcagcgggtgtgggccagcatggggatggcgtggcccccagggcgggttttcactccgctgcctgggcttccagattcccgttctggcagcgcaccggccgggtttctcggaccgttgactttatttgggggagttttcccgcagttcagttcctgactgtgcaaggccaacagggcaggggaggggaagacctggggaaggaagaatgaggacagtcccgtcgtaagacctgtcacaacaataagcagggaggggagatgtggaggggacacatctggttgccttggaggcagaagctgtgagtttcagaacagctgtctgcagggaacgccaccatgttgaccctctggaggagagcgctgtggagcccctcccgtgttccagctccgtctgccctgtgcctatatatacacatgcgtctatccatactgtgcttttatctgtgattttctcgctgaaaccatgtttctcagacaggccaaggccacctgactcctatcacgacgcacccaagcccctcagtccagcttcccaatgcctggcaccccccttcggcaatagctcaccgtttacaccctccctcatagatacacagaagttatttttttaatggatatttatttttttacattggtcagtacacaggtcaggagctcacgccagggccttgaggacaggctgaccctcctccccggggtggcgtggggctggggcaccctccgacggcagagcctccttcagaaagtgcagctcaagtcttaaagacaccaaaactgagccatgggcacgcgccgtctccgggccatggcgttcactgcagggcgggggcggcaccgctcccctgtgactgcatcccgcctccctggggacctgcctgtggcaggaaggaatggggggccccagccccaggccgggaaggagccagcggccgacaaagcagaaacacccgctgctccacgtagcccctgctcgctgtccttgctctcagaagtcccggtcccatgtagatagaggggggcgcatcttaccaaagcatttcctcctggaggctacgccgctgtgctcccagtcaggcggctggtagggagctttgcctgccccggggataccctctgccagccgctggaagtgggaatgctggcgacagactgtgtcctctttcccaccttcatagcaggaatcacccggacccgactggctgggcttcgtgctagcgagggttctgggggtgggtcttggtgatcttgtcctatggggagtctgcagtggtctcagccacatcctatgtattttggctctggaggagcaaagctgtatcctggagttggtctgtgatttgccgacagccttgcaggctgggctcagggacaaagtcccccccaaaacccgcaggtcctcatgtccagacgctgcccagtcctgtcctgaaaacagcacgccccaggcccacagaaccccccaccctacatttgccttgggtggagctgggggtggtcctaggactgcgggtgcccttagctgaagggggtggggagaagcgtggactgggcagcctgtgggtaattggaggttcattgagaattgagtctttggaaacactaagaaaatcaaatttttaaaagttatttatggcctgggaaacaatttgcatttgtccccaaatacgcttagctgtgtgccgcttagaacgatgcgaaaccatccctctgtgtaagcccgtgccgtgtgactcgaagcctagcgccctccctgcgaagcatcagacgccacccagccctggggggaggcccacgcctgctggaccaacgcgggttctggggtgcacagcgccaggttaacgctgaagctgccgtgagccatgagcggaaggctgggtgaccagatcgatctgactgtctcttgcaaggtggtgggtgttgagctgacgcggagtctgtaagacgggatcccactgggtcgtgacttcagctggtcgagttcgacctcggaagggggggggggttcaacgtaaaaccttttcctattatggctcctttaaaaagggaggggcgcctctaccatttcctttcttcctctttggg

SEQ ID NO: 417842 - DNA, 1887 bp, Homo sapiens
gcctggtggcgaattcggcacgaggatgagcccgccgagcccgggccgccgtcgggagcagcgcaggccgcgagccgccgccaccatggccacgccgctgcccggccgcgcgggcgggcccgccacgccgctgtcgcccacgcgcctgtcgcggctgcaggagaaggaggagctgcgcgagctcaacgaccgcctggcgcactacatcgaccgcgtccgcgcgctggagctggagaacgaccggctcctgctcaagatctcagagaaggaggaggtgaccacgcgcgaggtgagtggcatcaaggcgctgtacgagtcggagctggccgatgcccggagagtcctggatgagacggctcgagagcgtgcccggctgcagatagagattgggaagctgagggcagagttggacgaggtcaacaagagcgccaagaagagggagggcgagcttacggtggcccagggccgtgtgaaggacctggagtccctgttccaccggagcgaggtggagctggcagctgccctcagcgacaagcgcggcctggagagtgacgtggctgagctgcgggcccagctggccaaggccgaggacggtcatgcagtggccaaaaagcagctggagaagggctgtccttgctctcagaagtcccggtcccatgtagatagaggggggcgcatcttaccaaagcatttcctcctggaggctacgccgctgtgctcccagtcaggcggctggtagggagctttgcctgccccggggataccctctgccagccgctggaagtgggaatgctggcgacagactgtgtcctctttcccaccttcatagcaggaatcacccggacccgactggctgggcttcgtgctagcgagggttctgggggtgggtcttggtgatcttgtcctatggggagtctgcagtggtctcagccacatcctatgtattttggctctggaggagcaaagctgtatcctggagttggtctgtgatttgccgacagccttgcaggctgggctcagggacaaagtcccccccaaaacccgcaggtcctcatgtccagacgctgcccagtcctgtcctgaaaacagcacgccccaggcccacagaaccccccaccctacatttgccttgggtggagctgggggtggtcctaggactgcgggtgcccttagctgaagggggtggggagaagcgtggactgggcagcctgtgggtaattggaggttcattgagaattgagtctttggaaacactaagaaaatcaaatttttaaaagttatttatggcctgggaaacaatttgcatttgtccccaaatacgcttagctgtgtgccgcttagaacgatgcgaaaccatccctctgtgtaagcccgtgccgtgtgactcgaagcctagcgccctccctgcgaagcatcagacgccacccagccctggggggaggcccacgcctgctggaccaacgcgggttctggggtgcacagcgccaggttaacgctgaagcctgccccgctgagcccaggagccgggaggcctgcgggctgacccagaatccgatcatgcacctgtcctcatgccagcggctttggctggggttggtctgaagcctgcacgcggcagttctttgttaaagatctgagggactcctcagtcctggggcgtcgccgcctgcagcctcttccaagccctgcgtccagcgagcgtcacagcacaacctgcaaaaacggagctgggctgcagctggggctggcatggactttcatttcagagattcggtttttaagaagatgcatgcctaatgtgttcttttttttttccaatgatttgtaatatacattttatgactggaaacttttttgtacaacactccaataaacattttgatttta

SEQ ID NO: 417843 - DNA, 4041 bp, Homo sapiens
catcttgcagccggcggcgcggattgaatgagcccgccgagcccgggccgccgtcgggagcagcgcaggccgcgagccgccgccaccatggccacgccgctgcccggccgcgcgggcgggcccgccacgccgctgtcgcccacgcgcctgtcgcggctgcaggagaaggaggagctgcgcgagctcaacgaccgcctggcgcactacatcgaccgcgtccgcgcgctggagctggagaacgaccggctcctgctcaagatctcagagaaggaggaggtgaccacgcgcgaggtgagtggcatcaaggcgctgtacgagtcggagctggccgatgcccggagagtcctggatgagacggctcgagagcgtgcccggctgcagatagagattgggaagctgagggcagagttggacgaggtcaacaagagcgccaagaagagggagggcgagcttacggtggcccagggccgtgtgaaggacctggagtccctgttccaccggagcgaggtggagctggcagctgccctcagcgacaagcgcggcctggagagtgacgtggctgagctgcgggcccagctggccaaggccgaggacggtcatgcagtggccaaaaagcagctggagaaggagacgctgatgcgtgtggacctggagaaccgctgccagagcctgcaggaggagctggacttccggaagagtgtgttcgaggaggaggtgcgggagacgcggcggcggcacgagcggcgcctggtggaggtggacagcagccggcagcaggagtacgacttcaagatggcacaggcgctggaggagctgcggagccagcacgacgagcaagtgcggctctacaagctggagctggagcagacctaccaggccaagctggacagcgccaagctgagctctgaccagaacgacaaggcggccagtgcggctcgcgaggagctgaaggaggcccgcatgcgcctggagtccctcagctaccagctctccggcctccagaagcaggccagtgccgctgaagatcgcattcgggagctggaggaggccatggccggggagcgggacaagttccggaagatgctggacgccaaggagcaggagatgacggagatgcgggacgtgatgcagcagcagctggccgagtaccaggagctgctggacgtgaagctggccctggacatggagatcaacgcctaccggaagctcctggagggcgaggaggagaggctgaagctgtcccccagcccatcctcgcgcgtcaccgtctcacgagccacctcgagcagcagcggcagcttgtccgccaccgggcgcctgggccgcagtaagcggaagcggctggaggtggaggagcccttgggcagcggcccaagcgtcctgggcacgggcacgggtggcagcggtggcttccacctggcccagcaggcctcggcctcgggtagcgtcagcatcgaggagatcgacctggagggcaagtttgtgcagctcaagaacaactcggacaaggatcagtctctggggaactggagaatcaagaggcaggtcttggagggggaggagatcgcctacaagttcacgcccaagtacatcctgcgcgccggccagatggtcacggtgtgggcagctggtgcgggggtggcccacagccccccctcgacgctggtgtggaagggccagagcagctggggcacgggcgagagcttccgcaccgtcctggttaacgcggatggcgaggaagtggccatgaggactgtgaagaagtcctcggtgatgcgtgagaatgagaatggggaggaagaggaggaggaagccgagtttggcgaggaggatcttttccaccaacagggggacccgaggaccacctcaagaggctgctacgtgatgtgaacccacactcctcatccacacacctttctttacccagagccactgaaaactatttttatatcattggctttctttagttcttgatacatttctagagaatttctaagcgaactgccagaacgtgtgggtgggtctcccccagccctccctcctggcgggtctcctccagcctcacttcgctgccacttcgccgctgccccggagacttttcaatcccaccccactcctcatctcaccatttggtcaaattggaagcccagggccaggacccggaggtttagaagatgcttgggcttggagggaggagggccggcgaggctagcgaggggacaggagacggccctgctgcggacggagcgcggaaactgcgtaggaattcagtggtggtgggtttttttaaggctttctacaaaaccaaattcagaatccaggcgtcgacctggtggggcccggggccaagcctgcattctggctgcccagcttcggacagcgggaactcctcaggcagccacgcagcgggtgtgggccagcatggggatggcgtggcccccagggcgggttttcactccgctgcctgggcttccagattcccgttctggcagcgcaccggccgggtttctcggaccgttgactttatttgggggagttttcccgcagttcagttcctgactgtgcaaggccaacagggcaggggaggggaagacctggggaaggaagaatgaggacagtcccgtcgtaagacctgtcacaacaataagcagggaggggagatgtggaggggacacatctggttgccttggaggcagaagctgtgagtttcagaacagctgtctgcagggaacgccaccatgttgaccctctggaggagagcgctgtggagcccctcccgtgttccagctccgtctgccctgtgcctatatatacacatgcgtctatccatactgtgcttttatctgtgattttctcgctgaaaccatgtttctcagacaggccaaggccacctgactcctatcacgacgcacccaagcccctcagtccagcttcccaatgcctggcaccccccttcggcaatagctcaccgtttacaccctccctcatagatacacagaagttatttttttaatggatatttatttttttacattggtcagtacacaggtcaggagctcacgccagggccttgaggacaggctgaccctcctccccggggtggcgtggggctggggcaccctccgacggcagagcctccttcagaaagtgcagctcaagtcttaaagacaccaaaactgagccatgggcacgcgccgtctccgggccatggcgttcactgcagggcgggggcggcaccgctcccctgtgactgcatcccgcctccctggggacctgcctgtggcaggaaggaatggggggccccagccccaggccgggaaggagccagcggccgacaaagcagaaacacccgctgctccacgtagcccctgctcgctgtccttgctctcagaagtcccggtcccatgtagatagaggggggcgcatcttaccaaagcatttcctcctggaggctacgccgctgtgctcccagtcaggcggctggtagggagctttgcctgccccggggataccctctgccagccgctggaagtgggaatgctggcgacagactgtgtcctctttcccaccttcatagcaggaatcacccggacccgactggctgggcttcgtgctagcgagggttctgggggtgggtcttggtgatcttgtcctatggggagtctgcagtggtctcagccacatcctatgtattttggctctggaggagcaaagctgtatcctggagttggtctgtgatttgccgacagccttgcaggctgggctcagggacaaagtcccccccaaaacccgcaggtcctcattcctggggcgtcgccgcctgcagcctcttccaagccctgcgtccagcgagcgtcacagcacaacctgcaaaaacggagctgggctgcagctggggctggcatggactttcatttcagagattcggtttttaagaagatgcatgcctaatgtgttcttttttttttccaatgatttgtaatatacattttatgactggaaacttttttgtacaacactccaataaacattttgatttta

SEQ ID NO: 417844 - DNA, 2590 bp, Homo sapiens
catcttgcagccggcggcgcggattgaatgagcccgccgagcccgggccgccgtcgggagcagcgcaggccgcgagccgccgccaccatggccacgccgctgcccggccgcgcgggcgggcccgccacgccgctgtcgcccacgcgcctgtcgcggctgcaggagaaggaggagctgcgcgagctcaacgaccgcctggcgcactacatcgaccgcgtccgcgcgctggagctggagaacgaccggctcctgctcaagatctcagagaaggaggaggtgaccacgcgcgaggtgagtggcatcaaggcgctgtacgagtcggagctggccgatgcccggagagtcctggatgagacggctcgagagcgtgcccggctgcagatagagattgggaagctgagggcagagttggacgaggtcaacaagagcgccaagaagagggagggcgagcttacggtggcccagggccgtgtgaaggacctggagtccctgttccaccggagcgaggtggagctggcagctgccctcagcgacaagcgcggcctggagagtgacgtggctgagctgcgggcccagctggccaaggccgaggacggtcatgcagtggccaaaaagcagctggagaaggagacgctgatgcgtgtggacctggagaaccgctgccagagcctgcaggaggagctggacttccggaagagtgtgttcgaggaggaggtgcgggagacgcggcggcggcacgagcggcgcctggtggaggtggacagcagccggcagcaggagtacgacttcaagatggcacaggcgctggaggagctgcggagccagcacgacgagcaagtgcggctctacaagctggagctggagcagacctaccaggccaagctggacagcgccaagctgagctctgaccagaacgacaaggcggccagtgcggctcgcgaggagctgaaggaggcccgcatgcgcctggagtccctcagctaccagctctccggcctccagaagcaggccagtgccgctgaagatcgcattcgggagctggaggaggccatggccggggagcgggacaagttccggaagatgctggacgccaaggagcaggagatgacggagatgcgggacgtgatgcagcagcagctggccgagtaccaggagctgctggacgtgaagctggccctggacatggagatcaacgcctaccggaagctcctggagggcgaggaggagaggctgaagctgtcccccagcccatcctcgcgcgtcaccgtctcacgagccacctcgagcagcagcggcagcttgtccgccaccgggcgcctgggccgcagtaagcggaagcggctggaggtggaggagcccttgggcagcggcccaagcgtcctgggcacgggcacgggtggcagcggtggcttccacctggcccagcaggcctcggcctcgggtagcgtcagcatcgaggagatcgacctggagggcaagtttgtgcagctcaagaacaactcggacaaggatcagtctctggggaactggagaatcaagaggcaggtcttggagggggaggagatcgcctacaagttcacgcccaagtacatcctgcgcgccggccagatggtcacggtgtgggcagctggtgcgggggtggcccacagccccccctcgacgctggtgtggaagggccagagcagctggggcacgggcgagagcttccgcaccgtcctggttaacgcggatggcgaggaagtggccatgaggactgtgaagaagtcctcggtgatgcgtgagaatgagaatggggaggaagaggaggaggaagccgagtttggcgaggaggatcttttccaccaacagggggacccgaggaccacctcaagaggctgctacgtgatgtgaacccacactcctcatccacacacctttctttacccagagccactgaaaactatttttatatcattggctttctttagttcttgatacatttctagagaatttctaagcgaactgccagaacgtgtgggtgggtctcccccagccctccctcctggcgggtctcctccagcctcacttcgctgccacttcgccgctgccccggagacttttcaatcccaccccactcctcatctcaccatttggtcaaattggaagcccacgcctgctggaccaacgcgggttctggggtgcacagcgccaggttaacgctgaagcctgccccgctgagcccaggagccgggaggcctgcgggctgacccagaatccgatcatgcacctgtcctcatgccagcggctttggctggggttggtctgaagcctgcacgcggcagttctttgttaaagatctgagggactcctcagtcctggggcgtcgccgcctgcagcctcttccaagccctgcgtccagcgagcgtcacagcacaacctgcaaaaacggagctgggctgcagctggggctggcatggactttcatttcagagattcggtttttaagaagatgcatgcctaatgtgttcttttttttttccaatgatttgtaatatacattttatgactggaaacttttttgtacaacactccaataaacattttgatttta

SEQ ID NO: 417845 - DNA, 2436 bp, Homo sapiens
catcttgcagccggcggcgcggattgaatgagcccgccgagcccgggccgccgtcgggagcagcgcaggccgcgagccgccgccaccatggccacgccgctgcccggccgcgcgggcgggcccgccacgccgctgtcgcccacgcgcctgtcgcggctgcaggagaaggaggagctgcgcgagctcaacgaccgcctggcgcactacatcgaccgcgtccgcgcgctggagctggagaacgaccggctcctgctcaagatctcagagaaggaggaggtgaccacgcgcgaggtgagtggcatcaaggcgctgtacgagtcggagctggccgatgcccggagagtcctggatgagacggctcgagagcgtgcccggctgcagatagagattgggaagctgagggcagagttggacgaggtcaacaagagcgccaagaagagggagggcgagcttacggtggcccagggccgtgtgaaggacctggagtccctgttccaccggagcgaggtggagctggcagctgccctcagcgacaagcgcggcctggagagtgacgtggctgagctgcgggcccagctggccaaggccgaggacggtcatgcagtggccaaaaagcagctggagaaggagacgctgatgcgtgtggacctggagaaccgctgccagagcctgcaggaggagctggacttccggaagagtgtgttcgaggaggaggtgcgggagacgcggcggcggcacgagcggcgcctggtggaggtggacagcagccggcagcaggagtacgacttcaagatggcacaggcgctggaggagctgcggagccagcacgacgagcaagtgcggctctacaagctggagctggagcagacctaccaggccaagctggacagcgccaagctgagctctgaccagaacgacaaggcggccagtgcggctcgcgaggagctgaaggaggcccgcatgcgcctggagtccctcagctaccagctctccggcctccagaagcaggccagtgccgctgaagatcgcattcgggagctggaggaggccatggccggggagcgggacaagttccggaagatgctggacgccaaggagcaggagatgacggagatgcgggacgtgatgcagcagcagctggccgagtaccaggagctgctggacgtgaagctggccctggacatggagatcaacgcctaccggaagctcctggagggcgaggaggagaggctgaagctgtcccccagcccatcctcgcgcgtcaccgtctcacgagccacctcgagcagcagcggcagcttgtccgccaccgggcgcctgggccgcagtaagcggaagcggctggaggtggaggagcccttgggcagcggcccaagcgtcctgggcacgggcacgggtggcagcggtggcttccacctggcccagcaggcctcggcctcgggtagcgtcagcatcgaggagatcgacctggagggcaagtttgtgcagctcaagaacaactcggacaaggatcagtctctggggaactggagaatcaagaggcaggtcttggagggggaggagatcgcctacaagttcacgcccaagtacatcctgcgcgccggccagatggtcacggtgtgggcagctggtgcgggggtggcccacagccccccctcgacgctggtgtggaagggccagagcagctggggcacgggcgagagcttccgcaccgtcctggttaacgcggatggcgaggaagtggccatgaggactgtgaagaagtcctcggtgatgcgtgagaatgagaatggggaggaagaggaggaggaagccgagtttggcgaggaggatcttttccaccaacagggggacccgaggaccacctcaagaggctgctacgtgatgtgaacccacactcctcatccacacacctttctttacccagagccactgaaaactatttttatatcattggctttctttagttcttgatacatttctagagaatttctaagcgaactgccagaacgtgtgggtgggtctcccccagccctccctcctggcgggtctcctccagcctcacttcgctgccacttcgccgctgccccggagacttttcaatcccaccccactcctcatctcaccatttggtcaaattggaagcccagggccaggacccggaggtttagaagatgcttgggcttggagggaggaggtcctggggcgtcgccgcctgcagcctcttccaagccctgcgtccagcgagcgtcacagcacaacctgcaaaaacggagctgggctgcagctggggctggcatggactttcatttcagagattcggtttttaagaagatgcatgcctaatgtgttcttttttttttccaatgatttgtaatatacattttatgactggaaacttttttgtacaacactccaataaacattttgatttta

SEQ ID NO: 417846 - DNA, 2235 bp, Homo sapiens
catcttgcagccggcggcgcggattgaatgagcccgccgagcccgggccgccgtcgggagcagcgcaggccgcgagccgccgccaccatggccacgccgctgcccggccgcgcgggcgggcccgccacgccgctgtcgcccacgcgcctgtcgcggctgcaggagaaggaggagctgcgcgagctcaacgaccgcctggcgcactacatcgaccgcgtccgcgcgctggagctggagaacgaccggctcctgctcaagatctcagagaaggaggaggtgaccacgcgcgaggtgagtggcatcaaggcgctgtacgagtcggagctggccgatgcccggagagtcctggatgagacggctcgagagcgtgcccggctgcagatagagattgggaagctgagggcagagttggacgaggtcaacaagagcgccaagaagagggagggcgagcttacggtggcccagggccgtgtgaaggacctggagtccctgttccaccggagcgaggtggagctggcagctgccctcagcgacaagcgcggcctggagagtgacgtggctgagctgcgggcccagctggccaaggccgaggacggtcatgcagtggccaaaaagcagctggagaaggagacgctgatgcgtgtggacctggagaaccgctgccagagcctgcaggaggagctggacttccggaagagtgtgttcgaggaggaggtgcgggagacgcggcggcggcacgagcggcgcctggtggaggtggacagcagccggcagcaggagtacgacttcaagatggcacaggcgctggaggagctgcggagccagcacgacgagcaagtgcggctctacaagctggagctggagcagacctaccaggccaagctggacagcgccaagctgagctctgaccagaacgacaaggcggccagtgcggctcgcgaggagctgaaggaggcccgcatgcgcctggagtccctcagctaccagctctccggcctccagaagcaggccagtgccgctgaagatcgcattcgggagctggaggaggccatggccggggagcgggacaagttccggaagatgctggacgccaaggagcaggagatgacggagatgcgggacgtgatgcagcagcagctggccgagtaccaggagctgctggacgtgaagctggccctggacatggagatcaacgcctaccggaagctcctggagggcgaggaggagaggctgaagctgtcccccagcccatcctcgcgcgtcaccgtctcacgagccacctcgagcagcagcggcagcttgtccgccaccgggcgcctgggccgcagtaagcggaagcggctggaggtggaggagcccttgggcagcggcccaagcgtcctgggcacgggcacgggtggcagcggtggcttccacctggcccagcaggcctcggcctcgggtagcgtcagcatcgaggagatcgacctggagggcaagtttgtgcagctcaagaacaactcggacaaggatcagtctctggggaactggagaatcaagaggcaggtcttggagggggaggagatcgcctacaagttcacgcccaagtacatcctgcgcgccggccagatggtcacggtgtgggcagctggtgcgggggtggcccacagccccccctcgacgctggtgtggaagggccagagcagctggggcacgggcgagagcttccgcaccgtcctggttaacgcggatggcgaggaagtggccatgaggactgtgaagaagtcctcggtgatgcgtgagaatgagaatggggaggaagaggaggaggaagccgagtttggcgaggaggatcttttccaccaacagggggacccgaggaccacctcaagaggctgctacgtgatgtgaacccacactcctcatccacacacctttctttacccagagccactgaaaactatttttatatcattggctttctttattctttgttaaagatctgagggactcctcagtcctggggcgtcgccgcctgcagcctcttccaagccctgcgtccagcgagcgtcacagcacaacctgcaaaaacggagctgggctgcagctggggctggcatggactttcatttcagagattcggtttttaagaagatgcatgcctaatgtgttcttttttttttccaatgatttgtaatatacattttatgactggaaacttttttgtacaacactccaataaacattttgatttta

SEQ ID NO: 417847 - DNA, 1880 bp, Homo sapiens
catcttgcagccggcggcgcggattgaatgagcccgccgagcccgggccgccgtcgggagcagcgcaggccgcgagccgccgccaccatggccacgccgctgcccggccgcgcgggcgggcccgccacgccgctgtcgcccacgcgcctgtcgcggctgcaggagaaggaggagctgcgcgagctcaacgaccgcctggcgcactacatcgaccgcgtccgcgcgctggagctggagaacgaccggctcctgctcaagatctcagagaaggaggaggtgaccacgcgcgaggtgagtggcatcaaggcgctgtacgagtcggagctggccgatgcccggagagtcctggatgagacggctcgagagcgtgcccggctgcagatagagattgggaagctgagggcagagttggacgaggtcaacaagagcgccaagaagagggagggcgagcttacggtggcccagggccgtgtgaaggacctggagtccctgttccaccggagcgaggtggagctggcagctgccctcagcgacaagcgcggcctggagagtgacgtggctgagctgcgggcccagctggccaaggccgaggacggtcatgcagtggccaaaaagcagctggagaaggagacgctgatgcgtgtggacctggagaaccgctgccagagcctgcaggaggagctggacttccggaagagtgtgttcgaggaggaggtgcgggagacgcggcggcggcacgagcggcgcctggtggaggtggacagcagccggcagcaggagtacgacttcaagatggcacaggcgctggaggagctgcggagccagcacgacgagcaagtgcggctctacaagctggagctggagcagacctaccaggccaagctggacagcgccaagctgagctctgaccagaacgacaaggcggccagtgcggctcgcgaggagctgaaggaggcccgcatgcgcctggagtccctcagctaccagctctccggcctccagaagcaggccagtgccgctgaagatcgcattcgggagctggaggaggccatggccggggagcgggacaagttccggaagatgctggacgccaaggagcaggagatgacggagatgcgggacgtgatgcagcagcagctggccgagtaccaggagctgctggacgtgaagctggccctggacatggagatcaacgcctaccggaagctcctggagggcgaggaggagaggctgaagctgtcccccagcccatcctcgcgcgtcaccgtctcacgagccacctcgagcagcagcggcagcttgtccgccaccgggcgcctgggccgcagtaagcggaagcggctggaggtggaggagcccttgggcagcggcccaagcgtcctgggcacgggcacgggtggcagcggtggcttccacctggcccagcaggcctcggcctcgggtagcgtcagcatcgaggagatcgacctggagggcaagtttgtgcagctcaagaacaactcggacaaggatcagtctctggggaactggagaatcaagaggcaggtcttggagggggaggagatcgcctacaagttcacgcccaagtacatcctgcgcgccggccagatggtcacggtgtgggcagctggtgcgggggtggcccacagccccccctcgacgctggtgtggaagggccagagcagctggggcacgggcgagagcttccgcaccgtcctggttaacgcggatggcgaggaagtggccatgaggactgtgaagaagtcctcggtgatgcgtgagaatgagaatggggaggaagaggaggaggaagccgagtttggcgaggaggatcttttccaccaacaggtaggacccctgtgcccacttgcggctggggg

SEQ ID NO: 417848 - DNA, 1896 bp, Homo sapiens
tggctaggtagagcctcggcttgaatcggccgaggcgtgcccagccagctccgtctgccctgtgcctatatatacacatgcgtctatccatactgtgcttttatctgtgattttctcgctgaaaccatgtttctcagacaggccaaggccacctgactcctatcacgacgcacccaagcccctcagtccagcttcccaatgcctggcaccccccttcggcaatagctcaccgtttacaccctccctcatagatacacagaagttatttttttaatggatatttatttttttacattggtcagtacacaggtcaggagctcacgccagggccttgaggacaggctgaccctcctccccggggtggcgtggggctggggcaccctccgacggcagagcctccttcagaaagtgcagctcaagtcttaaagacaccaaaactgagccatgggcacgcgccgtctccgggccatggcgttcactgcagggcgggggcggcaccgctcccctgtgactgcatcccgcctccctggggacctgcctgtggcaggaaggaatggggggccccagccccaggccgggaaggagccagcggccgacaaagcagaaacacccgctgctccacgtagcccctgctcgctgtccttgctctcagaagtcccggtcccatgtagatagaggggggcgcatcttaccaaagcatttcctcctggaggctacgccgctgtgctcccagtcaggcggctggtagggagctttgcctgccccggggataccctctgccagccgctggaagtgggaatgctggcgacagactgtgtcctctttcccaccttcatagcaggaatcacccggacccgactggctgggcttcgtgctagcgagggttctgggggtgggtcttggtgatcttgtcctatggggagtctgcagtggtctcagccacatcctatgtattttggctctggaggagcaaagctgtatcctggagttggtctgtgatttgccgacagccttgcaggctgggctcagggacaaagtcccccccaaaacccgcaggtcctcatgtccagacgctgcccagtcctgtcctgaaaacagcacgccccaggcccacagaaccccccaccctacatttgccttgggtggagctgggggtggtcctaggactgcgggtgcccttagctgaagggggtggggagaagcgtggactgggcagcctgtgggtaattggaggttcattgagaattgagtctttggaaacactaagaaaatcaaatttttaaaagttatttatggcctgggaaacaatttgcatttgtccccaaatacgcttagctgtgtgccgcttagaacgatgcgaaaccatccctctgtgtaagcccgtgccgtgtgactcgaagcctagcgccctccctgcgaagcatcagacgccacccagccctggggggaggcccacgcctgctggaccaacgcgggttctggggtgcacagcgccaggttaacgctgaagcctgccccgctgagcccaggagccgggaggcctgcgggctgacccagaatccgatcatgcacctgtcctcatgccagcggctttggctggggttggtctgaagcctgcacgcggcagttctttgttaaagatctgagggactcctcagtcctggggcgtcgccgcctgcagcctcttccaagccctgcgtccagcgagcgtcacagcacaacctgcaaaaacggagctgggctgcagctggggctggcatggactttcatttcagagattcggtttttaagaagatgcatgcctaatgtgttcttttttttttccaatgatttgtaatatacattttatgactggaaacttttttgtacaacactccaataaacattttgatttta

SEQ ID NO: 417849 - DNA, 577 bp, Homo sapiens
aggggcagcggcggcggcgggaagcggagccgggaccgctgctgccagcggagccgggaccgctgccagtgtagcaacttgccagggaccccacccctccctctctgggcctgtgcagtgagcatggggattcccatcaaggggcctggcacctgtgctagttacgtagccgctgctcacgcgctcactcctgaccacatgcacgttccctagatgcagactgctttgaactttaaagctgtacaatttggttatgtttgtgctgacttaaaatatattttaatgaggaaaaaataatggagaaccctgggaaggacctggttcttttgcttctcggggaactgtaagccctcgcgttctgggaatcgctctctgctgctctttcctggaagctaagcctgtctccaccgcccgaggcctgcgccggtggctcccgccgcagttgcgtttgctttggaccttgcgtgcgggggagggggtgctcggtccgagcccgctcctttctgtacacctagcgctgcccgccccgcttgtgtctgaggtcgtgtatgtcaaaaataaagccgctagaaacgga

SEQ ID NO: 417850 - DNA, 4397 bp, Homo sapiens
gccatcttgttgttgatccgtacccagtgggcagcgccgggagctggaccaagcggccggtgagaggccgctgtagcggtgctcagccacctgtgctgcctgccagggggcgggccgaaacctggaggcccggggggcccagctcccgtagcgccggtgggcgctcggtgcccgggccgggcaggacagaataataagctgaatagaatctgaccattggctttcacctggccaggaccttctatgtagctctccttttgtggcccatgtgctgcatcctctgccctcagtgtgcaactggcccccaacgcaatgtgtgtttgtcaaaccatggaagtggggcagtatggcaagaatgcaagtcgggctggagaccggggagtcctcctggagcccttcatccaccaagtaggcggacacagcagcatgatgcgttacgacgatcacactgtgtgcaagcccctcatctcccgggaacagcgcttttacgagtccctccctcccgaaatgaaggagttcacccctgaatacaaaggcgtggtatctgtctgttttgagggggacagtgatggttacatcaacttagtggcctatccttatgtggaaagtgagactgtggaacaggatgacacaacagaacgggagcaacctcggcgcaaacactcccgccggagcctgcaccggtcaggcagtggcagtgaccacaaggaggagaaagccagcctgtcccttgagacctctgagagctcacaggaggcaaagagtccgaaggtggagctgcacagccactcagaggtccctttccagatgctagatggcaacagtggcttgagttctgagaagatcagccacaacccctggagcctgcgttgtcacaagcagcagctgagccgcatgcgctccgagtccaaggaccgaaagctctacaagttcctcctgcttgagaacgtggtgcaccacttcaagtacccctgcgtgttggacctgaagatgggcacgcggcagcatggcgatgacgcgtcagctgagaaggcagcccggcagatgcggaaatgcgagcagagcacatcagccacgctgggcgtcagggtctgcggcatgcaggtgtaccagctggacacagggcattacctctgcaggaacaagtactatggccgtgggctctccattgaaggcttccgcaatgccctctatcaatatctgcacaatggcctggacctgcgacgtgacctgtttgagcctatcctgagcaaactgcggggcctgaaagctgtgctggagcggcaggcctcttaccgcttctactccagttccctgcttgtcatctatgatggcaaggagtgccgggctgagtcctgcctggaccgccggtctgagatgcgtctcaagcacctggacatggtgctccctgaggtggcgtcatcctgtggccccagcaccagccccagcaacaccagccccgaggcgggtccctcctctcagcccaaggtggatgtccgcatgattgactttgcacacagcacattcaagggcttccgggatgaccccaccgtgcatgatgggccagacagaggctacgtgtttggcctggagaacctcatcagcatcatggaacagatgcgggacgagaaccagtaggccctgttctgggcccccagaaccccttcctctccactgcaggcagggaccattgttctgaacttgccgtgaggacacacagacttgcttttaaagggttatatttctctttggtgtaaactaaaagaaatgtttttagctgtagcctggaatccatatatataaagtgaaggagggcagaccacacgccctctcagccaggctcctcagctttgtggctctgactggtgtgtccaggctgccttaggaaggaagaggtgcccctggtgggcttggcagcagggacagggtgcccttggacattggtttctcttgtctagatctttgagatctgtggctgcagggccctgctgattgtaaggtaaagccctgggctggtgcagggcccctccacgcccactcttcccttgttccccagaagtagagggctctgggtgcccatttcttgggggctttccagtcttatgctgtgggtgtcagctagctctttaataggtgccctcagggcaccacagggctgactgcacaaagctggacccatccttcggtctgaccttagcatggggctagattaatgaagctgggctgaggccaacttatggcagagggcggcgcctgggttccccaggcacctgttggcacgtgacaggttggcacctgtcctattcctgaaacagcctctctcaccaagttcccttgcctaagaaggccactccctcccaccccactgaagtgggggatagtcggtgtcctagcaggcctcagggcctctggtggctctggcccagacagtatttgcagttcttgtgctatgggtgggagtcttcttcctcaagtttcggcagctgtgctgctgctggatgggctgctcctcccagggctcaagggctgtggtccgctcagggtctcatttccccaggccaagttcaaggcagcagccctttgtgaggcgctcttggccctgggcctggagggagaactttaagcttttttgctcacagggacgtggtatgggccctgggtgcaggtgcccacattctgctaatgagagctttgtctgatcagtcctgggtccatcagtttgtccatgtgtccggctgccagcccgtcccttgggatccttcccctggggtgtagccttgttcattagtatatactcattccttcatgctttcctcagcagaacacttccacttctgaggtgagcttttgccccgtgcccttcctccacaggtgttgcctttttataaagacctgatagcagaataaattggtgtttccctgttgacccagcaccatttctgtgggcctagaatatggccctcaacccttagagtggggcagtgagggcttgaggagtgacccttcctttctcatggttttagtcattttggctgccagcccttaatggcacagatctgctgcttctaacagatggccaggaggtgacaccgatttcagccattgccaaggttagcaccctctcctttgagcctagggccacactgttcattgtcactttaggcaagtgcctgtttggctttaaaggtaagcctgccagctgtgagaagccttggtaactgatggactcatttcctggtccttaaagatgcagcctcttaagggctccttgatggatgccatctctcctagcccccagccctggtgccactggtgggcaggttcccattctttggggctgggagggacagcttgcctgtttctggtcacaaattacagtcttctctcctgtaccattctgtggcttcagccatgggggcagtagcccttcattagtgtagatagtcattccctggtagggtggagggtaagacatagggtctggaactgtttgggaccttttggggatgtcctgtgcctcccagattcctagattctgggaggagaggctgccgcattctgctgctcctcacagcgagcaaagctgcacccacttacattcagtattttcctggcactacaaagagtgggaaggcctgggatttgctgctgctcccttagagcagggcccctcttttcagcactttggacacctggagacccagccctgttatttaatggtagtgggcaagtgtgtgtgcatactgtctgccactgctttctccctgccccatgccagagagccctgtccctgccaggcccagccttcttagccccaacttgggaacaaagtgcaacatgggatcatgggttggggtgctcaggtgagccctctctatagtgcttccctgggccaagctgacaccagcccctgagggtggggtgggacgggtggtgagtgagcatggggattcccatcaaggggcctggcacctgtgctagttacgtagccgctgctcacgcgctcactcctgaccacatgcacgttccctagatgcagactgctttgaactttaaagctgtacaatttggttatgtttgtgctgacttaaaatatattttaatgaggaaaaaataatggagaaccctgggaaggacctggttcttttgcttctcggggaactgtaagccctcgcgttctgggaatcgctctctgctgctctttcctggaagctaagcctgtctccaccgcccgaggcctgcgccggtggctcccgccgcagttgcgtttgctttggaccttgcgtgcgggggagggggtgctcggtccgagcccgctcctttctgtacacctagcgctgcccgccccgcttgtgtctgaggtcgtgtatgtcaaaaataaagccgctagaaacgga

SEQ ID NO: 417851 - DNA, 631 bp, Homo sapiens
agtgtagcaaacttgccaggaaccccaccccgcccagccttcttagccccaacttgggaacaaagtgcaacatgggatcatgggttggggtgctcaggtgagccctctctatagtgcttccctgggccaagctgacaccagcccctgagggtggggtgggacgggtggtgagtgagcatggggattcccatcaaggggcctggcacctgtgctagttacgtagccgctgctcacgcgctcactcctgaccacatgcacgttccctagatgcagactgctttgaactttaaagctgtacaatttggttatgtttgtgctgacttaaaatatattttaatgaggaaaaaataatggagaaccctgggaaggacctggttcttttgcttctcggggaactgtaagccctcgcgttctgggaatcgctctctgctgctctttcctggaagctaagcctgtctccaccgcccgaggcctgcgccggtggctcccgccgcagttgcgtttgctttggaccttgcgtgcgggggagggggtgctcggtccgagcccgctcctttctgtacacctagcgctgcccgccccgcttgtgtctgaggtcgtgtatgtcaaaaataaagccgctagaaacgga

SEQ ID NO: 417852 - DNA, 407 bp, Homo sapiens
gagatcagctcggcaccattatgtggactcagacgttccctagatgcagactgctttgaactttaaagctgtacaatttggttatgtttgtgctgacttaaaatatattttaatgaggaaaaaataatggagaaccctgggaaggacctggttcttttgcttctcggggaactgtaagccctcgcgttctgggaatcgctctctgctgctctttcctggaagctaagcctgtctccaccgcccgaggcctgcgccggtggctcccgccgcagttgcgtttgctttggaccttgcgtgcgggggagggggtgctcggtccgagcccgctcctttctgtacacctagcgctgcccgccccgcttgtgtctgaggtcgtgtatgtcaaaaataaagccgctagaaacgga

SEQ ID NO: 417853 - DNA, 384 bp, Homo sapiens
atgtttgtgctgacttaaaatatattttaatgaggaaaaaataatggagaaccctgggaaggacctggttcttttgcttctcggggaactgtaagccctcgcgttctgggaatcgctctctgctgctctttcctggaagctaagcctgtctccaccgcccgaggcctgcgccggtggctcccgccgcagttgcgtttgctttggaccttgcgtgcgggggagggggtgctcggtccgagcccgctcctttctgtacacctagcgctgcccgccccgcttgtgtctgaggtcgtgtatgtcaaaaataaagccgctagaaacggaaggcgagtctgtctttgtgaaaatcccgtggcccgggagccttccctggtcaccctcggg

SEQ ID NO: 417854 - DNA, 4466 bp, Homo sapiens
gccatcttgttgttgatccgtacccagtgggcagcgccgggagctggaccaagcggccggtgagaggccgctgtagcggtgctcagccacctgtgctgcctgccagggggcgggccgaaacctggaggcccggggggcccagctcccgtagcgccggtgggcgctcggtgcccgggccgggcaggacagaataataagctgaatagaatctgaccattggctttcacctggccaggaccttctatgtagctctccttttgtggcccatgtgctgcatcctctgccctcagtgtgcaactggcccccaacgcaatgtgtgtttgtcaaaccatggaagtggggcagtatggcaagaatgcaagtcgggctggagaccggggagtcctcctggagcccttcatccaccaagtaggcggacacagcagcatgatgcgttacgacgatcacactgtgtgcaagcccctcatctcccgggaacagcgcttttacgagtccctccctcccgaaatgaaggagttcacccctgaatacaaaggcgtggtatctgtctgttttgagggggacagtgatggttacatcaacttagtggcctatccttatgtggaaagtgagactgtggaacaggatgacacaacagaacgggagcaacctcggcgcaaacactcccgccggagcctgcaccggtcaggcagtggcagtgaccacaaggaggagaaagccagcctgtcccttgagacctctgagagctcacaggaggcaaagagtccgaaggtggagctgcacagccactcagaggtccctttccagatgctagatggcaacagtggcttgagttctgagaagatcagccacaacccctggagcctgcgttgtcacaagcagcagctgagccgcatgcgctccgagtccaaggaccgaaagctctacaagttcctcctgcttgagaacgtggtgcaccacttcaagtacccctgcgtgttggacctgaagatgggcacgcggcagcatggcgatgacgcgtcagctgagaaggcagcccggcagatgcggaaatgcgagcagagcacatcagccacgctgggcgtcagggtctgcggcatgcaggtgtaccagctggacacagggcattacctctgcaggaacaagtactatggccgtgggctctccattgaaggcttccgcaatgccctctatcaatatctgcacaatggcctggacctgcgacgtgacctgtttgagcctatcctgagcaaactgcggggcctgaaagctgtgctggagcggcaggcctcttaccgcttctactccagttccctgcttgtcatctatgatggcaaggagtgccgggctgagtcctgcctggaccgccggtctgagatgcgtctcaagcacctggacatggtgctccctgaggtggcgtcatcctgtggccccagcaccagccccagcaacaccagccccgaggcgggtccctcctctcagcccaaggtggatgtccgcatgattgactttgcacacagcacattcaagggcttccgggatgaccccaccgtgcatgatgggccagacagaggctacgtgtttggcctggagaacctcatcagcatcatggaacagatgcgggacgagaaccagtaggccctgttctgggcccccagaaccccttcctctccactgcaggcagggaccattgttctgaacttgccgtgaggacacacagacttgcttttaaagggttatatttctctttggtgtaaactaaaagaaatgtttttagctgtagcctggaatccatatatataaagtgaaggagggcagaccacacgccctctcagccaggctcctcagctttgtggctctgactggtgtgtccaggctgccttaggaaggaagaggtgcccctggtgggcttggcagcagggacagggtgcccttggacattggtttctcttgtctagatctttgagatctgtggctgcagggccctgctgattgtaaggtaaagccctgggctggtgcagggcccctccacgcccactcttcccttgttccccagaagtagagggctctgggtgcccatttcttgggggctttccagtcttatgctgtgggtgtcagctagctctttaataggtgccctcagggcaccacagggctgactgcacaaagctggacccatccttcggtctgaccttagcatggggctagattaatgaagctgggctgaggccaacttatggcagagggcggcgcctgggttccccaggcacctgttggcacgtgacaggttggcacctgtcctattcctgaaacagcctctctcaccaagttcccttgcctaagaaggccactccctcccaccccactgaagtgggggatagtcggtgtcctagcaggcctcagggcctctggtggctctggcccagacagtatttgcagttcttgtgctatgggtgggagtcttcttcctcaagtttcggcagctgtgctgctgctggatgggctgctcctcccagggctcaagggctgtggtccgctcagggtctcatttccccaggccaagttcaaggcagcagccctttgtgaggcgctcttggccctgggcctggagggagaactttaagcttttttgctcacagggacgtggtatgggccctgggtgcaggtgcccacattctgctaatgagagctttgtctgatcagtcctgggtccatcagtttgtccatgtgtccggctgccagcccgtcccttgggatccttcccctggggtgtagccttgttcattagtatatactcattccttcatgctttcctcagcagaacacttccacttctgaggtgagcttttgccccgtgcccttcctccacaggtgttgcctttttataaagacctgatagcagaataaattggtgtttccctgttgacccagcaccatttctgtgggcctagaatatggccctcaacccttagagtggggcagtgagggcttgaggagtgacccttcctttctcatggttttagtcattttggctgccagcccttaatggcacagatctgctgcttctaacagatggccaggaggtgacaccgatttcagccattgccaaggttagcaccctctcctttgagcctagggccacactgttcattgtcactttaggcaagtgcctgtttggctttaaaggtaagcctgccagctgtgagaagccttggtaactgatggactcatttcctggtccttaaagatgcagcctcttaagggctccttgatggatgccatctctcctagcccccagccctggtgccactggtgggcaggttcccattctttggggctgggagggacagcttgcctgtttctggtcacaaattacagtcttctctcctgtaccattctgtggcttcagccatgggggcagtagcccttcattagtgtagatagtcattccctggtagggtggagggtaagacatagggtctggaactgtttgggaccttttggggatgtcctgtgcctcccagattcctagattctgggaggagaggctgccgcattctgctgctcctcacagcgagcaaagctgcacccacttacattcagtattttcctggcactacaaagagtgggaaggcctgggatttgctgctgctcccttagagcagggcccctcttttcagcactttggacacctggagacccagccctgttatttaatggtagtgggcaagtgtgtgtgcatactgtctgccactgctttctccctgccccatgccagagagccctgtccctgccaggcccagccttcttagccccaacttgggaacaaagtgcaacatgggatcatgggttggggtgctcaggtgagccctctctatagtgcttccctgggccaagctgacaccagcccctgagggtggggtgggacgggtggtgcttaaaagaggaaggggaccagtgtagcaacttgccagggaccccacccctccctctctgggcctgtgcagtgagcatggggattcccatcaaggggcctggcacctgtgctagttacgtagccgctgctcacgcgctcactcctgaccacatgcacgttccctagatgcagactgctttgaactttaaagctgtacaatttggttatgtttgtgctgacttaaaatatattttaatgaggaaaaaataatggagaaccctgggaaggacctggttcttttgcttctcggggaactgtaagccctcgcgttctgggaatcgctctctgctgctctttcctggaagctaagcctgtctccaccgcccgaggcctgcgccggtggctcccgccgcagttgcgtttgctttggaccttgcgtgcgggggagggggtgctcggtccgagcccgctcctttctgtacacctagcgctgcccgccccgcttgtgtctgaggtcgtgtatgtcaaaaataaagccgctagaaacgga

SEQ ID NO: 417855 - DNA, 4432 bp, Homo sapiens
ggctggtacggtcggaatttaggatgtgagaggccgctgtagcggtgctcagccacctgtgctgcctgccagggggcgggccgaaacctggaggcccggggggcccagctcccgtagcgccggtgggcgctcggtgcccgggccgggcaggacagaataataagctgaatagaatctgaccattggctttcacctggccaggaccttctatgtagctctccttttgtggcccatgtgctgcatcctctgccctcagtgtgcaactggcccccaacgcaatgtgtgtttgtcaaaccatggaagtggggcagtatggcaagaatgcaagtcgggctggagaccggggagtcctcctggagcccttcatccaccaagtaggcggacacagcagcatgatgcgttacgacgatcacactgtgtgcaagcccctcatctcccgggaacagcgcttttacgagtccctccctcccgaaatgaaggagttcacccctgaatacaaaggcgtggtatctgtctgttttgagggggacagtgatggttacatcaacttagtggcctatccttatgtggaaagtgagactgtggaacaggatgacacaacagaacgggagcaacctcggcgcaaacactcccgccggagcctgcaccggtcaggcagtggcagtgaccacaaggaggagaaagccagcctgtcccttgagacctctgagagctcacaggaggcaaagagtccgaaggtggagctgcacagccactcagaggtccctttccagatgctagatggcaacagtggcttgagttctgagaagatcagccacaacccctggagcctgcgttgtcacaagcagcagctgagccgcatgcgctccgagtccaaggaccgaaagctctacaagttcctcctgcttgagaacgtggtgcaccacttcaagtacccctgcgtgttggacctgaagatgggcacgcggcagcatggcgatgacgcgtcagctgagaaggcagcccggcagatgcggaaatgcgagcagagcacatcagccacgctgggcgtcagggtctgcggcatgcaggtgtaccagctggacacagggcattacctctgcaggaacaagtactatggccgtgggctctccattgaaggcttccgcaatgccctctatcaatatctgcacaatggcctggacctgcgacgtgacctgtttgagcctatcctgagcaaactgcggggcctgaaagctgtgctggagcggcaggcctcttaccgcttctactccagttccctgcttgtcatctatgatggcaaggagtgccgggctgagtcctgcctggaccgccggtctgagatgcgtctcaagcacctggacatggtgctccctgaggtggcgtcatcctgtggccccagcaccagccccagcaacaccagccccgaggcgggtccctcctctcagcccaaggtggatgtccgcatgattgactttgcacacagcacattcaagggcttccgggatgaccccaccgtgcatgatgggccagacagaggctacgtgtttggcctggagaacctcatcagcatcatggaacagatgcgggacgagaaccagtaggccctgttctgggcccccagaaccccttcctctccactgcaggcagggaccattgttctgaacttgccgtgaggacacacagacttgcttttaaagggttatatttctctttggtgtaaactaaaagaaatgtttttagctgtagcctggaatccatatatataaagtgaaggagggcagaccacacgccctctcagccaggctcctcagctttgtggctctgactggtgtgtccaggctgccttaggaaggaagaggtgcccctggtgggcttggcagcagggacagggtgcccttggacattggtttctcttgtctagatctttgagatctgtggctgcagggccctgctgattgtaaggtaaagccctgggctggtgcagggcccctccacgcccactcttcccttgttccccagaagtagagggctctgggtgcccatttcttgggggctttccagtcttatgctgtgggtgtcagctagctctttaataggtgccctcagggcaccacagggctgactgcacaaagctggacccatccttcggtctgaccttagcatggggctagattaatgaagctgggctgaggccaacttatggcagagggcggcgcctgggttccccaggcacctgttggcacgtgacaggttggcacctgtcctattcctgaaacagcctctctcaccaagttcccttgcctaagaaggccactccctcccaccccactgaagtgggggatagtcggtgtcctagcaggcctcagggcctctggtggctctggcccagacagtatttgcagttcttgtgctatgggtgggagtcttcttcctcaagtttcggcagctgtgctgctgctggatgggctgctcctcccagggctcaagggctgtggtccgctcagggtctcatttccccaggccaagttcaaggcagcagccctttgtgaggcgctcttggccctgggcctggagggagaactttaagcttttttgctcacagggacgtggtatgggccctgggtgcaggtgcccacattctgctaatgagagctttgtctgatcagtcctgggtccatcagtttgtccatgtgtccggctgccagcccgtcccttgggatccttcccctggggtgtagccttgttcattagtatatactcattccttcatgctttcctcagcagaacacttccacttctgaggtgagcttttgccccgtgcccttcctccacaggtgttgcctttttataaagacctgatagcagaataaattggtgtttccctgttgacccagcaccatttctgtgggcctagaatatggccctcaacccttagagtggggcagtgagggcttgaggagtgacccttcctttctcatggttttagtcattttggctgccagcccttaatggcacagatctgctgcttctaacagatggccaggaggtgacaccgatttcagccattgccaaggttagcaccctctcctttgagcctagggccacactgttcattgtcactttaggcaagtgcctgtttggctttaaaggtaagcctgccagctgtgagaagccttggtaactgatggactcatttcctggtccttaaagatgcagcctcttaagggctccttgatggatgccatctctcctagcccccagccctggtgccactggtgggcaggttcccattctttggggctgggagggacagcttgcctgtttctggtcacaaattacagtcttctctcctgtaccattctgtggcttcagccatgggggcagtagcccttcattagtgtagatagtcattccctggtagggtggagggtaagacatagggtctggaactgtttgggaccttttggggatgtcctgtgcctcccagattcctagattctgggaggagaggctgccgcattctgctgctcctcacagcgagcaaagctgcacccacttacattcagtattttcctggcactacaaagagtgggaaggcctgggatttgctgctgctcccttagagcagggcccctcttttcagcactttggacacctggagacccagccctgttatttaatggtagtgggcaagtgtgtgtgcatactgtctgccactgctttctccctgccccatgccagagagccctgtccctgccaggcccagccttcttagccccaacttgggaacaaagtgcaacatgggatcatgggttggggtgctcaggtgagccctctctatagtgcttccctgggccaagctgacaccagcccctgagggtggggtgggacgggtggtgcttaaaagaggaaggggaccagtgtagcaacttgccagggaccccacccctccctctctgggcctgtgcagtgagcatggggattcccatcaaggggcctggcacctgtgctagttacgtagccgctgctcacgcgctcactcctgaccacatgcacgttccctagatgcagactgctttgaactttaaagctgtacaatttggttatgtttgtgctgacttaaaatatattttaatgaggaaaaaataatggagaaccctgggaaggacctggttcttttgcttctcggggaactgtaagccctcgcgttctgggaatcgctctctgctgctctttcctggaagctaagcctgtctccaccgcccgaggcctgcgccggtggctcccgccgcagttgcgtttgctttggaccttgcgtgcgggggagggggtgctcggtccgagcccgctcctttctgtacacctagcgctgcccgccccgcttgtgtctgaggtcgtgtatgtcaaaaataaagccgctagaaacgga

SEQ ID NO: 417856 - DNA, 4115 bp, Homo sapiens
gccatcttgttgttgatccgtacccagtgggcagcgccgggagctggaccaagcggccggtgagaggccgctgtagcggtgctcagccacctgtgctgcctgccagggggcgggccgaaacctggaggcccggggggcccagctcccgtagcgccggtgggcgctcggtgcccgggccgggcaggcgtggtatctgtctgttttgagggggacagtgatggttacatcaacttagtggcctatccttatgtggaaagtgagactgtggaacaggatgacacaacagaacgggagcaacctcggcgcaaacactcccgccggagcctgcaccggtcaggcagtggcagtgaccacaaggaggagaaagccagcctgtcccttgagacctctgagagctcacaggaggcaaagagtccgaaggtggagctgcacagccactcagaggtccctttccagatgctagatggcaacagtggcttgagttctgagaagatcagccacaacccctggagcctgcgttgtcacaagcagcagctgagccgcatgcgctccgagtccaaggaccgaaagctctacaagttcctcctgcttgagaacgtggtgcaccacttcaagtacccctgcgtgttggacctgaagatgggcacgcggcagcatggcgatgacgcgtcagctgagaaggcagcccggcagatgcggaaatgcgagcagagcacatcagccacgctgggcgtcagggtctgcggcatgcaggtgtaccagctggacacagggcattacctctgcaggaacaagtactatggccgtgggctctccattgaaggcttccgcaatgccctctatcaatatctgcacaatggcctggacctgcgacgtgacctgtttgagcctatcctgagcaaactgcggggcctgaaagctgtgctggagcggcaggcctcttaccgcttctactccagttccctgcttgtcatctatgatggcaaggagtgccgggctgagtcctgcctggaccgccggtctgagatgcgtctcaagcacctggacatggtgctccctgaggtggcgtcatcctgtggccccagcaccagccccagcaacaccagccccgaggcgggtccctcctctcagcccaaggtggatgtccgcatgattgactttgcacacagcacattcaagggcttccgggatgaccccaccgtgcatgatgggccagacagaggctacgtgtttggcctggagaacctcatcagcatcatggaacagatgcgggacgagaaccagtaggccctgttctgggcccccagaaccccttcctctccactgcaggcagggaccattgttctgaacttgccgtgaggacacacagacttgcttttaaagggttatatttctctttggtgtaaactaaaagaaatgtttttagctgtagcctggaatccatatatataaagtgaaggagggcagaccacacgccctctcagccaggctcctcagctttgtggctctgactggtgtgtccaggctgccttaggaaggaagaggtgcccctggtgggcttggcagcagggacagggtgcccttggacattggtttctcttgtctagatctttgagatctgtggctgcagggccctgctgattgtaaggtaaagccctgggctggtgcagggcccctccacgcccactcttcccttgttccccagaagtagagggctctgggtgcccatttcttgggggctttccagtcttatgctgtgggtgtcagctagctctttaataggtgccctcagggcaccacagggctgactgcacaaagctggacccatccttcggtctgaccttagcatggggctagattaatgaagctgggctgaggccaacttatggcagagggcggcgcctgggttccccaggcacctgttggcacgtgacaggttggcacctgtcctattcctgaaacagcctctctcaccaagttcccttgcctaagaaggccactccctcccaccccactgaagtgggggatagtcggtgtcctagcaggcctcagggcctctggtggctctggcccagacagtatttgcagttcttgtgctatgggtgggagtcttcttcctcaagtttcggcagctgtgctgctgctggatgggctgctcctcccagggctcaagggctgtggtccgctcagggtctcatttccccaggccaagttcaaggcagcagccctttgtgaggcgctcttggccctgggcctggagggagaactttaagcttttttgctcacagggacgtggtatgggccctgggtgcaggtgcccacattctgctaatgagagctttgtctgatcagtcctgggtccatcagtttgtccatgtgtccggctgccagcccgtcccttgggatccttcccctggggtgtagccttgttcattagtatatactcattccttcatgctttcctcagcagaacacttccacttctgaggtgagcttttgccccgtgcccttcctccacaggtgttgcctttttataaagacctgatagcagaataaattggtgtttccctgttgacccagcaccatttctgtgggcctagaatatggccctcaacccttagagtggggcagtgagggcttgaggagtgacccttcctttctcatggttttagtcattttggctgccagcccttaatggcacagatctgctgcttctaacagatggccaggaggtgacaccgatttcagccattgccaaggttagcaccctctcctttgagcctagggccacactgttcattgtcactttaggcaagtgcctgtttggctttaaaggtaagcctgccagctgtgagaagccttggtaactgatggactcatttcctggtccttaaagatgcagcctcttaagggctccttgatggatgccatctctcctagcccccagccctggtgccactggtgggcaggttcccattctttggggctgggagggacagcttgcctgtttctggtcacaaattacagtcttctctcctgtaccattctgtggcttcagccatgggggcagtagcccttcattagtgtagatagtcattccctggtagggtggagggtaagacatagggtctggaactgtttgggaccttttggggatgtcctgtgcctcccagattcctagattctgggaggagaggctgccgcattctgctgctcctcacagcgagcaaagctgcacccacttacattcagtattttcctggcactacaaagagtgggaaggcctgggatttgctgctgctcccttagagcagggcccctcttttcagcactttggacacctggagacccagccctgttatttaatggtagtgggcaagtgtgtgtgcatactgtctgccactgctttctccctgccccatgccagagagccctgtccctgccaggcccagccttcttagccccaacttgggaacaaagtgcaacatgggatcatgggttggggtgctcaggtgagccctctctatagtgcttccctgggccaagctgacaccagcccctgagggtggggtgggacgggtggtgcttaaaagaggaaggggaccagtgtagcaacttgccagggaccccacccctccctctctgggcctgtgcagtgagcatggggattcccatcaaggggcctggcacctgtgctagttacgtagccgctgctcacgcgctcactcctgaccacatgcacgttccctagatgcagactgctttgaactttaaagctgtacaatttggttatgtttgtgctgacttaaaatatattttaatgaggaaaaaataatggagaaccctgggaaggacctggttcttttgcttctcggggaactgtaagccctcgcgttctgggaatcgctctctgctgctctttcctggaagctaagcctgtctccaccgcccgaggcctgcgccggtggctcccgccgcagttgcgtttgctttggaccttgcgtgcgggggagggggtgctcggtccgagcccgctcctttctgtacacctagcgctgcccgccccgcttgtgtctgaggtcgtgtatgtcaaaaataaagccgctagaaacgga

SEQ ID NO: 417857 - DNA, 4532 bp, Homo sapiens
gccatcttgttgttgatccgtacccagtgggcagcgccgggagctggaccaagcggccggtgagaggccgctgtagcggtgctcagccacctgtgctgcctgccagggggcgggccgaaacctggaggcccggggggcccagctcccgtagcgccggtgggcgctcggtgcccgggccgggcaggacagaataataagctgaatagaatctgaccattggctttcacctggccaggaccttctatgtagctctccttttgtggcccatgtgctgcatcctctgccctcagtgtgcaactggcccccaacgcaatgtgtgtttgtcaaaccatggaagtggggcagtatggcaagaatgcaagtcgggctggagaccggggagtcctcctggagcccttcatccaccaagtaggcggacacagcagcatgatgcgttacgacgatcacactgtgtgcaagcccctcatctcccgggaacagcgcttttacgagtccctccctcccgaaatgaaggagttcacccctgaatacaaaggcgtggtatctgtctgttttgagggggacagtgatggttacatcaacttagtggcctatccttatgtggaaagtgagactgtggaacaggatgacacaacagaacgggagcaacctcggcgcaaacactcccgccggagcctgcaccggtcaggcagtggcagtgaccacaaggaggagaaagccagcctgtcccttgagacctctgagagctcacaggaggcaaagagtccgaaggtggagctgcacagccactcagaggtccctttccagatgctagatggcaacagtggcttgagttctgagaagatcagccacaacccctggagcctgcgttgtcacaagcagcagctgagccgcatgcgctccgagtccaaggaccgaaagctctacaagttcctcctgcttgagaacgtggtgcaccacttcaagtacccctgcgtgttggacctgaagatgggcacgcggcagcatggcgatgacgcgtcagctgagaaggcagcccggcagatgcggaaatgcgagcagagcacatcagccacgctgggcgtcagggtctgcggcatgcaggtgtaccagctggacacagggcattacctctgcaggaacaagtactatggccgtgggctctccattgaaggcttccgcaatgccctctatcaatatctgcacaatggcctggacctgcgacgtgacctgtttgagcctatcctgagcaaactgcggggcctgaaagctgtgctggagcggcaggcctcttaccgcttctactccagttccctgcttgtcatctatgatggcaaggagtgccgggctgagtcctgcctggaccgccggtctgagatgcgtctcaagcacctggacatggtgctccctgaggtggcgtcatcctgtggccccagcaccagccccagcaacaccagccccgaggcgggtccctcctctcagcccaaggtggatgtccgcatgattgactttgcacacagcacattcaagggcttccgggatgaccccaccgtgcatgatgggccagacagaggctacgtgtttggcctggagaacctcatcagcatcatggaacagatgcgggacgagaaccagtaggccctgttctgggcccccagaaccccttcctctccactgcaggcagggaccattgttctgaacttgccgtgaggacacacagacttgcttttaaagggttatatttctctttggtgtaaactaaaagaaatgtttttagctgtagcctggaatccatatatataaagtgaaggagggcagaccacacgccctctcagccaggctcctcagctttgtggctctgactggtgtgtccaggctgccttaggaaggaagaggtgcccctggtgggcttggcagcagggacagggtgcccttggacattggtttctcttgtctagatctttgagatctgtggctgcagggccctgctgattgtaaggtaaagccctgggctggtgcagggcccctccacgcccactcttcccttgttccccagaagtagagggctctgggtgcccatttcttgggggctttccagtcttatgctgtgggtgtcagctagctctttaataggtgccctcagggcaccacagggctgactgcacaaagctggacccatccttcggtctgaccttagcatggggctagattaatgaagctgggctgaggccaacttatggcagagggcggcgcctgggttccccaggcacctgttggcacgtgacaggttggcacctgtcctattcctgaaacagcctctctcaccaagttcccttgcctaagaaggccactccctcccaccccactgaagtgggggatagtcggtgtcctagcaggcctcagggcctctggtggctctggcccagacagtatttgcagttcttgtgctatgggtgggagtcttcttcctcaagtttcggcagctgtgctgctgctggatgggctgctcctcccagggctcaagggctgtggtccgctcagggtctcatttccccaggccaagttcaaggcagcagccctttgtgaggcgctcttggccctgggcctggagggagaactttaagcttttttgctcacagggacgtggtatgggccctgggtgcaggtgcccacattctgctaatgagagctttgtctgatcagtcctgggtccatcagtttgtccatgtgtccggctgccagcccgtcccttgggatccttcccctggggtgtagccttgttcattagtatatactcattccttcatgctttcctcagcagaacacttccacttctgaggtgagcttttgccccgtgcccttcctccacaggtgttgcctttttataaagacctgatagcagaataaattggtgtttccctgttgacccagcaccatttctgtgggcctagaatatggccctcaacccttagagtggggcagtgagggcttgaggagtgacccttcctttctcatggttttagtcattttggctgccagcccttaatggcacagatctgctgcttctaacagatggccaggaggtgacaccgatttcagccattgccaaggttagcaccctctcctttgagcctagggccacactgttcattgtcactttaggcaagtgcctgtttggctttaaaggtaagcctgccagctgtgagaagccttggtaactgatggactcatttcctggtccttaaagatgcagcctcttaagggctccttgatggatgccatctctcctagcccccagccctggtgccactggtgggcaggttcccattctttggggctgggagggacagcttgcctgtttctggtcacaaattacagtcttctctcctgtaccattctgtggcttcagccatgggggcagtagcccttcattagtgtagatagtcattccctggtagggtggagggtaagacatagggtctggaactgtttgggaccttttggggatgtcctgtgcctcccagattcctagattctgggaggagaggctgccgcattctgctgctcctcacagcgagcaaagctgcacccacttacattcagtattttcctggcactacaaagagtgggaaggcctgggatttgctgctgctcccttagagcagggcccctcttttcagcactttggacacctggagacccagccctgttatttaatggtagtgggcaagtgtgtgtgcatactgtctgccactgctttctccctgccccatgccagagagccctgtccctgccaggcccagccttcttagccccaacttgggaacaaagtgcaacatgggatcatgggttggggtgctcaggtgagccctctctatagtgcttccctgggccaagctgacaccagcccctgagggtggggtgggacgggtggtgcttaaaagaggaaggggaccagtgtagcaacttgccagggaccccacccctccctctctgggcctgtgcagtgagcatggggattcccatcaaggggcctggcacctgtgctagttacgtagccgctgctcacgcgctcactcctgaccacatgcacgttccctagatgcagactgctttgaactttaaagctgtacaatttggttatgtttgtgctgacttaaaatatattttaatgaggaaaaaataatggagaaccctgggaaggacctggttcttttgcttctcggggaactgtaagccctcgcgttctgggaatcgctctctgctgctctttcctggaagctaagcctgtctccaccgcccgaggcctgcgccggtggctcccgccgcagttgcgtttgctttggaccttgcgtgcgggggagggggtgctcggtccgagcccgctcctttctgtacacctagcgctgcccgccccgcttgtgtctgaggtcgtgtatgtcaaaaataaagccgctagaaacggaaaacaacaacacatcacaaaacacaaacacaaaacaacaaacgcatcaactgcacagacacgcggg

SEQ ID NO: 417858 - DNA, 4454 bp, Homo sapiens
gccatcttgttgttgatccgtacccagtgggcagcgccgggagctggaccaagcggccggtgagaggccgctgtagcggtgctcagccacctgtgctgcctgccagggggcgggccgaaacctggaggcccggggggcccagctcccgtagcgccggtgggcgctcggtgcccgggccgggcaggacagaataataagctgaatagaatctgaccattggctttcacctggccaggaccttctatgtagctctccttttgtggcccatgtgctgcatcctctgccctcagtgtgcaactggcccccaacgcaatgtgtgtttgtcaaaccatggaagtggggcagtatggcaagaatgcaagtcgggctggagaccggggagtcctcctggagcccttcatccaccaagtaggcggacacagcagcatgatgcgttacgacgatcacactgtgtgcaagcccctcatctcccgggaacagcgcttttacgagtccctccctcccgaaatgaaggagttcacccctgaatacaaaggcgtggtatctgtctgttttgagggggacagtgatggttacatcaacttagtggcctatccttatgtggaaagtgagactgtggaacaggatgacacaacagaacgggagcaacctcggcgcaaacactcccgccggagcctgcaccggtcaggcagtggcagtgaccacaaggaggagaaagccagcctgtcccttgagacctctgagagctcacaggaggcaaagagtccgaaggtggagctgcacagccactcagaggtccctttccagatgctagatggcaacagtggcttgagttctgagaagatcagccacaacccctggagcctgcgttgtcacaagcagcagctgagccgcatgcgctccgagtccaaggaccgaaagctctacaagttcctcctgcttgagaacgtggtgcaccacttcaagtacccctgcgtgttggacctgaagatgggcacgcggcagcatggcgatgacgcgtcagctgagaaggcagcccggcagatgcggaaatgcgagcagagcacatcagccacgctgggcgtcagggtctgcggcatgcaggtgtaccagctggacacagggcattacctctgcaggaacaagtactatggccgtgggctctccattgaaggcttccgcaatgccctctatcaatatctgcacaatggcctggacctgcgacgtgacctgtttgagcctatcctgagcaaactgcggggcctgaaagctgtgctggagcggcaggcctcttaccgcttctactccagttccctgcttgtcatctatgatggcaaggagtgccgggctgagtcctgcctggaccgccggtctgagatgcgtctcaagcacctggacatggtgctccctgaggtggcgtcatcctgtggccccagcaccagccccagcaacaccagccccgaggcgggtccctcctctcagcccaaggtggatgtccgcatgattgactttgcacacagcacattcaagggcttccgggatgaccccaccgtgcatgatgggccagacagaggctacgtgtttggcctggagaacctcatcagcatcatggaacagatgcgggacgagaaccagtaggccctgttctgggcccccagaaccccttcctctccactgcaggcagggaccattgttctgaacttgccgtgaggacacacagacttgcttttaaagggttatatttctctttggtgtaaactaaaagaaatgtttttagctgtagcctggaatccatatatataaagtgaaggagggcagaccacacgccctctcagccaggctcctcagctttgtggctctgactggtgtgtccaggctgccttaggaaggaagaggtgcccctggtgggcttggcagcagggacagggtgcccttggacattggtttctcttgtctagatctttgagatctgtggctgcagggccctgctgattgtaaggtaaagccctgggctggtgcagggcccctccacgcccactcttcccttgttccccagaagtagagggctctgggtgcccatttcttgggggctttccagtcttatgctgtgggtgtcagctagctctttaataggtgccctcagggcaccacagggctgactgcacaaagctggacccatccttcggtctgaccttagcatggggctagattaatgaagctgggctgaggccaacttatggcagagggcggcgcctgggttccccaggcacctgttggcacgtgacaggttggcacctgtcctattcctgaaacagcctctctcaccaagttcccttgcctaagaaggccactccctcccaccccactgaagtgggggatagtcggtgtcctagcaggcctcagggcctctggtggctctggcccagacagtatttgcagttcttgtgctatgggtgggagtcttcttcctcaagtttcggcagctgtgctgctgctggatgggctgctcctcccagggctcaagggctgtggtccgctcagggtctcatttccccaggccaagttcaaggcagcagccctttgtgaggcgctcttggccctgggcctggagggagaactttaagcttttttgctcacagggacgtggtatgggccctgggtgcaggtgcccacattctgctaatgagagctttgtctgatcagtcctgggtccatcagtttgtccatgtgtccggctgccagcccgtcccttgggatccttcccctggggtgtagccttgttcattagtatatactcattccttcatgctttcctcagcagaacacttccacttctgaggtgagcttttgccccgtgcccttcctccacaggtgttgcctttttataaagacctgatagcagaataaattggtgtttccctgttgacccagcaccatttctgtgggcctagaatatggccctcaacccttagagtggggcagtgagggcttgaggagtgacccttcctttctcatggttttagtcattttggctgccagcccttaatggcacagatctgctgcttctaacagatggccaggaggtgacaccgatttcagccattgccaaggttagcaccctctcctttgagcctagggccacactgttcattgtcactttaggcaagtgcctgtttggctttaaaggtaagcctgccagctgtgagaagccttggtaactgatggactcatttcctggtccttaaagatgcagcctcttaagggctccttgatggatgccatctctcctagcccccagccctggtgccactggtgggcaggttcccattctttggggctgggagggacagcttgcctgtttctggtcacaaattacagtcttctctcctgtaccattctgtggcttcagccatgggggcagtagcccttcattagtgtagatagtcattccctggtagggtggagggtaagacatagggtctggaactgtttgggaccttttggggatgtcctgtgcctcccagattcctagattctgggaggagaggctgccgcattctgctgctcctcacagcgagcaaagctgcacccacttacattcagtattttcctggcactacaaagagtgggaaggcctgggatttgctgctgctcccttagagcagggcccctcttttcagcactttggacacctggagacccagccctgttatttaatggtagtgggcaagtgtgtgtgcatactgtctgccactgctttctccctgccccatgccagagagccctgtccctgccaggcccagccttcttagccccaacttgggaacaaagtgcaacatgggatcatgggttggggtgctcaggtgagccctctctatagtgcttccctgggccaagctgacaccagcccctgagggtggggtgggacgggtggtgcttaaaagaggaaggggaccagtgtagcaacttgccagggaccccacccctccctctctgggcctgtgcagtgagcatggggattcccatcaaggggcctggcacctgtgctagttacgtagccgctgctcacgcgctcactcctgaccacatgcacgttccctagatgcagactgctttgaactttaaagctgtacaatttggttatgtttgtgctgacttaaaatatattttaatgaggaaaaaataatggagaaccctgggaaggacctggttcttttgcttctcggggaactgtaagccctcgcgttctgggaatcgctctctgctgctctttcctggaagctaagcctgtctccaccgcccgaggcctgcgccggtggctcccgccgcagttgcgtttgctttggaccttgcgtgcgggggagggggtgctcggtccgagcccgctcctttctgtacacctagcgctgcccgccccgctgcagatgaggtggtaagtcaggcgagctcgatgt

SEQ ID NO: 417859 - DNA, 1613 bp, Homo sapiens
ttaataatgactagagaatctgagaggcgtcatccctcaagtgtatcacttagttcaagagtcctggaatcttttcacatccactatgaacacctctcacctcctggccttgctgctcccaaaatctccacaaggtgaaaacagaagcaaacccctgggcaccccatacaacttctctgaacattgccaggattccgtggacgtgatggtcttcatcgtcacttcctacagcattgagactgtcgtgggggtcctgggtaacctctgcctgatgtgtgtgactgtgaggcagaaggagaaagccaacgtgaccaacctgcttatcgccaacctggccttctctgacttcctcatgtgcctcctctgccagccgctgaccgccgtctacaccatcatggactactggatctttggagagaccctctgcaagatgtcggccttcatccagtgcatgtcggtgacggtctccatcctctcgctcgtcctcgtggccctggagaggcatcagctcatcatcaacccaacaggctggaagcccagcatctcacaggcctacctggggattgtgctcatctgggtcattgcctgtgtcctctccctgcccttcctggccaacagcatcctggagaatgtcttccacaagaaccactccaaggctctggagttcctggcggataaggtggtctgtaccgagtcctggccactggctcaccaccgcaccatctacaccaccttcctgctcctcttccagtactgcctcccactgggcttcatcctggtctgttatgcacgcatctaccggcgcctgcagaggcaggggcgcgtgtttcacaagggcacctacagcttgcgagctgggcacatgaagcaggtcaatgtggtgctggtggtgatggtggtggcctttgccgtgctctggctgcctctgcatgtgttcaacagcctggaagactggcaccatgaggccatccccatctgccacgggaacctcatcttcttagtgtgccacttgcttgccatggcctccacctgcgtcaacccattcatctatggctttctcaacaccaacttcaagaaggagatcaaggccctggtgctgacttgccagcagagcgcccccctggaggagtcggagcatctgcccctgtccacagtacatacggaagtctccaaagggtccctgaggctaagtggcaggtccaatcccatttaaccaggtctaggtcttctccctgccatgtcccttgccaggctcttccacttagctaagtgggcacactgcaagctggggtggcaccccagcattcctggctttctggggtccagataggctggcaagagctgtttttgcatccatttgcatcgtgaagactggcattttgatacttcagctgtttgttcctgggagaattctgagcacagattccagaggtcacagtaagccttgcagcttgagctgaaagatgccagagccggagatgtctgctggcagcaggcagggttcattctggtgacacagcaacagatgcctggcctgggaacccagggatttcacctccaccagtgagaccacggggccactgtggggtgagggaaggagcgcttggagtcag

SEQ ID NO: 417860 - DNA, 1199 bp, Homo sapiens
gcagcagcggcggcgggcatggcagaggcgcgatcccagccctcggcggggccgcagctcaacgcgctaccggaccactctccgttgctgcagccgggcctggcggcgctgcggcgccgggcccgggaagctggcgtcccgctcgcgccgctgccgctcaccgactccttcctgctgcggttcctgcgcgcccgggatttcgatctggacctggcctggcggttactaaaaaactattataagtggagagcagaatgtccagaaataagtgcagatctacaccctagaagtattattggcctcctaaaggctggctaccatggagtcctgagatccagggatcccactggcagcaaagttcttatttacagaatcgcacactgggaccccaaagtttttacagcttatgacgtatttcgagtaagtctaatcacatccgagcttattgtacaggaggtagaaactcagcggaatggaatcaaggctatctttgatctggaaggttggcagttttctcatgcttttcaaatcactccatccgtagccaagaagattgctgctgtacttacggattcatttccattgaaagttcgtggcatccatttgataaatgaaccagtaattttccatgctgtcttttccatgatcaaaccattcctgactgaaaaaattaaggaacggattcacatgcatgggaacaactacaaacaaagcttgcttcagcatttcccagacattcttcctctggaatatggtggtgaagaattctccatggaggacatttgtcaggaatggacaaattttataatgaagtctgaagattatctcagcagcatttctgagagcattcaatgagaagttatgtcatgtgaatggcttcctaactaaaaatacatgagtgatatccaacctggttaaatgaatgaaagaaaaggagcaaatcttttaaactaatgcttgcctgaactttaaaaatgtagaaatcttctgacatgagcaacacaggtgtttggaaagattttttactttttaaatgcttttttctctacttttgaagtaattaaatgtcagtacattttaagagcataaaaatcggcgattttgtacttgaagagaacatgaaagttattgctaaagtagctgctcatgtgcatctttgtatgtttctagaaagttatattttaaacaagttctctgat

SEQ ID NO: 417861 - DNA, 468 bp, Homo sapiens
ttacttatttattgtgtttattatttattgcctgcccttcactgctagaatgtaagcctcatgagagcagggaactttctgtgtcttgtttgctgctttagcccctgtgcctaaaatagtgcctgccctgtagtagccagtcaatacttgttaagtgattgaaaggtttgcttatgtactccccttttttaaaactgtctatttgaagggctctctcgagaggtgatttcacacccaatctatttacagattgataaaacaagttttatataggtactaggtcttttgagctgagggagtgtgaagatttgcgggtatgtactagatagattgttgagtcagtgattcagggataaactgaaaatatcagggttcttggcaagatatcagttaacgaaatctaagaataggtttgtctttagagggaattttattgataaaatgactttccatgttaccaacatacat

SEQ ID NO: 417862 - DNA, 477 bp, Homo sapiens
cctcttcacttttgttttcaaacactagcaaatagttttgttttagtagctctgttttttccacttatcatttcaatgcacattgatatatctggaaccacgatagagttttacagagctccactgagctatagattcatgattcacattcattattgaagaaaattatagatgggtatgtcatgggcttcatgagtaatcaaaatggagaatgttaaatctgtgaaagtcaagggcgcaaagtatatattttctgttatatgtgtttgccttggtgaaatacacaaaaaaaattttagtagggcccctactatgctcattctgttttgtcatttatggaattttcacagagaaagcatgtgtctaaaaaacaaaaacaaaacaaaaaataccaccaccatcaccacacacacacacacacacacacacacacacacacacacatttatggaattttcacagagaaagcatgtgtct

SEQ ID NO: 417863 - DNA, 413 bp, Homo sapiens
cacatttctggactggtgcacaggtatgtctcattttcctgattcatgaactgtgccatctaccctgtatgggtacctaggaatattaaatgagttctaaatctcccaggcaagcatttattttgattattttgtctgttctaccatgtttagtcttgctcttcatttgttttactaacctttccttagaattttctctcctaaagtactgaattaagccctggattttcctaaatggagtctgtagccattgagatacctgaggctgtgatgggtggaaaggccttacaggacaatgagactagaaagaagagagaaggatacagaactcacaggccccaatctccaggggtttgcagtcctggttggataatggagcaatctcagcaagtgttttgaataaaaatatgaat

SEQ ID NO: 417864 - DNA, 618 bp, Homo sapiens
cagtcacgggccagcctttcccttaaggatgtctgagagctggtctcctcactcttttcttccgcctattaaactttccgcttcttaactcacccatgtgtgtccatgtcgttaatcatcttgacgagagatgatgaaccccggatatttaccccagacagtgatgccgcttcaccagcattgcactctacttccccgcttcctgatcctgcctcagcttctcctctccacagagaagaaaaaattctgcctaaagtctgcaacatcgtttcctgcctgagtttcagcctgccagcttctcctacggattctggacttgccagccccacaatcatactgcaattgagccatccaaggatacaatcatagcaatcaaaaagagtgactggaggaagaaggaaatgaacatagaagaggaaaaaaaagaaatcttgattttccctcatgctatagaagggaatggtgctgttatatttttggcctatccagaaaaccaattatgaaaataaacataaatggttttctgcctcatggtttagaagcacctctgtgtgtttgctcactgaattgttgtgatgttttgctctccatgatttggaagccaaaccaataaagcaa

SEQ ID NO: 417865 - DNA, 670 bp, Homo sapiens
actcaactccgcgactctccgggtcttttactcatcgttaatatacgtctaataaagacctttataagcgctccacagaaggcgacataggttcttgatcccccccgcgaagatacgtgatataataacgcgcccatgcgtgtgtttccttttatcaattaaaatgaaaaacaagtcaagggggggaaaacactcaggtttttgaacttaagctgcgagtgccttttttaattttcccccgcttcgagttccttcttaggtatggggatctcagcagtttcatttcagtggccacagcttgggaaacagacttctcccaatatcaaagggaatcaagtccccctttttttctccaggcctcggtctgcagcatctgtgatgcatcagactgcaattgagccatccaaggatacaatcatagcaatcaaaaagagtgactggaggaagaaggaaatgaacatagaagaggaaaaaaaagaaatcttgattttccctcatgctatagaagggaatggtgctgttatatttttggcctatccagaaaaccaattatgaaaataaacataaatggttttctgcctcatggtttagaagcacctctgtgtgtttgctcactgaattgttgtgatgttttgctctccatgatttggaagccaaaccaataaagcaa

SEQ ID NO: 417866 - DNA, 337 bp, Homo sapiens
ttcatagcagcagtgtatgaggattccagtttctccatccgtattcttgccaacacctgtttttatccatcttttttgttataggcatcgtcacaggtgtgaagtggtatctcattgtggatttgatttcgattttgcagatggctgatgatgtcaagcaatccttgatgtgcttattggccatttgtatatctccttaaaagaactgtctattcaaatcctttgctaatttttaaaagtgagttatttacccttctattattgagttgtaataattctttacatattctaggtacgagtcccttgtaacagtggtcgccaacatttttgacaccag

SEQ ID NO: 417867 - DNA, 1102 bp, Homo sapiens
cagtcacgggccagcctttcccttaaggatgtctgagagctggtctcctcactcttttcttccgcctattaaactttccgcttcttaactcacccatgtgtgtccatgtcgttaatcatcttgacgagagatgatgaaccccggatatttaccccagacagtgatgccgcttcaccagcattgcactctacttccccgcttcctgatcctgcctcagcttctcctctccacagagaagaaaaaattctgcctaaagtctgcaacatcgtttcctgcctgagtttcagcctgccagcttctcctacggattctggacttgccagccccacaatcataaccagagaggggcagcaattttgggcaaaatgtctgatttggaaataccaactttacctccatgggctccacaagaaatcagatgggagaagggacaagcagataagcgcaagcccatcaacctgaaggcataaaccacatccagccacctccttctgatcagcagcaaagctgacgttttgatctccatctgtctgattcttgtgtctacttctcagtttacaactccagtgggaaagaaagagctttatttacagacccataaaaatcccatcagtgtcgtcccctgctgagaggccatgtgagaccatatggaaaaacaacagccataatggcagcatggcagtggaagggtttgtcttgtgcccaggccttgcggtcatgcaagtttcttgtggatcctgttgggaccagccactcaccaaggctgagtaggtccacaaataatggggactttctaccagactcacagagaactgctgggtttttgggaagggtgtgcgtgtctttggggcatggaagttggggttatagtggagacccagaggatgagaaaacttctctgcctcagcagaagagtggcagctgagagagaggcaagaaactcgcacccactgtggactggggcagagagattttgaggagaatgaaatccagaaactctgtgtggtattagtttgtatccagagggtgaccctcttctcaaggaaatgggtgtcatcaattttctacactattaaagatataaagttcttggcattactac

SEQ ID NO: 417868 - DNA, 758 bp, Homo sapiens
ttttgagatggagtcttgccctgtcacccagacacgatctcagctcactgcaacctctgccttctgggttcaagctgttctcctgcctcagcctactgagtagctgggactacagttttcaccatttcatgcttctgtgctggcctcttgctcgtatgattttactgtaagattctggaacttttcaaagcctgactctcttcttgaaacagtggagcatcatacagagtttacttgtggtttagacttcagtcttcagagccccactcaggtggctgactgttcttgggatgaaacaataaagatctatgaccctgcttgtcttactattcctgcttgagatacactactttggtcagaaacagaggatgttggctgaagaactgcctaacagcaaataaattaactatggaaaacatagacattatgcttttatatgctattcagatttcaaatctttccaatttaccctggaatcagttttgagggagctgataaagactttagctgactcgttaagcctgatacataagccatatttaaaattctaagaaataattaatgttatgatatatcttgtagtatctattaaaatgtctctgggtcataaaatggattaaaatatgggagatcagtaggttatacttatatagatagtgatatatttcatttttaatttgtcatttttgatgtaaaatataatcactgctgtgataaataaactatctattgatcatttatcattttaaaaaaaaaaa

SEQ ID NO: 417869 - DNA, 1144 bp, Homo sapiens
cggtctgcctggtctctctaaccgcgccagtgtgcctccgactcggaacggcttccgcggccggggcagcgagggccgggggcggcgggcgggatgagtgcggtgtgcggtggagcggcgcggatgctgcggacgccgggacgccacggctacgccgccgagttctccccgtacctgccgggccgcctggcctgcgccaccgcgcagcactacggcatcgcgggctgtggaaccctactaatattggatccagatgaagctgggctaaggctttttagaagctttgactggaatgatggtttgtttgatgtgacttggagtgagaacaacgaacatgtcctcatcacctgtagtggcgatggctcgctgcagctctgggacactgccaaagctgcagggccactgcaagtctataaagaacacgctcaggaggtgtatagtgttgattggagccaaaccagaggtgaacagcttgtggtgtctggctcatgggatcaaactgtcaaattgtgggatccaactgttggaaagtctctgtgcacctttagaggccatgaaagtattatttatagcacaatctggtctccccacatccctggttgttttgcttcagcctcaggtgatcagactctgagaatatgggatgtgaaggcagcaggagtaagaatcgtgattcctgcacatcaggcagaaatcttgagttgtgactggtgtaaatacaatgagaatttgctggtgaccggggcggttgactgtagtttgagaggctgggacttaaggaatgtacgacaaccagtgtttgaacttcttggtcatacctatgctattaggagggtgaaattttcaccatttcatgcttctgtgctggcctcttgctcgtatgattttactgtaagattctggaacttttcaaagcctgactctcttcttgaaacagtggagcatcatacagagtttacttgtggtttagacttcagtcttcagagccccactcaggtggctgactgttcttgggatgaaacaataaagatctatgaccctgcttgtcttactattcctgcttgagatacactactttggtcagaaacagaggatgttggctgaagaactgcctaacagcaaataaattaactatggaaaacat

SEQ ID NO: 417870 - DNA, 1316 bp, Homo sapiens
cggtctgcctggtctctctaaccgcgccagtgtgcctccgactcggaacggcttccgcggccggggcagcgagggccgggggcggcgggcgggatgagtgcggtgtgcggtggagcggcgcggatgctgcggacgccgggacgccacggctacgccgccgagttctccccgtacctgccgggccgcctggcctgcgccaccgcgcagcactacggcatcgcgggctgtggaaccctactaatattggatccagatgaagctgggctaaggctttttagaagctttgactggaatgatggtttgtttgatgtgacttggagtgagaacaacgaacatgtcctcatcacctgtagtggcgatggctcgctgcagctctgggacactgccaaagctgcagggccactgcaagtctataaagaacacgctcaggagtatgttcagggaagctgtgttgtgaaatagaagagcaactaatgggtcattttcttctgtggaagagagtatataataaagacgtatagcatggttttagtcaatcttggatttgaatcccagctttaatttgctggtgaccggggcggttgactgtagtttgagaggctgggacttaaggaatgtacgacaaccagtgtttgaacttcttggtcatacctatgctattaggagggtgaaattttcaccatttcatgcttctgtgctggcctcttgctcgtatgattttactgtaagattctggaacttttcaaagcctgactctcttcttgaaacagtggagcatcatacagagtttacttgtggtttagacttcagtcttcagagccccactcaggtggctgactgttcttgggatgaaacaataaagatctatgaccctgcttgtcttactattcctgcttgagatacactactttggtcagaaacagaggatgttggctgaagaactgcctaacagcaaataaattaactatggaaaacatagacattatgcttttatatgctattcagatttcaaatctttccaatttaccctggaatcagttttgagggagctgataaagactttagctgactcgttaagcctgatacataagccatatttaaaattctaagaaataattaatgttatgatatatcttgtagtatctattaaaatgtctctgggtcataaaatggattaaaatatgggagatcagtaggttatacttatatagatagtgatatatttcatttttaatttgtcatttttgatgtaaaatataatcactgctgtgataaataaactatctattgatcatttatcattttaaaaaaaaaaa

SEQ ID NO: 417871 - DNA, 1206 bp, Homo sapiens
cggtctgcctggtctctctaaccgcgccagtgtgcctccgactcggaacggcttccgcggccggggcagcgagggccgggggcggcgggcgggatgagtgcggtgtgcggtggagcggcgcggatgctgcggacgccgggacgccacggctacgccgccgagttctccccgtacctgccgggccgcctggcctgcgccaccgcgcagcactacggcatcgcgggctgtggaaccctactaatattggatccagatgaagctgggctaaggctttttagaagctttgactggaatgatggtttgtttgatgtgacttggagtgagaacaacgaacatgtcctcatcacctgtagtggcgatggctcgctgcagctctgggacactgccaaagctgcagggccactgcaagtctataaagaacacgctcaggaggtgtatagtgttgattggagccaaaccagaggtgaacagcttgtggtgtctggctcatgggatcaaactgtcaaattgtgggatccaactgttggaaagtctctgtgcacctttagaggccatgaaagtattatttatagcacaatctggtctccccacatccctggttgttttgcttcagcctcagattctggaacttttcaaagcctgactctcttcttgaaacagtggagcatcatacagagtttacttgtggtttagacttcagtcttcagagccccactcaggtggctgactgttcttgggatgaaacaataaagatctatgaccctgcttgtcttactattcctgcttgagatacactactttggtcagaaacagaggatgttggctgaagaactgcctaacagcaaataaattaactatggaaaacatagacattatgcttttatatgctattcagatttcaaatctttccaatttaccctggaatcagttttgagggagctgataaagactttagctgactcgttaagcctgatacataagccatatttaaaattctaagaaataattaatgttatgatatatcttgtagtatctattaaaatgtctctgggtcataaaatggattaaaatatgggagatcagtaggttatacttatatagatagtgatatatttcatttttaatttgtcatttttgatgtaaaatataatcactgctgtgataaataaactatctattgatcatttatcattttaaaaaaaaaaa

SEQ ID NO: 417872 - DNA, 620 bp, Homo sapiens
gtcactgtgtcacacaggctggaatgcagtggtacgtcatggctcattgtagcttcaacttcctgggtgcaaacgatcctcccatctcaagcctccactcccaccctaccctactgaatagctgggactacaggtggctgactgttcttgggatgaaacaataaagatctatgaccctgcttgtcttactattcctgcttgagatacactactttggtcagaaacagaggatgttggctgaagaactgcctaacagcaaataaattaactatggaaaacatagacattatgcttttatatgctattcagatttcaaatctttccaatttaccctggaatcagttttgagggagctgataaagactttagctgactcgttaagcctgatacataagccatatttaaaattctaagaaataattaatgttatgatatatcttgtagtatctattaaaatgtctctgggtcataaaatggattaaaatatgggagatcagtaggttatacttatatagatagtgatatatttcatttttaatttgtcatttttgatgtaaaatataatcactgctgtgataaataaactatctattgatcatttatcattttaaaaaaaaaaa

SEQ ID NO: 417873 - DNA, 503 bp, Homo sapiens
atacgtttcttcttacttcatttttgttttctaggtggctgactgttcttgggatgaaacaataaagatctatgaccctgcttgtcttactattcctgcttgagatacactactttggtcagaaacagaggatgttggctgaagaactgcctaacagcaaataaattaactatggaaaacatagacattatgcttttatatgctattcagatttcaaatctttccaatttaccctggaatcagttttgagggagctgataaagactttagctgactcgttaagcctgatacataagccatatttaaaattctaagaaataattaatgttatgatatatcttgtagtatctattaaaatgtctctgggtcataaaatggattaaaatatgggagatcagtaggttatacttatatagatagtgatatatttcatttttaatttgtcatttttgatgtaaaatataatcactgctgtgataaataaactatctattgatcattta

SEQ ID NO: 417874 - DNA, 1483 bp, Homo sapiens
cggtctgcctggtctctctaaccgcgccagtgtgcctccgactcggaacggcttccgcggccggggcagcgagggccgggggcggcgggcgggatgagtgcggtgtgcggtggagcggcgcggatgctgcggacgccgggacgccacggctacgccgccgagttctccccgtacctgccgggccgcctggcctgcgccaccgcgcagcactacggcatcgcgggctgtggaaccctactaatattggatccagatgaagctgggctaaggctttttagaagctttgactggaatgatggtttgtttgatgtgacttggagtgagaacaacgaacatgtcctcatcacctgtagtggcgatggctcgctgcagctctgggacactgccaaagctgcagggccactgcaagtctataaagaacacgctcaggaggtgtatagtgttgattggagccaaaccagaggtgaacagcttgtggtgtctggctcatgggatcaaactgtcaaattgtgggatccaactgttggaaagtctctgtgcacctttagaggccatgaaagtattatttatagcacaatctggtctccccacatccctggttgttttgcttcagcctcaggtgatcagactctgagaatatgggatgtgaaggcagcaggagtaagaatcgtgattcctgcacatcaggcagaaatcttgagttgtgactggtgtaaatacaatgagaatttgctggtgaccggggcggttgactgtagtttgagaggctgggacttaaggaatgtacgacaaccagtgtttgaacttcttggtcatacctatgctattaggagggtgaaattttcaccatttcatgcttctgtgctggcctcttgctcgtatgattttactgtaagattctggaacttttcaaagcctgactctcttcttgaaacagtggagcatcatacagagtttacttgtggtttagacttcagtcttcagagccccactcaggtggctgactgttcttgggatgaaacaataaagatctatgaccctgcttgtcttactattcctgcttgagatacactactttggtcagaaacagaggatgttggctgaagaactgcctaacagcaaataaattaactatggaaaacatagacattatgcttttatatgctattcagatttcaaatctttccaatttaccctggaatcagttttgagggagctgataaagactttagctgactcgttaagcctgatacataagccatatttaaaattctaagaaataattaatgttatgatatatcttgtagtatctattaaaatgtctctgggtcataaaatggattaaaatatgggagatcagtaggttatacttatatagatagtgatatatttcatttttaatttgtcatttttgatgtaaaatataatcactgctgtgataaataaactatctattgatcatttatcattttaaaaaaaaaaa

SEQ ID NO: 417875 - DNA, 689 bp, Homo sapiens
cggtctgcctggtctctctaaccgcgccagtgtgcctccgactcggaacggcttccgcggccggggcagcgagggccgggggcggcgggcgggatgagtgcggtgtgcggtggagcggcgcggatgctgcggacgccgggacgccacggctacgccgccgagttctccccgtacctgccgggccgcctggcctgcgccaccgcgcagcactacggcatcgcgggctgtggaaccctactaatattggatccagatgaagctgggctaaggctttttagaagctttgactggaatgatggtttgtttgatgtgacttggagtgagaacaacgaacatgtcctcatcacctgtagtggcgatggctcgctgcagctctgggacactgccaaagctgcagggccactgcaagtctataaagaacacgctcaggagtatgttcagggaagctgtgttgtgaaatagaagagcaactaatgggtcattttcttctgtggaagagagtatataataaagacgtatagcatggttttagtcaatcttggatttgaatcccagctttgtaagttacctgttgtgagaccttgcgtatgtcacatatttttcctaaacttgagtgtttttatttgcaaactaagtttattagtagtctgtatcacagaccagcattgaataaatatgagctagtatta

SEQ ID NO: 417876 - DNA, 1075 bp, Homo sapiens
cggtctgcctggtctctctaaccgcgccagtgtgcctccgactcggaacggcttccgcggccggggcagcgagggccgggggcggcgggcgggatgagtgcggtgtgcggtggagcggcgcggatgctgcggacgccgggacgccacggctacgccgccgagttctccccgtacctgccgggccgcctggcctgcgccaccgcgcagcactacggcatcgcgggctgtggaaccctactaatattggatccagatgaagctgggctaaggctttttagaagctttgactggaatgatggtttgtttgatgtgacttggagtgagaacaacgaacatgtcctcatcacctgtagtggcgatggctcgctgcagctctgggacactgccaaagctgcagggccactgcaagtctataaagaacacgctcaggagttttcaccatttcatgcttctgtgctggcctcttgctcgtatgattttactgtaagattctggaacttttcaaagcctgactctcttcttgaaacagtggagcatcatacagagtttacttgtggtttagacttcagtcttcagagccccactcaggtggctgactgttcttgggatgaaacaataaagatctatgaccctgcttgtcttactattcctgcttgagatacactactttggtcagaaacagaggatgttggctgaagaactgcctaacagcaaataaattaactatggaaaacatagacattatgcttttatatgctattcagatttcaaatctttccaatttaccctggaatcagttttgagggagctgataaagactttagctgactcgttaagcctgatacataagccatatttaaaattctaagaaataattaatgttatgatatatcttgtagtatctattaaaatgtctctgggtcataaaatggattaaaatatgggagatcagtaggttatacttatatagatagtgatatatttcatttttaatttgtcatttttgatgtaaaatataatcactgctgtgataaataaactatctattgatcatttatcattttaaaaaaaaaaa

SEQ ID NO: 417877 - DNA, 1429 bp, Homo sapiens
  misc_feature (1)..(1): n is a, c, g, or t
  misc_feature (3)..(3): n is a, c, g, or t
ngnggaacttgcctcatgtgtgtgtatgtgtgtgtgtgtgattgtgggtgtgggtagtttaacctttttatatcttagctgcctgtaaactcagtgattgctacgttcagatcaaaccttgaactttttttttctggtgccaggagccttcctgtgctccccattgcctgccagaaccaccaccgtttcccatggttactctacagcagcttcactgcctgaaaatgaaaactgaacaaagggattaaattgtgagaacaactgtcaatctattatatatttgtacaatctggtattaaaatgctttccccaaaagatattctgcgaaaagatctgaagttggtccatggttatcccatgacctgtgcttttgcaagcaactgggaaaaaattgaacagttccatagcagaccagatgacattgtgatagccacttatcctaaatcaggtactacttgggttagtgaaattatagacatgattctaaatgatggagatattgaaaaatgtaagcgaggttttattactgaaaaagttccaatgttggaaatgactctccctggattaagaacatcaggtatagaacaattggagaagaatccatcaccccggattgtgaaaacacatctaccgactgatcttcttcctaaatctttctgggaaaacaattgcaagatgatttatctggctcgtaatgccaaggatgtttcagtctcatattaccattttgacttaatgaataatttacagccttttcctggtacctgggaagaatatctggagaaattcttaactggaaaagtggcctatggttcctggtttactcatgttaaaaactggtggaagaaaaaggaagaacacccaatactttttttgtactatgaagatatgaaagagaatccaaaggaggaaatcaagaagatcattagatttctagagaagaacctgaatgatgagatcttggataggatcatccatcacacctcatttgaagtgatgaaggacaatcctttggtaaattatacacatctaccaactacagtgatggatcatagcaaatccccttttatgcgtaaagggacggctggtgactggaagaattacttcaccgtggcccaaaatgagaaatttgatgctatttatgagacagaaatgtccaaaactgcacttcaattccgcacagagatttaaagtgtctaaatcacaaatctgaagaaataagagattgtctgtagttgattgaaacgagggcagttatgaattgatttgggcaatcaaatgaatttataaaggagaataatatgcttttaatatgttgattcttttcaatgttattaatcagatcccagttttgttcctttgattctgagtttccaaattctctaaggctaaagttcattgttaactttttgtaacaaaggaacaatgt

SEQ ID NO: 417878 - DNA, 1298 bp, Homo sapiens
  misc_feature (1)..(1): n is a, c, g, or t
  misc_feature (3)..(3): n is a, c, g, or t
ngnggaacttgcctcatgtgtgtgtatgtgtgtgtgtgtgattgtgggtgtgggtagtttaacctttttatatcttagctgcctgtaaactcagtgattgctacgttcagatcaaaccttgaactttttttttctggtgccaggagccttcctgtgctccccattgcctgccagaaccaccaccgtttcccatggttactctacagcagcttcactgcctgaaaatgaaaactgaacaaagggattaaattgtgagaacaactgtcaatctattatatatttgtacaatctggtattaaaatgctttccccaaaagatattctgcgaaaagatctgaagttggtccatggttatcccatgacctgtgcttttgcaagcaactgggaaaaaattgaacagttccatagcagaccagatgacattgtgatagccacttatcctaaatcaggtactacttgggttagtgaaattatagacatgattctaaatgatggagatattgaaaaatgtaagcgaggttttattactgaaaaagttccaatgttggaaatgactctccctggattaagaacatcaggtatagaacaattggagaagaatccatcaccccggattgtgaaaacacatctaccgactgatcttcttcctaaatctttctgggaaaacaattgcaagatgatttatctggctcgtaatgccaaggatgtttcagtctcatattaccattttgacttaatgaataatttacagccttttcctggtacctgggaagaatatctggagaaattcttaactggaaaagtggcctatggttcctggtttactcatgttaaaaactggtggaagaaaaaggaagaacacccaatactttttttgtactatgaagatatgaaagagaatccaaaggaggaaatcaagaagatcattagatttctagagaagaacctgaatgatgagatcttggataggatcatccatcacacctcatttgaagtgatgaaggacaatcctttggtaaattatacacatctaccaactacagtgatggatcatagcaaatccccttttatgcgtaaagggacggctggtgactggaagaattacttcaccgtggcccaaaatgagaaatttgatgctatttatgagacagaaatgtccaaaactgcacttcaattccgcacagagatttaaagtgtctaaatcacaaatctgaagaaataagagattgtctgtagttgattgaaacgagggcagttatgaattgatttgggcaatcaaatgaatttataaaggagaat

SEQ ID NO: 417879 - DNA, 390 bp, Homo sapiens
cttttttgttagtctgtaaaatcatttccaggtaaaatctagagcttaatccatatgttgtgccatcttttgcttttccacacctctgatcctaggtaagttagagctaacgagtatttgctgagcttctattatgggcccagcatatgttataatttcttttacacataggaatctgaggcttagagaagtttactgatttacctaatggcacaccataagtgctggggctaagatttaaactcaggtctcctgacttaattcagatggtcagctcgatggtaatcataataatattgttgttgttgttgttgttgttatttatcaacaatagtagtagctaagtcatttcatgaaacagctcattgatagtccatttgataattctga

SEQ ID NO: 417880 - DNA, 742 bp, Homo sapiens
ccacaggggaagtattttgacaacattaagatgccgtggctgtgcactgtactgaacttctgaccattaggtgtattgataccactgaaactgtgtaacattgtctcccttttctgtcttccctatgcttctgttggatgtgatatttcatttgagagtcatcgtcagtaacctgtgtaccttctcaaaacctatgtctgttgcactgaggatgaaaatccaacactaacaaatgttctttgggctaaaaataaagatcatttaaatacatggttttccaagaagggttgaacctgccacagggttgtgctactgtaatgtctccatgcgtcacttggactaaatctctctaattccattgattagagtcacaaatgggttataatatgttaagttccaatatttttctgacttgattggaacctgcttctctgtgaggctatttttgtaatgagttttttgtacttaatttaactgccgcggtctttggtgggggtgggaagggattttgttcttttgttgtttattgttaatgctctcctatgccagcctgtcattgttccagttgtttgaaaaaacaaaacaaaacaaaacaaaaaaggatgcattcgttgtctgggttctcgagtcaccttatggctgtctaaaaatgtcactgttccgattgcggtctctgcagccttatttgagtgttgccttagactgtctgactggacaaataaactctctttgccctatgtta

SEQ ID NO: 417881 - DNA, 1041 bp, Homo sapiens
aacacatttcatctgggcttcttaaatctaaatctttaaaatgactaagttttcttccttttctctgtttttcctaatagttggggcttatatgactcatgtgtgtttcaatatggaaattattggagggaaagaagtgtcacctcattccaggccatttatggcctccatccagtatggcggacatcacgtttgtggaggtgttctgattgatccacagtgggtgctgacagcagcccactgccaatatcggtttaccaaaggccagtctcccactgtggttttaggcgcacactctctctcaaagaatgaggcctccaaacaaacactggagatcaaaaaatttataccattctcaagagttacatcagatcctcaatcaaatgatatcatgctggttaagcttcaaacagccgcaaaactcaataaacatgtcaagatgctccacataagatccaaaacctctcttagatctggaaccaaatgcaaggttactggctggggagccaccgatccagattcattaagaccttctgacaccctgcgagaagtcactgttactgtcctaagtcgaaaactttgcaacagccaaagttactacaacggcgacccttttatcaccaaagacatggtctgtgcaggagatgccaaaggccagaaggattcctgtaagggtgactcagggggccccttgatctgtaaaggtgtcttccacgctatagtctctggaggtcatgaatgtggtgttgccacaaagcctggaatctacaccctgttaaccaagaaataccagacttggatcaaaagcaaccttgtcccgcctcatacaaattaagttacaaataattttattggatgcacttgcttcttttttcctaatatgctcgcaggttagagttgggtgtaagtaaagcagagcacatatggggtccatttttgcacttgtaagtcattttattaaggaatcaagttctttttcacttgtatcactgatgtatttctaccatgctggttttattctaaataaaatttagaagactc

SEQ ID NO: 417882 - DNA, 1477 bp, Homo sapiens
aacacatttcatctgggcttcttaaatctaaatctttaaaatgactaagttttcttccttttctctgtttttcctaatagttggggcttatatgactcatgtgtgtttcaatatggaaattattggagggaaagaagtgtcacctcattccaggccatttatggcctccatccagtatggcggacatcacgtttgtggaggtgttctgattgatccacagtgggtgctgacagcagcccactgccaatatcggtttaccaaaggccagtctcccactgtggttttaggcgcacactctctctcaaagaatgaggcctccaaacaaacactggagatcaaaaaatttataccattctcaagagttacatcagatcctcaatcaaatgatatcatgctggttaagcttcaaacagccgcaaaactcaataaacatgtcaagatgctccacataagatccaaaacctctcttagatctggaaccaaatgcaaggttactggctggggagccaccgatccagattcattaagaccttctgacaccctgcgagaagtcactgttactgtcctaagtcgaaaactttgcaacagccaaagttactacaacggcgacccttttatcaccaaagacatggtctgtgcaggagatgccaaaggccagaaggattcctgtaagggtgactcagggggccccttgatctgtaaaggtgtcttccacgctatagtctctggaggtcatgaatgtggtgttgccacaaagcctggaatctacaccctgttaaccaagaaataccagacttggatcaaaagcaaccttgtcccgcctcatacaaattaagttacaaataattttattggatgcacttgcttcttttttcctaatatgctcgcaggttagagttgggtgtaagtaaagcagagcacatatggggtccatttttgcacttgtaagtcattttattaaggaatcaagttctttttcacttgtatcactgatgtatttctaccatgctggttttattctaaataaaatttagaagactctctgtttgtcttttatcacatgaagtaatatctgcccccattgcacccacactcgccaaagggcaataaggtcactgaataaaacagtaatggtaccaccttcaactaggtgtaacttctgctggatcatcctaagttgttgggttgttttcttttcattgttgtgataacattgaacatgagataggcccttgcaacaaatgtttaagggtatgatacattattgttaactataggcatgatcttgcagtgcagatctctagaactgcttcatctcatataaatgaaactttatgccagttgaatagcagctctctatttccccaccacccccatcctctggcaaccccattctactctaagcttctatgagtttgtattttttaaatataaatcataaatataaatatcctaattcaagcaagcagcttataca

SEQ ID NO: 417883 - DNA, 868 bp, Homo sapiens
aaccctctcgaccatcaccactccccactgggggatttggaaatcattctgctgctttcattgtctttgctttttttaggtttaccaaaggccagtctcccactgtggttttaggcgcacactctctctcaaagaatgaggcctccaaacaaacactggagatcaaaaaatttataccattctcaagagttacatcagatcctcaatcaaatgatatcatgctggttaagcttcaaacagccgcaaaactcaataaacatgtcaagatgctccacataagatccaaaacctctcttagatctggaaccaaatgcaaggttactggctggggagccaccgatccagattcattaagaccttctgacaccctgcgagaagtcactgttactgtcctaagtcgaaaactttgcaacagccaaagttactacaacggcgacccttttatcaccaaagacatggtctgtgcaggagatgccaaaggccagaaggattcctgtaagggtgactcagggggccccttgatctgtaaaggtgtcttccacgctatagtctctggaggtcatgaatgtggtgttgccacaaagcctggaatctacaccctgttaaccaagaaataccagacttggatcaaaagcaaccttgtcccgcctcatacaaattaagttacaaataattttattggatgcacttgcttcttttttcctaatatgctcgcaggttagagttgggtgtaagtaaagcagagcacatatggggtccatttttgcacttgtaagtcattttattaaggaatcaagttctttttcacttgtatcactgatgtatttctaccatgctggttttattctaaataaaatttagaagactc

SEQ ID NO: 417884 - DNA, 828 bp, Homo sapiens
gtcagttaatggacatttgaattgttaccactttttggctattacgaagcatgttgctgcgaacattcttgtacagtttttttgtggagatgtagttaaatttaattccacagccacttctgggataggtcctaatctttactcatttcatcctcgaggaaaagccttgcagacctgaagtaacttatgtcaggacacatagttcctgccaggtggaatggggtcctaaaccctggtcaggacacatagttcctgccaggtggaatggggtcctaaaccctggtcaggacacatagttcctgccaggtggaatggggtcctaaaccctggtcctaccagtcttctttaatggtcacaagtctgtaagttacacagaagctccctatcattcactaccccatctactgcatctaacccagtgccagttggcccacaacaaatacttgttacaggggtgaatgagtggtggtctgtcttcttaggacctagaacaagagcgtcactctagtcttggatgcgccctgtgcctgtggctgcttgtctgggggcttctagggcaagtgtcttgtctaaatgttgatcactgaataaaatgggcccagcctggcttgccttctcttacccttgaacctgggttaggaccgcagagagcagcatttggcctttcccatgctcctcaaggccttcacagtgtctggtaactgccagctctcagacattgggcagacctggtcatctttactagagctgccctcaaaggaaccccaggaggaggtggccccgttacccactgccccttcctgcatgaggtgtctacatccctgacct

SEQ ID NO: 417885 - DNA, 385 bp, Homo sapiens
ctggaatacgagaactaagcgattgactttgctttccctaaaagataaacagggtagttgtagttgcaacagagtagatagaggtaggtctaccctgggtttaaagtggagatcacagccggggaaaaccggactggatcccgaggcctcctccagggaggggcggcaggggtgtctcaaaatctcccacctgtcagcccaacttttggattccttgtcaccttccacactgcccgagctccggacatacagccctggtgcacaagggtcccattctttgcacaccaggggtataatggactccggactgttggcgagagtgacagcaaaaagagccagcctcttctcccaggcttcttagcaacctgcctgtctcggctccagg

SEQ ID NO: 417886 - DNA, 561 bp, Homo sapiens
atatttgttgaagcaatgaagaatggatctgtaaaatggggacagagaaccagatctctcaagacctttctagacctcatcttctatgtagacagatgaatctgggaactagtgttgaatttgaagacacacacagacctgcttcacagcccttttctagtctttagtcattttattatactttttgccatctgtcttgtattgccatttgaaaccattctagtgaatgaaatataaattatgttcttatttgtttctaggaagcaagatttccagatgtagcaaatgggtttattgaggaaataattcattttaagaattattatgatctgaatgtctctctttggataatctgggttttccagaagaaaattacaaagtacattcagatcataatggtgtttccctttgtcttgaacgtagtttctgttgtgagattatggtacatggatgctaatcagtagatccatatattaacctgaaggaaaacttccttggcatttctgcacgtggagagtgtataaatggtagtttggtggtaaattcataactttttttttg

SEQ ID NO: 417887 - DNA, 178 bp, Homo sapiens
acagccttgcttagtccgggctccgaggcagcagcagccataagaaaaaacaggagaggaaggcgatgtggcgcttctgccgggccctcagactggggagtgtgaggtcaggacaggctggcgtgtcgttttcgtctctgtggctgctggacgtgtgaatgtgtggttcaaaccttgg

SEQ ID NO: 417888 - DNA, 5605 bp, Homo sapiens
cgcggagggccggaaggagtgcagcggctgccacggagctcgcagctgcggcttctgaggagtaagcggcgcggtagcgaaggccgccgaacctgcctggctagccggcgacttgagtgacgactcttttgaaacagatggtcaccatgtttagatattagcagtcccatatatgcatgtctgcatttgaaaatggaagagggaaacaacaatgaagaggtaattcacttgaacaactttcactgccatcggggacaagagtggatcaatctccgagatgggcccatcaccatatctgactcctcagatgaggaaaggattccaatgctggtcaccccagctcctcagcagcatgaagaagaggacctggatgatgatgtcatcctgacagaagatgattctgaggatgactacggtgaatttctggatcttgggcctcctggaatctctgaattcactaagccaagtggccaaacagaaagagaacccaagcctggaccgagtcataaccaagcagcaaatgacattgtcaaccccagatcagagcagaaagtcatcatcttggaagaaggtagccttctttacacagaaagcgatcctttggaaactcagaaccagtcatccgaagactcagagacagagctgttatcaaatctaggagagtcagctgctctagcagatgatcaggccatcgaagaagactgctggttagatcatccttacttccagtctctgaaccaacagccccgtgaaataacaaaccaggtcgttcctcaggaacggcagcctgaagcagaactgggccgcttgttgtttcagcatgaattcccagggcccgcttttccaaggccggaaccccagcaaggtgggatttcaggcccctcttctcctcagcctgcccatcctctaggagagtttgaagaccagcagttagcaagtgatgatgaagagccaggtccagcctttccaatgcaagaatctcaagagcccaatttggaaaacatttgggggcaagaagctgcagaggtagatcaagagctcgttgaactactagtgaaagaaacggaagcaagatttccagatgtagcaaatgggtttattgaggaaataattcattttaagaattattatgatctgaatgtactttgtaattttcttctggaaaacccagattatccaaagagagaagacagaatcattataaatcccagtagcagtctgctggccagccaagatgagacaaagttgcctaaaatagacttttttgactattctaaattgacccctcttgaccagcgctgcttcatccaagctgctgacctcctcatggccgacttcaaagtgctcagtagtcaggacatcaagtgggccctgcacgagctcaaaggacactatgcaatcacccgaaaggccttgtctgatgccattaaaaaatggcaggagctgtcaccagaaaccagtggaaaaaggaagaagagaaaacaaatgaaccagtattcttacattgatttcaagtttgaacaaggtgacataaaaatagaaaagaggatgttctttcttgaaaataagcgacgacattgtaggtcctatgaccgacgtgctctccttccagctgtgcaacaagagcaggagttctatgagcagaaaatcaaagagatggcagagcatgaagactttttgcttgccctacagatgaatgaagaacagtatcaaaaggatggccagctgattgagtgtcgctgctgctatggggaatttccattcgaggagctgacgcagtgcgcagatgctcacttgttctgcaaagagtgtctcatcagatatgcccaagaggcagtctttggatctggaaagttggagctcagctgcatggaaggcagctgcacgtgttcgttcccaaccagtgagctggagaaggtgctcccccagaccatcctgtataagtactatgagcgaaaagccgaggaggaggttgcggcagcctacgccgacgagcttgtcaggtgcccgtcctgtagctttccggctctgttggacagtgatgtgaagaggttcagctgtcctaatcctcactgccgaaaggaaacctgtaggaagtgtcagggactctggaaagaacataatggcctcacctgtgaagagctggctgaaaaagacgacatcaagtaccgtacctctattgaagaaaaaatgactgctgcccgcattagaaaatgccacaagtgtgggactggcctcatcaaatctgaaggctgcaaccgcatgtcttgccgctgtggtgcccagatgtgctacctctgtcgagtttctattaatggatatgaccatttctgccaacatccccgctcaccaggagccccttgccaggagtgttcaagatgctctctctggaccgatcccactgaagatgatgagaagcttattgaggaaatccagaaggaggctgaagaggaacagaaaagaaagaatggagagaacaccttcaaacgcattggacccccgctggagaagcctgtggagaaggtgcagagggtggaggccctcccgaggcccgttccgcagaacctgccacagccacagatgccaccctatgccttcgcgcacccacccttccccctgcctcccgtgcggcctgtgttcaacaacttcccactcaacatggggcctatcccagccccgtacgtgccccctctgcccaacgtgcgggtcaactatgacttcggtcccatccacatgcccctggagcacaacctgcccatgcactttggcccccagccgcggcatcgcttctgatggccccgaatccccattgagcagcacaaagcccgtttggggtaggagtgtggatggagaaccctcccccaaggctggtgtctgtaccattgcatcctaagtcagcttgaagggtaggctggttttcttcccacccctttcctagaagggctactgctcctggaagagtggacggatccataataaagacgtcccaaatggtggagttcggagagagctgcgatgtgaactgcccctcccctcgcatcccccaggccaccaacggcagtccttctgccttgtccatggcataggccatagaccaggtccctgctgctcacacctgggcctctcctcggagccgacccctgggtagcaaggcagccgagagcatctccctggaggggcccacggttgggccaagggcagagggggctgcacctgcgggcctgggaagcattgctcagggtggggggctgggaccatggcccgcagaggcactgccacagctgtgagggccaagatgctgtccccccatccaaaacccgtgcgccactgcagtgagtgttgagggcacctctcctcccctcttacacctactcagatgaggcagcagcagacccatctcgcggcgggggttttgttctgttgccgcctaactttctcatcctcggtctctggaaagtcaggctgagaaatcctttcccaggccaggccgctgcggtacactggatggttctgaagctggcccattgaaagagcctcttaaggcagctgggacagaggcctggtggccctgctgggcagcccaactgctgggggagacgtttctgccaccctgggtgatgagcagcttttcccccctggctttctgggggaggagtgggcctccttagggagacaggtgaccctgggtgccacccctgccccgtgtgtgccccgggtgttctcagtggttgctgaaggcaggtagagggtgctgtccagtatcccccatgtgaaggtcacttcccttctcatggagtcagctgagcatcagctcagccctgccatgtccccactcaccctcctcgcctcctgtccggccctgggtttctagcggtgcctgaggcatcactctggcccattgacagatgagaggtctgaagccttcctggccacaggcatcactttctcctcctcctcatgccctgccttgtccttgtcgtgttgccatggggttctgagaggctgggagttcacagacctcagacacagctgagtccgacaaccattggggtggggctgcatcagtctccggagtggcccgccacctcctgaagcagggcctggcccacccaaggtgcctggggcaggcgggcaccgtcattcgctgccattggcttctcagatgtatttcaaggactaaagtgggctctaagatctaagatggcccggcgcggtggctcccgcctgtaatcccagcactttgggaggccgaggcgggcggatgagttgaggtcgggagtttgagtccccgtctctactaaaaatacaaaattagccggacaaggtggcgcatgcctataatcccaggtactcaggaggctgaggcaggagaatcacttgaacctgggaggcagaggttgcagtgagccaagattgtgccactgcactccagcctgagcaacaaaagcaaaactctatctttaaaaaaaaaaaaaaaaaaactaagatacccattctttctgcctttgcccaggatggaggctttgaagacaggtggtcacctggacctggggtaagggtgcgcagggaggccgggcttgggggcagcctgctgctatgtccttgctggcgcccatacctgttggactgcctgaactttgctactagcctgaacgacagtgccttggaaaggcaggctccatgcggcacaacaggattgtcttcggtaccttaaatatgctccctgtgcttccccagggaggatctctgggagcagagggcggctgtagacatcacagctgaagaggtgacctcaggccctgggagcctcagctccctctgccctgtaccctaggcacgtggctccagcaagagccccaggcaggacaaagggagcaggcagcagctgcagaaacagccctagacaggtgctggcctcaaccctggcaggggagggggagcccagagtgatgtttctcctaaggccaaaccccaggggtgggtcatttgagaggagttccagctgttctggccacactgggctggtggggaaggagcggcggcctctttccttggagggtccctgattcctgaggatcctccccgagccaggcacgggggaccacagggctgccgtgagcacccaccctggttctccaggcccctctgtccagaggcagggcctgaacctcgggctcctgcctggaccagtgacagcattggggagagaagcactgggggtcttcagaccagccagcaaggggccgtgccagtgcccagagagcaggtcagacaacaggcaaccctgaggcagctggctccctctctctgccctgcagggcttgccgcagggcgtgaggctccccagccacagccccctcttacttgccttaaaactggagagaggaatctagtatttgcacttagcaaaatatttaaaaactgaaaaaaatgtgcatgatctgtcactttgtataaaaacaagaaacgattagttcattaaactttttctttaccttctggtagtaaaaatagataaaataattccgtttcaactactgtgtgtaaaaagcctgtatcatatgtaactgggacttttgtaaataaatgtttgtgcgctctgctc

SEQ ID NO: 417889 - DNA, 5776 bp, Homo sapiens
cgcggagggccggaaggagtgcagcggctgccacggagctcgcagctgcggcttctgaggagtaagcggcgcggtagcgaaggccgccgaacctgcctggctagccggcgacttgagtgacgactcttttgaaacagatggtcaccatgtttagatattagcagtcccatatatgcatgtctgcatttgaaaatggaagagggaaacaacaatgaagaggtaattcacttgaacaactttcactgccatcggggacaagagtggatcaatctccgagatgggcccatcaccatatctgactcctcagatgaggaaaggattccaatgctggtcaccccagctcctcagcagcatgaagaagaggacctggatgatgatgtcatcctgacagaaacaaataaacctcagagatcacgacccaatctcatcaaaccagctgcccagtggcaagatctgaaaaggttgggagaagaaaggcctaaaaagtctagagcagcatttgaatcagataagagcagctatttttcagtgtgtaacaacccattgtttgattctggggcacaggatgattctgaggatgactacggtgaatttctggatcttgggcctcctggaatctctgaattcactaagccaagtggccaaacagaaagagaacccaagcctggaccgagtcataaccaagcagcaaatgacattgtcaaccccagatcagagcagaaagtcatcatcttggaagaaggtagccttctttacacagaaagcgatcctttggaaactcagaaccagtcatccgaagactcagagacagagctgttatcaaatctaggagagtcagctgctctagcagatgatcaggccatcgaagaagactgctggttagatcatccttacttccagtctctgaaccaacagccccgtgaaataacaaaccaggtcgttcctcaggaacggcagcctgaagcagaactgggccgcttgttgtttcagcatgaattcccagggcccgcttttccaaggccggaaccccagcaaggtgggatttcaggcccctcttctcctcagcctgcccatcctctaggagagtttgaagaccagcagttagcaagtgatgatgaagagccaggtccagcctttccaatgcaagaatctcaagagcccaatttggaaaacatttgggggcaagaagctgcagaggtagatcaagagctcgttgaactactagtgaaagaaacggaagcaagatttccagatgtagcaaatgggtttattgaggaaataattcattttaagaattattatgatctgaatgtactttgtaattttcttctggaaaacccagattatccaaagagagaagacagaatcattataaatcccagtagcagtctgctggccagccaagatgagacaaagttgcctaaaatagacttttttgactattctaaattgacccctcttgaccagcgctgcttcatccaagctgctgacctcctcatggccgacttcaaagtgctcagtagtcaggacatcaagtgggccctgcacgagctcaaaggacactatgcaatcacccgaaaggccttgtctgatgccattaaaaaatggcaggagctgtcaccagaaaccagtggaaaaaggaagaagagaaaacaaatgaaccagtattcttacattgatttcaagtttgaacaaggtgacataaaaatagaaaagaggatgttctttcttgaaaataagcgacgacattgtaggtcctatgaccgacgtgctctccttccagctgtgcaacaagagcaggagttctatgagcagaaaatcaaagagatggcagagcatgaagactttttgcttgccctacagatgaatgaagaacagtatcaaaaggatggccagctgattgagtgtcgctgctgctatggggaatttccattcgaggagctgacgcagtgcgcagatgctcacttgttctgcaaagagtgtctcatcagatatgcccaagaggcagtctttggatctggaaagttggagctcagctgcatggaaggcagctgcacgtgttcgttcccaaccagtgagctggagaaggtgctcccccagaccatcctgtataagtactatgagcgaaaagccgaggaggaggttgcggcagcctacgccgacgagcttgtcaggtgcccgtcctgtagctttccggctctgttggacagtgatgtgaagaggttcagctgtcctaatcctcactgccgaaaggaaacctgtaggaagtgtcagggactctggaaagaacataatggcctcacctgtgaagagctggctgaaaaagacgacatcaagtaccgtacctctattgaagaaaaaatgactgctgcccgcattagaaaatgccacaagtgtgggactggcctcatcaaatctgaaggctgcaaccgcatgtcttgccgctgtggtgcccagatgtgctacctctgtcgagtttctattaatggatatgaccatttctgccaacatccccgctcaccaggagccccttgccaggagtgttcaagatgctctctctggaccgatcccactgaagatgatgagaagcttattgaggaaatccagaaggaggctgaagaggaacagaaaagaaagaatggagagaacaccttcaaacgcattggacccccgctggagaagcctgtggagaaggtgcagagggtggaggccctcccgaggcccgttccgcagaacctgccacagccacagatgccaccctatgccttcgcgcacccacccttccccctgcctcccgtgcggcctgtgttcaacaacttcccactcaacatggggcctatcccagccccgtacgtgccccctctgcccaacgtgcgggtcaactatgacttcggtcccatccacatgcccctggagcacaacctgcccatgcactttggcccccagccgcggcatcgcttctgatggccccgaatccccattgagcagcacaaagcccgtttggggtaggagtgtggatggagaaccctcccccaaggctggtgtctgtaccattgcatcctaagtcagcttgaagggtaggctggttttcttcccacccctttcctagaagggctactgctcctggaagagtggacggatccataataaagacgtcccaaatggtggagttcggagagagctgcgatgtgaactgcccctcccctcgcatcccccaggccaccaacggcagtccttctgccttgtccatggcataggccatagaccaggtccctgctgctcacacctgggcctctcctcggagccgacccctgggtagcaaggcagccgagagcatctccctggaggggcccacggttgggccaagggcagagggggctgcacctgcgggcctgggaagcattgctcagggtggggggctgggaccatggcccgcagaggcactgccacagctgtgagggccaagatgctgtccccccatccaaaacccgtgcgccactgcagtgagtgttgagggcacctctcctcccctcttacacctactcagatgaggcagcagcagacccatctcgcggcgggggttttgttctgttgccgcctaactttctcatcctcggtctctggaaagtcaggctgagaaatcctttcccaggccaggccgctgcggtacactggatggttctgaagctggcccattgaaagagcctcttaaggcagctgggacagaggcctggtggccctgctgggcagcccaactgctgggggagacgtttctgccaccctgggtgatgagcagcttttcccccctggctttctgggggaggagtgggcctccttagggagacaggtgaccctgggtgccacccctgccccgtgtgtgccccgggtgttctcagtggttgctgaaggcaggtagagggtgctgtccagtatcccccatgtgaaggtcacttcccttctcatggagtcagctgagcatcagctcagccctgccatgtccccactcaccctcctcgcctcctgtccggccctgggtttctagcggtgcctgaggcatcactctggcccattgacagatgagaggtctgaagccttcctggccacaggcatcactttctcctcctcctcatgccctgccttgtccttgtcgtgttgccatggggttctgagaggctgggagttcacagacctcagacacagctgagtccgacaaccattggggtggggctgcatcagtctccggagtggcccgccacctcctgaagcagggcctggcccacccaaggtgcctggggcaggcgggcaccgtcattcgctgccattggcttctcagatgtatttcaaggactaaagtgggctctaagatctaagatggcccggcgcggtggctcccgcctgtaatcccagcactttgggaggccgaggcgggcggatgagttgaggtcgggagtttgagtccccgtctctactaaaaatacaaaattagccggacaaggtggcgcatgcctataatcccaggtactcaggaggctgaggcaggagaatcacttgaacctgggaggcagaggttgcagtgagccaagattgtgccactgcactccagcctgagcaacaaaagcaaaactctatctttaaaaaaaaaaaaaaaaaaactaagatacccattctttctgcctttgcccaggatggaggctttgaagacaggtggtcacctggacctggggtaagggtgcgcagggaggccgggcttgggggcagcctgctgctatgtccttgctggcgcccatacctgttggactgcctgaactttgctactagcctgaacgacagtgccttggaaaggcaggctccatgcggcacaacaggattgtcttcggtaccttaaatatgctccctgtgcttccccagggaggatctctgggagcagagggcggctgtagacatcacagctgaagaggtgacctcaggccctgggagcctcagctccctctgccctgtaccctaggcacgtggctccagcaagagccccaggcaggacaaagggagcaggcagcagctgcagaaacagccctagacaggtgctggcctcaaccctggcaggggagggggagcccagagtgatgtttctcctaaggccaaaccccaggggtgggtcatttgagaggagttccagctgttctggccacactgggctggtggggaaggagcggcggcctctttccttggagggtccctgattcctgaggatcctccccgagccaggcacgggggaccacagggctgccgtgagcacccaccctggttctccaggcccctctgtccagaggcagggcctgaacctcgggctcctgcctggaccagtgacagcattggggagagaagcactgggggtcttcagaccagccagcaaggggccgtgccagtgcccagagagcaggtcagacaacaggcaaccctgaggcagctggctccctctctctgccctgcagggcttgccgcagggcgtgaggctccccagccacagccccctcttacttgccttaaaactggagagaggaatctagtatttgcacttagcaaaatatttaaaaactgaaaaaaatgtgcatgatctgtcactttgtataaaaacaagaaacgattagttcattaaactttttctttaccttctggtagtaaaaatagataaaataattccgtttcaactactgtgtgtaaaaagcctgtatcatatgtaactgggacttttgtaaataaatgtttgtgcgctctgctc

SEQ ID NO: 417890 - DNA, 3629 bp, Homo sapiens
acagccttgcttagtccgggctccgaggcagcagcagccataagaaaaaacaggagaggaaggcgatgtggcgcttctgccgggccctcagactggggagtgtgaggaaacctgtaggaagtgtcagggactctggaaagaacataatggcctcacctgtgaagagctggctgaaaaagacgacatcaagtaccgtacctctattgaagaaaaaatgactgctgcccgcattagaaaatgccacaagtgtgggactggcctcatcaaatctgaaggctgcaaccgcatgtcttgccgctgtggtgcccagatgtgctacctctgtcgagtttctattaatggatatgaccatttctgccaacatccccgctcaccaggagccccttgccaggagtgttcaagatgctctctctggaccgatcccactgaagatgatgagaagcttattgaggaaatccagaaggaggctgaagaggaacagaaaagaaagaatggagagaacaccttcaaacgcattggacccccgctggagaagcctgtggagaaggtgcagagggtggaggccctcccgaggcccgttccgcagaacctgccacagccacagatgccaccctatgccttcgcgcacccacccttccccctgcctcccgtgcggcctgtgttcaacaacttcccactcaacatggggcctatcccagccccgtacgtgccccctctgcccaacgtgcgggtcaactatgacttcggtcccatccacatgcccctggagcacaacctgcccatgcactttggcccccagccgcggcatcgcttctgatggccccgaatccccattgagcagcacaaagcccgtttggggtaggagtgtggatggagaaccctcccccaaggctggtgtctgtaccattgcatcctaagtcagcttgaagggtaggctggttttcttcccacccctttcctagaagggctactgctcctggaagagtggacggatccataataaagacgtcccaaatggtggagttcggagagagctgcgatgtgaactgcccctcccctcgcatcccccaggccaccaacggcagtccttctgccttgtccatggcataggccatagaccaggtccctgctgctcacacctgggcctctcctcggagccgacccctgggtagcaaggcagccgagagcatctccctggaggggcccacggttgggccaagggcagagggggctgcacctgcgggcctgggaagcattgctcagggtggggggctgggaccatggcccgcagaggcactgccacagctgtgagggccaagatgctgtccccccatccaaaacccgtgcgccactgcagtgagtgttgagggcacctctcctcccctcttacacctactcagatgaggcagcagcagacccatctcgcggcgggggttttgttctgttgccgcctaactttctcatcctcggtctctggaaagtcaggctgagaaatcctttcccaggccaggccgctgcggtacactggatggttctgaagctggcccattgaaagagcctcttaaggcagctgggacagaggcctggtggccctgctgggcagcccaactgctgggggagacgtttctgccaccctgggtgatgagcagcttttcccccctggctttctgggggaggagtgggcctccttagggagacaggtgaccctgggtgccacccctgccccgtgtgtgccccgggtgttctcagtggttgctgaaggcaggtagagggtgctgtccagtatcccccatgtgaaggtcacttcccttctcatggagtcagctgagcatcagctcagccctgccatgtccccactcaccctcctcgcctcctgtccggccctgggtttctagcggtgcctgaggcatcactctggcccattgacagatgagaggtctgaagccttcctggccacaggcatcactttctcctcctcctcatgccctgccttgtccttgtcgtgttgccatggggttctgagaggctgggagttcacagacctcagacacagctgagtccgacaaccattggggtggggctgcatcagtctccggagtggcccgccacctcctgaagcagggcctggcccacccaaggtgcctggggcaggcgggcaccgtcattcgctgccattggcttctcagatgtatttcaaggactaaagtgggctctaagatctaagatggcccggcgcggtggctcccgcctgtaatcccagcactttgggaggccgaggcgggcggatgagttgaggtcgggagtttgagtccccgtctctactaaaaatacaaaattagccggacaaggtggcgcatgcctataatcccaggtactcaggaggctgaggcaggagaatcacttgaacctgggaggcagaggttgcagtgagccaagattgtgccactgcactccagcctgagcaacaaaagcaaaactctatctttaaaaaaaaaaaaaaaaaaactaagatacccattctttctgcctttgcccaggatggaggctttgaagacaggtggtcacctggacctggggtaagggtgcgcagggaggccgggcttgggggcagcctgctgctatgtccttgctggcgcccatacctgttggactgcctgaactttgctactagcctgaacgacagtgccttggaaaggcaggctccatgcggcacaacaggattgtcttcggtaccttaaatatgctccctgtgcttccccagggaggatctctgggagcagagggcggctgtagacatcacagctgaagaggtgacctcaggccctgggagcctcagctccctctgccctgtaccctaggcacgtggctccagcaagagccccaggcaggacaaagggagcaggcagcagctgcagaaacagccctagacaggtgctggcctcaaccctggcaggggagggggagcccagagtgatgtttctcctaaggccaaaccccaggggtgggtcatttgagaggagttccagctgttctggccacactgggctggtggggaaggagcggcggcctctttccttggagggtccctgattcctgaggatcctccccgagccaggcacgggggaccacagggctgccgtgagcacccaccctggttctccaggcccctctgtccagaggcagggcctgaacctcgggctcctgcctggaccagtgacagcattggggagagaagcactgggggtcttcagaccagccagcaaggggccgtgccagtgcccagagagcaggtcagacaacaggcaaccctgaggcagctggctccctctctctgccctgcagggcttgccgcagggcgtgaggctccccagccacagccccctcttacttgccttaaaactggagagaggaatctagtatttgcacttagcaaaatatttaaaaactgaaaaaaatgtgcatgatctgtcactttgtataaaaacaagaaacgattagttcattaaactttttctttaccttctggtagtaaaaatagataaaataattccgtttcaactactgtgtgtaaaaagcctgtatcatatgtaactgggacttttgtaaataaatgtttgtgcgctctgctc

SEQ ID NO: 417891 - DNA, 3938 bp, Homo sapiens
ggcaaatttttgtatttttagtagagacagtttcaccatgttggtcaggctggtctcaaactcctgagctcaaatgatcttcctgctttggcctctcaaagttctgggattacaggcgtgcaccaccatgctcagcctgttctctccattttaagcctacagggattcctataacaaatagagcagtccttttctaaatgctgagtactgggcactatgccagggtactttatattttgtctgtaattctcaaaacaccatgagaaagttgtgttttcacagtttaaaaatgaggaaactgagtctccaggcaggtgagtaatttactgaaggtcatacaattaaaactttgaagcagttctcagactccaaaacctaggctcttttcactgtttaatgtcacaaaaaagccataagtgatcattttatgtgaaaataaataaatgcttaatggccatatttttttcctcctcatcttccctcccagctccaaattatgttttcttatttcagtgaagaaaaaatgactgctgcccgcattagaaaatgccacaagtgtgggactggcctcatcaaatctgaaggctgcaaccgcatgtcttgccgctgtggtgcccagatgtgctacctctgtcgagtttctattaatggatatgaccatttctgccaacatccccgctcaccaggagccccttgccaggagtgttcaagatgctctctctggaccgatcccactgaagatgatgagaagcttattgaggaaatccagaaggaggctgaagaggaacagaaaagaaagaatggagagaacaccttcaaacgcattggacccccgctggagaagcctgtggagaaggtgcagagggtggaggccctcccgaggcccgttccgcagaacctgccacagccacagatgccaccctatgccttcgcgcacccacccttccccctgcctcccgtgcggcctgtgttcaacaacttcccactcaacatggggcctatcccagccccgtacgtgccccctctgcccaacgtgcgggtcaactatgacttcggtcccatccacatgcccctggagcacaacctgcccatgcactttggcccccagccgcggcatcgcttctgatggccccgaatccccattgagcagcacaaagcccgtttggggtaggagtgtggatggagaaccctcccccaaggctggtgtctgtaccattgcatcctaagtcagcttgaagggtaggctggttttcttcccacccctttcctagaagggctactgctcctggaagagtggacggatccataataaagacgtcccaaatggtggagttcggagagagctgcgatgtgaactgcccctcccctcgcatcccccaggccaccaacggcagtccttctgccttgtccatggcataggccatagaccaggtccctgctgctcacacctgggcctctcctcggagccgacccctgggtagcaaggcagccgagagcatctccctggaggggcccacggttgggccaagggcagagggggctgcacctgcgggcctgggaagcattgctcagggtggggggctgggaccatggcccgcagaggcactgccacagctgtgagggccaagatgctgtccccccatccaaaacccgtgcgccactgcagtgagtgttgagggcacctctcctcccctcttacacctactcagatgaggcagcagcagacccatctcgcggcgggggttttgttctgttgccgcctaactttctcatcctcggtctctggaaagtcaggctgagaaatcctttcccaggccaggccgctgcggtacactggatggttctgaagctggcccattgaaagagcctcttaaggcagctgggacagaggcctggtggccctgctgggcagcccaactgctgggggagacgtttctgccaccctgggtgatgagcagcttttcccccctggctttctgggggaggagtgggcctccttagggagacaggtgaccctgggtgccacccctgccccgtgtgtgccccgggtgttctcagtggttgctgaaggcaggtagagggtgctgtccagtatcccccatgtgaaggtcacttcccttctcatggagtcagctgagcatcagctcagccctgccatgtccccactcaccctcctcgcctcctgtccggccctgggtttctagcggtgcctgaggcatcactctggcccattgacagatgagaggtctgaagccttcctggccacaggcatcactttctcctcctcctcatgccctgccttgtccttgtcgtgttgccatggggttctgagaggctgggagttcacagacctcagacacagctgagtccgacaaccattggggtggggctgcatcagtctccggagtggcccgccacctcctgaagcagggcctggcccacccaaggtgcctggggcaggcgggcaccgtcattcgctgccattggcttctcagatgtatttcaaggactaaagtgggctctaagatctaagatggcccggcgcggtggctcccgcctgtaatcccagcactttgggaggccgaggcgggcggatgagttgaggtcgggagtttgagtccccgtctctactaaaaatacaaaattagccggacaaggtggcgcatgcctataatcccaggtactcaggaggctgaggcaggagaatcacttgaacctgggaggcagaggttgcagtgagccaagattgtgccactgcactccagcctgagcaacaaaagcaaaactctatctttaaaaaaaaaaaaaaaaaaactaagatacccattctttctgcctttgcccaggatggaggctttgaagacaggtggtcacctggacctggggtaagggtgcgcagggaggccgggcttgggggcagcctgctgctatgtccttgctggcgcccatacctgttggactgcctgaactttgctactagcctgaacgacagtgccttggaaaggcaggctccatgcggcacaacaggattgtcttcggtaccttaaatatgctccctgtgcttccccagggaggatctctgggagcagagggcggctgtagacatcacagctgaagaggtgacctcaggccctgggagcctcagctccctctgccctgtaccctaggcacgtggctccagcaagagccccaggcaggacaaagggagcaggcagcagctgcagaaacagccctagacaggtgctggcctcaaccctggcaggggagggggagcccagagtgatgtttctcctaaggccaaaccccaggggtgggtcatttgagaggagttccagctgttctggccacactgggctggtggggaaggagcggcggcctctttccttggagggtccctgattcctgaggatcctccccgagccaggcacgggggaccacagggctgccgtgagcacccaccctggttctccaggcccctctgtccagaggcagggcctgaacctcgggctcctgcctggaccagtgacagcattggggagagaagcactgggggtcttcagaccagccagcaaggggccgtgccagtgcccagagagcaggtcagacaacaggcaaccctgaggcagctggctccctctctctgccctgcagggcttgccgcagggcgtgaggctccccagccacagccccctcttacttgccttaaaactggagagaggaatctagtatttgcacttagcaaaatatttaaaaactgaaaaaaatgtgcatgatctgtcactttgtataaaaacaagaaacgattagttcattaaactttttctttaccttctggtagtaaaaatagataaaataattccgtttcaactactgtgtgtaaaaagcctgtatcatatgtaactgggacttttgtaaataaatgtttgtgcgctctgctc

SEQ ID NO: 417892 - DNA, 417 bp, Homo sapiens
ggtctcactctgttgcccaggctggtctcaaactcctggcctgccacagccttccaaagtgctggtactacaggcgtcagccacctagccctaccacctcttaacctcttctattaaaagatgtctttagaaatatcccccctgaaaaggagaggcatcctctgaaagaattcaagccaagtaaagctcatttcatatcccttttgttgaacaggaacttctgtggtgtccactcaccaggagttgtctttgtgtctgtcctttatccccaggaaacctgtaggaagtgtcagggactctggaaagaacataatggcctcacctgtgaagagctggctgaaaaagacgacatcaagtaccgtacctctatgtgagtaacagaattcagaggggctatgggctgattctcaacttccc

SEQ ID NO: 417893 - DNA, 294 bp, Homo sapiens
tggtttcttgcagtggcatttgggaggtgtccacgttttgtgctttgatcagcatgtggagccactcccgtgtccagaggtcgctgccctggtcccaggctagattccattgaggttggtttaatgtttttctccactaatccccacatccctttcagagaacaccttcaaacgcattggacccccgctggagaagcctgtggagaaggtgcagagggtggaggccctcccgaggcccgttccgcagaacctgccacagccacagatgccaccctatgccttcgcgcacccacc

SEQ ID NO: 417894 - DNA, 164 bp, Homo sapiens
gtgacataaaaatagaaaagaggatgttctttcttgaaaataagcgacgacattgtaggtcctatgaccgacgtgctctccttccagctgtgcaacaagagcaggagttctatgagcagaaaatcaaagagatggcagaggtaggaagatgtgctctggtcttg

SEQ ID NO: 417895 - DNA, 6025 bp, Homo sapiens
cgcggagggccggaaggagtgcagcggctgccacggagctcgcagctgcggcttctgaggagtaagcggcgcggtagcgaaggccgccgaacctgcctggctagccggcgacttgagtgacgactcttttgaaacagatggtcaccatgtttagatattagcagtcccatatatgcatgtctgcatttgaaaatggaagagggaaacaacaatgaagaggtaattcacttgaacaactttcactgccatcggggacaagagtggatcaatctccgagatgggcccatcaccatatctgactcctcagatgaggaaaggattccaatgctggtcaccccagctcctcagcagcatgaagaagaggacctggatgatgatgtcatcctgacagaagatgattctgaggatgactacggtgaatttctggatcttgggcctcctggaatctctgaattcactaagccaagtggccaaacagaaagagaacccaagcctggaccgagtcataaccaagcagcaaatgacattgtcaaccccagatcagagcagaaagtcatcatcttggaagaaggtagccttctttacacagaaagcgatcctttggaaactcagaaccagtcatccgaagactcagagacagagctgttatcaaatctaggagagtcagctgctctagcagatgatcaggccatcgaagaagactgctggttagatcatccttacttccagtctctgaaccaacagccccgtgaaataacaaaccaggtcgttcctcaggaacggcagcctgaagcagaactgggccgcttgttgtttcagcatgaattcccagggcccgcttttccaaggccggaaccccagcaaggtgggatttcaggcccctcttctcctcagcctgcccatcctctaggagagtttgaagaccagcagttagcaagtgatgatgaagagccaggtccagcctttccaatgcaagaatctcaagagcccaatttggaaaacatttgggggcaagaagctgcagaggtagatcaagagctcgttgaactactagtgaaagaaacggaagcaagatttccagatgtagcaaatgggtttattgaggaaataattcattttaagaattattatgatctgaatgtactttgtaattttcttctggaaaacccagattatccaaagagagaagacagaatcattataaatcccagtagcagtctgctggccagccaagatgagacaaagttgcctaaaatagacttttttgactattctaaattgacccctcttgaccagcgctgcttcatccaagctgctgacctcctcatggccgacttcaaagtgctcagtagtcaggacatcaagtgggccctgcacgagctcaaaggacactatgcaatcacccgaaaggccttgtctgatgccattaaaaaatggcaggagctgtcaccagaaaccagtggaaaaaggaagaagagaaaacaaatgaaccagtattcttacattgatttcaagtttgaacaaggtgacataaaaatagaaaagaggatgttctttcttgaaaataagcgacgacattgtaggtcctatgaccgacgtgctctccttccagctgtgcaacaagagcaggagttctatgagcagaaaatcaaagagatggcagagcatgaagactttttgcttgccctacagatgaatgaagaacagtatcaaaaggatggccagctgattgagtgtcgctgctgctatggggaatttccattcgaggagctgacgcagtgcgcagatgctcacttgttctgcaaagagtgtctcatcagatatgcccaagaggcagtctttggatctggaaagttggagctcagctgcatggaaggcagctgcacgtgttcgttcccaaccagtgagctggagaaggtgctcccccagaccatcctgtataagtactatgagcgaaaagccgaggaggaggttgcggcagcctacgccgacgagcttgtcaggtgcccgtcctgtagctttccggctctgttggacagtgatgtgaagaggttcagctgtcctaatcctcactgccgaaaggaaacctgtaggaagtgtcagggactctggaaagaacataatggcctcacctgtgaagagctggctgaaaaagacgacatcaagtaccgtacctctattgaagaaaaaatgactgctgcccgcattagaaaatgccacaagtgtgggactggcctcatcaaatctgaaggctgcaaccgcatgtcttgccgctgtggtgcccagatgtgctacctctgtcgagtttctattaatggatatgaccatttctgccaacatccccgctcaccaggagccccttgccaggagtgttcaagatgctctctctggaccgatcccactgaagatgatgagaagcttattgaggaaatccagaaggaggctgaagaggaacagaaaagaaagaatggagagaacaccttcaaacgcattggacccccgctggagaagcctgtggagaaggtgcagagggtggaggccctcccgaggcccgttccgcagaacctgccacagccacagatgccaccctatgccttcgcgcacccacccttccccctgcctcccgtgcggcctgtgttcaacaacttcccactcaacatggggcctatcccagccccgtacgtgccccctctgcccaacgtgcgggtcaactatgacttcggtcccatccacatgcccctggagcacaacctgcccatgcactttggcccccagccgcggcatcgcttctgatggccccgaatccccattgagcagcacaaagcccgtttggggtaggagtgtggatggagaaccctcccccaaggctggtgtctgtaccattgcatcctaagtcagcttgaagggtaggctggttttcttcccacccctttcctagaagggctactgctcctggaagagtggacggatccataataaagacgtcccaaatggtggagttcggagagagctgcgatgtgaactgcccctcccctcgcatcccccaggccaccaacggcagtccttctgccttgtccatggcataggccatagaccaggtccctgctgctcacacctgggcctctcctcggagccgacccctgggtagcaaggcagccgagagcatctccctggaggggcccacggttgggccaagggcagagggggctgcacctgcgggcctgggaagcattgctcagggtggggggctgggaccatggcccgcagaggcactgccacagctgtgagggccaagatgctgtccccccatccaaaacccgtgcgccactgcagtgagtgttgagggcacctctcctcccctcttacacctactcagatgaggcagcagcagacccatctcgcggcgggggttttgttctgttgccgcctaactttctcatcctcggtctctggaaagtcaggctgagaaatcctttcccaggccaggccgctgcggtacactggatggttctgaagctggcccattgaaagagcctcttaaggcagctgggacagaggcctggtggccctgctgggcagcccaactgctgggggagacgtttctgccaccctgggtgatgagcagcttttcccccctggctttctgggggaggagtgggcctccttagggagacaggtgaccctgggtgccacccctgccccgtgtgtgccccgggtgttctcagtggttgctgaaggcaggtagagggtgctgtccagtatcccccatgtgaaggtcacttcccttctcatggagtcagctgagcatcagctcagccctgccatgtccccactcaccctcctcgcctcctgtccggccctgggtttctagcggtgcctgaggcatcactctggcccattgacagatgagaggtctgaagccttcctggccacaggcatcactttctcctcctcctcatgccctgccttgtccttgtcgtgttgccatggggttctgagaggctgggagttcacagacctcagacacagctgagtccgacaaccattggggtggggctgcatcagtctccggagtggcccgccacctcctgaagcagggcctggcccacccaaggtgcctggggcaggcgggcaccgtcattcgctgccattggcttctcagatgtatttcaaggactaaagtgggctctaagatctaagatggcccggcgcggtggctcccgcctgtaatcccagcactttgggaggccgaggcgggcggatgagttgaggtcgggagtttgagtccccgtctctactaaaaatacaaaattagccggacaaggtggcgcatgcctataatcccaggtactcaggaggctgaggcaggagaatcacttgaacctgggaggcagaggttgcagtgagccaagattgtgccactgcactccagcctgagcaacaaaagcaaaactctatctttaaaaaaaaaaaaaaaaaaactaagatacccattctttctgcctttgcccaggatggaggctttgaagacaggtggtcacctggacctggggtaagggtgcgcagggaggccgggcttgggggcagcctgctgctatgtccttgctggcgcccatacctgttggactgcctgaactttgctactagcctgaacgacagtgccttggaaaggcaggctccatgcggcacaacaggattgtcttcggtaccttaaatatgctccctgtgcttccccagggaggatctctgggagcagagggcggctgtagacatcacagctgaagaggtgacctcaggccctgggagcctcagctccctctgccctgtaccctaggcacgtggctccagcaagagccccaggcaggacaaagggagcaggcagcagctgcagaaacagccctagacaggtgctggcctcaaccctggcaggggagggggagcccagagtgatgtttctcctaaggccaaaccccaggggtgggtcatttgagaggagttccagctgttctggccacactgggctggtggggaaggagcggcggcctctttccttggagggtccctgattcctgaggatcctccccgagccaggcacgggggaccacagggctgccgtgagcacccaccctggttctccaggcccctctgtccagaggcagggcctgaacctcgggctcctgcctggaccagtgacagcattggggagagaagcactgggggtcttcagaccagccagcaaggggccgtgccagtgcccagagagcaggtcagacaacaggcaaccctgaggcagctggctccctctctctgccctgcagggcttgccgcagggcgtgaggctccccagccacagccccctcttacttgccttaaaactggagagaggaatctagtatttgcacttagcaaaatatttaaaaactgaaaaaaatgtgcatgatctgtcactttgtataaaaacaagaaacgattagttcattaaactttttctttaccttctggtagtaaaaatagataaaataattccgtttcaactactgtgtgtaaaaagcctgtatcatatgtaactgggacttttgtaaataaatgtttgtgcgctctgctccctccagcttcgtctctccaccccgccatccggcaagttacaggggccgccgacagattcgtccaagtgattgggtctaaaccagcatcctcacctccccgactgggtcctggcaggagcaggcccggaaggcccagtagtaagatccccaccactcccctgccagggaggaagatcaggtgatctgctaggcaaatcccgctagggcggctaccaaggcccacattgggcacaaagggtctatctgtttttggcacagaatcccctgcaagaaaggtgcagtcggtttcttttgcaggccccttccccagtctgcccacctaaaggtcaagtaaaccaggagaagcctcgcccagctgaggaggggacaaggttccaaggacaggaagtgcctgggctgagaggccatggcatttgagt

SEQ ID NO: 417896 - DNA, 2998 bp, Homo sapiens
cgcggagggccggaaggagtgcagcggctgccacggagctcgcagctgcggcttctgaggagtaagcggcgcggtagcgaaggccgccgaacctgcctggctagccggcgacttgagtgacgactcttttgaaacagatggtcaccatgtttagatattagcagtcccatatatgcatgtctgcatttgaaaatggaagagggaaacaacaatgaagaggtaattcacttgaacaactttcactgccatcggggacaagagtggatcaatctccgagatgggcccatcaccatatctgactcctcagatgaggaaaggattccaatgctggtcaccccagctcctcagcagcatgaagaagaggacctggatgatgatgtcatcctgacagaagatgattctgaggatgactacggtgaatttctggatcttgggcctcctggaatctctgaattcactaagccaagtggccaaacagaaagagaacccaagcctggaccgagtcataaccaagcagcaaatgacattgtcaaccccagatcagagcagaaagtcatcatcttggaagaaggtagccttctttacacagaaagcgatcctttggaaactcagaaccagtcatccgaagactcagagacagagctgttatcaaatctaggagagtcagctgctctagcagatgatcaggccatcgaagaagactgctggttagatcatccttacttccagtctctgaaccaacagccccgtgaaataacaaaccaggtcgttcctcaggaacggcagcctgaagcagaactgggccgcttgttgtttcagcatgaattcccagggcccgcttttccaaggccggaaccccagcaaggtgggatttcaggcccctcttctcctcagcctgcccatcctctaggagagtttgaagaccagcagttagcaagtgatgatgaagagccaggtccagcctttccaatgcaagaatctcaagagcccaatttggaaaacatttgggggcaagaagctgcagaggtagatcaagagctcgttgaactactagtgaaagaaacggaagcaagatttccagatgtagcaaatgggtttattgaggaaataattcattttaagaattattatgatctgaatgtactttgtaattttcttctggaaaacccagattatccaaagagagaagacagaatcattataaatcccagtagcagtctgctggccagccaagatgagacaaagttgcctaaaatagacttttttgactattctaaattgacccctcttgaccagcgctgcttcatccaagctgctgacctcctcatggccgacttcaaagtgctcagtagtcaggacatcaagtgggccctgcacgagctcaaaggacactatgcaatcacccgaaaggccttgtctgatgccattaaaaaatggcaggagctgtcaccagaaaccagtggaaaaaggaagaagagaaaacaaatgaaccagtattcttacattgatttcaagtttgaacaaggtgacataaaaatagaaaagaggatgttctttcttgaaaataagcgacgacattgtaggtcctatgaccgacgtgctctccttccagctgtgcaacaagagcaggagttctatgagcagaaaatcaaagagatggcagagcatgaagactttttgcttgccctacagatgaatgaagaacagtatcaaaaggatggccagctgattgagtgtcgctgctgctatggggaatttccattcgaggagctgacgcagtgcgcagatgctcacttgttctgcaaagagtgtctcatcagatatgcccaagaggcagtctttggatctggaaagttggagctcagctgcatggaaggcagctgcacgtgttcgttcccaaccagtgagctggagaaggtgctcccccagaccatcctgtataagtactatgagcgaaaagccgaggaggaggttgcggcagcctacgccgacgagcttgtcaggtgcccgtcctgtagctttccggctctgttggacagtgatgtgaagaggttcagctgtcctaatcctcactgccgaaaggaaacctgtaggaagtgtcagggactctggaaagaacataatggcctcacctgtgaagagctggctgaaaaagacgacatcaagtaccgtacctctattgaagaaaaaatgactgctgcccgcattagaaaatgccacaagtgtgggactggcctcatcaaatctgaaggctgcaaccgcatgtcttgccgctgtggtgcccagatgtgctacctctgtcgagtttctattaatggatatgaccatttctgccaacatccccgctcaccaggagccccttgccaggagtgttcaagatgctctctctggaccgatcccactgaagatgatgagaagcttattgaggaaatccagaaggaggctgaagaggaacagaaaagaaagaatggagagaacaccttcaaacgcattggacccccgctggagaagcctgtggagaaggtgcagagggtggaggccctcccgaggcccgttccgcagaacctgccacagccacagatgccaccctatgccttcgcgcacccacccttccccctgcctcccgtgcggcctgtgttcaacaacttcccactcaacatggggcctatcccagccccgtacgtgccccctctgcccaacgtgcgggtcaactatgacttcggtcccatccacatgcccctggagcacaacctgcccatgcactttggcccccagccgcggcatcgcttctgatggccccgaatccccattgagcagcacaaagcccgtttggggtaggagtgtggatggagaaccctcccccaaggctggtgtctgtaccattgcatcctaagtcagcttgaagggtaggctggttttcttcccacccctttcctagaagggctactgctcctggaagagtggacggatccataataaagacgtcccaaatggtgga

SEQ ID NO: 417897 - DNA, 3968 bp, Homo sapiens
cgcggagggccggaaggagtgcagcggctgccacggagctcgcagctgcggcttctgaggagtaagcggcgcggtagcgaaggccgccgaacctgcctggctagccggcgacttgagtgacgactcttttgaaacagatggtcaccatgtttagatattagcagtcccatatatgcatgtctgcatttgaaaatggaagagggaaacaacaatgaagaggtaattcacttgaacaactttcactgccatcggggacaagagtggatcaatctccgagatgggcccatcaccatatctgactcctcagatgaggaaaggattccaatgctggtcaccccagctcctcagcagcatgaagaagaggacctggatgatgatgtcatcctgacagaagatgattctgaggatgactacggtgaatttctggatcttgggcctcctggaatctctgaattcactaagccaagtggccaaacagaaagagaacccaagcctggaccgagtcataaccaagcagcaaatgacattgtcaaccccagatcagagcagaaagtcatcatcttggaagaaggtagccttctttacacagaaagcgatcctttggaaactcagaaccagtcatccgaagactcagagacagagctgttatcaaatctaggagagtcagctgctctagcagatgatcaggccatcgaagaagactgctggttagatcatccttacttccagtctctgaaccaacagccccgtgaaataacaaaccaggtcgttcctcaggaacggcagcctgaagcagaactgggccgcttgttgtttcagcatgaattcccagggcccgcttttccaaggccggaaccccagcaaggtgggatttcaggcccctcttctcctcagcctgcccatcctctaggagagtttgaagaccagcagttagcaagtgatgatgaagagccaggtccagcctttccaatgcaagaatctcaagagcccaatttggaaaacatttgggggcaagaagctgcagaggtagatcaagagctcgttgaactactagtgaaagaaacggaagcaagatttccagatgtagcaaatgggtttattgaggaaataattcattttaagaattattatgatctgaatgtactttgtaattttcttctggaaaacccagattatccaaagagagaagacagaatcattataaatcccagtagcagtctgctggccagccaagatgagacaaagttgcctaaaatagacttttttgactattctaaattgacccctcttgaccagcgctgcttcatccaagctgctgacctcctcatggccgacttcaaagtgctcagtagtcaggacatcaagtgggccctgcacgagctcaaaggacactatgcaatcacccgaaaggccttgtctgatgccattaaaaaatggcaggagctgtcaccagaaaccagtggaaaaaggaagaagagaaaacaaatgaaccagtattcttacattgatttcaagtttgaacaaggtgacataaaaatagaaaagaggatgttctttcttgaaaataagcgacgacattgtaggtcctatgaccgacgtgctctccttccagctgtgcaacaagagcaggagttctatgagcagaaaatcaaagagatggcagagcatgaagactttttgcttgccctacagatgaatgaagaacagtatcaaaaggatggccagctgattgagtgtcgctgctgctatggggaatttccattcgaggagctgacgcagtgcgcagatgctcacttgttctgcaaagagtgtctcatcagatatgcccaagaggcagtctttggatctggaaagttggagctcagctgcatggaaggcagctgcacgtgttcgttcccaaccagtgagctggagaaggtgctcccccagaccatcctgtataagtactatgagcgaaaagccgaggaggaggttgcggcagcctacgccgacgagcttgtcaggtgcccgtcctgtagctttccggctctgttggacagtgatgtgaagaggttcagctgtcctaatcctcactgccgaaaggaaacctgtaggaagtgtcagggactctggaaagaacataatggcctcacctgtgaagagctggctgaaaaagacgacatcaagtaccgtacctctattgaagaaaaaatgactgctgcccgcattagaaaatgccacaagtgtgggactggcctcatcaaatctgaaggctgcaaccgcatgtcttgccgctgtggtgcccagatgtgctacctctgtcgagtttctattaatggatatgaccatttctgccaacatccccgctcaccaggagccccttgccaggagtgttcaagatgctctctctggaccgatcccactgaagatgatgagaagcttattgaggaaatccagaaggaggctgaagaggaacagaaaagaaagaatggagagaacaccttcaaacgcattggacccccgctggagaagcctgtggagaaggtgcagagggtggaggccctcccgaggcccgttccgcagaacctgccacagccacagatgccaccctatgccttcgcgcacccacccttccccctgcctcccgtgcggcctgtgttcaacaacttcccactcaacatggggcctatcccagccccgtacgtgccccctctgcccaacgtgcgggtcaactatgacttcggtcccatccacatgcccctggagcacaacctgcccatgcactttggcccccagccgcggcatcgcttctgatggccccgaatccccattgagcagcacaaagcccgtttggggtaggagtgtggatggagaaccctcccccaaggctggtgtctgtaccattgcatcctaagtcagcttgaagggtaggctggttttcttcccacccctttcctagaagggctactgctcctggaagagtggacggatccataataaagacgtcccaaatggtggagttcggagagagctgcgatgtgaactgcccctcccctcgcatcccccaggccaccaacggcagtccttctgccttgtccatggcataggccatagaccaggtccctgctgctcacacctgggcctctcctcggagccgacccctgggtagcaaggcagccgagagcatctccctggaggggcccacggttgggccaagggcagagggggctgcacctgcgggcctgggaagcattgctcagggtggggggctgggaccatggcccgcagaggcactgccacagctgtgagggccaagatgctgtccccccatccaaaacccgtgcgccactgcagtgagtgttgagggcacctctcctcccctcttacacctactcagatgaggcagcagcagacccatctcgcggcgggggttttgttctgttgccgcctaactttctcatcctcggtctctggaaagtcaggctgagaaatcctttcccaggccaggccgctgcggtacactggatggttctgaagctggcccattgaaagagcctcttaaggcagctgggacagaggcctggtggccctgctgggcagcccaactgctgggggagacgtttctgccaccctgggtgatgagcagcttttcccccctggctttctgggggaggagtgggcctccttagggagacaggtgaccctgggtgccacccctgccccgtgtgtgccccgggtgttctcttacttgccttaaaactggagagaggaatctagtatttgcacttagcaaaatatttaaaaactgaaaaaaatgtgcatgatctgtcactttgtataaaaacaagaaacgattagttcattaaactttttctttaccttctggtagtaaaaatagataaaataattccgtttcaactactgtgtgtaaaaagcctgtatcatatgtaactgggacttttgtaaataaatgtttgtgcgctctgctc

SEQ ID NO: 417898 - DNA, 968 bp, Homo sapiens
ttagatttttctatctacatattggagataagtttaaattttgtgttagtgtttgggtattacttcctgccaacgtgaaaagttaacctttctaagacaatctctactaatttggactttttcaagatttttgcctacttctttcaaagagattgcaaaacgattttaactcactaaagaacatttttcacctcttgattgtccagtacaagtgtagtacagttctttttttatgtatcctccctttgtttttatagactggaaggtatccagaaataaggcattcagaaatggaggcacacatagatgaaggcaaaggccattcctatgaaggcaggtctgtaggcagctggttatttgtttttctcagcctctcttggcattctaccttcatctggaaaaaaatttaaaaagggaggatactttataggtcctgtctcaagtatctgacttccctgggaagcttgattctcacattcaaaatacatggggagtttggttcagttaaattttatcacaccagaattgttgaaaagcaataaattattactgtataattggtgcctgtttgttatcttaggtattgttatttctgtttttaacttgtttggaaaaccatagaccataaactttttctgaacgttcgatgcagagctccaaccgaactagcaaagaacatttcctcaaagaaacggagtatttttttctgtaacaatgtaactttctgtctttcattcttcaaaatgtatcactataaatttcctacaaaaagagctatttcttctctcagtatcatacagattgatttgtatagatgtatatgtatggctgttaaattgtttgttggtataaaatggtgagtgtcagtataataatgatgataataaatagcggctaacatttaaagcgcatactctgttccaggcaccgttgtaagcattttacatcgagttgctcaatctaaaacc

SEQ ID NO: 417899 - DNA, 535 bp, Homo sapiens
gcttaccctgcttctctgttggctctgattctccatcacagagcctagtatacagtattggcttaatgaacagccagtggattagaatgtacaacatatatataacgccctgacagttgccaaagtctcatgcaatgcaatgacctggagaggtagtactgacactattaccatttaacagaagaggttaagtctttcgcccaagttaaaaaaaatagttagctaagggtagagccaagaagtgaaccaggttcttttacagcaaattctttgttctttgtcgtaataccactctacacaaaaggctacagaacagacatccaggtgggggcgagagacgtcatcatcttgtctccttcagactgagctccaagaaacccatcacattacccagctgcacagccccattcctccccatttttccttcctatacctcaatcatatagtgcagaaaccccaaagccagcaaaagagcctactcttactgtcagaaacagctgcactctgccagcctgtaacatgatggctccagtgt

SEQ ID NO: 417900 - DNA, 587 bp, Homo sapiens
cagtaggacactcatatgaaaagccaactttgttcctcagttatcaagataagaaacctgtcatttctctcattcactctgtcagccttgagatactccaagcagacttacctctgtgttgtacaccccatatatcaggaagatgaagagaccctgtaaaataaaatggaggggaaaagctgttaacgctaatcatttcagcagtagaaatacctgaaataaactttcctgggaacagacaaaagaagacacacttcatcaaggtcaatttattttcctatttttcaacattagaaggtgtaccttgagcatttatatgataacatagcaagcacatcacttataatggttgtgctattcaattctttagaagtacaaaataaaaataccatcccaagtacaaagaatattaattagaaaaatcaatataccagttctgaaagatagctgggtaatgaaaaaattaaactcaggaaatgttattaaagtaatcatagaaataacactaagcatcagtatttccaagcactgttttagactgtagcaactagaatatatttgttacaatcttcaacagggttaaaatt

SEQ ID NO: 417901 - DNA, 439 bp, Homo sapiens
accctcccgctggttctgccatgcaaatgcaacgtgaccccatggctgcctgtgagctggaggctgcacgggagctgcttctgccatcagacaaacacacggctgagcccagggcagagtccctccccgttccctcttgcggctggagccctggctgatgaagctgccttaacgggcaggtgctggggggcagatcctgcagggaacatggtgaggcaccttgaagactccgccccctgatcgggatctggcagcctctgcttccaagagagacaggcagtgcctgggcagtactcagggaggggcgcttcccccagctcagcaactgccctgggaggggacagccccaaaggactaattgttcacacttgggtgagctgtttctaaacacctcatcttttatttctctttctttaacaatatagacaaattcagtaag

SEQ ID NO: 417902 - DNA, 815 bp, Homo sapiens
gattaatttctgtaatcctgccaaaaatatatggcctgaatctaatcatgagaaaacatcagacaatcccaaactgaagcaagttttccaaaataactcatctgtacatcttcaaaagcataaagatcatgaaagtccaggaaagatggaggggctgttctagattgagggaggctgaagagacaatattataactaaatgcaacatgcaatcctggactgggtccttttgctataaaggaccaaataatgaaacctgaatggagcctgaggattagataatccattgatgtggaataaggcatcaacgtaaatttcctgattctgatggtttatgattatcatgtaggagaatgtccttgtagaaattactgaagtattcaggggtcatagaacatcatgccaacaacttactctcaagtaaaataggaaaaaataaattatttgtactatgcttgccacttttctgcaagtttgaaattacttcaaagtaaaaaaaaaaaaaaaatactggcatggtagctcacacctgtaatcccactattttgggaggcaaaggcaggcggatcacttgaggtcaggagtttgagaccagcctagccaactggtgaaactccatctctactaaaaatacaaaaattagccaggcattgtggcatatgcctgtaatcccagatactcaggaggctgaggcaggagaatcacttgaacccgggaggtggaggatgcagtgggccgagatcacgccactgcattccagcctggacaacagagggagactccgtctcaaaacgaaccaacgaaccaacaaaccaa

SEQ ID NO: 417903 - DNA, 1557 bp, Homo sapiens
  misc_feature (780)..(780): n is a, c, g, or t
  misc_feature (1000)..(1000): n is a, c, g, or t
gtaagtctaagtgataaaggtatcttctggaaataactgagtaacacattgagaacatttcgacaaaattgaaagtggaaatgctctggggcaacatatttttttgcacctatcactgtttgaaagagaagctatagcaaatggatgactgggtgagtcactggaatgatggatcttaggggcccaggggtagcagagtgggaaaggctgcacccatgctctggagggtaggaggattgttatatgggactcacagcacaaacacgtgtggatgcagtgattgtcaaatgatccaagggcatgtcttgttgctcctattttttttttcctgtctgaatggaaaacagcaatttcctccattcctggttattgcagatgatctgataatttaacctgagagccgttatttcattttattttattttaaaactcaaaagaagtatactgttctcatcttaaacagtgagatgtctggtctttaatattactctttcttaacatacaataagctagcagtgtggtgatgacatgtagatacctcctaatgtgccataaaatcaaggcatgcattttaaaatgtttcgtgcccagaaatccaaacttttatagttgttgagcagccatcttcatatggtctgttctgaattcttaaaacctgcaggagctcatcagcctaacctggccccttccagctcatccccatgtcctattttgctatatttgagcataacaagattttatctcttcctttttaaaaattaattacctaataaatatgancaaaaattgttaaataattttttaattacctaataaatgtgaccacaaatattaaataaaattatatagattaaaatgctgacgttctcttctcccccatcctattcccttgcctagaaggaacttctgtataaaaaacttgctgggtatccttttagaaattttatggtatattaatcttgtatacatatacaactgtgggtacctatacaactatgtntctctttcttttaatacacttcaaattcttgctatataccataatatacttaaccatatctccatgatggacatttaaattgtttggagtttttggctattacaagcaatattgcagtaaacctgtttgtataatttttctgcacatactcctgtagaattactagaagtgccatttctgaataaaaaattgactagtattaccaagttaccctataaaatgcctaatcagtttatattctaacagggtatgaaagtgcccatttctagccaacattagataccctcagtctcatacttaagtattttttttcccctaatcagttagatgaaaggtgatttttttaactaacaattttctgattgaattttctgattgttccgtagcatttttttttcctaaggtattttagccatccttatttcttcttttcagaatggtatattcctgttgtatatccattttgatatcttaatgatttataaccctttataaaaatagaatgagtgctaatcctttgttatgtgtactacaaatacatatttttttccagtctg

SEQ ID NO: 417904 - DNA, 472 bp, Homo sapiens
gtgcatgccaccatgccctggctagttttgtattttttattgatgtggggtctcaccatgtagcctaggctggtctcaaactcctgtgctcaagcagtccgcctgccttggcctcccaaagtgttgggattacgggtgtgcaccaccatgcctggcctacatgcataatttaataaaactgagtactgtgtaatagtagtcttaaaatgaaaaagtaaaaggccattttggtagtgattatggtaaaaacataatacagttaacttttagaagtcttttattttgtatcacttcagttttctaatattagtgggaaaattttaggtggaattattaaacaacatgttattagtaaggtttaattattttacctccttttttaatacctaaaatgttacagaatcactcaaaacaatgttatagaaaaatagagtagaaatgaaaacttctatttggacaggactgcaccctc

SEQ ID NO: 417905 - DNA, 187 bp, Homo sapiens
aaactctgtctcaaaaataaataaataaataaataaataaactaataaataaataaatgaaagaatgaggctacaggaagagacagagtattttcctagacatctccgttaaagagaaacgatcacatgtttggcccctcttccacagtactaggaagccactccttctccccacagtgcaacaacc

SEQ ID NO: 417906 - DNA, 323 bp, Homo sapiens
aggggcaaattccacacatggagatcaacgggtgctcagaacttcctcttgttgtcagcgccgattaaacatcatctttgtgagctgtaggctgtgtagtgtgccaagaatggtacaggagggaatataggtcactagggctcaaaacacatctgtacacagacgcacataccttgttacagtataacatgctacacacatatacatgcttaaacgctaggttttcagaacactctcccatcctatttcagctctgccattttaaccctccagataattaagttaaaccccaagacttaaccagccccgcccccaccaccacc

SEQ ID NO: 417907 - DNA, 958 bp, Homo sapiens
agcggatgaggcacaaacctagcgccaaggttggctgtcaaggtagattccagggtgtggaagtggctttgtggtgccacctctaaccgctcggaggtcaacccccattctacaccgaaaactaggccttggctgctatggaaggacagcggcaagaaagccacgcaaccctaacactcgcccaggctcatttcaacaatggagagtacgcggaggccgaggcactgtactccgcttacattcgccggtgcgcttgcgcggcctccagcgacgagagtcccgggagcaaatgcagccctgaggatttggctactgcatataacaacagggggcaaatcaagtacttcagggttgatttttatgaagccatggatgactacacatctgccatagaagtccaacccaattttgaagttccatattacaacagagggttgatactgtataggctgggatattttgatgatgctttggaagatttcaagaaggtcttagacttaaatcctggatttcaagatgctactttgagcttaaaacagactattctagacaaagaagaaaaacaaagaagaaatgttgcaaaaaattattgatatttttaacttaatggaagtattgattcatgatccttacatctgcatctagttatcagtaatttagatattgagctattttgatttatatttaagaaattaatacattagcactgaaagttaaatagtgtgtttaaggtagttaatttcaggttgaatgggttttttttaatgaagtgtaaataataccaatgtataagtgtatattattatattaaatattatagtaaaaaggaatgtgtggtattttcttcagcaaaactatttttgtgatttttttattctcaactttttatttaaaaaatgttacatctgcagaaaagttgaaagtataataaactcttcagttaaattcatgagttgtt

SEQ ID NO: 417908 - DNA, 537 bp, Homo sapiens
ttctcttttccattttttgggttctggtacaggatattttgatgatgctttggaagatttcaagaaggtcttagacttaaatcctggatttcaagatgctactttgagcttaaaacagactattctagacaaagaagaaaaacaaagaagaaatgttgcaaaaaattattgatatttttaacttaatggaagtattgattcatgatccttacatctgcatctagttatcagtaatttagatattgagctattttgatttatatttaagaaattaatacattagcactgaaagttaaatagtgtgtttaaggtagttaatttcaggttgaatgggttttttttaatgaagtgtaaataataccaatgtataagtgtatattattatattaaatattatagtaaaaaggaatgtgtggtattttcttcagcaaaactatttttgtgatttttttattctcaactttttatttaaaaaatgttacatctgcagaaaagttgaaagtataataaactcttcagttaaattcatgagttgtt

SEQ ID NO: 417909 - DNA, 787 bp, Homo sapiens
  misc_feature (746)..(746): n is a, c, g, or t
tggggccgcggcgaccccgggtggaggcgacgttggggttgtttgggctcctatctttgcctctggagctcacggtcggcgcttgtcataacccagcactaggactgagcgggcggacgttcgtctttctagaaaggcctaggcgaggcctaggacgagggcggcggagaacgcggggagaagcccacccgtgaggagccagctgccgcgacgcaaatgcagccctgaggatttggctactgcatataacaacagggggcaaatcaagtacttcagggttgatttttatgaagccatggatgactacacatctgccatagaagtccaacccaattttgaagttccatattacaacagagggttgatactgtataggctgggatattttgatgatgctttggaagatttcaagaaggtcttagacttaaatcctggatttcaagatgctactttgagcttaaaacagactattctagacaaagaagaaaaacaaagaagaaatgttgcaaaaaattattgatatttttaacttaatggaagtattgattcatgatccttacatctgcatctagttatcagtaatttagatattgagctattttgatttatatttaagaaattaatacattagcactgaaagttaaatagtgtgtttaaggtagttaatttcaggttgaatgggttttttttaatgaagtgtaaataataccaatgtataagtgtatattattatatttattataggnggggggcccgggcccattcgcccatatagaggcgattacat

SEQ ID NO: 417910 - DNA, 1089 bp, Homo sapiens
gttttaagatcacttaaaaatttgagaatgaaattgattcacattgtgacatatccatagcaaactcgggctttgggctggctttccctctttgcttagtatttatctgttctgtcttctttgccctgctggtgtgtgcttagaaaaatgaacaatcattttaatgttatattcagcagaacaaattggcagtgaacacactgtaaagttagtatgcttttcaggttgacattgcagtggtataaccctacaaaagtagataacagggttaaacaaaaattgattttagctctttatttgtacgttttttcttcagcttggattttcagtgttgatgctgcatgttataggctgtgaagtttgacaatacccaaaagagaatgaaagtggaaatgagaggaatttggtaacacggtgtttttaatgtgaactttttgtttaaagcaaatgcagccctgaggatttggctactgcatataacaacagggggcaaatcaagtacttcagggttgatttttatgaagccatggatgactacacatctgccatagaagtccaacccaattttgaagttccatattacaacagagggttgatactgtataggctgggtaagaattttttttctttttgagttttgtcattgactgtattctgttatttcagagctttcaaatgttgtaaaactaacgtggtaatcaaattttaaagttctgtgaaatttaggtttagagcttggaacaaaggaagtgtccctgagtttattttaggcttttgataggcgttatagatcacagcagagcactggggtgggaattggacctgggcgcaggagcaggggtgaccccattactttgtgcttgtgcattcccagctgtgaaatgagggcaattcagatgttcacctgtgaaacttttctgagttaaaatctttgaagacacacaagacaatagaaagtgaagtttagattcttggattaaagggaccataggtagtgtttcttcatttaaagtgtcaaaaagaaaattagttcccgtttcttaattttactgcaattatgtaaaacaggtgatacagttttattaaaat

SEQ ID NO: 417911 - DNA, 847 bp, Homo sapiens
tggggccgcggcgaccccgggtggaggcgacgttggggttgtttgggctcctatctttgcctctggagctcacggtcggcgcttgtcataacccagcactaggactgagcgggcggacgttcgtctttctagaaaggcctaggcgaggcctaggacgagggcggcggagaacgcggggagaagcccacccgtgaggagccagctgccgcgacggtgcggagagatttccgggaaccaagccctctgcgcgatcctcgggcgcgggccgccgcctctcaccccgccgtctctccttccacgttcctcattcgcacccagagacttaggacagataggaattttccactcgtgattttagctggcgggaaatccgcgacctgggaagggaaggggtcacggctgcgtagggccacagtaccgcgactcccatctcagtgtcacggcgcaggctcttggtggtgtttttcacttgtgaaaaacgtttaaatatgtggaagagagcataacgaacgtctaggtgtttatcacttggcttaagcattatcagtttacctattgtattcatccatggatgtttcagaaggaaccaccatgtcatcatcacatagttacttaatatcaagtcgtcagtgttggaaccattctgatcgactaataaggtgttttgttctttggttcccttttcgcagttagttcaagtcaggatacacatcaagtctttttaagtctcttctccaccttcccctctttatttgttgaggaaaccgattcttgtgtcctttgaatttccgtgttttggacttgctgactgaatctcttctgtcgtttaatgtggtcatctgtctca

SEQ ID NO: 417912 - DNA, 885 bp, Homo sapiens
tggggccgcggcgaccccgggtggaggcgacgttggggttgtttgggctcctatctttgcctctggagctcacggtcggcgcttgtcataacccagcactaggactgagcgggcggacgttcgtctttctagaaaggcctaggcgaggcctaggacgagggcggcggagaacgcggggagaagcccacccgtgaggagccagctgccgcgacgcaaatgcagccctgaggatttggctactgcatataacaacagggggcaaatcaagtacttcagggttgatttttatgaagccatggatgactacacatctgccatagaagtccaacccaattttgaagttccatattacaacagagggttgatactgtataggctgggatattttgatgatgctttggaagatttcaagaaggtcttagacttaaatcctggatttcaagatgctactttgagcttaaaacagactattctagacaaagaagaaaaacaaagaagaaatgttgcaaaaaattattgatatttttaacttaatggaagtattgattcatgatccttacatctgcatctagttatcagtaatttagatattgagctattttgatttatatttaagaaattaatacattagcactgaaagttaaatagtgtgtttaaggtagttaatttcaggttgaatgggttttttttaatgaagtgtaaataataccaatgtataagtgtatattattatattaaatattatagtaaaaaggaatgtgtggtattttcttcagcaaaactatttttgtgatttttttattctcaactttttatttaaaaaatgttacatctgcagaaaagttgaaagtataataaactcttcagttaaattcatgagttgtt

SEQ ID NO: 417913 - DNA, 1331 bp, Homo sapiens
tggggccgcggcgaccccgggtggaggcgacgttggggttgtttgggctcctatctttgcctctggagctcacggtcggcgcttgtcataacccagcactaggactgagcgggcggacgttcgtctttctagaaaggcctaggcgaggcctaggacgagggcggcggagaacgcggggagaagcccacccgtgaggagccagctgccgcgacggtgcggagagatttccgggaaccaagccctctgcgcgatcctcgggcgcgggccgccgcctctcaccccgccgtctctccttccacgttcctcattcgcacccagagacttaggacagataggaattttccactcgtgattttagctggcgggaaatccgcgacctgggaagggaaggggtcacggctgcgtagggccacagtaccgcgactcccatctcagtgtcacggcgcaggctcttggtggtgtttttcacttgtgaaaaacgtttaaatatgtggaagagagcataacgaacgtctaggtgtttatcacttggcttaagcattatcagtttacctattgtattcatccatggatgtttcagaaggaaccaccatgtcatcatcacatagttacttaatatcaagtcgtcagtgttggaaccattctgatcgactaataagcaaatgcagccctgaggatttggctactgcatataacaacagggggcaaatcaagtacttcagggttgatttttatgaagccatggatgactacacatctgccatagaagtccaacccaattttgaagttccatattacaacagagggttgatactgtataggctgggatattttgatgatgctttggaagatttcaagaaggtcttagacttaaatcctggatttcaagatgctactttgagcttaaaacagactattctagacaaagaagaaaaacaaagaagaaatgttgcaaaaaattattgatatttttaacttaatggaagtattgattcatgatccttacatctgcatctagttatcagtaatttagatattgagctattttgatttatatttaagaaattaatacattagcactgaaagttaaatagtgtgtttaaggtagttaatttcaggttgaatgggttttttttaatgaagtgtaaataataccaatgtataagtgtatattattatattaaatattatagtaaaaaggaatgtgtggtattttcttcagcaaaactatttttgtgatttttttattctcaactttttatttaaaaaatgttacatctgcagaaaagttgaaagtataataaactcttcagttaaattcatgagttgtt

SEQ ID NO: 417914 - DNA, 1116 bp, Homo sapiens
gttttaagatcacttaaaaatttgagaatgaaattgattcacattgtgacatatccatagcaaactcgggctttgggctggctttccctctttgcttagtatttatctgttctgtcttctttgccctgctggtgtgtgcttagaaaaatgaacaatcattttaatgttatattcagcagaacaaattggcagtgaacacactgtaaagttagtatgcttttcaggttgacattgcagtggtataaccctacaaaagtagataacagggttaaacaaaaattgattttagctctttatttgtacgttttttcttcagcttggattttcagtgttgatgctgcatgttataggctgtgaagtttgacaatacccaaaagagaatgaaagtggaaatgagaggaatttggtaacacggtgtttttaatgtgaactttttgtttaaagcaaatgcagccctgaggatttggctactgcatataacaacagggggcaaatcaagtacttcagggttgatttttatgaagccatggatgactacacatctgccatagaagtccaacccaattttgaagttccatattacaacagagggttgatactgtataggctgggatattttgatgatgctttggaagatttcaagaaggtcttagacttaaatcctggatttcaagatgctactttgagcttaaaacagactattctagacaaagaagaaaaacaaagaagaaatgttgcaaaaaattattgatatttttaacttaatggaagtattgattcatgatccttacatctgcatctagttatcagtaatttagatattgagctattttgatttatatttaagaaattaatacattagcactgaaagttaaatagtgtgtttaaggtagttaatttcaggttgaatgggttttttttaatgaagtgtaaataataccaatgtataagtgtatattattatattaaatattatagtaaaaaggaatgtgtggtattttcttcagcaaaactatttttgtgatttttttattctcaactttttatttaaaaaatgttacatctgcagaaaagttgaaagtataataaactcttcagttaaattcatgagttgtt

SEQ ID NO: 417915 - DNA, 1304 bp, Homo sapiens
tggggccgcggcgaccccgggtggaggcgacgttggggttgtttgggctcctatctttgcctctggagctcacggtcggcgcttgtcataacccagcactaggactgagcgggcggacgttcgtctttctagaaaggcctaggcgaggcctaggacgagggcggcggagaacgcggggagaagcccacccgtgaggagccagctgccgcgacggtgcggagagatttccgggaaccaagccctctgcgcgatcctcgggcgcgggccgccgcctctcaccccgccgtctctccttccacgttcctcattcgcacccagagacttaggacagataggaattttccactcgtgattttagctggcgggaaatccgcgacctgggaagggaaggggtcacggctgcgtagggccacagtaccgcgactcccatctcagtgtcacggcgcaggctcttggtggtgtttttcacttgtgaaaaacgtttaaatatgtggaagagagcataacgaacgtctaggtgtttatcacttggcttaagcattatcagtttacctattgtattcatccatggatgtttcagaaggaaccaccatgtcatcatcacatagttacttaatatcaagtcgtcagtgttggaaccattctgatcgactaataagcaaatgcagccctgaggatttggctactgcatataacaacagggggcaaatcaagtacttcagggttgatttttatgaagccatggatgactacacatctgccatagaagtccaacccaattttgaagttccatattacaacagagggttgatactgtataggctgggtaagaattttttttctttttgagttttgtcattgactgtattctgttatttcagagctttcaaatgttgtaaaactaacgtggtaatcaaattttaaagttctgtgaaatttaggtttagagcttggaacaaaggaagtgtccctgagtttattttaggcttttgataggcgttatagatcacagcagagcactggggtgggaattggacctgggcgcaggagcaggggtgaccccattactttgtgcttgtgcattcccagctgtgaaatgagggcaattcagatgttcacctgtgaaacttttctgagttaaaatctttgaagacacacaagacaatagaaagtgaagtttagattcttggattaaagggaccataggtagtgtttcttcatttaaagtgtcaaaaagaaaattagttcccgtttcttaattttactgcaattatgtaaaacaggtgatacagttttattaaaat

SEQ ID NO: 417916 - DNA, 554 bp, Homo sapiens
acacacggcagaggacagaatactactgcaggaccgactgtacagacttccacgcagaaaaactcattaatgcagtcccttctcgatccgagccgggtacagcataatcatccccttcaagaatgtcttctatcacatggtgaccttctccatcatcgtggataacccagccttcaccattcgcgctggagagtctgtgcggcccaagaagatcaacaacatcacagtctcctttgaaggaaacccatctggcagcaaaacccccatcaccaccaagctgactgtgagctgccctcctggtgaagggagtgagactggagttaaatgggtttattatctgaaggggatcaccctttagtggtaaccagggttacctgtatcaaccaaaagctatgcattgtcttagcctgaaaaagaatagagaaaacaataagaattctaaaggaactgtttttattcttctcatacaattatagggcagttatttccctattatgtgttttccaaatatagatatgaaatatctattccatattaaacattataactaccca

SEQ ID NO: 417917 - DNA, 597 bp, Homo sapiens
tcttattcgagcccagccacctgggtgagaccaagggcatcctgatcctatcatcgctcgcaggtggagagtatatcatccccctctttggaatggctctgcctcccaagccccaaggtcccttctcgatccgagccgggtacagcataatcatccccttcaagaatgtcttctatcacatggtgaccttctccatcatcgtggataacccagccttcaccattcgcgctggagagtctgtgcggcccaagaagatcaacaacatcacagtctcctttgaaggaaacccatctggcagcaaaacccccatcaccaccaagctgactgtgagctgccctcctggtgaagggagtgagactggagttaaatgggtttattatctgaaggggatcaccctttagtggtaaccagggttacctgtatcaaccaaaagctatgcattgtcttagcctgaaaaagaatagagaaaacaataagaattctaaaggaactgtttttattcttctcatacaattatagggcagttatttccctattatgtgttttccaaatatagatatgaaatatctattccatattaaacattataactaccca

SEQ ID NO: 417918 - DNA, 348 bp, Homo sapiens
  misc_feature (280)..(280): n is a, c, g, or t
agaaaacaaatacaattaaagaaaaatctggtccttttccttcctatccatttctcccctaactgttctcccaccactctggagctgttcattcattgattcatactgcgattcaatagcatttactggcacttactgtatatgatactgttgttctttgtgttaaagatgctacaaaataatgtatgtcatggttcctgaactttaagagcttgtcttcagactatgtagaggaaactgtcataaatgaagcagctgaggaacagtgtggcgatagccntgccaggcaacctgcagggcctctctcctctggtctgacaagagcacttcagacctttttctttctcc

SEQ ID NO: 417919 - DNA, 612 bp, Homo sapiens
aacaggagacctcgcctcagacaagtggggcctgggtcccccatggatgaaagtgccttcccattatgctgtaccctgggcagagtggacagtgacgaccctggttcgagcccagggtgcgcttcgggaccgcttgcggttaccagaaagcgaacaaatggtccatgagcggaaggtgaggcacctgaggcagagaaagtaaagaaacgcgccgccgagaagcagtgcctgggtccctcacggaggaaattgtcttctccttagcccgttcgcttggcactgaggtccctggcgtccctggtttgatcccagggtacgcctcgggccactagtgttaccccaaggtgggcagaaagcccataaggggaaggcgaggcacctggggcagagaaaaaaaaaacttcgctgcagagaagcgcggcctgattccccacggacgaaagtgtcttcccatcagtccctgcactgggacccggggaccctggtgtccctggttcgagctcagggtgtgcctcagccgctacgtgcaccccaaggggagctttgggagcacaaagcccatgagggaaggtgagttttgagggaggagtggtgaggcacctgtcacagaaa

SEQ ID NO: 417920 - DNA, 723 bp, Homo sapiens
caagcaggtgttacagatctcctcctcctagggagcttgcagtattttacccagtttgtggagttccatttgaggattgctgggggttgtggaccatccagagatctttccatggtaaagatcaagcatcgtgggttgccatgatctattgtcagattgagtctcactctgttgcccaggctggagcacagtggcgtgatcttggctcactgcaacctccagggttcaagggaacctgtaaaggaaaccagtagcttatctgtaccagtggcatatctgtataatctcttagaaaatcaagggttcaaaatcaaacaccttgctagtttgcgattcagtgattcaagaatgaattctgcagttggaggactctctaggcccttcagtgttccacttactttttctgctcttattccctctcttcttctacacgccagcgtcctcttctgcactggatggtatcatgattttcaggaaggagagtcaaaaagggaaacaagtcagctcaagcaaaaacatcctggcacacgggaggacgaagtaaataatgatagtatgtgggacaccattagtcattgtcattctgcatgcttcagcaccaataaaaccatcttaaccaaacacccttggataattggttcccatgactaatacatagccactgatccagagcctaaggagtgtgaatgacaaacaataaacctgcttgggataacgtgattg

SEQ ID NO: 417921 - DNA, 377 bp, Homo sapiens
ggcatccagattggcatggaagaagtaaaacaagctctatcttaaattactgatcttgtatgtaggaaatcctaaagaatccacaaataaagctattagaacaaataggcaagcacatttgcaggatacaagataaatactcaaaaatcctgtgttattctgtacattagcaatgaacaatccaaaaatgaaatcagaccaggcacagtggctcctgcctgtaatcccagcactttgggaggcgaggtaggtggatcacttgaggccaggagttcaataccagcctggccaacatggtgaaactccatctctactaaaaaatacaaaaaactagctgggcatggtgatgcgcacctgtaatcccagctactagggag

SEQ ID NO: 417922 - DNA, 543 bp, Homo sapiens
tgtgaggctgtgtgtgtgtgcgtgtgtgcgcgcgtgcaggctttaaatgggtgtatttagcaatctgtgattttttaacaaaggtttaattatattttcacatggcctcagtcatgcccctgtgtaactggctcagtaagagataagggtgcacgtagctcaggccgtagcaggtgctaatgaagagtccccgttgagagagggcttcttaaaccactgagggaagggctctcccactggagaagaaacactgaagtatattcttctccatcctcctcccaaagtgttgacagagaaaaaaaacagagtgaccttgtttcctgccctgcctgacagtgagttaaacagaattccaaactagaggactggacatttattcacctgcaaaaacatttttttttgcagcatttcaaatgtacttgtgtctagatatggtttcaattacatggaattggcctttgtctttaagctcttattttctctcctgagtgtcccttgaacctctttatgttcacaaaaatcctactgtgtggtttttaaagc

SEQ ID NO: 417923 - DNA, 313 bp, Homo sapiens
tagctcatcccactggcacatgtcccagagtaagctgggctggaagcttttagtgtagttaaaagatgccagtctgtcatttgcatgcactgtaattgggcaagtggtttcaggctgagctttacattatccttccactgagagcagctggtggtgggctgtagattccatatgagctggggacttatcatctggtgtgtttagtgcaatcctgcctcatcttgggagcaattttttattgaatgataataataatgcacaatcttggtgaaagataatgcttgtggttattagaatgtgtagactgagtagg

SEQ ID NO: 417924 - DNA, 900 bp, Homo sapiens
agctggcaaggctgggtctagctgggggcagggactgggcagagtggatctgctgtgtctgtggggcctgtgtagaggccctgaggctgtgtgccccgaatgtaggtggtcctggcagctcccctcctgtggcccgacagggagagccgagcatgggcgctgccccttcctgctgggcatttcttggcaccgcgatgtgtggttagatctggagcacgtggaggtcgttccagcagaatctaccggccacgggagctgggaatgctcaggatgcggggtggtggccctggcaggaggggacctcgtagccgccctcggagctgaggctcccacagcagcgtggggggcggcaggggtggggcgaggaggcttctgggaacatttcctccccctgtactgatacctaacccaggatgtttggggaggggcggggcgaggggtggggcgaggcctgcaggagggtgggcttccctggacctcaagtggagggggctgagcgcagggccaggatgctggtcactgggtggccctgtgagctcccctcccttcaggagtcctccgctctgccacaggaagggcctgaccttcgtctctgtgcacgactgttactggactcacgcagctgatgtctccgtcatgaaccaggtgtgccgggagcagtttgtccgcttgcacagcgagcccatcctgcaggacctgtccagattcctggtcaagcggttctgctctgagccccagaagatcttggaggccagccagctgaaggagacactgcaggcggtgcccaagccaggggccttcgacctggagcaggtgaagcgttccacctacttcttcagctgacaccccgtgagccttgtcagtgtgtaaataaagctcttttgccacccccaaaaaaaa

SEQ ID NO: 417925 - DNA, 3795 bp, Homo sapiens
ctttgcacctgggcgtgcgcagcccaccgacccggccccgctttccactcgcccttgcccgcttttcgactgaggctcctccgtgcagtctgacctttgactcgtggtttcttatgcagcctcctgaccccagggaccgccggtggcgtctgcggccccaggaggagctcgtccgccagcccccaggagcaagaccaagaccgcaggaaggactggggccacgtggagctgctggaggtgctccaggcgcgggtgcggcagctgcaggctgagagcgtgtcggaggtggtggtgaacagggtggatgtggcgcggctcccagaatgtggcagtggagatggtagcctccagccacccaggaaggtccagatgggggccaaggatgccaccccggtgccctgtggccgctgggcaaagatactggagaaggataagcggacccagcagatgcgtatgcagcggttgaaggcgaagctgcagatgccattccagagcggggagttcaaggcgctgaccaggcgcctgcaggtggagccccggctcctgagcaagcagatggccgggtgcctggaggactgcacgcgccaggcccccgagagcccctgggaggagcagctggcccggctgctgcaggaggcccctgggaagctgagcctcgatgtggagcaggccccgtcggggcagcactcgcaggcccagctctcaggtcagcagcagaggctcctggccttcttcaagtgctgcctgctcactgaccagctgcccctcgcccaccacctgctggtcgtccaccacggccagcggcagaagcggaagctgctcacgctggacatgtacaacgccgtgatgcttggctgggcgcggcagggtgccttcaaggagctggtatatgtgttattcatggtgaaggatgccggcttgaccccggacctgctgtcctatgcggctgccctccagtgcatggggaggcaggaccaggacgccgggaccatcgaaaggtgtctggaacagatgagccaggaggggctgaagctgcaggcactcttcaccgccgttctgctgtctgaggaggatcgggccactgttctgaaggccgtgcacaaggtgaagcccaccttcagcctcccgccgcagctgccgcccccggtcaacacctccaagctgctcagggacgtgtatgccaaggatgggcgtgtgtcctacccgaagctgcacctgcccttgaagaccctgcagtgcctctttgagaagcagctccacatggagctggccagcagggtgtgcgtggtgtccgtggagaagcccacgttgccaagcaaggaggtcaagcacgcgcggaagaccctgaagaccctgcgggaccaatgggagaaagcactgtgccgggcgctgcgggagaccaagaaccgcctagagcgcgaggtgtacgagggccggttctcactttaccccttcctgtgcctgctggacgagcgcgaggtggtgcggatgctcctgcaggtcctgcaggcgctgcccgcccaaggtgagtccttcaccaccctggcccgggagctgagtgcgcgcactttcagccggcacgtggtgcagaggcagcgggtcagtggccaggtgcaggcgctgcagaaccactacaggaagtacctctgcttgctggcctccgacgccgaggtgcccgagccctgcctgccgcggcagtactgggaggcgctgggggcgcccgaggccctgcgggagcagccctggcccctgccagtgcagatggagctgggcaagctgctggcggagatgctggtgcaggctacgcagatgccatgcagcctggacaagccgcatcgttcctctcggcttgtccccgtgctctaccacgtgtattccttccgcaacgtccagcagatcggcatcctgaagccgcacccggcctacgtgcagctgctggagaaggccgcggagcccacgctgaccttcgaggcggtggatgtacccatgctttgccccccgctgccctggacatcgccgcactctggtgctttcctgctcagccccaccaagctgatgcgcacggtggaaggcgccacgcagcaccaggagctgctggaaacctgcccgcccaccgcgctgcatggcgcactggacgccctcacccaactgggcaactgcgcctggcgcgtcaacgggcgcgtgctggacctggtgctgcagctcttccaggccaagggctgcccccagctaggcgtgccggccccgccctccgaggcgccccagccgcccgaggcccacctgccgcacagcgccgcgcccgcccgcaaggccgagctgcgccgtgagctggcgcactgccagaaggtggcccgggagatgcacagcctgcgggcggaggcgctgtaccgcctctcgctggcgcagcacctgcgggaccgcgtcttctggctgccgcacaacatggacttccgcggccgcacctacccctgcccgccgcacttcaaccacctgggcagcgacgtggcgcgggccctgctggagttcgcccagggccgcccgctcggcccgcacggcctggattggctcaagatccacctggtcaatctcacggggttgaagaagcgggagccgctgcggaagcgcctggcctttgcggaggaggtgatggatgacatcctggactccgcggaccaacccttgacgggccgaaagtggtggatgggcgcggaggaaccctggcagacgctggcctgctgtatggaggtggcgaacgctgtgcgcgcctccgaccctgccgcctatgtctcccacctccccgtccatcaggacggctcttgcaacggcctgcagcattatgctgctctgggccgcgacagcgtgggcgccgcctccgtcaacctggagccctcggatgtgccgcaggacgtgtacagcggcgtggccgcgcaggtggaggtgttccgtaggcaggacgcccagcggggcatgcgggtggcacaggtgctggaaggtttcatcacccgcaaggtggtgaagcagacggtgatgacggtggtgtacggggtcacgcgctatggcgggcgcctgcagattgagaagcgcctccgggagctgagcgactttccccaggagttcgtgtgggaggcctctcactatctcgtacgccaggtcttcaagagtctacaggagatgttctcggggacccgggccatccagcactggctgaccgagagtgcccgcctcatctcccacatgggctctgtggtggagtgggtcacacccctgggcgtccccgtcatccagccgtatcgcctggactccaaggtcaagcaaataggaggtggaattcagagcatcacctacacccacaacggagacatcagccgaaagcccaacacacgtaagcagaagaacggcttcccgcccaacttcatccactcgctggactcctcccacatgatgctcaccgccctgcactgctacaggaagggcctgaccttcgtctctgtgcacgactgttactggactcacgcagctgatgtctccgtcatgaaccaggtgtgccgggagcagtttgtccgcttgcacagcgagcccatcctgcaggacctgtccagattcctggtcaagcggttctgctctgagccccagaagatcttggaggccagccagctgaaggagacactgcaggcggtgcccaagccaggggccttcgacctggagcaggtgaagcgttccacctacttcttcagctgacaccccgtgagccttgtcagtgtgtaaataaagctcttttgccacccccaaaaaaaa

SEQ ID NO: 417926 - DNA, 3937 bp, Homo sapiens
cccggcaggcggcgcgggcgcatgcgcaggcgcgggccggtggggtggcctggagcggcgtgcgtaatgtcggcactttgctggggccgcggagcggcggggctcaaacgagccctacggccttgcggccgcccgggactccccggcaaagaagggaccgccggtggcgtctgcggccccaggaggagctcgtccgccagcccccaggagcaagaccaagaccgcaggaaggactggggccacgtggagctgctggaggtgctccaggcgcgggtgcggcagctgcaggctgagagcgtgtcggaggtggtggtgaacagggtggatgtggcgcggctcccagaatgtggcagtggagatggtagcctccagccacccaggaaggtccagatgggggccaaggatgccaccccggtgccctgtggccgctgggcaaagatactggagaaggataagcggacccagcagatgcgtatgcagcggttgaaggcgaagctgcagatgccattccagagcggggagttcaaggcgctgaccaggcgcctgcaggtggagccccggctcctgagcaagcagatggccgggtgcctggaggactgcacgcgccaggcccccgagagcccctgggaggagcagctggcccggctgctgcaggaggcccctgggaagctgagcctcgatgtggagcaggccccgtcggggcagcactcgcaggcccagctctcaggtcagcagcagaggctcctggccttcttcaagtgctgcctgctcactgaccagctgcccctcgcccaccacctgctggtcgtccaccacggccagcggcagaagcggaagctgctcacgctggacatgtacaacgccgtgatgcttggctgggcgcggcagggtgccttcaaggagctggtatatgtgttattcatggtgaaggatgccggcttgaccccggacctgctgtcctatgcggctgccctccagtgcatggggaggcaggaccaggacgccgggaccatcgaaaggtgtctggaacagatgagccaggaggggctgaagctgcaggcactcttcaccgccgttctgctgtctgaggaggatcgggccactgttctgaaggccgtgcacaaggtgaagcccaccttcagcctcccgccgcagctgccgcccccggtcaacacctccaagctgctcagggacgtgtatgccaaggatgggcgtgtgtcctacccgaagctgcacctgcccttgaagaccctgcagtgcctctttgagaagcagctccacatggagctggccagcagggtgtgcgtggtgtccgtggagaagcccacgttgccaagcaaggaggtcaagcacgcgcggaagaccctgaagaccctgcgggaccaatgggagaaagcactgtgccgggcgctgcgggagaccaagaaccgcctagagcgcgaggtgtacgagggccggttctcactttaccccttcctgtgcctgctggacgagcgcgaggtggtgcggatgctcctgcaggtcctgcaggcgctgcccgcccaaggtgagtccttcaccaccctggcccgggagctgagtgcgcgcactttcagccggcacgtggtgcagaggcagcgggtcagtggccaggtgcaggcgctgcagaaccactacaggaagtacctctgcttgctggcctccgacgccgaggtgcccgagccctgcctgccgcggcagtactgggaggcgctgggggcgcccgaggccctgcgggagcagccctggcccctgccagtgcagatggagctgggcaagctgctggcggagatgctggtgcaggctacgcagatgccatgcagcctggacaagccgcatcgttcctctcggcttgtccccgtgctctaccacgtgtattccttccgcaacgtccagcagatcggcatcctgaagccgcacccggcctacgtgcagctgctggagaaggccgcggagcccacgctgaccttcgaggcggtggatgtacccatgctttgccccccgctgccctggacatcgccgcactctggtgctttcctgctcagccccaccaagctgatgcgcacggtggaaggcgccacgcagcaccaggagctgctggaaacctgcccgcccaccgcgctgcatggcgcactggacgccctcacccaactgggcaactgcgcctggcgcgtcaacgggcgcgtgctggacctggtgctgcagctcttccaggccaagggctgcccccagctaggcgtgccggccccgccctccgaggcgccccagccgcccgaggcccacctgccgcacagcgccgcgcccgcccgcaaggccgagctgcgccgtgagctggcgcactgccagaaggtggcccgggagatgcacagcctgcgggcggaggcgctgtaccgcctctcgctggcgcagcacctgcgggaccgcgtcttctggctgccgcacaacatggacttccgcggccgcacctacccctgcccgccgcacttcaaccacctgggcagcgacgtggcgcgggccctgctggagttcgcccagggccgcccgctcggcccgcacggcctggattggctcaagatccacctggtcaatctcacggggttgaagaagcgggagccgctgcggaagcgcctggcctttgcggaggaggtgatggatgacatcctggactccgcggaccaacccttgacgggccgaaagtggtggatgggcgcggaggaaccctggcagacgctggcctgctgtatggaggtggcgaacgctgtgcgcgcctccgaccctgccgcctatgtctcccacctccccgtccatcaggacggctcttgcaacggcctgcagcattatgctgctctgggccgcgacagcgtgggcgccgcctccgtcaacctggagccctcggatgtgccgcaggacgtgtacagcggcgtggccgcgcaggtggaggtgttccgtaggcaggacgcccagcggggcatgcgggtggcacaggtgctggaaggtttcatcacccgcaaggtggtgaagcagacggtgatgacggtggtgtacggggtcacgcgctatggcgggcgcctgcagattgagaagcgcctccgggagctgagcgactttccccaggagttcgtgtgggaggcctctcactatctcgtacgccaggtcttcaagagtctacaggagatgttctcggggacccgggccatccagcactggctgaccgagagtgcccgcctcatctcccacatgggctctgtggtggagtgggtcacacccctgggcgtccccgtcatccagccgtatcgcctggactccaaggtcaagcaaataggaggtggaattcagagcatcacctacacccacaacggagacatcagccgaaagcccaacacacgtaagcagaagaacggcttcccgcccaacttcatccactcgctggactcctcccacatgatgctcaccgccctgcactgctacaggaagggcctgaccttcgtctctgtgcacgactgttactggactcacgcagctgatgtctccgtcatgaaccaggtgcccccgtagtctgagcctcagtccacccatgggtggggcccccacactggggcgttgggtaggggtggtgcccagagcctgcctgatcacccctggggatcctctgactcctgcccaggtgtgccgggagcagtttgtccgcttgcacagcgagcccatcctgcaggacctgtccagattcctggtcaagcggttctgctctgagccccagaagatcttggaggccagccagctgaaggagacactgcaggcggtgcccaagccaggggccttcgacctggagcaggtgaagcgttccacctacttcttcagctgacaccccgtgagccttgtcagtgtgtaaataaagctcttttgccacccccaaaaaaaa

SEQ ID NO: 417927 - DNA, 3151 bp, Homo sapiens
agtgctacctccacaaacagagtgctacctccacaacggagacatcagccgaaagcccaacacacgtaagcagaggctcctggccttcttcaagtgctgcctgctcactgaccagctgcccctcgcccaccacctgctggtcgtccaccacggccagcggcagaagcggaagctgctcacgctggacatgtacaacgccgtgatgcttggctgggcgcggcagggtgccttcaaggagctggtatatgtgttattcatggtgaaggatgccggcttgaccccggacctgctgtcctatgcggctgccctccagtgcatggggaggcaggaccaggacgccgggaccatcgaaaggtgtctggaacagatgagccaggaggggctgaagctgcaggcactcttcaccgccgttctgctgtctgaggaggatcgggccactgttctgaaggccgtgcacaaggtgaagcccaccttcagcctcccgccgcagctgccgcccccggtcaacacctccaagctgctcagggacgtgtatgccaaggatgggcgtgtgtcctacccgaagctgcacctgcccttgaagaccctgcagtgcctctttgagaagcagctccacatggagctggccagcagggtgtgcgtggtgtccgtggagaagcccacgttgccaagcaaggaggtcaagcacgcgcggaagaccctgaagaccctgcgggaccaatgggagaaagcactgtgccgggcgctgcgggagaccaagaaccgcctagagcgcgaggtgtacgagggccggttctcactttaccccttcctgtgcctgctggacgagcgcgaggtggtgcggatgctcctgcaggtcctgcaggcgctgcccgcccaaggtgagtccttcaccaccctggcccgggagctgagtgcgcgcactttcagccggcacgtggtgcagaggcagcgggtcagtggccaggtgcaggcgctgcagaaccactacaggaagtacctctgcttgctggcctccgacgccgaggtgcccgagccctgcctgccgcggcagtactgggaggcgctgggggcgcccgaggccctgcgggagcagccctggcccctgccagtgcagatggagctgggcaagctgctggcggagatgctggtgcaggctacgcagatgccatgcagcctggacaagccgcatcgttcctctcggcttgtccccgtgctctaccacgtgtattccttccgcaacgtccagcagatcggcatcctgaagccgcacccggcctacgtgcagctgctggagaaggccgcggagcccacgctgaccttcgaggcggtggatgtacccatgctttgccccccgctgccctggacatcgccgcactctggtgctttcctgctcagccccaccaagctgatgcgcacggtggaaggcgccacgcagcaccaggagctgctggaaacctgcccgcccaccgcgctgcatggcgcactggacgccctcacccaactgggcaactgcgcctggcgcgtcaacgggcgcgtgctggacctggtgctgcagctcttccaggccaagggctgcccccagctaggcgtgccggccccgccctccgaggcgccccagccgcccgaggcccacctgccgcacagcgccgcgcccgcccgcaaggccgagctgcgccgtgagctggcgcactgccagaaggtggcccgggagatgcacagcctgcgggcggaggcgctgtaccgcctctcgctggcgcagcacctgcgggaccgcgtcttctggctgccgcacaacatggacttccgcggccgcacctacccctgcccgccgcacttcaaccacctgggcagcgacgtggcgcgggccctgctggagttcgcccagggccgcccgctcggcccgcacggcctggattggctcaagatccacctggtcaatctcacggggttgaagaagcgggagccgctgcggaagcgcctggcctttgcggaggaggtgatggatgacatcctggactccgcggaccaacccttgacgggccgaaagtggtggatgggcgcggaggaaccctggcagacgctggcctgctgtatggaggtggcgaacgctgtgcgcgcctccgaccctgccgcctatgtctcccacctccccgtccatcaggacggctcttgcaacggcctgcagcattatgctgctctgggccgcgacagcgtgggcgccgcctccgtcaacctggagccctcggatgtgccgcaggacgtgtacagcggcgtggccgcgcaggtggaggtgttccgtaggcaggacgcccagcggggcatgcgggtggcacaggtgctggaaggtttcatcacccgcaaggtggtgaagcagacggtgatgacggtggtgtacggggtcacgcgctatggcgggcgcctgcagattgagaagcgcctccgggagctgagcgactttccccaggagttcgtgtgggaggcctctcactatctcgtacgccaggtcttcaagagtctacaggagatgttctcggggacccgggccatccagcactggctgaccgagagtgcccgcctcatctcccacatgggctctgtggtggagtgggtcacacccctgggcgtccccgtcatccagccgtatcgcctggactccaaggtcaagcaaataggaggtggaattcagagcatcacctacacccacaacggagacatcagccgaaagcccaacacacgtaagcagaagaacggcttcccgcccaacttcatccactcgctggactcctcccacatgatgctcaccgccctgcactgctacaggaagggcctgaccttcgtctctgtgcacgactgttactggactcacgcagctgatgtctccgtcatgaaccaggtgtgccgggagcagtttgtccgcttgcacagcgagcccatcctgcaggacctgtccagattcctggtcaagcggttctgctctgagccccagaagatcttggaggccagccagctgaaggagacactgcaggcggtgcccaagccaggggccttcgacctggagcaggtgaagcgttccacctacttcttcagctgacaccccgtgagccttgtcagtgtgtaaataaagctcttttgccacccccaaaaaaaa

SEQ ID NO: 417928 - DNA, 2996 bp, Homo sapiens
gctaggctttagttgttatttttaattcatctatttctggatgggtcacattcatacagttctgagtttgaggagaaaacagccaacatctgggggtgcagtgaacggtctccccaggctctgccagctcccagcatcaccgcccctgccaccccctgcacggtgcccagtgtcccttctagaggggtcgaggccaggagggtcaaggcctttggtttgcactgctggcactgactttacccgcagcccgcctttccccgcgtcagcgatagccaccagcaacttgcaggagacgcagaaacgcgtgcacccatgctgtctcggggtcctgggagggcaggtcgccctctggcaagcccccaacctcactacccccatccctgcaggatgggcgtgtgtcctacccgaagctgcacctgcccttgaagaccctgcagtgcctctttgagaagcagctccacatggagctggccagcagggtgtgcgtggtgtccgtggagaagcccacgttgccaagcaaggaggtcaagcacgcgcggaagaccctgaagaccctgcgggaccaatgggagaaagcactgtgccgggcgctgcgggagaccaagaaccgcctagagcgcgaggtgtacgagggccggttctcactttaccccttcctgtgcctgctggacgagcgcgaggtggtgcggatgctcctgcaggtcctgcaggcgctgcccgcccaaggtgagtccttcaccaccctggcccgggagctgagtgcgcgcactttcagccggcacgtggtgcagaggcagcgggtcagtggccaggtgcaggcgctgcagaaccactacaggaagtacctctgcttgctggcctccgacgccgaggtgcccgagccctgcctgccgcggcagtactgggaggcgctgggggcgcccgaggccctgcgggagcagccctggcccctgccagtgcagatggagctgggcaagctgctggcggagatgctggtgcaggctacgcagatgccatgcagcctggacaagccgcatcgttcctctcggcttgtccccgtgctctaccacgtgtattccttccgcaacgtccagcagatcggcatcctgaagccgcacccggcctacgtgcagctgctggagaaggccgcggagcccacgctgaccttcgaggcggtggatgtacccatgctttgccccccgctgccctggacatcgccgcactctggtgctttcctgctcagccccaccaagctgatgcgcacggtggaaggcgccacgcagcaccaggagctgctggaaacctgcccgcccaccgcgctgcatggcgcactggacgccctcacccaactgggcaactgcgcctggcgcgtcaacgggcgcgtgctggacctggtgctgcagctcttccaggccaagggctgcccccagctaggcgtgccggccccgccctccgaggcgccccagccgcccgaggcccacctgccgcacagcgccgcgcccgcccgcaaggccgagctgcgccgtgagctggcgcactgccagaaggtggcccgggagatgcacagcctgcgggcggaggcgctgtaccgcctctcgctggcgcagcacctgcgggaccgcgtcttctggctgccgcacaacatggacttccgcggccgcacctacccctgcccgccgcacttcaaccacctgggcagcgacgtggcgcgggccctgctggagttcgcccagggccgcccgctcggcccgcacggcctggattggctcaagatccacctggtcaatctcacggggttgaagaagcgggagccgctgcggaagcgcctggcctttgcggaggaggtgatggatgacatcctggactccgcggaccaacccttgacgggccgaaagtggtggatgggcgcggaggaaccctggcagacgctggcctgctgtatggaggtggcgaacgctgtgcgcgcctccgaccctgccgcctatgtctcccacctccccgtccatcaggacggctcttgcaacggcctgcagcattatgctgctctgggccgcgacagcgtgggcgccgcctccgtcaacctggagccctcggatgtgccgcaggacgtgtacagcggcgtggccgcgcaggtggaggtgttccgtaggcaggacgcccagcggggcatgcgggtggcacaggtgctggaaggtttcatcacccgcaaggtggtgaagcagacggtgatgacggtggtgtacggggtcacgcgctatggcgggcgcctgcagattgagaagcgcctccgggagctgagcgactttccccaggagttcgtgtgggaggcctctcactatctcgtacgccaggtcttcaagagtctacaggagatgttctcggggacccgggccatccagcactggctgaccgagagtgcccgcctcatctcccacatgggctctgtggtggagtgggtcacacccctgggcgtccccgtcatccagccgtatcgcctggactccaaggtcaagcaaataggaggtggaattcagagcatcacctacacccacaacggagacatcagccgaaagcccaacacacgtaagcagaagaacggcttcccgcccaacttcatccactcgctggactcctcccacatgatgctcaccgccctgcactgctacaggaagggcctgaccttcgtctctgtgcacgactgttactggactcacgcagctgatgtctccgtcatgaaccaggtgtgccgggagcagtttgtccgcttgcacagcgagcccatcctgcaggacctgtccagattcctggtcaagcggttctgctctgagccccagaagatcttggaggccagccagctgaaggagacactgcaggcggtgcccaagccaggggccttcgacctggagcaggtgaagcgttccacctacttcttcagctgacaccccgtgagccttgtcagtgtgtaaataaagctcttttgccacccccaaaaaaaa

SEQ ID NO: 417929 - DNA, 1021 bp, Homo sapiens
agctggcaaggctgggtctagctgggggcagggactgggcagagtggatctgctgtgtctgtggggcctgtgtagaggccctgaggctgtgtgccccgaatgtaggtggtcctggcagctcccctcctgtggcccgacagggagagccgagcatgggcgctgccccttcctgctgggcatttcttggcaccgcgatgtgtggttagatctggagcacgtggaggtcgttccagcagaatctaccggccacgggagctgggaatgctcaggatgcggggtggtggccctggcaggaggggacctcgtagccgccctcggagctgaggctcccacagcagcgtggggggcggcaggggtggggcgaggaggcttctgggaacatttcctccccctgtactgatacctaacccaggatgtttggggaggggcggggcgaggggtggggcgaggcctgcaggagggtgggcttccctggacctcaagtggagggggctgagcgcagggccaggatgctggtcactgggtggccctgtgagctcccctcccttcaggagtcctccgctctgccacaggaagggcctgaccttcgtctctgtgcacgactgttactggactcacgcagctgatgtctccgtcatgaaccaggtgcccccgtagtctgagcctcagtccacccatgggtggggcccccacactggggcgttgggtaggggtggtgcccagagcctgcctgatcacccctggggatcctctgactcctgcccaggtgtgccgggagcagtttgtccgcttgcacagcgagcccatcctgcaggacctgtccagattcctggtcaagcggttctgctctgagccccagaagatcttggaggccagccagctgaaggagacactgcaggcggtgcccaagccaggggccttcgacctggagcaggtgaagcgttccacctacttcttcagctgacaccccgtgagccttgtcagtgtgtaaataaagctcttttgccacccccaaaaaaaa

SEQ ID NO: 417930 - DNA, 485 bp, Homo sapiens
agcccccaacctcactacccccatccctgcaggatgggcgtgtgtcctacccgaagctgcacctgcccttgaagaccctgcagtgcctctttgagaagcagctccacatggagctggccagcagggtgtgcgtggtgtccgtggagaagcccacgttgccaagcaaggaggtcaagcacgcggtaggggctgagccggggtcccgtgtccgccgcaggggctgagccggggtcgcgtgtccaccgcacgggctgagccggggtcccgtgtccgccgcaggggctgagccggggtcgcgtgtccgccgcaggggctgagctccgtgtatgcggttgaattgctcatgccctggtctggtcatgcagggcctaggaactcagcctggctgccgctcagggaaaacttgtggggtcccgaggttgggtcttggcctgtgcttctgcgcacactgcagctgggcttttgctcttggctgcgtcaggcac

SEQ ID NO: 417931 - DNA, 3816 bp, Homo sapiens
cccggcaggcggcgcgggcgcatgcgcaggcgcgggccggtggggtggcctggagcggcgtgcgtaatgtcggcactttgctggggccgcggagcggcggggctcaaacgagccctacggccttgcggccgcccgggactccccggcaaagaagggaccgccggtggcgtctgcggccccaggaggagctcgtccgccagcccccaggagcaagaccaagaccgcaggaaggactggggccacgtggagctgctggaggtgctccaggcgcgggtgcggcagctgcaggctgagagcgtgtcggaggtggtggtgaacagggtggatgtggcgcggctcccagaatgtggcagtggagatggtagcctccagccacccaggaaggtccagatgggggccaaggatgccaccccggtgccctgtggccgctgggcaaagatactggagaaggataagcggacccagcagatgcgtatgcagcggttgaaggcgaagctgcagatgccattccagagcggggagttcaaggcgctgaccaggcgcctgcaggtggagccccggctcctgagcaagcagatggccgggtgcctggaggactgcacgcgccaggcccccgagagcccctgggaggagcagctggcccggctgctgcaggaggcccctgggaagctgagcctcgatgtggagcaggccccgtcggggcagcactcgcaggcccagctctcaggtcagcagcagaggctcctggccttcttcaagtgctgcctgctcactgaccagctgcccctcgcccaccacctgctggtcgtccaccacggccagcggcagaagcggaagctgctcacgctggacatgtacaacgccgtgatgcttggctgggcgcggcagggtgccttcaaggagctggtatatgtgttattcatggtgaaggatgccggcttgaccccggacctgctgtcctatgcggctgccctccagtgcatggggaggcaggaccaggacgccgggaccatcgaaaggtgtctggaacagatgagccaggaggggctgaagctgcaggcactcttcaccgccgttctgctgtctgaggaggatcgggccactgttctgaaggccgtgcacaaggtgaagcccaccttcagcctcccgccgcagctgccgcccccggtcaacacctccaagctgctcagggacgtgtatgccaaggatgggcgtgtgtcctacccgaagctgcacctgcccttgaagaccctgcagtgcctctttgagaagcagctccacatggagctggccagcagggtgtgcgtggtgtccgtggagaagcccacgttgccaagcaaggaggtcaagcacgcgcggaagaccctgaagaccctgcgggaccaatgggagaaagcactgtgccgggcgctgcgggagaccaagaaccgcctagagcgcgaggtgtacgagggccggttctcactttaccccttcctgtgcctgctggacgagcgcgaggtggtgcggatgctcctgcaggtcctgcaggcgctgcccgcccaaggtgagtccttcaccaccctggcccgggagctgagtgcgcgcactttcagccggcacgtggtgcagaggcagcgggtcagtggccaggtgcaggcgctgcagaaccactacaggaagtacctctgcttgctggcctccgacgccgaggtgcccgagccctgcctgccgcggcagtactgggaggcgctgggggcgcccgaggccctgcgggagcagccctggcccctgccagtgcagatggagctgggcaagctgctggcggagatgctggtgcaggctacgcagatgccatgcagcctggacaagccgcatcgttcctctcggcttgtccccgtgctctaccacgtgtattccttccgcaacgtccagcagatcggcatcctgaagccgcacccggcctacgtgcagctgctggagaaggccgcggagcccacgctgaccttcgaggcggtggatgtacccatgctttgccccccgctgccctggacatcgccgcactctggtgctttcctgctcagccccaccaagctgatgcgcacggtggaaggcgccacgcagcaccaggagctgctggaaacctgcccgcccaccgcgctgcatggcgcactggacgccctcacccaactgggcaactgcgcctggcgcgtcaacgggcgcgtgctggacctggtgctgcagctcttccaggccaagggctgcccccagctaggcgtgccggccccgccctccgaggcgccccagccgcccgaggcccacctgccgcacagcgccgcgcccgcccgcaaggccgagctgcgccgtgagctggcgcactgccagaaggtggcccgggagatgcacagcctgcgggcggaggcgctgtaccgcctctcgctggcgcagcacctgcgggaccgcgtcttctggctgccgcacaacatggacttccgcggccgcacctacccctgcccgccgcacttcaaccacctgggcagcgacgtggcgcgggccctgctggagttcgcccagggccgcccgctcggcccgcacggcctggattggctcaagatccacctggtcaatctcacggggttgaagaagcgggagccgctgcggaagcgcctggcctttgcggaggaggtgatggatgacatcctggactccgcggaccaacccttgacgggccgaaagtggtggatgggcgcggaggaaccctggcagacgctggcctgctgtatggaggtggcgaacgctgtgcgcgcctccgaccctgccgcctatgtctcccacctccccgtccatcaggacggctcttgcaacggcctgcagcattatgctgctctgggccgcgacagcgtgggcgccgcctccgtcaacctggagccctcggatgtgccgcaggacgtgtacagcggcgtggccgcgcaggtggaggtgttccgtaggcaggacgcccagcggggcatgcgggtggcacaggtgctggaaggtttcatcacccgcaaggtggtgaagcagacggtgatgacggtggtgtacggggtcacgcgctatggcgggcgcctgcagattgagaagcgcctccgggagctgagcgactttccccaggagttcgtgtgggaggcctctcactatctcgtacgccaggtcttcaagagtctacaggagatgttctcggggacccgggccatccagcactggctgaccgagagtgcccgcctcatctcccacatgggctctgtggtggagtgggtcacacccctgggcgtccccgtcatccagccgtatcgcctggactccaaggtcaagcaaataggaggtggaattcagagcatcacctacacccacaacggagacatcagccgaaagcccaacacacgtaagcagaagaacggcttcccgcccaacttcatccactcgctggactcctcccacatgatgctcaccgccctgcactgctacaggaagggcctgaccttcgtctctgtgcacgactgttactggactcacgcagctgatgtctccgtcatgaaccaggtgtgccgggagcagtttgtccgcttgcacagcgagcccatcctgcaggacctgtccagattcctggtcaagcggttctgctctgagccccagaagatcttggaggccagccagctgaaggagacactgcaggcggtgcccaagccaggggccttcgacctggagcaggtgaagcgttccacctacttcttcagctgacaccccgtgagccttgtcagtgtgtaaataaagctcttttgccacccccaaaaaaaa

SEQ ID NO: 417932 - DNA, 558 bp, Homo sapiens
taccttaatgctcagccaacaaactcctcatgataactgcacacaatctgaaaaccactgaaggataagcggacccagcagatgcgtatgcagcggttgaaggcgaagctgcagatgccattccagagcggggagttcaaggcgctgaccaggcgcctgcaggtggagccccggctcctgagcaagcagatggccgggtgcctggaggactgcacgcgccaggcccccgagagcccctgggaggagcagctggcccggctgctgcaggaggcccctgggaagctgagcctcgatgtggagcaggccccgtcggggcagcactcgcaggcccagctctcaggtcagcagcagaggctcctggccttcttcaagtgctgcctgctcactgaccagctgcccctcgcccaccacctgctggtcgtccaccacggccagcggcagaagcggaagctgctcacgctggacatgtacaacgccgtgatgcttggctgggcgcggcaggtaggcagggttcgtgacagaatagggccagcaagtacacgctcacattcccgttgg

SEQ ID NO: 417933 - DNA, 3837 bp, Homo sapiens
cccggcaggcggcgcgggcgcatgcgcaggcgcgggccggtggggtggcctggagcggcgtgcgtaatgtcggcactttgctggggccgcggagcggcggggctcaaacgagccctacggccttgcggccgcccgggactccccggcaaagaagggaccgccggtggcgtctgcggccccaggaggagctcgtccgccagcccccaggagcaagaccaagaccgcaggaaggactggggccacgtggagctgctggaggtgctccaggcgcgggtgcggcagctgcaggctgagagcgtgtcggaggtggtggtgaacagggtggatgtggcgcggctcccagaatgtggcagtggagatggtagcctccagccacccaggaaggtccagatgggggccaaggatgccaccccggtgccctgtggccgctgggcaaagatactggagaaggataagcggacccagcagatgcgtatgcagcggttgaaggcgaagctgcagatgccattccagagcggggagttcaaggcgctgaccaggcgcctgcaggtggagccccggctcctgagcaagcagatggccgggtgcctggaggactgcacgcgccaggcccccgagagcccctgggaggagcagctggcccggctgctgcaggaggcccctgggaagctgagcctcgatgtggagcaggccccgtcggggcagcactcgcaggcccagctctcaggtcagcagcagaggctcctggccttcttcaagtgctgcctgctcactgaccagctgcccctcgcccaccacctgctggtcgtccaccacggccagcggcagaagcggaagctgctcacgctggacatgtacaacgccgtgatgcttggctgggcgcggcagggtgccttcaaggagctggtatatgtgttattcatggtgaaggatgccggcttgaccccggacctgctgtcctatgcggctgccctccagtgcatggggaggcaggaccaggacgccgggaccatcgaaaggtgtctggaacagatgagccaggaggggctgaagctgcaggcactcttcaccgccgttctgctgtctgaggaggatcgggccactgttctgaaggccgtgcacaaggtgaagcccaccttcagcctcccgccgcagctgccgcccccggtcaacacctccaagctgctcagggacgtgtatgccaaggatgggcgtgtgtcctacccgaagctgcacctgcccttgaagaccctgcagtgcctctttgagaagcagctccacatggagctggccagcagggtgtgcgtggtgtccgtggagaagcccacgttgccaagcaaggaggtcaagcacgcgcggaagaccctgaagaccctgcgggaccaatgggagaaagcactgtgccgggcgctgcgggagaccaagaaccgcctagagcgcgaggtgtacgagggccggttctcactttaccccttcctgtgcctgctggacgagcgcgaggtggtgcggatgctcctgcaggtcctgcaggcgctgcccgcccaaggtgagtccttcaccaccctggcccgggagctgagtgcgcgcactttcagccggcacgtggtgcagaggcagcgggtcagtggccaggtgcaggcgctgcagaaccactacaggaagtacctctgcttgctggcctccgacgccgaggtgcccgagccctgcctgccgcggcagtactgggaggcgctgggggcgcccgaggccctgcgggagcagccctggcccctgccagtgcagatggagctgggcaagctgctggcggagatgctggtgcaggctacgcagatgccatgcagcctggacaagccgcatcgttcctctcggcttgtccccgtgctctaccacgtgtattccttccgcaacgtccagcagatcggcatcctgaagccgcacccggcctacgtgcagctgctggagaaggccgcggagcccacgctgaccttcgaggcggtggatgtacccatgctttgccccccgctgccctggacatcgccgcactctggtgctttcctgctcagccccaccaagctgatgcgcacggtggaaggcgccacgcagcaccaggagctgctggaaacctgcccgcccaccgcgctgcatggcgcactggacgccctcacccaactgggcaactgcgcctggcgcgtcaacgggcgcgtgctggacctggtgctgcagctcttccaggccaagggctgcccccagctaggcgtgccggccccgccctccgaggcgccccagccgcccgaggcccacctgccgcacagcgccgcgcccgcccgcaaggccgagctgcgccgtgagctggcgcactgccagaaggtggcccgggagatgcacagcctgcgggcggaggcgctgtaccgcctctcgctggcgcagcacctgcgggaccgcgtcttctggctgccgcacaacatggacttccgcggccgcacctacccctgcccgccgcacttcaaccacctgggcagcgacgtggcgcgggccctgctggagttcgcccagggccgcccgctcggcccgcacggcctggattggctcaagatccacctggtcaatctcacggggttgaagaagcgggagccgctgcggaagcgcctggcctttgcggaggaggtgatggatgacatcctggactccgcggaccaacccttgacgggccgaaagtggtggatgggcgcggaggaaccctggcagacgctggcctgctgtatggaggtggcgaacgctgtgcgcgcctccgaccctgccgcctatgtctcccacctccccgtccatcaggacggctcttgcaacggcctgcagcattatgctgctctgggccgcgacagcgtgggcgccgcctccgtcaacctggagccctcggatgtgccgcaggacgtgtacagcggcgtggccgcgcaggtggaggtgttccgtaggcaggacgcccagcggggcatgcgggtggcacaggtgctggaaggtttcatcacccgcaaggtggtgaagcagacggtgatgacggtggtgtacggggtcacgcgctatggcgggcgcctgcagattgagaagcgcctccgggagctgagcgactttccccaggagttcgtgtgggaggcctctcactatctcgtacgccaggtcttcaagagtctacaggagatgttctcggggacccgggccatccagcactggctgaccgagagtgcccgcctcatctcccacatgggctctgtggtggagtgggtcacacccctgggcgtccccgtcatccagccgtatcgcctggactccaaggtcaagcaaataggaggtggaattcagagcatcacctacacccacaacggagacatcagccgaaagcccaacacacgtaagcagaagaacggcttcccgcccaacttcatccactcgctggactcctcccacatgatgctcaccgccctgcactgctacaggagtcctccgctctgccacaggaagggcctgaccttcgtctctgtgcacgactgttactggactcacgcagctgatgtctccgtcatgaaccaggtgtgccgggagcagtttgtccgcttgcacagcgagcccatcctgcaggacctgtccagattcctggtcaagcggttctgctctgagccccagaagatcttggaggccagccagctgaaggagacactgcaggcggtgcccaagccaggggccttcgacctggagcaggtgaagcgttccacctacttcttcagctgacaccccgtgagccttgtcagtgtgtaaataaagctcttttgccacccccaaaaaaaa

SEQ ID NO: 417934 - DNA, 3509 bp, Homo sapiens
cccggcaggcggcgcgggcgcatgcgcaggcgcgggccggtggggtggcctggagcggcgtgcgtaatgtcggcactttgctggggccgcggagcggcggggctcaaacgagccctacggccttgcggccgcccgggactccccggcaaagaagggaccgccggtggcgtctgcggccccaggaggagctcgtccgccagcccccaggagcaagaccaagaccgcaggaaggactggggccacgtggagctgctggaggtgctccaggcgcgggtgcggcagctgcaggctgagagcgtgtcggaggtggtggtgaacagggtggatgtggcgcggctcccagaatgtggcagtggagatggtagcctccagccacccaggaaggtccagatgggggccaaggatgccaccccggtgccctgtggccgctgggcaaagatactggagaaggataagcggacccagcagatgcgtatgcagcggttgaaggcgaagctgcagatgccattccagagcggggagttcaaggcgctgaccaggcgcctgcaggtggagccccggctcctgagcaagcagatggccgggtgcctggaggactgcacgcgccaggcccccgagagcccctgggaggagcagctggcccggctgctgcaggaggcccctgggaagctgagcctcgatgtggagcaggccccgtcggggcagcactcgcaggcccagctctcaggtcagcagcagaggctcctggccttcttcaagtgctgcctgctcactgaccagctgcccctcgcccaccacctgctggtcgtccaccacggccagcggcagaagcggaagctgctcacgctggacatgtacaacgccgtgatgcttggctgggcgcggcagggtgccttcaaggagctggtatatgtgttattcatggtgaaggatgccggcttgaccccggacctgctgtcctatgcggctgccctccagtgcatggggaggcaggaccaggacgccgggaccatcgaaaggtgtctggaacagatgagccaggaggggctgaagctgcaggcactcttcaccgccgttctgctgtctgaggaggatcgggccactgttctgaaggccgtgcacaaggtgaagcccaccttcagcctcccgccgcagctgccgcccccggtcaacacctccaagctgctcagggacgtgtatgccaaggatgggcgtgtgtcctacccgaagctgcacctgcccttgaagaccctgcagtgcctctttgagaagcagctccacatggagctggccagcagggtgtgcgtggtgtccgtggagaagcccacgttgccaagcaaggaggtcaagcacgcgcggaagaccctgaagaccctgcgggaccaatgggagaaagcactgtgccgggcgctgcgggagaccaagaaccgcctagagcgcgaggtgtacgagggccggttctcactttaccccttcctgtgcctgctggacgagcgcgaggtggtgcggatgctcctgcaggtcctgcaggcgctgcccgcccaaggtgagtccttcaccaccctggcccgggagctgagtgcgcgcactttcagccggcacgtggtgcagaggcagcgggtcagtggccaggtgcaggcgctgcagaaccactacaggaagtacctctgcttgctggcctccgacgccgaggtgcccgagccctgcctgccgcggcagtactgggaggcgctgggggcgcccgaggccctgcgggagcagccctggcccctgccagtgcagatggagctgggcaagctgctggcggagatgctggtgcaggctacgcagatgccatgcagcctggacaagccgcatcgttcctctcggcttgtccccgtgctctaccacgtgtattccttccgcaacgtccagcagatcggcatcctgaagccgcacccggcctacgtgcagctgctggagaaggccgcggagcccacgctgaccttcgaggcggtggatgtacccatgctttgccccccgctgccctggacatcgccgcactctggtgctttcctgctcagccccaccaagctgatgcgcacggtggaaggcgccacgcagcaccaggagctgctggaaacctgcccgcccaccgcgctgcatggcgcactggacgccctcacccaactgggcaactgcgcctggcgcgtcaacgggcgcgtgctggacctggtgctgcagctcttccaggccaagggctgcccccagctaggcgtgccggccccgccctccgaggcgccccagccgcccgaggcccacctgccgcacagcgccgcgcccgcccgcaaggccgagctgcgccgtgagctggcgcactgccagaaggtggcccgggagatgcacagcctgcgggcggaggcgctgtaccgcctctcgctggcgcagcacctgcgggaccgcgtcttctggctgccgcacaacatggacttccgcggccgcacctacccctgcccgccgcacttcaaccacctgggcagcgacgtggcgcgggccctgctggagttcgcccagggccgcccgctcggcccgcacggcctggattggctcaagatccacctggtcaatctcacggggttgaagaagcgggagccgctgcggaagcgcctggcctttgcggaggaggtgatggatgacatcctggactccgcggaccaacccttgacgggccgaaagtggtggatgggcgcggaggaaccctggcagacgctggcctgctgtatggaggtggcgaacgctgtgcgcgcctccgaccctgccgcctatgtctcccacctccccgtccatcaggacggctcttgcaacggcctgcagcattatgctgctctgggccgcgacagcgtgggcgccgcctccgtcaacctggagccctcggatgtgccgcaggacgtgtacagcggcgtggccgcgcaggtggaggtgttccgtaggcaggacgcccagcggggcatgcgggtggcacaggtgctggaaggtttcatcacccgcaaggtggtgaagcagacggtgatgacggtggtgtacggggtcacgcgctatggcgggcgcctgcagattgagaagcgcctccgggagctgagcgactttccccaggagttcgtgtgggaggcctctcactatctcgtacgccaggtcttcaagagtctacaggagatgttctcggggacccgggccatccagcactggctgaccgagagtgcccgcctcatctcccacatgggctctgtggtggagtgggtcacacccctgggcgtccccgtcatccagccgtatcgcctggactccaaggtcaagcaaataggaggtggaattcagagcatcacctacacccacaacggagacatcagccgaaagcccaacacacgtaagcagaagaacggcttcccgcccaacttcatccactcgctggactcctcccacatgaggccacgcggtggcctcatgaggcgcggtggcctcatgaggccacg

SEQ ID NO: 417935 - DNA, 1928 bp, Homo sapiens
cccggcaggcggcgcgggcgcatgcgcaggcgcgggccggtggggtggcctggagcggcgtgcgtaatgtcggcactttgctggggccgcggagcggcggggctcaaacgagccctacggccttgcggccgcccgggactccccggcaaagaagggaccgccggtggcgtctgcggccccaggaggagctcgtccgccagcccccaggagcaagaccaagaccgcaggaaggactggggccacgtggagctgctggaggtgctccaggcgcgggtgcggcagctgcaggctgagagcgtgtcggaggtggtggtgaacagggtggatgtggcgcggctcccagaatgtggcagtggagatggtagcctccagccacccaggaaggtccagatgggggccaaggatgccaccccggtgccctgtggccgctgggcaaagatactggagaaggataagcggacccagcagatgcgtatgcagcggttgaaggcgaagctgcagatgccattccagagcggggagttcaaggcgctgaccaggcgcctgcaggtggagccccggctcctgagcaagcagatggccgggtgcctggaggactgcacgcgccaggcccccgagagcccctgggaggagcagctggcccggctgctgcaggaggcccctgggaagctgagcctcgatgtggagcaggccccgtcggggcagcactcgcaggcccagctctcaggtcagcagcagaggctcctggccttcttcaagtgctgcctgctcactgaccagctgcccctcgcccaccacctgctggtcgtccaccacggccagcggcagaagcggaagctgctcacgctggacatgtacaacgccgtgatgcttggctgggcgcggcagggtgccttcaaggagctggtatatgtgttattcatggtgaaggatgccggcttgaccccggacctgctgtcctatgcggctgccctccagtgcatggggaggcaggaccaggacgccgggaccatcgaaaggtgtctggaacagatgagccaggaggggctgaagctgcaggcactcttcaccgccgttctgctgtctgaggaggatcgggccactgttctgaaggccgtgcacaaggtgaagcccaccttcagcctcccgccgcagctgccgcccccggtcaacacctccaagctgctcagggacgtgtatgccaaggatgggcgtgtgtcctacccgaagctgcacctgcccttgaagaccctgcagtgcctctttgagaagcagctccacatggagctggccagcagggtgtgcgtggtgtccgtggagaagcccacgttgccaagcaaggaggtcaagcacgcgcggaagaccctgaagaccctgcgggaccaatgggagaaagcactgtgccgggcgctgcgggagaccaagaaccgcctagagcgcgaggtcaaataggaggtggaattcagagcatcacctacacccacaacggagacatcagccgaaagcccaacacacgtaagcagaagaacggcttcccgcccaacttcatccactcgctggactcctcccacatgatgctcaccgccctgcactgctacaggaagggcctgaccttcgtctctgtgcacgactgttactggactcacgcagctgatgtctccgtcatgaaccaggtgtgccgggagcagtttgtccgcttgcacagcgagcccatcctgcaggacctgtccagattcctggtcaagcggttctgctctgagccccagaagatcttggaggccagccagctgaaggagacactgcaggcggtgcccaagccaggggccttcgacctggagcaggtgaagcgttccacctacttcttcagctgacaccccgtgagccttgtcagtgtgtaaataaagctcttttgccacccccaaaaaaaa

SEQ ID NO: 417936 - DNA, 620 bp, Homo sapiens
gcggccgcccgggactccccggcaaagaaggtaacacaaagggagacggccaggcagcccgggggccacggcgtgggctcctccccgcgcggccggggcctttggcgctttgacctttgcctctttgcacctgggcgtgcgcagcccaccgacccggccccgctttccactcgcccttgcccgcttttcgactgaggctcctccgtgcagtctgacctttgactcgtggtttcttatgcagcctcctgaccccaggtgtggtgtttagggctcttaacctttgacctgctgcacctcgagtgcgaggaaccctctctcggcggttccgcgcccgtgttcgccgcggcggggcccttccaccttcgctgtcttagtttctttccaacttaagcccgtgctccgagagtttccgctgcgtttagggctcctttgcccttcgacccttcggcttctgcctttatggaggcccccgcccacacgcccggccccgctcagccgctctcgtctttcccgcagggaccgccggtggcgtctgcggccccaggaggagctcgtccgccagcccccaggagcaagaccaagaccgcaggaaggactggggccacgtggagctgctggag

SEQ ID NO: 417937 - DNA, 251 bp, Homo sapiens
gatctttaaaagaagtactgcatgggctttattatttctataaacacgaaggttattttttttaaagtatgacgattgttcctttgcagccagcttgtttatggcaatttttgtgtaattttatggatgaggaataatatcctgaaaggtaaaattgatcacacttaaaatatgtaagaagtaaaattgaaaggtctgttagcaagaggaaaacagtattaaaattcaatgttctaagtaaaaatgtctga

SEQ ID NO: 417938 - DNA, 426 bp, Homo sapiens
acacatactttttgtaggagattctttggctcatccactgactctgttcattcatccaacaaattcttactgcacatcaacagggtgctagaaactgtactagattctgagagaaaagaaataaacaacaatgtgaaaataaatgtgtcttcatgaaggatgcgtttttataagggacgtaacaatcattgtttattagagacgaaaatgagtaagtgtaagttgggtaaagaacaatgttatctccctagtggccccaagcctcccacggaagcatgcacctgttgtgaacagtcaatgacggcagggtggactctcctgaatttcatcttttgcttcgaatgtatctctcactacctaattactctattttattaaatctaaggtatcaatgaatttaagtgatgcattcatttatgtaccact

SEQ ID NO: 417939 - DNA, 488 bp, Homo sapiens
atacgtgtgggtagaactaaaatggctttttggtataatactgttaatgattagtatgcagaaaaaaatgaaaaccccggaagtgtcagttactgtgaaagaggcatattttcagttgtgcttattgtgcagttgtacttaaatacatttgctagatgtaattcaagctgctttacccccagggaattgaaggaaaagatatatctgctggtgagcttcaggctttttatgatgatggcatttcacccttctgtttacagtgtcaactgatggagataaattccataaaattgtcattaactcagatactagccttccatgttaggtgctattcacaaatactggataaaagttaatatgggaatgaaaaactaaatgcaagagtttattgctatgaatgattggttaactgcattttgcagcatggaaatcaacacactatgagagtgaaaactttgtgctgaataaattgactcagacaaaaaact

SEQ ID NO: 417940 - DNA, 1945 bp, Homo sapiens
aaacgcctggctttcaccaggcatcagtgtgcttcacttgagagtttggtaccatggttaagatcgagtccatgctaggtaagtcctgttaggaatgtcagtttgtattccgcccacgtgaatgatgctgagcttaatgtattattttgaggggcttcttcagagcagttctcactgagctttccattaacctacactcttccggacggctcttaaaacttgcaggacataatgaaattgggaagagcagagtgttgaagtctatagcatggccttctgcttgaccctgagttcctgaattgaatgtgggagaccacaggccatacttctctaggcactcacatgtctcccttggcataaggaaacatgttagtaatatagttttttagatccaaacagtttatttggatctaaaagtttaagtgttcagttgaaaaacagctattgattttattagtagcaaattatcaccattaaagccagtggttttttttttggtttttttttttggtttttttttttttttttgcgacagagtctcttgtcgcccaggctggagtacaatggtgtgatctcagctcactgcaacctccgcctcccaggttcaagcgattctcctgcctcagcctcctgcgtagctgggattacaggtgcccaccaccacaccctgctaatttttgtacttttagtagagatggggtttcgccatgttggccaggctggtcttgaactgctgacctcaggtgatccacccgcctcggcctcccaaagtgctggtattacagtcatgagccacctcacccagcctgtttttgagacggagtttcacttttgtcgcccaggctggagtgcaatggcgctatctcagctcactgcaacccccacctcccaggttcaagcgattctcctgcctcagcctcccgagtagctgggattacaggcatgtgccaccacccctggctaattttgtatttttagtggagacggggtttctccatgttggtcaggctggtcttaaactcccgacctcaagtgatctgcccgcctcggctcccaaagtgctgggattacaggcgtgagccattgcacctgtccctgccagtgtgttttaaaatagtttagggggttgagaaaagatgcagtgagccattattctcctttagcaggtagtctcttaaaaattgatgtggattttaaaaatataccattgagaacacgtatctttctcaaacttgaccttgaacagagctggatgggggtgggagggaaacagatttggggcatatggaagatattcttgggagccccatattctacctcagttaccgaaggctattagaacctctgaatttttcctcctctgaaatcctaagcacaacttcagaaaaccatgtctgatagcggatgtcttcctgctgtgaggagctgcttgatgtggggaccaaggtgtgggtgtgggcggaatgtatcctagtagaaacagtgaacctcagatatgaataaataagcaagagaccgaaagttaagtgtgtgacaacctcagtactgtagttaagctacattctttaaattagcttttgtgaactgattgggaacctaatctcttttgtaactgtttgagaaaaactctgaagcacctgatattcaaacaaacttatggtacttactaactcatttgtaaattggcgatgtagctggctgtagtattgctttgataatttttttcttttaatttacctaatatatataaggaaggggtttggatatattaaaataggtgttaattttatctatttaccaataaattcatctctttaaaaaacaagcagcaagagggagaggcacagagaagaaaaaagaaaagagaaagagaaggagagagaaaaagaggagaaaagaaaaacgaaagaagaggggaagaaggggagggacgaaaacgagaggc

SEQ ID NO: 417941 - DNA, 1187 bp, Homo sapiens
cgggtccagcgcacgtttctcgggatgtcatgagccacctcacccagcctgtttttgagacggagtttcacttttgtcgcccaggctggagtgcaatggcgctatctcagctcactgcaacccccacctcccaggttcaagcgattctcctgcctcagcctcccgagtagctgggattacaggcatgtgccaccacccctggctaattttgtatttttagtggagacggggtttctccatgttggtcaggctggtcttaaactcccgacctcaagtgatctgcccgcctcggctcccaaagtgctgggattacaggcgtgagccattgcacctgtccctgccagtgtgttttaaaatagtttagggggttgagaaaagatgcagtgagccattattctcctttagcaggtagtctcttaaaaattgatgtggattttaaaaatataccattgagaacacgtatctttctcaaacttgaccttgaacagagctggatgggggtgggagggaaacagatttggggcatatggaagatattcttgggagccccatattctacctcagttaccgaaggctattagaacctctgaatttttcctcctctgaaatcctaagcacaacttcagaaaaccatgtctgatagcggatgtcttcctgctgtgaggagctgcttgatgtggggaccaaggtgtgggtgtgggcggaatgtatcctagtagaaacagtgaacctcagatatgaataaataagcaagagaccgaaagttaagtgtgtgacaacctcagtactgtagttaagctacattctttaaattagcttttgtgaactgattgggaacctaatctcttttgtaactgtttgagaaaaactctgaagcacctgatattcaaacaaacttatggtacttactaactcatttgtaaattggcgatgtagctggctgtagtattgctttgataatttttttcttttaatttacctaatatatataaggaaggggtttggatatattaaaataggtgttaattttatctatttaccaataaattcatctctttaaaaaacaagcagcaagagggagaggcacagagaagaaaaaagaaaagagaaagagaaggagagagaaaaagaggagaaaagaaaaacgaaagaagaggggaagaaggggagggacgaaaacgagaggc

SEQ ID NO: 417942 - DNA, 1181 bp, Homo sapiens
cagaaactcctccaagcaacctaactcttaacccaacttctgacaccatgacctgctgccagaccagcttctgtggatatcccagcttctccatcagtgggacctgtggctccagctgctgccagccaagctgctgtgagaccagctgctgccagccacgcagctgccagactagcttctgcggatttcccagcttctcaaccagtgggacctgcagctccagttgctgccagccaagctgctgtgagaccagctgctgccagccaagctgctgtgagaccagctgctgccagccaagctgctgccagatcagctcctgcggaactggctgtggcattggtggtggcatcagctatggccaggagggcagcagtggagctgtgagcacccgtatcaggtggtgccgcccagacagtcgtgtggagggcacctacctacccccctgctgtgtggtgagctgcacgcccccatcctgctgccaactgcaccatgcccaggcctcctgctgccgcccgtcctactgtggacagtcctgctgccgcccagtctgctgctgtgagcccacttgctgaaagccagtttgcttattttcaattgcctaggtcacagtgtctctgaactgttcatcccttgaccacctctggaccactaacaagttctcagactttgcattgcttgtgatggagactactaagtatatgagctcacaattctatctgattccattctacaatgaataccttgacccttcactggggacacagaaatgctacaaagccacctgctgatcatcaatttgcttgggatatactatttctgatatttctgcaggattaaaaattactgacatgttgtggaatttatccatgagaactatccacaagtctaatgtttccatgctttataatctattttatcttgtttacctaaaattttttgcaacatcaaagacaccaaattatagccaagtgacattcctcaagtcaccagagagaatggaagctcatcacccaacattcagcttctaagaagtaggctggactttccacattttaacatctgatccatcccttggtttttggatcataatgatcttgcctgctggatatttcagttatatctgtgatacaatgtcttctgtcatttcttaataaatattatatactaggcaaagaaaccat

SEQ ID NO: 417943 - DNA, 325 bp, Homo sapiens
  misc_feature (264)..(264): n is a, c, g, or t
tgatccatatagactagaaattactatcctcactatacagaaaatggaactgaagagcagaggaatctgttaacttgcagaaggtcacatcggcaataaagggtaaagctcccatttgaacccagttctgccagaccctggagactatgttactaatcaccatggcacctggctcccacttgctatttctgagctcatcttccccatctgaaaaaaaaaataacccatgcctaccttccaggatttctagagaggagcatatgnaaccgtggatcgaaggggctttgtacattaaaagaaatgtaaaaaatttttacttatgatc

SEQ ID NO: 417944 - DNA, 652 bp, Homo sapiens
atattgaagctgcatctacattttaaacctttctagcctttagaatttggggatttatatgcgatccagtgttaggacacagcaagctgaagacttcttttacatggcaaaaccagccctctgacactgtgttttccttaatagctaatgagacagctgtttagtgacggcaacagggattgatgcagattttctttttttaatctgactaggtccactgcttccagatattgtctttttatttttttagtgatgtgattgattttccaacattttattatacagcaaagttgaacattctccagtgagctcacttatacgcagtacctacatgctgtgattctcattttactgtatttgtcttatcatgttatctgtttatttctctctctccctctcttcccccgtctatccacccatccatccattttttcttcttttaaataatttttttaatgcctataatcctagcactttgggaggccaaggcgggcagattgcttgaagccaggagttcgagaccatcctggccaacatggtgaaaccccgtctctactaaaaatacaaaaatgagctggatgtggtgacgggcacctataatcccagctattcaggaagctgaagcatgagaattgcttgaacccaggagggc

SEQ ID NO: 417945 - DNA, 367 bp, Homo sapiens
ttgtgcgccgctgggtcctcggatgtgagggcgatctggctgcgacatctgtcaccccattgatcgccagggttgattcggctgatctggctggctaggcgggtgtccccttcctccctcaccgctccatgtgcgtccctcccgaagctgcgcgctcggtcgaagaggacgaccatccccgatagaggaggaccggtcttcggtcaagggtatacgagtagctgcgctcccctgctagaacctccaaacaagctctcaaggtccatttgtaggagaacgtagggtagtcaagcttccaagactccagacacatccgtcgacgcggccgcgaatttagtagtagtaggctagtagtagtagcggccgc

SEQ ID NO: 417946 - DNA, 359 bp, Homo sapiens
ttgtgcgccgctgggtcctcggatgtgagggcgatctggctgcgacatctgtcaccccattgatcgccagggttgattcggctgatctggctggctaggcgggtgtccccttcctccctcaccgctccatgtgcgtccctcccgaagctgcgcgctcggtcgaagaggacgaccatccccgatagaggaggaccggtcttcggtcaagggtatacgagtagctgcgctcccctgctagaacctccaaacaagctctcaaggtccatttgtaggagaacgtagggtagtcaagcttccaagactccagacacatccaaatgaggcgctgcatgtggcagtctgcctttcttaaaaaaaaa

SEQ ID NO: 417947 - DNA, 411 bp, Homo sapiens
aaagcagtaaaaactcggtttatcaaaaaaaataagatataaagagtaccccgggggtgaaataaatacgataaaaaattatagtgcagcggagaacactggctgcgacatctgtcaccccattgatcgccagggttgattcggctgatctggctggctaggcgggtgtccccttcctccctcaccgctccatgtgcgtccctcccgaagctgcgcgctcggtcgaagaggacgaccatccccgatagaggaggaccggtcttcggtcaagggtatacgagtagctgcgctcccctgctagaacctccaaacaagctctcaaggtccatttgtaggagaacgtagggtagtcaagcttccaagactccagacacatccgaaaggcagactgccgtcgacgcggccgcgaat

SEQ ID NO: 417948 - DNA, 348 bp, Homo sapiens
ttgtgcgccgctgggtcctcggatgtgagggcgatctggctgcgacatctgtcaccccattgatcgccagggttgattcggctgatctggctggctaggcgggtgtccccttcctccctcaccgctccatgtgcgtccctcccgaagctgcgcgctcggtcgaagaggacgaccatccccgatagaggaggaccggtcttcggtcaagggtatacgagtagctgcgctcccctgctagaacctccaaacaagctctcaaggtccatttgtaggagaacgtagggtagtcaagcttccaagactccagacacatccgaaaggcagactgccgtcgacgcggccgcgaat

SEQ ID NO: 417949 - DNA, 471 bp, Homo sapiens
  misc_feature (347)..(347): n is a, c, g, or t
  misc_feature (466)..(466): n is a, c, g, or t
ttgtgcgccgctgggtcctcggatgtgagggcgatctggctgcgacatctgtcaccccattgatcgccagggttgattcggctgatctggctggctaggcgggtgtccccttcctccctcaccgctccatgtgcgtccctcccgaagctgcgcgctcggtcgaagaggacgaccatccccgatagaggaggaccggtcttcggtcaagggtatacgagtagctgcgctcccctgctagaacctccaaacaagctctcaaggtccatttgtaggagaacgtagggtagtcaagcttccaagactccagacacatcctcctgttgcattaagacttgaaagacttgtanatgtgtgatgttcaggcacaggatgctgaaagctatgttactattcttagtttgtaaattgtccttttgataccatcatcttgttttctttttgtaggtataaataaaaaccctgttgncaata

SEQ ID NO: 417950 - DNA, 380 bp, Homo sapiens
cgaatttagtagtagtagcggccgcctactactactaaattcgcggccgcgtcgacctggctgcgacatctgtcaccccattgatcgccagggttgattcggctgatctggctggctaggcgggtgtccccttcctccctcaccgctccatgtgcgtccctcccgaagctgcgcgctcggtcgaagaggacgaccatccccgatagaggaggaccggtcttcggtcaagggtatacgagtagctgcgctcccctgctagaacctccaaacaagctctcaaggtccatttgtaggagaacgtagggtagtcaagcttccaagactccagacacatccaaatgaggcgctgcatgtggcagtctgcctttcttaaaaaaaaa

SEQ ID NO: 417951 - DNA, 441 bp, Homo sapiens
gctcgacctaccacaaattatgcagtcgagttcgcacatttggggaaatcgcaggggtcagcacatccggagtgcaatggataagcctcgccctgggaaaaccaccttcgtgatcatctggctgcgacatctgtcaccccattgatcgccagggttgattcggctgatctggctggctaggcgggtgtccccttcctccctcaccgctccatgtgcgtccctcccgaagctgcgcgctcggtcgaagaggacgaccatccccgatagaggaggaccggtcttcggtcaagggtatacgagtagctgcgctcccctgctagaacctccaaacaagctctcaaggtccatttgtaggagaacgtagggtagtcaagcttccaagactccagacacatccaaatgaggcgctgcatgtggcagtctgcctttcttaaaaaaaaa

SEQ ID NO: 417952 - DNA, 3695 bp, Homo sapiens
cttgcttttttttcctaggccaaatcacccaaggaggcggaagcagacctaagctttgactcataccattccacccaaactgacttgggcccatccctgggaaaacctggtgaaacctctcccccagactccaaatcatctccatctgtcttaatacattctttaggtaaatccactactgacaatgatgtcagaattcagcaactgcaagagattttgcaagatctacagaagagattagagagctctgaagcagagagaaaacagctacaggtcgaactccaatcccgaagggcagaactggtatgcttaaacaacactgagatttcagagaacagctctgacctcagccagaaacttaaagaaactcagagcaaatacgaggaggctatgaaagaagtccttagtgtgcagaagcagatgaaactcggtcttgtctcacctgaaagcatggataattattcacatttccacgagctgagggtcacggaagaggaaataaatgtgctaaagcaggatctgcagaatgcattagaagaaagtgaaagaaataaagagaaagtgagagagttagaggaaaaactggtagagagggagaaaggtacagtgattaagccacctgtggaagagtacgaggaaatgaaaagttcatattgctctgttattgagaatatgaataaggagaaagcatttttgtttgagaaataccaagaagcccaagaagaaatcatgaaattaaaagacacactaaaaagtcagatgacacaggaagccagtgatgaagctgaggacatgaaagaagccatgaataggatgatagatgaactcaataaacaggtgagcgagctgtcacagctgtacaaagaagcccaggctgagctggaggattacaggaagaggaaatctctagaggatgtcacagctgaatatatccataaagcagagcatgagaaactgatgcaattgacaaacgtgtccagggctaaagcagaagatgcactgtctgaaatgaagtctcagtattcaaaagtgttgaatgagttgacccagctcaaacaactggtggatgcacaaaaagagaactctgtctctatcacagaacatttgcaagtgataaccacgctgcggactgcagcaaaagagatggaagaaaaaataagcaatcttaaggaacaccttgcaagcaaggaagtggaagtagcaaagctggagaaacaactcttagaagagaaagctgctatgactgatgcaatggtacctcggtcttcctatgaaaaactccagtcatccttagagagtgaagtgagtgtgttggcatcgaaattaaaggaatctgtgaaagagaaagagaaggtccattcagaggttgtccagattagaagtgaggtctcacaggtgaaaagagaaaaggaaaatattcagactctcttgaaatccaaagagcaagaagtaaatgaacttctgcaaaaattccagcaagctcaggaagaacttgcagaaatgaaaagatacgctgagagctcttcaaaactggaggaagataaagataaaaagataaatgagatgtcgaaggaagtcaccaaattgaaggaggccttgaacagcctctcccagctctcctactcaacaagctcatccaaaaggcagagtcagcagctggaggcgctgcagcagcaagtcaaacagctccagaaccagctggcggaatgcaagaaacaacaccaggaggtcatatcagtttacagaatgcatcttctgtatgctgtgcagggccagatggatgaagatgtccagaaagtactgaagcaaatccttaccatgtgtaaaaaccagtctcaaaagaagtaaagtggattccttggcaggacactgccccttgtcatctgtctttgtgttagatccagagttgtcggcagccgctgccattgttctcattcgtggtatgcactgtggcctagcgtagcttcttccctttccaaaggtttctgaggacttctcccaggagaagactgcccgcctcagaactgcttagagacttcaaaccagcagaggtgaaagtccctgtcatcccttcagattccagagctgggatcagccatgcccagaggtctggtcctgatgctggcaggggggccccctcctccatccctgactggctgagtggctttatcaccaccgagtgatgtgctgaggcctcctgcagtgaatgctccttccattcctgtactcgggcagtgccattcagcacaggagagctctttttgcctttggctttcaattccaaaacatgatttaatttctaactaaattagtatggcactagttatgaagtatctgcttaaaacccttcatcatgatatcctgtggatttaaaaactctaattccatgttttcttcccatctgccttatatatctcatcaccctgcttatcaatattcagtttgatgagcactattaactaaaatatgaaacttaaaaacaaaagcaagttgtccttaaaagttctttttttaagtaaattgttgacatactgcaaattttctatgcaaacttgcctcctgctgttatctgtgaagctcaggaaatccaaacatttgtgtttcaacaagggacagtaaactgtgtgtttacagccaaaagaaatgcctcatagttcttaacctcaacttttgtagaagtatttttttctctgtaatatttttattggctcataaagatgttttcatatctgaactcctaaataagtgaaattacagtagattatattaacaaaatactttttaggtagccatgcttgagactttttaaaaatataactttttccttaaagttttcagctatagcaaaaggtagttatgtatgccagacctaatatgagctgccaccaacacccctagaactttcagccatggtgtcttcagaattgtagcgcatttctgaatctagcaaatcctccttttacccgttgaatgttttgaatgccctgactctaccagcgcccataaatgatctctagaaggactgttagtaccaatctgtttttcaactttgaagctaaaaaccctgatatggtaatattatggtgcatagcagaggtctcggaaaaaaaatatttctgttcactttactttcaggttaaaaatgtttctaacacgcttgcaacttcccttatggcattaatcttgttgagggagagagacagaatcctggactctccaaagtatttaactgaaagtagggcctgctctgacagggcccatgtcccacaaggctgcttggcctcagtgggtgcttggctgtgctggatgatatgttgatctgtattggataaggaccaatgacagcaaagcaaaaatggctttaaagcttggtgttacttttcttaagttgtttaattatagttaagcaatttcaaaaatgctccaaagaaatgtgaaaggaccttttgtcacagcacttcagaaaatacacaacagccccttctgcccccgcacagaaatgctgcagagtatataaaacttgagacatttttgtaggatgcctgacgaggtgtagccttttatcttgtttccggatgcatatttattacgagtactctggttaaatattgaaaagttatatgctgtagtttttagtattttgtctttgtaatttacagaagttattggagaaaataaacttgtttcattttgca

SEQ ID NO: 417953 - DNA, 3641 bp, Homo sapiens
cttgcttttttttcctaggccaaatcacccaaggaggcggaagcagacctaagctttgactcataccattccacccaaactgacttgggcccatccctgggaaaacctggtgaaacctctcccccagactccaaatcatctccatctgtcttaatacattctttaggtaaatccactactgacaatgatgtcagaattcagcaactgcaagagattttgcaagatctacagaagagattagagagctctgaagcagagagaaaacagctacaggtcgaactccaatcccgaagggcagaactggtatgcttaaacaacactgagatttcagagaacagctctgacctcagccagaaacttaaagaaactcagagcaaatacgaggaggctatgaaagaagtccttagtgtgcagaagcagatgaaactcggtcttgtctcacctgaaagcatggataattattcacatttccacgagctgagggtcacggaagaggaaataaatgtgctaaagcaggatctgcagaatgcattagaagaaagtgaaagaaataaagagaaagtgagagagttagaggaaaaactggtagagagggagaaaggtacagtgattaagccacctgtggaagagtacgaggaaatgaaaagttcatattgctctgttattgagaatatgaataaggagaaagcatttttgtttgagaaataccaagaagcccaagaagaaatcatgaaattaaaagacacactaaaaagtcagatgacacaggaagccagtgatgaagctgaggacatgaaagaagccatgaataggatgatagatgaactcaataaacaggtgagcgagctgtcacagctgtacaaagaagcccaggctgagctggaggattacaggaagaggaaatctctagaggatgtcacagctgaatatatccataaagcagagcatgagaaactgatgcaattgacaaacgtgtccagggctaaagcagaagatgcactgtctgaaatgaagtctcagtattcaaaagtgttgaatgagttgacccagctcaaacaactggtggatgcacaaaaagagaactctgtctctatcacagaacatttgcaagtgataaccacgctgcggactgcagcaaaagagatggaagaaaaaataagcaatcttaaggaacaccttgcaagcaaggaagtggaagtagcaaagctggagaaacaactcttagaagagaaagctgctatgactgatgcaatggtacctcggtcttcctatgaaaaactccagtcatccttagagagtgaagtgagtgtgttggcatcgaaattaaaggaatctgtgaaagagaaagagaaggtccattcagaggttgtccagattagaagtgaggtctcacaggtgaaaagagaaaaggaaaatattcagactctcttgaaatccaaagagcaagaagtaaatgaacttctgcaaaaattccagcaagctcaggaagaacttgcagaaatgaaaagatacgctgagagctcttcaaaactggaggaagataaagataaaaagataaatgagatgtcgaaggaagtcaccaaattgaaggaggccttgaacagcctctcccagctctcctactcaacaagctcatccaaaaggcagagtcagcagctggaggcgctgcagcagcaagtcaaacagctccagaaccagctggcggaatgcaagaaacaacaccaggaggtcatatcagtttacagaatgcatcttctgtatgctgtgcagggccagatggatgaagatgtccagaaagtactgaagcaaatccttaccatgtgtaaaaaccagtctcaaaagaagtaaagtggattccttggcaggacactgccccttgtcatctgtctttgtgttagatccagagttgtcggcagccgctgccattgttctcattcgtggtatgcactgtggcctagcgtagcttcttccctttccaaaggtttctgaggacttctcccaggagaagactgcccgcctcagaactgcttagagacttcaaaccagcagaggtgaaagtccctgtcatcccttcagattccagagctgggatcagccatgcccagaggtctggtcctgatgctggcaggggggccccctcctccatccctgactggctgagtggctttatcaccaccgagtgatgtgctgaggcctcctgcagtgaatgctccttccattcctgtactcgggcagtgccattcagcacaggagagctctttttgcctttggctttcaattccaaaacatgatttaatttctaactaaattagtatggcactagttatgaagtatctgcttaaaacccttcatcatgatatcctgtggatttaaaaactctaattccatgttttcttcccatctgccttatatatctcatcaccctgcttatcaatattcagtttgatgagcactattaactaaaatatgaaacttaaaaacaaaagcaagttgtccttaaaagttctttttttaagtaaattgttgacatactgcaaattttctatgcaaacttgcctcctgctgttatctgtgaagctcaggaaatccaaacatttgtgtttcaacaagggacagtaaactgtgtgtttacagccctgtaatatttttattggctcataaagatgttttcatatctgaactcctaaataagtgaaattacagtagattatattaacaaaatactttttaggtagccatgcttgagactttttaaaaatataactttttccttaaagttttcagctatagcaaaaggtagttatgtatgccagacctaatatgagctgccaccaacacccctagaactttcagccatggtgtcttcagaattgtagcgcatttctgaatctagcaaatcctccttttacccgttgaatgttttgaatgccctgactctaccagcgcccataaatgatctctagaaggactgttagtaccaatctgtttttcaactttgaagctaaaaaccctgatatggtaatattatggtgcatagcagaggtctcggaaaaaaaatatttctgttcactttactttcaggttaaaaatgtttctaacacgcttgcaacttcccttatggcattaatcttgttgagggagagagacagaatcctggactctccaaagtatttaactgaaagtagggcctgctctgacagggcccatgtcccacaaggctgcttggcctcagtgggtgcttggctgtgctggatgatatgttgatctgtattggataaggaccaatgacagcaaagcaaaaatggctttaaagcttggtgttacttttcttaagttgtttaattatagttaagcaatttcaaaaatgctccaaagaaatgtgaaaggaccttttgtcacagcacttcagaaaatacacaacagccccttctgcccccgcacagaaatgctgcagagtatataaaacttgagacatttttgtaggatgcctgacgaggtgtagccttttatcttgtttccggatgcatatttattacgagtactctggttaaatattgaaaagttatatgctgtagtttttagtattttgtctttgtaatttacagaagttattggagaaaataaacttgtttcattttgca

SEQ ID NO: 417954 - DNA, 3726 bp, Homo sapiens
cttgcttttttttcctaggccaaatcacccaaggaggcggaagcagacctaagctttgactcataccattccacccaaactgacttgggcccatccctgggaaaacctggtgaaacctctcccccagactccaaatcatctccatctgtcttaatacattctttaggtaaatccactactgacaatgatgtcagaattcagcaactgcaagagattttgcaagatctacagaagagattagagagctctgaagcagagagaaaacagctacaggtcgaactccaatcccgaagggcagaactggtatgcttaaacaacactgagatttcagagaacagctctgacctcagccagaaacttaaagaaactcagagcaaatacgaggaggctatgaaagaagtccttagtgtgcagaagcagatgaaactcggtcttgtctcacctgaaagcatggataattattcacatttccacgagctgagggtcacggaagaggaaataaatgtgctaaagcaggatctgcagaatgcattagaagaaagtgaaagaaataaagagaaagtgagagagttagaggaaaaactggtagagagggagaaaggtacagtgattaagccacctgtggaagagtacgaggaaatgaaaagttcatattgctctgttattgagaatatgaataaggagaaagcatttttgtttgagaaataccaagaagcccaagaagaaatcatgaaattaaaagacacactaaaaagtcagatgacacaggaagccagtgatgaagctgaggacatgaaagaagccatgaataggatgatagatgaactcaataaacaggtgagcgagctgtcacagctgtacaaagaagcccaggctgagctggaggattacaggaagaggaaatctctagaggatgtcacagctgaatatatccataaagcagagcatgagaaactgatgcaattgacaaacgtgtccagggctaaagcagaagatgcactgtctgaaatgaagtctcagtattcaaaagtgttgaatgagttgacccagctcaaacaactggtggatgcacaaaaagagaactctgtctctatcacagaacatttgcaagtgataaccacgctgcggactgcagcaaaagagatggaagaaaaaataagcaatcttaaggaacaccttgcaagcaaggaagtggaagtagcaaagctggagaaacaactcttagaagagaaagctgctatgactgatgcaatggtacctcggtcttcctatgaaaaactccagtcatccttagagagtgaagtgagtgtgttggcatcgaaattaaaggaatctgtgaaagagaaagagaaggtccattcagaggttgtccagattagaagtgaggtctcacaggtgaaaagagaaaaggaaaatattcagactctcttgaaatccaaagagcaagaagtaaatgaacttctgcaaaaattccagcaagctcaggaagaacttgcagaaatgaaaagatacgctgagagctcttcaaaactggaggaagataaagataaaaagataaatgagatgtcgaaggaagtcaccaaattgaaggaggccttgaacagcctctcccagctctcctactcaacaagctcatccaaaaggcagagtcagcagctggaggcgctgcagcagcaagtcaaacagctccagaaccagctggcggaatgcaagaaacaacaccaggaggtcatatcagtttacagaatgcatcttctgtatgctgtgcagggccagatggatgaagatgtccagaaagtactgaagcaaatccttaccatgtgtaaaaaccagtctcaaaagaagtaaagtggattccttggcaggacactgccccttgtcatctgtctttgtgttagatccagagttgtcggcagccgctgccattgttctcattcgtggtatgcactgtggcctagcgtagcttcttccctttccaaaggtttctgaggacttctcccaggagaagactgcccgcctcagaactgcttagagacttcaaaccagcagaggtgaaagtccctgtcatcccttcagattccagagctgggatcagccatgcccagaggtctggtcctgatgctggcaggggggccccctcctccatccctgactggctgagtggctttatcaccaccgagtgatgtgctgaggcctcctgcagtgaatgctccttccattcctgtactcgggcagtgccattcagcacaggagagctctttttgcctttggctttcaattccaaaacatgatttaatttctaactaaattagtatggcactagttatgaagtatctgcttaaaacccttcatcatgatatcctgtggatttaaaaactctaattccatgttttcttcccatctgccttatatatctcatcaccctgcttatcaatattcagtttgatgagcactattaactaaaatatgaaacttaaaaacaaaagcaagttgtccttaaaagttctttttttaagtaaattgttgacatactgcaaattttctatgcaaacttgcctcctgctgttatctgtgaagctcaggaaatccaaacatttgtgtttcaacaagggacagtaaactgtgtgtttacagccaaaagaaatgcctcatagttcttaacctcaacttttgtagaagtatttttttctctgtaatatttttattggctcataaagatgttttcatatctgaactcctaaataagtgaaattacagtagattatattaacaaaatactttttaggtagccatgcttgagactttttaaaaatataactttttccttaaagttttcagctatagcaaaaggtagttatgtatgccagacctaatatgagctgccaccaacacccctagaactttcagccatggtgtcttcagaattgtagcgcatttctgaatctagcaaatcctccttttacccgttgaatgttttgaatgccctgactctaccagcgcccataaatgatctctagaaggactgttagtaccaatctgtttttcaactttgaagctaaaaaccctgatatggtaatattatggtgcatagcagaggtctcggaaaaaaaatatttctgttcactttactttcaggttaaaaatgtttctaacacgcttgcaacttcccttatggcattaatcttgttgagggagagagacagaatcctggactctccaaagtatttaactgaaagtagggcctgctctgacagggcccatgtcccacaaggctgcttggcctcagtgggtgcttggctgtgctggatgatatgttgatctgtattggataaggaccaatgacagcaaagcaaaaatggctttaaagcttggtgttacttttcttaagttgtttaattatagttaagcaatttcaaaaatgctccaaagaaatgtgaaaggaccttttgtcacagcacttcagaaaatacacaacagccccttctgcccccgcacagaaatgctgcagagtatataaaacttgagacatttttgtaggatgcctgacgaggtgtagccttttatcttgtttccggatgcatatttattacgagtactctggttaaatattgaaaagttatatgctgtagtttttagtattttgtctttgtaatttacagaagttattggagaaaataaacttgtttcattttgcaaaaaaaaaaaagacgagacaacaacacaaca

SEQ ID NO: 417955 - DNA, 2658 bp, Homo sapiens
ataaaatcttgagtcagatacccttcttctaaaagtcgagtttcccttacacaaaagttctagaatgtttttagctcacatttatggtttcatggaaacatgaatgatttttttgaattttttgctactaaaaataactaaactataaagggggaattactgactggatcccagttagtcttacaaaaaagagaaagctgctatgactgatgcaatggtacctcggtcttcctatgaaaaactccagtcatccttagagagtgaagtgagtgtgttggcatcgaaattaaaggaatctgtgaaagagaaagagaaggtccattcagaggttgtccagattagaagtgaggtctcacaggtgaaaagagaaaaggaaaatattcagactctcttgaaatccaaagagcaagaagtaaatgaacttctgcaaaaattccagcaagctcaggaagaacttgcagaaatgaaaagatacgctgagagctcttcaaaactggaggaagataaagataaaaagataaatgagatgtcgaaggaagtcaccaaattgaaggaggccttgaacagcctctcccagctctcctactcaacaagctcatccaaaaggcagagtcagcagctggaggcgctgcagcagcaagtcaaacagctccagaaccagctggcggaatgcaagaaacaacaccaggaggtcatatcagtttacagaatgcatcttctgtatgctgtgcagggccagatggatgaagatgtccagaaagtactgaagcaaatccttaccatgtgtaaaaaccagtctcaaaagaagtaaagtggattccttggcaggacactgccccttgtcatctgtctttgtgttagatccagagttgtcggcagccgctgccattgttctcattcgtggtatgcactgtggcctagcgtagcttcttccctttccaaaggtttctgaggacttctcccaggagaagactgcccgcctcagaactgcttagagacttcaaaccagcagaggtgaaagtccctgtcatcccttcagattccagagctgggatcagccatgcccagaggtctggtcctgatgctggcaggggggccccctcctccatccctgactggctgagtggctttatcaccaccgagtgatgtgctgaggcctcctgcagtgaatgctccttccattcctgtactcgggcagtgccattcagcacaggagagctctttttgcctttggctttcaattccaaaacatgatttaatttctaactaaattagtatggcactagttatgaagtatctgcttaaaacccttcatcatgatatcctgtggatttaaaaactctaattccatgttttcttcccatctgccttatatatctcatcaccctgcttatcaatattcagtttgatgagcactattaactaaaatatgaaacttaaaaacaaaagcaagttgtccttaaaagttctttttttaagtaaattgttgacatactgcaaattttctatgcaaacttgcctcctgctgttatctgtgaagctcaggaaatccaaacatttgtgtttcaacaagggacagtaaactgtgtgtttacagccaaaagaaatgcctcatagttcttaacctcaacttttgtagaagtatttttttctctgtaatatttttattggctcataaagatgttttcatatctgaactcctaaataagtgaaattacagtagattatattaacaaaatactttttaggtagccatgcttgagactttttaaaaatataactttttccttaaagttttcagctatagcaaaaggtagttatgtatgccagacctaatatgagctgccaccaacacccctagaactttcagccatggtgtcttcagaattgtagcgcatttctgaatctagcaaatcctccttttacccgttgaatgttttgaatgccctgactctaccagcgcccataaatgatctctagaaggactgttagtaccaatctgtttttcaactttgaagctaaaaaccctgatatggtaatattatggtgcatagcagaggtctcggaaaaaaaatatttctgttcactttactttcaggttaaaaatgtttctaacacgcttgcaacttcccttatggcattaatcttgttgagggagagagacagaatcctggactctccaaagtatttaactgaaagtagggcctgctctgacagggcccatgtcccacaaggctgcttggcctcagtgggtgcttggctgtgctggatgatatgttgatctgtattggataaggaccaatgacagcaaagcaaaaatggctttaaagcttggtgttacttttcttaagttgtttaattatagttaagcaatttcaaaaatgctccaaagaaatgtgaaaggaccttttgtcacagcacttcagaaaatacacaacagccccttctgcccccgcacagaaatgctgcagagtatataaaacttgagacatttttgtaggatgcctgacgaggtgtagccttttatcttgtttccggatgcatatttattacgagtactctggttaaatattgaaaagttatatgctgtagtttttagtattttgtctttgtaatttacagaagttattggagaaaataaacttgtttcattttgca

SEQ ID NO: 417956 - DNA, 3941 bp, Homo sapiens
  misc_feature (3735)..(3735): n is a, c, g, or t
  misc_feature (3740)..(3740): n is a, c, g, or t
  misc_feature (3753)..(3753): n is a, c, g, or t
  misc_feature (3757)..(3757): n is a, c, g, or t
cttgcttttttttcctaggccaaatcacccaaggaggcggaagcagacctaagctttgactcataccattccacccaaactgacttgggcccatccctgggaaaacctggtgaaacctctcccccagactccaaatcatctccatctgtcttaatacattctttaggtaaatccactactgacaatgatgtcagaattcagcaactgcaagagattttgcaagatctacagaagagattagagagctctgaagcagagagaaaacagctacaggtcgaactccaatcccgaagggcagaactggtatgcttaaacaacactgagatttcagagaacagctctgacctcagccagaaacttaaagaaactcagagcaaatacgaggaggctatgaaagaagtccttagtgtgcagaagcagatgaaactcggtcttgtctcacctgaaagcatggataattattcacatttccacgagctgagggtcacggaagaggaaataaatgtgctaaagcaggatctgcagaatgcattagaagaaagtgaaagaaataaagagaaagtgagagagttagaggaaaaactggtagagagggagaaaggtacagtgattaagccacctgtggaagagtacgaggaaatgaaaagttcatattgctctgttattgagaatatgaataaggagaaagcatttttgtttgagaaataccaagaagcccaagaagaaatcatgaaattaaaagacacactaaaaagtcagatgacacaggaagccagtgatgaagctgaggacatgaaagaagccatgaataggatgatagatgaactcaataaacaggtgagcgagctgtcacagctgtacaaagaagcccaggctgagctggaggattacaggaagaggaaatctctagaggatgtcacagctgaatatatccataaagcagagcatgagaaactgatgcaattgacaaacgtgtccagggctaaagcagaagatgcactgtctgaaatgaagtctcagtattcaaaagtgttgaatgagttgacccagctcaaacaactggtggatgcacaaaaagagaactctgtctctatcacagaacatttgcaagtgataaccacgctgcggactgcagcaaaagagatggaagaaaaaataagcaatcttaaggaacaccttgcaagcaaggaagtggaagtagcaaagctggagaaacaactcttagaagagaaagctgctatgactgatgcaatggtacctcggtcttcctatgaaaaactccagtcatccttagagagtgaagtgagtgtgttggcatcgaaattaaaggaatctgtgaaagagaaagagaaggtccattcagaggttgtccagattagaagtgaggtctcacaggtgaaaagagaaaaggaaaatattcagactctcttgaaatccaaagagcaagaagtaaatgaacttctgcaaaaattccagcaagctcaggaagaacttgcagaaatgaaaagatacgctgagagctcttcaaaactggaggaagataaagataaaaagataaatgagatgtcgaaggaagtcaccaaattgaaggaggccttgaacagcctctcccagctctcctactcaacaagctcatccaaaaggcagagtcagcagctggaggcgctgcagcagcaagtcaaacagctccagaaccagctggcggaatgcaagaaacaacaccaggaggtcatatcagtttacagaatgcatcttctgtatgctgtgcagggccagatggatgaagatgtccagaaagtactgaagcaaatccttaccatgtgtaaaaaccagtctcaaaagaagtaaagtggattccttggcaggacactgccccttgtcatctgtctttgtgttagatccagagttgtcggcagccgctgccattgttctcattcgtggtatgcactgtggcctagcgtagcttcttccctttccaaaggtttctgaggacttctcccaggagaagactgcccgcctcagaactgcttagagacttcaaaccagcagaggtgaaagtccctgtcatcccttcagattccagagctgggatcagccatgcccagaggtctggtcctgatgctggcaggggggccccctcctccatccctgactggctgagtggctttatcaccaccgagtgatgtgctgaggcctcctgcagtgaatgctccttccattcctgtactcgggcagtgccattcagcacaggagagctctttttgcctttggctttcaattccaaaacatgatttaatttctaactaaattagtatggcactagttatgaagtatctgcttaaaacccttcatcatgatatcctgtggatttaaaaactctaattccatgttttcttcccatctgccttatatatctcatcaccctgcttatcaatattcagtttgatgagcactattaactaaaatatgaaacttaaaaacaaaagcaagttgtccttaaaagttctttttttaagtaaattgttgacatactgcaaattttctatgcaaacttgcctcctgctgttatctgtgaagctcaggaaatccaaacatttgtgtttcaacaagggacagtaaactgtgtgtttacagccaaaagaaatgcctcatagttcttaacctcaacttttgtagaagtatttttttctctgtaatatttttattggctcataaagatgttttcatatctgaactcctaaataagtgaaattacagtagattatattaacaaaatactttttaggtagccatgcttgagactttttaaaaatataactttttccttaaagttttcagctatagcaaaaggtagttatgtatgccagacctaatatgagctgccaccaacacccctagaactttcagccatggtgtcttcagaattgtagcgcatttctgaatctagcaaatcctccttttacccgttgaatgttttgaatgccctgactctaccagcgcccataaatgatctctagaaggactgttagtaccaatctgtttttcaactttgaagctaaaaaccctgatatggtaatattatggtgcatagcagaggtctcggaaaaaaaatatttctgttcactttactttcaggttaaaaatgtttctaacacgcttgcaacttcccttatggcattaatcttgttgagggagagagacagaatcctggactctccaaagtatttaactgaaagtagggcctgctctgacagggcccatgtcccacaaggctgcttggcctcagtgggtgcttggctgtgctggatgatatgttgatctgtattggataaggaccaatgacagcaaagcaaaaatggctttaaagcttggtgttacttttcttaagttgtttaattatagttaagcaatttcaaaaatgctccaaagaaatgtgaaaggaccttttgtcacagcacttcagaaaatacacaacagccccttctgcccccgcacagaaatgctgcagagtatataaaacttgagacatttttgtaggatgcctgacgaggtgtagccttttatcttgtttccggatgcatatttattacgagtactctggttaaatattgaaaagttatatgctgtagtttttagtattttgtctttgtaatttacagaagttattggagaaaataaacttgtttcattttgcaaaaaaaaaaaaaaaaaaaaaaaaaaaaaaaaaaaaaaaanaaaanaacaaaaaaaaanaaanaaaaaaaaaaaaaaaaaaaaaacaaacgagggggggcggccgccgacgacgccccacagaaagagcagtacaggccaccaggggggggtgcggcggcgccccgaagagagagagagaggcagaagaggggggcaagggagtgtgagaaaggaaaccgggggcaaaacaaagggaggggagagac

SEQ ID NO: 417957 - DNA, 2731 bp, Homo sapiens
  misc_feature (2525)..(2525): n is a, c, g, or t
  misc_feature (2530)..(2530): n is a, c, g, or t
  misc_feature (2543)..(2543): n is a, c, g, or t
  misc_feature (2547)..(2547): n is a, c, g, or t
cttgcttttttttcctaggccaaatcacccaaggaggcggaagcagacctaagctttgactcataccattccacccaaactgacttgggcccatccctgggaaaacctggtgaaacctctcccccagactccaaatcatctccatctgtcttaatacattctttaggtaaatccactactgacaatgatgtcagaattcagcaactgcaagagattttgcaagatctacagaagagattagagagctctgaagcagagagaaaacagctacaggtcgaactccaatcccgaagggcagaactggtatgcttaaacaacactgagatttcagagaacagctctgacctcagccagaaacttaaagaaactcagagcaaatacgaggaggctatgaaagaagtccttagtgtgcagaagcagatgaaactcggtcttgtctcacctgaaagcatggataattattcacatttccacgagctgagggtcacggaagaggaaataaatgtgctaaagcaggatctgcagaatgcattagaagaaagtgaaagaaataaagagaaagtgagagagttagaggaaaaactggtagagagggagaaaggtacagtgattaagccacctgtggaagagtacgaggaaatgaaaagttcatattgctctgttattgagaatatgaataaggagaaagcatttttgtttgagaaataccaagaagcccaagaagaaatcatgaaattaaaagacacactaaaaagtcagatgacacaggaagccagtgatgaagctgaggacatgaaagaagccatgaataggatgatagatgaactcaataaacaggtgagcgagctgtcacagctgtacaaagaagcccaggctgagctggaggattacaggaagaggaaatctctagaggatgtcacagctgaatatatccataaagcagagcatgagaaactgatgcaattgacaaacgtgtccagggctaaagcagaagatgcactgtctgaaatgaagtctcagtattcaaaagtgttgaatgagttgacccagctcaaacaactggtggatgcacaaaaagagaactctgtctctatcacagaacatttgcaagtgataaccacgctgcggactgcagcaaaagagatggaagaaaaaataagcaatcttaaggaacaccttgcaagcaaggaagtggaagtagcaaagctggagaaacaactcttagaagagaaagctgctatgactgatgcaatggtacctcggtcttcctatgaaaaactccagtcatccttagagagtgaagtgagtgtgttggcatcgaaattaaaggaatctgtgaaagagaaagagaaggtccattcagaggttgtccagattagaagtgaggtctcacaggtgaaaagagaaaaggaaaatattcagactctcttgaaatccaaagagcaagaagtaaatgaacttctgcaaaaattccagcaagctcaggaagaacttgcagaaatgaaaagatacgctgagagctcttcaaaactggaggaagataaagataaaaagataaatgagatgtcgaaggaagtcaccaaattgaaggaggccttgaacagcctctcccagctctcctactcaacaagctcatccaaaaggcagagtcagcagctggaggcgctgcagcagcaagtcaaacagctccagaaccagctggcggaatgcaagaaacaacaccaggaggtcatatcagtttacagaatgcatcttctgtatgctgtgcagggccagatggatgaagatgtccagaaagtactgaagcaaatccttaccatgtgtaaaaaccagtctcaaaagaagtaaagtggattccttggcaggacactgccccttgtcatctgtctttgtgttagatccagagttgtcggcagccgctgccattgttctcattcgtggtatgcactgtggcctagcgtagcttcttccctttccaaaggtttctgaggacttctcccaggagaagactgcccgcctcagaactgcttagagacttcaaaccagcagaggtgaaagtccctgtcatcccttcagattccagagctgggatcagccatgcccagaggtctggtcctgatgctggcaggggggccccctcctccatccctgactggctgagtggctttatcaccaccgagtgatgtgctgaggcctcctgcagtgaatgctccttccattcctgtactcgggcagtgccattcagcacaggagagctctttttgcctttggctttcaattccaaaacatgatttaatttctaactaaattagtatggcactagttatgaagtatctgcttaaaacccttcatcatgatatcctgtggatttaaaaactctaattccatgttttcttcccatctgccttatatatctcatcaccctgcttatcaatattcagtttgatgagcactattaactaaaatatgaaacttaaaaacaaaaaaaaaaaaaaaaaaaaaaaaaaaaaaaaaaaaaaaaaaanaaaanaacaaaaaaaaanaaanaaaaaaaaaaaaaaaaaaaaaacaaacgagggggggcggccgccgacgacgccccacagaaagagcagtacaggccaccaggggggggtgcggcggcgccccgaagagagagagagaggcagaagaggggggcaagggagtgtgagaaaggaaaccgggggcaaaacaaagggaggggagagac

SEQ ID NO: 417958 - DNA, 1867 bp, Homo sapiens
cttgcttttttttcctaggccaaatcacccaaggaggcggaagcagacctaagctttgactcataccattccacccaaactgacttgggcccatccctgggaaaacctggtgaaacctctcccccagactccaaatcatctccatctgtcttaatacattctttaggtaaatccactactgacaatgatgtcagaattcagcaactgcaagagattttgcaagatctacagaagagattagagagctctgaagcagagagaaaacagctacaggtcgaactccaatcccgaagggcagaactggtatgcttaaacaacactgagatttcagagaacagctctgacctcagccagaaacttaaagaaactcagagcaaatacgaggaggctatgaaagaagtccttagtgtgcagaagcagatgaaactcggtcttgtctcacctgaaagcatggataattattcacatttccacgagctgagggtcacggaagaggaaataaatgtgctaaagcaggatctgcagaatgcattagaagaaagtgaaagaaataaagagaaagtgagagagttagaggaaaaactggtagagagggagaaaggtacagtgattaagccacctgtggaagagtacgaggaaatgaaaagttcatattgctctgttattgagaatatgaataaggagaaagcatttttgtttgagaaataccaagaagcccaagaagaaatcatgaaattaaaagacacactaaaaagtcagatgacacaggaagccagtgatgaagctgaggacatgaaagaagccatgaataggatgatagatgaactcaataaacaggtgagcgagctgtcacagctgtacaaagaagcccaggctgagctggaggattacaggaagaggaaatctctagaggatgtcacagctgaatatatccataaagcagagcatgagaaactgatgcaattgacaaacgtgtccagggctaaagcagaagatgcactgtctgaaatgaagtctcagtattcaaaagtgttgaatgagttgacccagctcaaacaactggtggatgcacaaaaagagaactctgtctctatcacagaacatttgcaagtgataaccacgctgcggactgcagcaaaagagatggaagaaaaaataagcaatcttaaggaacaccttgcaagcaaggaagtggaagtagcaaagctggagaaacaactcttagaagagaaagctgctatgactgatgcaatggtacctcggtcttcctatgaaaaactccagtcatccttagagagtgaagtgagtgtgttggcatcgaaattaaaggaatctgtgaaagagaaagagaaggtccattcagaggttgtccagattagaagtgaggtctcacaggtgaaaagagaaaaggaaaatattcagactctcttgaaatccaaagagcaagaagtaaatgaacttctgcaaaaattccagcaagctcaggaagaacttgcagaaatgaaaagatacgctgagagctcttcaaaactggaggaagataaagataaaaagataaatgagatgtcgaaggaagtcaccaaattgaaggaggccttgaacagcctctcccagctctcctactcaacaagctcatccaaaaggcagagtcagcagctggaggcgctgcagcagcaagtcaaacagctccagaaccagctggcggaatgcaagaaacaacaccaggaggtcatatcagtttacagaatgcatcttctgtatgctgtgcagggccagatggatgaagatgtccagaaagtactgaagcaaatccttaccatgtgtaaaaaccagtctcaaaagaagtaaagtggattccttggcagga

SEQ ID NO: 417959 - DNA, 2160 bp, Homo sapiens
cttgcttttttttcctaggccaaatcacccaaggaggcggaagcagacctaagctttgactcataccattccacccaaactgacttgggcccatccctgggaaaacctggtgaaacctctcccccagactccaaatcatctccatctgtcttaatacattctttaggtaaatccactactgacaatgatgtcagaattcagcaactgcaagagattttgcaagatctacagaagagattagagagctctgaagcagagagaaaacagctacaggtcgaactccaatcccgaagggcagaactggtatgcttaaacaacactgagatttcagagaacagctctgacctcagccagaaacttaaagaaactcagagcaaatacgaggaggctatgaaagaagtccttagtgtgcagaagcagatgaaactcggtcttgtctcacctgaaagcatggataattattcacatttccacgagctgagggtcacggaagaggaaataaatgtgctaaagcaggatctgcagaatgcattagaagaaagtgaaagaaataaagagaaagtgagagagttagaggaaaaactggtagagagggagaaaggtacagtgattaagccacctgtggaagagtacgaggaaatgaaaagttcatattgctctgttattgagaatatgaataaggagaaagcatttttgtttgagaaataccaagaagcccaagaagaaatcatgaaattaaaagacacactaaaaagtcagatgacacaggaagccagtgatgaagctgaggacatgaaagaagccatgaataggatgatagatgaactcaataaacaggtgagcgagctgtcacagctgtacaaagaagcccaggctgagctggaggattacaggaagaggaaatctctagaggatgtcacagctgaatatatccataaagcagagcatgagaaactgatgcaattgacaaacgtgtccagggctaaagcagaagatgcactgtctgaaatgaagtctcagtattcaaaagtgttgaatgagttgacccagctcaaacaactggtggatgcacaaaaagagaactctgtctctatcacagaacatttgcaagtgataaccacgctgcggactgcagcaaaagagatggaagaaaaaataagcaatcttaaggaacaccttgcaagcaaggaagtggaagtagcaaagctggagaaacaactcttagaagagaaagctgctatgactgatgcaatggtacctcggtcttcctatgaaaaactccagtcatccttagagagtgaagtgagtgtgttggcatcgaaattaaaggaatctgtgaaagagaaagagaaggtccattcagaggttgtccagattagaagtgaggtctcacaggtgaaaagagaaaaggaaaatattcagactctcttgaaatccaaagagcaagaagtaaatgaacttctgcaaaaattccagcaagctcaggaagaacttgcagaaatgaaaagatacgctgagagctcttcaaaactggaggaagataaagataaaaagataaatgagatgtcgaaggaagtcaccaaattgaaggaggccttgaacagcctctcccagctctcctactcaacaagctcatccaaaaggcagagtcagcagctggaggcgctgcagcagcaagtcaaacagctccagaaccagctggcggaatgcaagaaacaacaccaggaggtcatatcagtttacagaatgcatcttctgtatgctgtgcagggccagatggatgaagatgtccagaaagtactgaagcaaatccttaccatgtgtaaaaaccagtctcaaaagaagtaaagtggattccttggcaggaaaacaaaaacaaaaaataactgaggcagcctacaagagcaatcaaacagaatggagccagaagatgcgatcaccaacggaaatacaagacagaaaaggaccactaaagccacgctatatcatgatagaccccgagccatcgaatcaaatatataaatagcgagatgatgtataagataatgtgaagacacaagaacttcggtggcgcactgggtaccacccagcgtagatgaccacgaagataaaaaacgtattatggaaagaaaacataggtaagaaagcagtatatcgaac

SEQ ID NO: 417960 - DNA, 307 bp, Homo sapiens
ttttatgagttttttaatttaaatgtattaaaaaggaattgttccaaagtcttaagtcccagaggccaaaagagatgactatgtttgaggcttacaaatatatgaaattttgctttgtagacatgttactgtctgctaataccattttcctttgcccctagataaatgagatgtcgaaggaagtcaccaaattgaaggaggccttgaacagcctctcccagctctcctactcaacaagctcatccaaaaggcagagtcagcagctggaggcgctgcagcagcaagtcaaacagctccagaaccagct

SEQ ID NO: 417961 - DNA, 517 bp, Homo sapiens
  misc_feature (477)..(477): n is a, c, g, or t
ttcaaatagtatgactattatggttatgtgcatacaaactatcctacctattggattataaaccctgatatttaaatccatcctcacacatatcaccctacgcaaggctgccaagaaggtgtgttggtttttgttggttttttgagaccaggtctcactctgtcacccaggctgaagtgcagtggtgtgatcacggcttactgcagccttgacctccagggctcgtgtgatcctccaacctcagcctctcgaatacctgggactgcaagtgtacaccaccatatacagcattattttttgtgttttgtagagatgggggtctcaccaccttgcccaggctaatcgcgaactcctgagctcaagcgatcctccaattacagcctctcaaaggtctgggattatatgcgtgagccaccatgccaagcctggtatgctctttaaatgaaagccctcttctcttttccccatgaattgtgnaccctagctttttctccatcaattatagatttaggtgatc

SEQ ID NO: 417962 - DNA, 463 bp, Homo sapiens
  misc_feature (423)..(423): n is a, c, g, or t
ttcaaatagtatgactattatggttatgtgcatacaaactatcctacctattggattataaaccctgatatttaaatccatcctcacttgagaccaggtctcactctgtcacccaggctgaagtgcagtggtgtgatcacggcttactgcagccttgacctccagggctcgtgtgatcctccaacctcagcctctcgaatacctgggactgcaagtgtacaccaccatatacagcattattttttgtgttttgtagagatgggggtctcaccaccttgcccaggctaatcgcgaactcctgagctcaagcgatcctccaattacagcctctcaaaggtctgggattatatgcgtgagccaccatgccaagcctggtatgctctttaaatgaaagccctcttctcttttccccatgaattgtgnaccctagctttttctccatcaattatagatttaggtgatc

SEQ ID NO: 417963 - DNA, 432 bp, Homo sapiens
atccttttgcttaaattaattgtttggtacatccaaatgagcctaataatgttatccaaggaagtgttagctgaatcttttaagtatggagagaggaggtatttgaaatccgcttaatcctactaaatatttgaagtttaaaaagaacttaacgctatacaatttagaatgtaaagaggttttagatgtctagaccaactcccttttttacagatgggaaaactaagagctagtgctgttaaatgacttgcctacataactgtttatctttgttactaagaagttgtttgtaagttgaatttcattttacatgtattaaatgttttagagtgttgtgtagtaaattcagatctttatattttgattttccaacctaaggcatttctatattttgtaccattttaactacttttattaaaatatatacctttt

SEQ ID NO: 417964 - DNA, 1855 bp, Homo sapiens
atttttcatagtctattgttttgaactatggattctgttttatggtggatacctaaggtttatataatagttgctggaaaacttaaagtagctggtgagcttcctgttatgtcactattaaagaatgatggctgatgtaactctgcccctgaaatctacaagggtcatgcccaaattaatacaggttaacctttgtagaggtatatatgttggcattatttattgacatttatgcttcaagcatgtcttattttatgtaattttaagaaatactctatttaacttgtgaaatatacctaaaagcatactagttagctcttagactctcacttagggagggtaaagaaacatcactgatgccaatatgaagatctataaacaaatcctttgtttagaacttttttctcttcgtgcacctcacaacacacttaccatggtacatatttcttaatgccactaagaaaggcaagatagtgaacgcagaattatttatgtggtatagtgtttgttttcctgttttagtgcttttgtagctaaacttactggaactgcatcacaactacatttgcagtctcagtgggaggtggactagcctgtggttaattttagagcttaaaagtttataagcattaaaaacacatacatgtattagaatcttgtctaacccctcacaaaggatgatggtgatcagcatgccatcttttgaaggattaattctaaaattgaggactctggtaggttgttttatttccttcccaaccagccattcatttccaattgttctgcctttgaaactttttgtgaaaattgcctgtaccaattgcattggttgcgttgctctgatttaaatgccaaaaacactaaatatttgtgtagtgctgttaaatgaggtttttgatatttccatcaaaatgaatataaaattcacttgatggattttgtagtgatgttttcacagttgaaacaaacatattgctgtgcggtggacagccacttcacagacatgcagacccatttctttagagatattaggtttaaaacccattttaattttattttgctgaaggtttggaatatataaagtaatggattcacaaaatatgatatcttaaaacatgttgaaagatttgaaagtggtgcatttttacttttaagagcagcaatctttgaaattagtcaacaatgcagtcttttttaaaagtcagttttctcaagtagtatgttgtaacgtaagatgtaactgatataactagattttgactggtaaacttaaagtgctttttatatttgaggttgactttaaaaagccattgagcagtcctcagaggttatggactctcaagcgactaatggaatagtgttctgttgtgaagtctagaactaaagcaccttgtattgtctgcttctaaagtgtcctatagtttttaacttaaagtgtaaagagtaacattttatcttatgtcaattaaagttacatttttcatttgttggtgtacatgtgctacctgttttatggggaatgtttaacacgatcctccaagttggttctatgcataaccattcaccaaatactgctgctgtgattccttgaaggaaatattctgtggtctgctatgatgcattgccatcttgctgcttgacaataggtttataaataattagaattacgtgttttaatagtacctttgtatatataacaagatgtaaaattaaagatgaggaatgtgtgtaaatgatcattcactgtttttgttttaaaactggtcagtactatgaagcttctgtggtttgtatgatgttttaactttcactttaaactgcatagaataaattaaattgaaaacaacaaaaaaaa

SEQ ID NO: 417965 - DNA, 677 bp, Homo sapiens
caattttctatttttatgtgactctagggcataacaaaacagtgacagtttcaagcgttaattttaatgcttcctactagctaaatatcatcttaaaatgattatcagaaaaaaaaataatgcccccaaaaacttttgggggcattatttggtactgggaggatatttaaattagatttttcatagtctattgttttgaactatggattctgttttatggtggatacctaaggtttatataatagttgctggaaaacttaaagtagctggtgagcttcctgttatgtcactattaaagaatgatggctgatgtaactctgcccctgaaatctacaagggtcatgcccaaattaatacaggttaacctttgtagaggtatatatgttggcattatttattgacatttatgcttcaagcatgtcttattttatgtaattttaagaaatactctatttaacttgtgaaatatacctaaaagcatactagttagctcttagactctcacttagggagggtaaagaaacatcactgatgccaatatgaagatctataaacaaatcctttgtttagaacttttttctcttcgtgcacctcacaacacacttaccatggtacatatttcttaatgccactaagaaaggcaagatagtgaacgcagaattatttatgtggtatag

SEQ ID NO: 417966 - DNA, 4748 bp, Homo sapiens
  misc_feature (3457)..(3457): n is a, c, g, or t
  misc_feature (3479)..(3479): n is a, c, g, or t
  misc_feature (3922)..(3922): n is a, c, g, or t
  misc_feature (4512)..(4512): n is a, c, g, or t
ggttagaaggagccaggctagagtcctggaaggtggcagtcaggtcgcagggccacagcagtcactctgcgactctctcttccggtgtttctccagcgccaagcgggagaagacggagcctgggagctgggactggaggagcgggaagcgcagtatcgggaccacggctctgggaccaggaaaaacgcagactctccagagtcaatgtctacttcagccagctcaagggcgcgacaacctggcgccgagcatctcaggccgccgcggggaccccccctaagggactcgggaacacctgcctaccctagaagaggcggagaataaccccgtagggagttaagcggcctctgcctacagcgttcctcccgcctccacggcgccgagccctgattgacgttcagccaggccaatcatagcctgtgtctgaggcgcgcggagctggagcgcccagggcatgtccgccgatcccaaggaggcaatctgtcaggcgccgcccgggcggcagtatgcctgagggggtcctccgtgttcgcgcctcccgccgcctgcactgaaaggtctgtacctgagcctggatacttgaacagaggcagacactgcggctcaaaaccccaaggaatatcctagctctgagacaaaaattgggaacctcagcatgagtttgtcacctgaatgaaataaaaaaaatcacgttgaaggctggtgcagtaacatgtgcctgtagtcccagctactctggaggctgagtcaggaggatcacttgagaccagaagttcaggaattcaagactggcttgagcaacatagcaagacttcatttcaaaacaaacagaaaaaagccaccaccttcagtatttcttgccaaagcaaaggagccatttgttctttacgatggtcaggaaaggaagcatcaaggtcatcaaatgaaaaattttcagcatttcagcctctctgctcagggaaatacctgaatctagaatatcacaacatgagccaaaaccgccccatttctcatgccacatgtcactcttaacacaaggttactcaacctcgagcatggttggcatttggggctgaataattcttttttgtagggggctgtcctgggcattgtaggatgctcatgagctacctcagtctctaccacccactagatgccagtagcattgacccctgatctctctacccaagttgtgacaactaaaaccatctctggataatggaggaaccttaaatgcatattgctaaggaaaagccaatctgaaaggattacatattgtatgagtccaactatatggtaatctggaaaaggcaaaaccatggagacagtgaaaaggtagtggttaccagtggtccatgggaagggttggatgaataggtggagcacagaggatttttaaggcagtgaaactattctgaatgatactgtaatggtggatacatgtcatacctttgtcaaaaccaataaaatataacaaccaataaaactgcacaaagagtgaaccctaatgtaaactatggacttaataatgtatcaatattggctcaccaattttaacaaatgtaccacactaatgcaagatgttactaatagtggaaactggagggaagagggcttgaggggacatacgggaactctctgtaattcctgttcagtttttctgtaactgttaaactgtccaaaaaaagtctgtttttataaatggaggcatggttttatatggactaaaatactatgattgcctttttattttacacatggtgaaattagagcaggacatattttaaactcaaaattcacaaaattaatttatgaaaatgtttacccagatcaagaatattaaagaaacttagattaatattgttaccttgaatttattttactgagtaatcctctaagactcctctacacattattaatctagaaggatttttaaagtctttatgacaattaattattggtctacagtcaaattgcatatccccattaactagagttatatttttccattttctgatccaaaaactttaggaacaggaaatgtttattttagaaaacaagaacacttcttaagcatttgctgttaacagttattttcacatgtgcttgtacttattttacacttgtcagaacatagtatttacctttgaaccaaggttttataataagcaagcactttttttatttagaagtcacattttccaagtagaaaaatcattaaaaattcagtcctctgaaggctaatttctttaaatcatttaacctaattgtttaaggtatagattggaatttttctcagcactctcttgaaaacaggtgacagtggaaccctgttaggttcacaaatcctagactttgattatatagcccaggctcaaatttttctcgaatgttacgaacattcaaagcattaggagtcttggtttcatttcttaattttttttcttctgggtatatttgagactcatcttggattcaaataaattaataatagtctcatgaaaccgataaaaatgggagctccattgaacatgagagacattgattcgtagtttctaacatcctccaaatgaggagcccatccctaatttagatgcttctttcaaaggaggctcctttccttcgttatccataatatagtcacaccagtcctgaaaaaacatggaacagactccagatctttatatttcatactctaaagtcgtacaagccaatctgcatttcctctagtggaaactgtatagctggtcatctttccaggacccttttatcaagaaacaatgcagcttctacatttgtgctgcttctacaccaaaacagctggaatgtatatagtatggttctggatgctcttgtatacctcactcttcatttctcacctaacccatgtgctatgatttgaatgtttctcccctgcaaaactcatgttgaaatgtaattgccatgataacagtattaataggtggaatatttaagaggtgattagggtgggattggtgatgttataaaagggtaagttcagccccttcttgctctctctgtcacccttccaccttcctctgtgtgatgatgcaacaaaaaagcccttcccagatgccagcatcttgattttggacttctcagcctacagaactataagccaataaatttctgttatttgttattagtctgtgatattctgttacagtagcacaaaatggactatgacaccatgtgtttacacagaaagaaaaaaatatcatacggtaattgctcctaaatatgcagagaatatgttctgatatccttagtggatgcctgaaactgcagatagtaccaaaccttatatatactatgttttttttcccatacatatgcatgttaaagtttataagttaggcagagtaagatatgaacaataactaataatgaaatagaaacgtaacgatgtgctgtaataaaagttatgtgactgacncctctttttcttcctctttctntcaaaatatcttaatattttcaagccatggataactgaaactgcagaaagtgaaactgtagataaactattaactctatttaaacaataaaagaattataattatattcttgggaaaattaacaattatccaaagtccctttgcaaagggaaaaaaaatgcatgtattggaaaaaatctcaaccacagggttccctaagctttgcaaacaacaaatagcatccacctatccatcctcagagagcaacagttttactgttatttagaaaaagcaactatttcaggctgcaggttgtgcacatcagcacttcccagctctctactaatatgggaaaactgactatccctgacttcagtttttgtgaagctaaatgcctgactagagtttaaactgaggctaattggagatcataaaattttacagcttgctagaggtggaccacnattttgattggaaactttccaccaaccaattctaaaaggtgttaatggtgactattttctaaaacaaatctgaagagtaactaatatgataagaccagaaatatatttctctggcaagtccctataaaaagaaagctaggtaattaaataatctctcaacaatattgttttaggaaacccaatagagagtttcacaggcctgtttcttatgggattgctcaatgtaggtaaatattatcaaaccaaaaagtaattttgtaacagaaattctacagagccccaataccttacagaatgatgagtacaacagtagaaacaaatagaagataacctagaaaaataaagcgaataacttaatggcgtgagttaggttaagaaaagcttcctggaaaaagacatctgaatagaattttagtagatatagctaggaattcccaagcaggtagaagaagggggacattccaggcaaaggaatcatgtgaatgcaaaggtagggagtcatgaatcaatatgttcggtttttttgttgtttttgttttataaagagctataataggctgggcacagtggctgtaatcccagcactttgngaggctgaagcaggtggatcacttgagcccaggagttcgagaccagcctgggcaacatggcaaaacactgtctctacaaaaacaaaaaaaattatccctgttcagtggtgtgcgcctgtggtcccggctacctgggaggctgaggcgagaggagtgctcaaggtgggaggtggagattacagtgagcagagatcacaccactgcactccagcctgagcgacagagagactctgtct

SEQ ID NO: 417967 - DNA, 4847 bp, Homo sapiens
  misc_feature (3556)..(3556): n is a, c, g, or t
  misc_feature (3578)..(3578): n is a, c, g, or t
  misc_feature (4021)..(4021): n is a, c, g, or t
  misc_feature (4611)..(4611): n is a, c, g, or t
ggttagaaggagccaggctagagtcctggaaggtggcagtcaggtcgcagggccacagcagtcactctgcgactctctcttccggtgtttctccagcgccaagcgggagaagacggagcctgggagctgggactggaggagcgggaagcgcagtatcgggaccacggctctgggaccaggaaaaacgcagactctccagagtcaatgtctacttcagccagctcaagggcgcgacaacctggcgccgagcatctcaggccgccgcggggaccccccctaagggactcgggaacacctgcctaccctagaagaggcggagaataaccccgtagggagttaagcggcctctgcctacagcgttcctcccgcctccacggcgccgagccctgattgacgttcagccaggccaatcatagcctgtgtctgaggcgcgcggagctggagcgcccagggcatgtccgccgatcccaaggaggcaatctgtcaggcgccgcccgggcggcagtatgcctgagggggtcctccgtgttcgcgcctcccgccgcctgcactgaaaggtctgtacctgagcctggatacttgaacagaggcagacactgcggctcaaaaccccaagggtaggtgcctattgtgcggagtctcggaacgcctgtctggaagaagagttccggcggctccccgaacgcttggagaaagcgcttggatgcagttgcaggaatatcctagctctgagacaaaaattgggaacctcagcatgagtttgtcacctgaatgaaataaaaaaaatcacgttgaaggctggtgcagtaacatgtgcctgtagtcccagctactctggaggctgagtcaggaggatcacttgagaccagaagttcaggaattcaagactggcttgagcaacatagcaagacttcatttcaaaacaaacagaaaaaagccaccaccttcagtatttcttgccaaagcaaaggagccatttgttctttacgatggtcaggaaaggaagcatcaaggtcatcaaatgaaaaattttcagcatttcagcctctctgctcagggaaatacctgaatctagaatatcacaacatgagccaaaaccgccccatttctcatgccacatgtcactcttaacacaaggttactcaacctcgagcatggttggcatttggggctgaataattcttttttgtagggggctgtcctgggcattgtaggatgctcatgagctacctcagtctctaccacccactagatgccagtagcattgacccctgatctctctacccaagttgtgacaactaaaaccatctctggataatggaggaaccttaaatgcatattgctaaggaaaagccaatctgaaaggattacatattgtatgagtccaactatatggtaatctggaaaaggcaaaaccatggagacagtgaaaaggtagtggttaccagtggtccatgggaagggttggatgaataggtggagcacagaggatttttaaggcagtgaaactattctgaatgatactgtaatggtggatacatgtcatacctttgtcaaaaccaataaaatataacaaccaataaaactgcacaaagagtgaaccctaatgtaaactatggacttaataatgtatcaatattggctcaccaattttaacaaatgtaccacactaatgcaagatgttactaatagtggaaactggagggaagagggcttgaggggacatacgggaactctctgtaattcctgttcagtttttctgtaactgttaaactgtccaaaaaaagtctgtttttataaatggaggcatggttttatatggactaaaatactatgattgcctttttattttacacatggtgaaattagagcaggacatattttaaactcaaaattcacaaaattaatttatgaaaatgtttacccagatcaagaatattaaagaaacttagattaatattgttaccttgaatttattttactgagtaatcctctaagactcctctacacattattaatctagaaggatttttaaagtctttatgacaattaattattggtctacagtcaaattgcatatccccattaactagagttatatttttccattttctgatccaaaaactttaggaacaggaaatgtttattttagaaaacaagaacacttcttaagcatttgctgttaacagttattttcacatgtgcttgtacttattttacacttgtcagaacatagtatttacctttgaaccaaggttttataataagcaagcactttttttatttagaagtcacattttccaagtagaaaaatcattaaaaattcagtcctctgaaggctaatttctttaaatcatttaacctaattgtttaaggtatagattggaatttttctcagcactctcttgaaaacaggtgacagtggaaccctgttaggttcacaaatcctagactttgattatatagcccaggctcaaatttttctcgaatgttacgaacattcaaagcattaggagtcttggtttcatttcttaattttttttcttctgggtatatttgagactcatcttggattcaaataaattaataatagtctcatgaaaccgataaaaatgggagctccattgaacatgagagacattgattcgtagtttctaacatcctccaaatgaggagcccatccctaatttagatgcttctttcaaaggaggctcctttccttcgttatccataatatagtcacaccagtcctgaaaaaacatggaacagactccagatctttatatttcatactctaaagtcgtacaagccaatctgcatttcctctagtggaaactgtatagctggtcatctttccaggacccttttatcaagaaacaatgcagcttctacatttgtgctgcttctacaccaaaacagctggaatgtatatagtatggttctggatgctcttgtatacctcactcttcatttctcacctaacccatgtgctatgatttgaatgtttctcccctgcaaaactcatgttgaaatgtaattgccatgataacagtattaataggtggaatatttaagaggtgattagggtgggattggtgatgttataaaagggtaagttcagccccttcttgctctctctgtcacccttccaccttcctctgtgtgatgatgcaacaaaaaagcccttcccagatgccagcatcttgattttggacttctcagcctacagaactataagccaataaatttctgttatttgttattagtctgtgatattctgttacagtagcacaaaatggactatgacaccatgtgtttacacagaaagaaaaaaatatcatacggtaattgctcctaaatatgcagagaatatgttctgatatccttagtggatgcctgaaactgcagatagtaccaaaccttatatatactatgttttttttcccatacatatgcatgttaaagtttataagttaggcagagtaagatatgaacaataactaataatgaaatagaaacgtaacgatgtgctgtaataaaagttatgtgactgacncctctttttcttcctctttctntcaaaatatcttaatattttcaagccatggataactgaaactgcagaaagtgaaactgtagataaactattaactctatttaaacaataaaagaattataattatattcttgggaaaattaacaattatccaaagtccctttgcaaagggaaaaaaaatgcatgtattggaaaaaatctcaaccacagggttccctaagctttgcaaacaacaaatagcatccacctatccatcctcagagagcaacagttttactgttatttagaaaaagcaactatttcaggctgcaggttgtgcacatcagcacttcccagctctctactaatatgggaaaactgactatccctgacttcagtttttgtgaagctaaatgcctgactagagtttaaactgaggctaattggagatcataaaattttacagcttgctagaggtggaccacnattttgattggaaactttccaccaaccaattctaaaaggtgttaatggtgactattttctaaaacaaatctgaagagtaactaatatgataagaccagaaatatatttctctggcaagtccctataaaaagaaagctaggtaattaaataatctctcaacaatattgttttaggaaacccaatagagagtttcacaggcctgtttcttatgggattgctcaatgtaggtaaatattatcaaaccaaaaagtaattttgtaacagaaattctacagagccccaataccttacagaatgatgagtacaacagtagaaacaaatagaagataacctagaaaaataaagcgaataacttaatggcgtgagttaggttaagaaaagcttcctggaaaaagacatctgaatagaattttagtagatatagctaggaattcccaagcaggtagaagaagggggacattccaggcaaaggaatcatgtgaatgcaaaggtagggagtcatgaatcaatatgttcggtttttttgttgtttttgttttataaagagctataataggctgggcacagtggctgtaatcccagcactttgngaggctgaagcaggtggatcacttgagcccaggagttcgagaccagcctgggcaacatggcaaaacactgtctctacaaaaacaaaaaaaattatccctgttcagtggtgtgcgcctgtggtcccggctacctgggaggctgaggcgagaggagtgctcaaggtgggaggtggagattacagtgagcagagatcacaccactgcactccagcctgagcgacagagagactctgtct

SEQ ID NO: 417968 - DNA, 4688 bp, Homo sapiens
  misc_feature (3397)..(3397): n is a, c, g, or t
  misc_feature (3419)..(3419): n is a, c, g, or t
  misc_feature (3862)..(3862): n is a, c, g, or t
  misc_feature (4452)..(4452): n is a, c, g, or t
ggttagaaggagccaggctagagtcctggaaggtggcagtcaggtcgcagggccacagcagtcactctgcgactctctcttccggtgtttctccagcgccaagcgggagaagacggagcctgggagctgggactggaggagcgggaagcgcagtatcgggaccacggctctgggaccaggaaaaacgcagactctccagagtcaatgtctacttcagccagctcaagggcgcgacaacctggcgccgagcatctcaggccgccgcggggaccccccctaagggactcgggaacacctgcctaccctagaagaggcggagaataaccccgtagggagttaagcggcctctgcctacagcgttcctcccgcctccacggcgccgagccctgattgacgttcagccaggccaatcatagcctgtgtctgaggcgcgcggagctggagcgcccagggcatgtccgccgatcccaaggaggcaatctgtcaggcgccgcccgggcggcagtatgcctgagggggtcctccgtgttcgcgcctcccgccgcctgcactgaaagaatatcctagctctgagacaaaaattgggaacctcagcatgagtttgtcacctgaatgaaataaaaaaaatcacgttgaaggctggtgcagtaacatgtgcctgtagtcccagctactctggaggctgagtcaggaggatcacttgagaccagaagttcaggaattcaagactggcttgagcaacatagcaagacttcatttcaaaacaaacagaaaaaagccaccaccttcagtatttcttgccaaagcaaaggagccatttgttctttacgatggtcaggaaaggaagcatcaaggtcatcaaatgaaaaattttcagcatttcagcctctctgctcagggaaatacctgaatctagaatatcacaacatgagccaaaaccgccccatttctcatgccacatgtcactcttaacacaaggttactcaacctcgagcatggttggcatttggggctgaataattcttttttgtagggggctgtcctgggcattgtaggatgctcatgagctacctcagtctctaccacccactagatgccagtagcattgacccctgatctctctacccaagttgtgacaactaaaaccatctctggataatggaggaaccttaaatgcatattgctaaggaaaagccaatctgaaaggattacatattgtatgagtccaactatatggtaatctggaaaaggcaaaaccatggagacagtgaaaaggtagtggttaccagtggtccatgggaagggttggatgaataggtggagcacagaggatttttaaggcagtgaaactattctgaatgatactgtaatggtggatacatgtcatacctttgtcaaaaccaataaaatataacaaccaataaaactgcacaaagagtgaaccctaatgtaaactatggacttaataatgtatcaatattggctcaccaattttaacaaatgtaccacactaatgcaagatgttactaatagtggaaactggagggaagagggcttgaggggacatacgggaactctctgtaattcctgttcagtttttctgtaactgttaaactgtccaaaaaaagtctgtttttataaatggaggcatggttttatatggactaaaatactatgattgcctttttattttacacatggtgaaattagagcaggacatattttaaactcaaaattcacaaaattaatttatgaaaatgtttacccagatcaagaatattaaagaaacttagattaatattgttaccttgaatttattttactgagtaatcctctaagactcctctacacattattaatctagaaggatttttaaagtctttatgacaattaattattggtctacagtcaaattgcatatccccattaactagagttatatttttccattttctgatccaaaaactttaggaacaggaaatgtttattttagaaaacaagaacacttcttaagcatttgctgttaacagttattttcacatgtgcttgtacttattttacacttgtcagaacatagtatttacctttgaaccaaggttttataataagcaagcactttttttatttagaagtcacattttccaagtagaaaaatcattaaaaattcagtcctctgaaggctaatttctttaaatcatttaacctaattgtttaaggtatagattggaatttttctcagcactctcttgaaaacaggtgacagtggaaccctgttaggttcacaaatcctagactttgattatatagcccaggctcaaatttttctcgaatgttacgaacattcaaagcattaggagtcttggtttcatttcttaattttttttcttctgggtatatttgagactcatcttggattcaaataaattaataatagtctcatgaaaccgataaaaatgggagctccattgaacatgagagacattgattcgtagtttctaacatcctccaaatgaggagcccatccctaatttagatgcttctttcaaaggaggctcctttccttcgttatccataatatagtcacaccagtcctgaaaaaacatggaacagactccagatctttatatttcatactctaaagtcgtacaagccaatctgcatttcctctagtggaaactgtatagctggtcatctttccaggacccttttatcaagaaacaatgcagcttctacatttgtgctgcttctacaccaaaacagctggaatgtatatagtatggttctggatgctcttgtatacctcactcttcatttctcacctaacccatgtgctatgatttgaatgtttctcccctgcaaaactcatgttgaaatgtaattgccatgataacagtattaataggtggaatatttaagaggtgattagggtgggattggtgatgttataaaagggtaagttcagccccttcttgctctctctgtcacccttccaccttcctctgtgtgatgatgcaacaaaaaagcccttcccagatgccagcatcttgattttggacttctcagcctacagaactataagccaataaatttctgttatttgttattagtctgtgatattctgttacagtagcacaaaatggactatgacaccatgtgtttacacagaaagaaaaaaatatcatacggtaattgctcctaaatatgcagagaatatgttctgatatccttagtggatgcctgaaactgcagatagtaccaaaccttatatatactatgttttttttcccatacatatgcatgttaaagtttataagttaggcagagtaagatatgaacaataactaataatgaaatagaaacgtaacgatgtgctgtaataaaagttatgtgactgacncctctttttcttcctctttctntcaaaatatcttaatattttcaagccatggataactgaaactgcagaaagtgaaactgtagataaactattaactctatttaaacaataaaagaattataattatattcttgggaaaattaacaattatccaaagtccctttgcaaagggaaaaaaaatgcatgtattggaaaaaatctcaaccacagggttccctaagctttgcaaacaacaaatagcatccacctatccatcctcagagagcaacagttttactgttatttagaaaaagcaactatttcaggctgcaggttgtgcacatcagcacttcccagctctctactaatatgggaaaactgactatccctgacttcagtttttgtgaagctaaatgcctgactagagtttaaactgaggctaattggagatcataaaattttacagcttgctagaggtggaccacnattttgattggaaactttccaccaaccaattctaaaaggtgttaatggtgactattttctaaaacaaatctgaagagtaactaatatgataagaccagaaatatatttctctggcaagtccctataaaaagaaagctaggtaattaaataatctctcaacaatattgttttaggaaacccaatagagagtttcacaggcctgtttcttatgggattgctcaatgtaggtaaatattatcaaaccaaaaagtaattttgtaacagaaattctacagagccccaataccttacagaatgatgagtacaacagtagaaacaaatagaagataacctagaaaaataaagcgaataacttaatggcgtgagttaggttaagaaaagcttcctggaaaaagacatctgaatagaattttagtagatatagctaggaattcccaagcaggtagaagaagggggacattccaggcaaaggaatcatgtgaatgcaaaggtagggagtcatgaatcaatatgttcggtttttttgttgtttttgttttataaagagctataataggctgggcacagtggctgtaatcccagcactttgngaggctgaagcaggtggatcacttgagcccaggagttcgagaccagcctgggcaacatggcaaaacactgtctctacaaaaacaaaaaaaattatccctgttcagtggtgtgcgcctgtggtcccggctacctgggaggctgaggcgagaggagtgctcaaggtgggaggtggagattacagtgagcagagatcacaccactgcactccagcctgagcgacagagagactctgtct

SEQ ID NO: 417969 - DNA, 3455 bp, Homo sapiens
ggttagaaggagccaggctagagtcctggaaggtggcagtcaggtcgcagggccacagcagtcactctgcgactctctcttccggtgtttctccagcgccaagcgggagaagacggagcctgggagctgggactggaggagcgggaagcgcagtatcgggaccacggctctgggaccaggaaaaacgcagactctccagagtcaatgtctacttcagccagctcaagggcgcgacaacctggcgccgagcatctcaggccgccgcggggaccccccctaagggactcgggaacacctgcctaccctagaagaggcggagaataaccccgtagggagttaagcggcctctgcctacagcgttcctcccgcctccacggcgccgagccctgattgacgttcagccaggccaatcatagcctgtgtctgaggcgcgcggagctggagcgcccagggcatgtccgccgatcccaaggaggcaatctgtcaggcgccgcccgggcggcagtatgcctgagggggtcctccgtgttcgcgcctcccgccgcctgcactgaaaggtctgtacctgagcctggatacttgaacagaggcagacactgcggctcaaaaccccaaggaatatcctagctctgagacaaaaattgggaacctcagcatgagtttgtcacctgaatgaaataaaaaaaatcacgttgaaggctggtgcagtaacatgtgcctgtagtcccagctactctggaggctgagtcaggaggatcacttgagaccagaagttcaggaattcaagactggcttgagcaacatagcaagacttcatttcaaaacaaacagaaaaaagccaccaccttcagtatttcttgccaaagcaaaggagccatttgttctttacgatggtcaggaaaggaagcatcaaggtcatcaaatgaaaaattttcagcatttcagcctctctgctcagggaaatacctgaatctagaatatcacaacatgagccaaaaccgccccatttctcatgccacatgtcactcttaacacaaggttactcaacctcgagcatggttggcatttggggctgaataattcttttttgtagggggctgtcctgggcattgtaggatgctcatgagctacctcagtctctaccacccactagatgccagtagcattgacccctgatctctctacccaagttgtgacaactaaaaccatctctggataatggaggaaccttaaatgcatattgctaaggaaaagccaatctgaaaggattacatattgtatgagtccaactatatggtaatctggaaaaggcaaaaccatggagacagtgaaaaggtagtggttaccagtggtccatgggaagggttggatgaataggtggagcacagaggatttttaaggcagtgaaactattctgaatgatactgtaatggtggatacatgtcatacctttgtcaaaaccaataaaatataacaaccaataaaactgcacaaagagtgaaccctaatgtaaactatggacttaataatgtatcaatattggctcaccaattttaacaaatgtaccacactaatgcaagatgttactaatagtggaaactggagggaagagggcttgaggggacatacgggaactctctgtaattcctgttcagtttttctgtaactgttaaactgtccaaaaaaagtctgtttttataaatggaggcatggttttatatggactaaaatactatgattgcctttttattttacacatggtgaaattagagcaggacatattttaaactcaaaattcacaaaattaatttatgaaaatgtttacccagatcaagaatattaaagaaacttagattaatattgttaccttgaatttattttactgagtaatcctctaagactcctctacacattattaatctagaaggatttttaaagtctttatgacaattaattattggtctacagtcaaattgcatatccccattaactagagttatatttttccattttctgatccaaaaactttaggaacaggaaatgtttattttagaaaacaagaacacttcttaagcatttgctgttaacagttattttcacatgtgcttgtacttattttacacttgtcagaacatagtatttacctttgaaccaaggttttataataagcaagcactttttttatttagaagtcacattttccaagtagaaaaatcattaaaaattcagtcctctgaaggctaatttctttaaatcatttaacctaattgtttaaggtatagattggaatttttctcagcactctcttgaaaacaggtgacagtggaaccctgttaggttcacaaatcctagactttgattatatagcccaggctcaaatttttctcgaatgttacgaacattcaaagcattaggagtcttggtttcatttcttaattttttttcttctgggtatatttgagactcatcttggattcaaataaattaataatagtctcatgaaaccgataaaaatgggagctccattgaacatgagagacattgattcgtagtttctaacatcctccaaatgaggagcccatccctaatttagatgcttctttcaaaggaggctcctttccttcgttatccataatatagtcacaccagtcctgaaaaaacatggaacagactccagatctttatatttcatactctaaagtcgtacaagccaatctgcatttcctctagtggaaactgtatagctggtcatctttccaggacccttttatcaagaaacaatgcagcttctacatttgtgctgcttctacaccaaaacagctggaatgtatatagtatggttctggatgctcttgtatacctcactcttcatttctcacctaacccatgtgctatgatttgaatgtttctcccctgcaaaactcatgttgaaatgtaattgccatgataacagtattaataggtggaatatttaagaggtgattagggtgggattggtgatgttataaaagggtaagttcagccccttcttgctctctctgtcacccttccaccttcctctgtgtgatgatgcaacaaaaaagcccttcccagatgccagcatcttgattttggacttctcagcctacagaactataagccaataaatttctgttatttgttattagtctgtgatattctgttacagtagcacaaaatggactatgacaccatgtgtttacacagaaagaaaaaaatatcatacggtaattgctcctaaatatgcagagaatatgttctgatatccttagtggatgcctgaaactgcagatagtaccaaaccttatatatactatgttttttttcccatacatatgcatgttaaagtttataagttaggcagagtaagatatgaacaataactaataatgaaatagaaacgtaacgatgtgctgtaataaaagttatgtgactga

SEQ ID NO: 417970 - DNA, 3680 bp, Homo sapiens
ggttagaaggagccaggctagagtcctggaaggtggcagtcaggtcgcagggccacagcagtcactctgcgactctctcttccggtgtttctccagcgccaagcgggagaagacggagcctgggagctgggactggaggagcgggaagcgcagtatcgggaccacggctctgggaccaggaaaaacgcagactctccagagtcaatgtctacttcagccagctcaagggcgcgacaacctggcgccgagcatctcaggccgccgcggggaccccccctaagggactcgggaacacctgcctaccctagaagaggcggagaataaccccgtagggagttaagcggcctctgcctacagcgttcctcccgcctccacggcgccgagccctgattgacgttcagccaggccaatcatagcctgtgtctgaggcgcgcggagctggagcgcccagggcatgtccgccgatcccaaggaggcaatctgtcaggcgccgcccgggcggcagtatgcctgagggggtcctccgtgttcgcgcctcccgccgcctgcactgaaaggtctgtacctgagcctggatacttgaacagaggcagacactgcggctcaaaaccccaaggaatatcctagctctgagacaaaaattgggaacctcagcatgagtttgtcacctgaatgaaataaaaaaaatcacgttgaaggctggtgcagtaacatgtgcctgtagtcccagctactctggaggctgagtcaggaggatcacttgagaccagaagttcaggaattcaagactggcttgagcaacatagcaagacttcatttcaaaacaaacagaaaaaagccaccaccttcagtatttcttgccaaagcaaaggagccatttgttctttacgatggtcaggaaaggaagcatcaaggtcatcaaatgaaaaattttcagcatttcagcctctctgctcagggaaatacctgaatctagaatatcacaacatgagccaaaaccgccccatttctcatgccacatgtcactcttaacacaaggttactcaacctcgagcatggttggcatttggggctgaataattcttttttgtagggggctgtcctgggcattgtaggatgctcatgagctacctcagtctctaccacccactagatgccagtagcattgacccctgatctctctacccaagttgtgacaactaaaaccatctctggataatggaggaaccttaaatgcatattgctaaggaaaagccaatctgaaaggattacatattgtatgagtccaactatatggtaatctggaaaaggcaaaaccatggagacagtgaaaaggtagtggttaccagtggtccatgggaagggttggatgaataggtggagcacagaggatttttaaggcagtgaaactattctgaatgatactgtaatggtggatacatgtcatacctttgtcaaaaccaataaaatataacaaccaataaaactgcacaaagagtgaaccctaatgtaaactatggacttaataatgtatcaatattggctcaccaattttaacaaatgtaccacactaatgcaagatgttactaatagtggaaactggagggaagagggcttgaggggacatacgggaactctctgtaattcctgttcagtttttctgtaactgttaaactgtccaaaaaaagtctgtttttataaatggaggcatggttttatatggactaaaatactatgattgcctttttattttacacatggtgaaattagagcaggacatattttaaactcaaaattcacaaaattaatttatgaaaatgtttacccagatcaagaatattaaagaaacttagattaatattgttaccttgaatttattttactgagtaatcctctaagactcctctacacattattaatctagaaggatttttaaagtctttatgacaattaattattggtctacagtcaaattgcatatccccattaactagagttatatttttccattttctgatccaaaaactttaggaacaggaaatgtttattttagaaaacaagaacacttcttaagcatttgctgttaacagttattttcacatgtgcttgtacttattttacacttgtcagaacatagtatttacctttgaaccaaggttttataataagcaagcactttttttatttagaagtcacattttccaagtagaaaaatcattaaaaattcagtcctctgaaggctaatttctttaaatcatttaacctaattgtttaaggtatagattggaatttttctcagcactctcttgaaaacaggtgacagtggaaccctgttaggttcacaaatcctagactttgattatatagcccaggctcaaatttttctcgaatgttacgaacattcaaagcattaggagtcttggtttcatttcttaattttttttcttctgggtatatttgagactcatcttggattcaaataaattaataatagtctcatgaaaccgataaaaatgggagctccattgaacatgagagacattgattcgtagtttctaacatcctccaaatgaggagcccatccctaatttagatgcttctttcaaaggaggctcctttccttcgttatccataatatagtcacaccagtcctgaaaaaacatggaacagactccagatctttatatttcatactctaaagtcgtacaagccaatctgcatttcctctagtggaaactgtatagctggtcatctttccaggacccttttatcaagaaacaatgcagcttctacatttgtgctgcttctacaccaaaacagctggaatgtatatagtatggttctggatgctcttgtatacctcactcttcatttctcacctaacccatgtgctatgatttgaatgtttctcccctgcaaaactcatgtataaaagggtaagttcagccccttcttgctctctctgtcacccttccaccttcctctgtgtgatgatgcaacaaaaaagcccttcccagatgccagcatcttgattttggacttctcagcctacagaactataagccaataaatttctgttatttgttattagtctgtgatattctgttacagtagcacaaaatggactatgacaccatgtgtttacacagaaagaaaaaaatatcatacggtaattgctcctaaatatgcagagaatatgttctgatatccttagtggatgcctgaaactgcagatagtaccaaaccttatatatactatgttttttttcccatacatatgcatgttaaagtttataagttaggcagagtaagatatgaacaataactaataatgaaatagaaacgtaacgatgtgctgtaataaaagttatgtgactgaaaaaaaaaaaaaaaaaaaaaaaaaaaaaaacaagcaaaaaaacaaaaaagatgagaaagacatatctcttcgactcgaaaaagaaatcaacaacaactcggcacgcaaaaaaagcaagaagaccaaataaagtgatgaactgcaaagaaggaaagaaaacagagaaagaggggaagccaagaaaggaaagagaagaagatagagtagagaaagaaaatgagatagaagagaaggcaaacacgagcaagccagaaaaaagagaacagatgacaatcagagaaagcattagaaaataaaacaa

SEQ ID NO: 417971 - DNA, 1507 bp, Homo sapiens
ggttagaaggagccaggctagagtcctggaaggtggcagtcaggtcgcagggccacagcagtcactctgcgactctctcttccggtgtttctccagcgccaagcgggagaagacggagcctgggagctgggactggaggagcgggaagcgcagtatcgggaccacggctctgggaccaggaaaaacgcagactctccagagtcaatgtctacttcagccagctcaagggcgcgacaacctggcgccgagcatctcaggccgccgcggggaccccccctaagggactcgggaacacctgcctaccctagaagaggcggagaataaccccgtagggagttaagcggcctctgcctacagcgttcctcccgcctccacggcgccgagccctgattgacgttcagccaggccaatcatagcctgtgtctgaggcgcgcggagctggagcgcccagggcatgtccgccgatcccaaggaggcaatctgtcaggcgccgcccgggcggcagtatgcctgagggggtcctccgtgttcgcgcctcccgccgcctgcactgaaaggtctgtacctgagcctggatacttgaacagaggcagacactgcggctcaaaaccccaaggaatatcctagctctgagacaaaaattgggaacctcagcatgagtttgtcacctgaatgaaataaaaaaaatcacgttgaaggctggtgcagtaacatgtgcctgtagtcccagctactctggaggctgagtcaggaggatcacttgagaccagaagttcaggaattcaagactggcttgagcaacatagcaagacttcatttcaaaacaaacagaaaaaagccaccaccttcagtatttcttgccaaagcaaaggagccatttgttctttacgatggtcaggaaaggaagcatcaaggtcatcaaatgaaaaattttcagcatttcagcctctctgctcagggaaatacctgaatctagaatatcacaacatgagccaaaaccgccccatttctcatgccacatgtcactcttaacacaaggttactcaacctcgagcatggttggcatttggggctgaataattcttttttgtagggggctgtcctgggcattgtaggatgctcatgagctacctcagtctctaccacccactagatgccagtagcattgacccctgatctctctacccaagttgtgacaactaaaaccatctctggataatggaggaaccttaaatgcatattgctaaggaaaagccaatctgaaaggattacatattgtatgagtccaactatatggtaatctggaaaaggcaaaaccatggagacagtgaaaaggtagtggttaccagtggtccatgggaagggttggatgaataggtggagcacagaggatttttaaggcagtgaaactattctgaatgatactgtaatggtggatacatgtcatacctttgtcaaaaccaataaaatataacaaccaataaaactgcacaaagagtgaacccta

SEQ ID NO: 417972 - DNA, 857 bp, Homo sapiens
ggttagaaggagccaggctagagtcctggaaggtggcagtcaggtcgcagggccacagcagtcactctgcgactctctcttccggtgtttctccagcgccaagcgggagaagacggagcctgggagctgggactggaggagcgggaagcgcagtatcgggaccacggctctgggaccaggaaaaacgcagactctccagagtcaatgtctacttcagccagctcaagggcgcgacaacctggcgccgagcatctcaggccgccgcggggaccccccctaagggactcgggaacacctgcctaccctagaagaggcggagaataaccccgtagggagttaagcggcctctgcctacagcgttcctcccgcctccacggcgccgagccctgattgacgttcagccaggccaatcatagcctgtgtctgaggcgcgcggagctggagcgcccagggcatgtccgccgatcccaaggaggcaatctgtcaggcgccgcccgggcggcagtatgcctgagggggtcctccgtgttcgcgcctcccgccgcctgcactgaaaggtctgtacctgagcctggatacttgaacagaggcagacactgcggctcaaaaccccaagggtaggtgcctattgtgcggagtctcggaacgcctgtctggaagaagagttccggcggctccccgaacgcttggagaaagcgcttggatgcagttgcaggaatatcctagctctgagacaaaaattgggactacaggcctccctattctctgagacacagcaatatggaaattaggcaaatcaatgactgtacaatggcctctaagtgtccaggttaaaggaagaattacatgtctctccc

SEQ ID NO: 417973 - DNA, 2238 bp, Homo sapiens
ctcccttccctactattgcctctctgacctttttaaattatttttaataccaaaagagttcttttgaaatggaactgattaaaagggcagagggtctgttgccagcctgcattgatataccagtcccatttgtaaatatttacgtacctttataaattcagttgcatctgtggcaaaatttcagactatttttgcgtctttcctcatcactttttgtgatgcaactccagtctggactcagatgcatagatttggtccagtgtattttcatgataaagtgaaattgagtcagaacaagagttaatatctgcctgtatcttgcacagttcgagcgatctgttattaactgggaagcatttggtgttggttttcattccatttcgacgagcatgttattgggaagtattctgaagaggcaatagcagtaataacaacagacttaagtgctacgcccctttgtgctgctggcttttctggttgcaggctttcccatggtcacaggatgcactgtcagcatcaggtcccagagggccaccgtgtccattacagcagagtccagctgcagcatccagctcacgccctcatgggaattggcacaggcctggggcagggcttctgatggccatttgcttggcctcctgcattttagtccaactcacagtccactagcttcactcctttaaattcactttgaaacaggcctcatcccacttccaccagcaccatagaagaataattctgggcagaagtctgttttttttcatttttccaggacagttggatattgtcaggccacttgtgaccccagccatgtagtgagggtgctctttctctgtgcctgctccttatgagtgcagtggaaggaagccacacactggtcagtcatttcagaggcagcagatgcccagggagacccaagaaagagtcaggttagggagcagtgaaagtgaggagggaagacaattctgtgaactctgtaactcttaaaatttttgaaaactccatcgttaaacaacttttaaaagaaataactaaattttcaaatgagtaagcagtgccaccaactagtgttttgcccgatagaagagccagcatgttcacgttatttaaattaggtggaaaaatctaaacatttttatcttcataatttaaaaaatatatatgtatatattgcatattcactttttcctttaggtagagatgatttcaatccaaatactcttactttaaaaaatttcctttccccaagaatctccttgggactttgacttatttttaaagctgtgttggagctcatcttgttccctgatgtgtctcgagcccattggtagggtcatacaaagcccacggttacaagcagtggtaggattgcagccgtgggcctgctggacacacacatacaccaaagatgtatttggatctgggcaccccctcccaggatccctgtactcacgtgccagtctcctgactagagcactttactctgtttcctcagccctgcagcccctgggagcacacactgggtgcagccctgggccaggcacgggaggccctgccctgtgctgcccaggggctgtgtgcaccacatgagcacatttccctctggcctggcggcctccaggctggctgtggaaacagttcctgaggaaattagagattctatgaattgtaggagtattaaagaccaggctgttggcaccagaacttaaagcgatgactggatgtctctgtactgtatgtatctggttatcaagatgcctctgtgcagaaagtatgcctcccgtgggtatacgtttttaccttttttaaaaaacatttttgtagaaaaaataattaaatcccctttttggaaacttactgcaggttttgtgccttgacaacctctccctatgtgaggtttgtaaaaagtgtcctgtgacttaacacagaaacgcaataaacacacacaaaatagtttcatgagtgattcttcagatgcccttcccaactggttagttgatcaagaattttgggggtgggggttgcggagaaatcaagtttaaaattccttctgattaaaaaaatatagtggaatacaattgtctgccgtttccccttcttaatgtatatattgtgagtatttattagattcgtaggtcatattacttatcaactgagccaaatgtctgtgtgcaattgtgtttcctttaccttgtaaaattttgtacagcataaataagtaaaaaaatcactgttttt

SEQ ID NO: 417974 - DNA, 3686 bp, Homo sapiens
ctcccttccctactattgcctctctgacctttttaaattatttttaataccaaaagagttcttttgaaatggaactgattaaaagggcagagggtctgttgccagcctgcattgatataccagtcccatttgtaaatatttacgtacctttataaattcagttgcatctgtggcaaaatttcagactatttttgcgtctttcctcatcactttttgtgatgcaactccagtctggactcagatgcatagatttggtccagtgtattttcatgataaagtgaaattgagtcagaacaagagttaatatctgcctgtatcttgcacagttcgagcgatctgttattaactgggaagcatttggtgttggttttcattccatttcgacgagcatgttattgggaagtattctgaagaggcaatagcagtaataacaacagacttaagtgctacgcccctttgtgctgctggcttttctggttgcaggctttcccatggtcacaggatgcactgtcagcatcaggtcccagagggccaccgtgtccattacagcagagtccagctgcagcatccagctcacgccctcatgggaattggcacaggcctggggcagggcttctgatggccatttgcttggcctcctgcattttagtccaactcacagtccactagcttcactcctttaaattcactttgaaacaggcctcatcccacttccaccagcaccatagaagaataattctgggcagaagtctgttttttttcatttttccaggacagttggatattgtcaggccacttgtgaccccagccatgtagtgagggtgctctttctctgtgcctgctccttatgagtgcagtggaaggaagccacacactggtcagtcatttcagaggcagcagatgcccagggagacccaagaaagagtcaggttagggagcagtgaaagtgaggagggaagacaattctgtgaactctgtaactcttaaaatttttgaaaactccatcgttaaacaacttttaaaagaaataactaaattttcaaatgagtaagcagtgccaccaactagtgttttgcccgatagaagagccagcatgttcacgttatttaaattaggtggaaaaatctaaacatttttatcttcataatttaaaaaatatatatgtatatattgcatattcactttttcctttaggtagagatgatttcaatccaaatactcttactttaaaaaatttcctttccccaagaatctccttgggactttgacttatttttaaagctgtgttggagctcatcttgttccctgatgtgtctcgagcccattggtagggtcatacaaagcccacggttacaagcagtggtaggattgcagccgtgggcctgctggacacacacatacaccaaagatgtatttggatctgggcaccccctcccaggatccctgtactcacgtgccagtctcctgactagagcactttactctgtttcctcagccctgcagcccctgggagcacacactgggtgcagccctgggccaggcacgggaggccctgccctgtgctgcccaggggctgtgtgcaccacatgagcacatttccctctggcctggcggcctccaggctggctgtggaaacagttcctgaggaaattagagattctatgaattgtaggagtattaaagaccaggctgttggcaccagaacttaaagcgatgactggatgtctctgtactgtatgtatctggttatcaagatgcctctgtgcagaaagtatgcctcccgtgggtatacgtttttaccttttttaaaaaacatttttgtagaaaaaataattaaatcccctttttggaaacttactgcaggttttgtgccttgacaacctctccctatgtgaggtttgtaaaaagtgtcctgtgacttaacacagaaacgcaataaacacacacaaaatagtttcatgagtgattcttcagatgcccttcccaactggttagttgatcaagaattttgggggtgggggttgcggagaaatcaagtttaaaattccttctgattaaaaaaatatagtggaatacaattgtctgccgtttccccttcttaatgtatatattgtgagtatttattagattcgtaggtcatattacttatcaactgagccaaatgtctgtgtgcaattgtgtttcctttaccttgtaaaattttgtacagcataaataagtaaaaaaatcactgtttttctcaactttttcaaaatcaaggattgtaaatattgtagattctttttctgtgtgatgtgtcctactgtttcataatgctgtaacttgtagaaatattgtatatttattttctgcttatttaatgtcttaatttctgaaaagtattaacatccctgtctcccactcccctgccgtcccatgaagttaactcctgagagttgtcgggggtgactggagagctcattgcagaccacgtggtcctccagggtggctctccaccttcgggtcctggtatttccagtcaagtgggtttcaattcttgggctttgccgcccttatgatgaagtgtgtgtttgatgccagtgagaaactcagtctggcaggctacaaaattctactccaagaaatacccagcaaccttctgtttgttccaaagcaactagcttatcatgcaagcaaattttgctgactccaggctttatctttaggaaaacaaaaaaaccaaagtattatcagcaggtgggaaagatttttctattgaaaatttatccctgacaactcagcgtttagaaaagaaataaaatgtgccacttccagaggtgctgcattgcagttgttcagggctagggccaggcaggacaagtgaatgggtgggacaggtggctcctgcctaaggaccacctcaggccactaaccccttgtggacaactgtgagtagctgggttttcccccacctgctgtgcaacttcctgtgctttgaggttggactaacttgtcttcaggagctaattaactgtacagccctccccacgccccacccatacggtcactgcatttggtcagcctgcttcttcaggtcgatgccctccttctgatactccatctccttcaggggaggttggggccccactggactgggtgtcaagatgtgaaagcttatgggagctttaaggagacttcatggtggttccatgcaggtggttctgccatccctgctgatttagcctggtgcctgtgtgtgtccactcacgtacacgtggggtgggggaaacgtgtctacagatgacgctaaatcagttggggtctactctaaacagcattgtgtgtaagaagcatcctcaagctcccagttaagtaacttgactacttttatttgggaatttcagactatagaagctctcttatgttttatgtccagattctgtgaccactagttactgtatcagaactcatcaggtacccacttataaatagcactgatctggctgtatactgatccatcactaacctgttttctaggacccagcgtatgtagcatttgtattgcagtttccctggcttacttgtgttttgcactgatgaattttgacagggtaattgccactttacttgtgcaatactgctgtaaataactgcagatttttaaacaatcttttatgttaattttataaaaataaaactttcaacta

SEQ ID NO: 417975 - DNA, 3754 bp, Homo sapiens
ctcccttccctactattgcctctctgacctttttaaattatttttaataccaaaagagttcttttgaaatggaactgattaaaagggcagagggtctgttgccagcctgcattgatataccagtcccatttgtaaatatttacgtacctttataaattcagttgcatctgtggcaaaatttcagactatttttgcgtctttcctcatcactttttgtgatgcaactccagtctggactcagatgcatagatttggtccagtgtattttcatgataaagtgaaattgagtcagaacaagagttaatatctgcctgtatcttgcacagttcgagcgatctgttattaactgggaagcatttggtgttggttttcattccatttcgacgagcatgttattgggaagtattctgaagaggcaatagcagtaataacaacagacttaagtgctacgcccctttgtgctgctggcttttctggttgcaggctttcccatggtcacaggatgcactgtcagcatcaggtcccagagggccaccgtgtccattacagcagagtccagctgcagcatccagctcacgccctcatgggaattggcacaggcctggggcagggcttctgatggccatttgcttggcctcctgcattttagtccaactcacagtccactagcttcactcctttaaattcactttgaaacaggcctcatcccacttccaccagcaccatagaagaataattctgggcagaagtctgttttttttcatttttccaggacagttggatattgtcaggccacttgtgaccccagccatgtagtgagggtgctctttctctgtgcctgctccttatgagtgcagtggaaggaagccacacactggtcagtcatttcagaggcagcagatgcccagggagacccaagaaagagtcaggttagggagcagtgaaagtgaggagggaagacaattctgtgaactctgtaactcttaaaatttttgaaaactccatcgttaaacaacttttaaaagaaataactaaattttcaaatgagtaagcagtgccaccaactagtgttttgcccgatagaagagccagcatgttcacgttatttaaattaggtggaaaaatctaaacatttttatcttcataatttaaaaaatatatatgtatatattgcatattcactttttcctttaggtagagatgatttcaatccaaatactcttactttaaaaaatttcctttccccaagaatctccttgggactttgacttatttttaaagctgtgttggagctcatcttgttccctgatgtgtctcgagcccattggtagggtcatacaaagcccacggttacaagcagtggtaggattgcagccgtgggcctgctggacacacacatacaccaaagatgtatttggatctgggcaccccctcccaggatccctgtactcacgtgccagtctcctgactagagcactttactctgtttcctcagccctgcagcccctgggagcacacactgggtgcagccctgggccaggcacgggaggccctgccctgtgctgcccaggggctgtgtgcaccacatgagcacatttccctctggcctggcggcctccaggctggctgtggaaacagttcctgaggaaattagagattctatgaattgtaggagtattaaagaccaggctgttggcaccagaacttaaagcgatgactggatgtctctgtactgtatgtatctggttatcaagatgcctctgtgcagaaagtatgcctcccgtgggtatacgtttttaccttttttaaaaaacatttttgtagaaaaaataattaaatcccctttttggaaacttactgcaggttttgtgccttgacaacctctccctatgtgaggtttgtaaaaagtgtcctgtgacttaacacagaaacgcaataaacacacacaaaatagtttcatgagtgattcttcagatgcccttcccaactggttagttgatcaagaattttgggggtgggggttgcggagaaatcaagtttaaaattccttctgattaaaaaaatatagtggaatacaattgtctgccgtttccccttcttaatgtatatattgtgagtatttattagattcgtaggtcatattacttatcaactgagccaaatgtctgtgtgcaattgtgtttcctttaccttgtaaaattttgtacagcataaataagtaaaaaaatcactgtttttctcaactttttcaaaatcaaggattgtaaatattgtagattctttttctgtgtgatgtgtcctactgtttcataatgctgtaacttgtagaaatattgtatatttattttctgcttatttaatgtcttaatttctgaaaagtattaacatccctgtctcccactcccctgccgtcccatgaagttaactcctgagagttgtcgggggtgactggagagctcattgcagaccacgtggtcctccagggtggctctccaccttcgggtcctggtatttccagtcaagtgggtttcaattcttgggctttgccgcccttatgatgaagtgtgtgtttgatgccagtgagaaactcagtctggcaggctacaaaattctactccaagaaatacccagcaaccttctgtttgttccaaagcaactagcttatcatgcaagcaaattttgctgactccaggctttatctttaggaaaacaaaaaaaccaaagtattatcagcaggtgggaaagatttttctattgaaaatttatccctgacaactcagcgtttagaaaagaaataaaatgtgccacttccagaggtgctgcattgcagttgttcagggctagggccaggcaggacaagtgaatgggtgggacaggtggctcctgcctaaggaccacctcaggccactaaccccttgtggacaactgtgagtagctgggttttcccccacctgctgtgcaacttcctgtgctttgaggttggactaacttgtcttcaggagctaattaactgtacagccctccccacgccccacccatacggtcactgcatttggtcagcctgcttcttcaggtcgatgccctccttctgatactccatctccttcaggggaggttggggccccactggactgggtgtcaagatgtgaaagcttatgggagctttaaggagacttcatggtggttccatgcaggtggttctgccatccctgctgatttagcctggtgcctgtgtgtgtccactcacgtacacgtggggtgggggaaacgtgtctacagatgacgctaaatcagttggggtctactctaaacagcattgtgtgtaagaagcatcctcaagctcccagttaagtaacttgactacttttatttgggaatttcagactatagaagctctcttatgttttatgtccagattctgtgaccactagttactgtatcagaactcatcaggtacccacttataaatagcactgatctggctgtatactgatccatcactaacctgttttctaggacccagcgtatgtagcatttgtattgcagtttccctggcttacttgtgttttgcactgatgaattttgacagggtaattgccactttacttgtgcaatactgctgtaaataactgcagatttttaaacaatcttttatgttaattttataaaaataaaactttcaactaagtaaatacaacaaaacccagcaacacccgcgagtcagcaaggctatctaagcaccggaacaacacat

SEQ ID NO: 417976 - DNA, 3811 bp, Homo sapiens
ctcccttccctactattgcctctctgacctttttaaattatttttaataccaaaagagttcttttgaaatggaactgattaaaagggcagagggtctgttgccagcctgcattgatataccagtcccatttgtaaatatttacgtacctttataaattcagttgcatctgtggcaaaatttcagactatttttgcgtctttcctcatcactttttgtgatgcaactccagtctggactcagatgcatagatttggtccagtgtattttcatgataaagtgaaattgagtcagaacaagagttaatatctgcctgtatcttgcacagttcgagcgatctgttattaactgggaagcatttggtgttggttttcattccatttcgacgagcatgttattgggaagtattctgaagaggcaatagcagtaataacaacagacttaagtgctacgcccctttgtgctgctggcttttctggttgcaggctttcccatggtcacaggatgcactgtcagcatcaggtcccagagggccaccgtgtccattacagcagagtccagctgcagcatccagctcacgccctcatgggaattggcacaggcctggggcagggcttctgatggccatttgcttggcctcctgcattttagtccaactcacagtccactagcttcactcctttaaattcactttgaaacaggcctcatcccacttccaccagcaccatagaagaataattctgggcagaagtctgttttttttcatttttccaggacagttggatattgtcaggccacttgtgaccccagccatgtagtgagggtgctctttctctgtgcctgctccttatgagtgcagtggaaggaagccacacactggtcagtcatttcagaggcagcagatgcccagggagacccaagaaagagtcaggttagggagcagtgaaagtgaggagggaagacaattctgtgaactctgtaactcttaaaatttttgaaaactccatcgttaaacaacttttaaaagaaataactaaattttcaaatgagtaagcagtgccaccaactagtgttttgcccgatagaagagccagcatgttcacgttatttaaattaggtggaaaaatctaaacatttttatcttcataatttaaaaaatatatatgtatatattgcatattcactttttcctttaggtagagatgatttcaatccaaatactcttactttaaaaaatttcctttccccaagaatctccttgggactttgacttatttttaaagctgtgttggagctcatcttgttccctgatgtgtctcgagcccattggtagggtcatacaaagcccacggttacaagcagtggtaggattgcagccgtgggcctgctggacacacacatacaccaaagatgtatttggatctgggcaccccctcccaggatccctgtactcacgtgccagtctcctgactagagcactttactctgtttcctcagccctgcagcccctgggagcacacactgggtgcagccctgggccaggcacgggaggccctgccctgtgctgcccaggggctgtgtgcaccacatgagcacatttccctctggcctggcggcctccaggctggctgtggaaacagttcctgaggaaattagagattctatgaattgtaggagtattaaagaccaggctgttggcaccagaacttaaagcgatgactggatgtctctgtactgtatgtatctggttatcaagatgcctctgtgcagaaagtatgcctcccgtgggtatacgtttttaccttttttaaaaaacatttttgtagaaaaaataattaaatcccctttttggaaacttactgcaggttttgtgccttgacaacctctccctatgtgaggtttgtaaaaagtgtcctgtgacttaacacagaaacgcaataaacacacacaaaatagtttcatgagtgattcttcagatgcccttcccaactggttagttgatcaagaattttgggggtgggggttgcggagaaatcaagtttaaaattccttctgattaaaaaaatatagtggaatacaattgtctgccgtttccccttcttaatgtatatattgtgagtatttattagattcgtaggtcatattacttatcaactgagccaaatgtctgtgtgcaattgtgtttcctttaccttgtaaaattttgtacagcataaataagtaaaaaaatcactgtttttctcaactttttcaaaatcaaggattgtaaatattgtagattctttttctgtgtgatgtgtcctactgtttcataatgctgtaacttgtagaaatattgtatatttattttctgcttatttaatgtcttaatttctgaaaagtattaacatccctgtctcccactcccctgccgtcccatgaagttaactcctgagagttgtcgggggtgactggagagctcattgcagaccacgtggtcctccagggtggctctccaccttcgggtcctggtatttccagtcaagtgggtttcaattcttgggctttgccgcccttatgatgaagtgtgtgtttgatgccagtgagaaactcagtctggcaggctacaaaattctactccaagaaatacccagcaaccttctgtttgttccaaagcaactagcttatcatgcaagcaaattttgctgactccaggctttatctttaggaaaacaaaaaaaccaaagtattatcagcaggtgggaaagatttttctattgaaaatttatccctgacaactcagcgtttagaaaagaaataaaatgtgccacttccagaggtgctgcattgcagttgttcagggctagggccaggcaggacaagtgaatgggtgggacaggtggctcctgcctaaggaccacctcaggccactaaccccttgtggacaactgtgagtagctgggttttcccccacctgctgtgcaacttcctgtgctttgaggttggactaacttgtcttcaggagctaattaactgtacagccctccccacgccccacccatacggtcactgcatttggtcagcctgcttcttcaggtcgatgccctccttctgatactccatctccttcaggggaggttggggccccactggactgggtgtcaagatgtgaaagcttatgggagctttaaggagacttcatggtggttccatgcaggtggttctgccatccctgctgatttagcctggtgcctgtgtgtgtccactcacgtacacgtggggtgggggaaacgtgtctacagatgacgctaaatcagttggggtctactctaaacagcattgtgtgtaagaagcatcctcaagctcccagttaagtaacttgactacttttatttgggaatttcagactatagaagctctcttatgttttatgtccagattctgtgaccactagttactgtatcagaactcatcaggtacccacttataaatagcactgatctggctgtatactgatccatcactaacctgttttctaggacccagcgtatgtagcatttgtattgcagtttccctggcttacttgtgttttgcactgatgaattttgacagggtaattgccactttacttgtgcaatactgctgtaaataacctgttttctaggacccagcgtatgtagcatttgtattgcagtttccctggcttacttgtgttttgcactgatgaattttgacagggtaattgccactttacttgtgcaatactgctgtaaataactgcagatttttaaacaatcttttatgttaattttataaaaataaaactttcaacta

SEQ ID NO: 417977 - DNA, 961 bp, Homo sapiens
tccttaaagctcccataagctttcacatcttgacacccagtctcagtggggccccaacctcaccctgaagcgagatggagtatcagcaagcgatgggcattcgactctgaagaacctaggctgaccaaactgcagtgactgggtgggacaggtggctcctgcctaaggaccacctcaggccactaaccccttgtggacaactgtgagtagctgggttttcccccacctgctgtgcaacttcctgtgctttgaggttggactaacttgtcttcaggagctaattaactgtacagccctccccacgccccacccatacggtcactgcatttggtcagcctgcttcttcaggtcgatgccctccttctgatactccatctccttcaggggaggttggggccccactggactgggtgtcaagatgtgaaagcttatgggagctttaaggagacttcatggtggttccatgcaggtggttctgccatccctgctgatttagcctggtgcctgtgtgtgtccactcacgtacacgtggggtgggggaaacgtgtctacagatgacgctaaatcagttggggtctactctaaacagcattgtgtgtaagaagcatcctcaagctcccagttaagtaacttgactacttttatttgggaatttcagactatagaagctctcttatgttttatgtccagattctgtgaccactagttactgtatcagaactcatcaggtacccacttataaatagcactgatctggctgtatactgatccatcactaacctgttttctaggacccagcgtatgtagcatttgtattgcagtttccctggcttacttgtgttttgcactgatgaattttgacagggtaattgccactttacttgtgcaatactgctgtaaataactgcagatttttaaacaatcttttatgttaattttataaaaataaaactttcaacta

SEQ ID NO: 417978 - DNA, 3293 bp, Homo sapiens
ctcccttccctactattgcctctctgacctttttaaattatttttaataccaaaagagttcttttgaaatggaactgattaaaagggcagagggtctgttgccagcctgcattgatataccagtcccatttgtaaatatttacgtacctttataaattcagttgcatctgtggcaaaatttcagactatttttgcgtctttcctcatcactttttgtgatgcaactccagtctggactcagatgcatagatttggtccagtgtattttcatgataaagtgaaattgagtcagaacaagagttaatatctgcctgtatcttgcacagttcgagcgatctgttattaactgggaagcatttggtgttggttttcattccatttcgacgagcatgttattgggaagtattctgaagaggcaatagcagtaataacaacagacttaagtgctacgcccctttgtgctgctggcttttctggttgcaggctttcccatggtcacaggatgcactgtcagcatcaggtcccagagggccaccgtgtccattacagcagagtccagctgcagcatccagctcacgccctcatgggaattggcacaggcctggggcagggcttctgatggccatttgcttggcctcctgcattttagtccaactcacagtccactagcttcactcctttaaattcactttgaaacaggcctcatcccacttccaccagcaccatagaagaataattctgggcagaagtctgttttttttcatttttccaggacagttggatattgtcaggccacttgtgaccccagccatgtagtgagggtgctctttctctgtgcctgctccttatgagtgcagtggaaggaagccacacactggtcagtcatttcagaggcagcagatgcccagggagacccaagaaagagtcaggttagggagcagtgaaagtgaggagggaagacaattctgtgaactctgtaactcttaaaatttttgaaaactccatcgttaaacaacttttaaaagaaataactaaattttcaaatgagtaagcagtgccaccaactagtgttttgcccgatagaagagccagcatgttcacgttatttaaattaggtggaaaaatctaaacatttttatcttcataatttaaaaaatatatatgtatatattgcatattcactttttcctttaggtagagatgatttcaatccaaatactcttactttaaaaaatttcctttccccaagaatctccttgggactttgacttatttttaaagctgtgttggagctcatcttgttccctgatgtgtctcgagcccattggtagggtcatacaaagcccacggttacaagcagtggtaggattgcagccgtgggcctgctggacacacacatacaccaaagatgtatttggatctgggcaccccctcccaggatccctgtactcacgtgccagtctcctgactagagcactttactctgtttcctcagccctgcagcccctgggagcacacactgggtgcagccctgggccaggcacgggaggccctgccctgtgctgcccaggggctgtgtgcaccacatgagcacatttccctctggcctggcggcctccaggctggctgtggaaacagttcctgaggaaattagagattctatgaattgtaggagtattaaagaccaggctgttggcaccagaacttaaagcgatgactggatgtctctgtactgtatgtatctggttatcaagatgcctctgtgcagaaagtatgcctcccgtgggtatacgtttttaccttttttaaaaaacatttttgtagaaaaaataattaaatcccctttttggaaacttactgcaggttttgtgccttgacaacctctccctatgtgaggtttgtaaaaagtgtcctgtgacttaacacagaaacgcaataaacacacacaaaatagtttcatgagtgattcttcagatgcccttcccaactggttagttgatcaagaattttgggggtgggggttgcggagaaatcaagtttaaaattccttctgattaaaaaaatatagtggaatacaattgtctgccgtttccccttcttaatgtatatattgtgagtatttattagattcgtaggtcatattacttatcaactgagccaaatgtctgtgtgcaattgtgtttcctttaccttgtaaaattttgtacagcataaataagtaaaaaaatcactgtttttctcaactttttcaaaatcaaggattgtaaatattgtagattctttttctgtgtgatgtgtcctactgtttcataatgctgtaacttgtagaaatattgtatatttattttctgcttatttaatgtcttaatttctgaaaagtattaacatccctgtctcccactcccctgccgtcccatgaagttaactcctgagagttgtcgggggtgactggagagctcattgcagaccacgtggtcctccagggtggctctccaccttcgggtcctggtatttccagtcaagtgggtttcaattcttgggctttgccgcccttatgatgaagtgtgtgtttgatgccagtgagaaactcagtctggcaggctacaaaattctactccaagaaatacccagcaaccttctgtttgttccaaagcaactagcttatcatgcaagcaaattttgctgactccaggctttatctttaggaaaacaaaaaaaccaaagtattatcagcaggtgggaaagatttttctattgaaaatttatccctgacaactcagcgtttagaaaagaaataaaatgtgccacttccagaggtgctgcattgcagttgttcagggctagggccaggcaggacaagtgaatgggtgggacaggtggctcctgcctaaggaccacctcaggccactaaccccttgtggacaactgtgagtagctgggttttcccccacctgctgtgcaacttcctgtgctttgaggttggactaacttgtcttcaggagctaattaactgtacagccctccccacgccccactagttactgtatcagaactcatcaggtacccacttataaatagcactgatctggctgtatactgatccatcactaacctgttttctaggacccagcgtatgtagcatttgtattgcagtttccctggcttacttgtgttttgcactgatgaattttgacagggtaattgccactttacttgtgcaatactgctgtaaataactgcagatttttaaacaatcttttatgttaattttataaaaataaaactttcaacta

SEQ ID NO: 417979 - DNA, 500 bp, Homo sapiens
caaagttgagttctgggtcaaaaatctctcaagcgtcctccacagctgacttccacagtcccctgtgtgtctctgcaaggaacacaaaggaagtgagatagtgggaagtctggggccatcttcggtcacgtgagaattccctctcagttagccggggcgtgcagccgcacagaaggaaggcagccacgcagctccagtccaggctgggagagagctttgtagatccatctcccactgagcaggcttccctcctgcaaggagagactctaccgataatgtgttaagatcagattaatgcaggaaatacacatgaaataaataataacagtgtaataacagtggctgtcattgcaatggttatttctgttaaaaatgtgagatctacactacggatttcttaggataattttgcccttacttaaaagaaactgacagatgtactttataaaaatgaaaataatttaacaaataaagaattggagaatattgactcaccactc

SEQ ID NO: 417980 - DNA, 1441 bp, Homo sapiens
tgcggcttccggtcccggctcagcctccgacccaggtggtctggagcctgccgggagagtggtggcatctgagaggctggtcgtggactgtggttgggggaggtgggagctgttttaaccgtgtgccccctctcctgtgccggcgtgggcatcccccggggcagtggaacgcgggcgctcctccagcttccgagtccagccagcctgggcgcggggcgccgcccccgagacacccgaggagtccgttcctccctggttacgtggactgtggagctggtctcttgtggctcagcgccgtgcggaggttgaagcgtacctgcggaggtcgcaccagggcgtgaggaggaggaggaagggcatgagccgagcttgaggaatccgtgctccaaactctacactcaagggtggcccttgggtagggtgaagatcccctgtctttatcctagttccacaccttggtgtgggttactgggtgcaggatgaactgtcgctcggaggtgctggaggtgtcggtggaggggcggcaggtggaggaggccatgctggctgtgctgcacacggtgcttctgcaccgcagcacaggcaagttccactacaagaaggagggcacctactccattggcaccgtgggcacccaggatgttgactgtgacttcatcgacttcacttatgtgcgtgtctcttctgaggaactggatcgtgccctgcgcaaggttgttggggagttcaaggatgcactgcgcaactctggtggcgatgggctggggcagatgtccttggagttctaccagaagaagaagtctcgctggccattctcagacgagtgcatcccatgggaagtgtggacggtcaaggtgcatgtggtagccctggccacggagcaggagcggcagatctgccgggagaaggtgggtgagaaactctgcgagaagatcatcaacatcgtggaggtgatgaatcggcatgagtacttgcccaagatgcccacacagtcggaggtggataacgtgtttgacacaggcttgcgggacgtgcagccctacctgtacaagatctccttccagatcactgatgccctgggcacctcagtcaccaccaccatgcgcaggctcatcaaagacacccttgccctctgagcgtcgctggatctctgggagctccttgatggctcccagaccttggcttttgggaattgcacttttgggcctttgggctctggaacctgctctgggtcattggtgagacttggaaggggcagcccccgctggcttcttggttttgtggttgccagcctcaggtcatccttttaatctttgctgacggttcagtcctgcctctactgtctctccatagccctggtggggtcccccttctttctccactgtacagaagagccaccactgggatggggaataaagttgagaacatgagtttgggctga

SEQ ID NO: 417981 - DNA, 970 bp, Homo sapiens
gatgagtgatgttgagggtcacgcagagaagcaatggccgaattactagcctccgaaggactgtcaccagattggtcaccatggggtatcaagtagtgctgctgcataaaggcaacactgagagatgaagcccctttctccagcatctgtgtgggtggagggccagggatcccgtctgttacgcacattcaacaaactcaagttttgccatccactgggcgtcctgcagtacagcggtgtgggctcatctccaggacctctctctacggggtacgcccctcatcttgcggtgatcagtgttccttccagacctctcagtccggactgagttgggcaccgcgtcagcgtctcccggccaggctcgccgccgatgactccgctcggcctagggaggcggccgagagcccgtagggctcctccttccctccagtctctatggcggaagtgagttgtacgggccgaaacaccacagcgttctcggtggtgggctgaatggactcgtccacatgagggggatcttcatcaccatcaactcttaaaatccgagacataaccacgaaaggagcagcccccagatcagagagcaacgcatgactatctgcgtgtgcttctgtgactacgcggatgttgtgggcggctacatgcgtgcgggggcccggcgagctgggcaggtgccccctccggggccgtgggatctgctggtctcttgtggctcagcgccgtgcggaggttgaagcgtacctgcggaggtcgcaccagggcgtgaggaggaggaggaagggggcagcccccgctggcttcttggttttgtggttgccagcctcaggtcatccttttaatctttgctgacggttcagtcctgcctctactgtctctccatagccctggtggggtcccccttctttctccactgtacagaagagccaccactgggatggggaataaagttgagaacatgagtttgggctga

SEQ ID NO: 417982 - DNA, 724 bp, Homo sapiens
  misc_feature (39)..(39): n is a, c, g, or t
  misc_feature (46)..(46): n is a, c, g, or t
  misc_feature (53)..(53): n is a, c, g, or t
tggattgcttgctgcttcagctctgtcatttccttcatnctttagncacccanccatgtgccgctcccaaggatgcactgcgcaactctggtggcgatgggctggggcagatgtccttggagttctaccagaagaagaagtctcgctggccattctcagacgagtgcatcccatgggaagtgtggacggtcaaggtgcatgtggtagccctggccacggagcaggagcggcagatctgccgggagaaggtgggtgagaaactctgcgagaagatcatcaacatcgtggaggtgatgaatcggcatgagtacttgcccaagatgcccacacagtcggaggtggataacgtgtttgacacaggcttgcgggacgtgcagccctacctgtacaagatctccttccagatcactgatgccctgggcacctcagtcaccaccaccatgcgcaggctcatcaaagacacccttgccctctgagcgtcgctggatctctgggagctccttgatggctcccagaccttggcttgaaaatctttctctcttaactctattatatttattttatcataccattgaatctttataatcatattctttttcttctctcattttattcactatttacgtatatttctcttactattctaattctctctttactatgttattgtcgctccttaatattattttattatctatcttttatattatctgtatctattacg

SEQ ID NO: 417983 - DNA, 1684 bp, Homo sapiens
tgcggcttccggtcccggctcagcctccgacccaggtggtctggagcctgccgggagagtggtggcatctgagaggctggtcgtggactgtggttgggggaggtgggagctgttttaaccgtgtgccccctctcctgtgccggcgtgggcatcccccggggcagtggaacgcgggcgctcctccagcttccgagtccagccagcctgggcgcggggcgccgcccccgagacacccgaggagtccgttcctccctggttacgtggactgtggagctggtctcttgtggctcagcgccgtgcggaggttgaagcgtacctgcggaggtcgcaccagggcgtgaggaggaggaggaagggcatgagccgagcttgaggaatccgtgctccaaactctacactcaagggtggcccttgggtagggtgaagatcccctgtctttatcctagttccacaccttggtgtgggttactgggtgcaggatgaactgtcgctcggaggtgctggaggtgtcggtggaggggcggcaggtggaggaggccatgctggctgtgctgcacacggtgcttctgcaccgcagcacaggcaagttccactacaagaaggagggcacctactccattggcaccgtgggcacccaggatgttgactgtgacttcatcgacttcacttatgtgcgtgtctcttctgaggaactggatcgtgccctgcgcaaggttgttggggagttcaaggatgcactgcgcaactctggtggcgatgggctggggcagatgtccttggagttctaccagaagaagaagtctcgctggccattctcagacgagtgcatcccatgggaagtgtggacggtcaaggtgcatgtggtagccctggccacggagcaggagcggcagatctgccgggagaaggtgggtgagaaactctgcgagaagatcatcaacatcgtggaggtgatgaatcggcatgagtacttgcccaagatgcccacacagtcggaggtggataacgtgtttgacacaggcttgcgggacgtgcagccctacctgtacaagatctccttccagatcactgatgccctgggcacctcagtcaccaccaccatgcgcaggctcatcaaagacacccttgccctctgagcgtcgctggatctctgggagctccttgatggctcccagaccttggcttttgggaattgcacttttgggcctttgggctctggaacctgctctgggtcattggtgagacttggaaggggcagcccccgctggcttcttggttttgtggttgccagcctcaggtcatccttttaatctttgctgacggttcagtcctgcctctactgtctctccatagccctggtggggtcccccttctttctccactgtacagaagagccaccactgggatggggaataaagttgagaacatgagtttgggctgaaaaaaacataaccgctcatctccccgccagacgcgccacacacaaggggggggcgcgccctctaagagtttccccggcggggggcccccgtttaagcggttccccgcatttctctgttccccccgctggggcccccattgcggccgccctttttaaccctcgtgcctcggtggcgcgctctttaacacgggctccgcacccggcacacccccgccacccgcgggaccccttggcggcgcgcgc

SEQ ID NO: 417984 - DNA, 1422 bp, Homo sapiens
tgcggcttccggtcccggctcagcctccgacccaggtggtctggagcctgccgggagagtggtggcatctgagaggctggtcgtggactgtggttgggggaggtgggagctgttttaaccgtgtgccccctctcctgtgccggcgtgggcatcccccggggcagtggaacgcgggcgctcctccagcttccgagtccagccagcctgggcgcggggcgccgcccccgagacacccgaggagtccgttcctccctggttacgtggactgtggagctggtctcttgtggctcagcgccgtgcggaggttgaagcgtacctgcggaggtcgcaccagggcgtgaggaggaggaggaagggcatgagccgagcttgaggaatccgtgctccaaactctacactcaagggtggcccttgggtagggtgaagatcccctgtctttatcctagttccacaccttggtgtgggttactgggtgcaggatgaactgtcgctcggaggtgctggaggtgtcggtggaggggcggcaggtggaggaggccatgctggctgtgctgcacacggtgcttctgcaccgcagcacaggcaagttccactacaagaaggagggcacctactccattggcaccgtgggcacccaggatgttgactgtgacttcatcgacttcacttatgtgcgtgtctcttctgaggaactggatcgtgccctgcgcaaggttgttggggagttcaaggatgcactgcgcaactctggtggcgatgggctggggcagatgtccttggagttctaccagaagaagaagtctcgctggccattctcagacgagtgcatcccatgggaagtgtggacggtcaaggtgcatgtggtagccctggccacggagcaggagcggcagatctgccgggagaaggtgggtgagaaactctgcgagaagatcatcaacatcgtggaggtgatgaatcggcatgagtacttgcccaagatgcccacacagtcggaggtggataacgtgtttgacacaggcttgcgggacgtgcagccctacctgtacaagatctccttccagatcactgatgccctgggcacctcagtcaccaccaccatgcgcaggctcatcaaagacacccttgccctctgagcgtcgctggatctctgggagctccttgatggctcccagaccttggcttttgggaattgcacttttgggcctttgggctctggaacctgctctgggtcattggtgagacttggaaggggcagcccccgctggcttcttggttttgtggttgccagcctttgctgacggttcagtcctgcctctactgtctctccatagccctggtggggtcccccttctttctccactgtacagaagagccaccactgggatggggaataaagttgagaacatgagtttgggctga

SEQ ID NO: 417985 - DNA, 1170 bp, Homo sapiens
tgcggcttccggtcccggctcagcctccgacccaggtggtctggagcctgccgggagagtggtggcatctgagaggctggtcgtggactgtggttgggggaggtgggagctgttttaaccgtgtgccccctctcctgtgccggcgtgggcatcccccggggcagtggaacgcgggcgctcctccagcttccgagtccagccagcctgggcgcggggcgccgcccccgagacacccgaggagtccgttcctccctggttacgtggactgtggagctggtctcttgtggctcagcgccgtgcggaggttgaagcgtacctgcggaggtcgcaccagggcgtgaggaggaggaggaagggcatgagccgagcttgaggaatccgtgctccaaactctacactcaagggtggcccttgggtagggtgaagatcccctgtctttatcctagttccacaccttggtgtgggttactgggtgcaggatgaactgtcgctcggaggtgctggaggtgtcggtggaggggcggcaggtggaggaggccatgctggctgtgctgcacacggtgcttctgcaccgcagcacaggcaagttccactacaagaaggagggcacctactccattggcaccgtgggcacccaggatgttgactgtgacttcatcgacttcacttatgtgcgtgtctcttctgaggaactggatcgtgccctgcgcaaggttgttggggagttcaaggatgcactgcgcaactctggtggcgatgggctggggcagatgtccttggagttctaccagaagaagaagtctcgctggccattctcagacgagtgcatcccatgggaagtgtggacggtcaaggtgcatgtggtagccctggccacggagcaggagcggcagatctgccgggagaaggtgggtgagaaactctgcgagaagatcatcaacatcgtggaggtgatgaatcggcatgagtacttgcccaagatgcccacacagtcggaggtggataacgtgtttgacacaggcttgcgggacgtgcagccctacctgtacaagatctccttccagatcactgatgccctgggcacctcagtcaccaccaccatgcgcaggctcatcaaagacacccctcactctgtgctgtccacctcctctgtgcttcgggatcctctag

SEQ ID NO: 417986 - DNA, 1552 bp, Homo sapiens
tgcggcttccggtcccggctcagcctccgacccaggtggtctggagcctgccgggagagtggtggcatctgagaggctggtcgtggactgtggttgggggaggtgggagctgttttaaccgtgtgccccctctcctgtgccggcgtgggcatcccccggggcagtggaacgcgggcgctcctccagcttccgagtccagccagcctgggcgcggggcgccgcccccgagacacccgaggagtccgttcctccctggttacgtggactgtggaggttcgcgcgtagtggcggcgggggatacgggacccgggcgggaattccttcctgcgtccgtcccgagtctcttgatatggagccaagtaagttttctggttttgcttttagctggtctcttgtggctcagcgccgtgcggaggttgaagcgtacctgcggaggtcgcaccagggcgtgaggaggaggaggaagggcatgagccgagcttgaggaatccgtgctccaaactctacactcaagggtggcccttgggtagggtgaagatcccctgtctttatcctagttccacaccttggtgtgggttactgggtgcaggatgaactgtcgctcggaggtgctggaggtgtcggtggaggggcggcaggtggaggaggccatgctggctgtgctgcacacggtgcttctgcaccgcagcacaggcaagttccactacaagaaggagggcacctactccattggcaccgtgggcacccaggatgttgactgtgacttcatcgacttcacttatgtgcgtgtctcttctgaggaactggatcgtgccctgcgcaaggttgttggggagttcaaggatgcactgcgcaactctggtggcgatgggctggggcagatgtccttggagttctaccagaagaagaagtctcgctggccattctcagacgagtgcatcccatgggaagtgtggacggtcaaggtgcatgtggtagccctggccacggagcaggagcggcagatctgccgggagaaggtgggtgagaaactctgcgagaagatcatcaacatcgtggaggtgatgaatcggcatgagtacttgcccaagatgcccacacagtcggaggtggataacgtgtttgacacaggcttgcgggacgtgcagccctacctgtacaagatctccttccagatcactgatgccctgggcacctcagtcaccaccaccatgcgcaggctcatcaaagacacccttgccctctgagcgtcgctggatctctgggagctccttgatggctcccagaccttggcttttgggaattgcacttttgggcctttgggctctggaacctgctctgggtcattggtgagacttggaaggggcagcccccgctggcttcttggttttgtggttgccagcctcaggtcatccttttaatctttgctgacggttcagtcctgcctctactgtctctccatagccctggtggggtcccccttctttctccactgtacagaagagccaccactgggatggggaataaagttgagaacatgagtttgggctga

SEQ ID NO: 417987 - DNA, 1270 bp, Homo sapiens
tgcggcttccggtcccggctcagcctccgacccaggtggtctggagcctgccgggagagtggtggcatctgagaggctggtcgtggactgtggttgggggagctggtctcttgtggctcagcgccgtgcggaggttgaagcgtacctgcggaggtcgcaccagggcgtgaggaggaggaggaagggcatgagccgagcttgaggaatccgtgctccaaactctacactcaagggtggcccttgggtagggtgaagatcccctgtctttatcctagttccacaccttggtgtgggttactgggtgcaggatgaactgtcgctcggaggtgctggaggtgtcggtggaggggcggcaggtggaggaggccatgctggctgtgctgcacacggtgcttctgcaccgcagcacaggcaagttccactacaagaaggagggcacctactccattggcaccgtgggcacccaggatgttgactgtgacttcatcgacttcacttatgtgcgtgtctcttctgaggaactggatcgtgccctgcgcaaggttgttggggagttcaaggatgcactgcgcaactctggtggcgatgggctggggcagatgtccttggagttctaccagaagaagaagtctcgctggccattctcagacgagtgcatcccatgggaagtgtggacggtcaaggtgcatgtggtagccctggccacggagcaggagcggcagatctgccgggagaaggtgggtgagaaactctgcgagaagatcatcaacatcgtggaggtgatgaatcggcatgagtacttgcccaagatgcccacacagtcggaggtggataacgtgtttgacacaggcttgcgggacgtgcagccctacctgtacaagatctccttccagatcactgatgccctgggcacctcagtcaccaccaccatgcgcaggctcatcaaagacacccttgccctctgagcgtcgctggatctctgggagctccttgatggctcccagaccttggcttttgggaattgcacttttgggcctttgggctctggaacctgctctgggtcattggtgagacttggaaggggcagcccccgctggcttcttggttttgtggttgccagcctcaggtcatccttttaatctttgctgacggttcagtcctgcctctactgtctctccatagccctggtggggtcccccttctttctccactgtacagaagagccaccactgggatggggaataaagttgagaacatgagtttgggctga

SEQ ID NO: 417988 - DNA, 1247 bp, Homo sapiens
tgcggcttccggtcccggctcagcctccgacccaggtggtctggagcctgccgggagagtggtggcatctgagaggctgctggtctcttgtggctcagcgccgtgcggaggttgaagcgtacctgcggaggtcgcaccagggcgtgaggaggaggaggaagggcatgagccgagcttgaggaatccgtgctccaaactctacactcaagggtggcccttgggtagggtgaagatcccctgtctttatcctagttccacaccttggtgtgggttactgggtgcaggatgaactgtcgctcggaggtgctggaggtgtcggtggaggggcggcaggtggaggaggccatgctggctgtgctgcacacggtgcttctgcaccgcagcacaggcaagttccactacaagaaggagggcacctactccattggcaccgtgggcacccaggatgttgactgtgacttcatcgacttcacttatgtgcgtgtctcttctgaggaactggatcgtgccctgcgcaaggttgttggggagttcaaggatgcactgcgcaactctggtggcgatgggctggggcagatgtccttggagttctaccagaagaagaagtctcgctggccattctcagacgagtgcatcccatgggaagtgtggacggtcaaggtgcatgtggtagccctggccacggagcaggagcggcagatctgccgggagaaggtgggtgagaaactctgcgagaagatcatcaacatcgtggaggtgatgaatcggcatgagtacttgcccaagatgcccacacagtcggaggtggataacgtgtttgacacaggcttgcgggacgtgcagccctacctgtacaagatctccttccagatcactgatgccctgggcacctcagtcaccaccaccatgcgcaggctcatcaaagacacccttgccctctgagcgtcgctggatctctgggagctccttgatggctcccagaccttggcttttgggaattgcacttttgggcctttgggctctggaacctgctctgggtcattggtgagacttggaaggggcagcccccgctggcttcttggttttgtggttgccagcctcaggtcatccttttaatctttgctgacggttcagtcctgcctctactgtctctccatagccctggtggggtcccccttctttctccactgtacagaagagccaccactgggatggggaataaagttgagaacatgagtttgggctga

SEQ ID NO: 417989 - DNA, 1866 bp, Homo sapiens
gatgagtgatgttgagggtcacgcagagaagcaatggccgaattactagcctccgaaggactgtcaccagattggtcaccatggggtatcaagtagtgctgctgcataaaggcaacactgagagatgaagcccctttctccagcatctgtgtgggtggagggccagggatcccgtctgttacgcacattcaacaaactcaagttttgccatccactgggcgtcctgcagtacagcggtgtgggctcatctccaggacctctctctacggggtacgcccctcatcttgcggtgatcagtgttccttccagacctctcagtccggactgagttgggcaccgcgtcagcgtctcccggccaggctcgccgccgatgactccgctcggcctagggaggcggccgagagcccgtagggctcctccttccctccagtctctatggcggaagtgagttgtacgggccgaaacaccacagcgttctcggtggtgggctgaatggactcgtccacatgagggggatcttcatcaccatcaactcttaaaatccgagacataaccacgaaaggagcagcccccagatcagagagcaacgcatgactatctgcgtgtgcttctgtgactacgcggatgttgtgggcggctacatgcgtgcgggggcccggcgagctgggcaggtgccccctccggggccgtgggatctgctggtctcttgtggctcagcgccgtgcggaggttgaagcgtacctgcggaggtcgcaccagggcgtgaggaggaggaggaagggcatgagccgagcttgaggaatccgtgctccaaactctacactcaagggtggcccttgggtagggtgaagatcccctgtctttatcctagttccacaccttggtgtgggttactgggtgcaggatgaactgtcgctcggaggtgctggaggtgtcggtggaggggcggcaggtggaggaggccatgctggctgtgctgcacacggtgcttctgcaccgcagcacaggcaagttccactacaagaaggagggcacctactccattggcaccgtgggcacccaggatgttgactgtgacttcatcgacttcacttatgtgcgtgtctcttctgaggaactggatcgtgccctgcgcaaggttgttggggagttcaaggatgcactgcgcaactctggtggcgatgggctggggcagatgtccttggagttctaccagaagaagaagtctcgctggccattctcagacgagtgcatcccatgggaagtgtggacggtcaaggtgcatgtggtagccctggccacggagcaggagcggcagatctgccgggagaaggtgggtgagaaactctgcgagaagatcatcaacatcgtggaggtgatgaatcggcatgagtacttgcccaagatgcccacacagtcggaggtggataacgtgtttgacacaggcttgcgggacgtgcagccctacctgtacaagatctccttccagatcactgatgccctgggcacctcagtcaccaccaccatgcgcaggctcatcaaagacacccttgccctctgagcgtcgctggatctctgggagctccttgatggctcccagaccttggcttttgggaattgcacttttgggcctttgggctctggaacctgctctgggtcattggtgagacttggaaggggcagcccccgctggcttcttggttttgtggttgccagcctcaggtcatccttttaatctttgctgacggttcagtcctgcctctactgtctctccatagccctggtggggtcccccttctttctccactgtacagaagagccaccactgggatggggaataaagttgagaacatgagtttgggctga

SEQ ID NO: 417990 - DNA, 1397 bp, Homo sapiens
tgcggcttccggtcccggctcagcctccgacccaggtggtctggagcctgccgggagagtggtggcatctgagaggctggtcgtggactgtggttgggggaggtgggagctgttttaaccgtgtgccccctctcctgtgccggcgtgggcatcccccggggcagtggaacgcgggcgctcctccagcttccgagtccagccagcctgggcgcggggcgccgcccccgagacacccgaggagtccgttcctccctggttacgtggactgtggaggttcgcgcgtagtggcggcgggggatacgggacccgggcgggaattccttcctgcgtccgtcccgagtctcttgatatggagccaaggtggcccttgggtagggtgaagatcccctgtctttatcctagttccacaccttggtgtgggttactgggtgcaggatgaactgtcgctcggaggtgctggaggtgtcggtggaggggcggcaggtggaggaggccatgctggctgtgctgcacacggtgcttctgcaccgcagcacaggcaagttccactacaagaaggagggcacctactccattggcaccgtgggcacccaggatgttgactgtgacttcatcgacttcacttatgtgcgtgtctcttctgaggaactggatcgtgccctgcgcaaggttgttggggagttcaaggatgcactgcgcaactctggtggcgatgggctggggcagatgtccttggagttctaccagaagaagaagtctcgctggccattctcagacgagtgcatcccatgggaagtgtggacggtcaaggtgcatgtggtagccctggccacggagcaggagcggcagatctgccgggagaaggtgggtgagaaactctgcgagaagatcatcaacatcgtggaggtgatgaatcggcatgagtacttgcccaagatgcccacacagtcggaggtggataacgtgtttgacacaggcttgcgggacgtgcagccctacctgtacaagatctccttccagatcactgatgccctgggcacctcagtcaccaccaccatgcgcaggctcatcaaagacacccttgccctctgagcgtcgctggatctctgggagctccttgatggctcccagaccttggcttttgggaattgcacttttgggcctttgggctctggaacctgctctgggtcattggtgagacttggaaggggcagcccccgctggcttcttggttttgtggttgccagcctcaggtcatccttttaatctttgctgacggttcagtcctgcctctactgtctctccatagccctggtggggtcccccttctttctccactgtacagaagagccaccactgggatggggaataaagttgagaacatgagtttgggctga

SEQ ID NO: 417991 - DNA, 229 bp, Homo sapiens
cttggatgatgactagagctaagagagcataattccctggggtgtgggaagcaggccctcacaggtgggaactcagaggccttggcttgctcattcgttcccttcttcccaggatgcactgcgcaactctggtggcgatgggctggggcagatgtccttggagttctaccagaagaagaagtctcgctggccattctcagacgagtgcatcccatgggaagtgtggacg

SEQ ID NO: 417992 - DNA, 1697 bp, Homo sapiens
aggagaatcacttgaacccgggaggcagaggttgcagtgagccgagattgcgccactgtactccagcctggtgacagagcaagactccgtcaaaatagtaataataataataataataataataataataagaagaagaagaagaagaagaagaagaagaagaagaaacaggactctagtggctaggaatgaaattctgggataagcttgtgttaaagtagaccatgtgcgtttccaaacagtgagaacaggtcactagcaaacaatggcattttgtttgagaaatggagagcgagcaagactggagcattaccatcatgatggcctgtcaggcttttcagagaagaaatgaactgattaaccacaagtgcattattccaacaagccaaaagtcttccatcccatgggccagggtaattttcccaggttagatccagggtttgggtgaaatttaactttaagatgtgggtgccaaaagagagaattggcttgtggggcctttcaccagagacccatgccagtgactgaatgacctggattaggtatgcatacttgcaagcctcttatttgggaattacactaatggttacctgttttgtgtgaccaaaaatgttgagaactgaagacatcaaattataactgcagtataggggcccagaagaagggaccctcacaatctatctacacactctatttccaaaggataagattgcaagagccaggaggaccaactccagcttctgggatggaaggttcagcaactctactacggggggtcctgtttagtcacagagtgggctaggaaaatttgtcccagccccttaattttccagggtaagggttgattttctgtgagaagtatttaatgctattctttgctaaagagccgggtaaactctgaaaaattaaatccaaagctggttatttaaaaataactatgttcttaacactcttgcagacaaacctaaatatcagatagaaagtccttgtatcatttctatttgaaaattgaagattttattgcctcttttcttatgtactgcaccatcttacatcagaggaccagggcttgttttgacagggattattataattgcagcataatttgtattagacccatgtaacaagcctgtctacttcatggaaattgcagtgggttgcccagtcattccagttaatcagacactcatcgtgtgggaagcccggcattgagtttggtgctttgatgcacgtctgagacagtgtgatgtggttaagcataggaattgtgagcctctgagtggataaccttacctatctctcatttacaggtatgtgaaacaagaagttctgggtcctttcatcataagggagaagcttcagaaagttccgaggacctgctaaaatcagctactagaatctgctgccagaggggacaaagacgtgcactcaaccttctaccaggccactctcaggctcaccttaaaatcagcccttgatcccatttctgggcaatttagacagtgaaactgactttgtttacctgcttgcagcatattagaacagacgatccatgctaatattgtattttctcttaaaacatagctttcctgtaatttaaagtgcttttatgaaaatatttgtaattaattatatatagttggaaatagcagtaagctttcccattataatatatttttgtatacaaataaaatttg

SEQ ID NO: 417993 - DNA, 996 bp, Homo sapiens
ggagggcggcggggacagacccgtcgccccggctccgcagccccgccccggccccgcctccgctccggccgccgaaggctataagatctaggaacccgagccggtggtagggcgggcgcggaccgtgctgggagcggcgcggctggagcgcagcgccgaagggactggcagggctgaagtgtgcgggacagcaagcccccgaatagccccggctgccacctcgcaggacccaaggccacgcgcgccgggcccagctgagccgcctcatgaagccgccggaggacctgtcggacgcgctgtgcgagtttgacgcggtgctggccgacttcgcgtcgcccttccacgagcgccacttccactacgaggagcacctggagcgcatgaagcggcgcagcagcgccagtgtcagcgacagcagcggcttcagcgactcggagagtgcagattcactttataggaacagcttcagcttcagtgatgaaaaactgaattctccaacagactctaccccagctcttctctctgccactgtcactcctcagaaagctaaattaggagacacaaaagagctagaagccttcattgctgatcttgacaaaactttagcaagtatgtgaaacaagaagttctgggtcctttcatcataagggagaagcttcagaaagttccgaggacctgctaaaatcagctactagaatctgctgccagaggggacaaagacgtgcactcaaccttctaccaggccactctcaggctcaccttaaaatcagcccttgatcccatttctgggcaatttagacagtgaaactgactttgtttacctgcttgcagcatattagaacagacgatccatgctaatattgtattttctcttaaaacatagctttcctgtaatttaaagtgcttttatgaaaatatttgtaattaattatatatagttggaaatagcagtaagctttcccattataatatatttttgtatacaaataaaatttg

SEQ ID NO: 417994 - DNA, 890 bp, Homo sapiens
gaaaatttggagactagactgttctctctcatgtgatgtaatcaagactgtgcaaatgacagtgtttcttaggagtctcctcccagacttgttggttctagaatttaaaactcagcagtttgcctttgcagatagtgggattctttttattgcattaattatttaaccaatgctttcagatgaccaatttagcaattaaatggggttgtcattattagataagctatgatctaacatgatttaaaatagcagctccagcctgtctctactgtggtattaatagacctaaaatgtctttaaagatgcatgagcagtttcttattttttggaactggtaaaatgtctccagctagagagttgaatgttctgttacattggacaagtgcctttttgaaaacaaaaggagctttttttcttaagaaaagttatacttgctgaaaatagttgcagaatgcaataaaaatggaacatagttaaaaagaaatgacaattccatcactcttttcactttggcaataagacaggacttcactcttttttcagaagaggcatttgaaagttcccttctcaacatagcaacgttagcacccactgggaattctgccactatccagccctcagtctgtaatgaatcagttgaattcagagacagagcagtctaaaaagtggcttaaaacgtgctcagatttgttacctgatcctcaagaggtaggaattaaagagggaaaaaaagcccctagtggcaaattgacttaaaaggctaagaacaattagccatttgtagccagcaggtgttaattaataaaactgtccagtactgcatttcagggaaggcatgaatgatgtgatgaactctaaagtcagctagctgaatatctcaagggatgtca

SEQ ID NO: 417995 - DNA, 1059 bp, Homo sapiens
ggagggcggcggggacagacccgtcgccccggctccgcagccccgccccggccccgcctccgctccggccgccgaaggctataagatctaggaacccgagccggtggtagggcgggcgcggaccgtgctgggagcggcgcggctggagcgcagcgccgaagggactggcagggctgaagtgtgcgggacagcaagcccccgaatagccccggctgccacctcgcaggacccaaggccacgcgcgccgggcccagctgagccgcctcatgaagccgcccgcggcgcagggcagccccgcggccgccgcggccgcagccccggccctggactcggcggccgcggaggacctgtcggacgcgctgtgcgagtttgacgcggtgctggccgacttcgcgtcgcccttccacgagcgccacttccactacgaggagcacctggagcgcatgaagcggcgcagcagcgccagtgtcagcgacagcagcggcttcagcgactcggagagtgcagattcactttataggaacagcttcagcttcagtgatgaaaaactgaattctccaacagactctaccccagctcttctctctgccactgtcactcctcagaaagctaaattaggagacacaaaagagctagaagccttcattgctgatcttgacaaaactttagcaagtatgtgaaacaagaagttctgggtcctttcatcataagggagaagcttcagaaagttccgaggacctgctaaaatcagctactagaatctgctgccagaggggacaaagacgtgcactcaaccttctaccaggccactctcaggctcaccttaaaatcagcccttgatcccatttctgggcaatttagacagtgaaactgactttgtttacctgcttgcagcatattagaacagacgatccatgctaatattgtattttctcttaaaacatagctttcctgtaatttaaagtgcttttatgaaaatatttgtaattaattatatatagttggaaatagcagtaagctttcccattataatatatttttgtatacaaataaaatttg

SEQ ID NO: 417996 - DNA, 1044 bp, Homo sapiens
agcgggggggggacaggtaaccggcagcgcctggggaggaatctggccgcgccaagtcgctgggtgaccctgggcctggcgaaggctcagttttcttgtctgtaaaacggacttggtaatagaacgcacttcgggggtggtggagaagattacaaggtaacagcgactgcgtggctgtcacttggcagaggcgccaagtgtcagttatcttcgggaaccgtggcggcccctcctggccctgggaggtggtcccgctgcccccctgacttccgtgcactgagcccctggccctgcccgcagccccggccctggactcggcggccgcggaggacctgtcggacgcgctgtgcgagtttgacgcggtgctggccgacttcgcgtcgcccttccacgagcgccacttccactacgaggagcacctggagcgcatgaagcggcgcagcagcgccagtgtcagcgacagcagcggcttcagcgactcggagagtgcagattcactttataggaacagcttcagcttcagtgatgaaaaactgaattctccaacagactctaccccagctcttctctctgccactgtcactcctcagaaagctaaattaggagacacaaaagagctagaagccttcattgctgatcttgacaaaactttagcaagtatgtgaaacaagaagttctgggtcctttcatcataagggagaagcttcagaaagttccgaggacctgctaaaatcagctactagaatctgctgccagaggggacaaagacgtgcactcaaccttctaccaggccactctcaggctcaccttaaaatcagcccttgatcccatttctgggcaatttagacagtgaaactgactttgtttacctgcttgcagcatattagaacagacgatccatgctaatattgtattttctcttaaaacatagctttcctgtaatttaaagtgcttttatgaaaatatttgtaattaattatatatagttggaaatagcagtaagctttcccattataatatatttttgtatacaaataaaatttg

SEQ ID NO: 417997 - DNA, 945 bp, Homo sapiens
ggagggcggcggggacagacccgtcgccccggctccgcagccccgccccggccccgcctccgctccggccgccgaaggctataagatctaggaacccgagccggtggtagggcgggcgcggaccgtgctgggagcggcgcggctggagcgcagcgccgaagggactggcagggctgaagtgtgcgggacagcaagcccccgaatagccccggctgccacctcgcagggaggacctgtcggacgcgctgtgcgagtttgacgcggtgctggccgacttcgcgtcgcccttccacgagcgccacttccactacgaggagcacctggagcgcatgaagcggcgcagcagcgccagtgtcagcgacagcagcggcttcagcgactcggagagtgcagattcactttataggaacagcttcagcttcagtgatgaaaaactgaattctccaacagactctaccccagctcttctctctgccactgtcactcctcagaaagctaaattaggagacacaaaagagctagaagccttcattgctgatcttgacaaaactttagcaagtatgtgaaacaagaagttctgggtcctttcatcataagggagaagcttcagaaagttccgaggacctgctaaaatcagctactagaatctgctgccagaggggacaaagacgtgcactcaaccttctaccaggccactctcaggctcaccttaaaatcagcccttgatcccatttctgggcaatttagacagtgaaactgactttgtttacctgcttgcagcatattagaacagacgatccatgctaatattgtattttctcttaaaacatagctttcctgtaatttaaagtgcttttatgaaaatatttgtaattaattatatatagttggaaatagcagtaagctttcccattataatatatttttgtatacaaataaaatttg

SEQ ID NO: 417998 - DNA, 2057 bp, Homo sapiens
gaaaatttggagactagactgttctctctcatgtgatgtaatcaagactgtgcaaatgacagtgtttcttaggagtctcctcccagacttgttggttctagaatttaaaactcagcagtttgcctttgcagatagtgggattctttttattgcattaattatttaaccaatgctttcagatgaccaatttagcaattaaatggggttgtcattattagataagctatgatctaacatgatttaaaatagcagctccagcctgtctctactgtggtattaatagacctaaaatgtctttaaagatgcatgagcagtttcttattttttggaactggtaaaatgtctccagctagagagttgaatgttctgttacattggacaagtgcctttttgaaaacaaaaggagctttttttcttaagaaaagttatacttgctgaaaatagttgcagaatgcaataaaaatggaacatagttaaaaagaaatgacaattccatcactcttttcactttggcaataagacaggacttcactcttttttcagaagaggcatttgaaagttcccttctcaacatagcaacgttagcacccactgggaattctgccactatccagccctcagtctgtaatgaatcagttgaattcagagacagagcagtctaaaaagtggcttaaaacgtgctcagatttgttacctgatcctcaagaggtaggaattaaagagggaaaaaaagcccctagtggcaaattgacttaaaaggctaagaacaattagccatttgtagccagcaggtgttaattaataaaactgtccagtactgcatttcagggaaggcatgaatgatgtgatgaactctacaaaaataaagtcagctatatgaaaaaaatctctacatctcaggctctagagagaaccaaatcagaatgaggactcgtttccttgtgtgggcacctggaggggatgaggctgtcctgggcccagaagactcatggcaccttccctgtaccattttgataagaaacagtgaactcttcattcatttcatattggaggaactctgagggctgcagcgttgccctggggggacagcacaagcaagaatgcatcagaaggctagtgccgcaggaatgacacaatctaggtgtctgctctgcacagtgctatgcttactgaattttttgactaataactcatattctacacaatacaaaaaccagactccttttatcttcccttcctgctcctcactctcctgcaaacatttaagacagtgaaggaagattcctcttctaggtgagggagaagtggggtgggatgtttggagagggtggtgatgaactaaaaaataaagaaacacttaggctagtcttcagaatcagtttctgagtttactgtatcaaaacactggagcacacacttagggttggcccaggacactcttcaataaaagtctctgaagataaggaggtagatgtaaaatagaaataatccattctataactctggaagttccaacttcctggaaaactcaatatggagtcatcagctgtctttgttatggaaactgaactctctctctctctctctctccctctcctgtttcacagctaaattaggagacacaaaagagctagaagccttcattgctgatcttgacaaaactttagcaagtatgtgaaacaagaagttctgggtcctttcatcataagggagaagcttcagaaagttccgaggacctgctaaaatcagctactagaatctgctgccagaggggacaaagacgtgcactcaaccttctaccaggccactctcaggctcaccttaaaatcagcccttgatcccatttctgggcaatttagacagtgaaactgactttgtttacctgcttgcagcatattagaacagacgatccatgctaatattgtattttctcttaaaacatagctttcctgtaatttaaagtgcttttatgaaaatatttgtaattaattatatatagttggaaatagcagtaagctttcccattataatatatttttgtatacaaataaaatttg

SEQ ID NO: 417999 - DNA, 1092 bp, Homo sapiens
agcgggggggggacaggtaaccggcagcgcctggggaggaatctggccgcgccaagtcgctgggtgaccctgggcctggcgaaggctcagttttcttgtctgtaaaacggacttggtaatagaacgcacttcgggggtggtggagaagattacaagccccggccctggactcggcggccgcggaggacctgtcggacgcgctgtgcgagtttgacgcggtgctggccgacttcgcgtcgcccttccacgagcgccacttccactacgaggagcacctggagcgcatgaagcggcgcagcagcgccagtgtcagcgacagcagcggcttcagcgactcggagagtcctccaccaggctggagggggagccagagagcacatgggcatgaaggtggttcctggtgatctttctcacaatggagactaccccagggtctctttgtcctgaacaactttgtcaacaacagcaacaacaacaaaaacaacaaaagagacagctttttccaggaactcacatgtcctgggaggattacaggtgcagattcactttataggaacagcttcagcttcagtgatgaaaaactgaattctccaacagactctaccccagctcttctctctgccactgtcactcctcagaaagctaaattaggagacacaaaagagctagaagccttcattgctgatcttgacaaaactttagcaagtatgtgaaacaagaagttctgggtcctttcatcataagggagaagcttcagaaagttccgaggacctgctaaaatcagctactagaatctgctgccagaggggacaaagacgtgcactcaaccttctaccaggccactctcaggctcaccttaaaatcagcccttgatcccatttctgggcaatttagacagtgaaactgactttgtttacctgcttgcagcatattagaacagacgatccatgctaatattgtattttctcttaaaacatagctttcctgtaatttaaagtgcttttatgaaaatatttgtaattaattatatatagttggaaatagcagtaagctttcccattataatatatttttgtatacaaataaaatttg

SEQ ID NO: 418000 - DNA, 618 bp, Homo sapiens
gtgctaagtctataatctcatgagtactatttctaatgagtatattttccttcctgaaaggtgcagattcactttataggaacagcttcagcttcagtgatgaaaaactgaattctccaacagactctaccccagctcttctctctgccactgtcactcctcagaaagctaaattaggagacacaaaagagctagaagccttcattgctgatcttgacaaaactttagcaagtatgtgaaacaagaagttctgggtcctttcatcataagggagaagcttcagaaagttccgaggacctgctaaaatcagctactagaatctgctgccagaggggacaaagacgtgcactcaaccttctaccaggccactctcaggctcaccttaaaatcagcccttgatcccatttctgggcaatttagacagtgaaactgactttgtttacctgcttgcagcatattagaacagacgatccatgctaatattgtattttctcttaaaacatagctttcctgtaatttaaagtgcttttatgaaaatatttgtaattaattatatatagttggaaatagcagtaagctttcccattataatatatttttgtatacaaataaaatttg

SEQ ID NO: 418001 - DNA, 624 bp, Homo sapiens
gaggtgtggtccctgcgatctgggccagccagcctctgggcccagggatgggggcgaagctctcaggtgcagattcactttataggaacagcttcagcttcagtgatgaaaaactgaattctccaacagactctaccccagctcttctctctgccactgtcactcctcagaaagctaaattaggagacacaaaagagctagaagccttcattgctgatcttgacaaaactttagcaagtatgtgaaacaagaagttctgggtcctttcatcataagggagaagcttcagaaagttccgaggacctgctaaaatcagctactagaatctgctgccagaggggacaaagacgtgcactcaaccttctaccaggccactctcaggctcaccttaaaatcagcccttgatcccatttctgggcaatttagacagtgaaactgactttgtttacctgcttgcagcatattagaacagacgatccatgctaatattgtattttctcttaaaacatagctttcctgtaatttaaagtgcttttatgaaaatatttgtaattaattatatatagttggaaatagcagtaagctttcccattataatatatttttgtatacaaataaaatttg

SEQ ID NO: 418002 - DNA, 1696 bp, Homo sapiens
gaaaatttggagactagactgttctctctcatgtgatgtaatcaagactgtgcaaatgacagtgtttcttaggagtctcctcccagacttgttggttctagaatttaaaactcagcagtttgcctttgcagatagtgggattctttttattgcattaattatttaaccaatgctttcagatgaccaatttagcaattaaatggggttgtcattattagataagctatgatctaacatgatttaaaatagcagctccagcctgtctctactgtggtattaatagacctaaaatgtctttaaagatgcatgagcagtttcttattttttggaactggtaaaatgtctccagctagagagttgaatgttctgttacattggacaagtgcctttttgaaaacaaaaggagctttttttcttaagaaaagttatacttgctgaaaatagttgcagaatgcaataaaaatggaacatagttaaaaagaaatgacaattccatcactcttttcactttggcaataagacaggacttcactcttttttcagaagaggcatttgaaagttcccttctcaacatagcaacgttagcacccactgggaattctgccactatccagccctcagtctgtaatgaatcagttgaattcagagacagagcagtctaaaaagtggcttaaaacgtgctcagatttgttacctgatcctcaagaggtaggaattaaagagggaaaaaaagcccctagtggcaaattgacttaaaaggctaagaacaattagccatttgtagccagcaggtgttaattaataaaactgtccagtactgcatttcagggaaggcatgaatgatgtgatgaactctacaaaaataaagtcagctatatgaaaaaaatctctacatctcaggctctagagagaaccaaatcagaatgaggactcgtttccttgtgtgggcacctggaggggatgaggctgtcctgggcccagaagactcatggcaccttccctgtaccattttgataagaaacagtgaactcttcattcatttcatattggaggaactctgagggctgcagcgttgccctggggggacagcacaagcaagaatgcatcagaaggctagtgccgcaggaatgacacaatctaggtgtctgctctgcacagtgctatgcttactgaattttttgactaataactcatattctacacaatacaaaaaccagactccttttatcttcccttcctgctcctcactctcctgcaaacatttaagacagtgaaggaagattcctcttctaggtgagggagaagtggggtgggatgtttggagagggtggtgatgaactaaaaaataaagaaacacttaggctagtcttcagaatcagtttctgagtttactgtatcaaaacactggagcacacacttagggttggcccaggacactcttcaataaaagtctctgaagataaggaggtagatgtaaaatagaaataatccattctataactctggaagttccaacttcctggaaaactcaatatggagtcatcagctgtctttgttatggaaactgaactctctctctctctctctctccctctcctgtttcacagctaaattaggagacacaaaagagctagaagccttcattgctgatcttgacaaaactttagcaagtaagtacatgtctgatattaaaaac

SEQ ID NO: 418003 - DNA, 732 bp, Homo sapiens
ggagggcggcggggacagacccgtcgccccggctccgcagccccgccccggccccgcctccgctccggccgccgaaggctataagatctaggaacccgagccggtggtagggcgggcgcggaccgtgctgggagcggcgcggctggagcgcagcgccgaagggactggcagggctgaagtgtgcgggacagcaagcccccgaatagccccggctgccacctcgcaggacccaaggccacgcgcgccgggcccagctgagccgcctcatgaagccgcccgcggcgcagggcagccccgcggccgccgcggccgcagccccggccctggactcggcggccgcggaggacctgtcggacgcgctgtgcgagtttgacgcggtgctggccgacttcgcgtcgcccttccacgagcgccacttccactacgaggagcacctggagcgcatgaagcggcgcagcagcgccagtgtcagcgacagcagcggcttcagcgactcggagagtgcagattcactttataggaacagcttcagcttcagtgatgaaaaactgaattctccaacagactctaccccagctcttctctctgccactgtcactcctcagaaagctaaattaggagacacaaaagagctagaagccttcattgctgatcttgacaaaactttagcaattggaaacaagagtctgggccttctataagggggaggaaagctcaaagttccgagactgc

SEQ ID NO: 418004 - DNA, 1100 bp, Homo sapiens
ggagggcggcggggacagacccgtcgccccggctccgcagccccgccccggccccgcctccgctccggccgccgaaggctataagatctaggaacccgagccggtggtagggcgggcgcggaccgtgctgggagcggcgcggctggagcgcagcgccgaagggactggcagggctgaagtgtgcgggacagcaagcccccgaatagccccggctgccacctcgcaggacccaaggccacgcgcgccgggcccagctgagccgcctcatgaagccgcccgcggcgcagggcagccccgcggccgccgcggccgcagccccggccctggactcggcggccgcggaggacctgtcggacgcgctgtgcgagtttgacgcggtgctggccgacttcgcgtcgcccttccacgagcgccacttccactacgaggagcacctggagcgcatgaagcggcgcagcagcgccagtgtcagcgacagcagcggcttcagcgactcggagagtcctccaccaggctggagggggagccagagagcacatgggcatgaaggtggttcctggtgatctttctcacaatggagactaccccagggtctctttgtcctgaacaactttgtcaacaacagcaacaacaacaaaaacaacaaaagagacagctttttccaggaactcacatgtcctgggaggattacaggtacctcaaacagcaaattaggtgcctttttaatattacatgattgttggtttcaaatccagaattgcttattgtttttcaaagggcaaagtcaattttaaactcttctgtgttattcttcagcctttaatccttagatgggttacaggcatgaatgtcactccttttgctgcccttgactcaggacgtgaaagtaatggcctttccgtgtgattctcttattttgaaacctggagctcttccttgttcctgggctaagattcggggctagacatgaacatgagctgcccttctgcaaagggataaatgcgctcaccaccctggtcagggtttgactcaggaagctgagttccagcttgtttccttggcagcactgccaaagagttagaccaagctgcagcttttga

SEQ ID NO: 418005 - DNA, 885 bp, Homo sapiens
ggagggcggcggggacagacccgtcgccccggctccgcagccccgccccggccccgcctccgctccggccgccgaaggctataagatctaggaacccgagccggtggtagggcgggcgcggaccgtgctgggagcggcgcggctggagcgcagcgccgaagggactggcagggctgaagtgtgcgggacagcaagcccccgaatagccccggctgccacctcgcaggacccaaggccacgcgcgccgggcccagctgagccgcctcatgaagccgcccgcggcgcagggcagccccgcggccgccgcggccgcagccccggccctggactcggcggccgcggaggacctgtcggacgcgctgtgcgagtttgacgcggtgctggccgacttcgcgtcgcccttccacgagcgccacttccactacgaggagcacctggagcgcatgaagcggcgcagcagcgccagtgtcagcgacagcagcggcttcagcgactcggagagtaagtgcggcccccgctaggatggcgccgggatctcccagctcccaggacctgccccgcgaaggctgcggcctcagttttcttatcagtaaactgaggaatggtttcctgaagctcaacgcagtaggccgagtggtggcggggcccctgacgataatcacgggaaaggtcgctggagggcaggttggttcacttgccgcccacgggtgtgtcaccaggcaggcgagtttaagcagcttgtcccgactcagccagacaggactccctggacctgcaccaggcctttccgcagtttccctcctcttctcctttccgtgcctctcccctctcagctgtaactttgcagatgtggaacaagtgccagtggaatgagggggcacagtg

SEQ ID NO: 418006 - DNA, 2718 bp, Homo sapiens
  misc_feature (1)..(1): n is a, c, g, or t
  misc_feature (4)..(4): n is a, c, g, or t
  misc_feature (7)..(8): n is a, c, g, or t
ncgngtnngggggaaatctccttcagtggaagctgctgagtgtcgttggcggaaagtatcctggagcccagcaaaagcctccaaagcactagagcttccctaaagaaaagcagaataaaagaaagacaagaagggaagcccgttcctctaaagcccgggtttccaatagtcccggatcctcctggagttgggcgaaggcgcagttggcagcagccgctgctggcacccggacttggaaaggcggtgttcccccttttcgggaggagggaggcagggacttgcaggcaagagttgcacctggtctaggaacctgcagagaaaagaactctggggagaagaactgccccggagcgcagcagccaccctccgaccatgccccggtgaggggggcggacttcgagggcaacttgccgcggactgcctgggcttagccagcgagctacgcgctcccgggagcccggaattgcacggcgcagcccggcggggggctatcgtctatgtcttcttggggcgccagacgaatcggggtctcgtttttgctggaagagcccagtgttggtggcttcaggtggctgctgccgccgccgccgccgccgccgctgctagtgcggtttccgccgctggtgcgaagagaagagacacgcgagcggggagacctccaaggcagcgaggcatcggacatgtgtcagcacatctggggcgcacatccgtcgagcccgaggggagatttgccggaacaattcaaactgcgatattgatcttgggggtgactgtccctggccggctgtcgggtgggagtgcgagtgtgcactcgctcggaagtgtgtgcgagtgtgtatgtgtgtgtgccgtgtcgggctccccccttccccccgttttcccgtcgagtgatgcacttggaatgagaatcagaggatggaaatagtctgggaggtgctttttcttcttcaagccaatttcatcgtctgcatatcagctcaacagaattcaccaaaaatccatgaaggctggtgggcatacaaggaggtggtccagggaagctttgttccagttccttctttctggggattggtgaactcagcttggaatctttgctctgtggggaaacggcagtcgccagtcaacatagagaccagtcacatgatcttcgacccctttctgacacctcttcgcatcaacacggggggcaggaaggtcagtgggaccatgtacaacactggaagacacgtatcccttcgcctggacaaggagcacttggtcaacatatctggagggcccatgacatacagccaccggctggaggagatccgactacactttgggagtgaggacagccaagggtcggagcacctcctcaatggacaggccttctctggggaggtgcagctcatccactataaccatgagctatatacgaatgtcacagaagctgcaaagagtccaaatggattggtggtagtttctatatttataaaagtttctgattcatcaaacccatttcttaatcgaatgctcaacagagatactatcacaagaataacatataaaaatgatgcatatttactacaggggcttaatatagaggaactatatccagagacctctagtttcatcacttacgatgggtcgatgactatcccaccctgctatgagacagcaagttggatcataatgaacaaacctgtctatataaccaggatgcagatgcattccttgcgcctgctcagccagaaccagccatctcagatctttctgagcatgagtgacaacttcaggcctgtccagccactcaacaaccgctgcatccgcaccaatatcaacttcagtttacaggggaaggactgtccaaacaaccgagcccagaagcttcagtatagagtaaatgaatggctcctcaagtagggaacaaagccaagaagaatcccacctcagtgaaatgctacaactgtgaattgacgtaacctagaatgtcccccttcttgcttctctctccttctttcccccaagcctcattcattcttgggattggccctttcttcatgaaaagtgtctgcaaaaccatggcagaggaatacatctctcacacatactcacaaacacacacacaagcacttgcacatacatacaaacacatgcaaacatacctacacacacacacactcttacaacctccatcatgggaagtcaagtttcagaaacaaaagtctcattcataagaggtcttagaagaaaataaccagttaacctgatttcaattttgataccgttttcctgaactaataaatctacccaatgagacttttcagcctttgtacatacaaaattcttccaaaagagagaggagaaaatacagctctgatggcatcaaacggactttgcatcaagtaatttcagatagtgtcctaggatcctttgagggtgctggtagcaggtgagcaggacaaagttgaccaaggacacttatttctagattatgattcttctgtttactcaacaatttacaaagaaaaaaaggacagacattgaagagctacacattgtatatatatcaccacagactataaggaaatggaattatttccctctttgtcacatatctgtagtaggatttgccaagatcagaaatgatccatttgctgtttcttgttttccaaaggtcatacattgtgtttggttattgttaccagctcaataaatgtgtttaacgagttaatttca

SEQ ID NO: 418007 - DNA, 2932 bp, Homo sapiens
aatcgggacaagcgcgccgagaaatcctggatcttcccagggattccctctacgctccctcctcttcttcaataaccccaaagaggagaagaactgccccggagcgcagcagccaccctccgaccatgccccggtgaggggggcggacttcgagggcaacttgccgcggactgcctgggcttagccagcgagctacgcgctcccgggagcccggaattgcacggcgcagcccggcggggggctatcgtctatgtcttcttggggcgccagacgaatcggggtctcgtttttgctggaagagcccagtgttggtggcttcaggtggctgctgccgccgccgccgccgccgccgctgctagtgcggtttccgccgctggtgcgaagagaagagacacgcgagcggggagacctccaaggcagcgaggcatcggacatgtgtcagcacatctggggcgcacatccgtcgagcccgaggggagatttgccggaacaattcaaactgcgatattgatcttgggggtgactgtccctggccggctgtcgggtgggagtgcgagtgtgcactcgctcggaagtgtgtgcgagtgtgtatgtgtgtgtgccgtgtcgggctccccccttccccccgttttcccgtcgagtgatgcacttggaatgagaatcagaggatggaaatagtctgggaggtgctttttcttcttcaagccaatttcatcgtctgcatatcagctcaacagaattcaccaaaaatccatgaaggctggtgggcatacaaggaggtggtccagggaagctttgttccagttccttctttctggggattggtgaactcagcttggaatctttgctctgtggggaaacggcagtcgccagtcaacatagagaccagtcacatgatcttcgacccctttctgacacctcttcgcatcaacacggggggcaggaaggtcagtgggaccatgtacaacactggaagacacgtatcccttcgcctggacaaggagcacttggtcaacatatctggagggcccatgacatacagccaccggctggaggagatccgactacactttgggagtgaggacagccaagggtcggagcacctcctcaatggacaggccttctctggggaggtgcagctcatccactataaccatgagctatatacgaatgtcacagaagctgcaaagagtccaaatggattggtggtagtttctatatttataaaagtttctgattcatcaaacccatttcttaatcgaatgctcaacagagatactatcacaagaataacatataaaaatgatgcatatttactacaggggcttaatatagaggaactatatccagagacctctagtttcatcacttacgatgggtcgatgactatcccaccctgctatgagacagcaagttggatcataatgaacaaacctgtctatataaccaggatgcagatgcattccttgcgcctgctcagccagaaccagccatctcagatctttctgagcatgagtgacaacttcaggcctgtccagccactcaacaaccgctgcatccgcaccaatatcaacttcagtttacaggggaaggactgtccaaacaaccgagcccagaagcttcagtatagagtaaatgaatggctcctcaagtagggaacaaagccaagaagaatcccacctcagtgaaatgctacaactgtgaattgacgtaacctagaatgtcccccttcttgcttctctctccttctttcccccaagcctcattcattcttgggattggccctttcttcatgaaaagtgtctgcaaaaccatggcagaggaatacatctctcacacatactcacaaacacacacacaagcacttgcacatacatacaaacacatgcaaacatacctacacacacacacactcttacaacctccatcatgggaagtcaagtttcagaaacaaaagtctcattcataagaggtcttagaagaaaataaccagttaacctgatttcaattttgataccgttttcctgaactaataaatctacccaatgagacttttcagcctttgtacatacaaaattcttccaaaagagagaggagaaaatacagctctgatggcatcaaacggactttgcatcaagtaatttcagatagtgtcctaggatcctttgagggtgctggtagcaggtgagcaggacaaagttgaccaaggacacttatttctagattatgattcttctgtttactcaacaatttacaaagaaaaaaaggacagacattgaagagctacacattgtatatatatcaccacagactataaggaaatggaattatttccctctttgtcacatatctgtagtaggatttgccaagatcagaaatgatccatttgctgtttcttgttttccaaaggtcatacattgtgtttggttattgttaccagctcaataaatgtgtttaacgagttaatttcatttttctggctttggtctgttctccttccttacaggctaagccctggctccatgcaactgcattctttgatttcacttgttccttcatctacatgttttgttcatttgcagccagtttttactgagtttgtggcaatcaggaatgcatttgctaagcaagtatgactttaattccactccatggctcaatcattcacatgaggtgagcttcagcctgagatagcaggcgacagacttcttgcgtttcaaaactgccatgcccccctgtgatgctcccgtgaaggaatgcactttgccttgtaagttcctgggaaaggggtatgttttctctccaggtgcagccagatctcacaaagtacaaaacgaatgcctttcttttcttgtttataatggtcactcactgtgtttggttactgtcaagaaatcaataaatgtgtttaacaagttacccagtacccatg

SEQ ID NO: 418008 - DNA, 3212 bp, Homo sapiens
aaataacgacccctgcagttgtattgcggaaaatctcgacagcggcgctagttgcgggcgatggaagccaggcaactgggggttctggggagttcaggaaaatagcagaggagcaggaagggcgcgcgcgacctggagagtctgtgtgcccccaccgcgccccagtccccggggcccagcccttcccctcggcgccctggacgcactgccggaacccggctgagaggctgcaggctgcgcgcggacctggggagcagggagggtcggcggaggctgccggcggctggcggtttcgggcaataatccctgcctctctttctctgtgtgtctgctgtgtctgctccttccccgccccccggaagcaggagaagaactgccccggagcgcagcagccaccctccgaccatgccccggtgaggggggcggacttcgagggcaacttgccgcggactgcctgggcttagccagcgagctacgcgctcccgggagcccggaattgcacggcgcagcccggcggggggctatcgtctatgtcttcttggggcgccagacgaatcggggtctcgtttttgctggaagagcccagtgttggtggcttcaggtggctgctgccgccgccgccgccgccgccgctgctagtgcggtttccgccgctggtgcgaagagaagagacacgcgagcggggagacctccaaggcagcgaggcatcggacatgtgtcagcacatctggggcgcacatccgtcgagcccgaggggagatttgccggaacaattcaaactgcgatattgatcttgggggtgactgtccctggccggctgtcgggtgggagtgcgagtgtgcactcgctcggaagtgtgtgcgagtgtgtatgtgtgtgtgccgtgtcgggctccccccttccccccgttttcccgtcgagtgatgcacttggaatgagaatcagaggatggaaatagtctgggaggtgctttttcttcttcaagccaatttcatcgtctgcatatcagctcaacagaattcaccaaaaatccatgaaggctggtgggcatacaaggaggtggtccagggaagctttgttccagttccttctttctggggattggtgaactcagcttggaatctttgctctgtggggaaacggcagtcgccagtcaacatagagaccagtcacatgatcttcgacccctttctgacacctcttcgcatcaacacggggggcaggaaggtcagtgggaccatgtacaacactggaagacacgtatcccttcgcctggacaaggagcacttggtcaacatatctggagggcccatgacatacagccaccggctggaggagatccgactacactttgggagtgaggacagccaagggtcggagcacctcctcaatggacaggccttctctggggaggtgcagctcatccactataaccatgagctatatacgaatgtcacagaagctgcaaagagtccaaatggattggtggtagtttctatatttataaaagtttctgattcatcaaacccatttcttaatcgaatgctcaacagagatactatcacaagaataacatataaaaatgatgcatatttactacaggggcttaatatagaggaactatatccagagacctctagtttcatcacttacgatgggtcgatgactatcccaccctgctatgagacagcaagttggatcataatgaacaaacctgtctatataaccaggatgcagatgcattccttgcgcctgctcagccagaaccagccatctcagatctttctgagcatgagtgacaacttcaggcctgtccagccactcaacaaccgctgcatccgcaccaatatcaacttcagtttacaggggaaggactgtccaaacaaccgagcccagaagcttcagtatagagtaaatgaatggctcctcaagtagggaacaaagccaagaagaatcccacctcagtgaaatgctacaactgtgaattgacgtaacctagaatgtcccccttcttgcttctctctccttctttcccccaagcctcattcattcttgggattggccctttcttcatgaaaagtgtctgcaaaaccatggcagaggaatacatctctcacacatactcacaaacacacacacaagcacttgcacatacatacaaacacatgcaaacatacctacacacacacacactcttacaacctccatcatgggaagtcaagtttcagaaacaaaagtctcattcataagaggtcttagaagaaaataaccagttaacctgatttcaattttgataccgttttcctgaactaataaatctacccaatgagacttttcagcctttgtacatacaaaattcttccaaaagagagaggagaaaatacagctctgatggcatcaaacggactttgcatcaagtaatttcagatagtgtcctaggatcctttgagggtgctggtagcaggtgagcaggacaaagttgaccaaggacacttatttctagattatgattcttctgtttactcaacaatttacaaagaaaaaaaggacagacattgaagagctacacattgtatatatatcaccacagactataaggaaatggaattatttccctctttgtcacatatctgtagtaggatttgccaagatcagaaatgatccatttgctgtttcttgttttccaaaggtcatacattgtgtttggttattgttaccagctcaataaatgtgtttaacgagttaatttcatttttctggctttggtctgttctccttccttacaggctaagccctggctccatgcaactgcattctttgatttcacttgttccttcatctacatgttttgttcatttgcagccagtttttactgagtttgtggcaatcaggaatgcatttgctaagcaagtatgactttaattccactccatggctcaatcattcacatgaggtgagcttcagcctgagatagcaggcgacagacttcttgcgtttcaaaactgccatgcccccctgtgatgctcccgtgaaggaatgcactttgccttgtaagttcctgggaaaggggtatgttttctctccaggtgcagccagatctcacaaagtacaaaacgaatgcctttcttttcttgtttataatggtcactcactgtgtttggttactgtcaagaaatcaataaatgtgtttaacaagttacccagtacccatg

SEQ ID NO: 418009 - DNA, 2108 bp, Homo sapiens
agcggacagtcaggaaaatgaagctgaacatcaagtcccagcaagaaaagaaggaaaaggaatgccaagcagtcatgttagcagtttgaaggggctggagcaagatggaatcaggaataaggagtcagtgggaccatgtacaacactggaagacacgtatcccttcgcctggacaaggagcacttggtcaacatatctggagggcccatgacatacagccaccggctggaggagatccgactacactttgggagtgaggacagccaagggtcggagcacctcctcaatggacaggccttctctggggaggtgcagctcatccactataaccatgagctatatacgaatgtcacagaagctgcaaagagtccaaatggattggtggtagtttctatatttataaaagtttctgattcatcaaacccatttcttaatcgaatgctcaacagagatactatcacaagaataacatataaaaatgatgcatatttactacaggggcttaatatagaggaactatatccagagacctctagtttcatcacttacgatgggtcgatgactatcccaccctgctatgagacagcaagttggatcataatgaacaaacctgtctatataaccaggatgcagatgcattccttgcgcctgctcagccagaaccagccatctcagatctttctgagcatgagtgacaacttcaggcctgtccagccactcaacaaccgctgcatccgcaccaatatcaacttcagtttacaggggaaggactgtccaaacaaccgagcccagaagcttcagtatagagtaaatgaatggctcctcaagtagggaacaaagccaagaagaatcccacctcagtgaaatgctacaactgtgaattgacgtaacctagaatgtcccccttcttgcttctctctccttctttcccccaagcctcattcattcttgggattggccctttcttcatgaaaagtgtctgcaaaaccatggcagaggaatacatctctcacacatactcacaaacacacacacaagcacttgcacatacatacaaacacatgcaaacatacctacacacacacacactcttacaacctccatcatgggaagtcaagtttcagaaacaaaagtctcattcataagaggtcttagaagaaaataaccagttaacctgatttcaattttgataccgttttcctgaactaataaatctacccaatgagacttttcagcctttgtacatacaaaattcttccaaaagagagaggagaaaatacagctctgatggcatcaaacggactttgcatcaagtaatttcagatagtgtcctaggatcctttgagggtgctggtagcaggtgagcaggacaaagttgaccaaggacacttatttctagattatgattcttctgtttactcaacaatttacaaagaaaaaaaggacagacattgaagagctacacattgtatatatatcaccacagactataaggaaatggaattatttccctctttgtcacatatctgtagtaggatttgccaagatcagaaatgatccatttgctgtttcttgttttccaaaggtcatacattgtgtttggttattgttaccagctcaataaatgtgtttaacgagttaatttcatttttctggctttggtctgttctccttccttacaggctaagccctggctccatgcaactgcattctttgatttcacttgttccttcatctacatgttttgttcatttgcagccagtttttactgagtttgtggcaatcaggaatgcatttgctaagcaagtatgactttaattccactccatggctcaatcattcacatgaggtgagcttcagcctgagatagcaggcgacagacttcttgcgtttcaaaactgccatgcccccctgtgatgctcccgtgaaggaatgcactttgccttgtaagttcctgggaaaggggtatgttttctctccaggtgcagccagatctcacaaagtacaaaacgaatgcctttcttttcttgtttataatggtcactcactgtgtttggttactgtcaagaaatcaataaatgtgtttaacaagttacccagtacccatg

SEQ ID NO: 418010 - DNA, 1666 bp, Homo sapiens
aaataacgacccctgcagttgtattgcggaaaatctcgacagcggcgctagttgcgggcgatggaagccaggcaactgggggttctggggagttcaggaaaatagcagaggagcaggaagggcgcgcgcgacctggagagtctgtgtgcccccaccgcgccccagtccccggggcccagcccttcccctcggcgccctggacgcactgccggaacccggctgagaggctgcaggctgcgcgcggacctggggagcagggagggtcggcggaggctgccggcggctggcggtttcgggcaataatccctgcctctctttctctgtgtgtctgctgtgtctgctccttccccgccccccggaagcaggagaagaactgccccggagcgcagcagccaccctccgaccatgccccggtgaggggggcggacttcgagggcaacttgccgcggactgcctgggcttagccagcgagctacgcgctcccgggagcccggaattgcacggcgcagcccggcggggggctatcgtctatgtcttcttggggcgccagacgaatcggggtctcgtttttgctggaagagcccagtgttggtggcttcaggtggctgctgccgccgccgccgccgccgccgctgctagtgcggtttccgccgctggtgcgaagagaagagacacgcgagcggggagacctccaaggcagcgaggcatcggacatgtgtcagcacatctggggcgcacatccgtcgagcccgaggggagatttgccggaacaattcaaactgcgatattgatcttgggggtgactgtccctggccggctgtcgggtgggagtgcgagtgtgcactcgctcggaagtgtgtgcgagtgtgtatgtgtgtgtgccgtgtcgggctccccccttccccccgttttcccgtcgagtgatgcacttggaatgagaatcagaggatggaaatagtctgggaggtgctttttcttcttcaagccaatttcatcgtctgcatatcagctcaacagaattcaccaaaaatccatgaaggctggtgggcatacaaggaggtggtccagggaagctttgttccagttccttctttctggggattggtgaactcagcttggaatctttgctctgtggggaaacggcagtcgccagtcaacatagagaccagtcacatgatcttcgacccctttctgacacctcttcgcatcaacacggggggcaggaaggtcagtgggaccatgtacaacactggaagacacgtatcccttcgcctggacaaggagcacttggtcaacatatctggagggcccatgacatacagccaccggctggaggagatccgactacactttgggagtgaggacagccaagggtcggagcacctcctcaatggacaggccttctctggggaggaaaaagtctgctgacccctgaattacagtatgagccattcggaatgcatttctctttaaaagttctcgcctcattcagtgtctggaacacagtgggtgctccccaataggtgacaccttcctcaagtttccttgggagaacagactcaatgtcggatccacaaaggagacctgcacatacctaacccctatttctgcagaagctgaaggctgtattatctattgcttgcataataaatattgcataacaaca

SEQ ID NO: 418011 - DNA, 1582 bp, Homo sapiens
  misc_feature (8)..(8): n is a, c, g, or t
  misc_feature (11)..(11): n is a, c, g, or t
gggatctngcnagatcccctacaaattccccacatacgtaggccaggagcctcagcggtgccccttcaggctcatctggcaagacggtaccagcttgctcagaacaggggctggctattcatcatctcagagcatagagaccctctccttgccacccggcccttcccacctggttggtgacaaatcacaaggtggtagaagttgccagggacagataacatggcagccagcgggaagaccagcaagtccgaaccgaaccatgttatcttcaagaagatctcccgggacaaatcggtgaccatctacctggggaacagagactacatagaccatgtcagccaagtccagcctgtggatggtgtcgtgttggttgatcctgatcttgtgaagggaaagaaagtgtatgtcactctgacctgcgccttccgctatggccaagaggacattgacgtgatcggcttgaccttccgcagggacctgtacttctcccgggtccaggtgtatcctcctgtgggggccgcgagcacccccacaaaactgcaagagagcctgcttaaaaagctggggagcaacacgtacccctttctcctgacgtttcctgactacttgccctgttcagtgatgttgcagccagctccacaagattcagggaagtcctgtggggttgactttgaggtcaaagcattcgccacagacagcaccgatgccgaagaggacaaaatccccaagaagagctccgtgcgattactgatccgcaaagtacagcatgccccacttgagatgggtccccagccccgagctgaggcggcctggcagttcttcatgtctgacaagcccctgcaccttgcggtctctctcaacaaagagatctatttccatggggagcccatccctgtgaccgtgactgtcaccaataacacagagaagaccgtgaagaagattaaagcattcgtggaacaggtggccaatgtggttctctactcgagtgattattacgtcaagcccgtggctatggaggaagcgcaagaaaaagtgccaccaaacagcactttgaccaagacgctgacgctgctgcccttgctggctaacaatcgagaaaggagaggcattgccctggatgggaaaatcaagcacgaggacacaaaccttgcctccagcaccatcattaaggagggcatagaccggaccgtcctgggaatcctggtgtcttaccagatcaaggtgaagctcacagtgtcaggctttctgggagagctcacctccagtgaagtcgccactgaggtcccattccgcctcatgcaccctcagcctgaggacccagctaaggaaagttatcaggatgcaaatttagtttttgaggagtttgctcgccataatctgaaagatgcaggagaagctgaggaggggaagagagacaagaatgacattgatgagtgaagatgtcggctcaggatgccggaaaatgacctgtagttaccagtgcaacgagcaaagccccacagtttagtcctttggagttatgctgcgtatgaaaggatgagtcttcttccgagaaataaagcttgtttgttctcccctgggt

SEQ ID NO: 418012 - DNA, 473 bp, Homo sapiens
  misc_feature (170)..(170): n is a, c, g, or t
tcgcctgttcccaggtagatggtcaccgatttgtcccgggagatcttcttgaagataacatggttcggttcggacttgctggtcttcccgctggctgccatgttatctgtccctggcaacttctaccaccttgtgatttgtcaccaaccaggtgggaagggccgggtggnaaggagagtttcctgactacttgccctgttcagtgatgttgcagccagctccacaagattcagggaagtcctgtggggttgactttgaggtcaaagcattcgccacagacagcaccgatgccgaagaggacaaaatccccaagaagagctccgtgcgattactgatccgcaaagtacagcatgccccacttgagatgggtccccagccccgagctgaggcggcctggcagttcttcatgtctgacaagcccctgcaccttgcggtctctctcaacaaagaggtaaccacctaccatcgctact

SEQ ID NO: 418013 - DNA, 470 bp, Homo sapiens
  misc_feature (418)..(418): n is a, c, g, or t
ctcaggaggaggctgtggtctctgactcttgagccagtttgtctcattaactccatagaacattctagaaattcagcaattcagaataggctgagttgcttgaagaaatatcctcctgttgctgccagcccaccctgagatttcacaagcactgttctgcttctcagaaaaagtgccaccaaacagcactttgaccaagacgctgacgctgctgcccttgctggctaacaatcgagaaaggagaggcattgccctggatggtgtcagcaacgagtccaggccagaaagcctcttgtcaccaaaaactgtcactataagggggtcacagtgtgactgtgtggtaagttgtctagaggggcaacgcagggacccacaatttgtggatcacacagaccgaatagcttgggtccaaagcagnacatgctctttctctacttggatcttcttcatcatcaagtcggggtatagat

SEQ ID NO: 418014 - DNA, 1631 bp, Homo sapiens
  misc_feature (8)..(8): n is a, c, g, or t
  misc_feature (11)..(11): n is a, c, g, or t
gggatctngcnagatcccctacaaattccccacatacgtaggccaggagcctcagcggtgccccttcaggctcatctggcaagacggtaccagcttgctcagaacaggggctggctattcatcatctcagagcatagagaccctctccttgccacccggcccttcccacctggttggtgacaaatcacaaggattgtcttacctttctccaaccctctaacacctgaccaacaccccaaggtggtagaagttgccagggacagataacatggcagccagcgggaagaccagcaagtccgaaccgaaccatgttatcttcaagaagatctcccgggacaaatcggtgaccatctacctggggaacagagactacatagaccatgtcagccaagtccagcctgtggatggtgtcgtgttggttgatcctgatcttgtgaagggaaagaaagtgtatgtcactctgacctgcgccttccgctatggccaagaggacattgacgtgatcggcttgaccttccgcagggacctgtacttctcccgggtccaggtgtatcctcctgtgggggccgcgagcacccccacaaaactgcaagagagcctgcttaaaaagctggggagcaacacgtacccctttctcctgacgtttcctgactacttgccctgttcagtgatgttgcagccagctccacaagattcagggaagtcctgtggggttgactttgaggtcaaagcattcgccacagacagcaccgatgccgaagaggacaaaatccccaagaagagctccgtgcgattactgatccgcaaagtacagcatgccccacttgagatgggtccccagccccgagctgaggcggcctggcagttcttcatgtctgacaagcccctgcaccttgcggtctctctcaacaaagagatctatttccatggggagcccatccctgtgaccgtgactgtcaccaataacacagagaagaccgtgaagaagattaaagcattcgtggaacaggtggccaatgtggttctctactcgagtgattattacgtcaagcccgtggctatggaggaagcgcaagaaaaagtgccaccaaacagcactttgaccaagacgctgacgctgctgcccttgctggctaacaatcgagaaaggagaggcattgccctggatgggaaaatcaagcacgaggacacaaaccttgcctccagcaccatcattaaggagggcatagaccggaccgtcctgggaatcctggtgtcttaccagatcaaggtgaagctcacagtgtcaggctttctgggagagctcacctccagtgaagtcgccactgaggtcccattccgcctcatgcaccctcagcctgaggacccagctaaggaaagttatcaggatgcaaatttagtttttgaggagtttgctcgccataatctgaaagatgcaggagaagctgaggaggggaagagagacaagaatgacattgatgagtgaagatgtcggctcaggatgccggaaaatgacctgtagttaccagtgcaacgagcaaagccccacagtttagtcctttggagttatgctgcgtatgaaaggatgagtcttcttccgagaaataaagcttgtttgttctcccctgggt

SEQ ID NO: 418015 - DNA, 1240 bp, Homo sapiens
  misc_feature (2)..(2): n is a, c, g, or t
  misc_feature (6)..(7): n is a, c, g, or t
  misc_feature (28)..(28): n is a, c, g, or t
  misc_feature (42)..(42): n is a, c, g, or t
cncgcnncaagaaacttttggtgtcggncgttgactgatctngtgatgggaaagaaagtgtatgtcactctgacctgcgccttccgctatggccaagaggacattgacgtgatcggcttgaccttccgcagggacctgtacttctcccgggtccaggtgtatcctcctgtgggggccgcgagcacccccacaaaactgcaagagagcctgcttaaaaagctggggagcaacacgtacccctttctcctgacgtttcctgactacttgccctgttcagtgatgttgcagccagctccacaagattcagggaagtcctgtggggttgactttgaggtcaaagcattcgccacagacagcaccgatgccgaagaggacaaaatccccaagaagagctccgtgcgattactgatccgcaaagtacagcatgccccacttgagatgggtccccagccccgagctgaggcggcctggcagttcttcatgtctgacaagcccctgcaccttgcggtctctctcaacaaagagatctatttccatggggagcccatccctgtgaccgtgactgtcaccaataacacagagaagaccgtgaagaagattaaagcattcgtggaacaggtggccaatgtggttctctactcgagtgattattacgtcaagcccgtggctatggaggaagcgcaagaaaaagtgccaccaaacagcactttgaccaagacgctgacgctgctgcccttgctggctaacaatcgagaaaggagaggcattgccctggatgggaaaatcaagcacgaggacacaaaccttgcctccagcaccatcattaaggagggcatagaccggaccgtcctgggaatcctggtgtcttaccagatcaaggtgaagctcacagtgtcaggctttctgggagagctcacctccagtgaagtcgccactgaggtcccattccgcctcatgcaccctcagcctgaggacccagctaaggaaagttatcaggatgcaaatttagtttttgaggagtttgctcgccataatctgaaagatgcaggagaagctgaggaggggaagagagacaagaatgacattgatgagtgaagatgtcggctcaggatgccggaaaatgacctgtagttaccagtgcaacgagcaaagccccacagtttagtcctttggagttatgctgcgtatgaaaggatgagtcttcttccgagaaataaagcttgtttgttctcccctgggt

SEQ ID NO: 418016 - DNA, 929 bp, Homo sapiens
  misc_feature (8)..(8): n is a, c, g, or t
  misc_feature (11)..(11): n is a, c, g, or t
  misc_feature (874)..(874): n is a, c, g, or t
  misc_feature (902)..(902): n is a, c, g, or t
  misc_feature (918)..(918): n is a, c, g, or t
gggatctngcnagatcccctacaaattccccacatacgtaggccaggagcctcagcggtgccccttcaggctcatctggcaagacggtaccagcttgctcagaacaggggctggctattcatcatctcagagcatagagaccctctccttgccacccggcccttcccacctggttggtgacaaatcacaaggtggtagaagttgccagggacagataacatggcagccagcgggaagaccagcaagtccgaaccgaaccatgttatcttcaagaagatctcccgggacaaatcggtgaccatctacctggggaacagagactacatagaccatgtcagccaagtccagcctgtggatggtgtcgtgttggttgatcctgatcttgtgaagggaaagaaagtgtatgtcactctgacctgcgccttccgctatggccaagaggacattgacgtgatcggcttgaccttccgcagggacctgtacttctcccgggtccaggtgtatcctcctgtgggggccgcgagcacccccacaaaactgcaagagagcctgcttaaaaagctggggagcaacacgtacccctttctcctgacgtttcctgactacttgccctgttcagtgatgttgcagccagctccacaagattcagggaagtcctgtggggttgactttgaggtcaaagcattcgccacagacagcaccgatgccgaagaggacaaaatccccaagaagagctccgtgcgattactgatccgcaaagtacagcatgccccacttgagatgggtccccagccccgagctgaggcggcctggcagttcttcatgtctgacaagcccctgcaccttgcggtctctctcaacaaagagttttttncccatgggggggccatccccttttaacnttttttttaaccaatnaaaaagggggg

SEQ ID NO: 418017 - DNA, 464 bp, Homo sapiens
gatgttgagaaatctataccccgactgatgatgaagaagatccagtagagaaagagcatgtgctgctttggacccaagctattcggtctgtgtgatccacaaattgtgggtccctgcgttgcccctctagacaacttaccacacagtcacactgtgacccccttatagtgacagtttttggtgacaagaggctttctggcctggactcgttgctgacaccaaccagaaggttctgcaggccaccgtgtggttcacaaagtctcaggaggaggctgtggtctctgactcttgagccagtttgtctcattaactccatagaacattctagaaattcagcaattcagaataggctgagttgcttgaagaaatatcctcctgttgctgccagcccaccctgagatttcacaagcactgttctgcttctcgtaagtcaagttcccaggctcttgaacccaccttcccag

SEQ ID NO: 418018 - DNA, 3503 bp, Homo sapiens
gtgcacgaacgagaagtgttttttttgttttgttttgttttgttttgttttttgtcccaaggcgctgccgtaccgtccaggcggcgagttgcattctggttccgtcgtgtgtctggcgtgtggagctagtgctcccgcttattcgccactgtcgccaccgctgtcatgaaccgcgagagcttcgcggcgggagagcggctggtgtcgccggcttacgtgcggcagggctgtgaggcccgccgctcgcatgagcacctcatacggctgcttctggagaaggggcaagtgtccagagaatggctgggatgaaagtacacttgaactctttttacatgaacttgcaatcatggacagcaacaatttcttaggcaattgtggtgtgggagaaagggaagggagagtggcatccgcactggttgctcgtcgtcattacaggttcattcatggcattggacgatccggtgatatttctgctgtgcaaccaaaagctgcaggctctagccttttgaacaaaattaccaattctttggtcctggacattataaagctggctggtgtccatacagtagccaactgctttgtagttcctatggcaactggtatgagtctaactctgtgtttcttaacattacgacacaaaagaccaaaggcaaagtatattatatggccacgaatagaccagaagtcctgctttaaatccatgatcactgcaggttttgagcctgtggtgatagaaaatgttttggaaggtgacgagctgcgtacagacctgaaagcagtggaggctaaagtccaggaacttgggcctgattgcattctgtgtattcattctactacatcctgttttgctccaagggtgcctgatagattagaagaactggctgtgatttgtgctaattatgacattccacatatagttaataatgcttatggagtgcagtcttcaaagtgtatgcatctcattcagcagggggctcgagttggtagaatagatgcttttgttcagagcttggacaaaaattttatggttccagtaggtggtgctataattgctggctttaatgattcattcattcaggaaatcagcaagatgtatccaggaagagcttcagcttcaccttctttagatgtccttattactttattgtcacttggatcaaatggctataagaagctactaaaagaaagaaaggaaatgttttcatatttgtccaaccaaataaagaagttgtcagaagcctacaatgaaagactgttgcatacacctcacaatcccatatctttagctatgacacttaaaacactagatgaacaccgtgacaaagctgtcactcagcttggctcgatgctttttaccagacaggtttctggagccagggttgtgcctcttgggtccatgcaaactgtgagtggctatactttcagaggctttatgtcacatacaaataattacccttgtgcttacctcaatgctgcatcagccatcggaatgaagatgcaggatgtggacctgttcataaagagacttgacaggtgtttaaaggcagtaagaaaagaacgaagtaaagagagtgatgacaattatgacaaaactgaagatgtggatattgaagaaatggctttaaaactagataatgtacttcttgacacataccaggatgcttcttcatgacatgcgaagggtttcttcttgatcatttgaaagaaatgataaggctgtagtacaagcaagcagtttaaagataagacttgagatttttgaattgagaatttcatgggaatattcagtcaaggagcagactttggtctgaactagccattgatgattgttaagtttcccattcttagactgcatcaatccttgtgatccttaacaggttataatatacaattagcatttttctaattgttagaatatctgtcaattaagcatcatgactcagataatttttactagtgtaatgacagtaaaattacttcaattctctttgaaatgtagagtgcttcctcctaaccattctttaccgtttctgatcacacagaattgagaaagatctcttaggccactagttactagttgtttgttgagatgtgtaagtcacagtgtgcctgtaaaatgggcattccccaaggaagcagagtcaaggtataaactttcgttttgactcaaaagcagtgggtctcaactggggatgattcgcttatctgaacagcatctgcagacatttttggttgtcacaactggtgggatgctgttaacatctagaggatagaggccagggtgctactcaacatcctacaatgcatgggacaactcccacaacaaagaattatccagcccaaaatgtcattagtgctgaggttgagaaatactcctctaaagtagataaactccttgagtaaagagaagtttaccatagcaactttcagtagtacttcaaagaagatagctgtataaatgtcatcaaactatactatatagagaatcttaagtgataaccagggtcacggattccaaacatgtcattataaattgttttatatggtgctcactggtgcatttttccttttggataagggaaaacattattccacttactgtttttgctttaagcagcctgcatatattggttagtttgttcagatgttgtgcacagacatcatcaaaattagctaacatgggtatttttgaacatatttttgccaggaagatgaaaatcacatagtatgataaacaggtgtattcccctctacttgcccatgtgctcatttttctgagtctgaaattccagacttactggctttaacaataatttttgttgttaatttaagaaatagacttacttaagactattttaagaaatagagatgtcatagcctgaagatttactgaagcttctgaacatgccaccatgccaaagctatgtttctcaaacccagctctgtggatcatgttcctaaaagatgctcatggggagaaaatgtttacagacaaataattttgggagctgcctttgcaaacctgcctgttggcatattgaaggctctaagaattccttcactaaataacccagttttaatatatccttatccaaagagaaactcatttttttaaagtgaaatatttgttaacagcccattgaacatacttttaaaaacactatggtagagaatgctgtgttgccttctgggctgcatttttcttattgatttggaattgtaacctatgtatgagaaagggattttctggtattttggtgacgttgtacattgtcccagactgtttgtaaacatgaggtcagacatgtgtaaggtagacgcctatggccactggcttgaccaccttggaagtcaatgactattttgagatgaagtatttaactatgaatatcatgaaggttatttaaaaatgtatttattttatctttggggttcaaacattaaaaaaatttacataggtgtagtaactcatttcaagggaataaatgctggattaaaaagtg

SEQ ID NO: 418019 - DNA, 765 bp, Homo sapiens
gtgcacgaacgagaagtgttttttttgttttgttttgttttgttttgttttttgtcccaaggcgctgccgtaccgtccaggcggcgagttgcattctggttccgtcgtgtgtctggcgtgtggagctagtgctcccgcttattcgccactgtcgccaccgctgtcatgaaccgcgagagcttcgcggcgggagagcggctggtgtcgccggcttacgtgcggcagggctgtgaggcccgccgctcgcatgagcacctcatacggctgcttctggagaaggtaccgagctgtcggtcccctccccagccgccgcgaccccggggctctggctccgccgggcgtccccgctggtgctgcctcaccggcagctcttcgctgcttgagactagtcccaagtctgtctcagcttggcttgccctagctgaccgactgcggtctgtgccttctcagccttgccaaagccagtgaaagccaaatggtgttgttaggagggggtgttggggtcggggttttgagtcccgctgtttctaacttcgggatgcggaagtgagggaaagtcccagtgtacttttttattcgcggaaagggcaaagttcgcacctccatctttcaccaaccctcaacgactcagaacacataatggtgtttgtagactgtatgctaactcgaaccacgagctttccgcggaacttcacaggtctccctcctgccagcgttcatgtattttaatttcattaaaagttttgttgtgttttgtttttttga

SEQ ID NO: 418020 - DNA, 798 bp, Homo sapiens
gggctacgactcttactattttatatatgaaatatattatttcctcaagaaggatgctgggtgcttagcgggataacagatttctgttttgcttcttatttgtaggtgtccatacagtagccaactgctttgtagttcctatggcaactggtatgagtctaactctgtgtttcttaacattacgacacaaaagaccaaaggcaaagtatattatatggccacgaatagaccagaagtcctgctttaaatccatgatcactgcaggttttgagcctgtggtgatagaaaatgttttggaaggtgacgagctgcgtacagacctgaaagcagtggaggctaaagtccaggaacttgggcctgattgcattctgtgtattcattctactacatcctgttttgctccaagggtgcctgataggtaaatgatttgtgaatattgtcctttagctgtttatcagtcttttaaataaaatatactaattctcaaatatgcttaaataacacttcacaataaataggtgaatggtctgttctaagagaatagattgaccttgtggagaaatagcattaacagcttgggaaaccaaccatttgaaatataacaaggaaaaacaattagtacagggtggggagctccctttatcacctgagtcgatgcagaccgtctctgttttcttgctctttgtcctgtttctgatctcttagcatgttttttcttattatttaatagaagtttcttttctaagctaaatgttgggtttacttcttttcattgctatcagtattaataaattaaaa

SEQ ID NO: 418021 - DNA, 5601 bp, Homo sapiens
gtgcacgaacgagaagtgttttttttgttttgttttgttttgttttgttttttgtcccaaggcgctgccgtaccgtccaggcggcgagttgcattctggttccgtcgtgtgtctggcgtgtggagctagtgctcccgcttattcgccactgtcgccaccgctgtcatgaaccgcgagagcttcgcggcgggagagcggctggtgtcgccggcttacgtgcggcagggctgtgaggcccgccgctcgcatgagcacctcatacggctgcttctggagaaggggcaagtgtccagagaatggctgggatgaaagtacacttgaactctttttacatgaacttgcaatcatggacagcaacaatttcttaggcaattgtggtgtgggagaaagggaagggagagtggcatccgcactggttgctcgtcgtcattacaggttcattcatggcattggacgatccggtgatatttctgctgtgcaaccaaaagctgcaggctctagccttttgaacaaaattaccaattctttggtcctggacattataaagctggctggtgtccatacagtagccaactgctttgtagttcctatggcaactggtatgagtctaactctgtgtttcttaacattacgacacaaaagaccaaaggcaaagtatattatatggccacgaatagaccagaagtcctgctttaaatccatgatcactgcaggttttgagcctgtggtgatagaaaatgttttggaaggtgacgagctgcgtacagacctgaaagcagtggaggctaaagtccaggaacttgggcctgattgcattctgtgtattcattctactacatcctgttttgctccaagggtgcctgatagattagaagaactggctgtgatttgtgctaattatgacattccacatatagttaataatgcttatggagtgcagtcttcaaagtgtatgcatctcattcagcagggggctcgagttggtagaatagatgcttttgttcagagcttggacaaaaattttatggttccagtaggtggtgctataattgctggctttaatgattcattcattcaggaaatcagcaagatgtatccaggaagagcttcagcttcaccttctttagatgtccttattactttattgtcacttggatcaaatggctataagaagctactaaaagaaagaaaggaaatgttttcatatttgtccaaccaaataaagaagttgtcagaagcctacaatgaaagactgttgcatacacctcacaatcccatatctttagctatgacacttaaaacactagatgaacaccgtgacaaagctgtcactcagcttggctcgatgctttttaccagacaggtttctggagccagggttgtgcctcttgggtccatgcaaactgtgagtggctatactttcagaggctttatgtcacatacaaataattacccttgtgcttacctcaatgctgcatcagccatcggaatgaagatgcaggatgtggacctgttcataaagagacttgacaggtgtttaaaggcagtaagaaaagaacgaagtaaagagagtgatgacaattatgacaaaactgaagatgtggatattgaagaaatggctttaaaactagataatgtacttcttgacacataccaggatgcttcttcatgacatgcgaagggtttcttcttgatcatttgaaagaaatgataaggctgtagtacaagcaagcagtttaaagataagacttgagatttttgaattgagaatttcatgggaatattcagtcaaggagcagactttggtctgaactagccattgatgattgttaagtttcccattcttagactgcatcaatccttgtgatccttaacaggttataatatacaattagcatttttctaattgttagaatatctgtcaattaagcatcatgactcagataatttttactagtgtaatgacagtaaaattacttcaattctctttgaaatgtagagtgcttcctcctaaccattctttaccgtttctgatcacacagaattgagaaagatctcttaggccactagttactagttgtttgttgagatgtgtaagtcacagtgtgcctgtaaaatgggcattccccaaggaagcagagtcaaggtataaactttcgttttgactcaaaagcagtgggtctcaactggggatgattcgcttatctgaacagcatctgcagacatttttggttgtcacaactggtgggatgctgttaacatctagaggatagaggccagggtgctactcaacatcctacaatgcatgggacaactcccacaacaaagaattatccagcccaaaatgtcattagtgctgaggttgagaaatactcctctaaagtagataaactccttgagtaaagagaagtttaccatagcaactttcagtagtacttcaaagaagatagctgtataaatgtcatcaaactatactatatagagaatcttaagtgataaccagggtcacggattccaaacatgtcattataaattgttttatatggtgctcactggtgcatttttccttttggataagggaaaacattattccacttactgtttttgctttaagcagcctgcatatattggttagtttgttcagatgttgtgcacagacatcatcaaaattagctaacatgggtatttttgaacatatttttgccaggaagatgaaaatcacatagtatgataaacaggtgtattcccctctacttgcccatgtgctcatttttctgagtctgaaattccagacttactggctttaacaataatttttgttgttaatttaagaaatagacttacttaagactattttaagaaatagagatgtcatagcctgaagatttactgaagcttctgaacatgccaccatgccaaagctatgtttctcaaacccagctctgtggatcatgttcctaaaagatgctcatggggagaaaatgtttacagacaaataattttgggagctgcctttgcaaacctgcctgttggcatattgaaggctctaagaattccttcactaaataacccagttttaatatatccttatccaaagagaaactcatttttttaaagtgaaatatttgttaacagcccattgaacatacttttaaaaacactatggtagagaatgctgtgttgccttctgggctgcatttttcttattgatttggaattgtaacctatgtatgagaaagggattttctggtattttggtgacgttgtacattgtcccagactgtttgtaaacatgaggtcagacatgtgtaaggtagacgcctatggccactggcttgaccaccttggaagtcaatgactattttgagatgaagtatttaactatgaatatcatgaaggttatttaaaaatgtatttattttatctttggggttcaaacattaaaaaaatttacataggtgtagtaactcatttcaagggaataaatgctggattaaaaagtgtaaatttttcatgagaatttgggactaaattgctgaaccaataaagctgaagagttgcaacctctagagtcaaaaaagggattgaaatgttgttgcaaatgtaaatgctggcagtgcagcttgctatacatgtaagccaaaattgttttatagaacaagtgatctatattgttgtgatcatcatttagcttaagaaaggccagagctgggagagtagcaaatgttttctcatctgcagtgtatcagcagttcttgggcttcagctgctgaatagataataattctaattgaacataaattacatgaactcacatgtgaatgatagatatgttacaatatttcattcctgatgcagaaaatcagctgtggtttttattattaaccctttctttttcagtggttttggaattctagctctattcctcctggcttaaaatttgagggcatagaattcacaagagtttttgaagagttctgtctattcaggctttcctttgtccccaccctagtgtcattttcactcactcccatttctacacataagtattaaaaaggatgtatttattataattcgctagtactgattggtaagcctcataattggcctttgttatctttgtactgtgacgaaggcagtggatgatacattaccaatcattgccgaagataacctcttctatctttttgacccaactacccttattaaaactatcaggtaaaatattggagttaggtttttaaagtcattgggctgtggcagtgtgcttagaaaagaaaatggtggaacatagaatattcttttggtcactacacaatgtgttacttatacatggcagggaagggaattttaaatcaaactcgcagtttggttcttaggtcctctgctgatgaattctcgctctatcagggaatgatatgtgacgccagccttaggaacctggtgttcaactgtaaatctttctatttagctttttgtattagttgaatgaagttatagaatatgaattattgaatacagttctgttcagccaataggcacttgatatacagaatggtaaatttaaatataaattaaatttttctaatattatgatcagcacttcactgtggttctgtgtctttaaccacctcataataagaactgttattgaggactgggctacagaatgtgcttagactacatctatggcttccatagattttagtaaaatttaaacagataatttgtgtttactgctgatgttactttaatattgaattagtagttcatcctgagagttatatttcacagaggaaaataaccaacagctgaaaacaacaataataaagctctggtgagtctgactcatactcggagaaagtttttggaatacatacacatttggtgcatataagagttgggtttccttttcccactttctgagatgtactaacctctgccagacccttaaatgattttgttatgttttgcatttttgaggccaaccttattttgtaactgaaaaaagtccagttttgcatacacagaaatttggtcattttagaagtctcacaacctgaataatttgataataattgaatatgctattaacagctttttaagaaaaggttctattagtcagttttttccttgtctgtcatattatgttggttaatgtctcttatggccaatcttagtaaacagacctaacactcactgcatccttttgtgccttactttttactttccttttgcccttttggtatgtgcgcatgtaagatggtaagtttaaggctaatgaatatatgtttgtaatttcctactcactactctgcagttaaagctaaggccttaggcaaaatctagaaatgtttatattgttttgttttttatcaagtggtgtcaacttgagaaatacaaagaaaggctatgcttaactgtataaccgtgggggattttagccatgagaatatgaagctgatgtcagcctgctaacctgttttaccaaaaggaaaagatgtttccaaaaatgttttcggtgtagactgtttaaagatgaaaataaattatataatttattatatgaaataaatttttgataagtcactgaaagtacgt

SEQ ID NO: 418022 - DNA, 5444 bp, Homo sapiens
gtgcacgaacgagaagtgttttttttgttttgttttgttttgttttgttttttgtcccaaggcgctgccgtaccgtccaggcggcgagttgcattctggttccgtcgtgtgtctggcgtgtggagctagtgctcccgcttattcgccactgtcgccaccgctgtcatgaaccgcgagagcttcgcggcgggagagcggctggtgtcgccggcttacgtgcggcagggctgtgaggcccgccgctcgcatgagcacctcatacggctgcttctggagaaggtcattcatggcattggacgatccggtgatatttctgctgtgcaaccaaaagctgcaggctctagccttttgaacaaaattaccaattctttggtcctggacattataaagctggctggtgtccatacagtagccaactgctttgtagttcctatggcaactggtatgagtctaactctgtgtttcttaacattacgacacaaaagaccaaaggcaaagtatattatatggccacgaatagaccagaagtcctgctttaaatccatgatcactgcaggttttgagcctgtggtgatagaaaatgttttggaaggtgacgagctgcgtacagacctgaaagcagtggaggctaaagtccaggaacttgggcctgattgcattctgtgtattcattctactacatcctgttttgctccaagggtgcctgatagattagaagaactggctgtgatttgtgctaattatgacattccacatatagttaataatgcttatggagtgcagtcttcaaagtgtatgcatctcattcagcagggggctcgagttggtagaatagatgcttttgttcagagcttggacaaaaattttatggttccagtaggtggtgctataattgctggctttaatgattcattcattcaggaaatcagcaagatgtatccaggaagagcttcagcttcaccttctttagatgtccttattactttattgtcacttggatcaaatggctataagaagctactaaaagaaagaaaggaaatgttttcatatttgtccaaccaaataaagaagttgtcagaagcctacaatgaaagactgttgcatacacctcacaatcccatatctttagctatgacacttaaaacactagatgaacaccgtgacaaagctgtcactcagcttggctcgatgctttttaccagacaggtttctggagccagggttgtgcctcttgggtccatgcaaactgtgagtggctatactttcagaggctttatgtcacatacaaataattacccttgtgcttacctcaatgctgcatcagccatcggaatgaagatgcaggatgtggacctgttcataaagagacttgacaggtgtttaaaggcagtaagaaaagaacgaagtaaagagagtgatgacaattatgacaaaactgaagatgtggatattgaagaaatggctttaaaactagataatgtacttcttgacacataccaggatgcttcttcatgacatgcgaagggtttcttcttgatcatttgaaagaaatgataaggctgtagtacaagcaagcagtttaaagataagacttgagatttttgaattgagaatttcatgggaatattcagtcaaggagcagactttggtctgaactagccattgatgattgttaagtttcccattcttagactgcatcaatccttgtgatccttaacaggttataatatacaattagcatttttctaattgttagaatatctgtcaattaagcatcatgactcagataatttttactagtgtaatgacagtaaaattacttcaattctctttgaaatgtagagtgcttcctcctaaccattctttaccgtttctgatcacacagaattgagaaagatctcttaggccactagttactagttgtttgttgagatgtgtaagtcacagtgtgcctgtaaaatgggcattccccaaggaagcagagtcaaggtataaactttcgttttgactcaaaagcagtgggtctcaactggggatgattcgcttatctgaacagcatctgcagacatttttggttgtcacaactggtgggatgctgttaacatctagaggatagaggccagggtgctactcaacatcctacaatgcatgggacaactcccacaacaaagaattatccagcccaaaatgtcattagtgctgaggttgagaaatactcctctaaagtagataaactccttgagtaaagagaagtttaccatagcaactttcagtagtacttcaaagaagatagctgtataaatgtcatcaaactatactatatagagaatcttaagtgataaccagggtcacggattccaaacatgtcattataaattgttttatatggtgctcactggtgcatttttccttttggataagggaaaacattattccacttactgtttttgctttaagcagcctgcatatattggttagtttgttcagatgttgtgcacagacatcatcaaaattagctaacatgggtatttttgaacatatttttgccaggaagatgaaaatcacatagtatgataaacaggtgtattcccctctacttgcccatgtgctcatttttctgagtctgaaattccagacttactggctttaacaataatttttgttgttaatttaagaaatagacttacttaagactattttaagaaatagagatgtcatagcctgaagatttactgaagcttctgaacatgccaccatgccaaagctatgtttctcaaacccagctctgtggatcatgttcctaaaagatgctcatggggagaaaatgtttacagacaaataattttgggagctgcctttgcaaacctgcctgttggcatattgaaggctctaagaattccttcactaaataacccagttttaatatatccttatccaaagagaaactcatttttttaaagtgaaatatttgttaacagcccattgaacatacttttaaaaacactatggtagagaatgctgtgttgccttctgggctgcatttttcttattgatttggaattgtaacctatgtatgagaaagggattttctggtattttggtgacgttgtacattgtcccagactgtttgtaaacatgaggtcagacatgtgtaaggtagacgcctatggccactggcttgaccaccttggaagtcaatgactattttgagatgaagtatttaactatgaatatcatgaaggttatttaaaaatgtatttattttatctttggggttcaaacattaaaaaaatttacataggtgtagtaactcatttcaagggaataaatgctggattaaaaagtgtaaatttttcatgagaatttgggactaaattgctgaaccaataaagctgaagagttgcaacctctagagtcaaaaaagggattgaaatgttgttgcaaatgtaaatgctggcagtgcagcttgctatacatgtaagccaaaattgttttatagaacaagtgatctatattgttgtgatcatcatttagcttaagaaaggccagagctgggagagtagcaaatgttttctcatctgcagtgtatcagcagttcttgggcttcagctgctgaatagataataattctaattgaacataaattacatgaactcacatgtgaatgatagatatgttacaatatttcattcctgatgcagaaaatcagctgtggtttttattattaaccctttctttttcagtggttttggaattctagctctattcctcctggcttaaaatttgagggcatagaattcacaagagtttttgaagagttctgtctattcaggctttcctttgtccccaccctagtgtcattttcactcactcccatttctacacataagtattaaaaaggatgtatttattataattcgctagtactgattggtaagcctcataattggcctttgttatctttgtactgtgacgaaggcagtggatgatacattaccaatcattgccgaagataacctcttctatctttttgacccaactacccttattaaaactatcaggtaaaatattggagttaggtttttaaagtcattgggctgtggcagtgtgcttagaaaagaaaatggtggaacatagaatattcttttggtcactacacaatgtgttacttatacatggcagggaagggaattttaaatcaaactcgcagtttggttcttaggtcctctgctgatgaattctcgctctatcagggaatgatatgtgacgccagccttaggaacctggtgttcaactgtaaatctttctatttagctttttgtattagttgaatgaagttatagaatatgaattattgaatacagttctgttcagccaataggcacttgatatacagaatggtaaatttaaatataaattaaatttttctaatattatgatcagcacttcactgtggttctgtgtctttaaccacctcataataagaactgttattgaggactgggctacagaatgtgcttagactacatctatggcttccatagattttagtaaaatttaaacagataatttgtgtttactgctgatgttactttaatattgaattagtagttcatcctgagagttatatttcacagaggaaaataaccaacagctgaaaacaacaataataaagctctggtgagtctgactcatactcggagaaagtttttggaatacatacacatttggtgcatataagagttgggtttccttttcccactttctgagatgtactaacctctgccagacccttaaatgattttgttatgttttgcatttttgaggccaaccttattttgtaactgaaaaaagtccagttttgcatacacagaaatttggtcattttagaagtctcacaacctgaataatttgataataattgaatatgctattaacagctttttaagaaaaggttctattagtcagttttttccttgtctgtcatattatgttggttaatgtctcttatggccaatcttagtaaacagacctaacactcactgcatccttttgtgccttactttttactttccttttgcccttttggtatgtgcgcatgtaagatggtaagtttaaggctaatgaatatatgtttgtaatttcctactcactactctgcagttaaagctaaggccttaggcaaaatctagaaatgtttatattgttttgttttttatcaagtggtgtcaacttgagaaatacaaagaaaggctatgcttaactgtataaccgtgggggattttagccatgagaatatgaagctgatgtcagcctgctaacctgttttaccaaaaggaaaagatgtttccaaaaatgttttcggtgtagactgtttaaagatgaaaataaattatataatttattatatgaaataaatttttgataagtcactgaaagtacgt

SEQ ID NO: 418023 - DNA, 1770 bp, Homo sapiens
gtgcacgaacgagaagtgttttttttgttttgttttgttttgttttgttttttgtcccaaggcgctgccgtaccgtccaggcggcgagttgcattctggttccgtcgtgtgtctggcgtgtggagctagtgctcccgcttattcgccactgtcgccaccgctgtcatgaaccgcgagagcttcgcggcgggagagcggctggtgtcgccggcttacgtgcggcagggctgtgaggcccgccgctcgcatgagcacctcatacggctgcttctggagaaggggcaagtgtccagagaatggctgggatgaaagtacacttgaactctttttacatgaacttgcaatcatggacagcaacaatttcttaggcaattgtggtgtgggagaaagggaagggagagtggcatccgcactggttgctcgtcgtcattacaggttcattcatggcattggacgatccggtgatatttctgctgtgcaaccaaaagctgcaggctctagccttttgaacaaaattaccaattctttggtcctggacattataaagctggctggtgtccatacagtagccaactgctttgtagttcctatggcaactggtatgagtctaactctgtgtttcttaacattacgacacaaaagaccaaaggcaaagtatattatatggccacgaatagaccagaagtcctgctttaaatccatgatcactgcaggttttgagcctgtggtgatagaaaatgttttggaaggtgacgagctgcgtacagacctgaaagcagtggaggctaaagtccaggaacttgggcctgattgcattctgtgtattcattctactacatcctgttttgctccaagggtgcctgatagattagaagaactggctgtgatttgtgctaattatgacattccacatatagttaataatgcttatggagtgcagtcttcaaagtgtatgcatctcattcagcagggggctcgagttggtagaatagatgcttttgttcagagcttggacaaaaattttatggttccagtaggtggtgctataattgctggctttaatgattcattcattcaggaaatcagcaagatgtatccaggaagagcttcagcttcaccttctttagatgtccttattactttattgtcacttggatcaaatggctataagaagctactaaaagaaagaaaggaaatgttttcatatttgtccaaccaaataaagaagttgtcagaagcctacaatgaaagactgttgcatacacctcacaatcccatatctttagctatgacacttaaaacactagatgaacaccgtgacaaagctgtcactcagcttggctcgatgctttttaccagacaggtttctggagccaggtaagtatgtttaagatagatatgggtttatttgtcttttcaaacttaactccagtaaaatacctttcctcaacaatagtcccccaagtatatcctgaactatacctgcgaattcatcatggagtaaagaatgatgagttagagaatctgtaaggctactgtatgcccacctgtggactgcttatgcctgaaatagtcacaaaaagacatgaatcttgtttgttttcatagatgtacagaaccaaagttttattacctctctacatagatttttttctttatttcctttgttagatgatcttcagcaagtcacattatggtattagagataagccatcttcatcactaaattgaagtgaaagtgttcttaaggaaaagccttcttcctaaact

SEQ ID NO: 418024 - DNA, 1247 bp, Homo sapiens
gtgcacgaacgagaagtgttttttttgttttgttttgttttgttttgttttttgtcccaaggcgctgccgtaccgtccaggcggcgagttgcattctggttccgtcgtgtgtctggcgtgtggagctagtgctcccgcttattcgccactgtcgccaccgctgtcatgaaccgcgagagcttcgcggcgggagagcggctggtgtcgccggcttacgtgcggcagggctgtgaggcccgccgctcgcatgagcacctcatacggctgcttctggagaaggggcaagtgtccagagaatggctgggatgaaagtacacttgaactctttttacatgaacttgcaatcatggacagcaacaatttcttaggcaattgtggtgtgggagaaagggaagggagagtggcatccgcactggttgctcgtcgtcattacaggttcattcatggcattggacgatccggtgatatttctgctgtgcaaccaaaagctgcaggctctagccttttgaacaaaattaccaattctttggtcctggacattataaagctggctggtgtccatacagtagccaactgctttgtagttcctatggcaactggtatgagtctaactctgtgtttcttaacattacgacacaaaagaccaaaggcaaagtatattatatggccacgaatagaccagaagtcctgctttaaatccatgatcactgcaggttttgagcctgtggtgatagaaaatgttttggaaggtgacgagctgcgtacagacctgaaagcagtggaggctaaagtccaggaacttgggcctgattgcattctgtgtattcattctactacatcctgttttgctccaagggtgcctgataggtaaatgatttgtgaatattgtcctttagctgtttatcagtcttttaaataaaatatactaattctcaaatatgcttaaataacacttcacaataaataggtgaatggtctgttctaagagaatagattgaccttgtggagaaatagcattaacagcttgggaaaccaaccatttgaaatataacaaggaaaaacaattagtacagggtggggagctccctttatcacctgagtcgatgcagaccgtctctgttttcttgctctttgtcctgtttctgatctcttagcatgttttttcttattatttaatagaagtttcttttctaagctaaatgttgggtttacttcttttcattgctatcagtattaataaattaaaa

SEQ ID NO: 418025 - DNA, 418 bp, Homo sapiens
gcggccgcctactactactactactgctcgaattcaagcttctaacgatgtacggggacatggcacctcagccaggggtgtagccaagtagacaaatggaatcctgtgctgaacccgaatcttccaaaaaacagcctacaatctgtgaccaccacaagatgtgccctgatggcagctgaagtttgattcagatgggcacttttcttccccttccctgcctagtttccttttgttccttgagtccacgcagaattccattctctggtcagcagacaggcttaagctaaagtattgcctctattctgtaaagttctgtacatagttcccaagcttctgcagggggtgatttttgctcttgtcctgagaaataacagtgctgttttaaaaaacatttgaaataaataccgcacacaaaggc

SEQ ID NO: 418026 - DNA, 3301 bp, Homo sapiens
cttggggtggggaccgggtgaggggcctgacggcagagtcggtccagaactgcccggacagcgacgcacagcgaggagccaaaatggaagagggtgcaagtcccctcctggggccccagacgccccctcctttcttgctgcctggagcaggggcagtgctgttagtggctactcctggtgtgaacagcccatcctggccaccttccacaggaaacctgacctgaaggacagaagaggaaggaagcaggctttgccacaaatgtcagtgcagaactctggctggccccaccaagaagacagccccaagccccaggatccaggtccaccagccaactcagacagtgactcaggccacctgccgggggaggaccctgaggatacccatgctcaggaattcctgtctctgcacctgcttagaacatggggttttgactttaaactcattcacatgagtattcattatctctcctagggggtctgtattgtcaaaccagactctaggggctttggccccaaggcgtgaagggggttaagaagggaaagcataagaagggaagctgttttggggtgtggggcctccccagcctccctcaaggaagaccacacatgcaggcatcagtcagctatccttgcactcagtgaggatctgcaaggaggaccctcccaaatggagggcatgcttagaagctgctctagattggagaagaggtggcaatgatgagggggaaagaaggagaaaggaaagaaaaacctagtttcactcctccccttcttccatgtctcctcagggtcctgcagttctgagcttgggttccctttgcctggacaccaaccaagcccccaactggactggacttcagaccctcctgcagcaactccctccgcaggacattgatgagcgctactgcctggcccttggggaggaggagcgggccgagctgcagctcttctgtgccaggcggaagcaggaagccctgggacagggggtagcccgcctggtacttcccaagcttgaaggacacacctgtgagaagtgtagggagttgctgaagccaggggagtacggagtgtttgcagcccgggcaggggaacagcgctgctggcaccagccttgctttgcctgccaggcctgtggccaggccctgataaacctcatctacttctaccatgatggacaactctactgcggccgtcatcatgcagagttgctgcgcccgcgctgcccggcttgtgaccagctgatcttctcctggcgctgcaccgaggcggagggacagcgctggcatgagaaccacttctgttgccaggactgcgccgggcctctgggcgggggacgttatgccctgcctgggggaagcccctgctgccccagctgcttcgagaaccgctactcggatgcaggctcgagctgggccggggcactggaagggcaggcattccttggagcgcccccaccgcaccccccagacccaagcctcggggcccgcagctctcaccgcgcatccctggccggagcgttccaagggccgcccgaacccaccccgcgccgcggtcggggttgcggcgccagactccctcccaggcgcgggaggcggacgccctctggtggaggcgggggaccctggcgaggactctcggcggcggcggcggcgcgcacggcccaggggctgggcggggcgggaggctgggcctcacccccactagctgcggtgtaggtccagctccgcggctctgagaccagcgtttccgacccggcccggaacaggggagactggactcgaccgaactgaaggaagggaccaaacctcggtgaactctgcaaccctctcccgaacactccttctcgctgctgccggcggttccagcctgcaaactcagagggggctgcctggatccagtccccagcaggagaaccgacctggggacaaagcggaggcacccaaagggcaggagcaatgccgcctggagactattcgtgatcccaaggacacccctttctccacctgctcctcctcctctgactcggaacctgaaggatttttcttaggcgagcgccttccccagtcctggaagacccccggaagcctccaagcagaggacagcaacgcctctaagacgcactgcaccatgtgctagtggcgcagctcagagaggggatgtgagtgggaggaaaggggtctgtaaagcgggagaacaaggctagcctccccctaacaatcctagactgagacgcagtcaggcgcacgcccgcaagaggcggcgaggtgacaagtttggagtgcgcccccttcagtactgcgcgttctaagacttttggcggagactttcttggcaaaacccattccccaaagctacgcttcccctgctgagatagcccctacccccacctccacaggctgggacagccccgtccccaccatcctcctcccaagccaattaaatgatcacagcacgcgtgacagttaccggctggagagccggaggtgggaccgggagcaggggaccgtagaaccgggccgcgctcctcccctcctagagttcgtggaggcgcagcagagggccgtccctcttccggatgtcggactaagcgaacagcgcccccactgccggccggtagcagccggaagtgccagaccggaggtgcgtcattcaccggcgacgccgatacggttcctccaccgaggcccatgcgaagctttccactatggcttccagcactgtcccggtgagcgctgctggctcggctaatgaaactcccgaaataccggacaacgtgggagattggcttcggggcgtctaccgctttgccactgataggaatgacttccggaggaacttgatactaaatttgggactctttgctgcgggagtttggctggccaggaacttgagtgacattgacctcatggcacctcagccaggggtgtagccaagtagttctaatgccacctgtcgtcttatcatctgattgcagacaaatggaatcctgtgctgaacccgaatcttccaaaaaacagcctacaatctgtgaccaccacaagatgtgccctgatggcagctgaagtttgattcagatgggcacttttcttccccttccctgcctagtttccttttgttccttgagtccacgcagaattccattctctggtcagcagacaggcttaagctaaagtattgcctctattctgtaaagttctgtacatagttcccaagcttctgcagggggtgatttttgctcttgtcctgagaaataacagtgctgttttaaaaaacatttgaaataaataccgcacacaaaggc

SEQ ID NO: 418027 - DNA, 712 bp, Homo sapiens
  misc_feature (526)..(526): n is a, c, g, or t
ttacacttttgatagcttctgcccggaacatggcggtaatagaaagtcttagggcagccgtgtatattttctcaacccccggacaacgtgggagattggcttcggggcgtctaccgctttgccactgataggaatgacttccggaggaacttgatactaaatttgggactctttgctgcgggagtttggctggccaggaacttgagtgacattgacctcatggcacctcagccaggggtgtagccaagtagacaaatggaatcctgtgctgaacccgaatcttccaaaaaacagcctacaatctgtgaccaccacaagatgtgccctgatggcagctgaagtttgattcagatgggcacttttcttccccttccctgcctagtttccttttgttccttgagtccacgcagaattccattctctggtcagcagacaggcttaagctaaagtattgcctctattctgtaaagttctgtacatagttcccaagcttctgcagggggtgatttttgctcttgtccggggntgttaacaaccccggacaaaggagattggatgactgggaagcgctggcccggaacagcccctgcaactgtggggcctgcacacagcccttccacagttggcactgcaggtgcaggccaatcctttaaagaataaacaaggaagtcagctctttcactttttacaagtcggcaaaaacagactccgg

SEQ ID NO: 418028 - DNA, 2959 bp, Homo sapiens
gggagggggaagggaattatggaaggaatccagctggcctgttagtaagggtgttccagtgctaggtggaggtggagtttggctgcctttggggagattggaagggtgaggaatagaggcctgatttctgagtgttgtttctgtgttggacaattctatgcaaactagagccaaaatggaagagggtgcaagtcccctcctggggccccagacgccccctcctttcttgctgcctggagcaggggcagtgctgttagtggctactcctggtgtgaacagcccatcctggccaccttccacaggaaacctgacctgaaggacagaagaggaaggaagcaggctttgccacaaatgtcagtgcagaactctggctggccccaccaagaagacagccccaagccccaggatccaggtccaccagccaactcagacagtgactcaggccacctgccgggggaggaccctgaggatacccatgctcagggtcctgcagttctgagcttgggttccctttgcctggacaccaaccaagcccccaactggactggacttcagaccctcctgcagcaactccctccgcaggacattgatgagcgctactgcctggcccttggggaggaggagcgggccgagctgcagctcttctgtgccaggcggaagcaggaagccctgggacagggggtagcccgcctggtacttcccaagcttgaaggacacacctgtgagaagtgtagggagttgctgaagccaggggagtacggagtgtttgcagcccgggcaggggaacagcgctgctggcaccagccttgctttgcctgccaggcctgtggccaggccctgataaacctcatctacttctaccatgatggacaactctactgcggccgtcatcatgcagagttgctgcgcccgcgctgcccggcttgtgaccagctgatcttctcctggcgctgcaccgaggcggagggacagcgctggcatgagaaccacttctgttgccaggactgcgccgggcctctgggcgggggacgttatgccctgcctgggggaagcccctgctgccccagctgcttcgagaaccgctactcggatgcaggctcgagctgggccggggcactggaagggcaggcattccttggagcgcccccaccgcaccccccagacccaagcctcggggcccgcagctctcaccgcgcatccctggccggagcgttccaagggccgcccgaacccaccccgcgccgcggtcggggttgcggcgccagactccctcccaggcgcgggaggcggacgccctctggtggaggcgggggaccctggcgaggactctcggcggcggcggcggcgcgcacggcccaggggctgggcggggcgggaggctgggcctcacccccactagctgcggtgtaggtccagctccgcggctctgagaccagcgtttccgacccggcccggaacaggggagactggactcgaccgaactgaaggaagggaccaaacctcggtgaactctgcaaccctctcccgaacactccttctcgctgctgccggcggttccagcctgcaaactcagagggggctgcctggatccagtccccagcaggagaaccgacctggggacaaagcggaggcacccaaagggcaggagcaatgccgcctggagactattcgtgatcccaaggacacccctttctccacctgctcctcctcctctgactcggaacctgaaggatttttcttaggcgagcgccttccccagtcctggaagacccccggaagcctccaagcagaggacagcaacgcctctaagacgcactgcaccatgtgctagtggcgcagctcagagaggggatgtgagtgggaggaaaggggtctgtaaagcgggagaacaaggctagcctccccctaacaatcctagactgagacgcagtcaggcgcacgcccgcaagaggcggcgaggtgacaagtttggagtgcgcccccttcagtactgcgcgttctaagacttttggcggagactttcttggcaaaacccattccccaaagctacgcttcccctgctgagatagcccctacccccacctccacaggctgggacagccccgtccccaccatcctcctcccaagccaattaaatgatcacagcacgcgtgacagttaccggctggagagccggaggtgggaccgggagcaggggaccgtagaaccgggccgcgctcctcccctcctagagttcgtggaggcgcagcagagggccgtccctcttccggatgtcggactaagcgaacagcgcccccactgccggccggtagcagccggaagtgccagaccggaggtgcgtcattcaccggcgacgccgatacggttcctccaccgaggcccatgcgaagctttccactatggcttccagcactgtcccggtgagcgctgctggctcggctaatgaaactcccgaaataccggacaacgtgggagattggcttcggggcgtctaccgctttgccactgataggaatgacttccggaggaacttgatactaaatttgggactctttgctgcgggagtttggctggccaggaacttgagtgacattgacctcatggcacctcagccaggggtgtagccaagtagacaaatggaatcctgtgctgaacccgaatcttccaaaaaacagcctacaatctgtgaccaccacaagatgtgccctgatggcagctgaagtttgattcagatgggcacttttcttccccttccctgcctagtttccttttgttccttgagtccacgcagaattccattctctggtcagcagacaggcttaagctaaagtattgcctctattctgtaaagttctgtacatagttcccaagcttctgcagggggtgatttttgctcttgtcctgagaaataacagtgctgttttaaaaaacatttgaaataaataccgcacacaaaggc

SEQ ID NO: 418029 - DNA, 3484 bp, Homo sapiens
gggagggggaagggaattatggaaggaatccagctggcctgttagtaagggtgttccagtgctaggtggaggtggagtttggctgcctttggggagattggaagggtgaggaatagaggcctgatttctgagtgttgtttctgtgttggacaattctatgcaaactagagccaaaatggaagagggtgcaagtcccctcctggggccccagacgccccctcctttcttgctgcctggagcaggggcagtgctgttagtggctactcctggtgtgaacagcccatcctggccaccttccacaggaaacctgacctgaaggacagaagaggaaggaagcaggctttgccacaaatgtcagtgcagaactctggctggccccaccaagaagacagccccaagccccaggatccaggtccaccagccaactcagacagtgactcaggccacctgccgggggaggaccctgaggatacccatgctcaggtagtagagtcgtgcccttcctctgagaccaacatgtcctctatcctgtggagtggccacccttttccaccaacccggaggtagtttgacttcgtgcctaatctcttgttgcctttttctcttttcaggaattcctgtctctgcacctgcttagaacatggggttttgactttaaactcattcacatgagtattcattatctctcctagggggtctgtattgtcaaaccagactctaggggctttggccccaaggcgtgaagggggttaagaagggaaagcataagaagggaagctgttttggggtgtggggcctccccagcctccctcaaggaagaccacacatgcaggcatcagtcagctatccttgcactcagtgaggatctgcaaggaggaccctcccaaatggagggcatgcttagaagctgctctagattggagaagaggtggcaatgatgagggggaaagaaggagaaaggaaagaaaaacctagtttcactcctccccttcttccatgtctcctcagggtcctgcagttctgagcttgggttccctttgcctggacaccaaccaagcccccaactggactggacttcagaccctcctgcagcaactccctccgcaggacattgatgagcgctactgcctggcccttggggaggaggagcgggccgagctgcagctcttctgtgccaggcggaagcaggaagccctgggacagggggtagcccgcctggtacttcccaagcttgaaggacacacctgtgagaagtgtagggagttgctgaagccaggggagtacggagtgtttgcagcccgggcaggggaacagcgctgctggcaccagccttgctttgcctgccaggcctgtggccaggccctgataaacctcatctacttctaccatgatggacaactctactgcggccgtcatcatgcagagttgctgcgcccgcgctgcccggcttgtgaccagctgatcttctcctggcgctgcaccgaggcggagggacagcgctggcatgagaaccacttctgttgccaggactgcgccgggcctctgggcgggggacgttatgccctgcctgggggaagcccctgctgccccagctgcttcgagaaccgctactcggatgcaggctcgagctgggccggggcactggaagggcaggcattccttggagcgcccccaccgcaccccccagacccaagcctcggggcccgcagctctcaccgcgcatccctggccggagcgttccaagggccgcccgaacccaccccgcgccgcggtcggggttgcggcgccagactccctcccaggcgcgggaggcggacgccctctggtggaggcgggggaccctggcgaggactctcggcggcggcggcggcgcgcacggcccaggggctgggcggggcgggaggctgggcctcacccccactagctgcggtgtaggtccagctccgcggctctgagaccagcgtttccgacccggcccggaacaggggagactggactcgaccgaactgaaggaagggaccaaacctcggtgaactctgcaaccctctcccgaacactccttctcgctgctgccggcggttccagcctgcaaactcagagggggctgcctggatccagtccccagcaggagaaccgacctggggacaaagcggaggcacccaaagggcaggagcaatgccgcctggagactattcgtgatcccaaggacacccctttctccacctgctcctcctcctctgactcggaacctgaaggatttttcttaggcgagcgccttccccagtcctggaagacccccggaagcctccaagcagaggacagcaacgcctctaagacgcactgcaccatgtgctagtggcgcagctcagagaggggatgtgagtgggaggaaaggggtctgtaaagcgggagaacaaggctagcctccccctaacaatcctagactgagacgcagtcaggcgcacgcccgcaagaggcggcgaggtgacaagtttggagtgcgcccccttcagtactgcgcgttctaagacttttggcggagactttcttggcaaaacccattccccaaagctacgcttcccctgctgagatagcccctacccccacctccacaggctgggacagccccgtccccaccatcctcctcccaagccaattaaatgatcacagcacgcgtgacagttaccggctggagagccggaggtgggaccgggagcaggggaccgtagaaccgggccgcgctcctcccctcctagagttcgtggaggcgcagcagagggccgtccctcttccggatgtcggactaagcgaacagcgcccccactgccggccggtagcagccggaagtgccagaccggaggtgcgtcattcaccggcgacgccgatacggttcctccaccgaggcccatgcgaagctttccactatggcttccagcactgtcccggtgagcgctgctggctcggctaatgaaactcccgaaataccggacaacgtgggagattggcttcggggcgtctaccgctttgccactgataggaatgacttccggaggaacttgatactaaatttgggactctttgctgcgggagtttggctggccaggaacttgagtgacattgacctcatggcacctcagccaggggtgtagccaagtagacaaatggaatcctgtgctgaacccgaatcttccaaaaaacagcctacaatctgtgaccaccacaagatgtgccctgatggcagctgaagtttgattcagatgggcacttttcttccccttccctgcctagtttccttttgttccttgagtccacgcagaattccattctctggtcagcagacaggcttaagctaaagtattgcctctattctgtaaagttctgtacatagttcccaagcttctgcagggggtgatttttgctcttgtcctgagaaataacagtgctgttttaaaaaacatttgaaataaataccgcacacaaaggc

SEQ ID NO: 418030 - DNA, 1772 bp, Homo sapiens
ggctaggtacgaggctgggtgtgaatcggccgagggttgctgcgcccgcgctgccggcttgtgaccagctgatcttctcctggcgctgcaccgaggcggagggacagcgctggcatgagaaccacttctgttgccaggactgcgccgggcctctgggcgggggacgttatgccctgcctgggggaagcccctgctgccccagctgcttcgagaaccgctactcggatgcaggctcgagctgggccggggcactggaagggcaggcattccttggggagactggactcgaccgaactgaaggaagggaccaaacctcggtgaactctgcaaccctctcccgaacactccttctcgctgctgccggcggttccagcctgcaaactcagagggggctgcctggatccagtccccagcaggagaaccgacctggggacaaagcggaggcacccaaagggcaggagcaatgccgcctggagactattcgtgatcccaaggacacccctttctccacctgctcctcctcctctgactcggaacctgaaggatttttcttaggcgagcgccttccccagtcctggaagacccccggaagcctccaagcagaggacagcaacgcctctaagacgcactgcaccatgtgctagtggcgcagctcagagaggggatgtgagtgggaggaaaggggtctgtaaagcgggagaacaaggctagcctccccctaacaatcctagactgagacgcagtcaggcgcacgcccgcaagaggcggcgaggtgacaagtttggagtgcgcccccttcagtactgcgcgttctaagacttttggcggagactttcttggcaaaacccattccccaaagctacgcttcccctgctgagatagcccctacccccacctccacaggctgggacagccccgtccccaccatcctcctcccaagccaattaaatgatcacagcacgcgtgacagttaccggctggagagccggaggtgggaccgggagcaggggaccgtagaaccgggccgcgctcctcccctcctagagttcgtggaggcgcagcagagggccgtccctcttccggatgtcggactaagcgaacagcgcccccactgccggccggtagcagccggaagtgccagaccggaggtgcgtcattcaccggcgacgccgatacggttcctccaccgaggcccatgcgaagctttccactatggcttccagcactgtcccggtgagcgctgctggctcggctaatgaaactcccgaaataccggacaacgtgggagattggcttcggggcgtctaccgctttgccactgataggaatgacttccggaggaacttgatactaaatttgggactctttgctgcgggagtttggctggccaggaacttgagtgacattgacctcatggcacctcagccaggggtgtagccaagtagacaaatggaatcctgtgctgaacccgaatcttccaaaaaacagcctacaatctgtgaccaccacaagatgtgccctgatggcagctgaagtttgattcagatgggcacttttcttccccttccctgcctagtttccttttgttccttgagtccacgcagaattccattctctggtcagcagacaggcttaagctaaagtattgcctctattctgtaaagttctgtacatagttcccaagcttctgcagggggtgatttttgctcttgtcctgagaaataacagtgctgttttaaaaaacatttgaaataaataccgcacacaaaggc

SEQ ID NO: 418031 - DNA, 6301 bp, Homo sapiens
gggagggggaagggaattatggaaggaatccagctggcctgttagtaagggtgttccagtgctaggtggaggtggagtttggctgcctttggggagattggaagggtgaggaatagaggcctgatttctgagtgttgtttctgtgttggacaattctatgcaaactagagccaaaatggaagagggtgcaagtcccctcctggggccccagacgccccctcctttcttgctgcctggagcaggggcagtgctgttagtggctactcctggtgtgaacagcccatcctggccaccttccacaggaaacctgacctgaaggacagaagaggaaggaagcaggctttgccacaaatgtcagtgcagaactctggctggccccaccaagaagacagccccaagccccaggatccaggtccaccagccaactcagacagtgactcaggccacctgccgggggaggaccctgaggatacccatgctcagggtcctgcagttctgagcttgggttccctttgcctggacaccaaccaagcccccaactggactggacttcagaccctcctgcagcaactccctccgcaggacattgatgagcgctactgcctggcccttggggaggaggagcgggccgagctgcagctcttctgtgccaggcggaagcaggaagccctgggacagggggtagcccgcctggtacttcccaagcttgaaggacacacctgtgagaagtgtagggagttgctgaagccaggggagtacggagtgtttgcagcccgggcaggggaacagcgctgctggcaccagccttgctttgcctgccaggcctgtggccaggccctgataaacctcatctacttctaccatgatggacaactctactgcggccgtcatcatgcagagttgctgcgcccgcgctgcccggcttgtgaccagctgatcttctcctggcgctgcaccgaggcggagggacagcgctggcatgagaaccacttctgttgccaggactgcgccgggcctctgggcgggggacgttatgccctgcctgggggaagcccctgctgccccagctgcttcgagaaccgctactcggatgcaggctcgagctgggccggggcactggaagggcaggcattccttggagcgcccccaccgcaccccccagacccaagcctcggggcccgcagctctcaccgcgcatccctggccggagcgttccaagggccgcccgaacccaccccgcgccgcggtcggggttgcggcgccagactccctcccaggcgcgggaggcggacgccctctggtggaggcgggggaccctggcgaggactctcggcggcggcggcggcgcgcacggcccaggggctgggcggggcgggaggctgggcctcacccccactagctgcggtgtaggtccagctccgcggctctgagaccagcgtttccgacccggcccggaacaggggagactggactcgaccgaactgaaggaagggaccaaacctcggtgaactctgcaaccctctcccgaacactccttctcgctgctgccggcggttccagcctgcaaactcagagggggctgcctggatccagtccccagcaggagaaccgacctggggacaaagcggaggcacccaaagggcaggagcaatgccgcctggagactattcgtgatcccaaggacacccctttctccacctgctcctcctcctctgactcggaacctgaaggatttttcttaggcgagcgccttccccagtcctggaagacccccggaagcctccaagcagaggacagcaacgcctctaagacgcactgcaccatgtgctagtggcgcagctcagagaggggatgtgagtgggaggaaaggggtctgtaaagcgggagaacaaggctagcctccccctaacaatcctagactgagacgcagtcaggcgcacgcccgcaagaggcggcgaggtgacaagtttggagtgcgcccccttcagtactgcgcgttctaagacttttggcggagactttcttggcaaaacccattccccaaagctacgcttcccctgctgagatagcccctacccccacctccacaggctgggacagccccgtccccaccatcctcctcccaagccaattaaatgatcacagcacgcgtgacagttaccggctggagagccggaggtgggaccgggagcaggggaccgtagaaccgggccgcgctcctcccctcctagagttcgtggaggcgcagcagagggccgtccctcttccggatgtcggactaagcgaacagcgcccccactgccggccggtagcagccggaagtgccagaccggaggtgcgtcattcaccggcgacgccgatacggttcctccaccgaggcccatgcgaagctttccactatggcttccagcactgtcccggtgagcgctgctggctcggctaatgaaactcccgaaataccggacaacgtgggagattggcttcggggcgtctaccgctttgccactgataggaatgacttccggaggaacttgatactaaatttgggactctttgctgcgggagtttggctggccaggaacttgagtgacattgacctcatggcacctcagccaggggtgtagccaagtagacaaatggaatcctgtgctgaacccgaatcttccaaaaaacagcctacaatctgtgaccaccacaagatgtgccctgatggcagctgaagtttgattcagatgggcacttttcttccccttccctgcctagtttccttttgttccttgagtccacgcagaattccattctctggtcagcagacaggcttaagctaaagtattgcctctattctgtaaagttctgtacatagttcccaagcttctgcagggggtgatttttgctcttgtcctgagaaataacagtgctgttttaaaaaacatttgaaataaataccgcacacaaaggcagtcattttattcttttaataagaaacttttgcttacaaaaacaaggtgtaaaaagatttacaaaaatcataaaaacatgatttatatttcacacttgagagacaaaaacaagccccaaaacatggattttaatggaggtggtttgcttcattttaaaagggaaaaaaaaaaaaggaagctgtaaccatacattgatgttaacctagcatgaagtttattcttgaagaatttacattgttgagcaatattaggggaagaagccatttggtgttgcatagcattttagtgcaccagatgggttttccagacaccagggaggcatcattgctggaatagtgaggtttggtggcagaaagagggcagtgatgtgtagggggaggcaaagtgaagtaagcctgggcagtggtcactaaagtgacactgctgaggcagctgcttccttcagaaggaaatgttttgtgaccctaaaattcatggtagtgctactgtccagggtttgggggctctttggaaatggagtatgtacggaactggcatgtatagacttatatagccatagaaagaggtggatagaaacaggtccaccatggcaatatttttttctggccagtttactaggcattaaaaaaaatactgcttttatgtgccaagtctcttatggaactagtatgggattaaaggacgttaattggaaaggagggtcagtatataaggaccacagtggcctgttaaggatgacagatgtctctagcagtttgttcactactaaagttaaacaggacaaaatagtctttcctgaccttgctggcataaatattaagaaaattgtttgagaattagatttttttagtatgtatataaaaacagcaccattctttgtataaatcagatagatcttatctgatagatgaagctaagaccctttgagtctacactgggttgactctgagaggtttatatcttattgggtattaagataaagaagggtcacatgagagcaaagcttagctttgaagccatcacctcccaaatggtgaccaaggaggaaacttttaagccatagtatagatgctaacccccatttagacctgcatcagatcacttgctaagacaagaaataccagcacctcctgttctttataggaatgaaacttagatccttaaaggctgctacctgatatactcatgactggacagttttgataaaaacttccaaaattgaaaatcaaaatccagcaagaattaagacatggcagcttccaaaagcataattcaaatttcattcaaaatttactgttttggcttcaagtaagtgtttactgttggttgggttttaaagccataattatggttgagtaaggattcatttatttatttattaaatttttatacatttttgaaaagatttcaaatctatgtttcccaggctggtcttgagctcctggcctcaagcaatcctcccaccttggcctcccaaagtgttgggattacaggtgctagccaactgcatccagccaatgtttcatttcaactggcttaaatcttcaaagtggttaagaatttagtaaataaaactacttaatctacaactttcaaaaattgatgagtaatcactaattctgtaaatgaaggagttggacttcactattgccaaagcaacattttccccaaggaaagtcaatttgatatcctgtcacacttttcagccctggctagttaacacagtactatgaaaatctttagctagattttaaacgaaatatgccagcagaagtatggaatgagtccacaaaaatgagtgcctgccacaatgctatagtagctatggtgtatttagtgcagagtgtgggatgaataagtacatagtaattaaagtcatagtcctggcccaacagaacagttactaaatgtaagatacaaactaaactcacagtcatatttagaaggcgcttttcagctttagcactgacttaaaaagtctgaaccaccaggaagatgcgtacttaactggttaaaaaattaagtggccctggaaagttttaccccaaagatacaacttcttcacttatttagttcagtaatgaggctgagggacccaattttcaagtgtgcatttgagtgggaaacttttaaacaccatatgttgaagtttcatgagctcagtggaaaccttaaggtcagagtaaaagaaactggctgtaaacagccctgcagtgaagagactgggtcttagcaccttccacattcactcagcgccatctcagtcagcgcctgccagggaaagggcatggagagctgggacgggtgccttctcttttgcaccactccctttgcatattacacagtgcactggcttgccttacaatctaaggttcacatacagggggttttctatactgcttccggacattttttgcaaaagaacatcagaaccaatgaaggtaccatttcaggaggaatcatttttgtttgacttctgctatatgttgcccagcattagtcattgttttgataaagactaaaaggccttttctcaacatttgtgctctcccaaccacctgggaaagcaacccttccactcacaagaggtaacctcagatagggatatagtattcatttaagaaggggtagcccccccagcctgatttaaaaaggcccaagtcaatgtatggaacatgacaagggaagtgaaaaacaatggagtacacagtctgccttgaaaagcagccatttgatgaacagtcacaaatacaaagaatttggacattgtaacataatttcagaacttgctggtaagaataatttgcattcacacacaagagacatgaaatgctttttaaaagtctgtgataccagatgtcctttaaacactacacagacccatttgccacttgaaatgacaagaagaaatcctttcccttaatcttttcaattccatgcaaaccgtaattgagtacaaggcaccaaattttatgaattgtataaaattagttcacaaagctttatcagtaagtagaacaaactccatttctccctcccggccagcccaccctcctcccacccaccacccgccatccccgaccaagttttcattctgcactactgtcgacctctctagggcttatgctggggcatgccccactgtcagccaatccacctcattggttcttcccttgtacttggatgaagctgtaagcacagccagagtagcaaactcatacaatcattgactctagaagccttgccattaaaaacaaaaataaactctgctattgagtccataggacacattaacacttctacagtttccaattttattcatgacattttaagagacatct

SEQ ID NO: 418032 - DNA, 6338 bp, Homo sapiens
gggagggggaagggaattatggaaggaatccagctggcctgttagtaagggtgttccagtgctaggtggaggtggagtttggctgcctttggggagattggaagggtgaggaatagaggcctgatttctgagtgttgtttctgtgttggacaattctatgcaaactagagccaaaatggaagagggtgcaagtcccctcctggggccccagacgccccctcctttcttgctgcctggagcaggggcagtgctgttagtggctactcctggtgtgaacagcccatcctggccaccttccacaggaaacctgacctgaaggacagaagaggaaggaagcaggctttgccacaaatgtcagtgcagaactctggctggccccaccaagaagacagccccaagccccaggatccaggtccaccagccaactcagacagtgactcaggccacctgccgggggaggaccctgaggatacccatgctcagggtcctgcagttctgagcttgggttccctttgcctggacaccaaccaagcccccaactggactggacttcagaccctcctgcagcaactccctccgcaggacattgatgagcgctactgcctggcccttggggaggaggagcgggccgagctgcagctcttctgtgccaggcggaagcaggaagccctgggacagggggtagcccgcctggtacttcccaagcttgaaggacacacctgtgagaagtgtagggagttgctgaagccaggggagtacggagtgtttgcagcccgggcaggggaacagcgctgctggcaccagccttgctttgcctgccaggcctgtggccaggccctgataaacctcatctacttctaccatgatggacaactctactgcggccgtcatcatgcagagttgctgcgcccgcgctgcccggcttgtgaccagctgatcttctcctggcgctgcaccgaggcggagggacagcgctggcatgagaaccacttctgttgccaggactgcgccgggcctctgggcgggggacgttatgccctgcctgggggaagcccctgctgccccagctgcttcgagaaccgctactcggatgcaggctcgagctgggccggggcactggaagggcaggcattccttggagcgcccccaccgcaccccccagacccaagcctcggggcccgcagctctcaccgcgcatccctggccggagcgttccaagggccgcccgaacccaccccgcgccgcggtcggggttgcggcgccagactccctcccaggcgcgggaggcggacgccctctggtggaggcgggggaccctggcgaggactctcggcggcggcggcggcgcgcacggcccaggggctgggcggggcgggaggctgggcctcacccccactagctgcggtgtaggtccagctccgcggctctgagaccagcgtttccgacccggcccggaacaggggagactggactcgaccgaactgaaggaagggaccaaacctcggtgaactctgcaaccctctcccgaacactccttctcgctgctgccggcggttccagcctgcaaactcagagggggctgcctggatccagtccccagcaggagaaccgacctggggacaaagcggaggcacccaaagggcaggagcaatgccgcctggagactattcgtgatcccaaggacacccctttctccacctgctcctcctcctctgactcggaacctgaaggatttttcttaggcgagcgccttccccagtcctggaagacccccggaagcctccaagcagaggacagcaacgcctctaagacgcactgcaccatgtgctagtggcgcagctcagagaggggatgtgagtgggaggaaaggggtctgtaaagcgggagaacaaggctagcctccccctaacaatcctagactgagacgcagtcaggcgcacgcccgcaagaggcggcgaggtgacaagtttggagtgcgcccccttcagtactgcgcgttctaagacttttggcggagactttcttggcaaaacccattccccaaagctacgcttcccctgctgagatagcccctacccccacctccacaggctgggacagccccgtccccaccatcctcctcccaagccaattaaatgatcacagcacgcgtgacagttaccggctggagagccggaggtgggaccgggagcaggggaccgtagaaccgggccgcgctcctcccctcctagagttcgtggaggcgcagcagagggccgtccctcttccggatgtcggactaagcgaacagcgcccccactgccggccggtagcagccggaagtgccagaccggaggtgcgtcattcaccggcgacgccgatacggttcctccaccgaggcccatgcgaagctttccactatggcttccagcactgtcccggtgagcgctgctggctcggctaatgaaactcccgaaataccggacaacgtgggagattggcttcggggcgtctaccgctttgccactgataggaatgacttccggaggaacttgatactaaatttgggactctttgctgcgggagtttggctggccaggaacttgagtgacattgacctcatggcacctcagccaggggtgtagccaagtagttctaatgccacctgtcgtcttatcatctgattgcagacaaatggaatcctgtgctgaacccgaatcttccaaaaaacagcctacaatctgtgaccaccacaagatgtgccctgatggcagctgaagtttgattcagatgggcacttttcttccccttccctgcctagtttccttttgttccttgagtccacgcagaattccattctctggtcagcagacaggcttaagctaaagtattgcctctattctgtaaagttctgtacatagttcccaagcttctgcagggggtgatttttgctcttgtcctgagaaataacagtgctgttttaaaaaacatttgaaataaataccgcacacaaaggcagtcattttattcttttaataagaaacttttgcttacaaaaacaaggtgtaaaaagatttacaaaaatcataaaaacatgatttatatttcacacttgagagacaaaaacaagccccaaaacatggattttaatggaggtggtttgcttcattttaaaagggaaaaaaaaaaaaggaagctgtaaccatacattgatgttaacctagcatgaagtttattcttgaagaatttacattgttgagcaatattaggggaagaagccatttggtgttgcatagcattttagtgcaccagatgggttttccagacaccagggaggcatcattgctggaatagtgaggtttggtggcagaaagagggcagtgatgtgtagggggaggcaaagtgaagtaagcctgggcagtggtcactaaagtgacactgctgaggcagctgcttccttcagaaggaaatgttttgtgaccctaaaattcatggtagtgctactgtccagggtttgggggctctttggaaatggagtatgtacggaactggcatgtatagacttatatagccatagaaagaggtggatagaaacaggtccaccatggcaatatttttttctggccagtttactaggcattaaaaaaaatactgcttttatgtgccaagtctcttatggaactagtatgggattaaaggacgttaattggaaaggagggtcagtatataaggaccacagtggcctgttaaggatgacagatgtctctagcagtttgttcactactaaagttaaacaggacaaaatagtctttcctgaccttgctggcataaatattaagaaaattgtttgagaattagatttttttagtatgtatataaaaacagcaccattctttgtataaatcagatagatcttatctgatagatgaagctaagaccctttgagtctacactgggttgactctgagaggtttatatcttattgggtattaagataaagaagggtcacatgagagcaaagcttagctttgaagccatcacctcccaaatggtgaccaaggaggaaacttttaagccatagtatagatgctaacccccatttagacctgcatcagatcacttgctaagacaagaaataccagcacctcctgttctttataggaatgaaacttagatccttaaaggctgctacctgatatactcatgactggacagttttgataaaaacttccaaaattgaaaatcaaaatccagcaagaattaagacatggcagcttccaaaagcataattcaaatttcattcaaaatttactgttttggcttcaagtaagtgtttactgttggttgggttttaaagccataattatggttgagtaaggattcatttatttatttattaaatttttatacatttttgaaaagatttcaaatctatgtttcccaggctggtcttgagctcctggcctcaagcaatcctcccaccttggcctcccaaagtgttgggattacaggtgctagccaactgcatccagccaatgtttcatttcaactggcttaaatcttcaaagtggttaagaatttagtaaataaaactacttaatctacaactttcaaaaattgatgagtaatcactaattctgtaaatgaaggagttggacttcactattgccaaagcaacattttccccaaggaaagtcaatttgatatcctgtcacacttttcagccctggctagttaacacagtactatgaaaatctttagctagattttaaacgaaatatgccagcagaagtatggaatgagtccacaaaaatgagtgcctgccacaatgctatagtagctatggtgtatttagtgcagagtgtgggatgaataagtacatagtaattaaagtcatagtcctggcccaacagaacagttactaaatgtaagatacaaactaaactcacagtcatatttagaaggcgcttttcagctttagcactgacttaaaaagtctgaaccaccaggaagatgcgtacttaactggttaaaaaattaagtggccctggaaagttttaccccaaagatacaacttcttcacttatttagttcagtaatgaggctgagggacccaattttcaagtgtgcatttgagtgggaaacttttaaacaccatatgttgaagtttcatgagctcagtggaaaccttaaggtcagagtaaaagaaactggctgtaaacagccctgcagtgaagagactgggtcttagcaccttccacattcactcagcgccatctcagtcagcgcctgccagggaaagggcatggagagctgggacgggtgccttctcttttgcaccactccctttgcatattacacagtgcactggcttgccttacaatctaaggttcacatacagggggttttctatactgcttccggacattttttgcaaaagaacatcagaaccaatgaaggtaccatttcaggaggaatcatttttgtttgacttctgctatatgttgcccagcattagtcattgttttgataaagactaaaaggccttttctcaacatttgtgctctcccaaccacctgggaaagcaacccttccactcacaagaggtaacctcagatagggatatagtattcatttaagaaggggtagcccccccagcctgatttaaaaaggcccaagtcaatgtatggaacatgacaagggaagtgaaaaacaatggagtacacagtctgccttgaaaagcagccatttgatgaacagtcacaaatacaaagaatttggacattgtaacataatttcagaacttgctggtaagaataatttgcattcacacacaagagacatgaaatgctttttaaaagtctgtgataccagatgtcctttaaacactacacagacccatttgccacttgaaatgacaagaagaaatcctttcccttaatcttttcaattccatgcaaaccgtaattgagtacaaggcaccaaattttatgaattgtataaaattagttcacaaagctttatcagtaagtagaacaaactccatttctccctcccggccagcccaccctcctcccacccaccacccgccatccccgaccaagttttcattctgcactactgtcgacctctctagggcttatgctggggcatgccccactgtcagccaatccacctcattggttcttcccttgtacttggatgaagctgtaagcacagccagagtagcaaactcatacaatcattgactctagaagccttgccattaaaaacaaaaataaactctgctattgagtccataggacacattaacacttctacagtttccaattttattcatgacattttaagagacatct

SEQ ID NO: 418033 - DNA, 3135 bp, Homo sapiens
gggagggggaagggaattatggaaggaatccagctggcctgttagtaagggtgttccagtgctaggtggaggtggagtttggctgcctttggggagattggaagggtgaggaatagaggcctgatttctgagtgttgtttctgtgttggacaattctatgcaaactagagccaaaatggaagagggtgcaagtcccctcctggggccccagacgccccctcctttcttgctgcctggagcaggggcagtgctgttagtggctactcctggtgtgaacagcccatcctggccaccttccacaggaaacctgacctgaaggacagaagaggaaggaagcaggctttgccacaaatgtcagtgcagaactctggctggccccaccaagaagacagccccaagccccaggatccaggtccaccagccaactcagacagtgactcaggccacctgccgggggaggaccctgaggatacccatgctcagggtcctgcagttctgagcttgggttccctttgcctggacaccaaccaagcccccaactggactggacttcagaccctcctgcagcaactccctccgcaggacattgatgagcgctactgcctggcccttggggaggaggagcgggccgagctgcagctcttctgtgccaggcggaagcaggaagccctgggacagggggtagcccgcctggtacttcccaagcttgaaggacacacctgtgagaagtgtagggagttgctgaagccaggggagtacggagtgtttgcagcccgggcaggggaacagcgctgctggcaccagccttgctttgcctgccaggcctgtggccaggccctgataaacctcatctacttctaccatgatggacaactctactgcggccgtcatcatgcagagttgctgcgcccgcgctgcccggcttgtgaccagctgatcttctcctggcgctgcaccgaggcggagggacagcgctggcatgagaaccacttctgttgccaggactgcgccgggcctctgggcgggggacgttatgccctgcctgggggaagcccctgctgccccagctgcttcgagaaccgctactcggatgcaggctcgagctgggccggggcactggaagggcaggcattccttggagcgcccccaccgcaccccccagacccaagcctcggggcccgcagctctcaccgcgcatccctggccggagcgttccaagggccgcccgaacccaccccgcgccgcggtcggggttgcggcgccagactccctcccaggcgcgggaggcggacgccctctggtggaggcgggggaccctggcgaggactctcggcggcggcggcggcgcgcacggcccaggggctgggcggggcgggaggctgggcctcacccccactagctgcggtgtaggtccagctccgcggctctgagaccagcgtttccgacccggcccggaacaggggagactggactcgaccgaactgaaggaagggaccaaacctcggtgaactctgcaaccctctcccgaacactccttctcgctgctgccggcggttccagcctgcaaactcagagggggctgcctggatccagtccccagcaggagaaccgacctggggacaaagcggaggcacccaaagggcaggagcaatgccgcctggagactattcgtgatcccaaggacacccctttctccacctgctcctcctcctctgactcggaacctgaaggatttttcttaggcgagcgccttccccagtcctggaagacccccggaagcctccaagcagaggacagcaacgcctctaagacgcactgcaccatgtgctagtggcgcagctcagagaggggatgtgagtgggaggaaaggggtctgtaaagcgggagaacaaggctagcctccccctaacaatcctagactgagacgcagtcaggcgcacgcccgcaagaggcggcgaggtgacaagtttggagtgcgcccccttcagtactgcgcgttctaagacttttggcggagactttcttggcaaaacccattccccaaagctacgcttcccctgctgagatagcccctacccccacctccacaggctgggacagccccgtccccaccatcctcctcccaagccaattaaatgatcacagcacgcgtgacagttaccggctggagagccggaggtgggaccgggagcaggggaccgtagaaccgggccgcgctcctcccctcctagagttcgtggaggcgcagcagagggccgtccctcttccggatgtcggactaagcgaacagcgcccccactgccggccggtagcagccggaagtgccagaccggaggtgcgtcattcaccggcgacgccgatacggttcctccaccgaggcccatgcgaagctttccactatggcttccagcactgtcccggtgagcgctgctggctcggctaatgaaactcccgaaataccggacaacgtgggagattggcttcggggcgtctaccgctttgccactgataggaatgacttccggaggaacttgatactaaatttgggactctttgctgcgggagtttggctggccaggaacttgagtgacattgacctcatggcacctcagccaggggtgtagccaagtagacaaatggaatcctgtgctgaacccgaatcttccaaaaaacagcctacaatctgtgaccaccacaagatgtgccctgatggcagctgaagtttgattcagatgggcacttttcttccccttccctgcctagtttccttttgttccttgagtccacgcagaattccattctctggtcagcagacaggcttaagctaaagtattgcctctattctgtaaagttctgtacatagttcccaagcttctgcagggggtgatttttgctcttgtcctgagaaataacagtgctgttttaaaaaacatttgaaataaataccgcacacaaaggcaaaaaaaaaaaaaaaaaaaacctccggggcttcttttccgggggcgggaaaaggggttcttgaatggcccctgtggccttagttttcctggcccccgttttttgtccagggggaaatcggcgggcccccaaagggggccgttaaattccggaaaggccggtacctgtaaccgccaa

SEQ ID NO: 418034 - DNA, 3083 bp, Homo sapiens
gggagggggaagggaattatggaaggaatccagctggcctgttagtaagggtgttccagtgctaggtggaggtggagtttggctgcctttggggagattggaagggtgaggaatagaggcctgatttctgagtgttgtttctgtgttggacaattctatgcaaactagagccaaaatggaagagggtgcaagtcccctcctggggccccagacgccccctcctttcttgctgcctggagcaggggcagtgctgttagtggctactcctggtgtgaacagcccatcctggccaccttccacaggaaacctgacctgaaggacagaagaggaaggaagcaggctttgccacaaatgtcagtgcagaactctggctggccccaccaagaagacagccccaagccccaggatccaggtccaccagccaactcagacagtgactcaggccacctgccgggggaggaccctgaggatacccatgctcagggtcctgcagttctgagcttgggttccctttgcctggacaccaaccaagcccccaactggactggacttcagaccctcctgcagcaactccctccgcaggacattgatgagcgctactgcctggcccttggggaggaggagcgggccgagctgcagctcttctgtgccaggcggaagcaggaagccctgggacagggggtagcccgcctggtacttcccaagcttgaaggacacacctgtgagaagtgtagggagttgctgaagccaggggagtacggagtgtttgcagcccgggcaggggaacagcgctgctggcaccagccttgctttgcctgccaggcctgtggccaggccctgataaacctcatctacttctaccatgatggacaactctactgcggccgtcatcatgcagagttgctgcgcccgcgctgcccggcttgtgaccagctgatcttctcctggcgctgcaccgaggcggagggacagcgctggcatgagaaccacttctgttgccaggactgcgccgggcctctgggcgggggacgttatgccctgcctgggggaagcccctgctgccccagctgcttcgagaaccgctactcggatgcaggctcgagctgggccggggcactggaagggcaggcattccttggagcgcccccaccgcaccccccagacccaagcctcggggcccgcagctctcaccgcgcatccctggccggagcgttccaagggccgcccgaacccaccccgcgccgcggtcggggttgcggcgccagactccctcccaggcgcgggaggcggacgccctctggtggaggcgggggaccctggcgaggactctcggcggcggcggcggcgcgcacggcccaggggctgggcggggcgggaggctgggcctcacccccactagctgcggtgtaggtccagctccgcggctctgagaccagcgtttccgacccggcccggaacaggggagactggactcgaccgaactgaaggaagggaccaaacctcggtgaactctgcaaccctctcccgaacactccttctcgctgctgccggcggttccagcctgcaaactcagagggggctgcctggatccagtccccagcaggagaaccgacctggggacaaagcggaggcacccaaagggcaggagcaatgccgcctggagactattcgtgatcccaaggacacccctttctccacctgctcctcctcctctgactcggaacctgaaggatttttcttaggcgagcgccttccccagtcctggaagacccccggaagcctccaagcagaggacagcaacgcctctaagacgcactgcaccatgtgctagtggcgcagctcagagaggggatgtgagtgggaggaaaggggtctgtaaagcgggagaacaaggctagcctccccctaacaatcctagactgagacgcagtcaggcgcacgcccgcaagaggcggcgaggtgacaagtttggagtgcgcccccttcagtactgcgcgttctaagacttttggcggagactttcttggcaaaacccattccccaaagctacgcttcccctgctgagatagcccctacccccacctccacaggctgggacagccccgtccccaccatcctcctcccaagccaattaaatgatcacagcacgcgtgacagttaccggctggagagccggaggtgggaccgggagcaggggaccgtagaaccgggccgcgctcctcccctcctagagttcgtggaggcgcagcagagggccgtccctcttccggatgtcggactaagcgaacagcgcccccactgccggccggtagcagccggaagtgccagaccggaggtgcgtcattcaccggcgacgccgatacggttcctccaccgaggcccatgcgaagctttccactatggcttccagcactgtcccggtgagcgctgctggctcggctaatgaaactcccgaaataccggacaacgtgggagattggcttcggggcgtctaccgctttgccactgataggaatgacttccggaggaacttgatactaaatttgggactctttgctgcgggagtttggctggccaggaacttgagtgacattgacctcatggcacctcagccaggggtgtagccaagtagacaaatggaatcctgtgctgaacccgaatcttccaaaaaacagcctacaatctgtgaccaccacaagatgtgccctgatggcagctgaagtttgattcagatgggcacttttcttccccttccctgcctagtttccttttgttccttgagtccacgcagaattccattctctggtcagcagacaggcttaagctaaagtattgcctctattctgtaaagttctgtacatagttcccaagcttctgcagggggtgatttttgctcttgtcctgagaaataacagtgctgttttaaaaaacatttgaaataaataccgcacacaaaggcaaaaatatacgagcaagcttatcatgcggccggatttcggcttacttgcgcaattcgccttatagtgggccgattacaattcactggccgggggtttacaaggtgtgaattgggaaaccctggg

SEQ ID NO: 418035 - DNA, 3093 bp, Homo sapiens
  misc_feature (2907)..(2907): n is a, c, g, or t
gggagggggaagggaattatggaaggaatccagctggcctgttagtaagggtgttccagtgctaggtggaggtggagtttggctgcctttggggagattggaagggtgaggaatagaggcctgatttctgagtgttgtttctgtgttggacaattctatgcaaactagagccaaaatggaagagggtgcaagtcccctcctggggccccagacgccccctcctttcttgctgcctggagcaggggcagtgctgttagtggctactcctggtgtgaacagcccatcctggccaccttccacaggaaacctgacctgaaggacagaagaggaaggaagcaggctttgccacaaatgtcagtgcagaactctggctggccccaccaagaagacagccccaagccccaggatccaggtccaccagccaactcagacagtgactcaggccacctgccgggggaggaccctgaggatacccatgctcagggtcctgcagttctgagcttgggttccctttgcctggacaccaaccaagcccccaactggactggacttcagaccctcctgcagcaactccctccgcaggacattgatgagcgctactgcctggcccttggggaggaggagcgggccgagctgcagctcttctgtgccaggcggaagcaggaagccctgggacagggggtagcccgcctggtacttcccaagcttgaaggacacacctgtgagaagtgtagggagttgctgaagccaggggagtacggagtgtttgcagcccgggcaggggaacagcgctgctggcaccagccttgctttgcctgccaggcctgtggccaggccctgataaacctcatctacttctaccatgatggacaactctactgcggccgtcatcatgcagagttgctgcgcccgcgctgcccggcttgtgaccagctgatcttctcctggcgctgcaccgaggcggagggacagcgctggcatgagaaccacttctgttgccaggactgcgccgggcctctgggcgggggacgttatgccctgcctgggggaagcccctgctgccccagctgcttcgagaaccgctactcggatgcaggctcgagctgggccggggcactggaagggcaggcattccttggagcgcccccaccgcaccccccagacccaagcctcggggcccgcagctctcaccgcgcatccctggccggagcgttccaagggccgcccgaacccaccccgcgccgcggtcggggttgcggcgccagactccctcccaggcgcgggaggcggacgccctctggtggaggcgggggaccctggcgaggactctcggcggcggcggcggcgcgcacggcccaggggctgggcggggcgggaggctgggcctcacccccactagctgcggtgtaggtccagctccgcggctctgagaccagcgtttccgacccggcccggaacaggggagactggactcgaccgaactgaaggaagggaccaaacctcggtgaactctgcaaccctctcccgaacactccttctcgctgctgccggcggttccagcctgcaaactcagagggggctgcctggatccagtccccagcaggagaaccgacctggggacaaagcggaggcacccaaagggcaggagcaatgccgcctggagactattcgtgatcccaaggacacccctttctccacctgctcctcctcctctgactcggaacctgaaggatttttcttaggcgagcgccttccccagtcctggaagacccccggaagcctccaagcagaggacagcaacgcctctaagacgcactgcaccatgtgctagtggcgcagctcagagaggggatgtgagtgggaggaaaggggtctgtaaagcgggagaacaaggctagcctccccctaacaatcctagactgagacgcagtcaggcgcacgcccgcaagaggcggcgaggtgacaagtttggagtgcgcccccttcagtactgcgcgttctaagacttttggcggagactttcttggcaaaacccattccccaaagctacgcttcccctgctgagatagcccctacccccacctccacaggctgggacagccccgtccccaccatcctcctcccaagccaattaaatgatcacagcacgcgtgacagttaccggctggagagccggaggtgggaccgggagcaggggaccgtagaaccgggccgcgctcctcccctcctagagttcgtggaggcgcagcagagggccgtccctcttccggatgtcggactaagcgaacagcgcccccactgccggccggtagcagccggaagtgccagaccggaggtgcgtcattcaccggcgacgccgatacggttcctccaccgaggcccatgcgaagctttccactatggcttccagcactgtcccggtgagcgctgctggctcggctaatgaaactcccgaaataccggacaacgtgggagattggcttcggggcgtctaccgctttgccactgataggaatgacttccggaggaacttgatactaaatttgggactctttgctgcgggagtttggctggccaggaacttgagtgacattgacctcatggcacctcagccaggggtgtagccaagtagacaaatggaatcctgtgctgaacccgaatcttccaaaaaacagcctacaatctgtgaccaccacaagatgtgccctgatggcagctgaagtttgattcagatgggcacttttcttccccttccctgcctagtttccttttgttccttgagtccacgcagaattccattctctggtcagcagacaggcttaagctaaagtattgcctctattctgtaaagttctgtacatagttcccaagcttctgcagggggtgatttttgctcttgtccggggntgttaacaaccccggacaaaggagattggatgactgggaagcgctggcccggaacagcccctgcaactgtggggcctgcacacagcccttccacagttggcactgcaggtgcaggccaatcctttaaagaataaacaaggaagtcagctctttcactttttacaagtcggcaaaaacagactccgg

SEQ ID NO: 418036 - DNA, 6247 bp, Homo sapiens
gggagggggaagggaattatggaaggaatccagctggcctgttagtaagggtgttccagtgctaggtggaggtggagtttggctgcctttggggagattggaagggtgaggaatagaggcctgatttctgagtgttgtttctgtgttggacaattctatgcaaactagagccaaaatggaagagggtgcaagtcccctcctggggccccagacgccccctcctttcttgctgcctggagcaggggcagtgctgttagtggctactcctggtgtgaacagcccatcctggccaccttccacaggaaacctgacctgaaggacagaagaggaaggaagcaggctttgccacaaatgtcagtgcagaactctggctggccccaccaagaagacagccccaagccccaggatccaggtccaccagccaactcagacagtgactcaggccacctgccgggggaggaccctgaggatacccatgctcagggtcctgcagttctgagcttgggttccctttgcctggacaccaaccaagcccccaactggactggacttcagaccctcctgcagcaactccctccgcaggacattgatgagcgctactgcctggcccttggggaggaggagcgggccgagctgcagctcttctgtgccaggcggaagcaggaagccctgggacagggggtagcccgcctggtacttcccaagcttgaaggacacacctgtgagaagtgtagggagttgctgaagccaggggagtacggagtgtttgcagcccgggcaggggaacagcgctgctggcaccagccttgctttgcctgccaggcctgtggccaggccctgataaacctcatctacttctaccatgatggacaactctactgcggccgtcatcatgcagagttgctgcgcccgcgctgcccggcttgtgaccagctgatcttctcctggcgctgcaccgaggcggagggacagcgctggcatgagaaccacttctgttgccaggactgcgccgggcctctgggcgggggacgttatgccctgcctgggggaagcccctgctgccccagctgcttcgagaaccgctactcggatgcaggctcgagctgggccggggcactggaagggcaggcattccttggagcgcccccaccgcaccccccagacccaagcctcggggcccgcagctctcaccgcgcatccctggccggagcgttccaagggccgcccgaacccaccccgcgccgcggtcggggttgcggcgccagactccctcccaggcgcgggaggcggacgccctctggtggaggcgggggaccctggcgaggactctcggcggcggcggcggcgcgcacggcccaggggctgggcggggcgggaggctgggcctcacccccactagctgcggtgtaggtccagctccgcggctctgagaccagcgtttccgacccggcccggaacaggggagactggactcgaccgaactgaaggaagggaccaaacctcggtgaactctgcaaccctctcccgaacactccttctcgctgctgccggcggttccagcctgcaaactcagagggggctgcctggatccagtccccagcaggagaaccgacctggggacaaagcggaggcacccaaagggcaggagcaatgccgcctggagactattcgtgatcccaaggacacccctttctccacctgctcctcctcctctgactcggaacctgaaggatttttcttaggcgagcgccttccccagtcctggaagacccccggaagcctccaagcagaggacagcaacgcctctaagacgcactgcaccatgtgctagtggcgcagctcagagaggggatgtgagtgggaggaaaggggtctgtaaagcgggagaacaaggctagcctccccctaacaatcctagactgagacgcagtcaggcgcacgcccgcaagaggcggcgaggtgacaagtttggagtgcgcccccttcagtactgcgcgttctaagacttttggcggagactttcttggcaaaacccattccccaaagctacgcttcccctgctgagatagcccctacccccacctccacaggctgggacagccccgtccccaccatcctcctcccaagccaattaaatgatcacagcacgcgtgacagttaccggctggagagccggaggtgggaccgggagcaggggaccgtagaaccgggccgcgctcctcccctcctagagttcgtggaggcgcagcagagggccgtccctcttccggatgtcggactaagcgaacagcgcccccactgccggccggtagcagccggaagtgccagaccggaggtgcgtcattcaccggcgacgccgatacggttcctccaccgaggcccatgcgaagctttccactatggcttccagcactgtcccggtgagcgctgctggctcggctaatgaaactcccgaaataccggacaacgtgggagattggcttcggggcgtctaccgctttgccactgataggaatgacttccggaggaacttgatactaaatttgggactctttgctgcgggagtttggctggccaggaacttgagtgacattgacctcatggcacctcagccaggggtgtagccaagtagacaaatggaatcctgtgctgaacccgaatcttccaatttgattcagatgggcacttttcttccccttccctgcctagtttccttttgttccttgagtccacgcagaattccattctctggtcagcagacaggcttaagctaaagtattgcctctattctgtaaagttctgtacatagttcccaagcttctgcagggggtgatttttgctcttgtcctgagaaataacagtgctgttttaaaaaacatttgaaataaataccgcacacaaaggcagtcattttattcttttaataagaaacttttgcttacaaaaacaaggtgtaaaaagatttacaaaaatcataaaaacatgatttatatttcacacttgagagacaaaaacaagccccaaaacatggattttaatggaggtggtttgcttcattttaaaagggaaaaaaaaaaaaggaagctgtaaccatacattgatgttaacctagcatgaagtttattcttgaagaatttacattgttgagcaatattaggggaagaagccatttggtgttgcatagcattttagtgcaccagatgggttttccagacaccagggaggcatcattgctggaatagtgaggtttggtggcagaaagagggcagtgatgtgtagggggaggcaaagtgaagtaagcctgggcagtggtcactaaagtgacactgctgaggcagctgcttccttcagaaggaaatgttttgtgaccctaaaattcatggtagtgctactgtccagggtttgggggctctttggaaatggagtatgtacggaactggcatgtatagacttatatagccatagaaagaggtggatagaaacaggtccaccatggcaatatttttttctggccagtttactaggcattaaaaaaaatactgcttttatgtgccaagtctcttatggaactagtatgggattaaaggacgttaattggaaaggagggtcagtatataaggaccacagtggcctgttaaggatgacagatgtctctagcagtttgttcactactaaagttaaacaggacaaaatagtctttcctgaccttgctggcataaatattaagaaaattgtttgagaattagatttttttagtatgtatataaaaacagcaccattctttgtataaatcagatagatcttatctgatagatgaagctaagaccctttgagtctacactgggttgactctgagaggtttatatcttattgggtattaagataaagaagggtcacatgagagcaaagcttagctttgaagccatcacctcccaaatggtgaccaaggaggaaacttttaagccatagtatagatgctaacccccatttagacctgcatcagatcacttgctaagacaagaaataccagcacctcctgttctttataggaatgaaacttagatccttaaaggctgctacctgatatactcatgactggacagttttgataaaaacttccaaaattgaaaatcaaaatccagcaagaattaagacatggcagcttccaaaagcataattcaaatttcattcaaaatttactgttttggcttcaagtaagtgtttactgttggttgggttttaaagccataattatggttgagtaaggattcatttatttatttattaaatttttatacatttttgaaaagatttcaaatctatgtttcccaggctggtcttgagctcctggcctcaagcaatcctcccaccttggcctcccaaagtgttgggattacaggtgctagccaactgcatccagccaatgtttcatttcaactggcttaaatcttcaaagtggttaagaatttagtaaataaaactacttaatctacaactttcaaaaattgatgagtaatcactaattctgtaaatgaaggagttggacttcactattgccaaagcaacattttccccaaggaaagtcaatttgatatcctgtcacacttttcagccctggctagttaacacagtactatgaaaatctttagctagattttaaacgaaatatgccagcagaagtatggaatgagtccacaaaaatgagtgcctgccacaatgctatagtagctatggtgtatttagtgcagagtgtgggatgaataagtacatagtaattaaagtcatagtcctggcccaacagaacagttactaaatgtaagatacaaactaaactcacagtcatatttagaaggcgcttttcagctttagcactgacttaaaaagtctgaaccaccaggaagatgcgtacttaactggttaaaaaattaagtggccctggaaagttttaccccaaagatacaacttcttcacttatttagttcagtaatgaggctgagggacccaattttcaagtgtgcatttgagtgggaaacttttaaacaccatatgttgaagtttcatgagctcagtggaaaccttaaggtcagagtaaaagaaactggctgtaaacagccctgcagtgaagagactgggtcttagcaccttccacattcactcagcgccatctcagtcagcgcctgccagggaaagggcatggagagctgggacgggtgccttctcttttgcaccactccctttgcatattacacagtgcactggcttgccttacaatctaaggttcacatacagggggttttctatactgcttccggacattttttgcaaaagaacatcagaaccaatgaaggtaccatttcaggaggaatcatttttgtttgacttctgctatatgttgcccagcattagtcattgttttgataaagactaaaaggccttttctcaacatttgtgctctcccaaccacctgggaaagcaacccttccactcacaagaggtaacctcagatagggatatagtattcatttaagaaggggtagcccccccagcctgatttaaaaaggcccaagtcaatgtatggaacatgacaagggaagtgaaaaacaatggagtacacagtctgccttgaaaagcagccatttgatgaacagtcacaaatacaaagaatttggacattgtaacataatttcagaacttgctggtaagaataatttgcattcacacacaagagacatgaaatgctttttaaaagtctgtgataccagatgtcctttaaacactacacagacccatttgccacttgaaatgacaagaagaaatcctttcccttaatcttttcaattccatgcaaaccgtaattgagtacaaggcaccaaattttatgaattgtataaaattagttcacaaagctttatcagtaagtagaacaaactccatttctccctcccggccagcccaccctcctcccacccaccacccgccatccccgaccaagttttcattctgcactactgtcgacctctctagggcttatgctggggcatgccccactgtcagccaatccacctcattggttcttcccttgtacttggatgaagctgtaagcacagccagagtagcaaactcatacaatcattgactctagaagccttgccattaaaaacaaaaataaactctgctattgagtccataggacacattaacacttctacagtttccaattttattcatgacattttaagagacatct

SEQ ID NO: 418037 - DNA, 6233 bp, Homo sapiens
gggagggggaagggaattatggaaggaatccagctggcctgttagtaagggtgttccagtgctaggtggaggtggagtttggctgcctttggggagattggaagggtgaggaatagaggcctgatttctgagtgttgtttctgtgttggacaattctatgcaaactagagccaaaatggaagagggtgcaagtcccctcctggggccccagacgccccctcctttcttgctgcctggagcaggggcagtgctgttagtggctactcctggtgtgaacagcccatcctggccaccttccacaggaaacctgacctgaaggacagaagaggaaggaagcaggctttgccacaaatgtcagtgcagaactctggctggccccaccaagaagacagccccaagccccaggatccaggtccaccagccaactcagacagtgactcaggccacctgccgggggaggaccctgaggatacccatgctcagggtcctgcagttctgagcttgggttccctttgcctggacaccaaccaagcccccaactggactggacttcagaccctcctgcagcaactccctccgcaggacattgatgagcgctactgcctggcccttggggaggaggagcgggccgagctgcagctcttctgtgccaggcggaagcaggaagccctgggacagggggtagcccgcctggtacttcccaagcttgaaggacacacctgtgagaagtgtagggagttgctgaagccaggggagtacggagtgtttgcagcccgggcaggggaacagcgctgctggcaccagccttgctttgcctgccaggcctgtggccaggccctgataaacctcatctacttctaccatgatggacaactctactgcggccgtcatcatgcagagttgctgcgcccgcgctgcccggcttgtgaccagctgatcttctcctggcgctgcaccgaggcggagggacagcgctggcatgagaaccacttctgttgccaggactgcgccgggcctctgggcgggggacgttatgccctgcctgggggaagcccctgctgccccagctgcttcgagaaccgctactcggatgcaggctcgagctgggccggggcactggaagggcaggcattccttggagcgcccccaccgcaccccccagacccaagcctcggggcccgcagctctcaccgcgcatccctggccggagcgttccaagggccgcccgaacccaccccgcgccgcggtcggggttgcggcgccagactccctcccaggcgcgggaggcggacgccctctggtggaggcgggggaccctggcgaggactctcggcggcggcggcggcgcgcacggcccaggggctgggcggggcgggaggctgggcctcacccccactagctgcggtgtaggtccagctccgcggctctgagaccagcgtttccgacccggcccggaacaggggagactggactcgaccgaactgaaggaagggaccaaacctcggtgaactctgcaaccctctcccgaacactccttctcgctgctgccggcggttccagcctgcaaactcagagggggctgcctggatccagtccccagcaggagaaccgacctggggacaaagcggaggcacccaaagggcaggagcaatgccgcctggagactattcgtgatcccaaggacacccctttctccacctgctcctcctcctctgactcggaacctgaaggatttttcttaggcgagcgccttccccagtcctggaagacccccggaagcctccaagcagaggacagcaacgcctctaagacgcactgcaccatgtgctagtggcgcagctcagagaggggatgtgagtgggaggaaaggggtctgtaaagcgggagaacaaggctagcctccccctaacaatcctagactgagacgcagtcaggcgcacgcccgcaagaggcggcgaggtgacaagtttggagtgcgcccccttcagtactgcgcgttctaagacttttggcggagactttcttggcaaaacccattccccaaagctacgcttcccctgctgagatagcccctacccccacctccacaggctgggacagccccgtccccaccatcctcctcccaagccaattaaatgatcacagcacgcgtgacagttaccggctggagagccggaggtgggaccgggagcaggggaccgtagaaccgggccgcgctcctcccctcctagagttcgtggaggcgcagcagagggccgtccctcttccggatgtcggactaagcgaacagcgcccccactgccggccggtagcagccggaagtgccagaccggaggtgcgtcattcaccggcgacgccgatacggttcctccaccgaggcccatgcgaagctttccactatggcttccagcactgtcccggtgagcgctgctggctcggctaatgaaactcccgaaataccggacaacgtgggagattggcttcggggcgtctaccgctttgccactgataggaatgacttccggagttctaatgccacctgtcgtcttatcatctgattgcagacaaatggaatcctgtgctgaacccgaatcttccaaaaaacagcctacaatctgtgaccaccacaagatgtgccctgatggcagctgaagtttgattcagatgggcacttttcttccccttccctgcctagtttccttttgttccttgagtccacgcagaattccattctctggtcagcagacaggcttaagctaaagtattgcctctattctgtaaagttctgtacatagttcccaagcttctgcagggggtgatttttgctcttgtcctgagaaataacagtgctgttttaaaaaacatttgaaataaataccgcacacaaaggcagtcattttattcttttaataagaaacttttgcttacaaaaacaaggtgtaaaaagatttacaaaaatcataaaaacatgatttatatttcacacttgagagacaaaaacaagccccaaaacatggattttaatggaggtggtttgcttcattttaaaagggaaaaaaaaaaaaggaagctgtaaccatacattgatgttaacctagcatgaagtttattcttgaagaatttacattgttgagcaatattaggggaagaagccatttggtgttgcatagcattttagtgcaccagatgggttttccagacaccagggaggcatcattgctggaatagtgaggtttggtggcagaaagagggcagtgatgtgtagggggaggcaaagtgaagtaagcctgggcagtggtcactaaagtgacactgctgaggcagctgcttccttcagaaggaaatgttttgtgaccctaaaattcatggtagtgctactgtccagggtttgggggctctttggaaatggagtatgtacggaactggcatgtatagacttatatagccatagaaagaggtggatagaaacaggtccaccatggcaatatttttttctggccagtttactaggcattaaaaaaaatactgcttttatgtgccaagtctcttatggaactagtatgggattaaaggacgttaattggaaaggagggtcagtatataaggaccacagtggcctgttaaggatgacagatgtctctagcagtttgttcactactaaagttaaacaggacaaaatagtctttcctgaccttgctggcataaatattaagaaaattgtttgagaattagatttttttagtatgtatataaaaacagcaccattctttgtataaatcagatagatcttatctgatagatgaagctaagaccctttgagtctacactgggttgactctgagaggtttatatcttattgggtattaagataaagaagggtcacatgagagcaaagcttagctttgaagccatcacctcccaaatggtgaccaaggaggaaacttttaagccatagtatagatgctaacccccatttagacctgcatcagatcacttgctaagacaagaaataccagcacctcctgttctttataggaatgaaacttagatccttaaaggctgctacctgatatactcatgactggacagttttgataaaaacttccaaaattgaaaatcaaaatccagcaagaattaagacatggcagcttccaaaagcataattcaaatttcattcaaaatttactgttttggcttcaagtaagtgtttactgttggttgggttttaaagccataattatggttgagtaaggattcatttatttatttattaaatttttatacatttttgaaaagatttcaaatctatgtttcccaggctggtcttgagctcctggcctcaagcaatcctcccaccttggcctcccaaagtgttgggattacaggtgctagccaactgcatccagccaatgtttcatttcaactggcttaaatcttcaaagtggttaagaatttagtaaataaaactacttaatctacaactttcaaaaattgatgagtaatcactaattctgtaaatgaaggagttggacttcactattgccaaagcaacattttccccaaggaaagtcaatttgatatcctgtcacacttttcagccctggctagttaacacagtactatgaaaatctttagctagattttaaacgaaatatgccagcagaagtatggaatgagtccacaaaaatgagtgcctgccacaatgctatagtagctatggtgtatttagtgcagagtgtgggatgaataagtacatagtaattaaagtcatagtcctggcccaacagaacagttactaaatgtaagatacaaactaaactcacagtcatatttagaaggcgcttttcagctttagcactgacttaaaaagtctgaaccaccaggaagatgcgtacttaactggttaaaaaattaagtggccctggaaagttttaccccaaagatacaacttcttcacttatttagttcagtaatgaggctgagggacccaattttcaagtgtgcatttgagtgggaaacttttaaacaccatatgttgaagtttcatgagctcagtggaaaccttaaggtcagagtaaaagaaactggctgtaaacagccctgcagtgaagagactgggtcttagcaccttccacattcactcagcgccatctcagtcagcgcctgccagggaaagggcatggagagctgggacgggtgccttctcttttgcaccactccctttgcatattacacagtgcactggcttgccttacaatctaaggttcacatacagggggttttctatactgcttccggacattttttgcaaaagaacatcagaaccaatgaaggtaccatttcaggaggaatcatttttgtttgacttctgctatatgttgcccagcattagtcattgttttgataaagactaaaaggccttttctcaacatttgtgctctcccaaccacctgggaaagcaacccttccactcacaagaggtaacctcagatagggatatagtattcatttaagaaggggtagcccccccagcctgatttaaaaaggcccaagtcaatgtatggaacatgacaagggaagtgaaaaacaatggagtacacagtctgccttgaaaagcagccatttgatgaacagtcacaaatacaaagaatttggacattgtaacataatttcagaacttgctggtaagaataatttgcattcacacacaagagacatgaaatgctttttaaaagtctgtgataccagatgtcctttaaacactacacagacccatttgccacttgaaatgacaagaagaaatcctttcccttaatcttttcaattccatgcaaaccgtaattgagtacaaggcaccaaattttatgaattgtataaaattagttcacaaagctttatcagtaagtagaacaaactccatttctccctcccggccagcccaccctcctcccacccaccacccgccatccccgaccaagttttcattctgcactactgtcgacctctctagggcttatgctggggcatgccccactgtcagccaatccacctcattggttcttcccttgtacttggatgaagctgtaagcacagccagagtagcaaactcatacaatcattgactctagaagccttgccattaaaaacaaaaataaactctgctattgagtccataggacacattaacacttctacagtttccaattttattcatgacattttaagagacatct

SEQ ID NO: 418038 - DNA, 4424 bp, Homo sapiens
ctggccaggagagttcccgtgtggcaaaagcgatctttctgtcatgtggctgtatctgtaatgtcaccctgatcaagggaagaagtgctagcacgtaaacaggctttttcggccctggactagtgctttagctgggctttgcgtttgatcttacatttcttttttgttttttttttttttttgagacggagtctcactctgttgcccaggctggagtgcagtggcgcgatctcggctcactgcaagctccgcctcccgggttcacgccattctcctgcctcagcctccccagtagctgggattacaggcgcgcaccaccacgcccagctaatttttgtatttttagtagagacggggtttcaccatgttggccaggctggtctcgagctcctgacttcgtgatccgcctgccttggccttccaaagtgctgggattacaggcgtgaaccaccgcgcccagcctgaccttacacttactaggcacaaaaatgaactccaaattcccacgtgggtcttgagcaacctgccgtcacaaccacgtatcaacgcctcgggaaggtggtgatggaagcctttccccccagtacatttcgttaactgtacaactgactcagtgaccacagggttaataaaacacattgtttttccaggaacttgatactaaatttgggactctttgctgcgggagtttggctggccaggaacttgagtgacattgacctcatggcacctcagccaggggtgtagccaagtagacaaatggaatcctgtgctgaacccgaatcttccaaaaaacagcctacaatctgtgaccaccacaagatgtgccctgatggcagctgaagtttgattcagatgggcacttttcttccccttccctgcctagtttccttttgttccttgagtccacgcagaattccattctctggtcagcagacaggcttaagctaaagtattgcctctattctgtaaagttctgtacatagttcccaagcttctgcagggggtgatttttgctcttgtcctgagaaataacagtgctgttttaaaaaacatttgaaataaataccgcacacaaaggcagtcattttattcttttaataagaaacttttgcttacaaaaacaaggtgtaaaaagatttacaaaaatcataaaaacatgatttatatttcacacttgagagacaaaaacaagccccaaaacatggattttaatggaggtggtttgcttcattttaaaagggaaaaaaaaaaaaggaagctgtaaccatacattgatgttaacctagcatgaagtttattcttgaagaatttacattgttgagcaatattaggggaagaagccatttggtgttgcatagcattttagtgcaccagatgggttttccagacaccagggaggcatcattgctggaatagtgaggtttggtggcagaaagagggcagtgatgtgtagggggaggcaaagtgaagtaagcctgggcagtggtcactaaagtgacactgctgaggcagctgcttccttcagaaggaaatgttttgtgaccctaaaattcatggtagtgctactgtccagggtttgggggctctttggaaatggagtatgtacggaactggcatgtatagacttatatagccatagaaagaggtggatagaaacaggtccaccatggcaatatttttttctggccagtttactaggcattaaaaaaaatactgcttttatgtgccaagtctcttatggaactagtatgggattaaaggacgttaattggaaaggagggtcagtatataaggaccacagtggcctgttaaggatgacagatgtctctagcagtttgttcactactaaagttaaacaggacaaaatagtctttcctgaccttgctggcataaatattaagaaaattgtttgagaattagatttttttagtatgtatataaaaacagcaccattctttgtataaatcagatagatcttatctgatagatgaagctaagaccctttgagtctacactgggttgactctgagaggtttatatcttattgggtattaagataaagaagggtcacatgagagcaaagcttagctttgaagccatcacctcccaaatggtgaccaaggaggaaacttttaagccatagtatagatgctaacccccatttagacctgcatcagatcacttgctaagacaagaaataccagcacctcctgttctttataggaatgaaacttagatccttaaaggctgctacctgatatactcatgactggacagttttgataaaaacttccaaaattgaaaatcaaaatccagcaagaattaagacatggcagcttccaaaagcataattcaaatttcattcaaaatttactgttttggcttcaagtaagtgtttactgttggttgggttttaaagccataattatggttgagtaaggattcatttatttatttattaaatttttatacatttttgaaaagatttcaaatctatgtttcccaggctggtcttgagctcctggcctcaagcaatcctcccaccttggcctcccaaagtgttgggattacaggtgctagccaactgcatccagccaatgtttcatttcaactggcttaaatcttcaaagtggttaagaatttagtaaataaaactacttaatctacaactttcaaaaattgatgagtaatcactaattctgtaaatgaaggagttggacttcactattgccaaagcaacattttccccaaggaaagtcaatttgatatcctgtcacacttttcagccctggctagttaacacagtactatgaaaatctttagctagattttaaacgaaatatgccagcagaagtatggaatgagtccacaaaaatgagtgcctgccacaatgctatagtagctatggtgtatttagtgcagagtgtgggatgaataagtacatagtaattaaagtcatagtcctggcccaacagaacagttactaaatgtaagatacaaactaaactcacagtcatatttagaaggcgcttttcagctttagcactgacttaaaaagtctgaaccaccaggaagatgcgtacttaactggttaaaaaattaagtggccctggaaagttttaccccaaagatacaacttcttcacttatttagttcagtaatgaggctgagggacccaattttcaagtgtgcatttgagtgggaaacttttaaacaccatatgttgaagtttcatgagctcagtggaaaccttaaggtcagagtaaaagaaactggctgtaaacagccctgcagtgaagagactgggtcttagcaccttccacattcactcagcgccatctcagtcagcgcctgccagggaaagggcatggagagctgggacgggtgccttctcttttgcaccactccctttgcatattacacagtgcactggcttgccttacaatctaaggttcacatacagggggttttctatactgcttccggacattttttgcaaaagaacatcagaaccaatgaaggtaccatttcaggaggaatcatttttgtttgacttctgctatatgttgcccagcattagtcattgttttgataaagactaaaaggccttttctcaacatttgtgctctcccaaccacctgggaaagcaacccttccactcacaagaggtaacctcagatagggatatagtattcatttaagaaggggtagcccccccagcctgatttaaaaaggcccaagtcaatgtatggaacatgacaagggaagtgaaaaacaatggagtacacagtctgccttgaaaagcagccatttgatgaacagtcacaaatacaaagaatttggacattgtaacataatttcagaacttgctggtaagaataatttgcattcacacacaagagacatgaaatgctttttaaaagtctgtgataccagatgtcctttaaacactacacagacccatttgccacttgaaatgacaagaagaaatcctttcccttaatcttttcaattccatgcaaaccgtaattgagtacaaggcaccaaattttatgaattgtataaaattagttcacaaagctttatcagtaagtagaacaaactccatttctccctcccggccagcccaccctcctcccacccaccacccgccatccccgaccaagttttcattctgcactactgtcgacctctctagggcttatgctggggcatgccccactgtcagccaatccacctcattggttcttcccttgtacttggatgaagctgtaagcacagccagagtagcaaactcatacaatcattgactctagaagccttgccattaaaaacaaaaataaactctgctattgagtccataggacacattaacacttctacagtttccaattttattcatgacattttaagagacatct

SEQ ID NO: 418039 - DNA, 4655 bp, Homo sapiens
ctggccaggagagttcccgtgtggcaaaagcgatctttctgtcatgtggctgtatctgtaatgtcaccctgatcaagggaagaagtgctagcacgtaaacaggctttttcggccctggactagtgctttagctgggctttgcgtttgatcttacatttcttttttgttttttttttttttttgagacggagtctcactctgttgcccaggctggagtgcagtggcgcgatctcggctcactgcaagctccgcctcccgggttcacgccattctcctgcctcagcctccccagtagctgggattacaggcgcgcaccaccacgcccagctaatttttgtatttttagtagagacggggtttcaccatgttggccaggctggtctcgagctcctgacttcgtgatccgcctgccttggccttccaaagtgctgggattacaggcgtgaaccaccgcgcccagcctgaccttacacttactaggcacaaaaatgaactccaaattcccacgtgggtcttgagcaacctgccgtcacaaccacgtatcaacgcctcgggaaggtggtgatggaagcctttccccccagtacatttcgttaactgtacaactgactcagtgaccacagggttaataaaacacattgtttttccaggaacttgatactaaatttgggactctttgctgcgggagtttggctggccaggaacttgagtgacattgacctcatggcacctcagccaggggtgtagccaagtaggtaagcactgaactacacccatgcgtgtcttaggagacctagagactgggtgaagcaatgttttctgtcaagtattcatgaaatgtacaaaagaatgtgatgtaaaacccttaactattcctagttaaatgtgttttcagatgttgaaagggatttaagtatctcttaccagtttccctcccatacttttacagttctaatgccacctgtcgtcttatcatctgattgcagacaaatggaatcctgtgctgaacccgaatcttccaaaaaacagcctacaatctgtgaccaccacaagatgtgccctgatggcagctgaagtttgattcagatgggcacttttcttccccttccctgcctagtttccttttgttccttgagtccacgcagaattccattctctggtcagcagacaggcttaagctaaagtattgcctctattctgtaaagttctgtacatagttcccaagcttctgcagggggtgatttttgctcttgtcctgagaaataacagtgctgttttaaaaaacatttgaaataaataccgcacacaaaggcagtcattttattcttttaataagaaacttttgcttacaaaaacaaggtgtaaaaagatttacaaaaatcataaaaacatgatttatatttcacacttgagagacaaaaacaagccccaaaacatggattttaatggaggtggtttgcttcattttaaaagggaaaaaaaaaaaaggaagctgtaaccatacattgatgttaacctagcatgaagtttattcttgaagaatttacattgttgagcaatattaggggaagaagccatttggtgttgcatagcattttagtgcaccagatgggttttccagacaccagggaggcatcattgctggaatagtgaggtttggtggcagaaagagggcagtgatgtgtagggggaggcaaagtgaagtaagcctgggcagtggtcactaaagtgacactgctgaggcagctgcttccttcagaaggaaatgttttgtgaccctaaaattcatggtagtgctactgtccagggtttgggggctctttggaaatggagtatgtacggaactggcatgtatagacttatatagccatagaaagaggtggatagaaacaggtccaccatggcaatatttttttctggccagtttactaggcattaaaaaaaatactgcttttatgtgccaagtctcttatggaactagtatgggattaaaggacgttaattggaaaggagggtcagtatataaggaccacagtggcctgttaaggatgacagatgtctctagcagtttgttcactactaaagttaaacaggacaaaatagtctttcctgaccttgctggcataaatattaagaaaattgtttgagaattagatttttttagtatgtatataaaaacagcaccattctttgtataaatcagatagatcttatctgatagatgaagctaagaccctttgagtctacactgggttgactctgagaggtttatatcttattgggtattaagataaagaagggtcacatgagagcaaagcttagctttgaagccatcacctcccaaatggtgaccaaggaggaaacttttaagccatagtatagatgctaacccccatttagacctgcatcagatcacttgctaagacaagaaataccagcacctcctgttctttataggaatgaaacttagatccttaaaggctgctacctgatatactcatgactggacagttttgataaaaacttccaaaattgaaaatcaaaatccagcaagaattaagacatggcagcttccaaaagcataattcaaatttcattcaaaatttactgttttggcttcaagtaagtgtttactgttggttgggttttaaagccataattatggttgagtaaggattcatttatttatttattaaatttttatacatttttgaaaagatttcaaatctatgtttcccaggctggtcttgagctcctggcctcaagcaatcctcccaccttggcctcccaaagtgttgggattacaggtgctagccaactgcatccagccaatgtttcatttcaactggcttaaatcttcaaagtggttaagaatttagtaaataaaactacttaatctacaactttcaaaaattgatgagtaatcactaattctgtaaatgaaggagttggacttcactattgccaaagcaacattttccccaaggaaagtcaatttgatatcctgtcacacttttcagccctggctagttaacacagtactatgaaaatctttagctagattttaaacgaaatatgccagcagaagtatggaatgagtccacaaaaatgagtgcctgccacaatgctatagtagctatggtgtatttagtgcagagtgtgggatgaataagtacatagtaattaaagtcatagtcctggcccaacagaacagttactaaatgtaagatacaaactaaactcacagtcatatttagaaggcgcttttcagctttagcactgacttaaaaagtctgaaccaccaggaagatgcgtacttaactggttaaaaaattaagtggccctggaaagttttaccccaaagatacaacttcttcacttatttagttcagtaatgaggctgagggacccaattttcaagtgtgcatttgagtgggaaacttttaaacaccatatgttgaagtttcatgagctcagtggaaaccttaaggtcagagtaaaagaaactggctgtaaacagccctgcagtgaagagactgggtcttagcaccttccacattcactcagcgccatctcagtcagcgcctgccagggaaagggcatggagagctgggacgggtgccttctcttttgcaccactccctttgcatattacacagtgcactggcttgccttacaatctaaggttcacatacagggggttttctatactgcttccggacattttttgcaaaagaacatcagaaccaatgaaggtaccatttcaggaggaatcatttttgtttgacttctgctatatgttgcccagcattagtcattgttttgataaagactaaaaggccttttctcaacatttgtgctctcccaaccacctgggaaagcaacccttccactcacaagaggtaacctcagatagggatatagtattcatttaagaaggggtagcccccccagcctgatttaaaaaggcccaagtcaatgtatggaacatgacaagggaagtgaaaaacaatggagtacacagtctgccttgaaaagcagccatttgatgaacagtcacaaatacaaagaatttggacattgtaacataatttcagaacttgctggtaagaataatttgcattcacacacaagagacatgaaatgctttttaaaagtctgtgataccagatgtcctttaaacactacacagacccatttgccacttgaaatgacaagaagaaatcctttcccttaatcttttcaattccatgcaaaccgtaattgagtacaaggcaccaaattttatgaattgtataaaattagttcacaaagctttatcagtaagtagaacaaactccatttctccctcccggccagcccaccctcctcccacccaccacccgccatccccgaccaagttttcattctgcactactgtcgacctctctagggcttatgctggggcatgccccactgtcagccaatccacctcattggttcttcccttgtacttggatgaagctgtaagcacagccagagtagcaaactcatacaatcattgactctagaagccttgccattaaaaacaaaaataaactctgctattgagtccataggacacattaacacttctacagtttccaattttattcatgacattttaagagacatct

SEQ ID NO: 418040 - DNA, 3760 bp, Homo sapiens
gcggccgcctactactactactactgctcgaattcaagcttctaacgatgtacggggacatggcacctcagccaggggtgtagccaagtagacaaatggaatcctgtgctgaacccgaatcttccaaaaaacagcctacaatctgtgaccaccacaagatgtgccctgatggcagctgaagtttgattcagatgggcacttttcttccccttccctgcctagtttccttttgttccttgagtccacgcagaattccattctctggtcagcagacaggcttaagctaaagtattgcctctattctgtaaagttctgtacatagttcccaagcttctgcagggggtgatttttgctcttgtcctgagaaataacagtgctgttttaaaaaacatttgaaataaataccgcacacaaaggcagtcattttattcttttaataagaaacttttgcttacaaaaacaaggtgtaaaaagatttacaaaaatcataaaaacatgatttatatttcacacttgagagacaaaaacaagccccaaaacatggattttaatggaggtggtttgcttcattttaaaagggaaaaaaaaaaaaggaagctgtaaccatacattgatgttaacctagcatgaagtttattcttgaagaatttacattgttgagcaatattaggggaagaagccatttggtgttgcatagcattttagtgcaccagatgggttttccagacaccagggaggcatcattgctggaatagtgaggtttggtggcagaaagagggcagtgatgtgtagggggaggcaaagtgaagtaagcctgggcagtggtcactaaagtgacactgctgaggcagctgcttccttcagaaggaaatgttttgtgaccctaaaattcatggtagtgctactgtccagggtttgggggctctttggaaatggagtatgtacggaactggcatgtatagacttatatagccatagaaagaggtggatagaaacaggtccaccatggcaatatttttttctggccagtttactaggcattaaaaaaaatactgcttttatgtgccaagtctcttatggaactagtatgggattaaaggacgttaattggaaaggagggtcagtatataaggaccacagtggcctgttaaggatgacagatgtctctagcagtttgttcactactaaagttaaacaggacaaaatagtctttcctgaccttgctggcataaatattaagaaaattgtttgagaattagatttttttagtatgtatataaaaacagcaccattctttgtataaatcagatagatcttatctgatagatgaagctaagaccctttgagtctacactgggttgactctgagaggtttatatcttattgggtattaagataaagaagggtcacatgagagcaaagcttagctttgaagccatcacctcccaaatggtgaccaaggaggaaacttttaagccatagtatagatgctaacccccatttagacctgcatcagatcacttgctaagacaagaaataccagcacctcctgttctttataggaatgaaacttagatccttaaaggctgctacctgatatactcatgactggacagttttgataaaaacttccaaaattgaaaatcaaaatccagcaagaattaagacatggcagcttccaaaagcataattcaaatttcattcaaaatttactgttttggcttcaagtaagtgtttactgttggttgggttttaaagccataattatggttgagtaaggattcatttatttatttattaaatttttatacatttttgaaaagatttcaaatctatgtttcccaggctggtcttgagctcctggcctcaagcaatcctcccaccttggcctcccaaagtgttgggattacaggtgctagccaactgcatccagccaatgtttcatttcaactggcttaaatcttcaaagtggttaagaatttagtaaataaaactacttaatctacaactttcaaaaattgatgagtaatcactaattctgtaaatgaaggagttggacttcactattgccaaagcaacattttccccaaggaaagtcaatttgatatcctgtcacacttttcagccctggctagttaacacagtactatgaaaatctttagctagattttaaacgaaatatgccagcagaagtatggaatgagtccacaaaaatgagtgcctgccacaatgctatagtagctatggtgtatttagtgcagagtgtgggatgaataagtacatagtaattaaagtcatagtcctggcccaacagaacagttactaaatgtaagatacaaactaaactcacagtcatatttagaaggcgcttttcagctttagcactgacttaaaaagtctgaaccaccaggaagatgcgtacttaactggttaaaaaattaagtggccctggaaagttttaccccaaagatacaacttcttcacttatttagttcagtaatgaggctgagggacccaattttcaagtgtgcatttgagtgggaaacttttaaacaccatatgttgaagtttcatgagctcagtggaaaccttaaggtcagagtaaaagaaactggctgtaaacagccctgcagtgaagagactgggtcttagcaccttccacattcactcagcgccatctcagtcagcgcctgccagggaaagggcatggagagctgggacgggtgccttctcttttgcaccactccctttgcatattacacagtgcactggcttgccttacaatctaaggttcacatacagggggttttctatactgcttccggacattttttgcaaaagaacatcagaaccaatgaaggtaccatttcaggaggaatcatttttgtttgacttctgctatatgttgcccagcattagtcattgttttgataaagactaaaaggccttttctcaacatttgtgctctcccaaccacctgggaaagcaacccttccactcacaagaggtaacctcagatagggatatagtattcatttaagaaggggtagcccccccagcctgatttaaaaaggcccaagtcaatgtatggaacatgacaagggaagtgaaaaacaatggagtacacagtctgccttgaaaagcagccatttgatgaacagtcacaaatacaaagaatttggacattgtaacataatttcagaacttgctggtaagaataatttgcattcacacacaagagacatgaaatgctttttaaaagtctgtgataccagatgtcctttaaacactacacagacccatttgccacttgaaatgacaagaagaaatcctttcccttaatcttttcaattccatgcaaaccgtaattgagtacaaggcaccaaattttatgaattgtataaaattagttcacaaagctttatcagtaagtagaacaaactccatttctccctcccggccagcccaccctcctcccacccaccacccgccatccccgaccaagttttcattctgcactactgtcgacctctctagggcttatgctggggcatgccccactgtcagccaatccacctcattggttcttcccttgtacttggatgaagctgtaagcacagccagagtagcaaactcatacaatcattgactctagaagccttgccattaaaaacaaaaataaactctgctattgagtccataggacacattaacacttctacagtttccaattttattcatgacattttaagagacatct

SEQ ID NO: 418041 - DNA, 3190 bp, Homo sapiens
gggagggggaagggaattatggaaggaatccagctggcctgttagtaagggtgttccagtgctaggtggaggtggagtttggctgcctttggggagattggaagggtgaggaatagaggcctgatttctgagtgttgtttctgtgttggacaattctatgcaaactagagccaaaatggaagagggtgcaagtcccctcctggggccccagacgccccctcctttcttgctgcctggagcaggggcagtgctgttagtggctactcctggtgtgaacagcccatcctggccaccttccacaggaaacctgacctgaaggacagaagaggaaggaagcaggctttgccacaaatgtcagtgcagaactctggctggccccaccaagaagacagccccaagccccaggatccaggtccaccagccaactcagacagtgactcaggccacctgccgggggaggaccctgaggatacccatgctcagggtcctgcagttctgagcttgggttccctttgcctggacaccaaccaagcccccaactggactggacttcagaccctcctgcagcaactccctccgcaggacattgatgagcgctactgcctggcccttggggaggaggagcgggccgagctgcagctcttctgtgccaggcggaagcaggaagccctgggacagggggtagcccgcctggtacttcccaagcttgaaggacacacctgtgagaagtgtagggagttgctgaagccaggggagtacggagtgtttgcagcccgggcaggggaacagcgctgctggcaccagccttgctttgcctgccaggcctgtggccaggccctgataaacctcatctacttctaccatgatggacaactctactgcggccgtcatcatgcagagttgctgcgcccgcgctgcccggcttgtgaccagctgatcttctcctggcgctgcaccgaggcggagggacagcgctggcatgagaaccacttctgttgccaggactgcgccgggcctctgggcgggggacgttatgccctgcctgggggaagcccctgctgccccagctgcttcgagaaccgctactcggatgcaggctcgagctgggccggggcactggaagggcaggcattccttggagcgcccccaccgcaccccccagacccaagcctcggggcccgcagctctcaccgcgcatccctggccggagcgttccaagggccgcccgaacccaccccgcgccgcggtcggggttgcggcgccagactccctcccaggcgcgggaggcggacgccctctggtggaggcgggggaccctggcgaggactctcggcggcggcggcggcgcgcacggcccaggggctgggcggggcgggaggctgggcctcacccccactagctgcggtgtaggtccagctccgcggctctgagaccagcgtttccgacccggcccggaacaggggagactggactcgaccgaactgaaggaagggaccaaacctcggtgaactctgcaaccctctcccgaacactccttctcgctgctgccggcggttccagcctgcaaactcagagggggctgcctggatccagtccccagcaggagaaccgacctggggacaaagcggaggcacccaaagggcaggagcaatgccgcctggagactattcgtgatcccaaggacacccctttctccacctgctcctcctcctctgactcggaacctgaaggatttttcttaggcgagcgccttccccagtcctggaagacccccggaagcctccaagcagaggacagcaacgcctctaagacgcactgcaccatgtgctagtggcgcagctcagagaggggatgtgagtgggaggaaaggggtctgtaaagcgggagaacaaggctagcctccccctaacaatcctagactgagacgcagtcaggcgcacgcccgcaagaggcggcgaggtgacaagtttggagtgcgcccccttcagtactgcgcgttctaagacttttggcggagactttcttggcaaaacccattccccaaagctacgcttcccctgctgagatagcccctacccccacctccacaggctgggacagccccgtccccaccatcctcctcccaagccaattaaatgatcacagcacgcgtgacagttaccggctggagagccggaggtgggaccgggagcaggggaccgtagaaccgggccgcgctcctcccctcctagagttcgtggaggcgcagcagagggccgtccctcttccggatgtcggactaagcgaacagcgcccccactgccggccggtagcagccggaagtgccagaccggaggtgcgtcattcaccggcgacgccgatacggttcctccaccgaggcccatgcgaagctttccactatggcttccagcactgtcccggtgagcgctgctggctcggctaatgaaactcccgaaataccggacaacgtgggagattggcttcggggcgtctaccgctttgccactgataggaatgacttccggaggaacttgatactaaatttgggactctttgctgcgggagtttggctggccaggaacttgagtgacattgacctcatggcacctcagccaggggtgtagccaagtaggtaagcactgaactacacccatgcgtgtcttaggagacctagagactgggtgaagcaatgttttctgtcaagtattcatgaaatgtacaaaagaatgtgatgtaaaacccttaactattcctagttaaatgtgttttcagatgttgaaagggatttaagtatctcttaccagtttccctcccatacttttacagttctaatgccacctgtcgtcttatcatctgattgcagacaaatggaatcctgtgctgaacccgaatcttccaaaaaacagcctacaatctgtgaccaccacaagatgtgccctgatggcagctgaagtttgattcagatgggcacttttcttccccttccctgcctagtttccttttgttccttgagtccacgcagaattccattctctggtcagcagacaggcttaagctaaagtattgcctctattctgtaaagttctgtacatagttcccaagcttctgcagggggtgatttttgctcttgtcctgagaaataacagtgctgttttaaaaaacatttgaaataaataccgcacacaaaggc

SEQ ID NO: 418042 - DNA, 2917 bp, Homo sapiens
gggagggggaagggaattatggaaggaatccagctggcctgttagtaagggtgttccagtgctaggtggaggtggagtttggctgcctttggggagattggaagggtgaggaatagaggcctgatttctgagtgttgtttctgtgttggacaattctatgcaaactagagccaaaatggaagagggtgcaagtcccctcctggggccccagacgccccctcctttcttgctgcctggagcaggggcagtgctgttagtggctactcctggtgtgaacagcccatcctggccaccttccacaggaaacctgacctgaaggacagaagaggaaggaagcaggctttgccacaaatgtcagtgcagaactctggctggccccaccaagaagacagccccaagccccaggatccaggtccaccagccaactcagacagtgactcaggccacctgccgggggaggaccctgaggatacccatgctcagggtcctgcagttctgagcttgggttccctttgcctggacaccaaccaagcccccaactggactggacttcagaccctcctgcagcaactccctccgcaggacattgatgagcgctactgcctggcccttggggaggaggagcgggccgagctgcagctcttctgtgccaggcggaagcaggaagccctgggacagggggtagcccgcctggtacttcccaagcttgaaggacacacctgtgagaagtgtagggagttgctgaagccaggggagtacggagtgtttgcagcccgggcaggggaacagcgctgctggcaccagccttgctttgcctgccaggcctgtggccaggccctgataaacctcatctacttctaccatgatggacaactctactgcggccgtcatcatgcagagttgctgcgcccgcgctgcccggcttgtgaccagctgatcttctcctggcgctgcaccgaggcggagggacagcgctggcatgagaaccacttctgttgccaggactgcgccgggcctctgggcgggggacgttatgccctgcctgggggaagcccctgctgccccagctgcttcgagaaccgctactcggatgcaggctcgagctgggccggggcactggaagggcaggcattccttggagcgcccccaccgcaccccccagacccaagcctcggggcccgcagctctcaccgcgcatccctggccggagcgttccaagggccgcccgaacccaccccgcgccgcggtcggggttgcggcgccagactccctcccaggcgcgggaggcggacgccctctggtggaggcgggggaccctggcgaggactctcggcggcggcggcggcgcgcacggcccaggggctgggcggggcgggaggctgggcctcacccccactagctgcggtgtaggtccagctccgcggctctgagaccagcgtttccgacccggcccggaacaggggagactggactcgaccgaactgaaggaagggaccaaacctcggtgaactctgcaaccctctcccgaacactccttctcgctgctgccggcggttccagcctgcaaactcagagggggctgcctggatccagtccccagcaggagaaccgacctggggacaaagcggaggcacccaaagggcaggagcaatgccgcctggagactattcgtgatcccaaggacacccctttctccacctgctcctcctcctctgactcggaacctgaaggatttttcttaggcgagcgccttccccagtcctggaagacccccggaagcctccaagcagaggacagcaacgcctctaagacgcactgcaccatgtgctagtggcgcagctcagagaggggatgtgagtgggaggaaaggggtctgtaaagcgggagaacaaggctagcctccccctaacaatcctagactgagacgcagtcaggcgcacgcccgcaagaggcggcgaggtgacaagtttggagtgcgcccccttcagtactgcgcgttctaagacttttggcggagactttcttggcaaaacccattccccaaagctacgcttcccctgctgagatagcccctacccccacctccacaggctgggacagccccgtccccaccatcctcctcccaagccaattaaatgatcacagcacgcgtgacagttaccggctggagagccggaggtgggaccgggagcaggggaccgtagaaccgggccgcgctcctcccctcctagagttcgtggaggcgcagcagagggccgtccctcttccggatgtcggactaagcgaacagcgcccccactgccggccggtagcagccggaagtgccagaccggaggtgcgtcattcaccggcgacgccgatacggttcctccaccgaggcccatgcgaagctttccactatggcttccagcactgtcccggtgagcgctgctggctcggctaatgaaactcccgaaataccggacaacgtgggagattggcttcggggcgtctaccgctttgccactgataggaatgacttccggaggaacttgatactaaatttgggactctttgctgcgggagtttggctggccaggaacttgagtgacattgacctcatggcacctcagccaggggtgtagccaagtagttctaatgccacctgtcgtcttatcatctgattgcagacaaatggaatcctgtgctgaacccgaatcttccaaaaaacagcctacaatctgtgaccaccacaagatgtgccctgatggcagctgaagtttgattcagatgggcacttttcttccccttccctgcctagtttccttttgttccttgagtccactgattcattcttacccctttacatcctcgtagcaaagaccccaaaagagcaaagaccccaaaagagcaaagaccccaaaaggggtaccgagct

SEQ ID NO: 418043 - DNA, 485 bp, Homo sapiens
gcggaagcaggaagccctgggacagggggtagcccgcctggtacttcccaagcttgaaggacacacctgtgagaaggtatgtagcacccctccccccaaattccccttcctctattctttgccctctcatttctgcagaaggggctgggctagcttctgggattctggttgggaaacaggaaaaacagaaaccaagtttgcaagctcttggtataggttgcagtggatgtgggcttgctagggtatggcgagaacaggttgggatcggattgcaagagcaaggagggaagttaggatggtagtgcttactccgaccacctcagcacctcccctctgacagtgtagggagttgctgaagccaggggagtacggagtgtttgcagcccgggcaggggaacagcgctgctggcaccagccttgctttgcctgccaggcctgtggccaggccctgataaacctcatctacttctaccatgatggacaac

SEQ ID NO: 418044 - DNA, 2777 bp, Homo sapiens
atggttgttacgtatttattgagggtctacatgtgtccagcctaaaggcttacaattcaattggggaggcaagacaggagtatatgaaataatttgaggaaatgcaagaatgggaagtgatactgagctcttagctcattgggaacaaggacctaatggtgacagggctaagtgctgtgggcctgtcaggacctgattgatgacattcctagtggggcagggtgagactgaggtggctttcttgagctcctttccttttccatttcctcttctatgccattatctctggcatctccctgaggttctacaacctttctctgacccagcagccaagccctttttcctccaaccaatgctcaatgttttctgctggagctctcccagtaattgtagaggactgtttctgcaggagcgctactgcctggcccttggggaggaggagcgggccgagctgcagctcttctgtgccaggcggaagcaggaagccctgggacagggggtagcccgcctggtacttcccaagcttgaaggacacacctgtgagaagtgtagggagttgctgaagccaggggagtacggagtgtttgcagcccgggcaggggaacagcgctgctggcaccagccttgctttgcctgccaggcctgtggccaggccctgataaacctcatctacttctaccatgatggacaactctactgcggccgtcatcatgcagagttgctgcgcccgcgctgcccggcttgtgaccagctgatcttctcctggcgctgcaccgaggcggagggacagcgctggcatgagaaccacttctgttgccaggactgcgccgggcctctgggcgggggacgttatgccctgcctgggggaagcccctgctgccccagctgcttcgagaaccgctactcggatgcaggctcgagctgggccggggcactggaagggcaggcattccttggagcgcccccaccgcaccccccagacccaagcctcggggcccgcagctctcaccgcgcatccctggccggagcgttccaagggccgcccgaacccaccccgcgccgcggtcggggttgcggcgccagactccctcccaggcgcgggaggcggacgccctctggtggaggcgggggaccctggcgaggactctcggcggcggcggcggcgcgcacggcccaggggctgggcggggcgggaggctgggcctcacccccactagctgcggtgtaggtccagctccgcggctctgagaccagcgtttccgacccggcccggaacaggggagactggactcgaccgaactgaaggaagggaccaaacctcggtgaactctgcaaccctctcccgaacactccttctcgctgctgccggcggttccagcctgcaaactcagagggggctgcctggatccagtccccagcaggagaaccgacctggggacaaagcggaggcacccaaagggcaggagcaatgccgcctggagactattcgtgatcccaaggacacccctttctccacctgctcctcctcctctgactcggaacctgaaggatttttcttaggcgagcgccttccccagtcctggaagacccccggaagcctccaagcagaggacagcaacgcctctaagacgcactgcaccatgtgctagtggcgcagctcagagaggggatgtgagtgggaggaaaggggtctgtaaagcgggagaacaaggctagcctccccctaacaatcctagactgagacgcagtcaggcgcacgcccgcaagaggcggcgaggtgacaagtttggagtgcgcccccttcagtactgcgcgttctaagacttttggcggagactttcttggcaaaacccattccccaaagctacgcttcccctgctgagatagcccctacccccacctccacaggctgggacagccccgtccccaccatcctcctcccaagccaattaaatgatcacagcacgcgtgacagttaccggctggagagccggaggtgggaccgggagcaggggaccgtagaaccgggccgcgctcctcccctcctagagttcgtggaggcgcagcagagggccgtccctcttccggatgtcggactaagcgaacagcgcccccactgccggccggtagcagccggaagtgccagaccggaggtgcgtcattcaccggcgacgccgatacggttcctccaccgaggcccatgcgaagctttccactatggcttccagcactgtcccggtgagcgctgctggctcggctaatgaaactcccgaaataccggacaacgtgggagattggcttcggggcgtctaccgctttgccactgataggaatgacttccggaggaacttgatactaaatttgggactctttgctgcgggagtttggctggccaggaacttgagtgacattgacctcatggcacctcagccaggggtgtagccaagtagacaaatggaatcctgtgctgaacccgaatcttccaaaaaacagcctacaatctgtgaccaccacaagatgtgccctgatggcagctgaagtttgattcagatgggcacttttcttccccttccctgcctagtttccttttgttccttgagtccacgcagaattccattctctggtcagcagacaggcttaagctaaagtattgcctctattctgtaaagttctgtacatagttcccaagcttctgcagggggtgatttttgctcttgtcctgagaaataacagtgctgttttaaaaaacatttgaaataaataccgcacacaaaggc

SEQ ID NO: 418045 - DNA, 2776 bp, Homo sapiens
gggagggggaagggaattatggaaggaatccagctggcctgttagtaagggtgttccagtgctaggtggaggtggagtttggctgcctttggggagattggaagggtgaggaatagaggcctgatttctgagtgttgtttctgtgttggacaattctatgcaaactagagccaaaatggaagagggtgcaagtcccctcctggggccccagacgccccctcctttcttgctgcctggagcaggggcagtgctgttagtggctactcctggtgtgaacagcccatcctggccaccttccacaggaaacctgacctgaaggacagaagaggaaggaagcaggctttgccacaaatgtcagtgcagaactctggctggccccaccaagaagacagccccaagccccaggatccaggtccaccagccaactcagacagtgactcaggccacctgccgggggaggaccctgaggatacccatgctcagggtcctgcagttctgagcttgggttccctttgcctggacaccaaccaagcccccaactggactggacttcagaccctcctgcagcaactccctccgcaggacattgatgagcgctactgcctggcccttggggaggaggagcgggccgagctgcagctcttctgtgccaggcggaagcaggaagccctgggacagggggtagcccgcctggtacttcccaagcttgaaggacacacctgtgagaagtgtagggagttgctgaagccaggggagtacggagtgtttgcagcccgggcaggggaacagcgctgctggcaccagccttgctttgcctgccaggcctgtggccaggccctgataaacctcatctacttctaccatgatggacaactctactgcggccgtcatcatgcagagttgctgcgcccgcgctgcccggcttgtgaccagctgatcttctcctggcgctgcaccgaggcggagggacagcgctggcatgagaaccacttctgttgccaggactgcgccgggcctctgggcgggggacgttatgccctgcctgggggaagcccctgctgccccagctgcttcgagaaccgctactcggatgcaggctcgagctgggccggggcactggaagggcaggcattccttggagcgcccccaccgcaccccccagacccaagcctcggggcccgcagctctcaccgcgcatccctggccggagcgttccaagggccgcccgaacccaccccgcgccgcggtcggggttgcggcgccagactccctcccaggcgcgggaggcggacgccctctggtggaggcgggggaccctggcgaggactctcggcggcggcggcggcgcgcacggcccaggggctgggcggggcgggaggctgggcctcacccccactagctgcggtgtaggtccagctccgcggctctgagaccagcgtttccgacccggcccggaacaggggagactggactcgaccgaactgaaggaagggaccaaacctcggtgaactctgcaaccctctcccgaacactccttctcgctgctgccggcggttccagcctgcaaactcagagggggctgcctggatccagtccccagcaggagaaccgacctggggacaaagcggaggcacccaaagggcaggagcaatgccgcctggagactattcgtgatcccaaggacacccctttctccacctgctcctcctcctctgactcggaacctgaaggatttttcttaggcgagcgccttccccagtcctggaagacccccggaagcctccaagcagaggacagcaacgcctctaagacgcactgcaccatgtgctagtggcgcagctcagagaggggatgtgagtgggaggaaaggggtctgtaaagcgggagaacaaggctagcctccccctaacaatcctagactgagacgcagtcaggcgcacgcccgcaagaggcggcgaggtgacaagtttggagtgcgcccccttcagtactgcgcgttctaagacttttggcggagactttcttggcaaaacccattcccctcctagagttcgtggaggcgcagcagagggccgtccctcttccggatgtcggactaagcgaacagcgcccccactgccggccggtagcagccggaagtgccagaccggaggtgcgtcattcaccggcgacgccgatacggttcctccaccgaggcccatgcgaagctttccactatggcttccagcactgtcccggtgagcgctgctggctcggctaatgaaactcccgaaataccggacaacgtgggagattggcttcggggcgtctaccgctttgccactgataggaatgacttccggaggaacttgatactaaatttgggactctttgctgcgggagtttggctggccaggaacttgagtgacattgacctcatggcacctcagccaggggtgtagccaagtagacaaatggaatcctgtgctgaacccgaatcttccaaaaaacagcctacaatctgtgaccaccacaagatgtgccctgatggcagctgaagtttgattcagatgggcacttttcttccccttccctgcctagtttccttttgttccttgagtccacgcagaattccattctctggtcagcagacaggcttaagctaaagtattgcctctattctgtaaagttctgtacatagttcccaagcttctgcagggggtgatttttgctcttgtcctgagaaataacagtgctgttttaaaaaacatttgaaataaataccgcacacaaaggc

SEQ ID NO: 418046 - DNA, 4253 bp, Homo sapiens
acccccatttgtgtgactggattgggacacattacctgaatgagcaggtgaaagccatcaaagaattgggtgaccacgtgaccaacttgcgcaagatgggagcgcccgaatctggcttggcggaatatctctttgacaagcacaccctgggagacagtgataatgaaagctaagccgtggggctaatttccccatagccgtggggtgacttccctggtcaccaaggcagtgcatgcatgttggggtttcctttaccttttctataagttgtaccaaaacatccacttaagttctttgatttgtaccattccttcaaataaagaaatttggtacccaaaaaaaaaaaaaaaaaaaaaaaacagcactgtcccggtgagcgctgctggctcggctaatgaaactcccgaaataccggacaacgtgggagattggcttcggggcgtctaccgctttgccactgataggaatgacttccggaggaacttgatactaaatttgggactctttgctgcgggagtttggctggccaggaacttgagtgacattgacctcatggcacctcagccaggggtgtagccaagtagacaaatggaatcctgtgctgaacccgaatcttccaaaaaacagcctacaatctgtgaccaccacaagatgtgccctgatggcagctgaagtttgattcagatgggcacttttcttccccttccctgcctagtttccttttgttccttgagtccacgcagaattccattctctggtcagcagacaggcttaagctaaagtattgcctctattctgtaaagttctgtacatagttcccaagcttctgcagggggtgatttttgctcttgtcctgagaaataacagtgctgttttaaaaaacatttgaaataaataccgcacacaaaggcagtcattttattcttttaataagaaacttttgcttacaaaaacaaggtgtaaaaagatttacaaaaatcataaaaacatgatttatatttcacacttgagagacaaaaacaagccccaaaacatggattttaatggaggtggtttgcttcattttaaaagggaaaaaaaaaaaaggaagctgtaaccatacattgatgttaacctagcatgaagtttattcttgaagaatttacattgttgagcaatattaggggaagaagccatttggtgttgcatagcattttagtgcaccagatgggttttccagacaccagggaggcatcattgctggaatagtgaggtttggtggcagaaagagggcagtgatgtgtagggggaggcaaagtgaagtaagcctgggcagtggtcactaaagtgacactgctgaggcagctgcttccttcagaaggaaatgttttgtgaccctaaaattcatggtagtgctactgtccagggtttgggggctctttggaaatggagtatgtacggaactggcatgtatagacttatatagccatagaaagaggtggatagaaacaggtccaccatggcaatatttttttctggccagtttactaggcattaaaaaaaatactgcttttatgtgccaagtctcttatggaactagtatgggattaaaggacgttaattggaaaggagggtcagtatataaggaccacagtggcctgttaaggatgacagatgtctctagcagtttgttcactactaaagttaaacaggacaaaatagtctttcctgaccttgctggcataaatattaagaaaattgtttgagaattagatttttttagtatgtatataaaaacagcaccattctttgtataaatcagatagatcttatctgatagatgaagctaagaccctttgagtctacactgggttgactctgagaggtttatatcttattgggtattaagataaagaagggtcacatgagagcaaagcttagctttgaagccatcacctcccaaatggtgaccaaggaggaaacttttaagccatagtatagatgctaacccccatttagacctgcatcagatcacttgctaagacaagaaataccagcacctcctgttctttataggaatgaaacttagatccttaaaggctgctacctgatatactcatgactggacagttttgataaaaacttccaaaattgaaaatcaaaatccagcaagaattaagacatggcagcttccaaaagcataattcaaatttcattcaaaatttactgttttggcttcaagtaagtgtttactgttggttgggttttaaagccataattatggttgagtaaggattcatttatttatttattaaatttttatacatttttgaaaagatttcaaatctatgtttcccaggctggtcttgagctcctggcctcaagcaatcctcccaccttggcctcccaaagtgttgggattacaggtgctagccaactgcatccagccaatgtttcatttcaactggcttaaatcttcaaagtggttaagaatttagtaaataaaactacttaatctacaactttcaaaaattgatgagtaatcactaattctgtaaatgaaggagttggacttcactattgccaaagcaacattttccccaaggaaagtcaatttgatatcctgtcacacttttcagccctggctagttaacacagtactatgaaaatctttagctagattttaaacgaaatatgccagcagaagtatggaatgagtccacaaaaatgagtgcctgccacaatgctatagtagctatggtgtatttagtgcagagtgtgggatgaataagtacatagtaattaaagtcatagtcctggcccaacagaacagttactaaatgtaagatacaaactaaactcacagtcatatttagaaggcgcttttcagctttagcactgacttaaaaagtctgaaccaccaggaagatgcgtacttaactggttaaaaaattaagtggccctggaaagttttaccccaaagatacaacttcttcacttatttagttcagtaatgaggctgagggacccaattttcaagtgtgcatttgagtgggaaacttttaaacaccatatgttgaagtttcatgagctcagtggaaaccttaaggtcagagtaaaagaaactggctgtaaacagccctgcagtgaagagactgggtcttagcaccttccacattcactcagcgccatctcagtcagcgcctgccagggaaagggcatggagagctgggacgggtgccttctcttttgcaccactccctttgcatattacacagtgcactggcttgccttacaatctaaggttcacatacagggggttttctatactgcttccggacattttttgcaaaagaacatcagaaccaatgaaggtaccatttcaggaggaatcatttttgtttgacttctgctatatgttgcccagcattagtcattgttttgataaagactaaaaggccttttctcaacatttgtgctctcccaaccacctgggaaagcaacccttccactcacaagaggtaacctcagatagggatatagtattcatttaagaaggggtagcccccccagcctgatttaaaaaggcccaagtcaatgtatggaacatgacaagggaagtgaaaaacaatggagtacacagtctgccttgaaaagcagccatttgatgaacagtcacaaatacaaagaatttggacattgtaacataatttcagaacttgctggtaagaataatttgcattcacacacaagagacatgaaatgctttttaaaagtctgtgataccagatgtcctttaaacactacacagacccatttgccacttgaaatgacaagaagaaatcctttcccttaatcttttcaattccatgcaaaccgtaattgagtacaaggcaccaaattttatgaattgtataaaattagttcacaaagctttatcagtaagtagaacaaactccatttctccctcccggccagcccaccctcctcccacccaccacccgccatccccgaccaagttttcattctgcactactgtcgacctctctagggcttatgctggggcatgccccactgtcagccaatccacctcattggttcttcccttgtacttggatgaagctgtaagcacagccagagtagcaaactcatacaatcattgactctagaagccttgccattaaaaacaaaaataaactctgctattgagtccataggacacattaacacttctacagtttccaattttattcatgacattttaagagacatct

SEQ ID NO: 418047 - DNA, 3482 bp, Homo sapiens
gggagggggaagggaattatggaaggaatccagctggcctgttagtaagggtgttccagtgctaggtggaggtggagtttggctgcctttggggagattggaagggtgaggaatagaggcctgatttctgagtgttgtttctgtgttggacaattctatgcaaactagagccaaaatggaagagggtgcaagtcccctcctggggccccagacgccccctcctttcttgctgcctggagcaggggcagtgctgttagtggctactcctggtgtgaacagcccatcctggccaccttccacaggaaacctgacctgaaggacagaagaggaaggaagcaggctttgccacaaatgtcagtgcagaactctggctggccccaccaagaagacagccccaagccccaggatccaggtccaccagccaactcagacagtgactcaggccacctgccgggggaggaccctgaggatacccatgctcagggtcctgcagttctgagcttgggttccctttgcctggacaccaaccaagcccccaactggactggacttcagaccctcctgcagcaactccctccgcaggacattgatgagcgctactgcctggcccttggggaggaggagcgggccgagctgcagctcttctgtgccaggcggaagcaggaagccctgggacagggggtagcccgcctggtacttcccaagcttgaaggacacacctgtgagaagtgtagggagttgctgaagccaggggagtacggagtgtttgcagcccgggcaggggaacagcgctgctggcaccagccttgctttgcctgccaggcctgtggccaggccctgataaacctcatctacttctaccatgatggacaactctactgcggccgtcatcatgcagagttgctgcgcccgcgctgcccggcttgtgaccagctgatcttctcctggcgctgcaccgaggcggagggacagcgctggcatgagaaccacttctgttgccaggactgcgccgggcctctgggcgggggacgttatgccctgcctgggggaagcccctgctgccccagctgcttcgagaaccgctactcggatgcaggctcgagctgggccggggcactggaagggcaggcattccttggagcgcccccaccgcaccccccagacccaagcctcggggcccgcagctctcaccgcgcatccctggccggagcgttccaagggccgcccgaacccaccccgcgccgcggtcggggttgcggcgccagactccctcccaggcgcgggaggcggacgccctctggtggaggcgggggaccctggcgaggactctcggcggcggcggcggcgcgcacggcccaggggctgggcggggcgggaggctgggcctcacccccactagctgcggtgtaggtccagctccgcggctctgagaccagcgtttccgacccggcccggaacaggggagactggactcgaccgaactgaaggaagggaccaaacctcggtgaactctgcaaccctctcccgaacactccttctcgctgctgccggcggttccagcctgcaaactcagagggggctgcctggatccagtccccagcaggagaaccgacctggggacaaagcggaggcacccaaagggcaggagcaatgccgcctggagactattcgtgatcccaaggacacccctttctccacctgctcctcctcctctgactcggaacctgaaggatttttcttaggcgagcgccttccccagtcctggaagacccccggaagcctccaagcagaggacagcaacgcctctaagacgcactgcaccatgtgctagtggcgcagctcagagaggggatgtgagtgggaggaaaggggtctgtaaagcgggagaacaaggctagcctccccctaacaatcctagactgagacgcagtcaggcgcacgcccgcaagaggcggcgaggtgacaagtttggagtgcgcccccttcagtactgcgcgttctaagacttttggcggagactttcttggcaaaacccattccccaaagctacgcttcccctgctgagatagcccctacccccacctccacaggctgggacagccccgtccccaccatcctcctcccaagccaattaaatgatcacagcacgcgtgacagttaccggctggagagccggaggtgggaccgggagcaggggaccgtagaaccgggccgcgctcctcccctcctagagttcgtggaggcgcagcagagggccgtccctcttccggatgtcggactaagcgaacagcgcccccactgccggccggtagcagccggaagtgccagaccggaggtgcgtcattcaccggcgacgccgatacggttcctccaccgaggcccatgcgaagctttccactatggcttccagcactgtcccggtgagcgctgctggctcggctaatgaaactcccgaaataccggacaacgtgggagattggcttcggggcgtctaccgctttgccactgataggaatgacttccggaggaacttgatactaaatttgggactctttgctgcgggagtttggctggccaggaacttgagtgacattgacctcatggcacctcagccaggggtgtagccaagtagacaaatggaatcctgtgctgaacccgaatcttccaaaaaacagcctacaatctgtgaccaccacaagatgtgccctgatggcagctgaagtttgattcagatgggcacttttcttccccttccctgcctagtttccttttgttccttgagtccacgcagaattccattctctggtcagcagacaggcttaagctaaagtattgcctctattctgtaaagttctgtacatagttcccaagcttctgcagggggtgatttttgctcttgtcctgagaaataacagtgctgttttaaaaaacatttgaaataaataccgcacacaaaggcaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaacaaaaaaaagaggggggggggggggcgacaatcccggcagggcgcgcacacacggacccatgggagcccaggcggcgcaccgagggaggagcataattaatacggcagaggagcgagcgacacgagaaagcaggaggaggggggggaggaccacgagcgagaagaaacaataaaaagagaaccaaccaccacacagaggcgtgaggaccacagctgagtcgggagtacaagcacaaaggagaggataaggacagtccgcgcagagccactaatacaccgtcgaagagaaggagagaggggggcaaaaaagacacagccattgatgcgcaaggatgcgaagaatgagaagccgcggacgaagaagaagaaagacgcaactcaagagagggcataagagcaggaaacgaccaggta

SEQ ID NO: 418048 - DNA, 3367 bp, Homo sapiens
  misc_feature (3331)..(3331): n is a, c, g, or t
  misc_feature (3344)..(3344): n is a, c, g, or t
gggagggggaagggaattatggaaggaatccagctggcctgttagtaagggtgttccagtgctaggtggaggtggagtttggctgcctttggggagattggaagggtgaggaatagaggcctgatttctgagtgttgtttctgtgttggacaattctatgcaaactagagccaaaatggaagagggtgcaagtcccctcctggggccccagacgccccctcctttcttgctgcctggagcaggggcagtgctgttagtggctactcctggtgtgaacagcccatcctggccaccttccacaggaaacctgacctgaaggacagaagaggaaggaagcaggctttgccacaaatgtcagtgcagaactctggctggccccaccaagaagacagccccaagccccaggatccaggtccaccagccaactcagacagtgactcaggccacctgccgggggaggaccctgaggatacccatgctcagggtcctgcagttctgagcttgggttccctttgcctggacaccaaccaagcccccaactggactggacttcagaccctcctgcagcaactccctccgcaggacattgatgagcgctactgcctggcccttggggaggaggagcgggccgagctgcagctcttctgtgccaggcggaagcaggaagccctgggacagggggtagcccgcctggtacttcccaagcttgaaggacacacctgtgagaagtgtagggagttgctgaagccaggggagtacggagtgtttgcagcccgggcaggggaacagcgctgctggcaccagccttgctttgcctgccaggcctgtggccaggccctgataaacctcatctacttctaccatgatggacaactctactgcggccgtcatcatgcagagttgctgcgcccgcgctgcccggcttgtgaccagctgatcttctcctggcgctgcaccgaggcggagggacagcgctggcatgagaaccacttctgttgccaggactgcgccgggcctctgggcgggggacgttatgccctgcctgggggaagcccctgctgccccagctgcttcgagaaccgctactcggatgcaggctcgagctgggccggggcactggaagggcaggcattccttggagcgcccccaccgcaccccccagacccaagcctcggggcccgcagctctcaccgcgcatccctggccggagcgttccaagggccgcccgaacccaccccgcgccgcggtcggggttgcggcgccagactccctcccaggcgcgggaggcggacgccctctggtggaggcgggggaccctggcgaggactctcggcggcggcggcggcgcgcacggcccaggggctgggcggggcgggaggctgggcctcacccccactagctgcggtgtaggtccagctccgcggctctgagaccagcgtttccgacccggcccggaacaggggagactggactcgaccgaactgaaggaagggaccaaacctcggtgaactctgcaaccctctcccgaacactccttctcgctgctgccggcggttccagcctgcaaactcagagggggctgcctggatccagtccccagcaggagaaccgacctggggacaaagcggaggcacccaaagggcaggagcaatgccgcctggagactattcgtgatcccaaggacacccctttctccacctgctcctcctcctctgactcggaacctgaaggatttttcttaggcgagcgccttccccagtcctggaagacccccggaagcctccaagcagaggacagcaacgcctctaagacgcactgcaccatgtgctagtggcgcagctcagagaggggatgtgagtgggaggaaaggggtctgtaaagcgggagaacaaggctagcctccccctaacaatcctagactgagacgcagtcaggcgcacgcccgcaagaggcggcgaggtgacaagtttggagtgcgcccccttcagtactgcgcgttctaagacttttggcggagactttcttggcaaaacccattccccaaagctacgcttcccctgctgagatagcccctacccccacctccacaggctgggacagccccgtccccaccatcctcctcccaagccaattaaatgatcacagcacgcgtgacagttaccggctggagagccggaggtgggaccgggagcaggggaccgtagaaccgggccgcgctcctcccctcctagagttcgtggaggcgcagcagagggccgtccctcttccggatgtcggactaagcgaacagcgcccccactgccggccggtagcagccggaagtgccagaccggaggtgcgtcattcaccggcgacgccgatacggttcctccaccgaggcccatgcgaagctttccactatggcttccagcactgtcccggtgagcgctgctggctcggctaatgaaactcccgaaataccggacaacgtgggagattggcttcggggcgtctaccgctttgccactgataggaatgacttccggaggaacttgatactaaatttgggactctttgctgcgggagtttggctggccaggaacttgagtgacattgacctcatggcacctcagccaggggtgtagccaagtagacaaatggaatcctgtgctgaacccgaatcttccaaaaaacagcctacaatctgtgaccaccacaagatgtgccctgatggcagctgaagtttgattcagatgggcacttttcttccccttccctgcctagtttccttttgttccttgagtccacgcagaattccattctctggtcagcagacaggcttaagctaaagtattgcctctattctgtaaagttctgtacatagttcccaagcttctgcagggggtgatttttgctcttgtcctgagaaataacagtgctgttttaaaaaacatttgaaataaataccgcacacaaaggcaaaaaaaaaacccgaggtttttttattggggggccccttggggaaaattttggggggggggggcccctcacagggggctcgggggccaggaagcgcgggaaaacacaaaccttgtgaaacaaaacgtaccgcgggagctgtcagggacgcgcatgacgcgcaaacccccgcggcgcggggggcgcgcggggcgtaacaacgtgccccaggggctagggacgtggaccacgggtgtgtacataggccgcagaccacgcggcattctgggggcggtcagcgccaagaaggcgcgggggcgcaccaccaaggcggaggagatgcaacgcgacggcagggtttcgccaacaggcagccgggcgggtcactctggcnacgaagcaaggcngacccggtggctccacacagggc

SEQ ID NO: 418049 - DNA, 6532 bp, Homo sapiens
gggagggggaagggaattatggaaggaatccagctggcctgttagtaagggtgttccagtgctaggtggaggtggagtttggctgcctttggggagattggaagggtgaggaatagaggcctgatttctgagtgttgtttctgtgttggacaattctatgcaaactagagccaaaatggaagagggtgcaagtcccctcctggggccccagacgccccctcctttcttgctgcctggagcaggggcagtgctgttagtggctactcctggtgtgaacagcccatcctggccaccttccacaggaaacctgacctgaaggacagaagaggaaggaagcaggctttgccacaaatgtcagtgcagaactctggctggccccaccaagaagacagccccaagccccaggatccaggtccaccagccaactcagacagtgactcaggccacctgccgggggaggaccctgaggatacccatgctcagggtcctgcagttctgagcttgggttccctttgcctggacaccaaccaagcccccaactggactggacttcagaccctcctgcagcaactccctccgcaggacattgatgagcgctactgcctggcccttggggaggaggagcgggccgagctgcagctcttctgtgccaggcggaagcaggaagccctgggacagggggtagcccgcctggtacttcccaagcttgaaggacacacctgtgagaagtgtagggagttgctgaagccaggggagtacggagtgtttgcagcccgggcaggggaacagcgctgctggcaccagccttgctttgcctgccaggcctgtggccaggccctgataaacctcatctacttctaccatgatggacaactctactgcggccgtcatcatgcagagttgctgcgcccgcgctgcccggcttgtgaccagctgatcttctcctggcgctgcaccgaggcggagggacagcgctggcatgagaaccacttctgttgccaggactgcgccgggcctctgggcgggggacgttatgccctgcctgggggaagcccctgctgccccagctgcttcgagaaccgctactcggatgcaggctcgagctgggccggggcactggaagggcaggcattccttggagcgcccccaccgcaccccccagacccaagcctcggggcccgcagctctcaccgcgcatccctggccggagcgttccaagggccgcccgaacccaccccgcgccgcggtcggggttgcggcgccagactccctcccaggcgcgggaggcggacgccctctggtggaggcgggggaccctggcgaggactctcggcggcggcggcggcgcgcacggcccaggggctgggcggggcgggaggctgggcctcacccccactagctgcggtgtaggtccagctccgcggctctgagaccagcgtttccgacccggcccggaacaggggagactggactcgaccgaactgaaggaagggaccaaacctcggtgaactctgcaaccctctcccgaacactccttctcgctgctgccggcggttccagcctgcaaactcagagggggctgcctggatccagtccccagcaggagaaccgacctggggacaaagcggaggcacccaaagggcaggagcaatgccgcctggagactattcgtgatcccaaggacacccctttctccacctgctcctcctcctctgactcggaacctgaaggatttttcttaggcgagcgccttccccagtcctggaagacccccggaagcctccaagcagaggacagcaacgcctctaagacgcactgcaccatgtgctagtggcgcagctcagagaggggatgtgagtgggaggaaaggggtctgtaaagcgggagaacaaggctagcctccccctaacaatcctagactgagacgcagtcaggcgcacgcccgcaagaggcggcgaggtgacaagtttggagtgcgcccccttcagtactgcgcgttctaagacttttggcggagactttcttggcaaaacccattccccaaagctacgcttcccctgctgagatagcccctacccccacctccacaggctgggacagccccgtccccaccatcctcctcccaagccaattaaatgatcacagcacgcgtgacagttaccggctggagagccggaggtgggaccgggagcaggggaccgtagaaccgggccgcgctcctcccctcctagagttcgtggaggcgcagcagagggccgtccctcttccggatgtcggactaagcgaacagcgcccccactgccggccggtagcagccggaagtgccagaccggaggtgcgtcattcaccggcgacgccgatacggttcctccaccgaggcccatgcgaagctttccactatggcttccagcactgtcccggtgagcgctgctggctcggctaatgaaactcccgaaataccggacaacgtgggagattggcttcggggcgtctaccgctttgccactgataggaatgacttccggaggaacttgatactaaatttgggactctttgctgcgggagtttggctggccaggaacttgagtgacattgacctcatggcacctcagccaggggtgtagccaagtaggtaagcactgaactacacccatgcgtgtcttaggagacctagagactgggtgaagcaatgttttctgtcaagtattcatgaaatgtacaaaagaatgtgatgtaaaacccttaactattcctagttaaatgtgttttcagatgttgaaagggatttaagtatctcttaccagtttccctcccatacttttacagttctaatgccacctgtcgtcttatcatctgattgcagacaaatggaatcctgtgctgaacccgaatcttccaaaaaacagcctacaatctgtgaccaccacaagatgtgccctgatggcagctgaagtttgattcagatgggcacttttcttccccttccctgcctagtttccttttgttccttgagtccacgcagaattccattctctggtcagcagacaggcttaagctaaagtattgcctctattctgtaaagttctgtacatagttcccaagcttctgcagggggtgatttttgctcttgtcctgagaaataacagtgctgttttaaaaaacatttgaaataaataccgcacacaaaggcagtcattttattcttttaataagaaacttttgcttacaaaaacaaggtgtaaaaagatttacaaaaatcataaaaacatgatttatatttcacacttgagagacaaaaacaagccccaaaacatggattttaatggaggtggtttgcttcattttaaaagggaaaaaaaaaaaaggaagctgtaaccatacattgatgttaacctagcatgaagtttattcttgaagaatttacattgttgagcaatattaggggaagaagccatttggtgttgcatagcattttagtgcaccagatgggttttccagacaccagggaggcatcattgctggaatagtgaggtttggtggcagaaagagggcagtgatgtgtagggggaggcaaagtgaagtaagcctgggcagtggtcactaaagtgacactgctgaggcagctgcttccttcagaaggaaatgttttgtgaccctaaaattcatggtagtgctactgtccagggtttgggggctctttggaaatggagtatgtacggaactggcatgtatagacttatatagccatagaaagaggtggatagaaacaggtccaccatggcaatatttttttctggccagtttactaggcattaaaaaaaatactgcttttatgtgccaagtctcttatggaactagtatgggattaaaggacgttaattggaaaggagggtcagtatataaggaccacagtggcctgttaaggatgacagatgtctctagcagtttgttcactactaaagttaaacaggacaaaatagtctttcctgaccttgctggcataaatattaagaaaattgtttgagaattagatttttttagtatgtatataaaaacagcaccattctttgtataaatcagatagatcttatctgatagatgaagctaagaccctttgagtctacactgggttgactctgagaggtttatatcttattgggtattaagataaagaagggtcacatgagagcaaagcttagctttgaagccatcacctcccaaatggtgaccaaggaggaaacttttaagccatagtatagatgctaacccccatttagacctgcatcagatcacttgctaagacaagaaataccagcacctcctgttctttataggaatgaaacttagatccttaaaggctgctacctgatatactcatgactggacagttttgataaaaacttccaaaattgaaaatcaaaatccagcaagaattaagacatggcagcttccaaaagcataattcaaatttcattcaaaatttactgttttggcttcaagtaagtgtttactgttggttgggttttaaagccataattatggttgagtaaggattcatttatttatttattaaatttttatacatttttgaaaagatttcaaatctatgtttcccaggctggtcttgagctcctggcctcaagcaatcctcccaccttggcctcccaaagtgttgggattacaggtgctagccaactgcatccagccaatgtttcatttcaactggcttaaatcttcaaagtggttaagaatttagtaaataaaactacttaatctacaactttcaaaaattgatgagtaatcactaattctgtaaatgaaggagttggacttcactattgccaaagcaacattttccccaaggaaagtcaatttgatatcctgtcacacttttcagccctggctagttaacacagtactatgaaaatctttagctagattttaaacgaaatatgccagcagaagtatggaatgagtccacaaaaatgagtgcctgccacaatgctatagtagctatggtgtatttagtgcagagtgtgggatgaataagtacatagtaattaaagtcatagtcctggcccaacagaacagttactaaatgtaagatacaaactaaactcacagtcatatttagaaggcgcttttcagctttagcactgacttaaaaagtctgaaccaccaggaagatgcgtacttaactggttaaaaaattaagtggccctggaaagttttaccccaaagatacaacttcttcacttatttagttcagtaatgaggctgagggacccaattttcaagtgtgcatttgagtgggaaacttttaaacaccatatgttgaagtttcatgagctcagtggaaaccttaaggtcagagtaaaagaaactggctgtaaacagccctgcagtgaagagactgggtcttagcaccttccacattcactcagcgccatctcagtcagcgcctgccagggaaagggcatggagagctgggacgggtgccttctcttttgcaccactccctttgcatattacacagtgcactggcttgccttacaatctaaggttcacatacagggggttttctatactgcttccggacattttttgcaaaagaacatcagaaccaatgaaggtaccatttcaggaggaatcatttttgtttgacttctgctatatgttgcccagcattagtcattgttttgataaagactaaaaggccttttctcaacatttgtgctctcccaaccacctgggaaagcaacccttccactcacaagaggtaacctcagatagggatatagtattcatttaagaaggggtagcccccccagcctgatttaaaaaggcccaagtcaatgtatggaacatgacaagggaagtgaaaaacaatggagtacacagtctgccttgaaaagcagccatttgatgaacagtcacaaatacaaagaatttggacattgtaacataatttcagaacttgctggtaagaataatttgcattcacacacaagagacatgaaatgctttttaaaagtctgtgataccagatgtcctttaaacactacacagacccatttgccacttgaaatgacaagaagaaatcctttcccttaatcttttcaattccatgcaaaccgtaattgagtacaaggcaccaaattttatgaattgtataaaattagttcacaaagctttatcagtaagtagaacaaactccatttctccctcccggccagcccaccctcctcccacccaccacccgccatccccgaccaagttttcattctgcactactgtcgacctctctagggcttatgctggggcatgccccactgtcagccaatccacctcattggttcttcccttgtacttggatgaagctgtaagcacagccagagtagcaaactcatacaatcattgactctagaagccttgccattaaaaacaaaaataaactctgctattgagtccataggacacattaacacttctacagtttccaattttattcatgacattttaagagacatct

SEQ ID NO: 418050 - DNA, 6284 bp, Homo sapiens
gggagggggaagggaattatggaaggaatccagctggcctgttagtaagggtgttccagtgctaggtggaggtggagtttggctgcctttggggagattggaagggtgaggaatagaggcctgatttctgagtgttgtttctgtgttggacaattctatgcaaactagagccaaaatggaagagggtgcaagtcccctcctggggccccagacgccccctcctttcttgctgcctggagcaggggcagtgctgttagtggctactcctggtgtgaacagcccatcctggccaccttccacaggaaacctgacctgaaggacagaagaggaaggaagcaggctttgccacaaatgtcagtgcagaactctggctggccccaccaagaagacagccccaagccccaggatccaggtccaccagccaactcagacagtgactcaggccacctgccgggggaggaccctgaggatacccatgctcagggtcctgcagttctgagcttgggttccctttgcctggacaccaaccaagcccccaactggactggacttcagaccctcctgcagcaactccctccgcaggacattgatgagcgctactgcctggcccttggggaggaggagcgggccgagctgcagctcttctgtgccaggcggaagcaggaagccctgggacagggggtagcccgcctggtacttcccaagcttgaaggacacacctgtgagaagtgtagggagttgctgaagccaggggagtacggagtgtttgcagcccgggcaggggaacagcgctgctggcaccagccttgctttgcctgccaggcctgtggccaggccctgataaacctcatctacttctaccatgatggacaactctactgcggccgtcatcatgcagagttgctgcgcccgcgctgcccggcttgtgaccagctgatcttctcctggcgctgcaccgaggcggagggacagcgctggcatgagaaccacttctgttgccaggactgcgccgggcctctgggcgggggacgttatgccctgcctgggggaagcccctgctgccccagctgcttcgagaaccgctactcggatgcaggctcgagctgggccggggcactggaagggcaggcattccttggagcgcccccaccgcaccccccagacccaagcctcggggcccgcagctctcaccgcgcatccctggccggagcgttccaagggccgcccgaacccaccccgcgccgcggtcggggttgcggcgccagactccctcccaggcgcgggaggcggacgccctctggtggaggcgggggaccctggcgaggactctcggcggcggcggcggcgcgcacggcccaggggctgggcggggcgggaggctgggcctcacccccactagctgcggtgtaggtccagctccgcggctctgagaccagcgtttccgacccggcccggaacaggggagactggactcgaccgaactgaaggaagggaccaaacctcggtgaactctgcaaccctctcccgaacactccttctcgctgctgccggcggttccagcctgcaaactcagagggggctgcctggatccagtccccagcaggagaaccgacctggggacaaagcggaggcacccaaagggcaggagcaatgccgcctggagactattcgtgatcccaaggacacccctttctccacctgctcctcctcctctgactcggaacctgaaggatttttcttaggcgagcgccttccccagtcctggaagacccccggaagcctccaagcagaggacagcaacgcctctaagacgcactgcaccatgtgctagtggcgcagctcagagaggggatgtgagtgggaggaaaggggtctgtaaagcgggagaacaaggctagcctccccctaacaatcctagactgagacgcagtcaggcgcacgcccgcaagaggcggcgaggtgacaagtttggagtgcgcccccttcagtactgcgcgttctaagacttttggcggagactttcttggcaaaacccattccccaaagctacgcttcccctgctgagatagcccctacccccacctccacaggctgggacagccccgtccccaccatcctcctcccaagccaattaaatgatcacagcacgcgtgacagttaccggctggagagccggaggtgggaccgggagcaggggaccgtagaaccgggccgcgctcctcccctcctagagttcgtggaggcgcagcagagggccgtccctcttccggatgtcggactaagcgaacagcgcccccactgccggccggtagcagccggaagtgccagaccggaggtgcgtcattcaccggcgacgccgatacggttcctccaccgaggcccatgcgaagctttccactatggcttccagcactgtcccggtgagcgctgctggctcggctaatgaaactcccgaaataccggacaacgtgggagattggcttcggggcgtctaccgctttgccactgataggaatgacttccggaggaacttgatactaaatttgggactctttgctgcgggagtttggctggccaggaacttgagtgacattgacctcatggcacctcagccaggggtgtagccaagtagttctaatgccacctgtcgtcttatcatctgattgcagacaaatggaatcctgtgctgaacccgaatcttccaatttgattcagatgggcacttttcttccccttccctgcctagtttccttttgttccttgagtccacgcagaattccattctctggtcagcagacaggcttaagctaaagtattgcctctattctgtaaagttctgtacatagttcccaagcttctgcagggggtgatttttgctcttgtcctgagaaataacagtgctgttttaaaaaacatttgaaataaataccgcacacaaaggcagtcattttattcttttaataagaaacttttgcttacaaaaacaaggtgtaaaaagatttacaaaaatcataaaaacatgatttatatttcacacttgagagacaaaaacaagccccaaaacatggattttaatggaggtggtttgcttcattttaaaagggaaaaaaaaaaaaggaagctgtaaccatacattgatgttaacctagcatgaagtttattcttgaagaatttacattgttgagcaatattaggggaagaagccatttggtgttgcatagcattttagtgcaccagatgggttttccagacaccagggaggcatcattgctggaatagtgaggtttggtggcagaaagagggcagtgatgtgtagggggaggcaaagtgaagtaagcctgggcagtggtcactaaagtgacactgctgaggcagctgcttccttcagaaggaaatgttttgtgaccctaaaattcatggtagtgctactgtccagggtttgggggctctttggaaatggagtatgtacggaactggcatgtatagacttatatagccatagaaagaggtggatagaaacaggtccaccatggcaatatttttttctggccagtttactaggcattaaaaaaaatactgcttttatgtgccaagtctcttatggaactagtatgggattaaaggacgttaattggaaaggagggtcagtatataaggaccacagtggcctgttaaggatgacagatgtctctagcagtttgttcactactaaagttaaacaggacaaaatagtctttcctgaccttgctggcataaatattaagaaaattgtttgagaattagatttttttagtatgtatataaaaacagcaccattctttgtataaatcagatagatcttatctgatagatgaagctaagaccctttgagtctacactgggttgactctgagaggtttatatcttattgggtattaagataaagaagggtcacatgagagcaaagcttagctttgaagccatcacctcccaaatggtgaccaaggaggaaacttttaagccatagtatagatgctaacccccatttagacctgcatcagatcacttgctaagacaagaaataccagcacctcctgttctttataggaatgaaacttagatccttaaaggctgctacctgatatactcatgactggacagttttgataaaaacttccaaaattgaaaatcaaaatccagcaagaattaagacatggcagcttccaaaagcataattcaaatttcattcaaaatttactgttttggcttcaagtaagtgtttactgttggttgggttttaaagccataattatggttgagtaaggattcatttatttatttattaaatttttatacatttttgaaaagatttcaaatctatgtttcccaggctggtcttgagctcctggcctcaagcaatcctcccaccttggcctcccaaagtgttgggattacaggtgctagccaactgcatccagccaatgtttcatttcaactggcttaaatcttcaaagtggttaagaatttagtaaataaaactacttaatctacaactttcaaaaattgatgagtaatcactaattctgtaaatgaaggagttggacttcactattgccaaagcaacattttccccaaggaaagtcaatttgatatcctgtcacacttttcagccctggctagttaacacagtactatgaaaatctttagctagattttaaacgaaatatgccagcagaagtatggaatgagtccacaaaaatgagtgcctgccacaatgctatagtagctatggtgtatttagtgcagagtgtgggatgaataagtacatagtaattaaagtcatagtcctggcccaacagaacagttactaaatgtaagatacaaactaaactcacagtcatatttagaaggcgcttttcagctttagcactgacttaaaaagtctgaaccaccaggaagatgcgtacttaactggttaaaaaattaagtggccctggaaagttttaccccaaagatacaacttcttcacttatttagttcagtaatgaggctgagggacccaattttcaagtgtgcatttgagtgggaaacttttaaacaccatatgttgaagtttcatgagctcagtggaaaccttaaggtcagagtaaaagaaactggctgtaaacagccctgcagtgaagagactgggtcttagcaccttccacattcactcagcgccatctcagtcagcgcctgccagggaaagggcatggagagctgggacgggtgccttctcttttgcaccactccctttgcatattacacagtgcactggcttgccttacaatctaaggttcacatacagggggttttctatactgcttccggacattttttgcaaaagaacatcagaaccaatgaaggtaccatttcaggaggaatcatttttgtttgacttctgctatatgttgcccagcattagtcattgttttgataaagactaaaaggccttttctcaacatttgtgctctcccaaccacctgggaaagcaacccttccactcacaagaggtaacctcagatagggatatagtattcatttaagaaggggtagcccccccagcctgatttaaaaaggcccaagtcaatgtatggaacatgacaagggaagtgaaaaacaatggagtacacagtctgccttgaaaagcagccatttgatgaacagtcacaaatacaaagaatttggacattgtaacataatttcagaacttgctggtaagaataatttgcattcacacacaagagacatgaaatgctttttaaaagtctgtgataccagatgtcctttaaacactacacagacccatttgccacttgaaatgacaagaagaaatcctttcccttaatcttttcaattccatgcaaaccgtaattgagtacaaggcaccaaattttatgaattgtataaaattagttcacaaagctttatcagtaagtagaacaaactccatttctccctcccggccagcccaccctcctcccacccaccacccgccatccccgaccaagttttcattctgcactactgtcgacctctctagggcttatgctggggcatgccccactgtcagccaatccacctcattggttcttcccttgtacttggatgaagctgtaagcacagccagagtagcaaactcatacaatcattgactctagaagccttgccattaaaaacaaaaataaactctgctattgagtccataggacacattaacacttctacagtttccaattttattcatgacattttaagagacatct

SEQ ID NO: 418051 - DNA, 3125 bp, Homo sapiens
gggagggggaagggaattatggaaggaatccagctggcctgttagtaagggtgttccagtgctaggtggaggtggagtttggctgcctttggggagattggaagggtgaggaatagaggcctgatttctgagtgttgtttctgtgttggacaattctatgcaaactagagccaaaatggaagagggtgcaagtcccctcctggggccccagacgccccctcctttcttgctgcctggagcaggggcagtgctgttagtggctactcctggtgtgaacagcccatcctggccaccttccacaggaaacctgacctgaaggacagaagaggaaggaagcaggctttgccacaaatgtcagtgcagaactctggctggccccaccaagaagacagccccaagccccaggatccaggtccaccagccaactcagacagtgactcaggccacctgccgggggaggaccctgaggatacccatgctcagggtcctgcagttctgagcttgggttccctttgcctggacaccaaccaagcccccaactggactggacttcagaccctcctgcagcaactccctccgcaggacattgatgagcgctactgcctggcccttggggaggaggagcgggccgagctgcagctcttctgtgccaggcggaagcaggaagccctgggacagggggtagcccgcctggtacttcccaagcttgaaggacacacctgtgagaagtgtagggagttgctgaagccaggggagtacggagtgtttgcagcccgggcaggggaacagcgctgctggcaccagccttgctttgcctgccaggcctgtggccaggccctgataaacctcatctacttctaccatgatggacaactctactgcggccgtcatcatgcagagttgctgcgcccgcgctgcccggcttgtgaccagctgatcttctcctggcgctgcaccgaggcggagggacagcgctggcatgagaaccacttctgttgccaggactgcgccgggcctctgggcgggggacgttatgccctgcctgggggaagcccctgctgccccagctgcttcgagaaccgctactcggatgcaggctcgagctgggccggggcactggaagggcaggcattccttggagcgcccccaccgcaccccccagacccaagcctcggggcccgcagctctcaccgcgcatccctggccggagcgttccaagggccgcccgaacccaccccgcgccgcggtcggggttgcggcgccagactccctcccaggcgcgggaggcggacgccctctggtggaggcgggggaccctggcgaggactctcggcggcggcggcggcgcgcacggcccaggggctgggcggggcgggaggctgggcctcacccccactagctgcggtgtaggtccagctccgcggctctgagaccagcgtttccgacccggcccggaacaggggagactggactcgaccgaactgaaggaagggaccaaacctcggtgaactctgcaaccctctcccgaacactccttctcgctgctgccggcggttccagcctgcaaactcagagggggctgcctggatccagtccccagcaggagaaccgacctggggacaaagcggaggcacccaaagggcaggagcaatgccgcctggagactattcgtgatcccaaggacacccctttctccacctgctcctcctcctctgactcggaacctgaaggatttttcttaggcgagcgccttccccagtcctggaagacccccggaagcctccaagcagaggacagcaacgcctctaagacgcactgcaccatgtgctagtggcgcagctcagagaggggatgtgagtgggaggaaaggggtctgtaaagcgggagaacaaggctagcctccccctaacaatcctagactgagacgcagtcaggcgcacgcccgcaagaggcggcgaggtgacaagtttggagtgcgcccccttcagtactgcgcgttctaagacttttggcggagactttcttggcaaaacccattccccaaagctacgcttcccctgctgagatagcccctacccccacctccacaggctgggacagccccgtccccaccatcctcctcccaagccaattaaatgatcacagcacgcgtgacagttaccggctggagagccggaggtgggaccgggagcaggggaccgtagaaccgggccgcgctcctcccctcctagagttcgtggaggcgcagcagagggccgtccctcttccggatgtcggactaagcgaacagcgcccccactgccggccggtagcagccggaagtgccagaccggaggtgcgtcattcaccggcgacgccgatacggttcctccaccgaggcccatgcgaagctttccactatggcttccagcactgtcccggtgagcgctgctggctcggctaatgaaactcccgaaataccggacaacgtgggagattggcttcggggcgtctaccgctttgccactgataggaatgacttccggaggaacttgatactaaatttgggactctttgctgcgggagtttggctggccaggaacttgagtgacattgacctcatggcacctcagccaggggtgtagccaagtagttctaatgccacctgtcgtcttatcatctgattgcagacaaatggaatcctgtgctgaacccgaatcttccaaaaaacagcctacaatctgtgaccaccacaagatgtgccctgatggcagctgaagtttgattcagatgggcacttttcttccccttccctgcctagtttccttttgttccttgagtccacgcagaattccattctctggtcagcagacaggcttaagctaaagtattgcctctattctgtaaagttctgtacatagttcccaagcttctgcagggggtgatttttgctcttgtcctgagaaataacagtgctgttttaaaaaacatttgaaataaataccgcacacaaaggcaaaaaaaaaaaaaaaaaacgccgaattgagctactttggcatcgccctatatggaggggattacaataatgggccgcggttaaaacccggggatgggcccgggggtcccacttgcttggggccctttgc

SEQ ID NO: 418052 - DNA, 2905 bp, Homo sapiens
gggagggggaagggaattatggaaggaatccagctggcctgttagtaagggtgttccagtgctaggtggaggtggagtttggctgcctttggggagattggaagggtgaggaatagaggcctgatttctgagtgttgtttctgtgttggacaattctatgcaaactagagccaaaatggaagagggtgcaagtcccctcctggggccccagacgccccctcctttcttgctgcctggagcaggggcagtgctgttagtggctactcctggtgtgaacagcccatcctggccaccttccacaggaaacctgacctgaaggacagaagaggaaggaagcaggctttgccacaaatgtcagtgcagaactctggctggccccaccaagaagacagccccaagccccaggatccaggtccaccagccaactcagacagtgactcaggccacctgccgggggaggaccctgaggatacccatgctcagggtcctgcagttctgagcttgggttccctttgcctggacaccaaccaagcccccaactggactggacttcagaccctcctgcagcaactccctccgcaggacattgatgagcgctactgcctggcccttggggaggaggagcgggccgagctgcagctcttctgtgccaggcggaagcaggaagccctgggacagggggtagcccgcctggtacttcccaagcttgaaggacacacctgtgagaagtgtagggagttgctgaagccaggggagtacggagtgtttgcagcccgggcaggggaacagcgctgctggcaccagccttgctttgcctgccaggcctgtggccaggccctgataaacctcatctacttctaccatgatggacaactctactgcggccgtcatcatgcagagttgctgcgcccgcgctgcccggcttgtgaccagctgatcttctcctggcgctgcaccgaggcggagggacagcgctggcatgagaaccacttctgttgccaggactgcgccgggcctctgggcgggggacgttatgccctgcctgggggaagcccctgctgccccagctgcttcgagaaccgctactcggatgcaggctcgagctgggccggggcactggaagggcaggcattccttggagcgcccccaccgcaccccccagacccaagcctcggggcccgcagctctcaccgcgcatccctggccggagcgttccaagggccgcccgaacccaccccgcgccgcggtcggggttgcggcgccagactccctcccaggcgcgggaggcggacgccctctggtggaggcgggggaccctggcgaggactctcggcggcggcggcggcgcgcacggcccaggggctgggcggggcgggaggctgggcctcacccccactagctgcggtgtaggtccagctccgcggctctgagaccagcgtttccgacccggcccggaacaggggagactggactcgaccgaactgaaggaagggaccaaacctcggtgaactctgcaaccctctcccgaacactccttctcgctgctgccggcggttccagcctgcaaactcagagggggctgcctggatccagtccccagcaggagaaccgacctggggacaaagcggaggcacccaaagggcaggagcaatgccgcctggagactattcgtgatcccaaggacacccctttctccacctgctcctcctcctctgactcggaacctgaaggatttttcttaggcgagcgccttccccagtcctggaagacccccggaagcctccaagcagaggacagcaacgcctctaagacgcactgcaccatgtgctagtggcgcagctcagagaggggatgtgagtgggaggaaaggggtctgtaaagcgggagaacaaggctagcctccccctaacaatcctagactgagacgcagtcaggcgcacgcccgcaagaggcggcgaggtgacaagtttggagtgcgcccccttcagtactgcgcgttctaagacttttggcggagactttcttggcaaaacccattccccaaagctacgcttcccctgctgagatagcccctacccccacctccacaggctgggacagccccgtccccaccatcctcctcccaagccaattaaatgatcacagcacgcgtgacagttaccggctggagagccggaggtgggaccgggagcaggggaccgtagaaccgggccgcgctcctcccctcctagagttcgtggaggcgcagcagagggccgtccctcttccggatgtcggactaagcgaacagcgcccccactgccggccggtagcagccggaagtgccagaccggaggtgcgtcattcaccggcgacgccgatacggttcctccaccgaggcccatgcgaagctttccactatggcttccagcactgtcccggtgagcgctgctggctcggctaatgaaactcccgaaataccggacaacgtgggagattggcttcggggcgtctaccgctttgccactgataggaatgacttccggaggaacttgatactaaatttgggactctttgctgcgggagtttggctggccaggaacttgagtgacattgacctcatggcacctcagccaggggtgtagccaagtagacaaatggaatcctgtgctgaacccgaatcttccaatttgattcagatgggcacttttcttccccttccctgcctagtttccttttgttccttgagtccacgcagaattccattctctggtcagcagacaggcttaagctaaagtattgcctctattctgtaaagttctgtacatagttcccaagcttctgcagggggtgatttttgctcttgtcctgagaaataacagtgctgttttaaaaaacatttgaaataaataccgcacacaaaggc

SEQ ID NO: 418053 - DNA, 3603 bp, Homo sapiens
  misc_feature (222)..(222): n is a, c, g, or t
agcccagtcgagtcctgcccggctagaagccggctgtcggtctccgtgtcgccgccgccgcccggcatcgtggagctggggcccccttttgcctgggagttttgtagtcgcctagggtcagcggtgacatcccaaagggcaggcccggcagccgccatggtggccaaggattaccccttctacctcacggtcaagagagcgaactgcagcctggagctaccnccggccagcggtccggccaaggacgctgaggagcctagtaataaacgggtcaaacccctttcccgagtcacgtcgctagcaaacctcatcccgcccgtgaaggccacgccattaaagcgcttcagtcaaaccctgcagcgctccattagcttccgcagtgagagccgccctgacatcctcgccccccgaccctggtccagaaatgccgccccctcgagcacgaaacggagagatagcaagctgtggagtgagaccttcgatgtgtgcgtcaatcagatgcttacatccaaggaaatcaaacgtcaggaggcgatctttgagctttcccaaggagaagaagacttgatagaagacttgaaattagcaaaaaaggcctatcatgaccccatgctgaaactctccataatgacagaacaagagttgaatcaaatttttggaacactggactctctaattcctctacatgaagagctccttagtcagcttcgagatgttaggaagcctgatggctcgactgaacatgttggtcccatcctcgtgggctggctcccttgcctcagctcctatgatagctactgcagcaatcaagtagccgccaaagctctgctggaccacaaaaagcaagatcaccgagtccaggatttcctacagcgatgtttagaatccccctttagccgcaaactagatctctggaatttcctcgatattccaagaagccgcctggtaaaataccctctgcttctccgagaaatcttgaggcacacaccaaatgataatccagatcagcagcacttggaagaagctataaatatcattcagggaattgtggcagaaatcaacaccaagactggtgaatctgaatgccgctattataaagagcggcttctttacttggaagaaggccagaaagactccctgatcgacagctctcgagtcttgtgttgtcatggtgaactgaagaacaatcggggcgtgaaactgcatgttttcctgttccaagaagtgcttgtgatcactcgagccgtcacccacaatgagcagctttgctaccagctgtaccgtcagccaatccccgtgaaagacctcctgctggaagacctccaggatggagaagtgaggctgggtggctccctgcgaggggcattcagcaacaatgagagaattaaaaacttcttcagagtcagtttcaaaaatggatcccaaagtcagacccactcgctacaagccaatgacactttcaacaaacagcagtggcttaactgtattcgtcaagccaaagaaacagttttgtgtgctgccgggcaagctggggtgcttgactccgagggatcgttcctaaatcccaccaccgggagcagagagctacagggagaaacaaaacttgagcagatggaccaatcggacagtgagtcagactgtagtatggacacgagtgaggtcagcctcgactgtgagcgcatggaacagacagactcttcctgtggaaacagcaggcacggtgaaagtaacgtctgacagaagcatgtgcacttcgggaagcaggcctgcatcttacctgtacagtatttgcattccacagatggaacggtttggagaagcactttttcatacttttgtgaaagtatacatgttggcccagtctctcgtatctgtacctttgtccctagtactgtaactgccaatctgtctgtgtaagctggaatctgtggcaactattaccctgtgttgtatttcccaagtgtctggatggatggagaggtactcaaacaagttactttcagttgtcctgctggattttaaaaaaatagaaaaagaatctcaaaactactgttttacatagattgtttgaagagtccttcctcttgtgcttctgtaccactttcccagctcttagatgtggtagctaaaggcacggaatttagacggccttgtaaatagggcatgaggaactcatctgtgtattgggatggtattagagagagaatcaggaaagaccaactcatgaagtgaacttggtttgatcttactcaactagaaagcttgaaaacatccctggggattctgaaggcttaattttgcaaaggaggatgcattgtctgaactttgcaacttcatccagtgcaagtttgatgcaagaatgtattaggacataaaatagaggctgaccttaaaagggccaggacagaagcggctgccagctctgaatctttaactgaaatgcacatggcaccaggaggtgtctctcatagttggttgctagcctaaaacatcagaatagaacccaaagggcttaggaaggcctgccaggataacaagaaggccctgtattcattgtgtttcatctgcctaggcctactcattattttagagaatgaatgaagcaacaaggaagagagaccatgactctatcgatgacactgtttatagaaacacaggagaggaagaatttggaatgaaaagcacttcgtcagaaccttctgtgggagccattgagagaaaagcatggtccagtgccttctgagaaaggccagagctttgggctttcctgctctgcttttgggtcgtcaatttgccatctctggttctgtgctataatcagaattgtaattatgttctccagaggccaatttcattaactctgattaattagaatcagctagccagattagtaacctctttgtccagccttgatttacagtgcagggtaaagtgcagaccttaaaaacagctaagtacctagaagagctccctgcaagtgtaaatattaaggatgacctgtgcaaaattatacccacaccagcactagtggtaattattctaaattattgccaaaaagttttttttaatctgtctttcaagtttacagaaaagaaagcagtaaatgcattgatgtcattttattatgtacatatatcatgtgcattcaagctgtgtgacaagatatatcaatataaaaacaaggtatatactttattattttttgaaaacaaggatattgtgatcaattttaccctgtaaaacatatttctgtatttataggtcttaaacatgatgaattttttctattacaagtttatttaaaactgctttctcaagtcgttattgatacagcaagtgaacctgctgcagacagaagcagaggaaagccaagaacagcctttattggtgaagaaaagaatgaatgattctttgtaggcgccatcagccacttttagaagccatcagccagtgtgttgggaaaagaggtttgtcaagtgttggcctatgggaaggtggtcaatgaatgttttgatgaaatgaatgtttttgtataatggccttaaacttttctggaagtatttcaaataaattacattattaagtcatcctccatgtgtacag

SEQ ID NO: 418054 - DNA, 801 bp, Homo sapiens
agcgggttttttccagcctggagaggccgaaccagcgcgggggtcgaggagacctgagcctgccatactgagtctatggacagttccacagcaatgaatcaatgcagctgtagaggaatggaagaaaacaaggaaaggcctaaacggcagcggcaaaacaactttcccatgtttccctctcctaaagcctggaatttcagagggcgaaaacggaaacagagcacccaagatgaagatgctgttagcctttgcagtctcgacataagtgagcctagtaataaacgggtcaaacccctttcccgagtcacgtcgctagcaaacctcatcccgcccgtgaaggccacgccattaaagcgcttcagtcaaaccctgcagcgctccattagcttccgcagtgagagccgccctgacatcctcgccccccgaccctggtccagaaatgccgccccctcgagcacgaaacggagagatagcaagctgtggagtgagaccttcgatgtgtgcgtcaatcagatgcttacatccaaggaaatcaaacgtcaggaggcgatctttgagctttcccaaggagaagaagacttgatagaagacttgaaattagcaaaaaaggcctatcatgaccccatgctgaaactctccataatgacagaacaagagttgaatcaaatttttggaacactggactctctaattcctctacatgaagagctccttagtcagcttcgagatgttaggaagcctgatggctcgactgaacatgttggtcccatcctcgtgggctgggtaagaaagttctctggt

SEQ ID NO: 418055 - DNA, 451 bp, Homo sapiens
  misc_feature (222)..(222): n is a, c, g, or t
agcccagtcgagtcctgcccggctagaagccggctgtcggtctccgtgtcgccgccgccgcccggcatcgtggagctggggcccccttttgcctgggagttttgtagtcgcctagggtcagcggtgacatcccaaagggcaggcccggcagccgccatggtggccaaggattaccccttctacctcacggtcaagagagcgaactgcagcctggagctaccnccggccagcggtccggccaaggacgctgaggtagggccgcgccctgcacctggacctctatgggtcatctgcctgtctcgtctgcctccatctcccattctcggcgcccgtccagtgtcactgtctctgtttccatctctcactctccgtgtgtgccactttctctctctacatctctcccacagtcttctttgtgtctccccgtcgccatctctcaccctgtctcctt

SEQ ID NO: 418056 - DNA, 3791 bp, Homo sapiens
accatagtaacaatgggggagaaggggcagtttctagaaggagaaggaggcactggagcagatacaaataattcctgcctacaaaattcttccctatctgtcctcctatcataaaagtgtcagctttcatgactgacgatgcatctacaaggactggagttgaacttcaagcaagagactcacagacaaaggcgccctgggccagtggcacacactagctttatcaaagagactcagggacaagtacgcctggtctgtactgcggtttgccaattagctggatgaacagctggctaatttctgttttatctcttgggcagaagacacatgaggctagaataggttatcttcaacggggagccgagctaaggcctcatcgaaaacggaaacagagcacccaagatgaagatgctgttagcctttgcagtctcgacataagtgagcctagtaataaacgggtcaaacccctttcccgagtcacgtcgctagcaaacctcatcccgcccgtgaaggccacgccattaaagcgcttcagtcaaaccctgcagcgctccattagcttccgcagtgagagccgccctgacatcctcgccccccgaccctggtccagaaatgccgccccctcgagcacgaaacggagagatagcaagctgtggagtgagaccttcgatgtgtgcgtcaatcagatgcttacatccaaggaaatcaaacgtcaggaggcgatctttgagctttcccaaggagaagaagacttgatagaagacttgaaattagcaaaaaaggcctatcatgaccccatgctgaaactctccataatgacagaacaagagttgaatcaaatttttggaacactggactctctaattcctctacatgaagagctccttagtcagcttcgagatgttaggaagcctgatggctcgactgaacatgttggtcccatcctcgtgggctggctcccttgcctcagctcctatgatagctactgcagcaatcaagtagccgccaaagctctgctggaccacaaaaagcaagatcaccgagtccaggatttcctacagcgatgtttagaatccccctttagccgcaaactagatctctggaatttcctcgatattccaagaagccgcctggtaaaataccctctgcttctccgagaaatcttgaggcacacaccaaatgataatccagatcagcagcacttggaagaagctataaatatcattcagggaattgtggcagaaatcaacaccaagactggtgaatctgaatgccgctattataaagagcggcttctttacttggaagaaggccagaaagactccctgatcgacagctctcgagtcttgtgttgtcatggtgaactgaagaacaatcggggcgtgaaactgcatgttttcctgttccaagaagtgcttgtgatcactcgagccgtcacccacaatgagcagctttgctaccagctgtaccgtcagccaatccccgtgaaagacctcctgctggaagacctccaggatggagaagtgaggctgggtggctccctgcgaggggcattcagcaacaatgagagaattaaaaacttcttcagagtcagtttcaaaaatggatcccaaagtcagacccactcgctacaagccaatgacactttcaacaaacagcagtggcttaactgtattcgtcaagccaaagaaacagttttgtgtgctgccgggcaagctggggtgcttgactccgagggatcgttcctaaatcccaccaccgggagcagagagctacagggagaaacaaaacttgagcagatggaccaatcggacagtgagtcagactgtagtatggacacgagtgaggtcagcctcgactgtgagcgcatggaacagacagactcttcctgtggaaacagcaggcacggtgaaagtaacgtctgacagaagcatgtgcacttcgggaagcaggcctgcatcttacctgtacagtatttgcattccacagatggaacggtttggagaagcactttttcatacttttgtgaaagtatacatgttggcccagtctctcgtatctgtacctttgtccctagtactgtaactgccaatctgtctgtgtaagctggaatctgtggcaactattaccctgtgttgtatttcccaagtgtctggatggatggagaggtactcaaacaagttactttcagttgtcctgctggattttaaaaaaatagaaaaagaatctcaaaactactgttttacatagattgtttgaagagtccttcctcttgtgcttctgtaccactttcccagctcttagatgtggtagctaaaggcacggaatttagacggccttgtaaatagggcatgaggaactcatctgtgtattgggatggtattagagagagaatcaggaaagaccaactcatgaagtgaacttggtttgatcttactcaactagaaagcttgaaaacatccctggggattctgaaggcttaattttgcaaaggaggatgcattgtctgaactttgcaacttcatccagtgcaagtttgatgcaagaatgtattaggacataaaatagaggctgaccttaaaagggccaggacagaagcggctgccagctctgaatctttaactgaaatgcacatggcaccaggaggtgtctctcatagttggttgctagcctaaaacatcagaatagaacccaaagggcttaggaaggcctgccaggataacaagaaggccctgtattcattgtgtttcatctgcctaggcctactcattattttagagaatgaatgaagcaacaaggaagagagaccatgactctatcgatgacactgtttatagaaacacaggagaggaagaatttggaatgaaaagcacttcgtcagaaccttctgtgggagccattgagagaaaagcatggtccagtgccttctgagaaaggccagagctttgggctttcctgctctgcttttgggtcgtcaatttgccatctctggttctgtgctataatcagaattgtaattatgttctccagaggccaatttcattaactctgattaattagaatcagctagccagattagtaacctctttgtccagccttgatttacagtgcagggtaaagtgcagaccttaaaaacagctaagtacctagaagagctccctgcaagtgtaaatattaaggatgacctgtgcaaaattatacccacaccagcactagtggtaattattctaaattattgccaaaaagttttttttaatctgtctttcaagtttacagaaaagaaagcagtaaatgcattgatgtcattttattatgtacatatatcatgtgcattcaagctgtgtgacaagatatatcaatataaaaacaaggtatatactttattattttttgaaaacaaggatattgtgatcaattttaccctgtaaaacatatttctgtatttataggtcttaaacatgatgaattttttctattacaagtttatttaaaactgctttctcaagtcgttattgatacagcaagtgaacctgctgcagacagaagcagaggaaagccaagaacagcctttattggtgaagaaaagaatgaatgattctttgtaggcgccatcagccacttttagaagccatcagccagtgtgttgggaaaagaggtttgtcaagtgttggcctatgggaaggtggtcaatgaatgttttgatgaaatgaatgtttttgtataatggccttaaacttttctggaagtatttcaaataaattacattattaagtcatcctccatgtgtacag

SEQ ID NO: 418057 - DNA, 3725 bp, Homo sapiens
cacccgaggtcagcgtcgcgtcgggcgctgctggtggcggctcacagggccgcgggtcacttcgcggcgggggagccgggctcagggcgctccgggcggcgggcgccgtcccagcctgcatgaggcccttgtcccggcggctgcatcttgtaaaccgagcagccagaaaatcccgagataggacaccagggtggaggacgccaaggggttaaggtcagcgtgggtgcctcgcagccagagacgggcctaaacggcagcggcaaaacaactttcccatgtttccctctcctaaagcctggaatttcagagggcgaaaacggaaacagagcacccaagatgaagatgctgttagcctttgcagtctcgacataagtgagcctagtaataaacgggtcaaacccctttcccgagtcacgtcgctagcaaacctcatcccgcccgtgaaggccacgccattaaagcgcttcagtcaaaccctgcagcgctccattagcttccgcagtgagagccgccctgacatcctcgccccccgaccctggtccagaaatgccgccccctcgagcacgaaacggagagatagcaagctgtggagtgagaccttcgatgtgtgcgtcaatcagatgcttacatccaaggaaatcaaacgtcaggaggcgatctttgagctttcccaaggagaagaagacttgatagaagacttgaaattagcaaaaaaggcctatcatgaccccatgctgaaactctccataatgacagaacaagagttgaatcaaatttttggaacactggactctctaattcctctacatgaagagctccttagtcagcttcgagatgttaggaagcctgatggctcgactgaacatgttggtcccatcctcgtgggctggctcccttgcctcagctcctatgatagctactgcagcaatcaagtagccgccaaagctctgctggaccacaaaaagcaagatcaccgagtccaggatttcctacagcgatgtttagaatccccctttagccgcaaactagatctctggaatttcctcgatattccaagaagccgcctggtaaaataccctctgcttctccgagaaatcttgaggcacacaccaaatgataatccagatcagcagcacttggaagaagctataaatatcattcagggaattgtggcagaaatcaacaccaagactggtgaatctgaatgccgctattataaagagcggcttctttacttggaagaaggccagaaagactccctgatcgacagctctcgagtcttgtgttgtcatggtgaactgaagaacaatcggggcgtgaaactgcatgttttcctgttccaagaagtgcttgtgatcactcgagccgtcacccacaatgagcagctttgctaccagctgtaccgtcagccaatccccgtgaaagacctcctgctggaagacctccaggatggagaagtgaggctgggtggctccctgcgaggggcattcagcaacaatgagagaattaaaaacttcttcagagtcagtttcaaaaatggatcccaaagtcagacccactcgctacaagccaatgacactttcaacaaacagcagtggcttaactgtattcgtcaagccaaagaaacagttttgtgtgctgccgggcaagctggggtgcttgactccgagggatcgttcctaaatcccaccaccgggagcagagagctacagggagaaacaaaacttgagcagatggaccaatcggacagtgagtcagactgtagtatggacacgagtgaggtcagcctcgactgtgagcgcatggaacagacagactcttcctgtggaaacagcaggcacggtgaaagtaacgtctgacagaagcatgtgcacttcgggaagcaggcctgcatcttacctgtacagtatttgcattccacagatggaacggtttggagaagcactttttcatacttttgtgaaagtatacatgttggcccagtctctcgtatctgtacctttgtccctagtactgtaactgccaatctgtctgtgtaagctggaatctgtggcaactattaccctgtgttgtatttcccaagtgtctggatggatggagaggtactcaaacaagttactttcagttgtcctgctggattttaaaaaaatagaaaaagaatctcaaaactactgttttacatagattgtttgaagagtccttcctcttgtgcttctgtaccactttcccagctcttagatgtggtagctaaaggcacggaatttagacggccttgtaaatagggcatgaggaactcatctgtgtattgggatggtattagagagagaatcaggaaagaccaactcatgaagtgaacttggtttgatcttactcaactagaaagcttgaaaacatccctggggattctgaaggcttaattttgcaaaggaggatgcattgtctgaactttgcaacttcatccagtgcaagtttgatgcaagaatgtattaggacataaaatagaggctgaccttaaaagggccaggacagaagcggctgccagctctgaatctttaactgaaatgcacatggcaccaggaggtgtctctcatagttggttgctagcctaaaacatcagaatagaacccaaagggcttaggaaggcctgccaggataacaagaaggccctgtattcattgtgtttcatctgcctaggcctactcattattttagagaatgaatgaagcaacaaggaagagagaccatgactctatcgatgacactgtttatagaaacacaggagaggaagaatttggaatgaaaagcacttcgtcagaaccttctgtgggagccattgagagaaaagcatggtccagtgccttctgagaaaggccagagctttgggctttcctgctctgcttttgggtcgtcaatttgccatctctggttctgtgctataatcagaattgtaattatgttctccagaggccaatttcattaactctgattaattagaatcagctagccagattagtaacctctttgtccagccttgatttacagtgcagggtaaagtgcagaccttaaaaacagctaagtacctagaagagctccctgcaagtgtaaatattaaggatgacctgtgcaaaattatacccacaccagcactagtggtaattattctaaattattgccaaaaagttttttttaatctgtctttcaagtttacagaaaagaaagcagtaaatgcattgatgtcattttattatgtacatatatcatgtgcattcaagctgtgtgacaagatatatcaatataaaaacaaggtatatactttattattttttgaaaacaaggatattgtgatcaattttaccctgtaaaacatatttctgtatttataggtcttaaacatgatgaattttttctattacaagtttatttaaaactgctttctcaagtcgttattgatacagcaagtgaacctgctgcagacagaagcagaggaaagccaagaacagcctttattggtgaagaaaagaatgaatgattctttgtaggcgccatcagccacttttagaagccatcagccagtgtgttgggaaaagaggtttgtcaagtgttggcctatgggaaggtggtcaatgaatgttttgatgaaatgaatgtttttgtataatggccttaaacttttctggaagtatttcaaataaattacattattaagtcatcctccatgtgtacag

SEQ ID NO: 418058 - DNA, 3618 bp, Homo sapiens
agcgggttttttccagcctggagaggccgaaccagcgcgggggtcgaggagacctgagcctgccatactgagtctatggacagttccacagcaatgaatcaatgcagctgtagaggaatggaagaaaacaaggaaaggcctaaacggcagcggcaaaacaactttcccatgtttccctctcctaaagcctggaatttcagagggcgaaaacggaaacagagcacccaagatgaagatgctgttagcctttgcagtctcgacataagtgagcctagtaataaacgggtcaaacccctttcccgagtcacgtcgctagcaaacctcatcccgcccgtgaaggccacgccattaaagcgcttcagtcaaaccctgcagcgctccattagcttccgcagtgagagccgccctgacatcctcgccccccgaccctggtccagaaatgccgccccctcgagcacgaaacggagagatagcaagctgtggagtgagaccttcgatgtgtgcgtcaatcagatgcttacatccaaggaaatcaaacgtcaggaggcgatctttgagctttcccaaggagaagaagacttgatagaagacttgaaattagcaaaaaaggcctatcatgaccccatgctgaaactctccataatgacagaacaagagttgaatcaaatttttggaacactggactctctaattcctctacatgaagagctccttagtcagcttcgagatgttaggaagcctgatggctcgactgaacatgttggtcccatcctcgtgggctggctcccttgcctcagctcctatgatagctactgcagcaatcaagtagccgccaaagctctgctggaccacaaaaagcaagatcaccgagtccaggatttcctacagcgatgtttagaatccccctttagccgcaaactagatctctggaatttcctcgatattccaagaagccgcctggtaaaataccctctgcttctccgagaaatcttgaggcacacaccaaatgataatccagatcagcagcacttggaagaagctataaatatcattcagggaattgtggcagaaatcaacaccaagactggtgaatctgaatgccgctattataaagagcggcttctttacttggaagaaggccagaaagactccctgatcgacagctctcgagtcttgtgttgtcatggtgaactgaagaacaatcggggcgtgaaactgcatgttttcctgttccaagaagtgcttgtgatcactcgagccgtcacccacaatgagcagctttgctaccagctgtaccgtcagccaatccccgtgaaagacctcctgctggaagacctccaggatggagaagtgaggctgggtggctccctgcgaggggcattcagcaacaatgagagaattaaaaacttcttcagagtcagtttcaaaaatggatcccaaagtcagacccactcgctacaagccaatgacactttcaacaaacagcagtggcttaactgtattcgtcaagccaaagaaacagttttgtgtgctgccgggcaagctggggtgcttgactccgagggatcgttcctaaatcccaccaccgggagcagagagctacagggagaaacaaaacttgagcagatggaccaatcggacagtgagtcagactgtagtatggacacgagtgaggtcagcctcgactgtgagcgcatggaacagacagactcttcctgtggaaacagcaggcacggtgaaagtaacgtctgacagaagcatgtgcacttcgggaagcaggcctgcatcttacctgtacagtatttgcattccacagatggaacggtttggagaagcactttttcatacttttgtgaaagtatacatgttggcccagtctctcgtatctgtacctttgtccctagtactgtaactgccaatctgtctgtgtaagctggaatctgtggcaactattaccctgtgttgtatttcccaagtgtctggatggatggagaggtactcaaacaagttactttcagttgtcctgctggattttaaaaaaatagaaaaagaatctcaaaactactgttttacatagattgtttgaagagtccttcctcttgtgcttctgtaccactttcccagctcttagatgtggtagctaaaggcacggaatttagacggccttgtaaatagggcatgaggaactcatctgtgtattgggatggtattagagagagaatcaggaaagaccaactcatgaagtgaacttggtttgatcttactcaactagaaagcttgaaaacatccctggggattctgaaggcttaattttgcaaaggaggatgcattgtctgaactttgcaacttcatccagtgcaagtttgatgcaagaatgtattaggacataaaatagaggctgaccttaaaagggccaggacagaagcggctgccagctctgaatctttaactgaaatgcacatggcaccaggaggtgtctctcatagttggttgctagcctaaaacatcagaatagaacccaaagggcttaggaaggcctgccaggataacaagaaggccctgtattcattgtgtttcatctgcctaggcctactcattattttagagaatgaatgaagcaacaaggaagagagaccatgactctatcgatgacactgtttatagaaacacaggagaggaagaatttggaatgaaaagcacttcgtcagaaccttctgtgggagccattgagagaaaagcatggtccagtgccttctgagaaaggccagagctttgggctttcctgctctgcttttgggtcgtcaatttgccatctctggttctgtgctataatcagaattgtaattatgttctccagaggccaatttcattaactctgattaattagaatcagctagccagattagtaacctctttgtccagccttgatttacagtgcagggtaaagtgcagaccttaaaaacagctaagtacctagaagagctccctgcaagtgtaaatattaaggatgacctgtgcaaaattatacccacaccagcactagtggtaattattctaaattattgccaaaaagttttttttaatctgtctttcaagtttacagaaaagaaagcagtaaatgcattgatgtcattttattatgtacatatatcatgtgcattcaagctgtgtgacaagatatatcaatataaaaacaaggtatatactttattattttttgaaaacaaggatattgtgatcaattttaccctgtaaaacatatttctgtatttataggtcttaaacatgatgaattttttctattacaagtttatttaaaactgctttctcaagtcgttattgatacagcaagtgaacctgctgcagacagaagcagaggaaagccaagaacagcctttattggtgaagaaaagaatgaatgattctttgtaggcgccatcagccacttttagaagccatcagccagtgtgttgggaaaagaggtttgtcaagtgttggcctatgggaaggtggtcaatgaatgttttgatgaaatgaatgtttttgtataatggccttaaacttttctggaagtatttcaaataaattacattattaagtcatcctccatgtgtacag

SEQ ID NO: 418059 - DNA, 3531 bp, Homo sapiens
accatagtaacaatgggggagaaggggcagtttctagaaggagaaggaggcactggagcagatacaaataattcctgcctacaaaattcttccctatctgtcctcctatcataaaagcgaaaacggaaacagagcacccaagatgaagatgctgttagcctttgcagtctcgacataagtgagcctagtaataaacgggtcaaacccctttcccgagtcacgtcgctagcaaacctcatcccgcccgtgaaggccacgccattaaagcgcttcagtcaaaccctgcagcgctccattagcttccgcagtgagagccgccctgacatcctcgccccccgaccctggtccagaaatgccgccccctcgagcacgaaacggagagatagcaagctgtggagtgagaccttcgatgtgtgcgtcaatcagatgcttacatccaaggaaatcaaacgtcaggaggcgatctttgagctttcccaaggagaagaagacttgatagaagacttgaaattagcaaaaaaggcctatcatgaccccatgctgaaactctccataatgacagaacaagagttgaatcaaatttttggaacactggactctctaattcctctacatgaagagctccttagtcagcttcgagatgttaggaagcctgatggctcgactgaacatgttggtcccatcctcgtgggctggctcccttgcctcagctcctatgatagctactgcagcaatcaagtagccgccaaagctctgctggaccacaaaaagcaagatcaccgagtccaggatttcctacagcgatgtttagaatccccctttagccgcaaactagatctctggaatttcctcgatattccaagaagccgcctggtaaaataccctctgcttctccgagaaatcttgaggcacacaccaaatgataatccagatcagcagcacttggaagaagctataaatatcattcagggaattgtggcagaaatcaacaccaagactggtgaatctgaatgccgctattataaagagcggcttctttacttggaagaaggccagaaagactccctgatcgacagctctcgagtcttgtgttgtcatggtgaactgaagaacaatcggggcgtgaaactgcatgttttcctgttccaagaagtgcttgtgatcactcgagccgtcacccacaatgagcagctttgctaccagctgtaccgtcagccaatccccgtgaaagacctcctgctggaagacctccaggatggagaagtgaggctgggtggctccctgcgaggggcattcagcaacaatgagagaattaaaaacttcttcagagtcagtttcaaaaatggatcccaaagtcagacccactcgctacaagccaatgacactttcaacaaacagcagtggcttaactgtattcgtcaagccaaagaaacagttttgtgtgctgccgggcaagctggggtgcttgactccgagggatcgttcctaaatcccaccaccgggagcagagagctacagggagaaacaaaacttgagcagatggaccaatcggacagtgagtcagactgtagtatggacacgagtgaggtcagcctcgactgtgagcgcatggaacagacagactcttcctgtggaaacagcaggcacggtgaaagtaacgtctgacagaagcatgtgcacttcgggaagcaggcctgcatcttacctgtacagtatttgcattccacagatggaacggtttggagaagcactttttcatacttttgtgaaagtatacatgttggcccagtctctcgtatctgtacctttgtccctagtactgtaactgccaatctgtctgtgtaagctggaatctgtggcaactattaccctgtgttgtatttcccaagtgtctggatggatggagaggtactcaaacaagttactttcagttgtcctgctggattttaaaaaaatagaaaaagaatctcaaaactactgttttacatagattgtttgaagagtccttcctcttgtgcttctgtaccactttcccagctcttagatgtggtagctaaaggcacggaatttagacggccttgtaaatagggcatgaggaactcatctgtgtattgggatggtattagagagagaatcaggaaagaccaactcatgaagtgaacttggtttgatcttactcaactagaaagcttgaaaacatccctggggattctgaaggcttaattttgcaaaggaggatgcattgtctgaactttgcaacttcatccagtgcaagtttgatgcaagaatgtattaggacataaaatagaggctgaccttaaaagggccaggacagaagcggctgccagctctgaatctttaactgaaatgcacatggcaccaggaggtgtctctcatagttggttgctagcctaaaacatcagaatagaacccaaagggcttaggaaggcctgccaggataacaagaaggccctgtattcattgtgtttcatctgcctaggcctactcattattttagagaatgaatgaagcaacaaggaagagagaccatgactctatcgatgacactgtttatagaaacacaggagaggaagaatttggaatgaaaagcacttcgtcagaaccttctgtgggagccattgagagaaaagcatggtccagtgccttctgagaaaggccagagctttgggctttcctgctctgcttttgggtcgtcaatttgccatctctggttctgtgctataatcagaattgtaattatgttctccagaggccaatttcattaactctgattaattagaatcagctagccagattagtaacctctttgtccagccttgatttacagtgcagggtaaagtgcagaccttaaaaacagctaagtacctagaagagctccctgcaagtgtaaatattaaggatgacctgtgcaaaattatacccacaccagcactagtggtaattattctaaattattgccaaaaagttttttttaatctgtctttcaagtttacagaaaagaaagcagtaaatgcattgatgtcattttattatgtacatatatcatgtgcattcaagctgtgtgacaagatatatcaatataaaaacaaggtatatactttattattttttgaaaacaaggatattgtgatcaattttaccctgtaaaacatatttctgtatttataggtcttaaacatgatgaattttttctattacaagtttatttaaaactgctttctcaagtcgttattgatacagcaagtgaacctgctgcagacagaagcagaggaaagccaagaacagcctttattggtgaagaaaagaatgaatgattctttgtaggcgccatcagccacttttagaagccatcagccagtgtgttgggaaaagaggtttgtcaagtgttggcctatgggaaggtggtcaatgaatgttttgatgaaatgaatgtttttgtataatggccttaaacttttctggaagtatttcaaataaattacattattaagtcatcctccatgtgtacag

SEQ ID NO: 418060 - DNA, 3586 bp, Homo sapiens
agcggaggaacccatctggtgagctgagagttagtgaggggcccaagagaatggggcttgctctgccctgtgctttagatggaccatgtttgatagaaatatttggcctaaacggcagcggcaaaacaactttcccatgtttccctctcctaaagcctggaatttcagagggcgaaaacggaaacagagcacccaagatgaagatgctgttagcctttgcagtctcgacataagtgagcctagtaataaacgggtcaaacccctttcccgagtcacgtcgctagcaaacctcatcccgcccgtgaaggccacgccattaaagcgcttcagtcaaaccctgcagcgctccattagcttccgcagtgagagccgccctgacatcctcgccccccgaccctggtccagaaatgccgccccctcgagcacgaaacggagagatagcaagctgtggagtgagaccttcgatgtgtgcgtcaatcagatgcttacatccaaggaaatcaaacgtcaggaggcgatctttgagctttcccaaggagaagaagacttgatagaagacttgaaattagcaaaaaaggcctatcatgaccccatgctgaaactctccataatgacagaacaagagttgaatcaaatttttggaacactggactctctaattcctctacatgaagagctccttagtcagcttcgagatgttaggaagcctgatggctcgactgaacatgttggtcccatcctcgtgggctggctcccttgcctcagctcctatgatagctactgcagcaatcaagtagccgccaaagctctgctggaccacaaaaagcaagatcaccgagtccaggatttcctacagcgatgtttagaatccccctttagccgcaaactagatctctggaatttcctcgatattccaagaagccgcctggtaaaataccctctgcttctccgagaaatcttgaggcacacaccaaatgataatccagatcagcagcacttggaagaagctataaatatcattcagggaattgtggcagaaatcaacaccaagactggtgaatctgaatgccgctattataaagagcggcttctttacttggaagaaggccagaaagactccctgatcgacagctctcgagtcttgtgttgtcatggtgaactgaagaacaatcggggcgtgaaactgcatgttttcctgttccaagaagtgcttgtgatcactcgagccgtcacccacaatgagcagctttgctaccagctgtaccgtcagccaatccccgtgaaagacctcctgctggaagacctccaggatggagaagtgaggctgggtggctccctgcgaggggcattcagcaacaatgagagaattaaaaacttcttcagagtcagtttcaaaaatggatcccaaagtcagacccactcgctacaagccaatgacactttcaacaaacagcagtggcttaactgtattcgtcaagccaaagaaacagttttgtgtgctgccgggcaagctggggtgcttgactccgagggatcgttcctaaatcccaccaccgggagcagagagctacagggagaaacaaaacttgagcagatggaccaatcggacagtgagtcagactgtagtatggacacgagtgaggtcagcctcgactgtgagcgcatggaacagacagactcttcctgtggaaacagcaggcacggtgaaagtaacgtctgacagaagcatgtgcacttcgggaagcaggcctgcatcttacctgtacagtatttgcattccacagatggaacggtttggagaagcactttttcatacttttgtgaaagtatacatgttggcccagtctctcgtatctgtacctttgtccctagtactgtaactgccaatctgtctgtgtaagctggaatctgtggcaactattaccctgtgttgtatttcccaagtgtctggatggatggagaggtactcaaacaagttactttcagttgtcctgctggattttaaaaaaatagaaaaagaatctcaaaactactgttttacatagattgtttgaagagtccttcctcttgtgcttctgtaccactttcccagctcttagatgtggtagctaaaggcacggaatttagacggccttgtaaatagggcatgaggaactcatctgtgtattgggatggtattagagagagaatcaggaaagaccaactcatgaagtgaacttggtttgatcttactcaactagaaagcttgaaaacatccctggggattctgaaggcttaattttgcaaaggaggatgcattgtctgaactttgcaacttcatccagtgcaagtttgatgcaagaatgtattaggacataaaatagaggctgaccttaaaagggccaggacagaagcggctgccagctctgaatctttaactgaaatgcacatggcaccaggaggtgtctctcatagttggttgctagcctaaaacatcagaatagaacccaaagggcttaggaaggcctgccaggataacaagaaggccctgtattcattgtgtttcatctgcctaggcctactcattattttagagaatgaatgaagcaacaaggaagagagaccatgactctatcgatgacactgtttatagaaacacaggagaggaagaatttggaatgaaaagcacttcgtcagaaccttctgtgggagccattgagagaaaagcatggtccagtgccttctgagaaaggccagagctttgggctttcctgctctgcttttgggtcgtcaatttgccatctctggttctgtgctataatcagaattgtaattatgttctccagaggccaatttcattaactctgattaattagaatcagctagccagattagtaacctctttgtccagccttgatttacagtgcagggtaaagtgcagaccttaaaaacagctaagtacctagaagagctccctgcaagtgtaaatattaaggatgacctgtgcaaaattatacccacaccagcactagtggtaattattctaaattattgccaaaaagttttttttaatctgtctttcaagtttacagaaaagaaagcagtaaatgcattgatgtcattttattatgtacatatatcatgtgcattcaagctgtgtgacaagatatatcaatataaaaacaaggtatatactttattattttttgaaaacaaggatattgtgatcaattttaccctgtaaaacatatttctgtatttataggtcttaaacatgatgaattttttctattacaagtttatttaaaactgctttctcaagtcgttattgatacagcaagtgaacctgctgcagacagaagcagaggaaagccaagaacagcctttattggtgaagaaaagaatgaatgattctttgtaggcgccatcagccacttttagaagccatcagccagtgtgttgggaaaagaggtttgtcaagtgttggcctatgggaaggtggtcaatgaatgttttgatgaaatgaatgtttttgtataatggccttaaacttttctggaagtatttcaaataaattacattattaagtcatcctccatgtgtacag

SEQ ID NO: 418061 - DNA, 3609 bp, Homo sapiens
  misc_feature (222)..(222): n is a, c, g, or t
agcccagtcgagtcctgcccggctagaagccggctgtcggtctccgtgtcgccgccgccgcccggcatcgtggagctggggcccccttttgcctgggagttttgtagtcgcctagggtcagcggtgacatcccaaagggcaggcccggcagccgccatggtggccaaggattaccccttctacctcacggtcaagagagcgaactgcagcctggagctaccnccggccagcggtccggccaaggacgctgaggagcctagtaataaacgggtcaaacccctttcccgagtcacgtcgctagcaaacctcatcccgcccgtgaaggccacgccattaaagcgcttcagtcaaaccctgcagcgctccattagcttccgcagtgagagccgccctgacatcctcgccccccgaccctggtccagaaatgccgccccctcgagcacgaaacggagagatagcaagctgtggagtgagaccttcgatgtgtgcgtcaatcagatgcttacatccaaggaaatcaaacgtcaggaggcgatctttgagctttcccaaggagaagaagacttgatagaagacttgaaattagcaaaaaaggcctatcatgaccccatgctgaaactctccataatgacagaacaagagttgaatcaaatttttggaacactggactctctaattcctctacatgaagagctccttagtcagcttcgagatgttaggaagcctgatggctcgactgaacatgttggtcccatcctcgtgggctggctcccttgcctcagctcctatgatagctactgcagcaatcaagtagccgccaaagctctgctggaccacaaaaagcaagatcaccgagtccaggatttcctacagcgatgtttagaatccccctttagccgcaaactagatctctggaatttcctcgatattccaagaagccgcctggtaaaataccctctgcttctccgagaaatcttgaggcacacaccaaatgataatccagatcagcagcacttggaagaagctataaatatcattcagggaattgtggcagaaatcaacaccaagactggtgaatctgaatgccgctattataaagagcggcttctttacttggaagaaggccagaaagactccctgatcgacagctctcgagtcttgtgttgtcatggtgaactgaagaacaatcggggcgtgaaactgcatgttttcctgttccaagaagtgcttgtgatcactcgagccgtcacccacaatgagcagctttgctaccagctgtaccgtcagccaatccccgtgaaagacctcctgctggaagacctccaggatggagaagtgaggctgggtggctccctgcgaggggcattcagcaacaatgagagaattaaaaacttcttcagagtcagtttcaaaaatggatcccaaagtcagacccactcgctacaagccaatgacactttcaacaaacagcagtggcttaactgtattcgtcaagccaaagaaacagttttgtgtgctgccgggcaagctggggtgcttgactccgagggatcgttcctaaatcccaccaccgggagcagagagctacagggagaaacaaaacttgagcagatggaccaatcggacagtgagtcagactgtagtatggacacgagtgaggtcagcctcgactgtgagcgcatggaacagacagactcttcctgtggaaacagcaggcacggtgaaagtaacgtctgacagaagcatgtgcacttcgggaagcaggcctgcatcttacctgtacagtatttgcattccacagatggaacggtttggagaagcactttttcatacttttgtgaaagtatacatgttggcccagtctctcgtatctgtacctttgtccctagtactgtaactgccaatctgtctgtgtaagctggaatctgtggcaactattaccctgtgttgtatttcccaagtgtctggatggatggagaggtactcaaacaagttactttcagttgtcctgctggattttaaaaaaatagaaaaagaatctcaaaactactgttttacatagattgtttgaagagtccttcctcttgtgcttctgtaccactttcccagctcttagatgtggtagctaaaggcacggaatttagacggccttgtaaatagggcatgaggaactcatctgtgtattgggatggtattagagagagaatcaggaaagaccaactcatgaagtgaacttggtttgatcttactcaactagaaagcttgaaaacatccctggggattctgaaggcttaattttgcaaaggaggatgcattgtctgaactttgcaacttcatccagtgcaagtttgatgcaagaatgtattaggacataaaatagaggctgaccttaaaagggccaggacagaagcggctgccagctctgaatctttaactgaaatgcacatggcaccaggaggtgtctctcatagttggttgctagcctaaaacatcagaatagaacccaaagggcttaggaaggcctgccaggataacaagaaggccctgtattcattgtgtttcatctgcctaggcctactcattattttagagaatgaatgaagcaacaaggaagagagaccatgactctatcgatgacactgtttatagaaacacaggagaggaagaatttggaatgaaaagcacttcgtcagaaccttctgtgggagccattgagagaaaagcatggtccagtgccttctgagaaaggccagagctttgggctttcctgctctgcttttgggtcgtcaatttgccatctctggttctgtgctataatcagaattgtaattatgttctccagaggccaatttcattaactctgattaattagaatcagctagccagattagtaacctctttgtccagccttgatttacagtgcagggtaaagtgcagaccttaaaaacagctaagtacctagaagagctccctgcaagtgtaaatattaaggatgacctgtgcaaaattatacccacaccagcactagtggtaattattctaaattattgccaaaaagttttttttaatctgtctttcaagtttacagaaaagaaagcagtaaatgcattgatgtcattttattatgtacatatatcatgtgcattcaagctgtgtgacaagatatatcaatataaaaacaaggtatatactttattattttttgaaaacaaggatattgtgatcaattttaccctgtaaaacatatttctgtatttataggtcttaaacatgatgaattttttctattacaagtttatttaaaactgctttctcaagtcgttattgatacagcaagtgaacctgctgcagacagaagcagaggaaagccaagaacagcctttattggtgaagaaaagaatgaatgattctttgtaggcgccatcagccacttttagaagccatcagccagtgtgttgggaaaagaggtttgtcaagtgttggcctatgggaaggtggtcaatgaatgttttgatgaaatgaatgtttttgtagatcggccgggccagtgtccctccccatgtccctgttcccaccatgagtacatcaaaacaaaaaaaagaaaagcat

SEQ ID NO: 418062 - DNA, 3632 bp, Homo sapiens
  misc_feature (222)..(222): n is a, c, g, or t
agcccagtcgagtcctgcccggctagaagccggctgtcggtctccgtgtcgccgccgccgcccggcatcgtggagctggggcccccttttgcctgggagttttgtagtcgcctagggtcagcggtgacatcccaaagggcaggcccggcagccgccatggtggccaaggattaccccttctacctcacggtcaagagagcgaactgcagcctggagctaccnccggccagcggtccggccaaggacgctgaggagcctagtaataaacgggtcaaacccctttcccgagtcacgtcgctagcaaacctcatcccgcccgtgaaggccacgccattaaagcgcttcagtcaaaccctgcagcgctccattagcttccgcagtgagagccgccctgacatcctcgccccccgaccctggtccagaaatgccgccccctcgagcacgaaacggagagatagcaagctgtggagtgagaccttcgatgtgtgcgtcaatcagatgcttacatccaaggaaatcaaacgtcaggaggcgatctttgagctttcccaaggagaagaagacttgatagaagacttgaaattagcaaaaaaggcctatcatgaccccatgctgaaactctccataatgacagaacaagagttgaatcaaatttttggaacactggactctctaattcctctacatgaagagctccttagtcagcttcgagatgttaggaagcctgatggctcgactgaacatgttggtcccatcctcgtgggctggctcccttgcctcagctcctatgatagctactgcagcaatcaagtagccgccaaagctctgctggaccacaaaaagcaagatcaccgagtccaggatttcctacagcgatgtttagaatccccctttagccgcaaactagatctctggaatttcctcgatattccaagaagccgcctggtaaaataccctctgcttctccgagaaatcttgaggcacacaccaaatgataatccagatcagcagcacttggaagaagctataaatatcattcagggaattgtggcagaaatcaacaccaagactggtgaatctgaatgccgctattataaagagcggcttctttacttggaagaaggccagaaagactccctgatcgacagctctcgagtcttgtgttgtcatggtgaactgaagaacaatcggggcgtgaaactgcatgttttcctgttccaagaagtgcttgtgatcactcgagccgtcacccacaatgagcagctttgctaccagctgtaccgtcagccaatccccgtgaaagacctcctgctggaagacctccaggatggagaagtgaggctgggtggctccctgcgaggggcattcagcaacaatgagagaattaaaaacttcttcagagtcagtttcaaaaatggatcccaaagtcagacccactcgctacaagccaatgacactttcaacaaacagcagtggcttaactgtattcgtcaagccaaagaaacagttttgtgtgctgccgggcaagctggggtgcttgactccgagggatcgttcctaaatcccaccaccgggagcagagagctacagggagaaacaaaacttgagcagatggaccaatcggacagtgagtcagactgtagtatggacacgagtgaggtcagcctcgactgtgagcgcatggaacagacagactcttcctgtggaaacagcaggcacggtgaaagtaacgtctgacagaagcatgtgcacttcgggaagcaggcctgcatcttacctgtacagtatttgcattccacagatggaacggtttggagaagcactttttcatacttttgtgaaagtatacatgttggcccagtctctcgtatctgtacctttgtccctagtactgtaactgccaatctgtctgtgtaagctggaatctgtggcaactattaccctgtgttgtatttcccaagtgtctggatggatggagaggtactcaaacaagttactttcagttgtcctgctggattttaaaaaaatagaaaaagaatctcaaaactactgttttacatagattgtttgaagagtccttcctcttgtgcttctgtaccactttcccagctcttagatgtggtagctaaaggcacggaatttagacggccttgtaaatagggcatgaggaactcatctgtgtattgggatggtattagagagagaatcaggaaagaccaactcatgaagtgaacttggtttgatcttactcaactagaaagcttgaaaacatccctggggattctgaaggcttaattttgcaaaggaggatgcattgtctgaactttgcaacttcatccagtgcaagtttgatgcaagaatgtattaggacataaaatagaggctgaccttaaaagggccaggacagaagcggctgccagctctgaatctttaactgaaatgcacatggcaccaggaggtgtctctcatagttggttgctagcctaaaacatcagaatagaacccaaagggcttaggaaggcctgccaggataacaagaaggccctgtattcattgtgtttcatctgcctaggcctactcattattttagagaatgaatgaagcaacaaggaagagagaccatgactctatcgatgacactgtttatagaaacacaggagaggaagaatttggaatgaaaagcacttcgtcagaaccttctgtgggagccattgagagaaaagcatggtccagtgccttctgagaaaggccagagctttgggctttcctgctctgcttttgggtcgtcaatttgccatctctggttctgtgctataatcagaattgtaattatgttctccagaggccaatttcattaactctgattaattagaatcagctagccagattagtaacctctttgtccagccttgatttacagtgcagggtaaagtgcagaccttaaaaacagctaagtacctagaagagctccctgcaagtgtaaatattaaggatgacctgtgcaaaattatacccacaccagcactagtggtaattattctaaattattgccaaaaagttttttttaatctgtctttcaagtttacagaaaagaaagcagtaaatgcattgatgtcattttattatgtacatatatcatgtgcattcaagctgtgtgacaagatatatcaatataaaaacaaggtatatactttattattttttgaaaacaaggatattgtgatcaattttaccctgtaaaacatatttctgtatttataggtcttaaacatgatgaattttttctattacaagtttatttaaaactgctttctcaagtcgttattgatacagcaagtgaacctgctgcagacagaagcagaggaaagccaagaacagcctttattggtgaagaaaagaatgaatgattctttgtgtatgttatcgcccaacacaagtgatctttaattgctttgacagacccagggtgtcaacagcgttagtctacagggctacccttaccctttcctcctctgcagctgaggcaatgggcagtcccatcgctaagaacctgttcttagaaattcactggtctcttgctctgaacagatgctgagctaatgatgggtcacatatttaacagctagcttaaa

SEQ ID NO: 418063 - DNA, 420 bp, Homo sapiens
actaaattcaaggccgctcagacaaacaaggatattgtgatcaattttaccctgtaaaacatatttctgtatttataggtcttaaacatgatgaattttttctattacaagtttatttaaaactgctttctcaagtcgttattgatacagcaagtgaacctgctgcagacagaagcagaggaaagccaagaacagcctttattggtgaagaaaagaatgaatgattctttgtaggcgccatcagccacttttagaagccatcagccagtgtgttgggaaaagaggtttgtcaagtgttggcctatgggaaggtggtcaatgaatgttttgatgaaatgaatgtttttgtataatggccttaaacttttctggaagtatttcaaataaattacattattaagtcatcctccatgtgtacag

SEQ ID NO: 418064 - DNA, 983 bp, Homo sapiens
accatagtaacaatgggggagaaggggcagtttctagaaggagaaggaggcactggagcagatacaaataattcctgcctacaaaattcttccctatctgtcctcctatcataaaagtgtcagctttcatgactgacgatgcatctacaaggactggagttgaacttcaagcaagagactcacagacaaaggcgccctgggccagtggcacacactagctttatcaaagagactcagggacaagtacgcctggtctgtactgcggtttgccaattagctggatgaacagctggctaatttctgttttatctcttgggcagaagacacatgaggctagaataggttatcttcaacggggagccgagctaaggcctcatcgaaaacggaaacagagcacccaagatgaagatgctgttagcctttgcagtctcgacataagtgagcctagtaataaacgggtcaaacccctttcccgagtcacgtcgctagcaaacctcatcccgcccgtgaaggccacgccattaaagcgcttcagtcaaaccctgcagcgctccattagcttccgcagtgagagccgccctgacatcctcgccccccgaccctggtccagaaatgccgccccctcgagcacgaaacggagagatagcaagctgtggagtgagaccttcgatgtgtgcgtcaatcagatgcttacatccaaggaaatcaaacgtcaggaggcgatctttgagctttcccaaggagaagaagacttgatagaagacttgaaattagcaaaaaaggcctatcatgaccccatgctgaaactctccataatgacagaacaagagttgaatcaaatttttggaacactggactctctaattcctctacatgaagagctccttagtcagcttcgagatgttaggaagcctgatggctcgactgaacatgttggtcccatcctcgtgggctgggaaagagccagagtacatggaagcaaa

SEQ ID NO: 418065 - DNA, 500 bp, Homo sapiens
gtaaatttaaatccagcagtcacttgagtcaagtcacattttttttcttgagtaatttcacaaccctaaagtggtgcttcgtgagaactgtctttatgactaagactggtctgctaccacacaccaagcagtggggaaagtgtttcaaaacaagagggcagaatagctctccagacctggcacctttaggggtttacctctgtatgtctctaatgcatgtcaaagaatacttcagcctaaatcagaaagtgtccatggaggcctcgccttatgtatatttcattgtcctagaagtctcatatgtaggactctttgcccataggagagaatgtgtgcatgtctgaaacttgaactgagtcttagaaataaagccatttgaatctcaaaagtgaataaagtgaaatgaggcaattgcatactatcatataagttggggtcttttatataggaatttgttttctaatcaacattttgtgtggggaggaggaggacaacaaacc

SEQ ID NO: 418066 - DNA, 423 bp, Homo sapiens
ctctcagagccagaattactagggagggattctgattggtccaacttggatcaagtggatactcttggaccaatcagcagtggccagggagtgggattatgctgtaccaccatggtgactcctatggtaaccatagtaacaatgggggagaaggggcagtttctagaaggagaaggaggcactggagcagatacaaataattcctgcctacaaaattcttccctatctgtcctcctatcataaaaggtaatcatcctgattccattttttcctgtctgactccatgtgggcaaaactcctaactcctcttctttcatctttggttagaagcagtccatttagttattgattttttttcaacctggacaatctcttctgggagcaagaacagcctgtttggcaagctattcagcaagacataaa

SEQ ID NO: 418067 - DNA, 278 bp, Homo sapiens
caatgtgaataacccagaacctacttccagccctgttcatatttgaatgcctaacaaataagcatctgtttgttttttgccagagctccttagtcagcttcgagatgttaggaagcctgatggctcgactgaacatgttggtcccatcctcgtgggctgggtaagaaagttctctggtctttattgaagataaatttcaataatatagatgggagtttcattttagctagactttttttatttttatttttatttttttacaaatgttggtttcacat

SEQ ID NO: 418068 - DNA, 401 bp, Homo sapiens
cagttaggtgtttgttcagtcccaataaatgatgccaccgtagcctcagagctcaattattttgacattccaaccttctctttctgtttccttcttagctcccttgcctcagctcctatgatagctactgcagcaatcaagtagccgccaaagctctgctggaccacaaaaagcaagatcaccgagtccaggatttcctacagcgatgtttagaatccccctttagccgcaaactagatctctggaatttcctcgatattccaagaagccgcctggtaaaataccctctgcttctccgagaaatcttgaggcacacaccaaatgataatccagatcagcagcacttggaagaagctgtaagtttgtctgtttccttctctctcttcttgttatttccacca

SEQ ID NO: 418069 - DNA, 1147 bp, Homo sapiens
tatgaaacactttatttgggtatcactcaattttactgtagcagcctccatcccttcttagttataccaccgttaccaccacttttgtccttgctcctcccttgatgttttgtctttcatgaaacccatctcccaaggtctttctggatgataatggcttaattcactctctttcccagatacatgtttttccttctttataggaacctaactctgcctgtctaattggggaattccaggcagggtattgaaaatgtctggggggccgggtgcagtggctcaagcttgtaaacccagcaagcacattggaaggctgaggcgggagattgtttgagctcagaagttggagaccagccagacaacataataagactccatccctacaaaatatttaaaaattagctgagtatgttgatgcatgtttgtagtcccagctgtttgggagactaaggtaggaggattgcttgagcccaggaggtcgaggctgcagtgcaccgtgattgtgccactgtgttctagcctcggtgagggtgtgagaccctgtttaaaaaaaaagaaacagaaaatgtctgagcagtgggttctcctgtcactgacttttctgtcattgcttggcttgtaacattggatccacgtgtgtgctgtttatagaggaaccttacaacaggcagagagcttatgagactttagagttcagtaaactcagagttgcctcttagttgaccatctattaactgtttaaatttggacaagtgtctcaacctttctgaatctcagcttcttcatgtataaaataggggcagttacacctccttgtggggttgggaggattaaatgtgatcatgtataggaagtatctcatgtctgtaatcctagtactttcggaagccgaggcaggaggatcacttgagcccaggagtttgagagcagcctgggcaacatagtaagacctcccatctctaaaaaaataaaataaatagccggtatttccagttacttggtggggccaaggcaggaggatcgcttgagcccaggagtttgagaccagcctgggcaacgtaataagaccgtttctctaaaaaaattaaaaaattagccagtgctcccaggtgcttggggggctgaggtgggacggttgattgagctc

SEQ ID NO: 418070 - DNA, 721 bp, Homo sapiens
gcgggggcggggccagcctgggggcccagacgtggcgcagcgactcggaggttcgcctccagcttgcgcatcatctgcggccgggtcccgatgagcctcctgttgcctccgctggcgctgctgctgcttctcgcggcgcttgtggccccagccacagccgccactgcctaccggccggactggaaccgtctgagcggcctaacccgcgcccgggtagagacctgcgggggatgacagctgaaccgcctaaaggaggtgaaggctttcgtcacgcaggacattccattctatcacaacctggtgatgaaacacctccctggggccgaccctgagctcgtgctgctgggccgccgctacgaggaactagagcgcatcccactcagtgaaatgacccgcgaagagatcaatgcgctagtgcaggagctcggcttctaccgcaaggcggcgcccgacgcgcaggtgccccccgagtacgtgtgggcgcccgcgaagcccccagaggaaacttcggaccacgctgacctgtaggtccgggggcgcggcggagctgggacctacctgcctgagtcctggagacagaatgaagcgctcagcatcccgggaatacttctcttgctgagagccgatgcccgtccccgggccagcagggatggggttggggaggttctcccaaccccactttcttccttccccagctccactaaattccctcctgccttaa

SEQ ID NO: 418071 - DNA, 1482 bp, Homo sapiens
  misc_feature (777)..(777): n is a, c, g, or t
gcgggggcggggccagcctgggggcccagacgtggcgcagcgactcggaggttcgcctccagcttgcgcatcatctgcggccgggtcccgatgagcctcctgttgcctccgctggcgctgctgctgcttctcgcggcgcttgtggccccagccacagccgccactgcctaccggccggactggaaccgtctgagcggcctaacccgcgcccgggtagagacctgcgggggatgacagctgaaccgcctaaaggaggtgaaggctttcgtcacgcaggacattccattctatcacaacctggtgatgaaacacctccctggggccgaccctgagctcgtgctgctgggccgccgctacgaggaactagagcgcatcccactcagtgaaatgacccgcgaagagatcaatgcgctagtgcaggagctcggcttctaccgcaaggcggcgcccgacgcgcaggtgccccccgagtacgtgtgggcgcccgcgaagcccccagaggaaacttcggaccacgctgacctgtaggtccgggggcgcggcggagctgggacctacctgcctgagtcctggagacagaatgaagcgctcagcatcccgggaatacttctcttgctgagagccgatgcccgtccccgggccagcagggatggggttggggaggttctcccaaccccactttcttccttccccagctccactaaattccctcctgccttaaaaaaaaaaaaaaaaaaaaaaaaaaaaaaaaaaaaaaaaaaaaaaaaaaaaaaaaanaaaagagagagagagagagagagagagagagaagagagggagaggagagagaaaagagagggagggagaaaagagaaggagggaggagaaagaaaggggggaaaagagagaggagagccgacgaaacaaagggaggcccaccaacataaaagacaaagagaaaaaagagacagagacaaaagaccgacaaaaacaacgaacaaaaaaggaagcgagcaagaaagacgctcgcgaaaaaaacaaccaaagaagagcaagagaaaaacacaactaagggggcgaccaacacacaacaacggcgggcagggcagactacgttcgcacgcgcacaccccgcaagagaggagaccacggacacaagaagagggaaaagccggcgagcaccacagcgcggcgagaaacaccaggcgtggagcagaaagcacggaacagagcgaagagaaacaacgggaggaaaaaacaaggaataaccgaaaccagcgggacagagccataagagacagcaagacactccgacaccaacagacgacgggggaaaaaaaagaaaagaccggacacacagcggatcgcgagagaccgaaagcaacagagcacgacgggagaggcacggaggacaaggagaagcaccaagccaagcacgacgacgaacagaggaaggcctaacggacgagacggccaccccgccacgagcacacgacaaaccac

SEQ ID NO: 418072 - DNA, 919 bp, Homo sapiens
gcgggggcggggccagcctgggggcccagacgtggcgcagcgactcggaggttcgcctccagcttgcgcatcatctgcggccgggtcccgatgagcctcctgttgcctccgctggcgctgctgctgcttctcgcggcgcttgtggccccagccacagccgccactgcctaccggccggactggaaccgtctgagcggcctaacccgcgcccgggtagaggcctgagtctccccacctgtatacacagttcccccttctgcccacaagggtccagcatttccttcagaccttgggaactgctgatccggggataactcacagcccgacccaactcagggataaggaagtatggctttggggatgtgactggaataaacgtgaaggactcctgacctatcccattttatccccctccagacctgcgggggatgacagctgaaccgcctaaaggaggtgaaggctttcgtcacgcaggacattccattctatcacaacctggtgatgaaacacctccctggggccgaccctgagctcgtgctgctgggccgccgctacgaggaactagagcgcatcccactcagtgaaatgacccgcgaagagatcaatgcgctagtgcaggagctcggcttctaccgcaaggcggcgcccgacgcgcaggtgccccccgagtacgtgtgggcgcccgcgaagcccccagaggaaacttcggaccacgctgacctgtaggtccgggggcgcggcggagctgggacctacctgcctgagtcctggagacagaatgaagcgctcagcatcccgggaatacttctcttgctgagagccgatgcccgtccccgggccagcagggatggggttggggaggttctcccaaccccactttcttccttccccagctccactaaattccctcctgccttaa

SEQ ID NO: 418073 - DNA, 909 bp, Homo sapiens
tgggcttcagtgtctcgtctgtacctcgagtagactgaggtcatggtctctgatgctctggttcctccccaggtgaaggctttcgtcacgcaggacattccattctagtatccttctgttctgggggaggggaaatgggatgggcacctgggagaatctccacgtaacttcagaaaggggtggcagatggttttcaactgacaagttgaattgattggtagtggctcccagaggattctgaggtggtctccatgttgggtgggcaagagagattgactagtgatgactgccacagaatggagaggagggccctttacttctttgaaccctaattttctcacgtataagcggagaccctggcccctcccgggcacagagtaagctctgagcaaaggaggcaatgctgttcccatcagtaaggctgcggaaaccaccacctccctctgcccaccaccccgctccttaacaccacctccagtcacaacctggtgatgaaacacctccctggggccgaccctgagctcgtgctgctgggccgccgctacgaggaactagagcgcatcccactcagtgaaatgacccgcgaagagatcaatgcgctagtgcaggagctcggcttctaccgcaaggcggcgcccgacgcgcaggtgccccccgagtacgtgtgggcgcccgcgaagcccccagaggaaacttcggaccacgctgacctgtaggtccgggggcgcggcggagctgggacctacctgcctgagtcctggagacagaatgaagcgctcagcatcccgggaatacttctcttgctgagagccgatgcccgtccccgggccagcagggatggggttggggaggttctcccaaccccactttcttccttccccagctccactaaattccctcctgccttaa

SEQ ID NO: 418074 - DNA, 800 bp, Homo sapiens
gcgggggcggggccagcctgggggcccagacgtggcgcagcgactcggaggttcgcctccagcttgcgcatcatctgcggccgggtcccgatgagcctcctgttgcctccgctggcgctgctgctgcttctcgcggcgcttgtggccccagccacagccgccactgcctaccggccggactggaaccgtctgagcggcctaacccgcgcccgggtagagacctgcgggggatgacagctgaaccgcctaaaggaggtgaaggctttcgtcacgcaggacattccattctatcacaacctggtgatgaaacacctccctggggccgaccctgagctcgtgctgctgggccgccgctacgaggaactagaggtgaggccgtgggaggtgggctgggggcgaggccagaggcgaggcccagcctgctgaccccgcccctcctccgcctcagcgcatcccactcagtgaaatgacccgcgaagagatcaatgcgctagtgcaggagctcggcttctaccgcaaggcggcgcccgacgcgcaggtgccccccgagtacgtgtgggcgcccgcgaagcccccagaggaaacttcggaccacgctgacctgtaggtccgggggcgcggcggagctgggacctacctgcctgagtcctggagacagaatgaagcgctcagcatcccgggaatacttctcttgctgagagccgatgcccgtccccgggccagcagggatggggttggggaggttctcccaaccccactttcttccttccccagctccactaaattccctcctgccttaa

SEQ ID NO: 418075 - DNA, 1193 bp, Homo sapiens
  misc_feature (777)..(777): n is a, c, g, or t
gcgggggcggggccagcctgggggcccagacgtggcgcagcgactcggaggttcgcctccagcttgcgcatcatctgcggccgggtcccgatgagcctcctgttgcctccgctggcgctgctgctgcttctcgcggcgcttgtggccccagccacagccgccactgcctaccggccggactggaaccgtctgagcggcctaacccgcgcccgggtagagacctgcgggggatgacagctgaaccgcctaaaggaggtgaaggctttcgtcacgcaggacattccattctatcacaacctggtgatgaaacacctccctggggccgaccctgagctcgtgctgctgggccgccgctacgaggaactagagcgcatcccactcagtgaaatgacccgcgaagagatcaatgcgctagtgcaggagctcggcttctaccgcaaggcggcgcccgacgcgcaggtgccccccgagtacgtgtgggcgcccgcgaagcccccagaggaaacttcggaccacgctgacctgtaggtccgggggcgcggcggagctgggacctacctgcctgagtcctggagacagaatgaagcgctcagcatcccgggaatacttctcttgctgagagccgatgcccgtccccgggccagcagggatggggttggggaggttctcccaaccccactttcttccttccccagctccactaaattccctcctgccttaaaaaaaaaaaaaaaaaaaaaaaaaaaaaaaaaaaaaaaaaaaaaaaaaaaaaaaaanaaaaaaaaaaaaaaaaaaacaaaaaagacaaaaaagacacgaaaagcgaaacaaaaaaccacaaaaaaaaaccaaaacaagaagaacagacaaagaccagcggagcggggcccggcacgacagcacacgccccggcgcggcgacgctcatgcgccgacgccccaccccgacttcaggagtggtgtgctgcggaaggcggcgtgccctccatgacggggtaggcgtgtgatcgatgcacacagggacggcggcgcgccgcacgtagtaagataaatagcagtgtgatgggagaagacaagacctccggggacgctgatcgtgaagcacgacactcctctctctcatggtggggagaaagtacagaggtggacacagagcacacggcacgtcagcgtccccaccaggacgcttcgaac

SEQ ID NO: 418076 - DNA, 802 bp, Homo sapiens
gcgggggcggggccagcctgggggcccagacgtggcgcagcgactcggaggttcgcctccagcttgcgcatcatctgcggccgggtcccgatgagcctcctgttgcctccgctggcgctgctgctgcttctcgcggcgcttgtggccccagccacagccgccactgcctaccggccggactggaaccgtctgagcggcctaacccgcgcccgggtagagggataaggaagtatggctttggggatgtgactggaataaacgtgaaggactcctgacctatcccattttatccccctccagacctgcgggggatgacagctgaaccgcctaaaggaggtgaaggctttcgtcacgcaggacattccattctatcacaacctggtgatgaaacacctccctggggccgaccctgagctcgtgctgctgggccgccgctacgaggaactagagcgcatcccactcagtgaaatgacccgcgaagagatcaatgcgctagtgcaggagctcggcttctaccgcaaggcggcgcccgacgcgcaggtgccccccgagtacgtgtgggcgcccgcgaagcccccagaggaaacttcggaccacgctgacctgtaggtccgggggcgcggcggagctgggacctacctgcctgagtcctggagacagaatgaagcgctcagcatcccgggaatacttctcttgctgagagccgatgcccgtccccgggccagcagggatggggttggggaggttctcccaaccccactttcttccttccccagctccactaaattccctcctgccttaa

SEQ ID NO: 418077 - DNA, 528 bp, Homo sapiens
tgctcttgaggatcccccatttggcgcacgatggtcgatgacagctgaaccgcctaaaggaggtgaaggctttcgtcacgcaggacattccattctatcacaacctggtgatgaaacacctccctggggccgaccctgagctcgtgctgctgggccgccgctacgaggaactagagcgcatcccactcagtgaaatgacccgcgaagagatcaatgcgctagtgcaggagctcggcttctaccgcaaggcggcgcccgacgcgcaggtgccccccgagtacgtgtgggcgcccgcgaagcccccagaggaaacttcggaccacgctgacctgtaggtccgggggcgcggcggagctgggacctacctgcctgagtcctggagacagaatgaagcgctcagcatcccgggaatacttctcttgctgagagccgatgcccgtccccgggccagcagggatggggttggggaggttctcccaaccccactttcttccttccccagctccactaaattccctcctgccttaa

SEQ ID NO: 418078 - DNA, 2001 bp, Homo sapiens
ggctggggaggagcaggaacagtcaggactggaatctagctttgctccaaagccagctcttaattaccaacatggggatgggggtggcgtgttcctggccctcattttccgggagaggggtaactcccccgattttggcccccacatccctgagaaccttggggtctggctgtaggaggtaggggagctctgaggggtccgcgctggctagttcctgagagagcgttaaaagtagattctcctttcgctccaactttctcggtgtctcaaacactctcctgccttctgggcccattgggcacaccgccacccaatccggggacccccggagactcgccagctctccaggatgggaatttcgtgatgttccctgcctgagcttcggggagggcgggggagtgctgtaaggggctatcgcgcaagtgcagaccctctgcttctgccgcaaacggcgggcctcacctggacccggggactcttcaacgaggggcgctagcctggcccgactgggcgagtccccgcgtccctgcccgttccgtcgctcagttccacgacacgctcccctgccgccccgcctgttcgcgggtgggtgggcgcttccctcggctccccgtgacactttgcagacgctccccggcgccgggcatgggcgccgccgccgtcggtccccgagccggattccgcgagcggtgcccctgaggccctcggctgctggggtccgcaggaagccgcgccatgaatgaccggagcagtcggaggcggacaatgaaggacgatgagaccttcgagatctccattcccttcgatgaggcaccccacctagacccacagatcttttacagtctgagcccctctcggagaaacttcgaggagcctccggaggctgcgtcctccgccctggctctgatgaacagcgtcaagacccagctgcacatggctctggagaggaactcctggctgcagaagcgcatcgaggacctggaggaagagagggacttcctgcggtgccagctggacaaattcatctcttctgctcggatggaggcagaggaccactgccggatgaagcctgggcccaggcggatggagggggacagccgtggtggggctgggggcgaggcctcggaccctgagtcagcagcctcctccctcagcggagcgtccgaagaaggcagtgccagtgagaggaggcggcagaagcagaagggaggtgctagtcggaggcgctttgggaagcccaaggcccgggagaggcagcgagtgaaggacgccgacggggtcctctgccggtacaagaagatcctgggcaccttccagaagctcaagagcatgtcgcgggccttcgagcaccaccgcgtggacaggaacaccgtggcgctgaccacgcccatcgccgagctgctcattgtggcccccgagaagctggccgaggtgggcgagttcgacccctccaaggagcgcctgctcgagtactcccgccgctgctttctggccctggacgacgagacgctcaagaaggtgcaggcgctcaagaagagcaagctgctgctgcccatcacctaccgcttcaagcggtgatcgcaccacgcctccgcgcctccacccgggccttcctcccccgtggaccccggtggatgacctgcccctctccccgccgcgcccctgcccctcctcctcgctccctgggttgggggctcccttagccgggcccccaagcgcgacggccccggaccggccgcggccccttcccgaacgccggcacccccttccgcttgggctgcccagccctgtcctcgccgggccccttcctcctggaaaaccaggcaggcgggtgcccccccctcgagtgggggactgtacagaccccgtctccgccctggccccgcggaggagctgcccacctgattcccggacagacctccccaactccgcgtgagacagagaattattcagataatttaaattaaaaaacgacgtgaaaatttggaataaaattggcct

SEQ ID NO: 418079 - DNA, 2726 bp, Homo sapiens
ggctggggaggagcaggaacagtcaggactggaatctagctttgctccaaagccagctcttaattaccaacatggggatgggggtggcgtgttcctggccctcattttccgggagaggggtaactcccccgattttggcccccacatccctgagaaccttggggtctggctgtaggaggtaggggagctctgaggggtccgcgctggctagttcctgagagagcgttaaaagtagattctcctttcgctccaactttctcggtgtctcaaacactctcctgccttctgggcccattgggcacaccgccacccaatccggggacccccggagactcgccagctctccaggatgggaatttcgtgatgttccctgcctgagcttcggggagggcgggggagtgctgtaaggggctatcgcgcaagtgcagaccctctgcttctgccgcaaacggcgggcctcacctggacccggggactcttcaacgaggggcgctagcctggcccgactgggcgagtccccgcgtccctgcccgttccgtcgctcagttccacgacacgctcccctgccgccccgcctgttcgcgggtgggtgggcgcttccctcggctccccgtgacactttgcagacgctccccggcgccgggcatgggcgccgccgccgtcggtccccgagccggattccgcgagcgggtgggtgagcgcggggggcctcggcccctcggaccccgggcacccgcgggcgggggatggtggccgcgtttgcacccccgccctagtgcatgttcccgctggaatcgttccacgaccgctccccctcccacccgcgggacaaagggcgggggcgggggggggcgcacccccacgcgtgacctttccccgtactgcgcacgcgcccagcccccaccaccgggggacggtccgcccgcccacgcgagtgcgggggaggggtgtgggggccccgaaggtagaggaggcagcgcgcacgggctggacctcctcctaccctgggaagttggggcagtttccccctgcacctgcctcttccttaggcctggcagtggcccgcgatgagagagggtccttccccttcaggctaggtgtccctggtcaggcgaccccttggggcacccagcaatttagggcttcagcttccttttccttcgatacccaggagcccacgtccccagctcacttctcccccaggacctaggcggctgggccccctgcccctgactccaggagcccaggagtttgaagcccaggcgcgttttgcctcagtcctggggtccaggctccctcctccctcagaccaggggtccaggccagaaggtccctcctgtctcacttcacctcccccaggatggaccctccagtccatctgcgtctctccatttgtggctgccgtttctgtccagtgcccctgaggccctcggctgctggggtccgcaggaagccgcgccatgaatgaccggagcagtcggaggcggacaatgaaggacgatgagaccttcgagatctccattcccttcgatgaggcaccccacctagacccacagatcttttacagtctgagcccctctcggagaaacttcgaggagcctccggaggctgcgtcctccgccctggctctgatgaacagcgtcaagacccagctgcacatggctctggagaggaactcctggctgcagaagcgcatcgaggacctggaggaagagagggacttcctgcggtgccagctggacaaattcatctcttctgctcggatggaggcagaggaccactgccggatgaagcctgggcccaggcggatggagggggacagccgtggtggggctgggggcgaggcctcggaccctgagtcagcagcctcctccctcagcggagcgtccgaagaaggcagtgccagtgagaggaggcggcagaagcagaagggaggtgctagtcggaggcgctttgggaagcccaaggcccgggagaggcagcgagtgaaggacgccgacggggtcctctgccggtacaagaagatcctgggcaccttccagaagctcaagagcatgtcgcgggccttcgagcaccaccgcgtggacaggaacaccgtggcgctgaccacgcccatcgccgagctgctcattgtggcccccgagaagctggccgaggtgggcgagttcgacccctccaaggagcgcctgctcgagtactcccgccgctgctttctggccctggacgacgagacgctcaagaaggtgcaggcgctcaagaagagcaagctgctgctgcccatcacctaccgcttcaagcggtgatcgcaccacgcctccgcgcctccacccgggccttcctcccccgtggaccccggtggatgacctgcccctctccccgccgcgcccctgcccctcctcctcgctccctgggttgggggctcccttagccgggcccccaagcgcgacggccccggaccggccgcggccccttcccgaacgccggcacccccttccgcttgggctgcccagccctgtcctcgccgggccccttcctcctggaaaaccaggcaggcgggtgcccccccctcgagtgggggactgtacagaccccgtctccgccctggccccgcggaggagctgcccacctgattcccggacagacctccccaactccgcgtgagacagagaattattcagataatttaaattaaaaaacgacgtgaaaatttggaataaaattggcct

SEQ ID NO: 418080 - DNA, 2245 bp, Homo sapiens
ggctggggaggagcaggaacagtcaggactggaatctagctttgctccaaagccagctcttaattaccaacatggggatgggggtggcgtgttcctggccctcattttccgggagaggggtaactcccccgattttggcccccacatccctgagaaccttggggtctggctgtaggaggtaggggagctctgaggggtccgcgctggctagttcctgagagagcgttaaaagtagattctcctttcgctccaactttctcggtgtctcaaacactctcctgccttctgggcccattgggcacaccgccacccaatccggggacccccggagactcgccagctctccaggatgggaatttcgtgatgttccctgcctgagcttcggggagggcgggggagtgctgtaaggggctatcgcgcaagtgcagaccctctgcttctgccgcaaacggcgggcctcacctggacccggggactcttcaacgaggggcgctagcctggcccgactgggcgagtccccgcgtccctgcccgttccgtcgctcagttccacgacacgctcccctgccgccccgcctgttcgcgggtgggtgggcgcttccctcggctccccgtgacactttgcagacgctccccggcgccgggcatgggcgccgccgccgtcggtccccgagccggattccgcgagcgggagcccacgtccccagctcacttctcccccaggacctaggcggctgggccccctgcccctgactccaggagcccaggagtttgaagcccaggcgcgttttgcctcagtcctggggtccaggctccctcctccctcagaccaggggtccaggccagaaggtccctcctgtctcacttcacctcccccaggatggaccctccagtccatctgcgtctctccatttgtggctgccgtttctgtccagtgcccctgaggccctcggctgctggggtccgcaggaagccgcgccatgaatgaccggagcagtcggaggcggacaatgaaggacgatgagaccttcgagatctccattcccttcgatgaggcaccccacctagacccacagatcttttacagtctgagcccctctcggagaaacttcgaggagcctccggaggctgcgtcctccgccctggctctgatgaacagcgtcaagacccagctgcacatggctctggagaggaactcctggctgcagaagcgcatcgaggacctggaggaagagagggacttcctgcggtgccagctggacaaattcatctcttctgctcggatggaggcagaggaccactgccggatgaagcctgggcccaggcggatggagggggacagccgtggtggggctgggggcgaggcctcggaccctgagtcagcagcctcctccctcagcggagcgtccgaagaaggcagtgccagtgagaggaggcggcagaagcagaagggaggtgctagtcggaggcgctttgggaagcccaaggcccgggagaggcagcgagtgaaggacgccgacggggtcctctgccggtacaagaagatcctgggcaccttccagaagctcaagagcatgtcgcgggccttcgagcaccaccgcgtggacaggaacaccgtggcgctgaccacgcccatcgccgagctgctcattgtggcccccgagaagctggccgaggtgggcgagttcgacccctccaaggagcgcctgctcgagtactcccgccgctgctttctggccctggacgacgagacgctcaagaaggtgcaggcgctcaagaagagcaagctgctgctgcccatcacctaccgcttcaagcggtgatcgcaccacgcctccgcgcctccacccgggccttcctcccccgtggaccccggtggatgacctgcccctctccccgccgcgcccctgcccctcctcctcgctccctgggttgggggctcccttagccgggcccccaagcgcgacggccccggaccggccgcggccccttcccgaacgccggcacccccttccgcttgggctgcccagccctgtcctcgccgggccccttcctcctggaaaaccaggcaggcgggtgcccccccctcgagtgggggactgtacagaccccgtctccgccctggccccgcggaggagctgcccacctgattcccggacagacctccccaactccgcgtgagacagagaattattcagataatttaaattaaaaaacgacgtgaaaatttggaataaaattggcct

SEQ ID NO: 418081 - DNA, 2057 bp, Homo sapiens
ggctggggaggagcaggaacagtcaggactggaatctagctttgctccaaagccagctcttaattaccaacatggggatgggggtggcgtgttcctggccctcattttccgggagaggggtaactcccccgattttggcccccacatccctgagaaccttggggtctggctgtaggaggtaggggagctctgaggggtccgcgctggctagttcctgagagagcgttaaaagtagattctcctttcgctccaactttctcggtgtctcaaacactctcctgccttctgggcccattgggcacaccgccacccaatccggggacccccggagactcgccagctctccaggatgggaatttcgtgatgttccctgcctgagcttcggggagggcgggggagtgctgtaaggggctatcgcgcaagtgcagaccctctgcttctgccgcaaacggcgggcctcacctggacccggggactcttcaacgaggggcgctagcctggcccgactgggcgagtccccgcgtccctgcccgttccgtcgctcagttccacgacacgctcccctgccgccccgcctgttcgcgggtgggtgggcgcttccctcggctccccgtgacactttgcagacgctccccggcgccgggcatgggcgccgccgccgtcggtccccgagccggattccgcgagcgggatggaccctccagtccatctgcgtctctccatttgtggctgccgtttctgtccagtgcccctgaggccctcggctgctggggtccgcaggaagccgcgccatgaatgaccggagcagtcggaggcggacaatgaaggacgatgagaccttcgagatctccattcccttcgatgaggcaccccacctagacccacagatcttttacagtctgagcccctctcggagaaacttcgaggagcctccggaggctgcgtcctccgccctggctctgatgaacagcgtcaagacccagctgcacatggctctggagaggaactcctggctgcagaagcgcatcgaggacctggaggaagagagggacttcctgcggtgccagctggacaaattcatctcttctgctcggatggaggcagaggaccactgccggatgaagcctgggcccaggcggatggagggggacagccgtggtggggctgggggcgaggcctcggaccctgagtcagcagcctcctccctcagcggagcgtccgaagaaggcagtgccagtgagaggaggcggcagaagcagaagggaggtgctagtcggaggcgctttgggaagcccaaggcccgggagaggcagcgagtgaaggacgccgacggggtcctctgccggtacaagaagatcctgggcaccttccagaagctcaagagcatgtcgcgggccttcgagcaccaccgcgtggacaggaacaccgtggcgctgaccacgcccatcgccgagctgctcattgtggcccccgagaagctggccgaggtgggcgagttcgacccctccaaggagcgcctgctcgagtactcccgccgctgctttctggccctggacgacgagacgctcaagaaggtgcaggcgctcaagaagagcaagctgctgctgcccatcacctaccgcttcaagcggtgatcgcaccacgcctccgcgcctccacccgggccttcctcccccgtggaccccggtggatgacctgcccctctccccgccgcgcccctgcccctcctcctcgctccctgggttgggggctcccttagccgggcccccaagcgcgacggccccggaccggccgcggccccttcccgaacgccggcacccccttccgcttgggctgcccagccctgtcctcgccgggccccttcctcctggaaaaccaggcaggcgggtgcccccccctcgagtgggggactgtacagaccccgtctccgccctggccccgcggaggagctgcccacctgattcccggacagacctccccaactccgcgtgagacagagaattattcagataatttaaattaaaaaacgacgtgaaaatttggaataaaattggcct

SEQ ID NO: 418082 - DNA, 1977 bp, Homo sapiens
ggctggggaggagcaggaacagtcaggactggaatctagctttgctccaaagccagctcttaattaccaacatggggatgggggtggcgtgttcctggccctcattttccgggagaggggtaactcccccgattttggcccccacatccctgagaaccttggggtctggctgtaggaggtaggggagctctgaggggtccgcgctggctagttcctgagagagcgttaaaagtagattctcctttcgctccaactttctcggtgtctcaaacactctcctgccttctgggcccattgggcacaccgccacccaatccggggacccccggagactcgccagctctccaggatgggaatttcgtgatgttccctgcctgagcttcggggagggcgggggagtgctgtaaggggctatcgcgcaagtgcagaccctctgcttctgccgcaaacggcgggcctcacctggacccggggactcttcaacgaggggcgctagcctggcccgactgggcgagtccccgcgtccctgcccgttccgtcgctcagttccacgacacgctcccctgccgccccgcctgttcgcgggtgggtgggcgcttccctcggctccccgtgacactttgcagacgctccccggcgccgggcatgggcgccgccgccgtcggtccccgagccggattccgcgagcgggtgggtgagcgcggggggcctcggcccctcggaccccgggcacccgcgggcgggggatggtggccgcgtttgcacccccgccctagtgcatgttcccgctggaatcgttccacgaccgctccccctcccacccgcgggacaaagggcgggggcgggggggggcgcacccccacgcgtgacctttccccgtactgcgcacgcgcccagcccccaccaccgggggacggtccgcccgcccacgcgagtgcgggggaggggtgtgggggccccgaaggtagaggaggcagcgcgcacgggctggacctcctcctaccctgggaagttggggcagtttccccctgcacctgcctcttccttaggcctggcagtggcccgcgatgagagagggtccttccccttcaggctaggtgtccctggtcaggcgaccccttggggcacccagcaatttagggcttcagcttccttttccttcgatacccaggagcccacgtccccagctcacttctcccccaggacctaggcggctgggccccctgcccctgactccaggagcccaggagtttgaagcccaggcgcgttttgcctcagtcctggggtccaggctccctcctccctcagaccaggggtccaggccagaaggtccctcctgtctcacttcacctcccccaggatggaccctccagtccatctgcgtctctccatttgtggctgccgtttctgtccagtgcccctgaggccctcggctgctggggtccgcaggaagccgcgccatgaatgaccggagcagtcggaggcggacaatgaaggacgatgagaccttcgagatctccattcccttcgatgaggcaccccacctagacccacagatcttttacagtctgagcccctctcggagaaacttcgaggagcctccggaggctgcgtcctccgccctggctctgatgaacagcgtcaagacccagctgcacatggctctggagaggaactcctggctgcagaagcgcatcgaggacctggaggaagagagggacttcctgcggtgccagctggacaaattcatctcttctgctcggatggaggcagagacactgccggatgaagctggccagcggtgagggcaaccggttgtgttgggcagcccacctgataagctctccaagaagccaaaagaggctgaaaggggaacaggggtaagcctgaccaccgaagaggaaacgggacccgaaaaagtcccaaaattggtccacggagtccccagacaagaggaacaacatcaaaaaaaccacg

SEQ ID NO: 418083 - DNA, 1604 bp, Homo sapiens
gcctggtggcgaattcggcacgagggcttccttttccttcgatacccaggagcccacgtccccagctcacttctcccccaggacctaggcggctgggccccctgcccctgactccaggagcccaggagtttgaagcccaggcgcgttttgcctcagtcctggggtccaggctccctcctccctcagaccaggggtccaggccagaaggtccctcctgtctcacttcacctcccccaggatggaccctccagtccatctgcgtctctccatttgtggctgccgtttctgtccagtgcccctgaggccctcggctgctggggtccgcaggaagccgcgccatgaatgaccggagcagtcggaggcggacaatgaaggacgatgagaccttcgagatctccattcccttcgatgaggcaccccacctagacccacagatcttttacagtctgagcccctctcggagaaacttcgaggagcctccggaggctgcgtcctccgccctggctctgatgaacagcgtcaagacccagctgcacatggctctggagaggaactcctggctgcagaagcgcatcgaggacctggaggaagagagggacttcctgcggtgccagctggacaaattcatctcttctgctcggatggaggcagaggaccactgccggatgaagcctgggcccaggcggatggagggggacagccgtggtggggctgggggcgaggcctcggaccctgagtcagcagcctcctccctcagcggagcgtccgaagaaggcagtgccagtgagaggaggcggcagaagcagaagggaggtgctagtcggaggcgctttgggaagcccaaggcccgggagaggcagcgagtgaaggacgccgacggggtcctctgccggtacaagaagatcctgggcaccttccagaagctcaagagcatgtcgcgggccttcgagcaccaccgcgtggacaggaacaccgtggcgctgaccacgcccatcgccgagctgctcattgtggcccccgagaagctggccgaggtgggcgagttcgacccctccaaggagcgcctgctcgagtactcccgccgctgctttctggccctggacgacgagacgctcaagaaggtgcaggcgctcaagaagagcaagctgctgctgcccatcacctaccgcttcaagcggtgatcgcaccacgcctccgcgcctccacccgggccttcctcccccgtggaccccggtggatgacctgcccctctccccgccgcgcccctgcccctcctcctcgctccctgggttgggggctcccttagccgggcccccaagcgcgacggccccggaccggccgcggccccttcccgaacgccggcacccccttccgcttgggctgcccagccctgtcctcgccgggccccttcctcctggaaaaccaggcaggcgggtgcccccccctcgagtgggggactgtacagaccccgtctccgccctggccccgcggaggagctgcccacctgattcccggacagacctccccaactccgcgtgagacagagaattattcagataatttaaattaaaaaacgacgtgaaaatttggaataaaattggcct

SEQ ID NO: 418084 - DNA, 1745 bp, Homo sapiens
aacatgctaggtggcgggtaatggagagggggagtggggatttccccctgcacctgcctcttccttaggcctggcagtggcccgcgatgagagagggtccttccccttcaggctaggtgtccctggtcaggcgaccccttggggcacccagcaatttagggcttcagcttccttttccttcgatacccaggagcccacgtccccagctcacttctcccccaggacctaggcggctgggccccctgcccctgactccaggagcccaggagtttgaagcccaggcgcgttttgcctcagtcctggggtccaggctccctcctccctcagaccaggggtccaggccagaaggtccctcctgtctcacttcacctcccccaggatggaccctccagtccatctgcgtctctccatttgtggctgccgtttctgtccagtgcccctgaggccctcggctgctggggtccgcaggaagccgcgccatgaatgaccggagcagtcggaggcggacaatgaaggacgatgagaccttcgagatctccattcccttcgatgaggcaccccacctagacccacagatcttttacagtctgagcccctctcggagaaacttcgaggagcctccggaggctgcgtcctccgccctggctctgatgaacagcgtcaagacccagctgcacatggctctggagaggaactcctggctgcagaagcgcatcgaggacctggaggaagagagggacttcctgcggtgccagctggacaaattcatctcttctgctcggatggaggcagaggaccactgccggatgaagcctgggcccaggcggatggagggggacagccgtggtggggctgggggcgaggcctcggaccctgagtcagcagcctcctccctcagcggagcgtccgaagaaggcagtgccagtgagaggaggcggcagaagcagaagggaggtgctagtcggaggcgctttgggaagcccaaggcccgggagaggcagcgagtgaaggacgccgacggggtcctctgccggtacaagaagatcctgggcaccttccagaagctcaagagcatgtcgcgggccttcgagcaccaccgcgtggacaggaacaccgtggcgctgaccacgcccatcgccgagctgctcattgtggcccccgagaagctggccgaggtgggcgagttcgacccctccaaggagcgcctgctcgagtactcccgccgctgctttctggccctggacgacgagacgctcaagaaggtgcaggcgctcaagaagagcaagctgctgctgcccatcacctaccgcttcaagcggtgatcgcaccacgcctccgcgcctccacccgggccttcctcccccgtggaccccggtggatgacctgcccctctccccgccgcgcccctgcccctcctcctcgctccctgggttgggggctcccttagccgggcccccaagcgcgacggccccggaccggccgcggccccttcccgaacgccggcacccccttccgcttgggctgcccagccctgtcctcgccgggccccttcctcctggaaaaccaggcaggcgggtgcccccccctcgagtgggggactgtacagaccccgtctccgccctggccccgcggaggagctgcccacctgattcccggacagacctccccaactccgcgtgagacagagaattattcagataatttaaattaaaaaacgacgtgaaaatttggaataaaattggcct

SEQ ID NO: 418085 - DNA, 1568 bp, Homo sapiens
tagcaggctggtacctggtctggagatttatggatccggggactcttcaacgaggggcgctagcctggcccgactgggcgagtccccgcgtccctgcccgttccgtcgctcagttccacgacacgctcccctgccgccccgcctgttcgcgggtgggtgggcgcttccctcggctccccgtgacactttgcagacgctccccggcgccgggcatgggcgccgccgccgtcggtccccgagccggattccgcgagcggtgcccctgaggccctcggctgctggggtccgcaggaagccgcgccatgaatgaccggagcagtcggaggcggacaatgaaggacgatgagaccttcgagatctccattcccttcgatgaggcaccccacctagacccacagatcttttacagtctgagcccctctcggagaaacttcgaggagcctccggaggctgcgtcctccgccctggctctgatgaacagcgtcaagacccagctgcacatggctctggagaggaactcctggctgcagaagcgcatcgaggacctggaggaagagagggacttcctgcggtgccagctggacaaattcatctcttctgctcggatggaggcagaggaccactgccggatgaagcctgggcccaggcggatggagggggacagccgtggtggggctgggggcgaggcctcggaccctgagtcagcagcctcctccctcagcggagcgtccgaagaaggcagtgccagtgagaggaggcggcagaagcagaagggaggtgctagtcggaggcgctttgggaagcccaaggcccgggagaggcagcgagtgaaggacgccgacggggtcctctgccggtacaagaagatcctgggcaccttccagaagctcaagagcatgtcgcgggccttcgagcaccaccgcgtggacaggaacaccgtggcgctgaccacgcccatcgccgagctgctcattgtggcccccgagaagctggccgaggtgggcgagttcgacccctccaaggagcgcctgctcgagtactcccgccgctgctttctggccctggacgacgagacgctcaagaaggtgcaggcgctcaagaagagcaagctgctgctgcccatcacctaccgcttcaagcggtgatcgcaccacgcctccgcgcctccacccgggccttcctcccccgtggaccccggtggatgacctgcccctctccccgccgcgcccctgcccctcctcctcgctccctgggttgggggctcccttagccgggcccccaagcgcgacggccccggaccggccgcggccccttcccgaacgccggcacccccttccgcttgggctgcccagccctgtcctcgccgggccccttcctcctggaaaaccaggcaggcgggtgcccccccctcgagtgggggactgtacagaccccgtctccgccctggccccgcggaggagctgcccacctgattcccggacagacctccccaactccgcgtgagacagagaattattcagataatttaaattaaaaaacgacgtgaaaatttggaataaaattggcct

SEQ ID NO: 418086 - DNA, 1017 bp, Homo sapiens
ggctggggaggagcaggaacagtcaggactggaatctagctttgctccaaagccagctcttaattaccaacatggggatgggggtggcgtgttcctggccctcattttccgggagaggggtaactcccccgattttggcccccacatccctgagaaccttggggtctggctgtaggaggtaggggagctctgaggggtccgcgctggctagttcctgagagagcgttaaaagtagattctcctttcgctccaactttctcggtgtctcaaacactctcctgccttctgggcccattgggcacaccgccacccaatccggggacccccggagactcgccagctctccaggatgggaatttcgtgatgttccctgcctgagcttcggggagggcgggggagtgctgtaaggggctatcgcgcaagtgcagaccctctgcttctgccgcaaacggcgggcctcacctggacccggggactcttcaacgaggggcgctagcctggcccgactgggcgagtccccgcgtccctgcccgttccgtcgctcagttccacgacacgctcccctgccgccccgcctgttcgcgggtgggtgggcgcttccctcggctccccgtgacactttgcagacgctccccggcgccgggcatgggcgccgccgccgtcggtccccgagccggattccgcgagcggtgcccctgaggccctcggctgctggggtccgcaggaagccgcgccatgaatgaccggagcagtcggaggcggacaatgaaggacgatgagaccttcgagatctccattcccttcgatgaggcaccccacctagacccacagatcttttacagtctgagcccctctcggagaaacttcgaggtgtacagaccccgtctccgccctggccccgcggaggagctgcccacctgattcccggacagacctccccaactccgcgtgagacagagaattattcagataatttaaattaaaaaacgacgtgaaaatttggaataaaattggcct

SEQ ID NO: 418087 - DNA, 428 bp, Homo sapiens
agagtgatgtgagagatgatatatgagtggtaaagcggaggttcagtgatcttaaaagccttatctaacaaaagcagaaagataaaaataaaaaaaataaaagctgatgaaggacagaggccagatcaaatgagatgctatcagagaagatcaaagaacatatcacacaaataaattaaatgtgggagggacaaggagagctatacatgtactgatcatctgctatgctggaagtttatttagcaaatgtaatcttatttaatcatctggacccaagggaggtaatctgacctctctgaatctcagcttcatgtgaaaacggggataatattattgagagagaacatttgttacaggggcaaaccctgttccaaggtttctttcactcaaagtataaacaatgaggcactttttacactttagacact

SEQ ID NO: 418088 - DNA, 759 bp, Homo sapiens
gctgcccatcacatggacagtattctgtgacttaatgacaataataaggtcatgaagtctcctatacagggtcttgctctgtcacccaagctggagtgcaatggcgcaaccatggctcactgcagcctcaaactcttgggctcaaatgatcctcctgcctcagcctcctgagtagctgggactataggcacatgctgccacgcccagctgaagtcatgctctctatccatgagcatctttataacttgcatagatatatttgggtgaaatcctgtcttggtctttcccgattctccctgagcaggttccaaacattgtttagggctcaaagggaaattagtcttcagagtttctccaataaagtaattacgggagatcgggtcatttattcaacagattggggtggcctaccatgtgccaagactgtgccaggcactggggatatgatgatgaaaccaaagatgctagcatgaacacaatcactaaaccaaagtcacacaaataaattaaatgtgggagggacaaggagagctatacatgtactgatcatctgctatgctggaagtttatttagcaaatgtaatcttatttaatcatctggacccaagggaggtaatctgacctctctgaatctcagcttcatgtgaaaacggggataatattattgagagagaacatttgttacaggggcaaaccctgttccaaggtttctttcactcaaagtataaacaatgaggcactttttacactttagacact

SEQ ID NO: 418089 - DNA, 726 bp, Homo sapiens
tgggatttggtctctttgactaatcaccaaaaagcaaccaactcctccgactcttccttggcttcaaccttagctggggctgcagcagcagagcgagcagctgtggtggcagcagcaacggggcagcagcacaaaggcagatggatcagccaagaaggccttgaccttttcagcaagtgggaaggtgtaatccgtctccacagacaaggccagtgcgagtatggcggcgtcaaaggtgaagcaggacatgcctccgccggggggctatgggcccatcgactacaaacggaacttgccgcgtcgaggactgtcgggctacagcatgctggccatagggattggaaccctgatctacgggcactggagcataatgaagtggaaccgtgagcgcaggcgcctacaaatcgaggacttcgaggctcgcatcgcgctgttgccactgttacaggcagaaaccgaccggaggaccttgcagatgcttcgggagaacctggaggaggaggccatcatcatgaaggacgtgcccgactggaaggtgggggagtctgtgttccacacaacccgctgggtgccccccttgatcggggagctgtacgggctgcgcaccacagaggaggctctccatgccagccacggcttcatgtggtacacgtaggccctgtgccctccggccacctggatccctgcccctccccactgggacggaataaatgctctgcagacctg

SEQ ID NO: 418090 - DNA, 872 bp, Homo sapiens
cctccctccacggatgcgcttaaaaggcggtggcggtggcggcagcgcccggcgcccgggctcacctcggccatgagcagcgcagccggcccagacccgtcggaggcgcccgaagagcggcatttcctcagcaccgcggaggcagccgccctggagcgggagctgctggaggattatcgctttgggcggcagcagctcgtggagctgtgcggtcatgctagtgccgtggctgtgaccaaggcgttcccgttgcccgctctctcccggaagcagaggacggtgctggtcgtgtgtggcccggagcagaacggggcagtggggctggtctgtgcccggcacctgcgggtgtttgagtatgaacccaccatcttctaccccacacgctcgctggacctgctgcatcgggacctgaccacccagtgcgagaagatggacatccccttcctgagctacctgcccactgaggtgcagctcattaacgaagcctatgggctggtggtggatgccgtactgggccccggcgtggagccgggcgaggtcgggggcccctgcacccgcgcgctggccacgctcaagctgctgtccatccccctcgtgagcctggacatcccctcaggctgggacgcagagaccggcagcgattcggaggacgggctgcggcctgacgtgctggtgtctctcgcggcgcccaagcgctgcgctggccgcttctccgggcgccaccacttcgtggccggcaggttcgtgcccgatgacgtgcgccgcaagttcgctctgcgcctgccgggatacacgggcaccgactgcgtcgcggcactgtgaccgccacccgcggccacaccgcagggaccctcgccaataaacagccctcc

SEQ ID NO: 418091 - DNA, 553 bp, Homo sapiens
  misc_feature (73)..(73): n is a, c, g, or t
ggttgtgaagaagatcgagacacgtgatgggaagctggtggtctgagtcctctgacgtctgccccaaagtgancagctgcggcagcccctcccagcctacccctcctgcgctgccccagagcctgggaaggaggccgctatgcagggtagcactgggaacaggagacccacctgaggctcagccctagccctcagcccacctggggagtttactacctggggaccccccttgcccatgcctccagctacaaaacaattcaattgcttttttttttggtccaaaataaaacctcagctagctctgccaaaaaaaaaaaaaaaaaaaaaagggcggctgctcgcgatctagaaccccgactggagtgggggagtctgtgttccacacaacccgctgggtgccccccttgatcggggagctgtacgggctgcgcaccacagaggaggctctccatgccagccacggcttcatgtggtacacgtaggccctgtgccctccggccacctggatccctgcccctccccactgggacggaataaatgctctgcagacctg

SEQ ID NO: 418092 - DNA, 315 bp, Homo sapiens
agagatgaaaggctgcagaaatgtttattgaatacagtgccaggtttataaataaaacgtatttacaatttccctcgtcgaattcggcacgaggccatcatcatgaaggacgtgcccgactggagtgggggagtctgtgttccacacaacccgctgggtgccccccttgatcggggagctgtacgggctgcgcaccacagaggaggctctccatgccagccacggcttcatgtggtacacgtaggccctgtgccctccggccacctggatccctgcccctccccactgggacggaataaatgctctgcagacctg

SEQ ID NO: 418093 - DNA, 148 bp, Homo sapiens
  misc_feature (25)..(25): n is a, c, g, or t
gcggccgcctactactactactacnactgctcgaattcaagcttctaacgatgtacggggacatgtggtacacgtaggccctgtgccctccggccacctggatccctgcccctccccactgggacggaataaatgctctgcagacctg

SEQ ID NO: 418094 - DNA, 470 bp, Homo sapiens
gattgggagggaaacacctccaaggactgggagagacttgtctgagggcggaggcagagttctagggggcgacaagtctcaccaggacccatgtgccagagagaaaaggctgggtctgatgggggaggggaagtgggggtggggcagcaggactctggtgctgagggcaggccaccctcccagttcccaatccccccggaccctcctccctcaggctgggacgcagagaccggcagcgattcggaggacgggctgcggcctgacgtgctggtgtctctcgcggcgcccaagcgctgcgctggccgcttctccgggcgccaccacttcgtggccggcaggttcgtgcccgatgacgtgcgccgcaagttcgctctgcgcctgccgggatacacgggcaccgactgcgtcgcggcactgtgaccgccacccgcggccacaccgcagggaccctcgccaataaacagccctcc

SEQ ID NO: 418095 - DNA, 1243 bp, Homo sapiens
agcaagggatacccatcaccaccagggagcagaatccgttccaggattggggtgagtccgacttcgagcagcagctgccccccaacatcatgtacccagcccgtgactacgtggagccctgggcttcgcgtagagtccctagacggggcgaaaacgggaaaaggggccttaactggggcacctggctcctttgagagctcggagtttctgactggcctgcgcaacaccccagaggcaaggtgaacgcgagggcctataatgcaagaaccaaggcgagtcacgccctgtctgggcaaaagaggagtaaagacccctcagctgcagcccggcagcgcattcctacccagggtccgccgccagagctttcccgcgcggtcggatagttacactactgtccgggacttcctagccgtgccgcggaccatctcaagtgcttccgccacactcatcatggcggtggcagtaagtcacttccgcccgggaccggaagtgtgggatactgcgagtatggcggcgtcaaaggtgaagcaggacatgcctccgccggggggctatgggcccatcgactacaaacggaacttgccgcgtcgaggactgtcgggctacagcatgctggccatagggattggaaccctgatctacgggcactggagcataatgaagtggaaccgtgagcgcaggcgcctacaaatcgaggacttcgaggctcgcatcgcgctgttgccactgttacaggcagaaaccgaccggaggaccttgcagatgcttcgggagaacctggaggaggaggccatcatcatgaaggacgtgcccgactggaaggtgggggagtctgtgttccacacaacccgctgggtgccccccttgatcggggagctgtacgggctgcgcaccacagaggaggctctccatgccagccacggcttcatgtggtacacgtaggccctgtgccctccggccacctggatccctgcccctccccactgggacggaataaatgctctgcagacctgaaaaaaaacaacaaaaaaaaaaaaaccccgagaggcgcactcaatagtgccgggggggcgcgagacacaaacaggggtattggaatgtgggcagttggctcaataggttggttcccttggacccaagtttttcttggtccaagcggggaagaaccggcgggcgctcccccaatgagagaggcggaataattcgaaaaacgccggtacctggtagagtccccagaaaacat

SEQ ID NO: 418096 - DNA, 1071 bp, Homo sapiens
agcaagggatacccatcaccaccagggagcagaatccgttccaggattggggtgagtccgacttcgagcagcagctgccccccaacatcatgtacccagcccgtgactacgtggagccctgggcttcgcgtagagtccctagacggggcgaaaacgggaaaaggggccttaactggggcacctggctcctttgagagctcggagtttctgactggcctgcgcaacaccccagaggcaaggtgaacgcgagggcctataatgcaagaaccaaggcgagtcacgccctgtctgggcaaaagaggagtaaagacccctcagctgcagcccggcagcgcattcctacccagggtccgccgccagagctttcccgcgcggtcggatagttacactactgtccgggacttcctagccgtgccgcggaccatctcaagtgcttccgccacactcatcatggcggtggcagtaagtcacttccgcccgggaccggaagtgtgggatactgcgagtatggcggcgtcaaaggtgaagcaggacatgcctccgccggggggctatgggcccatcgactacaaacggaacttgccgcgtcgaggactgtcgggctacagcatgctggccatagggattggaaccctgatctacgggcactggagcataatgaagtggaaccgtgagcgcaggcgcctacaaatcgaggacttcgaggctcgcatcgcgctgttgccactgttacaggcagaaaccgaccggaggaccttgcagatgcttcgggagaacctggaggaggaggccatcatcatgaaggacgtgcccgactggaaggtgggggagtctgtgttccacacaacccgctgggtgccccccttgatcggggagctgtacgggctgcgcaccacagaggaggctctccatgccagccacggcttcatgtggtacacgtaggccctgtgccctccggccacctggatccctgcccctccccactgggacggaataaatgctctgcagacctgaagtggaaccgtgagcgcaggcgcctacaaatcgaggacttcgaggctcgcatcgcgc

SEQ ID NO: 418097 - DNA, 1170 bp, Homo sapiens
agcaagggatacccatcaccaccagggagcagaatccgttccaggattggggtgagtccgacttcgagcagcagctgccccccaacatcatgtacccagcccgtgactacgtggagccctgggcttcgcgtagagtccctagacggggcgaaaacgggaaaaggggccttaactggggcacctggctcctttgagagctcggagtttctgactggcctgcgcaacaccccagaggcaaggtgaacgcgagggcctataatgcaagaaccaaggcgagtcacgccctgtctgggcaaaagaggagtaaagacccctcagctgcagcccggcagcgcattcctacccagggtccgccgccagagctttcccgcgcggtcggatagttacactactgtccgggacttcctagccgtgccgcggaccatctcaagtgcttccgccacactcatcatggcggtggcagtaagtcacttccgcccgggaccggaagtgtgggatactgcgagtatggcggcgtcaaaggtgaagcaggacatgcctccgccggggggctatgggcccatcgactacaaacggaacttgccgcgtcgaggactgtcggaaaacccctggcatgggggcagaggtgtcacagtccaagcagcctcactcctgagaagccgccagtgtcccctgattgcagagtgggcagcgcctggagctgtggaggagggtgtctgggggcgggctggcccgctgagcagcgcctctcttcacaggctacagcatgctggccatagggattggaaccctgatctacgggcactggagcataatgaagtggaaccgtgagcgcaggcgcctacaaatcgaggacttcgaggctcgcatcgcgctgttgccactgttacaggcagaaaccgaccggaggaccttgcagatgcttcgggagaacctggaggaggaggccatcatcatgaaggacgtgcccgactggaaggtgggggagtctgtgttccacacaacccgctgggtgccccccttgatcggggagctgtacgggctgcgcaccacagaggaggctctccatgccagccacggcttcatgtggtacacgtaggccctgtgccctccggccacctggatccctgcccctccccactgggacggaataaatgctctgcagacctg

SEQ ID NO: 418098 - DNA, 1363 bp, Homo sapiens
agcaagggatacccatcaccaccagggagcagaatccgttccaggattggggtgagtccgacttcgagcagcagctgccccccaacatcatgtacccagcccgtgactacgtggagccctgggcttcgcgtagagtccctagacggggcgaaaacgggaaaaggggccttaactggggcacctggctcctttgagagctcggagtttctgactggcctgcgcaacaccccagaggcaaggtgaacgcgagggcctataatgcaagaaccaaggcgagtcacgccctgtctgggcaaaagaggagtaaagacccctcagctgcagcccggcagcgcattcctacccagggtccgccgccagagctttcccgcgcggtcggatagttacactactgtccgggacttcctagccgtgccgcggaccatctcaagtgcttccgccacactcatcatggcggtggcagtaagtcacttccgcccgggaccggaagtgtgggatactgcgagtatggcggcgtcaaaggtgaagcaggacatgcctccgccggggggctatgggcccatcgactacaaacggaacttgccgcgtcgaggactgtcggaaaacccctggcatgggggcagaggtgtcacagtccaagcagcctcactcctgagaagccgccagtgtcccctgattgcagagtgggcagcgcctggagctgtggaggagggtgtctgggggcgggctggcccgctgagcagcgcctctcttcacaggctacagcatgctggccatagggattggaaccctgatctacgggcactggagcataatgaagtggaaccgtgagcgcaggcgcctacaaatcgaggacttcgaggctcgcatcgcgctgttgccactgttacaggcagaaaccgaccggaggaccttgcagatgcttcgggagaacctggaggaggaggccatcatcatgaaggacgtgcccgactggaaggtgggggagtctgtgttccacacaacccgctgggtgccccccttgatcggggagctgtacgggctgcgcaccacagaggaggctctccatgccagccacggcttcatgtggtacacgtaggccctgtgccctccggccacctggatccctgcccctccccactgggacggaataaatgctctgcagacctgaacacacaccaacaaaacaccaccaccacacaaaccacaccggcgccagacaggcacacaaaaggccccacgcggtgagcaccaacgcagcaccgcgccaacaccgagacaaggaaacactcgcgggccccaacaaagggacaccaacacaacacagaagacaacgacccgcctccaagcaccaacacaaccg

SEQ ID NO: 418099 - DNA, 2061 bp, Homo sapiens
agcaagggatacccatcaccaccagggagcagaatccgttccaggattggggtgagtccgacttcgagcagcagctgccccccaacatcatgtacccagcccgtgactacgtggagccctgggcttcgcgtagagtccctagacggggcgaaaacgggaaaaggggccttaactggggcacctggctcctttgagagctcggagtttctgactggcctgcgcaacaccccagaggcaaggtgaacgcgagggcctataatgcaagaaccaaggcgagtcacgccctgtctgggcaaaagaggagtaaagacccctcagctgcagcccggcagcgcattcctacccagggtccgccgccagagctttcccgcgcggtcggatagttacactactgtccgggacttcctagccgtgccgcggaccatctcaagtgcttccgccacactcatcatggcggtggcagtaagtcacttccgcccgggaccggaagtgtgggatactgcgagtatggcggcgtcaaaggtgaagcaggacatgcctccgccggggggctatgggcccatcgactacaaacggaacttgccgcgtcgaggactgtcgggctacagcatgctggccatagggattggaaccctgatctacgggcactggagcataatgaagtggaaccgtgagcgcaggcgcctacaaatcgaggacttcgaggctcgcatcgcgctgttgccactgttacaggcagaaaccgaccggaggtagcaccgcaggggccaaggttgggaggtcactggccggaaggccccaggctgcagggcctgacctgcatccccgaaggtggccagaatgcacgtgggggccatcgccctgtgccgtcagctgcatcctcaggcgtggagacttagtggagacccaagggggcgaaccggaaggcttcctggaggaggaggcagcactggggttggggcaagagaaaagctaggagttggctgggggaaaaggagacagggtcggagggaggcttgaaggggtgctactaggggccctaggcaggggcccctcagggcactgaggccccacccccaccatcggccccatccccacaggaccttgcagatgcttcgggagaacctggaggaggaggccatcatcatgaaggacgtgcccgactggaagggccttggagctgcagcccccacttgccgacatgggaagagcggagcttagctcaaatgctaccacctcccttgtccagaggaggaaacaggcctggggaaggcagtcatggctagagcagatttggaacgcagggcctgtttgccagagcaccgcggaggcagccgccctggagcgggagctgctggaggattatcgctttgggcggcagcagctcgtggagctgtgcggtcatgctagtgccgtggctgtgaccaaggcgttcccgttgcccgctctctcccggaagcagaggacggtgctggtcgtgtgtggcccggagcagaacggggcagtggggctggtctgtgcccggcacctgcgggtgtttgagtatgaacccaccatcttctaccccacacgctcgctggacctgctgcatcgggacctgaccacccagtgcgagaagatggacatccccttcctgagctacctgcccactgaggtgcagctcattaacgaagcctatgggctggtggtggatgccgtactgggccccggcgtggagccgggcgaggtcgggggcccctgcacccgcgcgctggccacgctcaagctgctgtccatccccctcgtgagcctggacatcccctcaggctgggacgcagagaccggcagcgattcggaggacgggctgcggcctgacgtgctggtgtctctcgcggcgcccaagcgctgcgctggccgcttctccgggcgccaccacttcgtggccggcaggttcgtgcccgatgacgtgcgccgcaagttcgctctgcgcctgccgggatacacgggcaccgactgcgtcgcggcactgtgaccgccacccgcggccacaccgcagggaccctcgccaataaacagccctcc

SEQ ID NO: 418100 - DNA, 1661 bp, Homo sapiens
tttaggataaaaaaagtttttaattgaaaagaaagtagaaagccaacagtcttgtgggcagtcacccgtgcagctgcctgcacccgccctcctctcaggctcctggtgggctctgcccacagcccttgcccttcccgcgaccctcgccctgccccctgcctgcctccccgcccccctccgcctcttcccccagcagcaccctggcccctgaggtctgtgctgcctgtgctcccccgacctagcctggtctgacctgagtgtgggtttcgggctttcacaggcgcctacaaatcgaggacttcgaggctcgcatcgcgctgttgccactgttacaggcagaaaccgaccggaggtagcaccgcaggggccaaggttgggaggtcactggccggaaggccccaggctgcagggcctgacctgcatccccgaaggtggccagaatgcacgtgggggccatcgccctgtgccgtcagctgcatcctcaggcgtggagacttagtggagacccaagggggcgaaccggaaggcttcctggaggaggaggcagcactggggttggggcaagagaaaagctaggagttggctgggggaaaaggagacagggtcggagggaggcttgaaggggtgctactaggggccctaggcaggggcccctcagggcactgaggccccacccccaccatcggccccatccccacaggaccttgcagatgcttcgggagaacctggaggaggaggccatcatcatgaaggacgtgcccgactggaagggccttggagctgcagcccccacttgccgacatgggaagagcggagcttagctcaaatgctaccacctcccttgtccagaggaggaaacaggcctggggaaggcagtcatggctagagcagatttggaacgcagggcctgtttgccagagcaccgcggaggcagccgccctggagcgggagctgctggaggattatcgctttgggcggcagcagctcgtggagctgtgcggtcatgctagtgccgtggctgtgaccaaggcgttcccgttgcccgctctctcccggaagcagaggacggtgctggtcgtgtgtggcccggagcagaacggggcagtggggctggtctgtgcccggcacctgcgggtgtttgagtatgaacccaccatcttctaccccacacgctcgctggacctgctgcatcgggacctgaccacccagtgcgagaagatggacatccccttcctgagctacctgcccactgaggtgcagctcattaacgaagcctatgggctggtggtggatgccgtactgggccccggcgtggagccgggcgaggtcgggggcccctgcacccgcgcgctggccacgctcaagctgctgtccatccccctcgtgagcctggacatcccctcaggctgggacgcagagaccggcagcgattcggaggacgggctgcggcctgacgtgctggtgtctctcgcggcgcccaagcgctgcgctggccgcttctccgggcgccaccacttcgtggccggcaggttcgtgcccgatgacgtgcgccgcaagttcgctctgcgcctgccgggatacacgggcaccgactgcgtcgcggcactgtgaccgccacccgcggccacaccgcagggaccctcgccaataaacagccctcc

SEQ ID NO: 418101 - DNA, 1138 bp, Homo sapiens
agcaagggatacccatcaccaccagggagcagaatccgttccaggattggggtgagtccgacttcgagcagcagctgccccccaacatcatgtacccagcccgtgactacgtggagccctgggcttcgcgtagagtccctagacggggcgaaaacgggaaaaggggccttaactggggcacctggctcctttgagagctcggagtttctgactggcctgcgcaacaccccagaggcaaggtgaacgcgagggcctataatgcaagaaccaaggcgagtcacgccctgtctgggcaaaagaggagtaaagacccctcagctgcagcccggcagcgcattcctacccagggtccgccgccagagctttcccgcgcggtcggatagttacactactgtccgggacttcctagccgtgccgcggaccatctcaagtgcttccgccacactcatcatggcggtggcagtaagtcacttccgcccgggaccggaagtgtgggatactgcgagtatggcggcgtcaaaggtgaagcaggacatgcctccgccggggggctatgggcccatcgactacaaacggaacttgccgcgtcgaggactgtcgggctacagcatgctggccatagggattggaaccctgatctacgggcactggagcataatgaagtggaaccgtgagcgcaggtagggcccctggtgggcgttgtctgaaagtgcccccccggcgagttgtcggggtcctgtagcattccgctgttgtctgtgctggcgaggggtgaacgggccccttggacttggctgtgcaatcccaggccccagaaagtgcagatccagacccagcacttccacttctaggctctgtcctcgagatgtctccatgtctgcaatcccagcactttgggaggccaaggtgggagcattgcttgagcccaggagttcaagaccagcctgggcaacagagggaaaccctgtcctcgccaccccaaaaaatgtgtctagtgaggagggttgggacccgtggatccagattaggacaggatatgagtggggggcctgcctcgggccctctaagcaggattttgtcagaggtgaccaggctcaaaccagaccacaccaggcagtggacacacagggccagatga

SEQ ID NO: 418102 - DNA, 431 bp, Homo sapiens
agcaaggccccactggtgctcagtaaatattcatgatggcctaggtccttcctggggtgcagggcagggggcttcaccctgcagagccaagaggtagcacggccacccctagagtccggggggtggctgggcagcccccacagggcactgcctgtccctggcagctgtgtgcagcccccgcagggcagcacgcggaactgtggcccaggtggccgggagccaccatggacactgtcagaactgcccttccacttcagggccagcctgccgcccagggtccaaacagccttctagaacacgatggacctggggcccccctagcaaccaccatctagaccctcaggcctcctgaggttgctgcctggcttgtacctttcagaaaacccctggcatgggggcagaggtgtcacagtccaagcagcctcactcct

SEQ ID NO: 418103 - DNA, 1013 bp, Homo sapiens
agcaagggatacccatcaccaccagggagcagaatccgttccaggattggggtgagtccgacttcgagcagcagctgccccccaacatcatgtacccagcccgtgactacgtggagccctgggcttcgcgtagagtccctagacggggcgaaaacgggaaaaggggccttaactggggcacctggctcctttgagagctcggagtttctgactggcctgcgcaacaccccagaggcaaggtgaacgcgagggcctataatgcaagaaccaaggcgagtcacgccctgtctgggcaaaagaggagtaaagacccctcagctgcagcccggcagcgcattcctacccagggtccgccgccagagctttcccgcgcggtcggatagttacactactgtccgggacttcctagccgtgccgcggaccatctcaagtgcttccgccacactcatcatggcggtggcagtaagtcacttccgcccgggaccggaagtgtgggatactgcgagtatggcggcgtcaaaggtgaagcaggacatgcctccgccggggggctatgggcccatcgactacaaacggaacttgccgcgtcgaggactgtcgggctacagcatgctggccatagggattggaaccctgatctacgggcactggagcataatgaagtggaaccgtgagcgcaggcgcctacaaatcgaggacttcgaggctcgcatcgcgctgttgccactgttacaggcagaaaccgaccggaggaccttgcagatgcttcgggagaacctggaggaggaggccatcatcatgaaggacgtgcccgactggaaggtgggggagtctgtgttccacacaacccgctgggtgccccccttgatcggggagctgtacgggctgcgcaccacagaggaggctctccatgccagccacggcttcatgtggtacacgtaggccctgtgccctccggccacctggatccctgcccctccccactgggacggaataaatgctctgcagacctg

SEQ ID NO: 418104 - DNA, 539 bp, Homo sapiens
cttcagcctcgccaaaaagtccatggaaactggatgcgtcccatcagcggtgccccaccgtcaggccaaggaatttatgtcctcttggactgacaagagcccatcgggtctggcctcgtgccgaattcgcacgtgcagctcattaacgaagcctatgggctggtggtggatgccgtactgggccccggcgtggagccgggcgaggtcgggggcccctgcacccgcgcgctggccacgctcaagctgctgtccatccccctcgtgagcctggacatcccctcaggctgggacgcagagaccggcagcgattcggaggacgggctgcggcctgacgtgctggtgtctctcgcggcgcccaagcgctgcgctggccgcttctccgggcgccaccacttcgtggccggcaggttcgtgcccgatgacgtgcgccgcaagttcgctctgcgcctgccgggatacacgggcaccgactgcgtcgcggcactgtgaccgccacccgcggccacaccgcagggaccctcgccaataaacagccctcc

SEQ ID NO: 418105 - DNA, 1159 bp, Homo sapiens
agcaagggatacccatcaccaccagggagcagaatccgttccaggattggggtgagtccgacttcgagcagcagctgccccccaacatcatgtacccagcccgtgactacgtggagccctgggcttcgcgtagagtccctagacggggcgaaaacgggaaaaggggccttaactggggcacctggctcctttgagagctcggagtttctgactggcctgcgcaacaccccagaggcaaggtgaacgcgagggcctataatgcaagaaccaaggcgagtcacgccctgtctgggcaaaagaggagtaaagacccctcagctgcagcccggcagcgcattcctacccagggtccgccgccagagctttcccgcgcggtcggatagttacactactgtccgggacttcctagccgtgccgcggaccatctcaagtgcttccgccacactcatcatggcggtggcagtaagtcacttccgcccgggaccggaagtgtgggatactgcgagtatggcggcgtcaaaggtgaagcaggacatgcctccgccggggggctatgggcccatcgactacaaacggaacttgccgcgtcgaggactgtcgggctacagcatgctggccatagggattggaaccctgatctacgggcactggagcataatgaagtggaaccgtgagcgcaggcgcctacaaatcgaggacttcgaggctcgcatcgcgctgttgccactgttacaggcagaaaccgaccggaggaccttgcagatgcttcgggagaacctggaggaggaggccatcatcatgaaggacgtgcccgactggaaggtgggggagtctgtgttccacacaacccgctgggtgccccccttgatcggggagctgtacgggctgcgcaccacagaggaggctctccatgccagccacggcttcatgtggtacacgtaggccctgtgccctccggccacctggatccctgcccctccccactgggacggaataaatgctctgcagacctgaaaaaaaaaaaaaaaaaacaaaaaaaaaaaaaaaaaaaaaacaacaaaaaaaaaaaaacagggggggggcagcaaacaaaaaaccccacagaggggccaagataagagcagacacacagggtattgtgagacaagggggcgcccag

SEQ ID NO: 418106 - DNA, 1364 bp, Homo sapiens
  misc_feature (1209)..(1209): n is a, c, g, or t
agcaagggatacccatcaccaccagggagcagaatccgttccaggattggggtgagtccgacttcgagcagcagctgccccccaacatcatgtacccagcccgtgactacgtggagccctgggcttcgcgtagagtccctagacggggcgaaaacgggaaaaggggccttaactggggcacctggctcctttgagagctcggagtttctgactggcctgcgcaacaccccagaggcaaggtgaacgcgagggcctataatgcaagaaccaaggcgagtcacgccctgtctgggcaaaagaggagtaaagacccctcagctgcagcccggcagcgcattcctacccagggtccgccgccagagctttcccgcgcggtcggatagttacactactgtccgggacttcctagccgtgccgcggaccatctcaagtgcttccgccacactcatcatggcggtggcagtaagtcacttccgcccgggaccggaagtgtgggatactgcgagtatggcggcgtcaaaggtgaagcaggacatgcctccgccggggggctatgggcccatcgactacaaacggaacttgccgcgtcgaggactgtcgggctacagcatgctggccatagggattggaaccctgatctacgggcactggagcataatgaagtggaaccgtgagcgcaggcgcctacaaatcgaggacttcgaggctcgcatcgcgctgttgccactgttacaggcagaaaccgaccggaggaccttgcagatgcttcgggagaacctggaggaggaggccatcatcatgaaggacgtgcccgactggaaggtgggggagtctgtgttccacacaacccgctgggtgccccccttgatcggggagctgtacgggctgcgcaccacagaggaggctctccatgccagccacggcttcatgtggtacacgtaggccctgtgccctccggccacctggatccctgcccctccccactgggacggaataaatgctctgcagacctgaaaaaaaaaaaaaaaaaacaaaaaaaaaaaaaaccgggggctttttttcgggggggggaaaaaagggttttaaagggccgtgggttatttgttcccggcccccttttttttttccaaggggggagatcggcgggcccctaaagagggcggttaaattcgaaaacgccggtactgtagtgttccggctcagaacacncacacgaggggagagaacgggagacaacgacagcaagcacacacaagcagaacgtaggcagacgaagacgaggacgatcgccacgcacgcagacacagcaccataaagcatatcacaatgtcacacatcacagcagcgactctacacggcacact

SEQ ID NO: 418107 - DNA, 1206 bp, Homo sapiens
agcaagggatacccatcaccaccagggagcagaatccgttccaggattggggtgagtccgacttcgagcagcagctgccccccaacatcatgtacccagcccgtgactacgtggagccctgggcttcgcgtagagtccctagacggggcgaaaacgggaaaaggggccttaactggggcacctggctcctttgagagctcggagtttctgactggcctgcgcaacaccccagaggcaaggtgaacgcgagggcctataatgcaagaaccaaggcgagtcacgccctgtctgggcaaaagaggagtaaagacccctcagctgcagcccggcagcgcattcctacccagggtccgccgccagagctttcccgcgcggtcggatagttacactactgtccgggacttcctagccgtgccgcggaccatctcaagtgcttccgccacactcatcatggcggtggcagtaagtcacttccgcccgggaccggaagtgtgggatactgcgagtatggcggcgtcaaaggtgaagcaggacatgcctccgccggggggctatgggcccatcgactacaaacggaacttgccgcgtcgaggactgtcgggctacagcatgctggccatagggattggaaccctgatctacgggcactggagcataatgaagtggaaccgtgagcgcaggcgcctacaaatcgaggacttcgaggctcgcatcgcgctgttgccactgttacaggcagaaaccgaccggaggaccttgcagatgcttcgggagaacctggaggaggaggccatcatcatgaaggacgtgcccgactggaaggtgggggagtctgtgttccacacaacccgctgggtgccccccttgatcggggagctgtacgggctgcgcaccacagaggaggctctccatgccagccacggcttcatgtggtacacgtaggccctgtgccctccggccacctggatccctgcccctccccactgggacggaataaatgctctgcagacctgaacacacaccaacaaaacaccaccaccacacaaaccacaccggcgccagacaggcacacaaaaggccccacgcggtgagcaccaacgcagcaccgcgccaacaccgagacaaggaaacactcgcgggccccaacaaagggacaccaacacaacacagaagacaacgacccgcctccaagcaccaacacaaccg

SEQ ID NO: 418108 - DNA, 1315 bp, Homo sapiens
agcaagggatacccatcaccaccagggagcagaatccgttccaggattggggtgagtccgacttcgagcagcagctgccccccaacatcatgtacccagcccgtgactacgtggagccctgggcttcgcgtagagtccctagacggggcgaaaacgggaaaaggggccttaactggggcacctggctcctttgagagctcggagtttctgactggcctgcgcaacaccccagaggcaaggtgaacgcgagggcctataatgcaagaaccaaggcgagtcacgccctgtctgggcaaaagaggagtaaagacccctcagctgcagcccggcagcgcattcctacccagggtccgccgccagagctttcccgcgcggtcggatagttacactactgtccgggacttcctagccgtgccgcggaccatctcaagtgcttccgccacactcatcatggcggtggcagtaagtcacttccgcccgggaccggaagtgtgggatactgcgagtatggcggcgtcaaaggtgaagcaggacatgcctccgccggggggctatgggcccatcgactacaaacggaacttgccgcgtcgaggactgtcgggctacagcatgctggccatagggattggaaccctgatctacgggcactggagcataatgaagtggaaccgtgagcgcaggcgcctacaaatcgaggacttcgaggctcgcatcgcgctgttgccactgttacaggcagaaaccgaccggaggaccttgcagatgcttcgggagaacctggaggaggaggccatcatcatgaaggacgtgcccgactggaaggtgggggagtctgtgttccacacaacccgctgggtgccccccttgatcggggagctgtacgggctgcgcaccacagaggaggctctccatgccagccacggcttcatgtggtacacgtaggccctgtgccctccggccacctggatccctgcccctccccactgggacggaataaatgctctgcagacctgtggcctgcctgttttcctggggactgggggaaagaagggggagagggcccagctaggcaccaccggatcacatgtagcatggggacgcagcagatatgcacagggtgacctcaaaacacacctaggggctgcccctggatccactggcggcctcctctctgcctccgatatacctggactctcctgcctcccttttgaaaccatgcctgtcagcagcccacttacctctccaggctgggggcccctgggtcagctttgggtcagaccttctccacggaggtctggagagtggggggagcctt

SEQ ID NO: 418109 - DNA, 1713 bp, Homo sapiens
agcaagggatacccatcaccaccagggagcagaatccgttccaggattggggtgagtccgacttcgagcagcagctgccccccaacatcatgtacccagcccgtgactacgtggagccctgggcttcgcgtagagtccctagacggggcgaaaacgggaaaaggggccttaactggggcacctggctcctttgagagctcggagtttctgactggcctgcgcaacaccccagaggcaaggtgaacgcgagggcctataatgcaagaaccaaggcgagtcacgccctgtctgggcaaaagaggagtaaagacccctcagctgcagcccggcagcgcattcctacccagggtccgccgccagagctttcccgcgcggtcggatagttacactactgtccgggacttcctagccgtgccgcggaccatctcaagtgcttccgccacactcatcatggcggtggcagtaagtcacttccgcccgggaccggaagtgtgggatactgcgagtatggcggcgtcaaaggtgaagcaggacatgcctccgccggggggctatgggcccatcgactacaaacggaacttgccgcgtcgaggactgtcgggctacagcatgctggccatagggattggaaccctgatctacgggcactggagcataatgaagtggaaccgtgagcgcaggcgcctacaaatcgaggacttcgaggctcgcatcgcgctgttgccactgttacaggcagaaaccgaccggaggaccttgcagatgcttcgggagaacctggaggaggaggccatcatcatgaaggacgtgcccgactggaagggccttggagctgcagcccccacttgccgacatgggaagagcggagcttagctcaaatgctaccacctcccttgtccagaggaggaaacaggcctggggaaggcagtcatggctagagcagatttggaacgcagggcctgtttgccagagcaccgcggaggcagccgccctggagcgggagctgctggaggattatcgctttgggcggcagcagctcgtggagctgtgcggtcatgctagtgccgtggctgtgaccaaggcgttcccgttgcccgctctctcccggaagcagaggacggtgctggtcgtgtgtggcccggagcagaacggggcagtggggctggtctgtgcccggcacctgcgggtgtttgagtatgaacccaccatcttctaccccacacgctcgctggacctgctgcatcgggacctgaccacccagtgcgagaagatggacatccccttcctgagctacctgcccactgaggtgcagctcattaacgaagcctatgggctggtggtggatgccgtactgggccccggcgtggagccgggcgaggtcgggggcccctgcacccgcgcgctggccacgctcaagctgctgtccatccccctcgtgagcctggacatcccctcaggctgggacgcagagaccggcagcgattcggaggacgggctgcggcctgacgtgctggtgtctctcgcggcgcccaagcgctgcgctggccgcttctccgggcgccaccacttcgtggccggcaggttcgtgcccgatgacgtgcgccgcaagttcgctctgcgcctgccgggatacacgggcaccgactgcgtcgcggcactgtgaccgccacccgcggccacaccgcagggaccctcgccaataaacagccctcc

SEQ ID NO: 418110 - DNA, 1022 bp, Homo sapiens
cctccctccacggatgcgcttaaaaggcggtggcggtggcggcagcgcccggcgcccgggctcacctcggccatgagcagcgcagccggcccagacccgtcggaggcgcccgaagagcggcatttcctcagggccttggagctgcagcccccacttgccgacatgggaagagcggagcttagctcaaatgctaccacctcccttgtccagaggaggaaacaggcctggggaaggcagtcatggctagagcagatttggaacgcagggcctgtttgccagagcaccgcggaggcagccgccctggagcgggagctgctggaggattatcgctttgggcggcagcagctcgtggagctgtgcggtcatgctagtgccgtggctgtgaccaaggcgttcccgttgcccgctctctcccggaagcagaggacggtgctggtcgtgtgtggcccggagcagaacggggcagtggggctggtctgtgcccggcacctgcgggtgtttgagtatgaacccaccatcttctaccccacacgctcgctggacctgctgcatcgggacctgaccacccagtgcgagaagatggacatccccttcctgagctacctgcccactgaggtgcagctcattaacgaagcctatgggctggtggtggatgccgtactgggccccggcgtggagccgggcgaggtcgggggcccctgcacccgcgcgctggccacgctcaagctgctgtccatccccctcgtgagcctggacatcccctcaggctgggacgcagagaccggcagcgattcggaggacgggctgcggcctgacgtgctggtgtctctcgcggcgcccaagcgctgcgctggccgcttctccgggcgccaccacttcgtggccggcaggttcgtgcccgatgacgtgcgccgcaagttcgctctgcgcctgccgggatacacgggcaccgactgcgtcgcggcactgtgaccgccacccgcggccacaccgcagggaccctcgccaataaacagccctcc

SEQ ID NO: 418111 - DNA, 944 bp, Homo sapiens
agaaaggtggaagaatgtctgcaactcaggcggagaataaacaaaccgcactccgggcgacgggcagtggctggatgcacgtttttcctgcaccgacctggcagagcctgagaccgggcctctgcatctccagcggggaaactgaggccccaagaggcccaacccctcatccagaacagctcacctcctgtcctatcctgttgcctccaggcccaagccccatcccttcccctactccgggcctcagtttcctctccaggcaaggaggaatctggactgtgcctgtgcctttgctgtgtcccctaccaccaggcgttcccgttgcccgctctctcccggaagcagaggacggtgctggtcgtgtgtggcccggagcagaacggggcagtggggctggtctgtgcccggcacctgcgggtgtttgagtatgaacccaccatcttctaccccacacgctcgctggacctgctgcatcgggacctgaccacccagtgcgagaagatggacatccccttcctgagctacctgcccactgaggtgcagctcattaacgaagcctatgggctggtggtggatgccgtactgggccccggcgtggagccgggcgaggtcgggggcccctgcacccgcgcgctggccacgctcaagctgctgtccatccccctcgtgagcctggacatcccctcaggctgggacgcagagaccggcagcgattcggaggacgggctgcggcctgacgtgctggtgtctctcgcggcgcccaagcgctgcgctggccgcttctccgggcgccaccacttcgtggccggcaggttcgtgcccgatgacgtgcgccgcaagttcgctctgcgcctgccgggatacacgggcaccgactgcgtcgcggcactgtgaccgccacccgcggccacaccgcagggaccctcgccaataaacagccctcc

SEQ ID NO: 418112 - DNA, 432 bp, Homo sapiens
agaaaaggctgggtctgatgggggaggggaagtgggggtggggcagcaggactctggtctgagggcagaggctcagtgttggaggggagaggagaggaggcagggacaggatggactctaggctgagggcaggccaccctcccagttcccaatccccccggaccctcctccctcaggctgggacgcagagaccggcagcgattcggaggacgggctgcggcctgacgtgctggtgtctctcgcggcgcccaagcgctgcgctggccgcttctccgggcgccaccacttcgtggccggcaggttcgtgcccgatgacgtgcgccgcaagttcgctctgcgcctgccgggatacacgggcaccgactgcgtcgcggcactgtgaccgccacccgcggccacaccgcagggaccctcgccaataaacagccctcc

SEQ ID NO: 418113 - DNA, 2800 bp, Homo sapiens
cggggcagtaggaacgccgagtcggctgccgtggctgtgctgagggtggcggccggatagctgatgttctaatcatgtcagataaagatgatattgagactccactgctaactgaagcagcccccatccttgaagatggaaactgtgagccagccaagaattctgagtctgttgaccaaggtgccaaaccagagagtaaatcagaacctgtagtttccactcggaaaagaccagagaccaaaccttccagtgaccttgagacttcaaaagttctccctattcaggataatgtttccaaagatgtaccccagaccagatggggttattgggggagctggggcaagtccatactctcctcagcctcggctacagtagctacagtaggacaaggcatttcaaatgtcatcgagaaggcagagacttcccttggaatccctagtcccagtgaaatttcaactgaagtcaagtatgtagcaggagagacaaatgccaaagagaatgaaaactcctccccagtggctggggcatttggtgtattctctaccatctctactgctgttcagagcacaggaaagagtgttataagtgggggtttggatgccttagaattcattggaaaaaagacaatggatgtgatagcagaaggggatcctggatttaaaagaaccaagggtctgatgaaccgaaatgctacactatctcaggttttacgagaggcgaaggagaaagaagagatacggacctccaatgaggttaccgtggaaacagacaagaaaactcattatgggctactctttgatgaatttcaaggcctttcacatctagaagctctggagatgctttcccaagaaagtgaaataaaggtgaaatctatccttaattctctgagtggagaagaattagagactctaaaagttgaattagagcaactcaaagaaacattttctctagcagaattttgtgaagaagaggaagaagagaaaaaaggggatgaagattttaccaaggacataacagagctgttttcccagctgcacgtttcctccaaaccagagaaacttgccagggcaagaaataccgcccacgaatggatcaggaagtctctgaccaagccattagcagagaatgaagaaggagaaaaacagtcggaagcagaaaatactgagcaagtcaacaaaaattcaatagaggatatccatgcgtttgcaatccggagcctggctgaactgactgcctgctcaattgaactattccacaaaacagctgcattggttctgcatggcaggaagcaggaagtgacagccatagaaaggagccaaactctttcccagatgacaattgtgttgtgtaaagagttgtcctctctgtctaaagagttcactacctgcctaacaactgctggggtcaaagaaatggcagatgtccttaacccattaatcactgcagtatttctagaggcatcaaacagtgcctcctacatccaggacgcctttcagctactcttacctgtgctagagatctctctcattgagaacaagattgaatcacacagacatgagctgcagggccagaaacctttgttagaacattgaagaatggagatgttttgacctgggacttgtgacggccaaggaatgccaccttattctggctactcctgcagaaatgaaggagtggggttattttagtatataaaaattcaggcaggagagatggtttaaagaggaagattgttgccttcagtgtttgattgaagtattcaggttctcacagtattctttccagttgttgtaattcataaattatttgaaaagaaacttttgtagaaagtccaagaataataactctagataaagattagtgggacactcaggcaaaaatgttggtctttctttgacatgttgcaaaatgttatcaattttgtcatggatataatttgcagcccatggatataactggttgataagccagagaaaaataatttagtgttctaaaattcatggcatgtgtggtttattaatgccatgtactttctcctttctggaataaaatctatggctttaagaaaactgagcatatgtaaactctgtgatgattaccctttatcacatgaattcttggaaatagaaagtttcatctgcttttttaaattcttagtagatatttggcattgaggagaaacttgtagactattatagccatgtgaattaactgtagcaaagtgccctttttcttcaaattgctccccctccccaggatgacacacttcatgtcatagctgaaccctactctactggattcaaggccagtaaatgcaatttagagaagcagttttatgtttgcagatattctgagtctcttcaggatgtgtttcgtgtctaccatatatgcaggataaattctttaacagcaaactccaaaggaatgttgaagctgttttagcaatgaggatttttttgtttgagtgttgaagtgggccatagtcctttagaaatgatgttcatttatgataggatttaacttctaaggcatagtttattttttcctctttcctttttgtttgttttaatgtattctttagcatgtttttgatataacttttatcctccagatcttaagctttcttttgctctcttcagcaatttaagagactattaagctgtcatcttcctaaaagctattttggtatccactctttttaaaaaaattctccaactttgtgattttttaatgattaaggtaatttgttagctctgcccctcatcttctaaaacctttgtaataaaatgtattaatcatg

SEQ ID NO: 418114 - DNA, 3244 bp, Homo sapiens
cggggcagtaggaacgccgagtcggctgccgtggctgtgctgagggtggcggccggatagggacccagaactccatttgacagatgaggaaacggcgaggcagacaggtgacctgacttccccacaatcgctgcaggacaggaagaaagtaaactccagagcccgtgctcttagctactaagctgtactgctcttcattttgctgatgttctaatcatgtcagataaagatgatattgagactccactgctaactgaagcagcccccatccttgaagatggaaactgtgagccagccaagaattctgagtctgttgaccaaggtgccaaaccagagagtaaatcagaacctgtagtttccactcggaaaagaccagagaccaaaccttccagtgaccttgagacttcaaaagttctccctattcaggataatgtttccaaagatgtaccccagaccagatggggttattgggggagctggggcaagtccatactctcctcagcctcggctacagtagctacagtaggacaaggcatttcaaatgtcatcgagaaggcagagacttcccttggaatccctagtcccagtgaaatttcaactgaagtcaagtatgtagcaggagagacaaatgccaaagagaatgaaaactcctccccagtggctggggcatttggtgtattctctaccatctctactgctgttcagagcacaggaaagagtgttataagtgggggtttggatgccttagaattcattggaaaaaagacaatggatgtgatagcagaaggggatcctggatttaaaagaaccaagggtctgatgaaccgaaatgctacactatctcaggttttacgagaggcgaaggagaaagaagagatacggacctccaatgaggttaccgtggaaacagacaagaaaactcattatgggctactctttgatgaatttcaaggcctttcacatctagaagctctggagatgctttcccaagaaagtgaaataaaggtgaaatctatccttaattctctgagtggagaagaattagagactctaaaagttgaattagagcaactcaaagaaacattttctctagcagaattttgtgaagaagaggaagaagagaaaaaaggggatgaagattttaccaaggacataacagagctgttttcccagctgcacgtttcctccaaaccagagaaacttgccagggcaagaaataccgcccacgaatggatcaggaagtctctgaccaagccattagcagagaatgaagaaggagaaaaacagtcggaagcagaaaatactgagcaagtcaacaaaaattcaatagaggatatccatgcgtttgcaatccggagcctggctgaactgactgcctgctcaattgaactattccacaaaacagctgcattggttctgcatggcaggaagcaggaagtgacagccatagaaaggagccaaactctttcccagatgacaattgtgttgtgtaaagagttgtcctctctgtctaaagagttcactacctgcctaacaactgctggggtcaaagaaatggcagatgtccttaacccattaatcactgcagtatttctagaggcatcaaacagtgcctcctacatccaggacgcctttcagctactcttacctgtgctagagatctctctcattgagaacaagattgaatcacacagacatgagctgcagggccagaaacctttgttagaacattgaagaatggagatgttttgacctgggacttgtgacggccaaggaatgccaccttattctggctactcctgcagaaatgaaggagtggggttattttagtatataaaaattcaggcaggagagatggtttaaagaggaagattgttgccttcagtgtttgattgaagtattcaggttctcacagtattctttccagttgttgtaattcataaattatttgaaaagaaacttttgtagaaagtccaagaataataactctagataaagattagtgggacactcaggcaaaaatgttggtctttctttgacatgttgcaaaatgttatcaattttgtcatggatataatttgcagcccatggatataactggttgataagccagagaaaaataatttagtgttctaaaattcatggcatgtgtggtttattaatgccatgtactttctcctttctggaataaaatctatggctttaagaaaactgagcatatgtaaactctgtgatgattaccctttatcacatgaattcttggaaatagaaagtttcatctgcttttttaaattcttagtagatatttggcattgaggagaaacttgtagactattatagccatgtgaattaactgtagcaaagtgccctttttcttcaaattgctccccctccccaggatgacacacttcatgtcatagctgaaccctactctactggattcaaggccagtaaatgcaatttagagaagcagttttatgtttgcagatattctgagtctcttcaggatgtgtttcgtgtctaccatatatgcaggataaattctttaacagcaaactccaaaggaatgttgaagctgttttagcaatgaggatttttttgtttgagtgttgaagtgggccatagtcctttagaaatgatgttcatttatgataggatttaacttctaaggcatagtttattttttcctctttcctttttgtttgttttaatgtattctttagcatgtttttgatataacttttatcctccagatcttaagctttcttttgctctcttcagcaatttaagagactattaagctgtcatcttcctaaaagctattttggtatccactctttttaaaaaaattctccaactttgtgattttttaatgattaaggtaatttgttagctctgcccctcatcttctaaaacctttgtaataaaatgtattaatcatgttatttgatcctttcatttacttttgtaaacacgagccctaatatcttacttagaccaaaaaaaaaaaaaaaaaatagcaaagcaaagccataaatagattagtataaagactgtttctatgtaatcttctttggggcaggagtcagttagtaagcaaggaagagaaataaatttggtttaaaaaggtataccaacagcactacaatgttactctgcctatattctgtcttaatatgatcagaaagtttttgaatattcctttttaaagacaaatttcaccctttccagcttgaatatttct

SEQ ID NO: 418115 - DNA, 3132 bp, Homo sapiens
cggggcagtaggaacgccgagtcggctgccgtggctgtgctgagggtggcggccggataggtgcggagcttcctgaacgaggcaggagggctgatgttctaatcatgtcagataaagatgatattgagactccactgctaactgaagcagcccccatccttgaagatggaaactgtgagccagccaagaattctgagtctgttgaccaaggtgccaaaccagagagtaaatcagaacctgtagtttccactcggaaaagaccagagaccaaaccttccagtgaccttgagacttcaaaagttctccctattcaggataatgtttccaaagatgtaccccagaccagatggggttattgggggagctggggcaagtccatactctcctcagcctcggctacagtagctacagtaggacaaggcatttcaaatgtcatcgagaaggcagagacttcccttggaatccctagtcccagtgaaatttcaactgaagtcaagtatgtagcaggagagacaaatgccaaagagaatgaaaactcctccccagtggctggggcatttggtgtattctctaccatctctactgctgttcagagcacaggaaagagtgttataagtgggggtttggatgccttagaattcattggaaaaaagacaatggatgtgatagcagaaggggatcctggatttaaaagaaccaagggtctgatgaaccgaaatgctacactatctcaggttttacgagaggcgaaggagaaagaagagatacggacctccaatgaggttaccgtggaaacagacaagaaaactcattatgggctactctttgatgaatttcaaggcctttcacatctagaagctctggagatgctttcccaagaaagtgaaataaaggtgaaatctatccttaattctctgagtggagaagaattagagactctaaaagttgaattagagcaactcaaagaaacattttctctagcagaattttgtgaagaagaggaagaagagaaaaaaggggatgaagattttaccaaggacataacagagctgttttcccagctgcacgtttcctccaaaccagagaaacttgccagggcaagaaataccgcccacgaatggatcaggaagtctctgaccaagccattagcagagaatgaagaaggagaaaaacagtcggaagcagaaaatactgagcaagtcaacaaaaattcaatagaggatatccatgcgtttgcaatccggagcctggctgaactgactgcctgctcaattgaactattccacaaaacagctgcattggttctgcatggcaggaagcaggaagtgacagccatagaaaggagccaaactctttcccagatgacaattgtgttgtgtaaagagttgtcctctctgtctaaagagttcactacctgcctaacaactgctggggtcaaagaaatggcagatgtccttaacccattaatcactgcagtatttctagaggcatcaaacagtgcctcctacatccaggacgcctttcagctactcttacctgtgctagagatctctctcattgagaacaagattgaatcacacagacatgagctgcagggccagaaacctttgttagaacattgaagaatggagatgttttgacctgggacttgtgacggccaaggaatgccaccttattctggctactcctgcagaaatgaaggagtggggttattttagtatataaaaattcaggcaggagagatggtttaaagaggaagattgttgccttcagtgtttgattgaagtattcaggttctcacagtattctttccagttgttgtaattcataaattatttgaaaagaaacttttgtagaaagtccaagaataataactctagataaagattagtgggacactcaggcaaaaatgttggtctttctttgacatgttgcaaaatgttatcaattttgtcatggatataatttgcagcccatggatataactggttgataagccagagaaaaataatttagtgttctaaaattcatggcatgtgtggtttattaatgccatgtactttctcctttctggaataaaatctatggctttaagaaaactgagcatatgtaaactctgtgatgattaccctttatcacatgaattcttggaaatagaaagtttcatctgcttttttaaattcttagtagatatttggcattgaggagaaacttgtagactattatagccatgtgaattaactgtagcaaagtgccctttttcttcaaattgctccccctccccaggatgacacacttcatgtcatagctgaaccctactctactggattcaaggccagtaaatgcaatttagagaagcagttttatgtttgcagatattctgagtctcttcaggatgtgtttcgtgtctaccatatatgcaggataaattctttaacagcaaactccaaaggaatgttgaagctgttttagcaatgaggatttttttgtttgagtgttgaagtgggccatagtcctttagaaatgatgttcatttatgataggatttaacttctaaggcatagtttattttttcctctttcctttttgtttgttttaatgtattctttagcatgtttttgatataacttttatcctccagatcttaagctttcttttgctctcttcagcaatttaagagactattaagctgtcatcttcctaaaagctattttggtatccactctttttaaaaaaattctccaactttgtgattttttaatgattaaggtaatttgttagctctgcccctcatcttctaaaacctttgtaataaaatgtattaatcatgttatttgatcctttcatttacttttgtaaacacgagccctaatatcttacttagaccaaaaaaaaaaaaaaaaaatagcaaagcaaagccataaatagattagtataaagactgtttctatgtaatcttctttggggcaggagtcagttagtaagcaaggaagagaaataaatttggtttaaaaaggtataccaacagcactacaatgttactctgcctatattctgtcttaatatgatcagaaagtttttgaatattcctttttaaagacaaatttcaccctttccagcttgaatatttct

SEQ ID NO: 418116 - DNA, 3572 bp, Homo sapiens
cggggcagtaggaacgccgagtcggctgccgtggctgtgctgagggtggcggccggataggtgcggagcttcctgaacgaggcaggaggggtgcgaggttcaggggcagggcccgggcagccgaagtcgttagggaggcggttacctgacggtgggcggcggacatctcgcagcagggtcgagggctgtgaaagcggtttagtgattgaagcgctacgtttgtgtgaggaattcttgtcgttgtcagcgcctgagaacttagttgggagcggacgtttacgtcgaatctctcgtttgggaccccattcttgaatgtgggaagaagggagaacgcatgtttgctcatctagagacagccgtattaataacgataggatacaaaccatcaccccaccaagtgatagcagctgttaacctgtgggcgggttacgtgccggtcactgttccaagcccctcacatatcgcgtcactgaatctttatagggacccagaactccatttgacagatgaggaaacggcgaggcagacagctgatgttctaatcatgtcagataaagatgatattgagactccactgctaactgaagcagcccccatccttgaagatggaaactgtgagccagccaagaattctgagtctgttgaccaaggtgccaaaccagagagtaaatcagaacctgtagtttccactcggaaaagaccagagaccaaaccttccagtgaccttgagacttcaaaagttctccctattcaggataatgtttccaaagatgtaccccagaccagatggggttattgggggagctggggcaagtccatactctcctcagcctcggctacagtagctacagtaggacaaggcatttcaaatgtcatcgagaaggcagagacttcccttggaatccctagtcccagtgaaatttcaactgaagtcaagtatgtagcaggagagacaaatgccaaagagaatgaaaactcctccccagtggctggggcatttggtgtattctctaccatctctactgctgttcagagcacaggaaagagtgttataagtgggggtttggatgccttagaattcattggaaaaaagacaatggatgtgatagcagaaggggatcctggatttaaaagaaccaagggtctgatgaaccgaaatgctacactatctcaggttttacgagaggcgaaggagaaagaagagatacggacctccaatgaggttaccgtggaaacagacaagaaaactcattatgggctactctttgatgaatttcaaggcctttcacatctagaagctctggagatgctttcccaagaaagtgaaataaaggtgaaatctatccttaattctctgagtggagaagaattagagactctaaaagttgaattagagcaactcaaagaaacattttctctagcagaattttgtgaagaagaggaagaagagaaaaaaggggatgaagattttaccaaggacataacagagctgttttcccagctgcacgtttcctccaaaccagagaaacttgccagggcaagaaataccgcccacgaatggatcaggaagtctctgaccaagccattagcagagaatgaagaaggagaaaaacagtcggaagcagaaaatactgagcaagtcaacaaaaattcaatagaggatatccatgcgtttgcaatccggagcctggctgaactgactgcctgctcaattgaactattccacaaaacagctgcattggttctgcatggcaggaagcaggaagtgacagccatagaaaggagccaaactctttcccagatgacaattgtgttgtgtaaagagttgtcctctctgtctaaagagttcactacctgcctaacaactgctggggtcaaagaaatggcagatgtccttaacccattaatcactgcagtatttctagaggcatcaaacagtgcctcctacatccaggacgcctttcagctactcttacctgtgctagagatctctctcattgagaacaagattgaatcacacagacatgagctgcagggccagaaacctttgttagaacattgaagaatggagatgttttgacctgggacttgtgacggccaaggaatgccaccttattctggctactcctgcagaaatgaaggagtggggttattttagtatataaaaattcaggcaggagagatggtttaaagaggaagattgttgccttcagtgtttgattgaagtattcaggttctcacagtattctttccagttgttgtaattcataaattatttgaaaagaaacttttgtagaaagtccaagaataataactctagataaagattagtgggacactcaggcaaaaatgttggtctttctttgacatgttgcaaaatgttatcaattttgtcatggatataatttgcagcccatggatataactggttgataagccagagaaaaataatttagtgttctaaaattcatggcatgtgtggtttattaatgccatgtactttctcctttctggaataaaatctatggctttaagaaaactgagcatatgtaaactctgtgatgattaccctttatcacatgaattcttggaaatagaaagtttcatctgcttttttaaattcttagtagatatttggcattgaggagaaacttgtagactattatagccatgtgaattaactgtagcaaagtgccctttttcttcaaattgctccccctccccaggatgacacacttcatgtcatagctgaaccctactctactggattcaaggccagtaaatgcaatttagagaagcagttttatgtttgcagatattctgagtctcttcaggatgtgtttcgtgtctaccatatatgcaggataaattctttaacagcaaactccaaaggaatgttgaagctgttttagcaatgaggatttttttgtttgagtgttgaagtgggccatagtcctttagaaatgatgttcatttatgataggatttaacttctaaggcatagtttattttttcctctttcctttttgtttgttttaatgtattctttagcatgtttttgatataacttttatcctccagatcttaagctttcttttgctctcttcagcaatttaagagactattaagctgtcatcttcctaaaagctattttggtatccactctttttaaaaaaattctccaactttgtgattttttaatgattaaggtaatttgttagctctgcccctcatcttctaaaacctttgtaataaaatgtattaatcatgttatttgatcctttcatttacttttgtaaacacgagccctaatatcttacttagaccaaaaaaaaaaaaaaaaaatagcaaagcaaagccataaatagattagtataaagactgtttctatgtaatcttctttggggcaggagtcagttagtaagcaaggaagagaaataaatttggtttaaaaaggtataccaacagcactacaatgttactctgcctatattctgtcttaatatgatcagaaagtttttgaatattcctttttaaagacaaatttcaccctttccagcttgaatatttct

SEQ ID NO: 418117 - DNA, 3632 bp, Homo sapiens
atattatatgcccatatattctgaactccatagtgttgtcttaatctacctttctagcttcatgccttcccattgttcttctctctgccatggtaactactccctactgtaactgtccatgttccatactgtcagacctcaggcctttggctgtaccctcatgttatttccatatccttgaatcctgtcattggcatcatcatctgtcaaaatcataagcttcttttaaggcaggtgttgccaactcagacgcctacagaggttaatcaggtagcataatttgagtgaagtggatttgcgtgggggattgtagggagctggagagcaactgccctagctaaaagggcccagcggctatttagcacaagcctagttattacagagttgaatgtgggcccggtgttgctagatcttttaatttcacaagttagaagttggaagcctatatttttatatgaagtctgatttttaaatgttggcatctagtttttgcaaaggttaaatattgtgcaggccaaataaaaacatctgtaggctggatttggcacttaaattcccagtttgtgaccactactctaggcttatttcagctgatgttctaatcatgtcagataaagatgatattgagactccactgctaactgaagcagcccccatccttgaagatggaaactgtgagccagccaagaattctgagtctgttgaccaaggtgccaaaccagagagtaaatcagaacctgtagtttccactcggaaaagaccagagaccaaaccttccagtgaccttgagacttcaaaagttctccctattcaggataatgtttccaaagatgtaccccagaccagatggggttattgggggagctggggcaagtccatactctcctcagcctcggctacagtagctacagtaggacaaggcatttcaaatgtcatcgagaaggcagagacttcccttggaatccctagtcccagtgaaatttcaactgaagtcaagtatgtagcaggagagacaaatgccaaagagaatgaaaactcctccccagtggctggggcatttggtgtattctctaccatctctactgctgttcagagcacaggaaagagtgttataagtgggggtttggatgccttagaattcattggaaaaaagacaatggatgtgatagcagaaggggatcctggatttaaaagaaccaagggtctgatgaaccgaaatgctacactatctcaggttttacgagaggcgaaggagaaagaagagatacggacctccaatgaggttaccgtggaaacagacaagaaaactcattatgggctactctttgatgaatttcaaggcctttcacatctagaagctctggagatgctttcccaagaaagtgaaataaaggtgaaatctatccttaattctctgagtggagaagaattagagactctaaaagttgaattagagcaactcaaagaaacattttctctagcagaattttgtgaagaagaggaagaagagaaaaaaggggatgaagattttaccaaggacataacagagctgttttcccagctgcacgtttcctccaaaccagagaaacttgccagggcaagaaataccgcccacgaatggatcaggaagtctctgaccaagccattagcagagaatgaagaaggagaaaaacagtcggaagcagaaaatactgagcaagtcaacaaaaattcaatagaggatatccatgcgtttgcaatccggagcctggctgaactgactgcctgctcaattgaactattccacaaaacagctgcattggttctgcatggcaggaagcaggaagtgacagccatagaaaggagccaaactctttcccagatgacaattgtgttgtgtaaagagttgtcctctctgtctaaagagttcactacctgcctaacaactgctggggtcaaagaaatggcagatgtccttaacccattaatcactgcagtatttctagaggcatcaaacagtgcctcctacatccaggacgcctttcagctactcttacctgtgctagagatctctctcattgagaacaagattgaatcacacagacatgagctgcagggccagaaacctttgttagaacattgaagaatggagatgttttgacctgggacttgtgacggccaaggaatgccaccttattctggctactcctgcagaaatgaaggagtggggttattttagtatataaaaattcaggcaggagagatggtttaaagaggaagattgttgccttcagtgtttgattgaagtattcaggttctcacagtattctttccagttgttgtaattcataaattatttgaaaagaaacttttgtagaaagtccaagaataataactctagataaagattagtgggacactcaggcaaaaatgttggtctttctttgacatgttgcaaaatgttatcaattttgtcatggatataatttgcagcccatggatataactggttgataagccagagaaaaataatttagtgttctaaaattcatggcatgtgtggtttattaatgccatgtactttctcctttctggaataaaatctatggctttaagaaaactgagcatatgtaaactctgtgatgattaccctttatcacatgaattcttggaaatagaaagtttcatctgcttttttaaattcttagtagatatttggcattgaggagaaacttgtagactattatagccatgtgaattaactgtagcaaagtgccctttttcttcaaattgctccccctccccaggatgacacacttcatgtcatagctgaaccctactctactggattcaaggccagtaaatgcaatttagagaagcagttttatgtttgcagatattctgagtctcttcaggatgtgtttcgtgtctaccatatatgcaggataaattctttaacagcaaactccaaaggaatgttgaagctgttttagcaatgaggatttttttgtttgagtgttgaagtgggccatagtcctttagaaatgatgttcatttatgataggatttaacttctaaggcatagtttattttttcctctttcctttttgtttgttttaatgtattctttagcatgtttttgatataacttttatcctccagatcttaagctttcttttgctctcttcagcaatttaagagactattaagctgtcatcttcctaaaagctattttggtatccactctttttaaaaaaattctccaactttgtgattttttaatgattaaggtaatttgttagctctgcccctcatcttctaaaacctttgtaataaaatgtattaatcatgttatttgatcctttcatttacttttgtaaacacgagccctaatatcttacttagaccaaaaaaaaaaaaaaaaaatagcaaagcaaagccataaatagattagtataaagactgtttctatgtaatcttctttggggcaggagtcagttagtaagcaaggaagagaaataaatttggtttaaaaaggtataccaacagcactacaatgttactctgcctatattctgtcttaatatgatcagaaagtttttgaatattcctttttaaagacaaatttcaccctttccagcttgaatatttct

SEQ ID NO: 418118 - DNA, 2533 bp, Homo sapiens
cggggcagtaggaacgccgagtcggctgccgtggctgtgctgagggtggcggccggataggtgcggagcttcctgaacgaggcaggaggggtgcgaggttcaggggcagggcccgggcagccgaagtcgttagggaggcggttacctgacggtgggcggcggacatctcgcagcagggtcgagggctgtgaaagcggtttagtgattgaagcgctacgtttgtgtgaggaattcttgtcgttgtcagcgcctgagaacttagttgggagcggacgtttacgtcgaatctctcgtttgggaccccattcttgaatgtgggaagaagggagaacgcatgtttgctcatctagagacagccgtattaataacgataggatacaaaccatcaccccaccaagtgatagcagctgttaacctgtgggcgggttacgtgccggtcactgttccaagcccctcacatatcgcgtcactgaatctttatagggacccagaactccatttgacagatgaggaaacggcgaggcagacagctgatgttctaatcatgtcagataaagatgatattgagactccactgctaactgaagcagcccccatccttgaagatggaaactgtgagccagccaagaattctgagtctgttgaccaaggtgccaaaccagagagtaaatcagaacctgtagtttccactcggaaaagaccagagaccaaaccttccagtgaccttgagacttcaaaagttctccctattcaggataatgtttccaaagatgtaccccagaccagatggggttattgggggagctggggcaagtccatactctcctcagcctcggctacagtagctacagtaggacaaggcatttcaaatgtcatcgagaaggcagagacttcccttggaatccctagtcccagtgaaatttcaactgaagtcaagtatgtagcaggagagacaaatgccaaagagaatgaaaactcctccccagtggctggggcatttggtgtattctctaccatctctactgctgttcagagcacaggaaagagtgttataagtgggggtttggatgccttagaattcattggaaaaaagacaatggatgtgatagcagaaggggatcctggatttaaaagaaccaagggtctgatgaaccgaaatgctacactatctcaggttttacgagaggcgaaggagaaagaagagatacggacctccaatgaggttaccgtggaaacagacaagaaaactcattatgggctactctttgatgaatttcaaggcctttcacatctagaagctctggagatgctttcccaagaaagtgaaataaaggtgaaatctatccttaattctctgagtggagaagaattagagactctaaaagttgaattagagcaactcaaagaaacattttctctagcagaattttgtgaagaagaggaagaagagaaaaaaggggatgaagattttaccaaggacataacagagctgttttcccagctgcacgtttcctccaaaccagagaaacttgccagggcaagaaataccgcccacgaatggatcaggaagtctctgaccaagccattagcagagaatgaagaaggagaaaaacagtcggaagcagaaaatactgagcaagtcaacaaaaattcaatagaggatatccatgcgtttgcaatccggagcctggctgaactgactgcctgctcaattgaactattccacaaaacagctgcattggttctgcatggcaggaagcaggaagtgacagccatagaaaggagccaaactctttcccagatgacaattgtgttgtgtaaagagttgtcctctctgtctaaagagttcactacctgcctaacaactgctggggtcaaagaaatggcagatgtccttaacccattaatcactgcagtatttctagaggcatcaaacagtgcctcctacatccaggacgcctttcagctactcttacctgtgctagagatctctctcattgagaacaagattgaatcacacagacatgagctgcagggccagaaacctttgttagaacattgaagaatggagatgttttgacctgggacttgtgacggccaaggaatgccaccttattctggctactcctgcagaaatgaaggagtggggttattttagtatataaaaattcaggcaggagagatggtttaaagaggaagattgttgccttcagtgtttgattgaagtattcaggttctcacagtattctttccagttgttgtaattcataaattatttgaaaagaaacttttgtagaaagtccaagaataataactctagataaagattagtgggacactcaggcaaaaatgttggtctttctttgacatgttgcaaaatgttatcaattttgtcatggatataatttgcagcccatggatataactggttgataagccagagaaaaataatttagtgttctaaaattcatggcatgtgtggtttattaatgccatgtactttctcctttctggaataaaatctatggcttta

SEQ ID NO: 418119 - DNA, 2034 bp, Homo sapiens
acccttgagttttttgagcacatgttccatatctacatgttttgttttaaaatggttctaaggttttgtggtcaaatgaagataccttttaaagtcaataaaaaggtataaaacaatacactgtcaatatggatagcacagaaagatattaagaaagaagtttaaaacacttagaatttccattctaaagatgacattttgctctcagtccagacttctgtgcttatatttaatatttatgtatgggtgtgtgtgtgtgttttaaagtgtgatcgtactccacttactgttatttaacctactctgctcacttaaaaatgtattcgttattccaggtcaaagaaatggcagatgtccttaacccattaatcactgcagtatttctagaggcatcaaacagtgcctcctacatccaggacgcctttcagctactcttacctgtgctagagatctctctcattgagaacaagattgaatcacacagacatgagctgcagggccagaaacctttgttagaacattgaagaatggagatgttttgacctgggacttgtgacggccaaggaatgccaccttattctggctactcctgcagaaatgaaggagtggggttattttagtatataaaaattcaggcaggagagatggtttaaagaggaagattgttgccttcagtgtttgattgaagtattcaggttctcacagtattctttccagttgttgtaattcataaattatttgaaaagaaacttttgtagaaagtccaagaataataactctagataaagattagtgggacactcaggcaaaaatgttggtctttctttgacatgttgcaaaatgttatcaattttgtcatggatataatttgcagcccatggatataactggttgataagccagagaaaaataatttagtgttctaaaattcatggcatgtgtggtttattaatgccatgtactttctcctttctggaataaaatctatggctttaagaaaactgagcatatgtaaactctgtgatgattaccctttatcacatgaattcttggaaatagaaagtttcatctgcttttttaaattcttagtagatatttggcattgaggagaaacttgtagactattatagccatgtgaattaactgtagcaaagtgccctttttcttcaaattgctccccctccccaggatgacacacttcatgtcatagctgaaccctactctactggattcaaggccagtaaatgcaatttagagaagcagttttatgtttgcagatattctgagtctcttcaggatgtgtttcgtgtctaccatatatgcaggataaattctttaacagcaaactccaaaggaatgttgaagctgttttagcaatgaggatttttttgtttgagtgttgaagtgggccatagtcctttagaaatgatgttcatttatgataggatttaacttctaaggcatagtttattttttcctctttcctttttgtttgttttaatgtattctttagcatgtttttgatataacttttatcctccagatcttaagctttcttttgctctcttcagcaatttaagagactattaagctgtcatcttcctaaaagctattttggtatccactctttttaaaaaaattctccaactttgtgattttttaatgattaaggtaatttgttagctctgcccctcatcttctaaaacctttgtaataaaatgtattaatcatgttatttgatcctttcatttacttttgtaaacacgagccctaatatcttacttagaccaaaaaaaaaaaaaaaaaatagcaaagcaaagccataaatagattagtataaagactgtttctatgtaatcttctttggggcaggagtcagttagtaagcaaggaagagaaataaatttggtttaaaaaggtataccaacagcactacaatgttactctgcctatattctgtcttaatatgatcagaaagtttttgaatattcctttttaaagacaaatttcaccctttccagcttgaatatttct

SEQ ID NO: 418120 - DNA, 618 bp, Homo sapiens
cggggcagtaggaacgccgagtcggctgccgtggctgtgctgagggtggcggccggatagggacccagaactccatttgacagatgaggaaacggcgaggcagacaggtgacctgacttccccacaatcgctgcaggacaggaagaaagtaaactccagagcccgtgctcttagctactaagctgtactgctcttcattttgctgatgttctaatcatgtcagataaagatgatattgagactccactgctaactgaagcagcccccatccttgaagatggaaaattgttgccttcagtgtttgattgaagtattcaggttctcacagtattctttccagttgttgtaattcataaattatttgaaaagaaacttttgtagaaagtccaagaataataactctagataaagattagtgggacactcaggcaaaaatgttggtctttctttgacatgttgcaaaatgttatcaattttgtcatggatataatttgcagcccatggatataactggttgataagccagagaaaaataatttagtgttctaaaattcatggcatgtgtggtttattaatgccatgtactttctcctttctggaataaaatctatggcttta

SEQ ID NO: 418121 - DNA, 356 bp, Homo sapiens
ttcagtttgtagctattacaagcagagctgttatgaacatttttgtgcatgtcttctgatgaacctctgtacttatttctgttaggatgtaaccatgagtggaatttctgggtcatgcagctggagtagatattgacaaacagttttctaatgtggttatacctatttacgttcccacaagcagtgtgtgattgtttcatttgctttacattcttgccagtgcttggtattgttagccactatttttatataataaatacataataaaaatgcataaaaatatgttttcttaatattgttgtaatgaggttgcatgtattttctagggaaagagtgttataagtgggggtttggat

SEQ ID NO: 418122 - DNA, 3667 bp, Homo sapiens
cggggcagtaggaacgccgagtcggctgccgtggctgtgctgagggtggcggccggataggtgcggagcttcctgaacgaggcaggaggggtgcgaggttcaggggcagggcccgggcagccgaagtcgttagggaggcggttacctgacggtgggcggcggacatctcgcagcagggtcgagggctgtgaaagcggtttagtgattgaagcgctacgtttgtgtgaggaattcttgtcgttgtcagcgcctgagaacttagttgggagcggacgtttacgtcgaatctctcgtttgggaccccattcttgaatgtgggaagaagggagaacgcatgtttgctcatctagagacagccgtattaataacgataggatacaaaccatcaccccaccaagtgatagcagctgttaacctgtgggcgggttacgtgccggtcactgttccaagcccctcacatatcgcgtcactgaatctttatagggacccagaactccatttgacagatgaggaaacggcgaggcagacaggtgacctgacttccccacaatcgctgcaggacaggaagaaagtaaactccagagcccgtgctcttagctactaagctgtactgctcttcattttgctgatgttctaatcatgtcagataaagatgatattgagactccactgctaactgaagcagcccccatccttgaagatggaaactgtgagccagccaagaattctgagtctgttgaccaaggtgccaaaccagagagtaaatcagaacctgtagtttccactcggaaaagaccagagaccaaaccttccagtgaccttgagacttcaaaagttctccctattcaggataatgtttccaaagatgtaccccagaccagatggggttattgggggagctggggcaagtccatactctcctcagcctcggctacagtagctacagtaggacaaggcatttcaaatgtcatcgagaaggcagagacttcccttggaatccctagtcccagtgaaatttcaactgaagtcaagtatgtagcaggagagacaaatgccaaagagaatgaaaactcctccccagtggctggggcatttggtgtattctctaccatctctactgctgttcagagcacaggaaagagtgttataagtgggggtttggatgccttagaattcattggaaaaaagacaatggatgtgatagcagaaggggatcctggatttaaaagaaccaagggtctgatgaaccgaaatgctacactatctcaggttttacgagaggcgaaggagaaagaagagatacggacctccaatgaggttaccgtggaaacagacaagaaaactcattatgggctactctttgatgaatttcaaggcctttcacatctagaagctctggagatgctttcccaagaaagtgaaataaaggtgaaatctatccttaattctctgagtggagaagaattagagactctaaaagttgaattagagcaactcaaagaaacattttctctagcagaattttgtgaagaagaggaagaagagaaaaaaggggatgaagattttaccaaggacataacagagctgttttcccagctgcacgtttcctccaaaccagagaaacttgccagggcaagaaataccgcccacgaatggatcaggaagtctctgaccaagccattagcagagaatgaagaaggagaaaaacagtcggaagcagaaaatactgagcaagtcaacaaaaattcaatagaggatatccatgcgtttgcaatccggagcctggctgaactgactgcctgctcaattgaactattccacaaaacagctgcattggttctgcatggcaggaagcaggaagtgacagccatagaaaggagccaaactctttcccagatgacaattgtgttgtgtaaagagttgtcctctctgtctaaagagttcactacctgcctaacaactgctggggtcaaagaaatggcagatgtccttaacccattaatcactgcagtatttctagaggcatcaaacagtgcctcctacatccaggacgcctttcagctactcttacctgtgctagagatctctctcattgagaacaagattgaatcacacagacatgagctgcagggccagaaacctttgttagaacattgaagaatggagatgttttgacctgggacttgtgacggccaaggaatgccaccttattctggctactcctgcagaaatgaaggagtggggttattttagtatataaaaattcaggcaggagagatggtttaaagaggaagattgttgccttcagtgtttgattgaagtattcaggttctcacagtattctttccagttgttgtaattcataaattatttgaaaagaaacttttgtagaaagtccaagaataataactctagataaagattagtgggacactcaggcaaaaatgttggtctttctttgacatgttgcaaaatgttatcaattttgtcatggatataatttgcagcccatggatataactggttgataagccagagaaaaataatttagtgttctaaaattcatggcatgtgtggtttattaatgccatgtactttctcctttctggaataaaatctatggctttaagaaaactgagcatatgtaaactctgtgatgattaccctttatcacatgaattcttggaaatagaaagtttcatctgcttttttaaattcttagtagatatttggcattgaggagaaacttgtagactattatagccatgtgaattaactgtagcaaagtgccctttttcttcaaattgctccccctccccaggatgacacacttcatgtcatagctgaaccctactctactggattcaaggccagtaaatgcaatttagagaagcagttttatgtttgcagatattctgagtctcttcaggatgtgtttcgtgtctaccatatatgcaggataaattctttaacagcaaactccaaaggaatgttgaagctgttttagcaatgaggatttttttgtttgagtgttgaagtgggccatagtcctttagaaatgatgttcatttatgataggatttaacttctaaggcatagtttattttttcctctttcctttttgtttgttttaatgtattctttagcatgtttttgatataacttttatcctccagatcttaagctttcttttgctctcttcagcaatttaagagactattaagctgtcatcttcctaaaagctattttggtatccactctttttaaaaaaattctccaactttgtgattttttaatgattaaggtaatttgttagctctgcccctcatcttctaaaacctttgtaataaaatgtattaatcatgttatttgatcctttcatttacttttgtaaacacgagccctaatatcttacttagaccaaaaaaaaaaaaaaaaaatagcaaagcaaagccataaatagattagtataaagactgtttctatgtaatcttctttggggcaggagtcagttagtaagcaaggaagagaaataaatttggtttaaaaaggtataccaacagcactacaatgttactctgcctatattctgtcttaatatgatcagaaagtttttgaatattcctttttaaagacaaatttcaccctttccagcttgaatatttct

SEQ ID NO: 418123 - DNA, 3254 bp, Homo sapiens
cggggcagtaggaacgccgagtcggctgccgtggctgtgctgagggtggcggccggatagctgatgttctaatcatgtcagataaagatgatattgagactccactgctaactgaagcagcccccatccttgaagatggaaactgtgagccagccaagaattctgagtctgttgaccaaggtgccaaaccagagagtaaatcagaacctgtagtttccactcggaaaagaccagagaccaaaccttccagtgaccttgagacttcaaaagttctccctattcaggataatgtttccaaagatgtaccccagaccagatggggttattgggggagctggggcaagtccatactctcctcagcctcggctacagtagctacagtaggacaaggcatttcaaatgtcatcgagaaggcagagacttcccttggaatccctagtcccagtgaaatttcaactgaagtcaagtatgtagcaggagagacaaatgccaaagagaatgaaaactcctccccagtggctggggcatttggtgtattctctaccatctctactgctgttcagagcacaggaaagagtgttataagtgggggtttggatgccttagaattcattggaaaaaagacaatggatgtgatagcagaaggggatcctggatttaaaagaaccaagggtctgatgaaccgaaatgctacactatctcaggttttacgagaggcgaaggagaaagaagagatacggacctccaatgaggttaccgtggaaacagacaagaaaactcattatgggctactctttgatgaatttcaaggcctttcacatctagaagctctggagatgctttcccaagaaagtgaaataaaggtgaaatctatccttaattctctgagtggagaagaattagagactctaaaagttgaattagagcaactcaaagaaacattttctctagcagaattttgtgaagaagaggaagaagagaaaaaaggggatgaagattttaccaaggacataacagagctgttttcccagctgcacgtttcctccaaaccagagaaacttgccagggcaagaaataccgcccacgaatggatcaggaagtctctgaccaagccattagcagagaatgaagaaggagaaaaacagtcggaagcagaaaatactgagcaagtcaacaaaaattcaatagaggatatccatgcgtttgcaatccggagcctggctgaactgactgcctgctcaattgaactattccacaaaacagctgcattggttctgcatggcaggaagcaggaagtgacagccatagaaaggagccaaactctttcccagatgacaattgtgttgtgtaaagagttgtcctctctgtctaaagagttcactacctgcctaacaactgctggggtcaaagaaatggcagatgtccttaacccattaatcactgcagtatttctagagaaagcatacagttgaagctgcagggtactggaagaagcagtagattgtcattacttagtactaatccttgacagcttaatggacggttcacagtaatgaaacaccttctgaataccagctggtaaacatgaagggctgaaaattataaacaggcatcaaacagtgcctcctacatccaggacgcctttcagctactcttacctgtgctagagatctctctcattgagaacaagattgaatcacacagacatgagctgcagggccagaaacctttgttagaacattgaagaatggagatgttttgacctgggacttgtgacggccaaggaatgccaccttattctggctactcctgcagaaatgaaggagtggggttattttagtatataaaaattcaggcaggagagatggtttaaagaggaagattgttgccttcagtgtttgattgaagtattcaggttctcacagtattctttccagttgttgtaattcataaattatttgaaaagaaacttttgtagaaagtccaagaataataactctagataaagattagtgggacactcaggcaaaaatgttggtctttctttgacatgttgcaaaatgttatcaattttgtcatggatataatttgcagcccatggatataactggttgataagccagagaaaaataatttagtgttctaaaattcatggcatgtgtggtttattaatgccatgtactttctcctttctggaataaaatctatggctttaagaaaactgagcatatgtaaactctgtgatgattaccctttatcacatgaattcttggaaatagaaagtttcatctgcttttttaaattcttagtagatatttggcattgaggagaaacttgtagactattatagccatgtgaattaactgtagcaaagtgccctttttcttcaaattgctccccctccccaggatgacacacttcatgtcatagctgaaccctactctactggattcaaggccagtaaatgcaatttagagaagcagttttatgtttgcagatattctgagtctcttcaggatgtgtttcgtgtctaccatatatgcaggataaattctttaacagcaaactccaaaggaatgttgaagctgttttagcaatgaggatttttttgtttgagtgttgaagtgggccatagtcctttagaaatgatgttcatttatgataggatttaacttctaaggcatagtttattttttcctctttcctttttgtttgttttaatgtattctttagcatgtttttgatataacttttatcctccagatcttaagctttcttttgctctcttcagcaatttaagagactattaagctgtcatcttcctaaaagctattttggtatccactctttttaaaaaaattctccaactttgtgattttttaatgattaaggtaatttgttagctctgcccctcatcttctaaaacctttgtaataaaatgtattaatcatgttatttgatcctttcatttacttttgtaaacacgagccctaatatcttacttagaccaaaaaaaaaaaaaaaaaatagcaaagcaaagccataaatagattagtataaagactgtttctatgtaatcttctttggggcaggagtcagttagtaagcaaggaagagaaataaatttggtttaaaaaggtataccaacagcactacaatgttactctgcctatattctgtcttaatatgatcagaaagtttttgaatattcctttttaaagacaaatttcaccctttccagcttgaatatttct

SEQ ID NO: 418124 - DNA, 1076 bp, Homo sapiens
cggggcagtaggaacgccgagtcggctgccgtggctgtgctgagggtggcggccggatagctgatgttctaatcatgtcagataaagatgatattgagactccactgctaactgaagcagcccccatccttgaagatggaaactgtgagccagccaagaattctgagtctgttgaccaaggtgccaaaccagagagtaaatcagaacctgtagtttccactcggaaaagaccagagaccaaaccttccagtgaccttgagacttcaaaagttctccctattcaggataatgtttccaaagatgtaccccagaccagatggggttattgggggagctggggcaagtccatactctcctcagcctcggctacagtagctacagtaggacaaggcatttcaaatgtcatcgagaaggcagagacttcccttggaatccctagtcccagtgaaatttcaactgaagtcaagtatgtagcaggagagacaaatgccaaagagaatgaaaactcctccccagtggctggggcatttggtgtattctctaccatctctactgctgttcagagcacaggaaagagtgttataagtgggggtttggatgccttagaattcattggaaaaaagacaatggatgtgatagcagaaggggatcctggatttaaaagaaccaagggtctgatgaaccgaaatgctacactatctcaggttttacgagaggcgaaggagaaagaagagatacggacctccaatgaggttaccgtggaaacagacaagaaaactcattatgggctactctttgatgaatttcaaggcctttcacatctagaagctctggagatgctttcccaagaaagtgaaataaaggtgaaatctatccttaattctctgagtggagaagaattagagactctaaaagttgaattagagcaactcaaagaaacattttctctagcagaattttgtgaagaagaggaagaagagaaaaaaggtaatatgaaaatttagtatctgagtggagaggatgcagtgtgtttgtatgcagtgcattgcccttgaaataaattatttactcttaaa

SEQ ID NO: 418125 - DNA, 545 bp, Homo sapiens
atctcccaaagtgctgtgattataagtgtgagccactgtgcctggcctgtaacctttgttttgacaaatggatagtattaaaggaaattttcttgatacgcagtttagtctgttcttggacaagcaatgcagtaggtttgactttgagtgctttattactaacactttctggccaggccacagttaaggtccggttggaaaacacttgttgaggtttgaattgtaacctttttactggatgatagggtattttttagcccatagataaacttgcttaaaaaaccaagaaagacactgaaatctcagtctatacatagtttcatcagtgtttattgggaactgtgttctggataaagcaatcgtatgtatacatttttattatgtaatgtataagtgatttgtaaattataaagatctcctacgatactgtggtgtcttctagatagaaaatatatctttctaaaatgtgtgcctaattctagtgtagtgtcaatttatagtacacaataaatatttaatgaataaacattattctgttgttgatt

SEQ ID NO: 418126 - DNA, 3188 bp, Homo sapiens
gaacccggtggctgcacagacaaaaaagccccgaatggctggagggcgttcagctgttaacagccttttggggcagagcacggatttgacagctccacaacgtgaggatatccactgaccccgcgagacggaggagaacgcttccccgaaattctctgcccaccaaagccagcgctgcaaggttgcaactttcaaactttgtttttccagaaagaagactgccctttcgtgtacaaggagagggtgagagggtgacctagcttgtagatcggctgaaggcaccagtggttccaaatgtcacccagatgtgtgttttcatgacgatttgatttctctgattttatttttacatttttcattttaaaaatacaaagcaatttttttggggcatgctgaaaggtaactgaagaccgcaaaggaaaaactattgtcatggctgaaggagagaatgaagtgagatgggatggactctgcagcagagattcaactactagggagacagcattggaaaacattaggcaaaccattttgaggaaaaccgagtatcttcgttcggtgaaagaaacacctcatcgtccatcagacgggctttcaaataccgagtcttcggatgggttgaataagctacttgctcatctgcttatgctttctaagaggtgtcccttcaaagatgtgagagagaaaagtgagtttattctgaagagcatccaggaacttggcattagaattcctcgaccactaggacagggaccaagcagattcatcccagaaaaggagatcctccaagtggggagtgaagacgcacagatgcatgctttatttgcagattcttttgctgctttgggccgtttggataacattacgttagtgatggttttccacccacaatatttagaaagtttcttaaaaactcagcactatctactgcaaatggatgggccgttacccctacattatcgtcactacattggaataatggctgcggcaagacatcagtgctcctacttagtgaacctgcatgtaaatgatttccttcatgttggtggggaccccaagtggctcaatggtttagagaatgctcctcaaaaactacagaatttaggagaacttaacaaagtgttagcccatagaccttggcttattaccaaagaacacattgagggacttttaaaagctgaagagcacagctggtcccttgcggaattggtacatgcagtagttttactcacacactatcattctcttgcctcattcacattcggctgtggaatcagtccagaaattcattgtgatggtggccacacattcagacctccttctgttagcaactactgcatctgtgacattacaaatggcaatcacagtgtggatgagatgccggtcaactcagcagaaaatgtttctgtaagtgattctttctttgaggttgaagccctcatggaaaagatgaggcagttacaggaatgtcgagatgaagaagaggcaagtcaggaagagatggcttcacgttttgaaatagaaaaaagagagagtatgtttgtcttctcttcagatgatgaagaagttacaccagcaagagctgtatctcgtcattttgaggatactagttatggctataaagatttctctagacatgggatgcatgttccaacatttcgtgtccaggactattgctgggaagatcatggttattctttggtaaatcgcctttatccagatgtgggacagttgattgatgaaaaatttcacattgcttacaatcttacttataatacaatggcaatgcacaaagatgttgatacctcaatgcttagacgggcaatttggaactatattcactgcatgtttggaataagatatgatgattatgactatggtgaaattaaccagctattggatcgtagctttaaagtttatatcaaaactgttgtttgcactcctgaaaaggttaccaaaagaatgtatgatagcttctggaggcagttcaagcactctgagaaggttcatgttaatctgcttcttatagaagctaggatgcaagcagaactcctttatgctctgagagccattacccgctatatgacctgatgcctttccttcattaaagatgattctggaatgatcagcagatatagtctacaagggggaaggtactaagccccaggaccaatggtagacaaaataattcagaaatccattgtgccatgattcctttagtttctgctatttttctgtggaaaaccactgctggcacaagcagtgactgtttggcagcttcaagtttagagctgtgaagacaggctgccattcacagtattttgctttttgacagtacaagatgctgtgtaactgttttaatacagcaaatagtaactctccaaatcctgttgcttttatgttaaataagataacaagaattggagcatgcaaagaatgggacttggataatgacttaagctttatatgtaaagaattttagaagatcttggtgctgctattcctgctggaggaatgaatagatggctgtttcagttaagctattagtaataaaagtgaacattgctactatctgagcctacatacataacttgtgtgatttcaaattaaacttgcattatgtgttaattttcttgcatctaaaaaagcatagaattcctactcacacagctcagcaacaaccattttgatggtaacagttaatttctttcattagttttttaaattcagggttctggatattaaattaaaatggcattcttaaagattttcttcaaaaagcaatcctaaatgaaagtgtgtaaattataagaagctggcgatcttttgatatgctgtttcacaggatcctgacactggagggcagctgtcttgtgcattacttgtgtttccagcaccaaagttgtgggacatgttgctgtagactgctgcgcagtcctgggtgcattcagtctctctgcctctgcctgcctcctggtccccactttaaaggctgtgcagctccttaaataataaagctggaaaatatttttagtcgggttatcaaatttgatttacaaaaacgctaactttgtttgaaatgcaaacaggtttgaaaatatgtattaagtactttgtattctggaagcgtgaattgcttttgaagtctgtcagtattactggtatttttaaataaagaagaatttttctcc

SEQ ID NO: 418127 - DNA, 2679 bp, Homo sapiens
cccccgccgtccgtgctgactgaggcgctgcagccaggagccgcggccggctgcccagcgctcgccgcctccgcgcgtccgcagccgtccccgcgccgacatgcgcttggccgccgccgcgaacgaggcgtacacggcccctttggcggtctcggggctgctgggctgcaagcagtgcggcgggggccgcgaccaggacgaggaacttggcattagaattcctcgaccactaggacagggaccaagcagattcatcccagaaaaggagatcctccaagtggggagtgaagacgcacagatgcatgctttatttgcagattcttttgctgctttgggccgtttggataacattacgttagtgatggttttccacccacaatatttagaaagtttcttaaaaactcagcactatctactgcaaatggatgggccgttacccctacattatcgtcactacattggaataatggctgcggcaagacatcagtgctcctacttagtgaacctgcatgtaaatgatttccttcatgttggtggggaccccaagtggctcaatggtttagagaatgctcctcaaaaactacagaatttaggagaacttaacaaagtgttagcccatagaccttggcttattaccaaagaacacattgagggacttttaaaagctgaagagcacagctggtcccttgcggaattggtacatgcagtagttttactcacacactatcattctcttgcctcattcacattcggctgtggaatcagtccagaaattcattgtgatggtggccacacattcagacctccttctgttagcaactactgcatctgtgacattacaaatggcaatcacagtgtggatgagatgccggtcaactcagcagaaaatgtttctgtaagtgattctttctttgaggttgaagccctcatggaaaagatgaggcagttacaggaatgtcgagatgaagaagaggcaagtcaggaagagatggcttcacgttttgaaatagaaaaaagagagagtatgtttgtcttctcttcagatgatgaagaagttacaccagcaagagctgtatctcgtcattttgaggatactagttatggctataaagatttctctagacatgggatgcatgttccaacatttcgtgtccaggactattgctgggaagatcatggttattctttggtaaatcgcctttatccagatgtgggacagttgattgatgaaaaatttcacattgcttacaatcttacttataatacaatggcaatgcacaaagatgttgatacctcaatgcttagacgggcaatttggaactatattcactgcatgtttggaataagatatgatgattatgactatggtgaaattaaccagctattggatcgtagctttaaagtttatatcaaaactgttgtttgcactcctgaaaaggttaccaaaagaatgtatgatagcttctggaggcagttcaagcactctgagaaggttcatgttaatctgcttcttatagaagctaggatgcaagcagaactcctttatgctctgagagccattacccgctatatgacctgatgcctttccttcattaaagatgattctggaatgatcagcagatatagtctacaagggggaaggtactaagccccaggaccaatggtagacaaaataattcagaaatccattgtgccatgattcctttagtttctgctatttttctgtggaaaaccactgctggcacaagcagtgactgtttggcagcttcaagtttagagctgtgaagacaggctgccattcacagtattttgctttttgacagtacaagatgctgtgtaactgttttaatacagcaaatagtaactctccaaatcctgttgcttttatgttaaataagataacaagaattggagcatgcaaagaatgggacttggataatgacttaagctttatatgtaaagaattttagaagatcttggtgctgctattcctgctggaggaatgaatagatggctgtttcagttaagctattagtaataaaagtgaacattgctactatctgagcctacatacataacttgtgtgatttcaaattaaacttgcattatgtgttaattttcttgcatctaaaaaagcatagaattcctactcacacagctcagcaacaaccattttgatggtaacagttaatttctttcattagttttttaaattcagggttctggatattaaattaaaatggcattcttaaagattttcttcaaaaagcaatcctaaatgaaagtgtgtaaattataagaagctggcgatcttttgatatgctgtttcacaggatcctgacactggagggcagctgtcttgtgcattacttgtgtttccagcaccaaagttgtgggacatgttgctgtagactgctgcgcagtcctgggtgcattcagtctctctgcctctgcctgcctcctggtccccactttaaaggctgtgcagctccttaaataataaagctggaaaatatttttagtcgggttatcaaatttgatttacaaaaacgctaactttgtttgaaatgcaaacaggtttgaaaatatgtattaagtactttgtattctggaagcgtgaattgcttttgaagtctgtcagtattactggtatttttaaataaagaagaatttttctcc

SEQ ID NO: 418128 - DNA, 2875 bp, Homo sapiens
gagacctgcgcaccgtgagtcgtccctgggcagaaaatgctaagctgggagagactgcggccgcggtcatgtaaatgaaagtctccaatacgtaaataacattgtcgtctggacaagtctccacaagtcagaaatccagcagacctcgagtcttgagggtgaaacagcctgtggatatgccccctcgattgtcttgtcttgtgaaaacagattatttagccaccttcatcccctttgcctcctacttaaaagagagagaaagaaaaaaaacacatttgactcagggaagagatgatgttgcctggaataagtgtgtcctgcaagctctatgacgttatgcacagcgtttactcttgcgtattaagccatcccttttctgaattgtcctttagaaagaggaacttggcattagaattcctcgaccactaggacagggaccaagcagattcatcccagaaaaggagatcctccaagtggggagtgaagacgcacagatgcatgctttatttgcagattcttttgctgctttgggccgtttggataacattacgttagtgatggttttccacccacaatatttagaaagtttcttaaaaactcagcactatctactgcaaatggatgggccgttacccctacattatcgtcactacattggaataatggctgcggcaagacatcagtgctcctacttagtgaacctgcatgtaaatgatttccttcatgttggtggggaccccaagtggctcaatggtttagagaatgctcctcaaaaactacagaatttaggagaacttaacaaagtgttagcccatagaccttggcttattaccaaagaacacattgagggacttttaaaagctgaagagcacagctggtcccttgcggaattggtacatgcagtagttttactcacacactatcattctcttgcctcattcacattcggctgtggaatcagtccagaaattcattgtgatggtggccacacattcagacctccttctgttagcaactactgcatctgtgacattacaaatggcaatcacagtgtggatgagatgccggtcaactcagcagaaaatgtttctgtaagtgattctttctttgaggttgaagccctcatggaaaagatgaggcagttacaggaatgtcgagatgaagaagaggcaagtcaggaagagatggcttcacgttttgaaatagaaaaaagagagagtatgtttgtcttctcttcagatgatgaagaagttacaccagcaagagctgtatctcgtcattttgaggatactagttatggctataaagatttctctagacatgggatgcatgttccaacatttcgtgtccaggactattgctgggaagatcatggttattctttggtaaatcgcctttatccagatgtgggacagttgattgatgaaaaatttcacattgcttacaatcttacttataatacaatggcaatgcacaaagatgttgatacctcaatgcttagacgggcaatttggaactatattcactgcatgtttggaataagatatgatgattatgactatggtgaaattaaccagctattggatcgtagctttaaagtttatatcaaaactgttgtttgcactcctgaaaaggttaccaaaagaatgtatgatagcttctggaggcagttcaagcactctgagaaggttcatgttaatctgcttcttatagaagctaggatgcaagcagaactcctttatgctctgagagccattacccgctatatgacctgatgcctttccttcattaaagatgattctggaatgatcagcagatatagtctacaagggggaaggtactaagccccaggaccaatggtagacaaaataattcagaaatccattgtgccatgattcctttagtttctgctatttttctgtggaaaaccactgctggcacaagcagtgactgtttggcagcttcaagtttagagctgtgaagacaggctgccattcacagtattttgctttttgacagtacaagatgctgtgtaactgttttaatacagcaaatagtaactctccaaatcctgttgcttttatgttaaataagataacaagaattggagcatgcaaagaatgggacttggataatgacttaagctttatatgtaaagaattttagaagatcttggtgctgctattcctgctggaggaatgaatagatggctgtttcagttaagctattagtaataaaagtgaacattgctactatctgagcctacatacataacttgtgtgatttcaaattaaacttgcattatgtgttaattttcttgcatctaaaaaagcatagaattcctactcacacagctcagcaacaaccattttgatggtaacagttaatttctttcattagttttttaaattcagggttctggatattaaattaaaatggcattcttaaagattttcttcaaaaagcaatcctaaatgaaagtgtgtaaattataagaagctggcgatcttttgatatgctgtttcacaggatcctgacactggagggcagctgtcttgtgcattacttgtgtttccagcaccaaagttgtgggacatgttgctgtagactgctgcgcagtcctgggtgcattcagtctctctgcctctgcctgcctcctggtccccactttaaaggctgtgcagctccttaaataataaagctggaaaatatttttagtcgggttatcaaatttgatttacaaaaacgctaactttgtttgaaatgcaaacaggtttgaaaatatgtattaagtactttgtattctggaagcgtgaattgcttttgaagtctgtcagtattactggtatttttaaataaagaagaatttttctcc

SEQ ID NO: 418129 - DNA, 1345 bp, Homo sapiens
gagacctgcgcaccgtgagtcgtccctgggcagaaaatgctaagctgggagagactgcggccgcggtcatgtaaatgaaagtctccaatacgtaaataacattgtcgtctggacaagtctccacaagtcagaaatccagcagacctcgagtcttgagggtgaaacagcctgtggatatgccccctcgattgtcttgtcttgtgaaaacagattatttagccaccttcatcccctttgcctcctacttaaaagagagagaaagaaaaaaaacacatttgactcagggaagagatgatgttgcctggaataagtgtgtcctgcaagctctatgacgttatgcacagcgtttactcttgcgtattaagccatcccttttctgaattgtcctttagaaagaggtacttaattgtaacattttgtgtttttttctaagtggttgcaaataggaaaccatttgaaagttactaatgtaaccttaggtaaaactcgaaccttaaatttggattgaaatcaggtgctgtcagagtgttgccttagttcaagaaatctaaatgtgaattattttttctgcagctttactcactaaaatgacgtggtttcgtgatttctttaatggagtctattatcagtatactatgtatattcatagaaacttaaatgaagacactttgtcatgaaggttgtaaagcaccaaatatttttttgagattttaacatttatggacatattagatgttccttgtttacagataataaaacaatctttaaaaatctcttacagtatcgctttggaaactttaccaaaaagtgaaaacagtatgaaagtattgaattaacatttacagtttctgtttgcgggtcataatagatcttttctctttttgagtagaagtgagccccaatcatcatgcttgaatagatctgttatttctgctgatgtttgtgtgcagagtcctggttcttgctcagatctagaatttctaaagatagctttgtaaactaaaagataaagaaatagattttggcttgcatattgttacagcgcttatgggattgtgttgaggaaaccgggaagctttgtatagttgtatttcatttttaatacatcccaacatgtgagaagataacttaggaaggaatgctttataggaaaactattcactttacaaaaagaataacacaattctttcaaatagctagcttccataatgcttttaaattaaacactttcaagaaacggaactcctgagcaaagtatagggcacaaatatggcctaagtattacaaatgcagtaacttaaagtcagtaagttttttttctaaaatatagttcatagaaggcaaa

SEQ ID NO: 418130 - DNA, 2821 bp, Homo sapiens
gagacctgcgcaccgtgagtcgtccctgggcagaaaatgctaagctgggagagactgcggccgcggtcatgtaaatgaaagtctccaatacgtaaataacattgtcgtctggacaagtctccacaagtcagaaatccagcagacctcgagtcttgagggtgaaacagcctgtggatatgccccctcgattgtcttgtcttgtgaaaacagattatttagccaccttcatcccctttgcctcctacttaaaagagagagaaagaaaacaagctctatgacgttatgcacagcgtttactcttgcgtattaagccatcccttttctgaattgtcctttagaaagaggaacttggcattagaattcctcgaccactaggacagggaccaagcagattcatcccagaaaaggagatcctccaagtggggagtgaagacgcacagatgcatgctttatttgcagattcttttgctgctttgggccgtttggataacattacgttagtgatggttttccacccacaatatttagaaagtttcttaaaaactcagcactatctactgcaaatggatgggccgttacccctacattatcgtcactacattggaataatggctgcggcaagacatcagtgctcctacttagtgaacctgcatgtaaatgatttccttcatgttggtggggaccccaagtggctcaatggtttagagaatgctcctcaaaaactacagaatttaggagaacttaacaaagtgttagcccatagaccttggcttattaccaaagaacacattgagggacttttaaaagctgaagagcacagctggtcccttgcggaattggtacatgcagtagttttactcacacactatcattctcttgcctcattcacattcggctgtggaatcagtccagaaattcattgtgatggtggccacacattcagacctccttctgttagcaactactgcatctgtgacattacaaatggcaatcacagtgtggatgagatgccggtcaactcagcagaaaatgtttctgtaagtgattctttctttgaggttgaagccctcatggaaaagatgaggcagttacaggaatgtcgagatgaagaagaggcaagtcaggaagagatggcttcacgttttgaaatagaaaaaagagagagtatgtttgtcttctcttcagatgatgaagaagttacaccagcaagagctgtatctcgtcattttgaggatactagttatggctataaagatttctctagacatgggatgcatgttccaacatttcgtgtccaggactattgctgggaagatcatggttattctttggtaaatcgcctttatccagatgtgggacagttgattgatgaaaaatttcacattgcttacaatcttacttataatacaatggcaatgcacaaagatgttgatacctcaatgcttagacgggcaatttggaactatattcactgcatgtttggaataagatatgatgattatgactatggtgaaattaaccagctattggatcgtagctttaaagtttatatcaaaactgttgtttgcactcctgaaaaggttaccaaaagaatgtatgatagcttctggaggcagttcaagcactctgagaaggttcatgttaatctgcttcttatagaagctaggatgcaagcagaactcctttatgctctgagagccattacccgctatatgacctgatgcctttccttcattaaagatgattctggaatgatcagcagatatagtctacaagggggaaggtactaagccccaggaccaatggtagacaaaataattcagaaatccattgtgccatgattcctttagtttctgctatttttctgtggaaaaccactgctggcacaagcagtgactgtttggcagcttcaagtttagagctgtgaagacaggctgccattcacagtattttgctttttgacagtacaagatgctgtgtaactgttttaatacagcaaatagtaactctccaaatcctgttgcttttatgttaaataagataacaagaattggagcatgcaaagaatgggacttggataatgacttaagctttatatgtaaagaattttagaagatcttggtgctgctattcctgctggaggaatgaatagatggctgtttcagttaagctattagtaataaaagtgaacattgctactatctgagcctacatacataacttgtgtgatttcaaattaaacttgcattatgtgttaattttcttgcatctaaaaaagcatagaattcctactcacacagctcagcaacaaccattttgatggtaacagttaatttctttcattagttttttaaattcagggttctggatattaaattaaaatggcattcttaaagattttcttcaaaaagcaatcctaaatgaaagtgtgtaaattataagaagctggcgatcttttgatatgctgtttcacaggatcctgacactggagggcagctgtcttgtgcattacttgtgtttccagcaccaaagttgtgggacatgttgctgtagactgctgcgcagtcctgggtgcattcagtctctctgcctctgcctgcctcctggtccccactttaaaggctgtgcagctccttaaataataaagctggaaaatatttttagtcgggttatcaaatttgatttacaaaaacgctaactttgtttgaaatgcaaacaggtttgaaaatatgtattaagtactttgtattctggaagcgtgaattgcttttgaagtctgtcagtattactggtatttttaaataaagaagaatttttctcc

SEQ ID NO: 418131 - DNA, 2252 bp, Homo sapiens
tttaattaaaaattcacaaaatttggccagatctggtggctcccacgtgtaatcccagcactttgagagaccaagatgggaaaatcactgaggccaagcattcaagactagcatgggcagcaaaacaagaccctatctctacaaataattttaaaagtagccaagcaaggtggcctgtgcctatagttccagttactcaggaggctgaggcagggaggatcgcttgagcccagcagttggagactgcagtgagctgtgatcataccattgtactctagcctggacaacatagtgagaccttgtctcttaaaacacacacacacacacacacactcataatttgaagaccactttgaatggctgcagcaatggaaaaggagaggggactcccaagctggtcacatctggggggctgagtggagagagagtgaaagacataaaggccaatgtgtaaggggaagagactattagtttttttttgttgttgttgttctttttgagatgagactattagtttttaaactcactgagttataaaacacaaccttttgcatgttgcagtatgggaattgaaaaaaagattggagtgtaagtgaagctgggagttagggataaaagccagttggattgtcagccaaatgacaatgatttttaccatgctacagagctatagatatagaactgtacttgaccacatttattcacatttgttctattccctgtatttaggactattgctgggaagatcatggttattctttggtaaatcgcctttatccagatgtgggacagttgattgatgaaaaatttcacattgcttacaatcttacttataatacaatggcaatgcacaaagatgttgatacctcaatgcttagacgggcaatttggaactatattcactgcatgtttggaataagatatgatgattatgactatggtgaaattaaccagctattggatcgtagctttaaagtttatatcaaaactgttgtttgcactcctgaaaaggttaccaaaagaatgtatgatagcttctggaggcagttcaagcactctgagaaggttcatgttaatctgcttcttatagaagctaggatgcaagcagaactcctttatgctctgagagccattacccgctatatgacctgatgcctttccttcattaaagatgattctggaatgatcagcagatatagtctacaagggggaaggtactaagccccaggaccaatggtagacaaaataattcagaaatccattgtgccatgattcctttagtttctgctatttttctgtggaaaaccactgctggcacaagcagtgactgtttggcagcttcaagtttagagctgtgaagacaggctgccattcacagtattttgctttttgacagtacaagatgctgtgtaactgttttaatacagcaaatagtaactctccaaatcctgttgcttttatgttaaataagataacaagaattggagcatgcaaagaatgggacttggataatgacttaagctttatatgtaaagaattttagaagatcttggtgctgctattcctgctggaggaatgaatagatggctgtttcagttaagctattagtaataaaagtgaacattgctactatctgagcctacatacataacttgtgtgatttcaaattaaacttgcattatgtgttaattttcttgcatctaaaaaagcatagaattcctactcacacagctcagcaacaaccattttgatggtaacagttaatttctttcattagttttttaaattcagggttctggatattaaattaaaatggcattcttaaagattttcttcaaaaagcaatcctaaatgaaagtgtgtaaattataagaagctggcgatcttttgatatgctgtttcacaggatcctgacactggagggcagctgtcttgtgcattacttgtgtttccagcaccaaagttgtgggacatgttgctgtagactgctgcgcagtcctgggtgcattcagtctctctgcctctgcctgcctcctggtccccactttaaaggctgtgcagctccttaaataataaagctggaaaatatttttagtcgggttatcaaatttgatttacaaaaacgctaactttgtttgaaatgcaaacaggtttgaaaatatgtattaagtactttgtattctggaagcgtgaattgcttttgaagtctgtcagtattactggtatttttaaataaagaagaatttttctcc

SEQ ID NO: 418132 - DNA, 1275 bp, Homo sapiens
cttattttatgtgttcattagattcactgaaaaactgattgtgaatgcttgtaacccttccttatatgatgttgtattttatattcaggttcatgttaatctgcttcttatagaagctaggatgcaagcagaactcctttatgctctgagagccattacccgctatatgacctgatgcctttccttcattaaagatgattctggaatgatcagcagatatagtctacaagggggaaggtactaagccccaggaccaatggtagacaaaataattcagaaatccattgtgccatgattcctttagtttctgctatttttctgtggaaaaccactgctggcacaagcagtgactgtttggcagcttcaagtttagagctgtgaagacaggctgccattcacagtattttgctttttgacagtacaagatgctgtgtaactgttttaatacagcaaatagtaactctccaaatcctgttgcttttatgttaaataagataacaagaattggagcatgcaaagaatgggacttggataatgacttaagctttatatgtaaagaattttagaagatcttggtgctgctattcctgctggaggaatgaatagatggctgtttcagttaagctattagtaataaaagtgaacattgctactatctgagcctacatacataacttgtgtgatttcaaattaaacttgcattatgtgttaattttcttgcatctaaaaaagcatagaattcctactcacacagctcagcaacaaccattttgatggtaacagttaatttctttcattagttttttaaattcagggttctggatattaaattaaaatggcattcttaaagattttcttcaaaaagcaatcctaaatgaaagtgtgtaaattataagaagctggcgatcttttgatatgctgtttcacaggatcctgacactggagggcagctgtcttgtgcattacttgtgtttccagcaccaaagttgtgggacatgttgctgtagactgctgcgcagtcctgggtgcattcagtctctctgcctctgcctgcctcctggtccccactttaaaggctgtgcagctccttaaataataaagctggaaaatatttttagtcgggttatcaaatttgatttacaaaaacgctaactttgtttgaaatgcaaacaggtttgaaaatatgtattaagtactttgtattctggaagcgtgaattgcttttgaagtctgtcagtattactggtatttttaaataaagaagaatttttctcc

SEQ ID NO: 418133 - DNA, 1158 bp, Homo sapiens
gatatagtctacaagggggaaggtactaagccccaggacaatggtagacaatatctgctgatcattccagaatcatctttaatgaaggaaaggcatcagatatagtctacaagggggaaggtactaagccccaggaccaatggtagacaaaataattcagaaatccattgtgccatgattcctttagtttctgctatttttctgtggaaaaccactgctggcacaagcagtgactgtttggcagcttcaagtttagagctgtgaagacaggctgccattcacagtattttgctttttgacagtacaagatgctgtgtaactgttttaatacagcaaatagtaactctccaaatcctgttgcttttatgttaaataagataacaagaattggagcatgcaaagaatgggacttggataatgacttaagctttatatgtaaagaattttagaagatcttggtgctgctattcctgctggaggaatgaatagatggctgtttcagttaagctattagtaataaaagtgaacattgctactatctgagcctacatacataacttgtgtgatttcaaattaaacttgcattatgtgttaattttcttgcatctaaaaaagcatagaattcctactcacacagctcagcaacaaccattttgatggtaacagttaatttctttcattagttttttaaattcagggttctggatattaaattaaaatggcattcttaaagattttcttcaaaaagcaatcctaaatgaaagtgtgtaaattataagaagctggcgatcttttgatatgctgtttcacaggatcctgacactggagggcagctgtcttgtgcattacttgtgtttccagcaccaaagttgtgggacatgttgctgtagactgctgcgcagtcctgggtgcattcagtctctctgcctctgcctgcctcctggtccccactttaaaggctgtgcagctccttaaataataaagctggaaaatatttttagtcgggttatcaaatttgatttacaaaaacgctaactttgtttgaaatgcaaacaggtttgaaaatatgtattaagtactttgtattctggaagcgtgaattgcttttgaagtctgtcagtattactggtatttttaaataaagaagaatttttctcc

SEQ ID NO: 418134 - DNA, 1868 bp, Homo sapiens
cccccgccgtccgtgctgactgaggcgctgcagccaggagccgcggccggctgcccagcgctcgccgcctccgcgcgtccgcagccgtccccgcgccgacatgcgcttggccgccgccgcgaacgaggcgtacacggcccctttggcggtctcggggctgctgggctgcaagcagtgcggcgggggccgcgaccaggacgaggaacttggcattagaattcctcgaccactaggacagggaccaagcagattcatcccagaaaaggagatcctccaagtggggagtgaagacgcacagatgcatgctttatttgcagattcttttgctgctttgggccgtttggataacattacgttagtgatggttttccacccacaatatttagaaagtttcttaaaaactcagcactatctactgcaaatggatgggccgttacccctacattatcgtcactacattggaataatggctgcggcaagacatcagtgctcctacttagtgaacctgcatgtaaatgatttccttcatgttggtggggaccccaagtggctcaatggtttagagaatgctcctcaaaaactacagaatttaggagaacttaacaaagtgttagcccatagaccttggcttattaccaaagaacacattgagggacttttaaaagctgaagagcacagctggtcccttgcggaattggtacatgcagtagttttactcacacactatcattctcttgcctcattcacattcggctgtggaatcagtccagaaattcattgtgatggtggccacacattcagacctccttctgttagcaactactgcatctgtgacattacaaatggcaatcacagtgtggatgagatgccggtcaactcagcagaaaatgtttctgtaagtgattctttctttgaggttgaagccctcatggaaaagatgaggcagttacaggaatgtcgagatgaagaagaggcaagtcaggaagagatggcttcacgttttgaaatagaaaaaagagagagtatgtttgtcttctcttcagatgatgaagaagttacaccagcaagagctgtatctcgtcattttgaggatactagttatggctataaagatttctctagacatgggatgcatgttccaacatttcgtgtccaggactattgctgggaagatcatggttattctttggtaaatcgcctttatccagatgtgggacagttgattgatgaaaaatttcacattgcttacaatcttacttataatacaatggcaatgcacaaagatgttgatacctcaatgcttagacgggcaatttggaactatattcactgcatgtttggaataagatatgatgattatgactatggtgaaattaaccagctattggatcgtagctttaaagtttatatcaaaactgttgtttgcactcctgaaaaggttaccaaaagaatgtatgatagcttctggaggcagttcaagcactctgagaaggtatgtgcctattgtggcttatttactttgtaacttagcaatgattcgtagtctccttcacctaacctaatggtgctgaaaccctttccatcacccctaccaacccaaagaaaaacattccaggacagctgtctcaggtaccccttcagaagggaacctgattatgttgatagagtaaaagaataaagacagggaacacaggtgggctggcccgtcttcagaagtgctggcatggctgtcagcacatagaagactgttttataaaagctgtgtataggtagaagtgtctgttctctttgaaacatctttatagaaattactgaataatgatttggcaggggaagttgctattctgataaaacagtgtctagatttt

SEQ ID NO: 418135 - DNA, 434 bp, Homo sapiens
atgtcgagatgaagaagaggcaagtcaggaagagatggcttcacgttttgaaatagaaaaaagagagagtatgtttgtcttctcttcaggtaagaacaaccattatatagtcaatataattattgcaaactcaactttttatttagagaatttaaataacttttaaagcatcaatctaaatatgtccttccttttagagagactattgcataggtattcctatttacaaataatttttaaagcaagcaactaagaaaaggtcataagtgaaaacatcctagactaagggggaggacatttaatttggattctggcactaaaattacttctaataagctttgtgaacttggcttagtcacttaacatatgagtgccctcttttttctctttttttttttttttttttttttaagaaacagggtcttgctttgttg

SEQ ID NO: 418136 - DNA, 918 bp, Homo sapiens
gaacccggtggctgcacagacaaaaaagccccgaatggctggagggcgttcagctgttaacagccttttggggcagagcacggatttgacagctccacaacgtgaggatatccactgaccccgcgagacggaggagaacgcttccccgaaattctctgcccaccaaagccagcgctgcaaggttgcaactttcaaactttgtttttccagaaagaagactgccctttcgtgtacaaggagagggtgagagggtgacctagcttgtagatcggctgaaggcaccagtggttccaaatgtcacccagatgtgtgttttcatgacgatttgatttctctgattttatttttacatttttcattttaaaaatacaaagcaatttttttggggcatgctgaaaggtaactgaagaccgcaaaggaaaaactattgtcatggctgaaggagagaatgaagtgagatgggatggactctgcagcagagattcaactactagggagacagcattggaaaacattaggcaaaccattttgaggaaaaccgagtatcttcgttcggtgaaagaaacacctcatcgtccatcagacgggctttcaaataccgagtcttcggatgggttgaataagctacttgctcatctgcttatgctttctaagaggtgtcccttcaaagatgtgagagagaaaagtgagtttattctgaagagcatccagtgtactcaaagtgaagaccgtaagaatgaagatcttcatgattatccacgtccacttaatgaatgcatagcaaatgatgtctccattcctacagcatgctattccaggcaccatgtgcagacatgactatctgcagctaagaagaaaagagtttcttcccacgtctctctctcggggaagaaaacctttcccagaaaccctctagca

SEQ ID NO: 418137 - DNA, 2814 bp, Homo sapiens
cccccgccgtccgtgctgactgaggcgctgcagccaggagccgcggccggctgcccagcgctcgccgcctccgcgcgtccgcagccgtccccgcgccgacatgcgcttggccgccgccgcgaacgaggcgtacacggcccctttggcggtctcggggctgctgggctgcaagcagtgcggcgggggccgcgaccaggacgaggaacttggcattagaattcctcgaccactaggacagggaccaagcagattcatcccagaaaaggagatcctccaagtggggagtgaagacgcacagatgcatgctttatttgcagattcttttgctgctttgggccgtttggataacattacgttagtgatggttttccacccacaatatttagaaagtttcttaaaaactcagcactatctactgcaaatggatgggccgttacccctacattatcgtcactacattggaataatggctgcggcaagacatcagtgctcctacttagtgaacctgcatgtaaatgatttccttcatgttggtggggaccccaagtggctcaatggtttagagaatgctcctcaaaaactacagaatttaggagaacttaacaaagtgttagcccatagaccttggcttattaccaaagaacacattgagggacttttaaaagctgaagagcacagctggtcccttgcggaattggtacatgcagtagttttactcacacactatcattctcttgcctcattcacattcggctgtggaatcagtccagaaattcattgtgatggtggccacacattcagacctccttctgttagcaactactgcatctgtgacattacaaatggcaatcacagtgtggatgagatgccggtcaactcagcagaaaatgtttctgtaagtgattctttctttgaggttgaagccctcatggaaaagatgaggcagttacaggaatgtcgagatgaagaagaggcaagtcaggaagagatggcttcacgttttgaaatagaaaaaagagagagtatgtttgtcttctcttcagatgatgaagaagttacaccagcaagagctgtatctcgtcattttgaggatactagttatggctataaagatttctctagacatgggatgcatgttccaacatttcgtgtccaggactattgctgggaagatcatggttattctttggtaaatcgcctttatccagatgtgggacagttgattgatgaaaaatttcacattgcttacaatcttacttataatacaatggcaatgcacaaagatgttgatacctcaatgcttagacgggcaatttggaactatattcactgcatgtttggaataagatatgatgattatgactatggtgaaattaaccagctattggatcgtagctttaaagtttatatcaaaactgttgtttgcactcctgaaaaggttaccaaaagaatgtatgatagcttctggaggcagttcaagcactctgagaaggttcatgttaatctgcttcttatagaagctaggatgcaagcagaactcctttatgctctgagagccattacccgctatatgacctgatgcctttccttcattaaagatgattctggaatgatcagcagatatagtctacaagggggaaggtactaagccccaggaccaatggtagacaaaataattcagaaatccattgtgccatgattcctttagtttctgctatttttctgtggaaaaccactgctggcacaagcagtgactgtttggcagcttcaagtttagagctgtgaagacaggctgccattcacagtattttgctttttgacagtacaagatgctgtgtaactgttttaatacagcaaatagtaactctccaaatcctgttgcttttatgttaaataagataacaagaattggagcatgcaaagaatgggacttggataatgacttaagctttatatgtaaagaattttagaagatcttggtgctgctattcctgctggaggaatgaatagatggctgtttcagttaagctattagtaataaaagtgaacattgctactatctgagcctacatacataacttgtgtgatttcaaattaaacttgcattatgtgttaattttcttgcatctaaaaaagcatagaattcctactcacacagctcagcaacaaccattttgatggtaacagttaatttctttcattagttttttaaattcagggttctggatattaaattaaaatggcattcttaaagattttcttcaaaaagcaatcctaaatgaaagtgtgtaaattataagaagctggcgatcttttgatatgctgtttcacaggatcctgacactggagggcagctgtcttgtgcattacttgtgtttccagcaccaaagttgtgggacatgttgctgtagactgctgcgcagtcctgggtgcattcagtctctctgcctctgcctgcctcctggtccccactttaaaggctgtgcagctccttaaataataaagctggaaaatatttttagtcgggttatcaaatttgatttacaaaaacgctaactttgtttgaaatgcaaacaggtttgaaaatatgtattaagtactttgtattctggaagcgtgaattgcttttgaagtctgtcagtattactggtatttttaaataaagaagaatttttctcccaaaaaaaaaacaaccaccacaccacaacaccaaaacacacaccaaagtcaaaccacaagaaaagcgcatacccacaccacaacaacaccccaacagcgcgcaccacacacccaacaccccccccactaagagaa

SEQ ID NO: 418138 - DNA, 872 bp, Homo sapiens
  misc_feature (750)..(750): n is a, c, g, or t
  misc_feature (779)..(779): n is a, c, g, or t
  misc_feature (807)..(807): n is a, c, g, or t
  misc_feature (860)..(860): n is a, c, g, or t
cccacggatcatcagaaggcgcggacctggaggaggcgccccagaaggcgacgcctcttgcctcctgtctctcgcctctcgaaggaagtttgctcttaatttcagagccgggttcgccgtcggatcaacctccaggagctagcagcgggcgcggaccgggcagtttccgcgctcagcacaggcagctcgcggtcatgggcggctcagcctccagccagctggacgagggcaagtgcgcttacatccgagggaaaactgaggctgccatcaaaaacttcagtccctactacagtcgtcagtactctgtggctttctgcaatcacgtgcgcactgaagtagaacagcaaagagatttaacgtcacagtttttgaagaccaagccaccattggcgcctggaactattttgtatgaagcagagctatcacaattttctgaagacataaagaagtggaaggagagatacgttgtagttaaaaatgattatgctgtggagagctatgagaataaagaggcctatcagagaggagctgctcctaaatgtcgaattcttccagccggtggcaaggtgttaacctcagaagatgaatataatctgttgtctgacaggcatttcccagaccctcttgcctccagtgagaaggagaacactcagccctttgtggtcctgcccaaggaattcccagtgtacctgtggcagcccttcttcagacacggctacttctgcttccacgaggctgctgaccagaaanaaagttttaattggccctccttggaattngacttgccgttcagggcattctccaatncattgaaattaccttgaaaagccagaatgaacatttttggaaagccccaaagnccctttttttaa

SEQ ID NO: 418139 - DNA, 579 bp, Homo sapiens
  misc_feature (543)..(543): n is a, c, g, or t
cccacggatcatcagaaggcgcggacctggaggaggcgccccagaaggcgacgcctcttgcctcctgtctctcgcctctcgaaggaagtttgctcttaatttcagagccgggttcgccgtcggatcaacctccaggagctagcagcgggcgcggaccgggcagtttccgcgctcagcacaggcagctcgcggtcatgggcggctcagcctccagccagctggacgagggcaagtgcgcttacatccgagggaaaactgaggctgccatcaaaaacttcagtccctactacagtcgtcagtactctgtggctttctgcaatcacgtgcgcactgaagtagaacagcaaagagatttaacgtcacagtttttgaagaccaagccaccattggcgcctggaactattttgtatgaagcagagctatcacaattttctgaagacataaagaagtggaaggagagatacgttgtagttaaaaatgattatgctgtggagagctatgagaataaagagggcctatcagaggagggagctgcccttcagngggagttaaaggggccaattttggtgaagtctttct

SEQ ID NO: 418140 - DNA, 6451 bp, Homo sapiens
cccacggatcatcagaaggcgcggacctggaggaggcgccccagaaggcgacgcctcttgcctcctgtctctcgcctctcgaaggaagtttgctcttaatttcagagccgggttcgccgtcggatcaacctccaggagctagcagcgggcgcggaccgggcagtttccgcgctcagcacaggcagctcgcggtcatgggcggctcagcctccagccagctggacgagggcaagtgcgcttacatccgagggaaaactgaggctgccatcaaaaacttcagtccctactacagtcgtcagtactctgtggctttctgcaatcacgtgcgcactgaagtagaacagcaaagagatttaacgtcacagtttttgaagaccaagccaccattggcgcctggaactattttgtatgaagcagagctatcacaattttctgaagacataaagaagtggaaggagagatacgttgtagttaaaaatgattatgctgtggagagctatgagaataaagaggcctatcagagaggagctgctcctaaatgtcgaattcttccagccggtggcaaggtgttaacctcagaagatgaatataatctgttgtctgacaggcatttcccagaccctcttgcctccagtgagaaggagaacactcagccctttgtggtcctgcccaaggaattcccagtgtacctgtggcagcccttcttcagacacggctacttctgcttccacgaggctgctgaccagaagaggtttagtgccctcctgagtgactgcgtcaggcatctcaatcatgattacatgaagcagatgacatttgaagcccaagcctttttagaagctgtgcaattcttccgacaggagaagggtcactatggttcctgggaaatgatcactggggatgaaatccagatcctgagtaacctggtgatggaggagctcctgcccactcttcagacagacctgctgcctaagatgaaggggaagaagaatgacagaaagaggacgtggcttggtctcctcgaggaggcctacaccctggttcagcatcaagtttcagaaggattaagtgccttgaaggaggaatgcagagctctgacaaagggcctggaaggaacgatccgttctgacatggatcagattgtgaactcaaagaactatttaattggaaagatcaaagcgatggtggcccagccggcggagaaaagctgcttggagagtgtgcagccattcctggcatccatcctggaggagctcatgggaccagtgagctcgggattcagtgaagtacgtgtactctttgagaaagaggtgaatgaagtcagccagaacttccagaccaccaaagacagtgtccagctaaaggagcatctagaccggcttatgaatcttccgctgcattccgtgaagatggaaccttgttatactaaagtcaacctgcttcacgagcgcctgcaggatctcaagagccgcttcagattcccccacattgatctggtggttcagaggacacagaactacatgcaggagctaatggagaatgcagtgttcacttttgagcagttgctttccccacatctccaaggagaggcctccaaaactgcagttgccattgagaaggttaaactccgagtcttaaagcaatatgattatgacagcagcaccatccgaaagaagatatttcaagaggcactagttcaaatcacacttcccactgtgcagaaggcactggcgtccacatgcaaaccagagcttcagaaatacgagcagttcatctttgcagatcataccaatatgattcacgttgaaaatgtctatgaggagattttacatcagatcctgcttgatgaaactctgaaagtgataaaggaagctgctatcttgaagaaacacaacttatttgaagataacatggccttgcccagtgaaagtgtgtccagcttaacagatctaaagccccccacagggtcaaaccaggccagccctgccaggagagcttctgccattctgccaggagttctgggtagtgagaccctcagtaacgaagtattccaggagtcagaggaagagaagcagcctgaggtccctagctcgttggccaaaggagaaagcctttctctccctgggccaagcccacccccagatgggactgagcaggtgattatttcaagagtggatgaccccgtggtgaatcctgtggcaacagaggacacagcaggactcccgggcacatgctcatcagagctggagtttggagggacccttgaggatgaagaacccgcccaggaagagccagaacccatcactgcctcgggttctttgaaggcgctcagaaagttgctgacagcgtccgtggaagtaccagtggactctgctccagtgatggaagaagatacgaatggggagagccacgttccccaagaaaatgaagaagaagaggaaaaagagcccagtcaggcagctgccatccaccccgacaactgtgaagaaagtgaagtcagcgagagggaggcccaacctccctgtcccgaggcccatggggaggagttggggggatttccagaggtaggcagcccagcctctccgccagccagtggagggctcaccgaggagcccctggggcccatggagggggagctcccaggagaggcctgcacactcactgcccatgaaggaagagggggcaagtgtaccgaggaaggggatgcctcacagcaagagggctgcaccttaggttctgaccccatctgcctcagtgagagccaggtttctgaggaacaagaagagatgggagggcaaagcagcgcggcccaggccacggccagtgtgaatgcagaggagatcaaggtagcccgtattcatgagtgtcagtgggtggtggaggatgctccaaacccggatgtcctgctgtcacacaaagatgacgtgaaggagggagaaggtggtcaggagagtttcccagagctgccctcagaggagtgaaagggacaatttggctgaagtctttctctgaaaaaagccaaagggttataggggtacacttaggggttgcatgcaagctgttaccaaaaaatttttaagtattttcttaatttgaataataaaaccagaggaaatgcatacagggcatgagcaactgaggcaaacctttgtggacatgaattgttctacgatgaatttttgctttagtattttaataagaattacaaagacaatggcatacttggggtgagagggagctgaggatgtctgaggagggaatagtattgcagggaagactgagaaaacagtaggatgacagttttgagtatactctgcacttttcaattgtgcaatcttcttgtgcactttaaggctttttaattttgtttgagaatgcaaatgtatactgtaagtctacctttactatctactatgcctacttcaccatctcttaaggactcggcatttgtccacagtcagactgcaagagagggtaggtcatgaacagtcacccgtgctggctgtagcccccacagaggcaatcatgcccaatagattcaagagaagctaagcggaaatggagggtggaaggtgtgatctgtgggactgtctgggcctgttactcatcctgctatcaatttcttattaattaatcttgatgattcttattaattaatcacatttgcaggaaattcagatgaggcaagaaaattttattggcctgggtaagactgaaagcattccaaattaggcttagactgtgcaaagggcttagctaagttatcgagcttaaaacccgtcaattaaacaaacattatttgaacagttactgcatgccacgcactgtgttgggcttagtaataaaaaaaagaaaagataagtgcttgttctagcataaattaaaaggtccaagggaatttaatctggaagagaacatatgccaatttttaaactatgacagcttttttttttctctttccattcaaatagtcctggttcattcccagaagggcacaaaatgaatgaataaataaataaatgaataaagacaaaagccaaggtgtatgctctcaagttccaaagatgttatcaaaagctgaaatcatttgtttggtcattcagcaagctaattgagtctctgttatataccaagcactggggataccatggcgaaaaacaactttgttccttcctcctagaacttacattttaatggaaatagacaaaacacatcttcttaacggatggtgacctataaccattaatgttgaaaatggaagagacttgcttccaaaagattaaaaggagttgttcttttctccttcagaaaaataccagatcatttcctaaaatctccagtcccaagtattacatcgtggtttccctccccgactttttattttattttattctatttttttgagatggagtctcgctctgtcgccaaggctggagtgcagtggtgtgatctcggctcactgcaacctccgcctcctgggttcaggagattctcctctgtcagcgtcccaagtagctggaattacagccatgcggcaccattcccggctaatttttgtatttttggtggagatgggttttcaccatgttggccaggctggtctcaaactcctgatttcaggcgatccacccacctcgacttcccaaagtgctgggattacagcgtgagctacctggcccctccccaaattttaacatcagatctcaacatatttgttgagaacttgtttagatcatcactatcgagtaaatttatgtcagttctttagagcatttgcttcacacacagttcaaccatttaaccagaaattaaaatatcacccttttcagccctcccatgaagaatttctaggtcataaacatgaataatactcagtatatgtataatatcatatttaattgttgcaacttttcttggcgtgtttaaatcctcatgtctttgagggatcccaccacaggtgaaggaagtaaagaccacttctcccccagtctctgctttctgcagtgctcactcatatcctggcatttagcatggtgtgttgaaattaggtttacttcttgtctctccaagtggctcctctcttaaaagacagaaactagggtttagtcatcatttgtgcttcctgctagaaacccacagccttgaataatggcttcctgcctccttgagtcactttaatatccctggtgcataggacctggcatgcgtcaggctgctcgggaaatgtgggaactggacacccagaacactgctgtgctggggctatttggggcctgctgtcaggcagaaagacgttttgaattgggctttctgcccttgttgagttttctcttaagtaaagtccaaagtccaaggggcagatggccagatgcactgcccagtaaggcaggaagccaaagaggcagtgcccagccccacaaaggctgcccgactccctgggacagtagtgtggagtcccagcccaggctgacctcacaccggagcttcctagcttcctttctttgctcaatgcagggcttcttgcaccccctggaaagctaagagatttttttcaaccctaaaagagagtacctttcactgcattggatggatgaacatcagtgccctaactttatccatcatgtaggtcagggaggactgggcactatttggcaggatgtactccagaatataatcaaagaattttctgtacatatttcactaaagacaagtttttgggctggatgtggtagcttacacctataatcccagcactttgggaggctgaggtgagagggtcacttgagcccaggagttctagacaagcctgggaaacatagcaagatctcatccttacaaaaaataataatggtgtgtgcctgcagtcctagctacttgggtggttgaggcaggaggattgtttgagtgagggaagttgaggctgcagtgaactatgattttaccactgcactccagcttgggcaacaaaatgagaccctgtctcaaaaaaaaaaaaaagttttctagaataagcaggatgattgtttaatttgaagatggaacaggaaactagagtgcatttaaaatactctgtcttcattttaacatgttgaatggaataactgcatatcaccatgagtttgttttgcttttcatacagacttgtatgtgtcatttgagtggtttccagattggagcgaggttattctgatctaaatgaacagcatttttttccttagcctctgtttgccactctgggtatctctcctatgggcaaagccattagaaatgcataaaacctcgagacatggtttttggcaaaaactccatgactttaaactagctcttttactactgacctttcacagagaaaaaatatttcccttgaaaaaaactgggcttgtcattttttcccttgtagctttaagcagagacataagtgccttgcattacacatagtaaactttcttta

SEQ ID NO: 418141 - DNA, 6823 bp, Homo sapiens
cccacggatcatcagaaggcgcggacctggaggaggcgccccagaaggcgacgcctcttgcctcctgtctctcgcctctcgaaggaagtttgctcttaatttcagagccgggttcgccgtcggatcaacctccaggagctagcagcgggcgcggaccgggcagtttccgcgctcagcacaggcagctcgcggtcatgggcggctcagcctccagccagctggacgagggcaagtgcgcttacatccgagggaaaactgaggctgccatcaaaaacttcagtccctactacagtcgtcagtactctgtggctttctgcaatcacgtgcgcactgaagtagaacagcaaagagatttaacgtcacagtttttgaagaccaagccaccattggcgcctggaactattttgtatgaagcagagctatcacaattttctgaagacataaagaagtggaaggagagatacgttgtagttaaaaatgattatgctgtggagagctatgagaataaagaggcctatcagagaggagctgctcctaaatgtcgaattcttccagccggtggcaaggtgttaacctcagaagatgaatataatctgttgtctgacaggcatttcccagaccctcttgcctccagtgagaaggagaacactcagccctttgtggtcctgcccaaggaattcccagtgtacctgtggcagcccttcttcagacacggctacttctgcttccacgaggctgctgaccagaagaggtttagtgccctcctgagtgactgcgtcaggcatctcaatcatgattacatgaagcagatgacatttgaagcccaagcctttttagaagctgtgcaattcttccgacaggagaagggtcactatggttcctgggaaatgatcactggggatgaaatccagatcctgagtaacctggtgatggaggagctcctgcccactcttcagacagacctgctgcctaagatgaaggggaagaagaatgacagaaagaggacgtggcttggtctcctcgaggaggcctacaccctggttcagcatcaagtttcagaaggattaagtgccttgaaggaggaatgcagagctctgacaaagggcctggaaggaacgatccgttctgacatggatcagattgtgaactcaaagaactatttaattggaaagatcaaagcgatggtggcccagccggcggagaaaagctgcttggagagtgtgcagccattcctggcatccatcctggaggagctcatgggaccagtgagctcgggattcagtgaagtacgtgtactctttgagaaagaggtgaatgaagtcagccagaacttccagaccaccaaagacagtgtccagctaaaggagcatctagaccggcttatgaatcttccgctgcattccgtgaagatggaaccttgttatactaaagtcaacctgcttcacgagcgcctgcaggatctcaagagccgcttcagattcccccacattgatctggtggttcagaggacacagaactacatgcaggagcaatatgattatgacagcagcaccatccgaaagaagatatttcaagaggcactagttcaaatcacacttcccactgtgcagaaggcactggcgtccacatgcaaaccagagcttcagaaatacgagcagttcatctttgcagatcataccaatatgattcacgttgaaaatgtctatgaggagattttacatcagatcctgcttgatgaaactctgaaagtgataaaggaagctgctatcttgaagaaacacaacttatttgaagataacatggccttgcccagtgaaagtgtgtccagcttaacagatctaaagccccccacagggtcaaaccaggccagccctgccaggagagcttctgccattctgccaggagttctgggtagtgagaccctcagtaacgaagtattccaggagtcagaggaagagaagcagcctgaggtccctagctcgttggccaaaggagaaagcctttctctccctgggccaagcccacccccagatgggactgagcaggtgattatttcaagagtggatgaccccgtggtgaatcctgtggcaacagaggacacagcaggactcccgggcacatgctcatcagagctggagtttggagggacccttgaggatgaagaacccgcccaggaagagccagaacccatcactgcctcgggttctttgaaggcgctcagaaagttgctgacagcgtccgtggaagtaccagtggactctgctccagtgatggaagaagatacgaatggggagagccacgttccccaagaaaatgaagaagaagaggaaaaagagcccagtcaggcagctgccatccaccccgacaactgtgaagaaagtgaagtcagcgagagggaggcccaacctccctgtcccgaggcccatggggaggagttggggggatttccagaggtaggcagcccagcctctccgccagccagtggagggctcaccgaggagcccctggggcccatggagggggagctcccaggagaggcctgcacactcactgcccatgaaggaagagggggcaagtgtaccgaggaaggggatgcctcacagcaagagggctgcaccttaggttctgaccccatctgcctcagtgagagccaggtttctgaggaacaagaagagatgggagggcaaagcagcgcggcccaggccacggccagtgtgaatgcagaggagatcaaggtagcccgtattcatgagtgtcagtgggtggtggaggatgctccaaacccggatgtcctgctgtcacacaaagatgacgtgaaggagggagaaggtggtcaggagagtttcccagagctgccctcagaggagtgaaagggacaatttggctgaagtctttctctgaaaaaagccaaagggttataggggtacacttaggggttgcatgcaagctgttaccaaaaaatttttaagtattttcttaatttgaataataaaaccagaggaaatgcatacagggcatgagcaactgaggcaaacctttgtggacatgaattgttctacgatgaatttttgctttagtattttaataagaattacaaagacaatggcatacttggggtgagagggagctgaggatgtctgaggagggaatagtattgcagggaagactgagaaaacagtaggatgacagttttgagtatactctgcacttttcaattgtgcaatcttcttgtgcactttaaggctttttaattttgtttgagaatgcaaatgtatactgtaagtctacctttactatctactatgcctacttcaccatctcttaaggactcggcatttgtccacagtcagactgcaagagagggtaggtcatgaacagtcacccgtgctggctgtagcccccacagaggcaatcatgcccaatagattcaagagaagctaagcggaaatggagggtggaaggtgtgatctgtgggactgtctgggcctgttactcatcctgctatcaatttcttattaattaatcttgatgattcttattaattaatcacatttgcaggaaattcagatgaggcaagaaaattttattggcctgggtaagactgaaagcattccaaattaggcttagactgtgcaaagggcttagctaagttatcgagcttaaaacccgtcaattaaacaaacattatttgaacagttactgcatgccacgcactgtgttgggcttagtaataaaaaaaagaaaagataagtgcttgttctagcataaattaaaaggtccaagggaatttaatctggaagagaacatatgccaatttttaaactatgacagcttttttttttctctttccattcaaatagtcctggttcattcccagaagggcacaaaatgaatgaataaataaataaatgaataaagacaaaagccaaggtgtatgctctcaagttccaaagatgttatcaaaagctgaaatcatttgtttggtcattcagcaagctaattgagtctctgttatataccaagcactggggataccatggcgaaaaacaactttgttccttcctcctagaacttacattttaatggaaatagacaaaacacatcttcttaacggatggtgacctataaccattaatgttgaaaatggaagagacttgcttccaaaagattaaaaggagttgttcttttctccttcagaaaaataccagatcatttcctaaaatctccagtcccaagtattacatcgtggtttccctccccgactttttattttattttattctatttttttgagatggagtctcgctctgtcgccaaggctggagtgcagtggtgtgatctcggctcactgcaacctccgcctcctgggttcaggagattctcctctgtcagcgtcccaagtagctggaattacagccatgcggcaccattcccggctaatttttgtatttttggtggagatgggttttcaccatgttggccaggctggtctcaaactcctgatttcaggcgatccacccacctcgacttcccaaagtgctgggattacagcgtgagctacctggcccctccccaaattttaacatcagatctcaacatatttgttgagaacttgtttagatcatcactatcgagtaaatttatgtcagttctttagagcatttgcttcacacacagttcaaccatttaaccagaaattaaaatatcacccttttcagccctcccatgaagaatttctaggtcataaacatgaataatactcagtatatgtataatatcatatttaattgttgcaacttttcttggcgtgtttaaatcctcatgtctttgagggatcccaccacaggtgaaggaagtaaagaccacttctcccccagtctctgctttctgcagtgctcactcatatcctggcatttagcatggtgtgttgaaattaggtttacttcttgtctctccaagtggctcctctcttaaaagacagaaactagggtttagtcatcatttgtgcttcctgctagaaacccacagccttgaataatggcttcctgcctccttgagtcactttaatatccctggtgcataggacctggcatgcgtcaggctgctcgggaaatgtgggaactggacacccagaacactgctgtgctggggctatttggggcctgctgtcaggcagaaagacgttttgaattgggctttctgcccttgttgagttttctcttaagtaaagtccaaagtccaaggggcagatggccagatgcactgcccagtaaggcaggaagccaaagaggcagtgcccagccccacaaaggctgcccgactccctgggacagtagtgtggagtcccagcccaggctgacctcacaccggagcttcctagcttcctttctttgctcaatgcagggcttcttgcaccccctggaaagctaagagatttttttcaaccctaaaagagagtacctttcactgcattggatggatgaacatcagtgccctaactttatccatcatgtaggtcagggaggactgggcactatttggcaggatgtactccagaatataatcaaagaattttctgtacatatttcactaaagacaagtttttgggctggatgtggtagcttacacctataatcccagcactttgggaggctgaggtgagagggtcacttgagcccaggagttctagacaagcctgggaaacatagcaagatctcatccttacaaaaaataataatggtgtgtgcctgcagtcctagctacttgggtggttgaggcaggaggattgtttgagtgagggaagttgaggctgcagtgaactatgattttaccactgcactccagcttgggcaacaaaatgagaccctgtctcaaaaaaaaaaaaaagttttctagaataagcaggatgattgtttaatttgaagatggaacaggaaactagagtgcatttaaaatactctgtcttcattttaacatgttgaatggaataactgcatatcaccatgagtttgttttgcttttcatacagacttgtatgtgtcatttgagtggtttccagattggagcgaggttattctgatctaaatgaacagcatttttttccttagcctctgtttgccactctgggtatctctcctatgggcaaagccattagaaatgcataaaacctcgagacatggtttttggcaaaaactccatgactttaaactagctcttttactactgacctttcacagagaaaaaatatttcccttgaaaaaaactgggcttgtcattttttcccttgtagctttaagcagagacataagtgccttgcattacacatagtaaactttctttaaaaaaaaaaaaaaaagattttggagactaccagggtaagattccaacttgtccaaaagctttctggccttacatattttattataaaaattctcaagtctggtaatcttctatgtcagagctagtgatttcaaaaggtttcacaattccccaagacaaaagtgattttcgttcattataataaggttaagtgatatgtgattcatagcaattttgatgtgaagaagggaaggacatcattgacttaataatagtatcagtcggtgcaacagttggcaacatgtgccttcacactttaccataaagagacgggtttgagggtttgccttctaaagtctgcaacttcaagaaaaaaaatcgacactgtggattgactttcccggtcactatataaagcaaataaacttaaaacactttgtaaccatgtatttactctgccaggtgcctatattccaataaaatgttcatccttgaaaaaaaaaaa

SEQ ID NO: 418142 - DNA, 1918 bp, Homo sapiens
tcctgcaaaaacatttattcacaggtgggctggggtcagctgagatttattcacaggtgggccagggtcagctgagcgtgaagtgctgggcacagagttcacccggccgtcccagcaggccctgggctgggataaactccagtggcaccggctcgggccccttcttcttcaggtcccgctcaaagatctcgtaggccgtgagctccagcagtggcgcgatgctgacctcaggcatggacagggcctggttgatgacgctgctgtcaggcagaaagacgttttgaattgggctttctgcccttgttgagttttctcttaagtaaagtccaaagtccaaggggcagatggccagatgcactgcccagtaaggcaggaagccaaagaggcagtgcccagccccacaaaggctgcccgactccctgggacagtagtgtggagtcccagcccaggctgacctcacaccggagcttcctagcttcctttctttgctcaatgcagggcttcttgcaccccctggaaagctaagagatttttttcaaccctaaaagagagtacctttcactgcattggatggatgaacatcagtgccctaactttatccatcatgtaggtcagggaggactgggcactatttggcaggatgtactccagaatataatcaaagaattttctgtacatatttcactaaagacaagtttttgggctggatgtggtagcttacacctataatcccagcactttgggaggctgaggtgagagggtcacttgagcccaggagttctagacaagcctgggaaacatagcaagatctcatccttacaaaaaataataatggtgtgtgcctgcagtcctagctacttgggtggttgaggcaggaggattgtttgagtgagggaagttgaggctgcagtgaactatgattttaccactgcactccagcttgggcaacaaaatgagaccctgtctcaaaaaaaaaaaaaagttttctagaataagcaggatgattgtttaatttgaagatggaacaggaaactagagtgcatttaaaatactctgtcttcattttaacatgttgaatggaataactgcatatcaccatgagtttgttttgcttttcatacagacttgtatgtgtcatttgagtggtttccagattggagcgaggttattctgatctaaatgaacagcatttttttccttagcctctgtttgccactctgggtatctctcctatgggcaaagccattagaaatgcataaaacctcgagacatggtttttggcaaaaactccatgactttaaactagctcttttactactgacctttcacagagaaaaaatatttcccttgaaaaaaactgggcttgtcattttttcccttgtagctttaagcagagacataagtgccttgcattacacatagtaaactttctttaaaaaaaaaaaaaaaagattttggagactaccagggtaagattccaacttgtccaaaagctttctggccttacatattttattataaaaattctcaagtctggtaatcttctatgtcagagctagtgatttcaaaaggtttcacaattccccaagacaaaagtgattttcgttcattataataaggttaagtgatatgtgattcatagcaattttgatgtgaagaagggaaggacatcattgacttaataatagtatcagtcggtgcaacagttggcaacatgtgccttcacactttaccataaagagacgggtttgagggtttgccttctaaagtctgcaacttcaagaaaaaaaatcgacactgtggattgactttcccggtcactatataaagcaaataaacttaaaacactttgtaaccatgtatttactctgccaggtgcctatattccaataaaatgttcatccttgaaaaaaaaaaa

SEQ ID NO: 418143 - DNA, 2313 bp, Homo sapiens
cccacggatcatcagaaggcgcggacctggaggaggcgccccagaaggcgacgcctcttgcctcctgtctctcgcctctcgaaggaagtttgctcttaatttcagagccgggttcgccgtcggatcaacctccaggagctagcagcgggcgcggaccgggcagtttccgcgctcagcacaggcagctcgcggtcatgggcggctcagcctccagccagctggacgagggcaagtgcgcttacatccgagggaaaactgaggctgccatcaaaaacttcagtccctactacagtcgtcagtactctgtggctttctgcaatcacgtgcgcactgaagtagaacagcaaagagatttaacgtcacagtttttgaagaccaagccaccattggcgcctggaactattttgtatgaagcagagctatcacaattttctgaagacataaagaagtggaaggagagatacgttgtagttaaaaatgattatgctgtggagagctatgagaataaagaggcctatcagagaggagctgctcctaaatgtcgaattcttccagccggtggcaaggtgttaacctcagaagatgaatataatctgttgtctgacaggcatttcccagaccctcttgcctccagtgagaaggagaacactcagccctttgtggtcctgcccaaggaattcccagtgtacctgtggcagcccttcttcagacacggctacttctgcttccacgaggctgctgaccagaagaggtttagtgccctcctgagtgactgcgtcaggcatctcaatcatgattacatgaagcagatgacatttgaagcccaagcctttttagaagctgtgcaattcttccgacaggagaagggtcactatggttcctgggaaatgatcactggggatgaaatccagatcctgagtaacctggtgatggaggagctcctgcccactcttcagacagacctgctgcctaagatgaaggggaagaagaatgacagaaagaggacgtggcttggtctcctcgaggaggcctacaccctggttcagcatcaagtttcagaaggattaagtgccttgaaggaggaatgcagagctctgacaaagggcctggaaggaacgatccgttctgacatggatcagattgtgaactcaaagaactatttaattggaaagatcaaagcgatggtggcccagccggcggagaaaagctgcttggagagtgtgcagccattcctggcatccatcctggaggagctcatgggaccagtgagctcgggattcagtgaagtacgtgtactctttgagaaagaggtgaatgaagtcagccagaacttccagaccaccaaagacagtgtccagctaaaggagcatctagaccggcttatgaatcttccgctgcattccgtgaagatggaaccttgttatactaaagtcaacctgcttcacgagcgcctgcaggatctcaagagccgcttcagattcccccacattgatctggtggttcagaggacacagaactacatgcaggagctaatggagaatgcagtgttcacttttgagcagttgctttccccacatctccaaggagaggcctccaaaactgcagttgccattgagaaggttaaactccgagtcttaaagcaatatgattatgacagcagcaccatccgaaagaagatatttcaagaggcactagttcaaatcacacttcccactgtgcagaaggcactggcgtccacatgcaaaccagagcttcagaaatacgagcagttcatctttgcagatcataccaatatgattcacgttgaaaatgtctatgaggagattttacatcagatcctgcttgatgaaactctgaaagcagggtaagattccaacttgtccaaaagctttctggccttacatattttattataaaaattctcaagtctggtaatcttctatgtcagagctagtgatttcaaaaggtttcacaattccccaagacaaaagtgattttcgttcattataataaggttaagtgatatgtgattcatagcaattttgatgtgaagaagggaaggacatcattgacttaataatagtatcagtcggtgcaacagttggcaacatgtgccttcacactttaccataaagagacgggtttgagggtttgccttctaaagtctgcaacttcaagaaaaaaaatcgacactgtggattgactttcccggtcactatataaagcaaataaacttaaaacactttgtaaccatgtatttactctgccaggtgcctatattccaataaaatgttcatccttgaaaaaaaaaaa

SEQ ID NO: 418144 - DNA, 729 bp, Homo sapiens
tggctgtggagaagcaggtcaagcagacaaccttgctgatcttctctgtggtttatccttcaatgtggctgtatctcttggagcatcccctcagactttctccagtgctggatgaaggcactgcatggtgggatgcagtggtacctgggctctggtcggtctagacgtcattctcacttcttcacactgctcctcccttcgtttactaaacattaaagaggatgacaatggggcttgggggacagtggggacgaagagcatggagatactttgataccttgatcatgaagggcttaggaggaatgatagtcccaggggacacagactaagatgcaagccaccaaaaccaagccttgcaattccttcacaattttgctgaagatgtccttatccattattgaactctttcattttactgtatgccctaagttcttctagtttgaatatgtgaagttcgaatttggggaatttgttatttacattgggaaaacaacaaggtgagaatatcagcagatgttactgttccttgcggatgtttaagaatgttcagcctctaagattgtcttagttgagatttctgtggcctctgtagtaggttaaactattaacctactacagagttcatctggtccgggacagggacagccaatcaggacatttttagttggcctgatgctcagatgtagccatcaccgactgaccgactctgggctgtcttctgctgcgcag

SEQ ID NO: 418145 - DNA, 386 bp, Homo sapiens
ctcctgcccactcttcagacagacctgctgcctaagatgaaggggaagaagaatgacagaaagaggacgtggcttggtgtaagcaatggttttgctctacaactgagctactcaaaatgggaacattctcttcccttttcttttagggcatttgttgttgttgttgatattcccttccctgggtgtagaaatgcctacttcgaacctgctgagtctcacttacaagaagactgttccaaacagactccaactttgaaagaaaaattacaatgtgtgtgcagttctgtttgttatgatggcctgtgatgaaggctcctccctccacttgactccatcagtgcttacacgtgacagagccctgatttatgtgttattccttgttgcag

SEQ ID NO: 418146 - DNA, 6934 bp, Homo sapiens
cccacggatcatcagaaggcgcggacctggaggaggcgccccagaaggcgacgcctcttgcctcctgtctctcgcctctcgaaggaagtttgctcttaatttcagagccgggttcgccgtcggatcaacctccaggagctagcagcgggcgcggaccgggcagtttccgcgctcagcacaggcagctcgcggtcatgggcggctcagcctccagccagctggacgagggcaagtgcgcttacatccgagggaaaactgaggctgccatcaaaaacttcagtccctactacagtcgtcagtactctgtggctttctgcaatcacgtgcgcactgaagtagaacagcaaagagatttaacgtcacagtttttgaagaccaagccaccattggcgcctggaactattttgtatgaagcagagctatcacaattttctgaagacataaagaagtggaaggagagatacgttgtagttaaaaatgattatgctgtggagagctatgagaataaagaggcctatcagagaggagctgctcctaaatgtcgaattcttccagccggtggcaaggtgttaacctcagaagatgaatataatctgttgtctgacaggcatttcccagaccctcttgcctccagtgagaaggagaacactcagccctttgtggtcctgcccaaggaattcccagtgtacctgtggcagcccttcttcagacacggctacttctgcttccacgaggctgctgaccagaagaggtttagtgccctcctgagtgactgcgtcaggcatctcaatcatgattacatgaagcagatgacatttgaagcccaagcctttttagaagctgtgcaattcttccgacaggagaagggtcactatggttcctgggaaatgatcactggggatgaaatccagatcctgagtaacctggtgatggaggagctcctgcccactcttcagacagacctgctgcctaagatgaaggggaagaagaatgacagaaagaggacgtggcttggtctcctcgaggaggcctacaccctggttcagcatcaagtttcagaaggattaagtgccttgaaggaggaatgcagagctctgacaaagggcctggaaggaacgatccgttctgacatggatcagattgtgaactcaaagaactatttaattggaaagatcaaagcgatggtggcccagccggcggagaaaagctgcttggagagtgtgcagccattcctggcatccatcctggaggagctcatgggaccagtgagctcgggattcagtgaagtacgtgtactctttgagaaagaggtgaatgaagtcagccagaacttccagaccaccaaagacagtgtccagctaaaggagcatctagaccggcttatgaatcttccgctgcattccgtgaagatggaaccttgttatactaaagtcaacctgcttcacgagcgcctgcaggatctcaagagccgcttcagattcccccacattgatctggtggttcagaggacacagaactacatgcaggagctaatggagaatgcagtgttcacttttgagcagttgctttccccacatctccaaggagaggcctccaaaactgcagttgccattgagaaggttaaactccgagtcttaaagcaatatgattatgacagcagcaccatccgaaagaagatatttcaagaggcactagttcaaatcacacttcccactgtgcagaaggcactggcgtccacatgcaaaccagagcttcagaaatacgagcagttcatctttgcagatcataccaatatgattcacgttgaaaatgtctatgaggagattttacatcagatcctgcttgatgaaactctgaaagtgataaaggaagctgctatcttgaagaaacacaacttatttgaagataacatggccttgcccagtgaaagtgtgtccagcttaacagatctaaagccccccacagggtcaaaccaggccagccctgccaggagagcttctgccattctgccaggagttctgggtagtgagaccctcagtaacgaagtattccaggagtcagaggaagagaagcagcctgaggtccctagctcgttggccaaaggagaaagcctttctctccctgggccaagcccacccccagatgggactgagcaggtgattatttcaagagtggatgaccccgtggtgaatcctgtggcaacagaggacacagcaggactcccgggcacatgctcatcagagctggagtttggagggacccttgaggatgaagaacccgcccaggaagagccagaacccatcactgcctcgggttctttgaaggcgctcagaaagttgctgacagcgtccgtggaagtaccagtggactctgctccagtgatggaagaagatacgaatggggagagccacgttccccaagaaaatgaagaagaagaggaaaaagagcccagtcaggcagctgccatccaccccgacaactgtgaagaaagtgaagtcagcgagagggaggcccaacctccctgtcccgaggcccatggggaggagttggggggatttccagaggtaggcagcccagcctctccgccagccagtggagggctcaccgaggagcccctggggcccatggagggggagctcccaggagaggcctgcacactcactgcccatgaaggaagagggggcaagtgtaccgaggaaggggatgcctcacagcaagagggctgcaccttaggttctgaccccatctgcctcagtgagagccaggtttctgaggaacaagaagagatgggagggcaaagcagcgcggcccaggccacggccagtgtgaatgcagaggagatcaaggtagcccgtattcatgagtgtcagtgggtggtggaggatgctccaaacccggatgtcctgctgtcacacaaagatgacgtgaaggagggagaaggtggtcaggagagtttcccagagctgccctcagaggagtgaaagggacaatttggctgaagtctttctctgaaaaaagccaaagggttataggggtacacttaggggttgcatgcaagctgttaccaaaaaatttttaagtattttcttaatttgaataataaaaccagaggaaatgcatacagggcatgagcaactgaggcaaacctttgtggacatgaattgttctacgatgaatttttgctttagtattttaataagaattacaaagacaatggcatacttggggtgagagggagctgaggatgtctgaggagggaatagtattgcagggaagactgagaaaacagtaggatgacagttttgagtatactctgcacttttcaattgtgcaatcttcttgtgcactttaaggctttttaattttgtttgagaatgcaaatgtatactgtaagtctacctttactatctactatgcctacttcaccatctcttaaggactcggcatttgtccacagtcagactgcaagagagggtaggtcatgaacagtcacccgtgctggctgtagcccccacagaggcaatcatgcccaatagattcaagagaagctaagcggaaatggagggtggaaggtgtgatctgtgggactgtctgggcctgttactcatcctgctatcaatttcttattaattaatcttgatgattcttattaattaatcacatttgcaggaaattcagatgaggcaagaaaattttattggcctgggtaagactgaaagcattccaaattaggcttagactgtgcaaagggcttagctaagttatcgagcttaaaacccgtcaattaaacaaacattatttgaacagttactgcatgccacgcactgtgttgggcttagtaataaaaaaaagaaaagataagtgcttgttctagcataaattaaaaggtccaagggaatttaatctggaagagaacatatgccaatttttaaactatgacagcttttttttttctctttccattcaaatagtcctggttcattcccagaagggcacaaaatgaatgaataaataaataaatgaataaagacaaaagccaaggtgtatgctctcaagttccaaagatgttatcaaaagctgaaatcatttgtttggtcattcagcaagctaattgagtctctgttatataccaagcactggggataccatggcgaaaaacaactttgttccttcctcctagaacttacattttaatggaaatagacaaaacacatcttcttaacggatggtgacctataaccattaatgttgaaaatggaagagacttgcttccaaaagattaaaaggagttgttcttttctccttcagaaaaataccagatcatttcctaaaatctccagtcccaagtattacatcgtggtttccctccccgactttttattttattttattctatttttttgagatggagtctcgctctgtcgccaaggctggagtgcagtggtgtgatctcggctcactgcaacctccgcctcctgggttcaggagattctcctctgtcagcgtcccaagtagctggaattacagccatgcggcaccattcccggctaatttttgtatttttggtggagatgggttttcaccatgttggccaggctggtctcaaactcctgatttcaggcgatccacccacctcgacttcccaaagtgctgggattacagcgtgagctacctggcccctccccaaattttaacatcagatctcaacatatttgttgagaacttgtttagatcatcactatcgagtaaatttatgtcagttctttagagcatttgcttcacacacagttcaaccatttaaccagaaattaaaatatcacccttttcagccctcccatgaagaatttctaggtcataaacatgaataatactcagtatatgtataatatcatatttaattgttgcaacttttcttggcgtgtttaaatcctcatgtctttgagggatcccaccacaggtgaaggaagtaaagaccacttctcccccagtctctgctttctgcagtgctcactcatatcctggcatttagcatggtgtgttgaaattaggtttacttcttgtctctccaagtggctcctctcttaaaagacagaaactagggtttagtcatcatttgtgcttcctgctagaaacccacagccttgaataatggcttcctgcctccttgagtcactttaatatccctggtgcataggacctggcatgcgtcaggctgctcgggaaatgtgggaactggacacccagaacactgctgtgctggggctatttggggcctgctgtcaggcagaaagacgttttgaattgggctttctgcccttgttgagttttctcttaagtaaagtccaaagtccaaggggcagatggccagatgcactgcccagtaaggcaggaagccaaagaggcagtgcccagccccacaaaggctgcccgactccctgggacagtagtgtggagtcccagcccaggctgacctcacaccggagcttcctagcttcctttctttgctcaatgcagggcttcttgcaccccctggaaagctaagagatttttttcaaccctaaaagagagtacctttcactgcattggatggatgaacatcagtgccctaactttatccatcatgtaggtcagggaggactgggcactatttggcaggatgtactccagaatataatcaaagaattttctgtacatatttcactaaagacaagtttttgggctggatgtggtagcttacacctataatcccagcactttgggaggctgaggtgagagggtcacttgagcccaggagttctagacaagcctgggaaacatagcaagatctcatccttacaaaaaataataatggtgtgtgcctgcagtcctagctacttgggtggttgaggcaggaggattgtttgagtgagggaagttgaggctgcagtgaactatgattttaccactgcactccagcttgggcaacaaaatgagaccctgtctcaaaaaaaaaaaaaagttttctagaataagcaggatgattgtttaatttgaagatggaacaggaaactagagtgcatttaaaatactctgtcttcattttaacatgttgaatggaataactgcatatcaccatgagtttgttttgcttttcatacagacttgtatgtgtcatttgagtggtttccagattggagcgaggttattctgatctaaatgaacagcatttttttccttagcctctgtttgccactctgggtatctctcctatgggcaaagccattagaaatgcataaaacctcgagacatggtttttggcaaaaactccatgactttaaactagctcttttactactgacctttcacagagaaaaaatatttcccttgaaaaaaactgggcttgtcattttttcccttgtagctttaagcagagacataagtgccttgcattacacatagtaaactttctttaaaaaaaaaaaaaaaagattttggagactaccagggtaagattccaacttgtccaaaagctttctggccttacatattttattataaaaattctcaagtctggtaatcttctatgtcagagctagtgatttcaaaaggtttcacaattccccaagacaaaagtgattttcgttcattataataaggttaagtgatatgtgattcatagcaattttgatgtgaagaagggaaggacatcattgacttaataatagtatcagtcggtgcaacagttggcaacatgtgccttcacactttaccataaagagacgggtttgagggtttgccttctaaagtctgcaacttcaagaaaaaaaatcgacactgtggattgactttcccggtcactatataaagcaaataaacttaaaacactttgtaaccatgtatttactctgccaggtgcctatattccaataaaatgttcatccttgaaaaaaaaaaa

SEQ ID NO: 418147 - DNA, 6633 bp, Homo sapiens
cccacggatcatcagaaggcgcggacctggaggaggcgccccagaaggcgacgcctcttgcctcctgtctctcgcctctcgaaggaagtttgctcttaatttcagagccgggttcgccgtcggatcaacctccaggagctagcagcgggcgcggaccgggcagtttccgcgctcagcacaggcagctcgcggtcatgggcggctcagcctccagccagctggacgagggcaagtgcgcttacatccgagggaaaactgaggctgccatcaaaaacttcagtccctactacagtcgtcagtactctgtggctttctgcaatcacgtgcgcactgaagtagaacagcaaagagatttaacgtcacagtttttgaagaccaagccaccattggcgcctggaactattttgtatgaagcagagctatcacaattttctgaagacataaagaagtggaaggagagatacgttgtagttaaaaatgattatgctgtggagagctatgagaataaagaggcctatcagagaggagctgctcctaaatgtcgaattcttccagccggtggcaaggtgttaacctcagaagatgaatataatctgttgtctgacaggcatttcccagaccctcttgcctccagtgagaaggagaacactcagccctttgtggtcctgcccaaggaattcccagtgtacctgtggcagcccttcttcagacacggctacttctgcttccacgaggctgctgaccagaagaggtttagtgccctcctgagtgactgcgtcaggcatctcaatcatgattacatgaagcagatgacatttgaagcccaagcctttttagaagctgtgcaattcttccgacaggagaagggtcactatggttcctgggaaatgatcactggggatgaaatccagatcctgagtaacctggtgatggaggagctcctgcccactcttcagacagacctgctgcctaagatgaaggggaagaagaatgacagaaagaggacgtggcttggtctcctcgaggaggcctacaccctggttcagcatcaagtttcagaaggattaagtgccttgaaggaggaatgcagagctctgacaaagggcctggaaggaacgatccgttctgacatggatcagattgtgaactcaaagaactatttaattggaaagatcaaagcgatggtggcccagccggcggagaaaagctgcttggagagtgtgcagccattcctggcatccatcctggaggagctcatgggaccagtgagctcgggattcagtgaagtacgtgtactctttgagaaagaggtgaatgaagtcagccagaacttccagaccaccaaagacagtgtccagctaaaggagcatctagaccggcttatgaatcttccgctgcattccgtgaagatggaaccttgttatactaaagtcaacctgcttcacgagcgcctgcaggatctcaagagccgcttcagattcccccacattgatctggtggttcagaggacacagaactacatgcaggagctaatggagaatgcagtgttcacttttgagcagttgctttccccacatctccaaggagaggcctccaaaactgcagttgccattgagaaggttaaactccgagtcttaaagcaatatgattatgacagcagcaccatccgaaagaagatatttcaagaggcactagttcaaatcacacttcccactgtgcagaaggcactggcgtccacatgcaaaccagagcttcagaaatacgagcagttcatctttgcagatcataccaatatgattcacgttgaaaatgtctatgaggagattttacatcagatcctgcttgatgaaactctgaaagtgataaaggaagctgctatcttgaagaaacacaacttatttgaagataacatggccttgcccagtgaaagtgtgtccagcttaacagatctaaagccccccacagggtcaaaccaggccagccctgccaggagagcttctgccattctgccaggagttctgggtagtgagaccctcagtaacgaagtattccaggagtcagaggaagagaagcagcctgaggtccctagctcgttggccaaaggagaaagcctttctctccctgggccaagcccacccccagatgggactgagcaggtgattatttcaagagtggatgaccccgtggtgaatcctgtggcaacagaggacacagcaggactcccgggcacatgctcatcagagctggagtttggagggacccttgaggatgaagaacccgcccaggaagagccagaacccatcactgcctcgggttctttgaaggcgctcagaaagttgctgacagcgtccgtggaagtaccagtggactctgctccagtgatggaagaagatacgaatggggagagccacgttccccaagaaaatgaagaagaagaggaaaaagagcccagtcaggcagctgccatccaccccgacaactgtgaagaaagtgaagtcagcgagagggaggcccaacctccctgtcccgaggcccatggggaggagttggggggatttccagaggtaggcagcccagcctctccgccagccagtggagggctcaccgaggagcccctggggcccatggagggggagctcccaggagaggcctgcacactcactgcccatgaaggaagagggggcaagtgtaccgaggaaggggatgcctcacagcaagagggctgcaccttaggttctgaccccatctgcctcagtgagagccaggtttctgaggaacaagaagagatgggagggcaaagcagcgcggcccaggccacggccagtgtgaatgcagaggagatcaaggtagcccgtattcatgagtgtcagtgggtggtggaggatgctccaaacccggatgtcctgctgtcacacaaagatgacgtgaaggagggagaaggtggtcaggagagtttcccagagctgccctcagaggagtgaaagggacaatttggctgaagtctttctctgaaaaaagccaaagggttataggggtacacttaggggttgcatgcaagctgttaccaaaaaatttttaagtattttcttaatttgaataataaaaccagaggaaatgcatacagggcatgagcaactgaggcaaacctttgtggacatgaattgttctacgatgaatttttgctttagtattttaataagaattacaaagacaatggcatacttggggtgagagggagctgaggatgtctgaggagggaatagtattgcagggaagactgagaaaacagtaggatgacagttttgagtatactctgcacttttcaattgtgcaatcttcttgtgcactttaaggctttttaattttgtttgagaatgcaaatgtatactgtaagtctacctttactatctactatgcctacttcaccatctcttaaggactcggcatttgtccacagtcagactgcaagagagggtaggtcatgaacagtcacccgtgctggctgtagcccccacagaggcaatcatgcccaatagattcaagagaagctaagcggaaatggagggtggaaggtgtgatctgtgggactgtctgggcctgttactcatcctgctatcaatttcttattaattaatcttgatgattcttattaattaatcacatttgcaggaaattcagatgaggcaagaaaattttattggcctgggtaagactgaaagcattccaaattaggcttagactgtgcaaagggcttagctaagttatcgagcttaaaacccgtcaattaaacaaacattatttgaacagttactgcatgccacgcactgtgttgggcttagtaataaaaaaaagaaaagataagtgcttgttctagcataaattaaaaggtccaagggaatttaatctggaagagaacatatgccaatttttaaactatgacagcttttttttttctctttccattcaaatagtcctggttcattcccagaagggcacaaaatgaatgaataaataaataaatgaataaagacaaaagccaaggtgtatgctctcaagttccaaagatgttatcaaaagctgaaatcatttgtttggtcattcagcaagctaattgagtctctgttatataccaagcactggggataccatggcgaaaaacaactttgttccttcctcctagaacttacattttaatggaaatagacaaaacacatcttcttaacggatggtgacctataaccattaatgttgaaaatggaagagacttgcttccaaaagattaaaaggagttgttcttttctccttcagaaaaataccagatcatttcctaaaatctccagtcccaagtattacatcgtggtttccctccccgactttttattttattttattctatttttttgagatggagtctcgctctgtcgccaaggctggagtgcagtggtgtgatctcggctcactgcaacctccgcctcctgggttcaggagattctcctctgtcagcgtcccaagtagctggaattacagccatgcggcaccattcccggctaatttttgtatttttggtggagatgggttttcaccatgttggccaggctggtctcaaactcctgatttcaggcgatccacccacctcgacttcccaaagtgctgggattacagcgtgagctacctggcccctccccaaattttaacatcagatctcaacatatttgttgagaacttgtttagatcatcactatcgagtaaatttatgtcagttctttagagcatttgcttcacacacagttcaaccatttaaccagaaattaaaatatcacccttttcagccctcccatgaagaatttctaggtcataaacatgaataatactcagtatatgtataatatcatatttaattgttgcaacttttcttggcgtgtttaaatcctcatgtctttgagggatcccaccacaggtgaaggaagtaaagaccacttctcccccagtctctgctttctgcagtgctcactcatatcctggcatttagcatggtgtgttgaaattaggtttacttcttgtctctccaagtggctcctctcttaaaagacagaaactagggtttagtcatcatttgtgcttcctgctagaaacccacagccttgaataatggcttcctgcctccttgagtcactttaatatccctggtgcataggacctggcatgcgtcaggctgctcgggaaatgtgggaactggacacccagaacactgctgtgctggggctatttggggcctgctgtcaggcagaaagacgttttgaattgggctttctgcccttgttgagttttctcttaagtaaagtccaaagtccaaggggcagatggccagatgcactgcccagtaaggcaggaagccaaagaggcagtgcccagccccacaaaggctgcccgactccctgggacagtagtgtggagtcccagcccaggctgacctcacaccggagcttcctagcttcctttctttgctcaatgcagggcttcttgcaccccctggaaagctaagagatttttttcaaccctaaaagagagtacctttcactgcattggatggatgaacatcagtgccctaactttatccatcatgtaggtcagggaggactgggcactatttggcaggatgtactccagaatataatcaaagaaaaaaaaaaaaaaaagttttctagaataagcaggatgattgtttaatttgaagatggaacaggaaactagagtgcatttaaaatactctgtcttcattttaacatgttgaatggaataactgcatatcaccatgagtttgttttgcttttcatacagacttgtatgtgtcatttgagtggtttccagattggagcgaggttattctgatctaaatgaacagcatttttttccttagcctctgtttgccactctgggtatctctcctatgggcaaagccattagaaatgcataaaacctcgagacatggtttttggcaaaaactccatgactttaaactagctcttttactactgacctttcacagagaaaaaatatttcccttgaaaaaaactgggcttgtcattttttcccttgtagctttaagcagagacataagtgccttgcattacacatagtaaactttctttaaaaaaaaaaaaaaaagattttggagactaccagggtaagattccaacttgtccaaaagctttctggccttacatattttattataaaaattctcaagtctggtaatcttctatgtcagagctagtgatttcaaaaggtttcacaattccccaagacaaaagtgattttcgttcattataataaggttaagtgatatgtgattcatagcaattttgatgtgaagaagggaaggacatcattgacttaataatagtatcagtcggtgcaacagttggcaacatgtgccttcacactttaccataaagagacgggtttgagggtttgccttctaaagtctgcaacttcaagaaaaaaaatcgacactgtggattgactttcccggtcactatataaagcaaataaacttaaaacactttgtaaccatgtatttactctgccaggtgcctatattccaataaaatgttcatccttgaaaaaaaaaaa

SEQ ID NO: 418148 - DNA, 6150 bp, Homo sapiens
cccacggatcatcagaaggcgcggacctggaggaggcgccccagaaggcgacgcctcttgcctcctgtctctcgcctctcgaaggaagtttgctcttaatttcagagccgggttcgccgtcggatcaacctccaggagctagcagcgggcgcggaccgggcagtttccgcgctcagcacaggcagctcgcggtcatgggcggctcagcctccagccagctggacgagggcaagtgcgcttacatccgagggaaaactgaggctgccatcaaaaacttcagtccctactacagtcgtcagtactctgtggctttctgcaatcacgtgcgcactgaagtagaacagcaaagagatttaacgtcacagtttttgaagaccaagccaccattggcgcctggaactattttgtatgaagcagagctatcacaattttctgaagacataaagaagtggaaggagagatacgttgtagttaaaaatgattatgctgtggagagctatgagaataaagaggcctatcagagaggagctgctcctaaatgtcgaattcttccagccggtggcaaggtgttaacctcagaagatgaatataatctgttgtctgacaggcatttcccagaccctcttgcctccagtgagaaggagaacactcagccctttgtggtcctgcccaaggaattcccagtgtacctgtggcagcccttcttcagacacggctacttctgcttccacgaggctgctgaccagaagaggtttagtgccctcctgagtgactgcgtcaggcatctcaatcatgattacatgaagcagatgacatttgaagcccaagcctttttagaagctgtgcaattcttccgacaggagaagggtcactatggttcctgggaaatgatcactggggatgaaatccagatcctgagtaacctggtgatggaggagctcctgcccactcttcagacagacctgctgcctaagatgaaggggaagaagaatgacagaaagaggacgtggcttggtctcctcgaggaggcctacaccctggttcagcatcaagtttcagaaggattaagtgccttgaaggaggaatgcagagctctgacaaagggcctggaaggaacgatccgttctgacatggatcagattgtgaactcaaagaactatttaattggaaagatcaaagcgatggtggcccagccggcggagaaaagctgcttggagagtgtgcagccattcctggcatccatcctggaggagctcatgggaccagtgagctcgggattcagtgaagtacgtgtactctttgagaaagaggtgaatgaagtcagccagaacttccagaccaccaaagacagtgtccagctaaaggagcatctagaccggcttatgaatcttccgctgcattccgtgaagatggaaccttgttatactaaagtcaacctgcttcacgagcgcctgcaggatctcaagagccgcttcagattcccccacattgatctggtggttcagaggacacagaactacatgcaggagctaatggagaatgcagtgttcacttttgagcagttgctttccccacatctccaaggagaggcctccaaaactgcagttgccattgagaaggttaaactccgagtcttaaagcaatatgattatgacagcagcaccatccgaaagaagatatttcaagaggcactagttcaaatcacacttcccactgtgcagaaggcactggcgtccacatgcaaaccagagcttcagaaatacgagcagttcatctttgcagatcataccaatatgattcacgttgaaaatgtctatgaggagattttacatcagatcctgcttgatgaaactctgaaagtgataaaggaagctgctatcttgaagaaacacaacttatttgaagataacatggccttgcccagtgaaagtgtgtccagcttaacagatctaaagccccccacagggtcaaaccaggccagccctgccaggagagcttctgccattctgccaggagttctgggtagtgagaccctcagtaacgaagtattccaggagtcagaggaagagaagcagcctgaggtccctagctcgttggccaaaggagaaagcctttctctccctgggccaagcccacccccagatgggactgagcaggtgattatttcaagagtggatgaccccgtggtgaatcctgtggcaacagaggacacagcaggactcccgggcacatgctcatcagagctggagtttggagggacccttgaggatgaagaacccgcccaggaagagccagaacccatcactgcctcgggttctttgaaggcgctcagaaagttgctgacagcgtccgtggaagtaccagtggactctgctccagtgatggaagaagatacgaatggggagagccacgttccccaagaaaatgaagaagaagaggaaaaagagcccagtcaggcagctgccatccaccccgacaactgtgaagaaagtgaagtcagcgagagggaggcccaacctccctgtcccgaggcccatggggaggagttggggggatttccagaggtaggcagcccagcctctccgccagccagtggagggctcaccgaggagcccctggggcccatggagggggagctcccaggagaggcctgcacactcactgcccatgaaggaagagggggcaagtgtaccgaggaaggggatgcctcacagcaagagggctgcaccttaggttctgaccccatctgcctcagtgagagccaggtttctgaggaacaagaagagatgggagggcaaagcagcgcggcccaggccacggccagtgtgaatgcagaggagatcaaggtagcccgtattcatgagtgtcagtgggtggtggaggatgctccaaacccggatgtcctgctgtcacacaaagatgacgtgaaggagggagaaggtggtcaggagagtttcccagagctgccctcagaggagtgaaagggacaatttggctgaagtctttctctgaaaaaagccaaagggttataggggtacacttaggggttgcatgcaagctgttaccaaaaaatttttaagtattttcttaatttgaataataaaaccagaggaaatgcatacagggcatgagcaactgaggcaaacctttgtggacatgaattgttctacgatgaatttttgctttagtattttaataagaattacaaagacaatggcatacttggggtgagagggagctgaggatgtctgaggagggaatagtattgcagggaagactgagaaaacagtaggatgacagttttgagtatactctgcacttttcaattgtgcaatcttcttgtgcactttaaggctttttaattttgtttgagaatgcaaatgtatactgtaagtctacctttactatctactatgcctacttcaccatctcttaaggactcggcatttgtccacagtcagactgcaagagagggtaggtcatgaacagtcacccgtgctggctgtagcccccacagaggcaatcatgcccaatagattcaagagaagctaagcggaaatggagggtggaaggtgtgatctgtgggactgtctgggcctgttactcatcctgctatcaatttcttattaattaatcttgatgattcttattaattaatcacatttgcaggaaattcagatgaggcaagaaaattttattggcctgggtaagactgaaagcattccaaattaggcttagactgtgcaaagggcttagctaagttatcgagcttaaaacccgtcaattaaacaaacattatttgaacagttactgcatgccacgcactgtgttgggcttagtaataaaaaaaagaaaagataagtgcttgttctagcataaattaaaaggtccaagggaatttaatctggaagagaacatatgccaatttttaaactatgacagcttttttttttctctttccattcaaatagtcctggttcattcccagaagggcacaaaatgaatgaataaataaataaatgaataaagacaaaagccaaggtgtatgctctcaagttccaaagatgttatcaaaagctgaaatcatttgtttggtcattcagcaagctaattgagtctctgttatataccaagcactggggataccatggcgaaaaacaactttgttccttcctcctagaacttacattttaatggaaatagacaaaacacatcttcttaacggatggtgacctataaccattaatgttgaaaatggaagagacttgcttccaaaagattaaaaggagttgttcttttctccttcagaaaaataccagatcatttcctaaaatctccagtcccaagtattacatcgtggtttccctccccgactttttattttattttattctatttttttgagatggagtctcgctctgtcgccaaggctggagtgcagtggtgtgatctcggctcactgcaacctccgcctcctgggttcaggagattctcctctgtcagcgtcccaagtagctggaattacagccatgcggcaccattcccggctaatttttgtatttttggtggagatgggttttcaccatgttggccaggctggtctcaaactcctgatttcaggcgatccacccacctcgacttcccaaagtgctgggattacagcgtgagctacctggcccctccccaaattttaacatcagatctcaacatatttgttgagaacttgtttagatcatcactatcgagtaaatttatgtcagttctttagagcatttgcttcacacacagttcaaccatttaaccagaaattaaaatatcacccttttcagccctcccatgaagaatttctaggtcataaacatgaataatactcagtatatgtataatatcatatttaattgttgcaacttttcttggcgtgtttaaatcctcatgtctttgagggatcccaccacaggtgaaggaagtaaagaccacttctcccccagtctctgctttctgcagtgctcactcatatcctggcatttagcatggtgtgttgaaattaggtttacttcttgtctctccaagtggctcctctcttaaaagacagaaactagggtttagtcatcatttgtgcttcctgctagaaacccacagccttgaataatggcttcctgcctccttgagtcactttaatatccctggtgcataggacctggcatgcgtcaggctgctcgggaaatgtgggaactggacacccagaacactgctgtgctggggctatttggggcctgctgtcaggcagaaagacgttttgaattgggctttctgcccttgttgagttttctcttaagtaaagtccaaagtccaaggggcagatggccagatgcactgcccagtaaggcaggaagccaaagaggcagtgcccagccccacaaaggctgcccgactccctgggacagtagtgtggagtcccagcccaggctgacctcacaccggagcttcctagcttcctttctttgctcaatgcagggcttcttgcaccccctggaaagctaagagatttttttcaaccctaaaagagagtacctttcactgcattggatggatgaacatcagtgccctaactttatccatcatgtaggtcagggaggactgggcactatttggcaggatgtactccagaatataatcaaagaaaaaaaaaaaaaaaagttttctagaataagcaggatgattgtttaatttgaagatggaacaggaaactagagtgcatttaaaatactctgtcttcattttaacatgttgaatggaataactgcatatcaccatgagtttgttttgcttttcatacagacttgtatgtgtcatttgagtggtttccagattggagcgaggttattctgatctaaatgaacagcatttttttccttagcctctgtttgccactctgggtatctctcctatgggcaaagccattagaaatgcataaaacctcgagacatggtttttggcaaaaactccatgactttaaactagctcttttactactgacctttcacagagaaaaaatatttcccttgaaaaaaactgggcttgtcattttttcccttgtagctttaagcagagacataagtgccttgcattacacatagtaaactttcttta

SEQ ID NO: 418149 - DNA, 4032 bp, Homo sapiens
cccacggatcatcagaaggcgcggacctggaggaggcgccccagaaggcgacgcctcttgcctcctgtctctcgcctctcgaaggaagtttgctcttaatttcagagccgggttcgccgtcggatcaacctccaggagctagcagcgggcgcggaccgggcagtttccgcgctcagcacaggcagctcgcggtcatgggcggctcagcctccagccagctggacgagggcaagtgcgcttacatccgagggaaaactgaggctgccatcaaaaacttcagtccctactacagtcgtcagtactctgtggctttctgcaatcacgtgcgcactgaagtagaacagcaaagagatttaacgtcacagtttttgaagaccaagccaccattggcgcctggaactattttgtatgaagcagagctatcacaattttctgaagacataaagaagtggaaggagagatacgttgtagttaaaaatgattatgctgtggagagctatgagaataaagaggcctatcagagaggagctgctcctaaatgtcgaattcttccagccggtggcaaggtgttaacctcagaagatgaatataatctgttgtctgacaggcatttcccagaccctcttgcctccagtgagaaggagaacactcagccctttgtggtcctgcccaaggaattcccagtgtacctgtggcagcccttcttcagacacggctacttctgcttccacgaggctgctgaccagaagaggtttagtgccctcctgagtgactgcgtcaggcatctcaatcatgattacatgaagcagatgacatttgaagcccaagcctttttagaagctgtgcaattcttccgacaggagaagggtcactatggttcctgggaaatgatcactggggatgaaatccagatcctgagtaacctggtgatggaggagctcctgcccactcttcagacagacctgctgcctaagatgaaggggaagaagaatgacagaaagaggacgtggcttggtctcctcgaggaggcctacaccctggttcagcatcaagtttcagaaggattaagtgccttgaaggaggaatgcagagctctgacaaagggcctggaaggaacgatccgttctgacatggatcagattgtgaactcaaagaactatttaattggaaagatcaaagcgatggtggcccagccggcggagaaaagctgcttggagagtgtgcagccattcctggcatccatcctggaggagctcatgggaccagtgagctcgggattcagtgaagtacgtgtactctttgagaaagaggtgaatgaagtcagccagaacttccagaccaccaaagacagtgtccagctaaaggagcatctagaccggcttatgaatcttccgctgcattccgtgaagatggaaccttgttatactaaagtcaacctgcttcacgagcgcctgcaggatctcaagagccgcttcagattcccccacattgatctggtggttcagaggacacagaactacatgcaggagctaatggagaatgcagtgttcacttttgagcagttgctttccccacatctccaaggagaggcctccaaaactgcagttgccattgagaaggttaaactccgagtcttaaagcaatatgattatgacagcagcaccatccgaaagaagatatttcaagaggcactagttcaaatcacacttcccactgtgcagaaggcactggcgtccacatgcaaaccagagcttcagaaatacgagcagttcatctttgcagatcataccaatatgattcacgttgaaaatgtctatgaggagattttacatcagatcctgcttgatgaaactctgaaagtgataaaggaagctgctatcttgaagaaacacaacttatttgaagataacatggccttgcccagtgaaagtgtgtccagcttaacagatctaaagccccccacagggtcaaaccaggccagccctgccaggagagcttctgccattctgccaggagttctgggtagtgagaccctcagtaacgaagtattccaggagtcagaggaagagaagcagcctgaggtccctagctcgttggccaaaggagaaagcctttctctccctgggccaagcccacccccagatgggactgagcaggtgattatttcaagagtggatgaccccgtggtgaatcctgtggcaacagaggacacagcaggactcccgggcacatgctcatcagagctggagtttggagggacccttgaggatgaagaacccgcccaggaagagccagaacccatcactgcctcgggttctttgaaggcgctcagaaagttgctgacagcgtccgtggaagtaccagtggactctgctccagtgatggaagaagatacgaatggggagagccacgttccccaagaaaatgaagaagaagaggaaaaagagcccagtcaggcagctgccatccaccccgacaactgtgaagaaagtgaagtcagcgagagggaggcccaacctccctgtcccgaggcccatggggaggagttggggggatttccagaggtaggcagcccagcctctccgccagccagtggagggctcaccgaggagcccctggggcccatggagggggagctcccaggagaggcctgcacactcactgcccatgaaggaagagggggcaagtgtaccgaggaaggggatgcctcacagcaagagggctgcaccttaggttctgaccccatctgcctcagtgagagccaggtttctgaggaacaagaagagatgggagggcaaagcagcgcggcccaggccacggccagtgtgaatgcagaggagatcaaggtagcccgtattcatgagtgtcagtgggtggtggaggatgctccaaacccggatgtcctgctgtcacacaaagatgacgtgaaggagggagaaggtggtcaggagagtttcccagagctgccctcagaggagtgaaagggacaatttggctgaagtctttctctgaaaaaagccaaagggttataggggtacacttaggggttgcatgcaagctgttaccaaaaaatttttaagtattttcttaatttgaataataaaaccagaggaaatgcatacagggcatgagcaactgaggcaaacctttgtggacatgaattgttctacgatgaatttttgctttagtattttaataagaattacaaagacaatggcatacttggggtgagagggagctgaggatgtctgaggagggaatagtattgcagggaagactgagaaaacagtaggatgacagttttgagtatactctgcacttttcaattgtgcaatcttcttgtgcactttaaggctttttaattttgtttgagaatgcaaatgtatactgtaagtctacctttactatctactatgcctacttcaccatctcttaaggactcggcatttgtccacagtcagactgcaagagagggtaggtcatgaacagtcacccgtgctggctgtagcccccacagaggcaatcatgcccaatagattcaagagaagctaagcggaaatggagggtggaaggtgtgatctgtgggactgtctgggcctgttactcatcctgctatcaatttcttattaattaatcttgatgattcttattaattaatcacatttgcaggaaattcagatgaggcaagaaaattttattggcctgggtaagactgaaagcattccaaattaggcttagactgtgcaaagggcttagctaagttatcgagcttaaaacccgtcaattaaacaaacattatttgaacagttactgcatgccacgcactgtgttgggcttagtaataaaaaaaagaaaagataagtgcttgttctagcataaattaaaaggtccaagggaatttaatctggaagagaacatatgccaatttttaaactatgacagcttttttttttctctttccattcaaatagtcctggttcattcccagaagggcacaaaatgaatgaataaataaataaatgaataaagaca

SEQ ID NO: 418150 - DNA, 346 bp, Homo sapiens
catgttttgttttctgatatctctcagtgataaaggaagctgctatcttgaagaaacacaacttatttgaagataacatggccttgcccagtgaaagtgtgtccagcttaacagatctaaagccccccacagggtcaaaccaggccagccctgccaggagagcttctgccattctgccaggagttctgggtagtgagaccctcagtaacgaagtattccaggagtcagaggaagagaagcagcctgaggtccctagctcgttggccaaaggagaaagcctttctctccctgggccaagcccacccccagatgggactgagcaggtgattatttcaagagtggatga

SEQ ID NO: 418151 - DNA, 1179 bp, Homo sapiens
atctaaacgatgtcatttcagacattcaaaactcataataataaatttcaggaaatcaagctcctaaacattaatagccaagataccaaataaattatcatattaaaatatttaagtttatttaaagagagaagtaaacataaacttatgtcaaagagaaattctcttaatctatttcctgacttcacagtcaaaacagtataagatagtgaagtaacttataatcttatttggtcattctgttctataaacagacaaatataatttaggctgctatatgacatgataaattaaaaactgagaaagtaaaattatgtcggggtctacacattaaatgactgttttggcagtttttcacctgaatttaaaaataaaatttgtctgttctatctgtatggacagaatatgacaaccatagaccaaaagatatcattgtatagatgtaaagagacaaaagtcatggttggcatgttctttaatttagggccttgtttatacttgtgagtttaataatttcttggcaatgagcactgctgcctttttaaatcatcaatgcctgtctttaaatgccaatcattagaagtttagaattacatttaaatttctcatatatgaatttttcatctgggaactacccactgtcgtcatttttatgtgcagaaaagatcctttttgaaaaccatatttattgggatcttatttaaatttaaattatcctttacaacttcttaaaatgaatatgctaatagataagactttatccattacatctaagaactttttaacctgtatatcaatctaaataggtttctagaaataatcctagctttcatacaccatgtagttctagactccgtccatatcagtgtaacattgtgtgataaaatgccaaatgtcttgtatctaagctacgctcccactcttccagccacccctacctcccaccttgacacccttaagaaagcaatgctgacttttattctgacaagtggaaatcaatagtggttaatcaagtggattttgtaaatgctaagaagtgtttgtgaaaaccttccctttctgagttaggattgttttttcctgttcatttcaggtgttttattgagcatctgatttgtgtcagcaccatgtaaatatgatgaggagtatttggaatagactttacattcaccagaaaat

SEQ ID NO: 418152 - DNA, 1210 bp, Homo sapiens
tcgaatcgtaaccgttcgtacgagaatcgctgtcctctccttgcggccgccagtgtggtggaattcggtgagtgtgtcggggggcttggcggcttttctcctcagttttctggagtgctttggaggagaggactatggcagccagggacgccacttcaggcagcctgtcagaggagagcagtgctttggacctgccatcagcgtgtgacataagagattacgtcctgcagggacccagccaagaagccaacagcgaggctttcagttctttggaattccattcttttccttattcttctgatgtggatccagacaccagtaacttaaatatagaacaaaataactcctggaccgctgagaacttctggcttgaccctgctgtgaaaggccagtcagagaaggaagaggatgatggccttcggaaatccctggatagattctatgaaatgtttggccatccacagccaggctctgcaaactcactctctgcatctgtctgcaagtgcctgtctcagaaaatcactcaactaagaggccaggagagccaaaagtatgccctccgcagttttcaaatggcccgggtgatcttcaaccgggacggctgctccgtcttacagaggcattccagggacacccacttctacccactggaggaaggaagtacatctttggatgatgaaaagccaaacccaggactgtcaaaggatattactcatttcctcttgcagcagaatgtaatgaaagacctgtaactggtgccgggtggtgtgcagggtagtaatggaggtgctgtgccatgaccagcagtgttggtggccacccagatcccctagggtctctggccagctctgtgtgcccaatcccaattaagtgctttgaggttaaaggctggcacctgtgacctggtattggagccagtcagcccatatggagagccagcagggtctgggagttctccgtcctcttggccaaggccgctgactgactgggctacgagtcaaaagcccagctcccttgcctcaaggaaggacattctctgaggagtaatttatgctctagcactccctttcctctagatcggcctgaggctgggacattacatgaaatcacacccttgctgggcttaatccctttccctaccctcccatttatttactggtgtctctgggagcctttccttaataaacctcttatatctgaaaaaaaaaaa

SEQ ID NO: 418153 - DNA, 1033 bp, Homo sapiens
  misc_feature (18)..(18): n is a, c, g, or t
agtgttaagggggggganaaatagtttatattattgaaaagaagaaaaactggtgggtgcttcgtgctggcttatgagaaaaggaacaccacagcagtgcagaccattgaaaatgacagtgatccaaggttaaagacaccagtaacttaaatatagaacaaaataactcctggaccgctgagaacttctggcttgaccctgctgtgaaaggccagtcagagaaggaagaggatgatggccttcggaaatccctggatagattctatgaaatgtttggccatccacagccaggctctgcaaactcactctctgcatctgtctgcaagtgcctgtctcagaaaatcactcaactaagaggccaggagagccaaaagtatgccctccgcagttttcaaatggcccgggtgatcttcaaccgggacggctgctccgtcttacagaggcattccagggacacccacttctacccactggaggaaggaagtacatctttggatgatgaaaagccaaacccaggactgtcaaaggatattactcatttcctcttgcagcagaatgtaatgaaagacctgtaactggtgccgggtggtgtgcagggtagtaatggaggtgctgtgccatgaccagcagtgttggtggccacccagatcccctagggtctctggccagctctgtgtgcccaatcccaattaagtgctttgaggttaaaggctggcacctgtgacctggtattggagccagtcagcccatatggagagccagcagggtctgggagttctccgtcctcttggccaaggccgctgactgactgggctacgagtcaaaagcccagctcccttgcctcaaggaaggacattctctgaggagtaatttatgctctagcactccctttcctctagatcggcctgaggctgggacattacatgaaatcacacccttgctgggcttaatccctttccctaccctcccatttatttactggtgtctctgggagcctttccttaataaacctcttatatctgaaaaaaaaaaa

SEQ ID NO: 418154 - DNA, 975 bp, Homo sapiens
  misc_feature (61)..(62): n is a, c, g, or t
  misc_feature (64)..(65): n is a, c, g, or t
  misc_feature (72)..(72): n is a, c, g, or t
  misc_feature (74)..(74): n is a, c, g, or t
  misc_feature (77)..(77): n is a, c, g, or t
gatgcttactttatatgttgggagaagagggggaccttgaaggtgactatgactctcttanntnnccaccgntncanacaccagtaacttaaatatagaacaaaataactcctggaccgctgagaacttctggcttgaccctgctgtgaaaggccagtcagagaaggaagaggatgatggccttcggaaatccctggatagattctatgaaatgtttggccatccacagccaggctctgcaaactcactctctgcatctgtctgcaagtgcctgtctcagaaaatcactcaactaagaggccaggagagccaaaagtatgccctccgcagttttcaaatggcccgggtgatcttcaaccgggacggctgctccgtcttacagaggcattccagggacacccacttctacccactggaggaaggaagtacatctttggatgatgaaaagccaaacccaggactgtcaaaggatattactcatttcctcttgcagcagaatgtaatgaaagacctgtaactggtgccgggtggtgtgcagggtagtaatggaggtgctgtgccatgaccagcagtgttggtggccacccagatcccctagggtctctggccagctctgtgtgcccaatcccaattaagtgctttgaggttaaaggctggcacctgtgacctggtattggagccagtcagcccatatggagagccagcagggtctgggagttctccgtcctcttggccaaggccgctgactgactgggctacgagtcaaaagcccagctcccttgcctcaaggaaggacattctctgaggagtaatttatgctctagcactccctttcctctagatcggcctgaggctgggacattacatgaaatcacacccttgctgggcttaatccctttccctaccctcccatttatttactggtgtctctgggagcctttccttaataaacctcttatatctgaaaaaaaaaaa

SEQ ID NO: 418155 - DNA, 1068 bp, Homo sapiens
aattttgatagaagtggaacagaggcctgcagtgttgtcccaggagctgttgagggcagtggcgcctgcttctggccatggacagagagattcagcatcaccatgtcattgcagaatgaagggagagttggctttgttaaccaccttggctgcccgtgatgcactgatcaacaccagtaacttaaatatagaacaaaataactcctggaccgctgagaacttctggcttgaccctgctgtgaaaggccagtcagagaaggaagaggatgatggccttcggaaatccctggatagattctatgaaatgtttggccatccacagccaggctctgcaaactcactctctgcatctgtctgcaagtgcctgtctcagaaaatcactcaactaagaggccaggagagccaaaagtatgccctccgcagttttcaaatggcccgggtgatcttcaaccgggacggctgctccgtcttacagaggcattccagggacacccacttctacccactggaggaaggaagtacatctttggatgatgaaaagccaaacccaggactgtcaaaggatattactcatttcctcttgcagcagaatgtaatgaaagacctgtaactggtgccgggtggtgtgcagggtagtaatggaggtgctgtgccatgaccagcagtgttggtggccacccagatcccctagggtctctggccagctctgtgtgcccaatcccaattaagtgctttgaggttaaaggctggcacctgtgacctggtattggagccagtcagcccatatggagagccagcagggtctgggagttctccgtcctcttggccaaggccgctgactgactgggctacgagtcaaaagcccagctcccttgcctcaaggaaggacattctctgaggagtaatttatgctctagcactccctttcctctagatcggcctgaggctgggacattacatgaaatcacacccttgctgggcttaatccctttccctaccctcccatttatttactggtgtctctgggagcctttccttaataaacctcttatatctgaaaaaaaaaaa

SEQ ID NO: 418156 - DNA, 622 bp, Homo sapiens
tcgaatcgtaaccgttcgtacgagaatcgctgtcctctccttgcggccgccagtgtggtggaattcggtgagtgtgtcggggggcttggcggcttttctcctcagttttctggagtgctttggaggagaggactatggcagccagggacgccacttcaggcagcctgtcagaggagagcagtgctttggacctgccatcagcgtgtgacataagagattacgtcctgcagggacccagccaagaagccaacagcgaggctttcagttctttggaattccattcttttccttattcttctgatgtggatccagcagatctctgagaatgcttcattgtcttaggcagaaaaacatcttacctaagcaaagctttcaggaggaacttcaaaggacagcttacctggcacagcaatgacaaggagctgtttcctggatgtctttttgttattgttgctgttaatctcaggtctctttctaatctccctcaaaatgaattcagaagcaggggaatatttggttcaacaaagagagagtggaatttttttttgttttgttcttttaaaacttcagaaaatagcaatgtgggcctgttatgtgtgatgagtaataaaaatagagactt

SEQ ID NO: 418157 - DNA, 327 bp, Homo sapiens
agccaacagcgaggctttcagttctttggaattccattcttttccttattcttctgatgtggatccaggtaataagcagagtttaaaacaaactaacttaaaaacaactagcagcaatacgggtgtgtgatagtttgtttctctctcttccaatagcagatctctgagaatgcttcattgtcttaggcagaaaaacatcttacctaagcaaagctttcaggaggaacttcaaaggacagcttacctggcacagcaatgacaaggagctgtttcctggatgtctttttgttattgttgctgttaatctcaggtctctttctaatctcc

SEQ ID NO: 418158 - DNA, 1145 bp, Homo sapiens
cctaatcccctcttccgccccccttcccaaccccttccgccttcgccccctcctgagcggcttcggactatggcagccagggacgccacttcaggcagcctgtcagaggagagcagtgctttggacctgccatcagcgtgtgacataagagattacgtcctgcagggacccagccaagaagccaacagcgaggctttcagttctttggaattccattcttttccttattcttctgatgtggatccagacaccagtaacttaaatatagaacaaaataactcctggaccgctgagaacttctggcttgaccctgctgtgaaaggccagtcagagaaggaagaggatgatggccttcggaaatccctggatagattctatgaaatgtttggccatccacagccaggctctgcaaactcactctctgcatctgtctgcaagtgcctgtctcagaaaatcactcaactaagaggccaggagagccaaaagtatgccctccgcagttttcaaatggcccgggtgatcttcaaccgggacggctgctccgtcttacagaggcattccagggacacccacttctacccactggaggaaggaagtacatctttggatgatgaaaagccaaacccaggactgtcaaaggatattactcatttcctcttgcagcagaatgtaatgaaagacctgtaactggtgccgggtggtgtgcagggtagtaatggaggtgctgtgccatgaccagcagtgttggtggccacccagatcccctagggtctctggccagctctgtgtgcccaatcccaattaagtgctttgaggttaaaggctggcacctgtgacctggtattggagccagtcagcccatatggagagccagcagggtctgggagttctccgtcctcttggccaaggccgctgactgactgggctacgagtcaaaagcccagctcccttgcctcaaggaaggacattctctgaggagtaatttatgctctagcactccctttcctctagatcggcctgaggctgggacattacatgaaatcacacccttgctgggcttaatccctttccctaccctcccatttatttactggtgtctctgggagcctttccttaataaacctcttatatctgaaaaaaaaaaa

SEQ ID NO: 418159 - DNA, 1146 bp, Homo sapiens
tcgaatcgtaaccgttcgtacgagaatcgctgtcctctccttgcggccgccagtgtggtggaattcgactatggcagccagggacgccacttcaggcagcctgtcagaggagagcagtgctttggacctgccatcagcgtgtgacataagagattacgtcctgcagggacccagccaagaagccaacagcgaggctttcagttctttggaattccattcttttccttattcttctgatgtggatccagacaccagtaacttaaatatagaacaaaataactcctggaccgctgagaacttctggcttgaccctgctgtgaaaggccagtcagagaaggaagaggatgatggccttcggaaatccctggatagattctatgaaatgtttggccatccacagccaggctctgcaaactcactctctgcatctgtctgcaagtgcctgtctcagaaaatcactcaactaagaggccaggagagccaaaagtatgccctccgcagttttcaaatggcccgggtgatcttcaaccgggacggctgctccgtcttacagaggcattccagggacacccacttctacccactggaggaaggaagtacatctttggatgatgaaaagccaaacccaggactgtcaaaggatattactcatttcctcttgcagcagaatgtaatgaaagacctgtaactggtgccgggtggtgtgcagggtagtaatggaggtgctgtgccatgaccagcagtgttggtggccacccagatcccctagggtctctggccagctctgtgtgcccaatcccaattaagtgctttgaggttaaaggctggcacctgtgacctggtattggagccagtcagcccatatggagagccagcagggtctgggagttctccgtcctcttggccaaggccgctgactgactgggctacgagtcaaaagcccagctcccttgcctcaaggaaggacattctctgaggagtaatttatgctctagcactccctttcctctagatcggcctgaggctgggacattacatgaaatcacacccttgctgggcttaatccctttccctaccctcccatttatttactggtgtctctgggagcctttccttaataaacctcttatatctgaaaaaaaaaaa

SEQ ID NO: 418160 - DNA, 724 bp, Homo sapiens
tgcagcacaccagcatggcacatgtatacatatgtaactaacctgcacattgtgcacatgtaccctaaaacttaaagtataataataatgaaataaaattaaaaaaaaaaaagaaaagtgcctcacctccctgtgaggcttgatgaatattgtggccagtgagtggaaaatgattcttgtcgaatagacagagtattcccaccccaggaatggattaatagaagacacaatttgagcacttctcagaattatctagtatgcctgagtagagactcacatgggtggaatctgtgttgtctcatcagagggaataaaaagacaatgaggtggtaaatgtgaaaaaagcagccttttagaaaaacattattttcaaatacctttataaatcatctaatttatcttcacataatataaagaaaaaactaataaaaattttcgtatttcactttacataatatgttctcccatatttagggatcatacaattgtattgtcttcaaaacacacacacacacacatacacacacacacacacacacacacaccccttccaagaaagctgatccttcagaaaataaatcttatttttaagcacttgggttttcaggccagaaaattaataaatcctaaacctgacccatttttgtaacagctaaaaaggagaagaaaaagctagttaaattttgtgtagaaagatgaccggggatactctagaacagccatg

SEQ ID NO: 418161 - DNA, 4451 bp, Homo sapiens
tgcagcacaccagcatggcacatgtatacatatgtaactaacctgcacattgtgcacatgtaccctaaaacttaaagtataataataatgaaataaaattaaaaaaaaaaaagaaaagtgcctcacctccctgtgaggcttgatgaatattgtggccagtgagtggaaaatgattcttgtcgaatagacagagtattcccaccccaggaatggattaatagaagacacaatttgagcacttctcagaattatctagtatgcctgagtagagactcacatgggtggaatctgtgttgtctcatcagagggaataaaaagacaatgaggtggtaaatgtgaaaaaagcagccttttagaaaaacattattttcaaatacctttataaatcatctaatttatcttcacataatataaagaaaaaactaataaaaattttcgtatttcactttacataatatgttctcccatatttagggatcatacaattgtattgtcttcaaaacacacacacacacacatacacacacacacacacacacacacaccccttccaagaaagctgatccttcagaaaataaatcttatttttaagcacttgggttttcaggccagaaaattaataaatcctaaacctgacccatttttgtaacagctaaaaaggagaagaaaaagctagttaaattttgtgtggatccatttatctcttaaaatatgccaaagcaatttgaggtgggggtggaaacaggtatttatctctcatgcgtgattctctctttatatttctatctgttgggaaaagggtaaagaactattcttggtcattattgatgtattgtgttgccactttgtatggtgcctgctgtgctttatcccgaggcatagcagtaatcgttactatcttgactctttccttcatcacaagagagtaaatatgaagtctgaatgtcgttcctcacccccaaattgtttaactctgcttccaaactagtttaagaaatgcaaaatgggaagagctagcttttcttagatacatttcttccttttttattctttcttgggagacgttaagtataaaagggaaaaagtcagttccttcttctctctctttctctttgggtgacagcaatgctcacttagtaattataaactggaaataggagagtagcttgagcaggttatgatatatctgcccaatgtgtttcattccttcaaacataaactttgagagtaaaagagatttttataatttaaatgccaacgacaggaatggcctcatgttttaactttcaaataataaatggggagttggtatttgggcagagtttgcattttactaatcctatatactttgagcttagtttttagaattgtgtcaaatacatcaacatatcaggattatagtgccaaaaatagttagagtgccttggtcctccctctgtaggcagcaaattgaaactaacatgggaccatgccatccttctagcataatggagaagtctgaactgaggagtatctttgatgaaagacatttaggaccctagaaactaaatcttgtcaccaagactttatagtaaagtagtagcaaaattatttttaaaagactttcttccttttactacccatttcctctcttgggaaagctgatgagcaaattatccaagactcatttctttattaggcaaagtcagaatatttcccctctgaaaatctgaattatgccctcattctttttcaagaaatatctcaaagagcaaatagaattaaacatgacacttgattgtctgattatttggcatgtataaaattatcatgtggcttaatgtgccttaagtgaaaatttaaacttagacctgaaacctttacagttggatgtagcgttgagcttttgcatgttttctgtataataaaccacttttgttttgtttgttttgtcttttaacctacacctttatcattactctaacagatttagggcttctctttctctacagctaagtaagggaatatgtgcaattatgagacatacaaaaaaggaaagggaaaggactttctaagtagcaaatctgtgccatgaagtagatgtggcgtgaagatacagagcctgaggatagtaattttccctgagccacgcacacaggcttttatttcatgccttttctctttctgtgccgtcacctttgagaaaaacgattgcaccttctccaagtctgcctttttaacagctacagttaagttggcaagacttccccagctctgaatatagccatttgccgactccggcctctttgcgagactgactcaaatctgtgatcttctgttcagcatacacatcagcaaagtgagaagatgagcactaaatataggctctattaactttacttttagatttactgccttcaaaaagtgcctattctgagcaacataaacgttattccttacatatgtatgtacacacggtacccagagtcgtactgtgcagccttcaaaaacataccatcagaaagagtaggtgctgagataaggaaactttgccaaatgaaagaaagtcactcacttccaatatcccctctcaagcggctaccgtgaaacgggctgcaaacacattccctgagcatcccttgctgatacagcttctttatatttatatcctactggatggtagcatattgctaaggtttcctgtactctgcttcaagggaatgtaagctttatggcattgaaacatttaggaaaaaaaaagatgtttaagagaattaatagagccgtagtctgtattaggatgtgtgtcatatgtgtgttctataaactaagcatcggtgggtttagagtgttaaagtgtcagcacattccttctccttttgtctctcaggctaacatgagagaaaatagaaaagtcttggctgtggggattggaagctcagggggccaaatgtccttgccagatccttagagcattactttgactcctaaaaatagtagtgtatgttatttgatggcttttgtttccatagttccatcactgacaaaactgtcaatactgttgatggagcagcagcatagcctagagtgatgcattcttacccagaggtggcaataggagagggtccatgtaaataggacgaggtagacagtgcatgattgtaggagaagggttgaagggaggacatgattccaaaaaagatcgttctcaatgtgtcgtctgactcaaccagctggcagattacacttgccaagtcgttccctttccttctaagtcagttggctccatattcacttgaatatgcctctgtttgggcaaagcaagatacctccacttaacctttatccaaggaagctcttggtgtcctcttggtcataaagttgtctcctacctaacccagttttaccaaatggaagtaaaaggggacaaactatggaagatggactccatgccattgcagtcagccaccattctcttttccatataaggagccccattacataagctacgggtgaggttggaacagctatgtttcataatttcaagagtgtgaccaccctgctctagtcatcatcattggatgaatccagttgactctttggcaaaagggtgatacttttcactaaaaatgcctactcttcctgttgatgttccttttctgtttttaccttgtccaatttccacactagtcattttttttattttttagaggatcagattttagcgctggaaaatgagttcaaaaatttcagtgtaatgtcataaggatgttgggatacagagattttttttttccttggaaacaaatggactgggaagaaacacagcatggctttgctctgagtttcaatctgatgattatgaccatggaagatagtcttatgtaaaggttaaatggtgtttacaagtggatagataaggcggagatggtgagaagccgggttttctctatgctaaatgtgtctactaagagcagcacttcctactagctaagcacaatcatagccccaccgtgatgagctgctagtctgaataacattccctgacttagggaaaggcacacaaaaacatataaagaatatgtctattttcatatgtgtgatactgacagagccatggtattcctaaaatataggtttctcttttttcttgtattcttagcaaattgcatttattcactacattacaaaccatcactgatgtatccaaaatagcacacatagttcagtatgaaaataagagaataaaatctgttataagcaagtgatttaggtattttcttttgtgtttatgcattatctgactatattaaaacctgtttttctatttaccttctatcagttttctctaccaattatgttttttcaatgctctataagaatgaatatggaaattatatttcttttttctgtaaaagagttgcaactactttattatatttagaaatccaataaacttcttattacattta

SEQ ID NO: 418162 - DNA, 4393 bp, Homo sapiens
tgcagcacaccagcatggcacatgtatacatatgtaactaacctgcacattgtgcacatgtaccctaaaacttaaagtataataataatgaaataaaattaaaaaaaaaaaagaaaagtgcctcacctccctgtgaggcttgatgaatattgtggccagtgagtggaaaatgattcttgtcgaatagacagagtattcccaccccaggaatggattaatagaagacacaatttgagcacttctcagaattatctagtatgcctgagtagagactcacatgggtggaatctgtgttgtctcatcagagggaataaaaagacaatgaggtggtaaatgtgaaaaaagcagccttttagaaaaacattattttcaaatacctttataaatcatctaatttatcttcacataatataaagaaaaaactaataaaaattttcgtatttcactttacataatatgttctcccatatttagggatcatacaattgtattgtcttcaaaacacacacacacacacatacacacacacacacacacacacacaccccttccaagaaagctgatccttcagaaaataaatcttatttttaagcacttgggttttcaggccagaaaattaataaatcctaaacctgacccatttttgtaacagctaaaaaggagaagaaaaagctagttaaattttgtgtggatccatttatctcttaaaatatgccaaagcaatttgaggtgggggtggaaacaggtatttatctctcatgcgtgattctctctttatatttctatctgttgggaaaagggtaaagaactattcttggtcattattgatgtattgtgttgccactttgtatggtgcctgctgtgctttatcccgaggcatagcagtaatcgttactatcttgactctttccttcatcacaagagagtaaatatgaagtctgaatgtcgttcctcacccccaaattgtttaactctgcttccaaactagtttaagaaatgcaaaatgggaagagctagcttttcttagatacatttcttccttttttattctttcttgggagacgttaagtataaaagggaaaaagtcagttccttcttctctctctttctctttgggtgacagcaatgctcacttagtaattataaactggaaataggagagtagcttgagcaggttatgatatatctgcccaatgtgtttcattccttcaaacataaactttgagagtaaaagagatttttataatttaaatgccaacgacaggaatggcctcatgttttaactttcaaataataaatggggagttggtatttgggcagagtttgcattttactaatcctatatactttgagcttagtttttagaattgtgtcaaatacatcaacatatcaggattatagtgccaaaaatagttagagtgccttggtcctccctctgtaggcagcaaattgaaactaacatgggaccatgccatccttctagcataatggagaagtctgaactgaggagtatctttgatgaaagacatttaggaccctagaaactaaatcttgtcaccaagactttatagtaaagtagtagcaaaattatttttaaaagactttcttccttttactacccatttcctctcttgggaaagctgatgagcaaattatccaagactcatttctttattaggcaaagtcagaatatttcccctctgaaaatctgaattatgccctcattctttttcaagaaatatctcaaagagcaaatagaattaaacatgacacttgattgtctgattatttggcatgtataaaattatcatgtggcttaatgtgccttaagtgaaaatttaaacttagacctgaaacctttacagttggatgtagcgttgagcttttgcatgttttctgtataataaaccacttttgttttgtttgttttgtcttttaacctacacctttatcattactctaacagatttagggcttctctttctctacagctaagtaagggaatatgtgcaattatgagacatacaaaaaaggaaagggaaaggactttctaagtagcaaatctgtgccatgaagtagatgtggcgtgaagatacagagcctgaggatagtaattttccctgagccacgcacacaggcttttatttcatgccttttctctttctgtgccgtcacctttgagaaaaacgattgcaccttctccaagtctgcctttttaacagctacagttaagttggcaagacttccccagctctgaatatagccatttgccgactccggcctctttgcgagactgactcaaatctgtgatcttctgttcagcatacacatcagcaaagtgagaagatgagcactaaatataggctctattaactttacttttagatttactgccttcaaaaagtgcctattctgagcaacataaacgttattccttacatatgtatgtacacacggtacccagagtcgtactgtgcagccttcaaaaacataccatcagaaagagtaggtgctgagataaggaaactttgccaaatgaaagaaagtcactcacttccaatatcccctctcaagcggctaccgtgaaacgggctgcaaacacattccctgagcatcccttgctgatacagcttctttatatttatatcctactggatggtagcatattgctaaggtttcctgtactctgcttcaagggaatgtaagctttatggcattgaaacatttaggatatgtgtgttctataaactaagcatcggtgggtttagagtgttaaagtgtcagcacattccttctccttttgtctctcaggctaacatgagagaaaatagaaaagtcttggctgtggggattggaagctcagggggccaaatgtccttgccagatccttagagcattactttgactcctaaaaatagtagtgtatgttatttgatggcttttgtttccatagttccatcactgacaaaactgtcaatactgttgatggagcagcagcatagcctagagtgatgcattcttacccagaggtggcaataggagagggtccatgtaaataggacgaggtagacagtgcatgattgtaggagaagggttgaagggaggacatgattccaaaaaagatcgttctcaatgtgtcgtctgactcaaccagctggcagattacacttgccaagtcgttccctttccttctaagtcagttggctccatattcacttgaatatgcctctgtttgggcaaagcaagatacctccacttaacctttatccaaggaagctcttggtgtcctcttggtcataaagttgtctcctacctaacccagttttaccaaatggaagtaaaaggggacaaactatggaagatggactccatgccattgcagtcagccaccattctcttttccatataaggagccccattacataagctacgggtgaggttggaacagctatgtttcataatttcaagagtgtgaccaccctgctctagtcatcatcattggatgaatccagttgactctttggcaaaagggtgatacttttcactaaaaatgcctactcttcctgttgatgttccttttctgtttttaccttgtccaatttccacactagtcattttttttattttttagaggatcagattttagcgctggaaaatgagttcaaaaatttcagtgtaatgtcataaggatgttgggatacagagattttttttttccttggaaacaaatggactgggaagaaacacagcatggctttgctctgagtttcaatctgatgattatgaccatggaagatagtcttatgtaaaggttaaatggtgtttacaagtggatagataaggcggagatggtgagaagccgggttttctctatgctaaatgtgtctactaagagcagcacttcctactagctaagcacaatcatagccccaccgtgatgagctgctagtctgaataacattccctgacttagggaaaggcacacaaaaacatataaagaatatgtctattttcatatgtgtgatactgacagagccatggtattcctaaaatataggtttctcttttttcttgtattcttagcaaattgcatttattcactacattacaaaccatcactgatgtatccaaaatagcacacatagttcagtatgaaaataagagaataaaatctgttataagcaagtgatttaggtattttcttttgtgtttatgcattatctgactatattaaaacctgtttttctatttaccttctatcagttttctctaccaattatgttttttcaatgctctataagaatgaatatggaaattatatttcttttttctgtaaaagagttgcaactactttattatatttagaaatccaataaacttcttattacattta

SEQ ID NO: 418163 - DNA, 3518 bp, Homo sapiens
  misc_feature (11)..(11): n is a, c, g, or t
tcataccatgnatcaagagaaagctcaagggaaattttaaaattatgtgaactagtttaagaaatgcaaaatgggaagagctagcttttcttagatacatttcttccttttttattctttcttgggagacgttaagtataaaagggaaaaagtcagttccttcttctctctctttctctttgggtgacagcaatgctcacttagtaattataaactggaaataggagagtagcttgagcaggttatgatatatctgcccaatgtgtttcattccttcaaacataaactttgagagtaaaagagatttttataatttaaatgccaacgacaggaatggcctcatgttttaactttcaaataataaatggggagttggtatttgggcagagtttgcattttactaatcctatatactttgagcttagtttttagaattgtgtcaaatacatcaacatatcaggattatagtgccaaaaatagttagagtgccttggtcctccctctgtaggcagcaaattgaaactaacatgggaccatgccatccttctagcataatggagaagtctgaactgaggagtatctttgatgaaagacatttaggaccctagaaactaaatcttgtcaccaagactttatagtaaagtagtagcaaaattatttttaaaagactttcttccttttactacccatttcctctcttgggaaagctgatgagcaaattatccaagactcatttctttattaggcaaagtcagaatatttcccctctgaaaatctgaattatgccctcattctttttcaagaaatatctcaaagagcaaatagaattaaacatgacacttgattgtctgattatttggcatgtataaaattatcatgtggcttaatgtgccttaagtgaaaatttaaacttagacctgaaacctttacagttggatgtagcgttgagcttttgcatgttttctgtataataaaccacttttgttttgtttgttttgtcttttaacctacacctttatcattactctaacagatttagggcttctctttctctacagctaagtaagggaatatgtgcaattatgagacatacaaaaaaggaaagggaaaggactttctaagtagcaaatctgtgccatgaagtagatgtggcgtgaagatacagagcctgaggatagtaattttccctgagccacgcacacaggcttttatttcatgccttttctctttctgtgccgtcacctttgagaaaaacgattgcaccttctccaagtctgcctttttaacagctacagttaagttggcaagacttccccagctctgaatatagccatttgccgactccggcctctttgcgagactgactcaaatctgtgatcttctgttcagcatacacatcagcaaagtgagaagatgagcactaaatataggctctattaactttacttttagatttactgccttcaaaaagtgcctattctgagcaacataaacgttattccttacatatgtatgtacacacggtacccagagtcgtactgtgcagccttcaaaaacataccatcagaaagagtaggtgctgagataaggaaactttgccaaatgaaagaaagtcactcacttccaatatcccctctcaagcggctaccgtgaaacgggctgcaaacacattccctgagcatcccttgctgatacagcttctttatatttatatcctactggatggtagcatattgctaaggtttcctgtactctgcttcaagggaatgtaagctttatggcattgaaacatttaggaaaaaaaaagatgtttaagagaattaatagagccgtagtctgtattaggatgtgtgtcatatgtgtgttctataaactaagcatcggtgggtttagagtgttaaagtgtcagcacattccttctccttttgtctctcaggctaacatgagagaaaatagaaaagtcttggctgtggggattggaagctcagggggccaaatgtccttgccagatccttagagcattactttgactcctaaaaatagtagtgtatgttatttgatggcttttgtttccatagttccatcactgacaaaactgtcaatactgttgatggagcagcagcatagcctagagtgatgcattcttacccagaggtggcaataggagagggtccatgtaaataggacgaggtagacagtgcatgattgtaggagaagggttgaagggaggacatgattccaaaaaagatcgttctcaatgtgtcgtctgactcaaccagctggcagattacacttgccaagtcgttccctttccttctaagtcagttggctccatattcacttgaatatgcctctgtttgggcaaagcaagatacctccacttaacctttatccaaggaagctcttggtgtcctcttggtcataaagttgtctcctacctaacccagttttaccaaatggaagtaaaaggggacaaactatggaagatggactccatgccattgcagtcagccaccattctcttttccatataaggagccccattacataagctacgggtgaggttggaacagctatgtttcataatttcaagagtgtgaccaccctgctctagtcatcatcattggatgaatccagttgactctttggcaaaagggtgatacttttcactaaaaatgcctactcttcctgttgatgttccttttctgtttttaccttgtccaatttccacactagtcattttttttattttttagaggatcagattttagcgctggaaaatgagttcaaaaatttcagtgtaatgtcataaggatgttgggatacagagattttttttttccttggaaacaaatggactgggaagaaacacagcatggctttgctctgagtttcaatctgatgattatgaccatggaagatagtcttatgtaaaggttaaatggtgtttacaagtggatagataaggcggagatggtgagaagccgggttttctctatgctaaatgtgtctactaagagcagcacttcctactagctaagcacaatcatagccccaccgtgatgagctgctagtctgaataacattccctgacttagggaaaggcacacaaaaacatataaagaatatgtctattttcatatgtgtgatactgacagagccatggtattcctaaaatataggtttctcttttttcttgtattcttagcaaattgcatttattcactacattacaaaccatcactgatgtatccaaaatagcacacatagttcagtatgaaaataagagaataaaatctgttataagcaagtgatttaggtattttcttttgtgtttatgcattatctgactatattaaaacctgtttttctatttaccttctatcagttttctctaccaattatgttttttcaatgctctataagaatgaatatggaaattatatttcttttttctgtaaaagagttgcaactactttattatatttagaaatccaataaacttcttattacattta

SEQ ID NO: 418164 - DNA, 4397 bp, Homo sapiens
tgcagcacaccagcatggcacatgtatacatatgtaactaacctgcacattgtgcacatgtaccctaaaacttaaagtataataataatgaaataaaattaaaaaaaaaaaagaaaagtgcctcacctccctgtgaggcttgatgaatattgtggccagtgagtggaaaatgattcttgtcgaatagacagagtattcccaccccaggaatggattaatagaagacacaatttgagcacttctcagaattatctagtatgcctgagtagagactcacatgggtggaatctgtgttgtctcatcagagggaataaaaagacaatgaggtggtaaatgtgaaaaaagcagccttttagaaaaacattattttcaaatacctttataaatcatctaatttatcttcacataatataaagaaaaaactaataaaaattttcgtatttcactttacataatatgttctcccatatttagggatcatacaattgtattgtcttcaaaacacacacacacacacatacacacacacacacacacacacacaccccttccaagaaagctgatccttcagaaaataaatcttatttttaagcacttgggttttcaggccagaaaattaataaatcctaaacctgacccatttttgtaacagctaaaaaggagaagaaaaagctagttaaattttgtgtggatccatttatctcttaaaatatgccaaagcaatttgaggtgggggtggaaacaggtatttatctctcatgcgtgattctctctttatatttctatctgttgggaaaagggtaaagaactattcttggtcattattgatgtattgtgttgccactttgtatggtgcctgctgtgctttatcccgaggcatagcagtaatcgttactatcttgactctttccttcatcacaagagagtaaatatgaagtctgaatgtcgttcctcacccccaaattgtttaactctgcttccaaactagtttaagaaatgcaaaatgggaagagctagcttttcttagatacatttcttccttttttattctttcttgggagacgttaagtataaaagggaaaaagtcagttccttcttctctctctttctctttgggtgacagcaatgctcacttagtaattataaactggaaataggagagtagcttgagcaggttatgatatatctgcccaatgtgtttcattccttcaaacataaactttgagagtaaaagagatttttataatttaaatgccaacgacaggaatggcctcatgttttaactttcaaataataaatggggagttggtatttgggcagagtttgcattttactaatcctatatactttgagcttagtttttagaattgtgtcaaatacatcaacatatcaggattatagtgccaaaaatagttagagtgccttggtcctccctctgtaggcagcaaattgaaactaacatgggaccatgccatccttctagcataatggagaagtctgaactgaggagtatctttgatgaaagacatttaggaccctagaaactaaatcttgtcaccaagactttatagtaaagtagtagcaaaattatttttaaaagactttcttccttttactacccatttcctctcttgggaaagctgatgagcaaattatccaagactcatttctttattaggcaaagtcagaatatttcccctctgaaaatctgaattatgccctcattctttttcaagaaatatctcaaagagcaaatagaattaaacatgacacttgattgtctgattatttggcatgtataaaattatcatgtggcttaatgtgccttaagtgaaaatttaaacttagacctgaaacctttacagttggatgtagcgttgagcttttgcatgttttctgtataataaaccacttttgttttgtttgttttgtcttttaacctacacctttatcattactctaacagatttagggcttctctttctctacagctaagtaagggaatatgtgcaattatgagacatacaaaaaaggaaagggaaaggactttctaagtagcaaatctgtgccatgaagtagatgtggcgtgaagatacagagcctgaggatagtaattttccctgagccacgcacacaggcttttatttcatgccttttctctttctgtgccgtcacctttgagaaaaacgattgcaccttctccaagtctgcctttttaacagctacagttaagttggcaagacttccccagctctgaatatagccatttgccgactccggcctctttgcgagactgactcaaatctgtgatcttctgttcagcatacacatcagcaaagtgagaagatgagcactaaatataggctctattaactttacttttagatttactgccttcaaaaagtgcctattctgagcaacataaacgttattccttacatatgtatgtacacacggtacccagagtcgtactgtgcagccttcaaaaaaagtcactcacttccaatatcccctctcaagcggctaccgtgaaacgggctgcaaacacattccctgagcatcccttgctgatacagcttctttatatttatatcctactggatggtagcatattgctaaggtttcctgtactctgcttcaagggaatgtaagctttatggcattgaaacatttaggaaaaaaaaagatgtttaagagaattaatagagccgtagtctgtattaggatgtgtgtcatatgtgtgttctataaactaagcatcggtgggtttagagtgttaaagtgtcagcacattccttctccttttgtctctcaggctaacatgagagaaaatagaaaagtcttggctgtggggattggaagctcagggggccaaatgtccttgccagatccttagagcattactttgactcctaaaaatagtagtgtatgttatttgatggcttttgtttccatagttccatcactgacaaaactgtcaatactgttgatggagcagcagcatagcctagagtgatgcattcttacccagaggtggcaataggagagggtccatgtaaataggacgaggtagacagtgcatgattgtaggagaagggttgaagggaggacatgattccaaaaaagatcgttctcaatgtgtcgtctgactcaaccagctggcagattacacttgccaagtcgttccctttccttctaagtcagttggctccatattcacttgaatatgcctctgtttgggcaaagcaagatacctccacttaacctttatccaaggaagctcttggtgtcctcttggtcataaagttgtctcctacctaacccagttttaccaaatggaagtaaaaggggacaaactatggaagatggactccatgccattgcagtcagccaccattctcttttccatataaggagccccattacataagctacgggtgaggttggaacagctatgtttcataatttcaagagtgtgaccaccctgctctagtcatcatcattggatgaatccagttgactctttggcaaaagggtgatacttttcactaaaaatgcctactcttcctgttgatgttccttttctgtttttaccttgtccaatttccacactagtcattttttttattttttagaggatcagattttagcgctggaaaatgagttcaaaaatttcagtgtaatgtcataaggatgttgggatacagagattttttttttccttggaaacaaatggactgggaagaaacacagcatggctttgctctgagtttcaatctgatgattatgaccatggaagatagtcttatgtaaaggttaaatggtgtttacaagtggatagataaggcggagatggtgagaagccgggttttctctatgctaaatgtgtctactaagagcagcacttcctactagctaagcacaatcatagccccaccgtgatgagctgctagtctgaataacattccctgacttagggaaaggcacacaaaaacatataaagaatatgtctattttcatatgtgtgatactgacagagccatggtattcctaaaatataggtttctcttttttcttgtattcttagcaaattgcatttattcactacattacaaaccatcactgatgtatccaaaatagcacacatagttcagtatgaaaataagagaataaaatctgttataagcaagtgatttaggtattttcttttgtgtttatgcattatctgactatattaaaacctgtttttctatttaccttctatcagttttctctaccaattatgttttttcaatgctctataagaatgaatatggaaattatatttcttttttctgtaaaagagttgcaactactttattatatttagaaatccaataaacttcttattacattta

SEQ ID NO: 418165 - DNA, 4397 bp, Homo sapiens
tgcagcacaccagcatggcacatgtatacatatgtaactaacctgcacattgtgcacatgtaccctaaaacttaaagtataataataatgaaataaaattaaaaaaaaaaaagaaaagtgcctcacctccctgtgaggcttgatgaatattgtggccagtgagtggaaaatgattcttgtcgaatagacagagtattcccaccccaggaatggattaatagaagacacaatttgagcacttctcagaattatctagtatgcctgagtagagactcacatgggtggaatctgtgttgtctcatcagagggaataaaaagacaatgaggtggtaaatgtgaaaaaagcagccttttagaaaaacattattttcaaatacctttataaatcatctaatttatcttcacataatataaagaaaaaactaataaaaattttcgtatttcactttacataatatgttctcccatatttagggatcatacaattgtattgtcttcaaaacacacacacacacacatacacacacacacacacacacacacaccccttccaagaaagctgatccttcagaaaataaatcttatttttaagcacttgggttttcaggccagaaaattaataaatcctaaacctgacccatttttgtaacagctaaaaaggagaagaaaaagctagttaaattttgtgtggatccatttatctcttaaaatatgccaaagcaatttgaggtgggggtggaaacaggtatttatctctcatgcgtgattctctctttatatttctatctgttgggaaaagggtaaagaactattcttggtcattattgatgtattgtgttgccactttgtatggtgcctgctgtgctttatcccgaggcatagcagtaatcgttactatcttgactctttccttcatcacaagagagtaaatatgaagtctgaatgtcgttcctcacccccaaattgtttaactctgcttccaaactagtttaagaaatgcaaaatgggaagagctagcttttcttagatacatttcttccttttttattctttcttgggagacgttaagtataaaagggaaaaagtcagttccttcttctctctctttctctttgggtgacagcaatgctcacttagtaattataaactggaaataggagagtagcttgagcaggttatgatatatctgcccaatgtgtttcattccttcaaacataaactttgagagtaaaagagatttttataatttaaatgccaacgacaggaatggcctcatgttttaactttcaaataataaatggggagttggtatttgggcagagtttgcattttactaatcctatatactttgagcttagtttttagaattgtgtcaaatacatcaacatatcaggattatagtgccaaaaatagttagagtgccttggtcctccctctgtaggcagcaaattgaaactaacatgggaccatgccatccttctagcataatggagaagtctgaactgaggagtatctttgatgaaagacatttaggaccctagaaactaaatcttgtcaccaagactttatagtaaagtagtagcaaaattatttttaaaagactttcttccttttactacccatttcctctcttgggaaagctgatgagcaaattatccaagactcatttctttattaggcaaagtcagaatatttcccctctgaaaatctgaattatgccctcattctttttcaagaaatatctcaaagagcaaatagaattaaacatgacacttgattgtctgattatttggcatgtataaaattatcatgtggcttaatgtgccttaagtgaaaatttaaacttagacctgaaacctttacagttggatgtagcgttgagcttttgcatgttttctgtataataaaccacttttgttttgtttgttttgtcttttaacctacacctttatcattactctaacagatttagggcttctctttctctacagctaagtaagggaatatgtgcaattatgagacatacaaaaaaggaaagggaaaggactttctaagtagcaaatctgtgccatgaagtagatgtggcgtgaagatacagagcctgaggatagtaattttccctgagccacgcacacaggcttttatttcatgccttttctctttctgtgccgtcacctttgagaaaaacgattgcaccttctccaagtctgcctttttaacagctacagttaagttggcaagacttccccagctctgaatatagccatttgccgactccggcctctttgcgagactgactcaaatctgtgatcttctgttcagcatacacatcagcaaagtgagaagatgagcactaaatataggctctattaactttacttttagatttactgccttcaaaaagtgcctattctgagcaacataaacgttattccttacatatgtatgtacacacggtacccagagtcgtactgtgcagccttcaaaaacataccatcagaaagagtaggtgctgagataaggaaactttgccaaatgaaagaaagtcactcacttccaatatcccctctcaagcggctaccgtgaaacgggctgcaaacacattccctgagcatcccttgctgatacagcttctttatatttatatcctactggatggtagcatattgctaaggtttcctgtactctgcttcaagggaatgtaagctttatggcattgaaacatttaggaaaaaaaaagatgtttaagagaattaatagagccgtagtctgtattaggatgtgtgtcatatgtgtgttctataaactaagcatcggtgggtttagagtgttaaagtgtcagcacattccttctccttttgtctctcaggctaacatgagagaaaatagaaaagtcttggctgtggggattggaagctcagggggccaaatgtccttgccagatccttagagcattactttgactcctaaaaatagtagtgtatgttatttgatggcttttgtttccatagttccatcactgacaaaactgtcaatactgttgatggagcagcagcatagcctagagtgatgcattcttacccagaggtggcaataggagagggtccatgtaaataggacgaggtagacagtgcatgattgtaggagaagggttgaagggaggacatgattccaaccaagtcgttccctttccttctaagtcagttggctccatattcacttgaatatgcctctgtttgggcaaagcaagatacctccacttaacctttatccaaggaagctcttggtgtcctcttggtcataaagttgtctcctacctaacccagttttaccaaatggaagtaaaaggggacaaactatggaagatggactccatgccattgcagtcagccaccattctcttttccatataaggagccccattacataagctacgggtgaggttggaacagctatgtttcataatttcaagagtgtgaccaccctgctctagtcatcatcattggatgaatccagttgactctttggcaaaagggtgatacttttcactaaaaatgcctactcttcctgttgatgttccttttctgtttttaccttgtccaatttccacactagtcattttttttattttttagaggatcagattttagcgctggaaaatgagttcaaaaatttcagtgtaatgtcataaggatgttgggatacagagattttttttttccttggaaacaaatggactgggaagaaacacagcatggctttgctctgagtttcaatctgatgattatgaccatggaagatagtcttatgtaaaggttaaatggtgtttacaagtggatagataaggcggagatggtgagaagccgggttttctctatgctaaatgtgtctactaagagcagcacttcctactagctaagcacaatcatagccccaccgtgatgagctgctagtctgaataacattccctgacttagggaaaggcacacaaaaacatataaagaatatgtctattttcatatgtgtgatactgacagagccatggtattcctaaaatataggtttctcttttttcttgtattcttagcaaattgcatttattcactacattacaaaccatcactgatgtatccaaaatagcacacatagttcagtatgaaaataagagaataaaatctgttataagcaagtgatttaggtattttcttttgtgtttatgcattatctgactatattaaaacctgtttttctatttaccttctatcagttttctctaccaattatgttttttcaatgctctataagaatgaatatggaaattatatttcttttttctgtaaaagagttgcaactactttattatatttagaaatccaataaacttcttattacattta

SEQ ID NO: 418166 - DNA, 4419 bp, Homo sapiens
tgcagcacaccagcatggcacatgtatacatatgtaactaacctgcacattgtgcacatgtaccctaaaacttaaagtataataataatgaaataaaattaaaaaaaaaaaagaaaagtgcctcacctccctgtgaggcttgatgaatattgtggccagtgagtggaaaatgattcttgtcgaatagacagagtattcccaccccaggaatggattaatagaagacacaatttgagcacttctcagaattatctagtatgcctgagtagagactcacatgggtggaatctgtgttgtctcatcagagggaataaaaagacaatgaggtggtaaatgtgaaaaaagcagccttttagaaaaacattattttcaaatacctttataaatcatctaatttatcttcacataatataaagaaaaaactaataaaaattttcgtatttcactttacataatatgttctcccatatttagggatcatacaattgtattgtcttcaaaacacacacacacacacatacacacacacacacacacacacacaccccttccaagaaagctgatccttcagaaaataaatcttatttttaagcacttgggttttcaggccagaaaattaataaatcctaaacctgacccatttttgtaacagctaaaaaggagaagaaaaagctagttaaattttgtgtggatccatttatctcttaaaatatgccaaagcaatttgaggtgggggtggaaacaggtatttatctctcatgcgtgattctctctttatatttctatctgttgggaaaagggtaaagaactattcttggtcattattgatgtattgtgttgccactttgtatggtgcctgctgtgctttatcccgaggcatagcagtaatcgttactatcttgactctttccttcatcacaagagagtaaatatgaagtctgaatgtcgttcctcacccccaaattgtttaactctgcttccaaactagtttaagaaatgcaaaatgggaagagctagcttttcttagatacatttcttccttttttattctttcttgggagacgttaagtataaaagggaaaaagtcagttccttcttctctctctttctctttgggtgacagcaatgctcacttagtaattataaactggaaataggagagtagcttgagcaggttatgatatatctgcccaatgtgtttcattccttcaaacataaactttgagagtaaaagagatttttataatttaaatgccaacgacaggaatggcctcatgttttaactttcaaataataaatggggagttggtatttgggcagagtttgcattttactaatcctatatactttgagcttagtttttagaattgtgtcaaatacatcaacatatcaggattatagtgccaaaaatagttagagtgccttggtcctccctctgtaggcagcaaattgaaactaacatgggaccatgccatccttctagcataatggagaagtctgaactgaggagtatctttgatgaaagacatttaggaccctagaaactaaatcttgtcaccaagactttatagtaaagtagtagcaaaattatttttaaaagactttcttccttttactacccatttcctctcttgggaaagctgatgagcaaattatccaagactcatttctttattaggcaaagtcagaatatttcccctctgaaaatctgaattatgccctcattctttttcaagaaatatctcaaagagcaaatagaattaaacatgacacttgattgtctgattatttggcatgtataaaattatcatgtggcttaatgtgccttaagtgaaaatttaaacttagacctgaaacctttacagttggatgtagcgttgagcttttgcatgttttctgtataataaaccacttttgttttgtttgttttgtcttttaacctacacctttatcattactctaacagatttagggcttctctttctctacagctaagtaagggaatatgtgcaattatgagacatacaaaaaaggaaagggaaaggactttctaagtagcaaatctgtgccatgaagtagatgtggcgtgaagatacagagcctgaggatagtaattttccctgagccacgcacacaggcttttatttcatgccttttctctttctgtgccgtcacctttgagaaaaacgattgcaccttctccaagtctgcctttttaacagctacagttaagttggcaagacttccccagctctgaatatagccatttgccgactccggcctctttgcgagactgactcaaatctgtgatcttctgttcagcatacacatcagcaaagtgagaagatgagcactaaatataggctctattaactttacttttagatttactgccttcaaaaagtgcctattctgagcaacataaacgttattccttacatatgtatgtacacacggtacccagagtcgtactgtgcagccttcaaaaacataccatcagaaagagtaggtgctgagataaggaaactttgccaaatgaaagaaagtcactcacttccaatatcccctctcaagcggctaccgtgaaacgggctgcaaacacattccctgagcatcccttgctgatacagcttctttatatttatatcctactggatggtagcatattgctaaggtttcctgtactctgcttcaagggaatgtaagctttatggcattgaaacatttaggaaaaaaaaagatgtttaagagaattaatagagccgtagtctgtattaggatgtgtgtcatatgtgtgttctataaactaagcatcggtgggtttagagtgttaaagtgtcagcacattccttctccttttgtctctcaggctaacatgagagaaaatagaaaagtcttggctgtggggattggaagctcagggggccaaatgtccttgccagatccttagagcattactttgactcctaaaaatagtagtgtatgttatttgatggcttttgtttccatagttccatcactgacaaaactgtcaatactgttgatggagcagcagcatagcctagagtgatgcattcttacccagaggtggcaataggagagggtccatgtaaataggacgaggtagacagtgcatgattgtaggagaagggttgaagggaggacatgattccaaaaaagatcgttctcaatgtgtcgtctgactcaaccagctggcagattacacttgccaagtcgttccctttccttctaagtcagttggctccatattcacttgaatatgcctctgtttgggcaaagcaagatacctccacttaacctttatccaaggaagctcttggtgtcctcttggtcataaagttgtctcctacctaacccagttttaccaaatggaagtaaaaggggacaaactatggaagatggactccatgccattgcagtcagccaccattctcttttccatataaggagccccattacataagctacgggtgaggttggaacagctatgtttcataatttcaagagtgtgaccaccctgctctagtcatcatcattggatgaatccagttgactctttggcaaaagggtgatacttttcactaaaaatgcctactcttcctgttgatgttccttttctgtttttaccttgtccaatttccacactagtcattttttttattttttagaggatcagattttagcgctggaaaatgagttcaaaaatttcagtgtaatgtcataaggatgttgggatacagagattttttttttccttggaaacaaatggactgggaagaaacacagcatggctttgctctgagtttcaatctgatgattatgaccatggaagatagtcttatgtaaaggttaaatggtgagaagccgggttttctctatgctaaatgtgtctactaagagcagcacttcctactagctaagcacaatcatagccccaccgtgatgagctgctagtctgaataacattccctgacttagggaaaggcacacaaaaacatataaagaatatgtctattttcatatgtgtgatactgacagagccatggtattcctaaaatataggtttctcttttttcttgtattcttagcaaattgcatttattcactacattacaaaccatcactgatgtatccaaaatagcacacatagttcagtatgaaaataagagaataaaatctgttataagcaagtgatttaggtattttcttttgtgtttatgcattatctgactatattaaaacctgtttttctatttaccttctatcagttttctctaccaattatgttttttcaatgctctataagaatgaatatggaaattatatttcttttttctgtaaaagagttgcaactactttattatatttagaaatccaataaacttcttattacattta

SEQ ID NO: 418167 - DNA, 868 bp, Homo sapiens
agctaaagaagctttaatgctttttattctgttaattaggcttctcatattgaccccaccacatggtgccagaaaccggagttccctttaataagccaatcatccgtataatgtgacccggggccttcttaaagatgaaatggtctgaattaaacacttgccagcataacgtgactcaccattttttttttccttggaaacaaatggactgggaagaaacacagcatggctttgctctgagtttcaatctgatgattatgaccatggaagatagtcttatgtaaaggttaaatggtgtttacaagtggatagataaggcggagatggtgagaagccgggttttctctatgctaaatgtgtctactaagagcagcacttcctactagctaagcacaatcatagccccaccgtgatgagctgctagtctgaataacattccctgacttagggaaaggcacacaaaaacatataaagaatatgtctattttcatatgtgtgatactgacagagccatggtattcctaaaatataggtttctcttttttcttgtattcttagcaaattgcatttattcactacattacaaaccatcactgatgtatccaaaatagcacacatagttcagtatgaaaataagagaataaaatctgttataagcaagtgatttaggtattttcttttgtgtttatgcattatctgactatattaaaacctgtttttctatttaccttctatcagttttctctaccaattatgttttttcaatgctctataagaatgaatatggaaattatatttcttttttctgtaaaagagttgcaactactttattatatttagaaatccaataaacttcttattacattta

SEQ ID NO: 418168 - DNA, 3825 bp, Homo sapiens
tgcagcacaccagcatggcacatgtatacatatgtaactaacctgcacattgtgcacatgtaccctaaaacttaaagtataataataatgaaataaaattaaaaaaaaaaaagaaaagtgcctcacctccctgtgaggcttgatgaatattgtggccagtgagtggaaaatgattcttgtcgaatagacagagtattcccaccccaggaatggattaatagaagacacaatttgagcacttctcagaattatctagtatgcctgagtagagactcacatgggtggaatctgtgttgtctcatcagagggaataaaaagacaatgaggtggtaaatgtgaaaaaagcagccttttagaaaaacattattttcaaatacctttataaatcatctaatttatcttcacataatataaagaaaaaactaataaaaattttcgtatttcactttacataatatgttctcccatatttagggatcatacaattgtattgtcttcaaaacacacacacacacacatacacacacacacacacacacacacaccccttccaagaaagctgatccttcagaaaataaatcttatttttaagcacttgggttttcaggccagaaaattaataaatcctaaacctgacccatttttgtaacagctaaaaaggagaagaaaaagctagttaaattttgtgtggatccatttatctcttaaaatatgccaaagcaatttgaggtgggggtggaaacaggtatttatctctcatgcgtgattctctctttatatttctatctgttgggaaaagggtaaagaactattcttggtcattattgatgtattgtgttgccactttgtatggtgcctgctgtgctttatcccgaggcatagcagtaatcgttactatcttgactctttccttcatcacaagagagtaaatatgaagtctgaatgtcgttcctcacccccaaattgtttaactctgcttccaaactagtttaagaaatgcaaaatgggaagagctagcttttcttagatacatttcttccttttttattctttcttgggagacgttaagtataaaagggaaaaagtcagttccttcttctctctctttctctttgggtgacagcaatgctcacttagtaattataaactggaaataggagagtagcttgagcaggttatgatatatctgcccaatgtgtttcattccttcaaacataaactttgagagtaaaagagatttttataatttaaatgccaacgacaggaatggcctcatgttttaactttcaaataataaatggggagttggtatttgggcagagtttgcattttactaatcctatatactttgagcttagtttttagaattgtgtcaaatacatcaacatatcaggattatagtgccaaaaatagttagagtgccttggtcctccctctgtaggcagcaaattgaaactaacatgggaccatgccatccttctagcataatggagaagtctgaactgaggagtatctttgatgaaagacatttaggaccctagaaactaaatcttgtcaccaagactttatagtaaagtagtagcaaaattatttttaaaagactttcttccttttactacccatttcctctcttgggaaagctgatgagcaaattatccaagactcatttctttattaggcaaagtcagaatatttcccctctgaaaatctgaattatgccctcattctttttcaagaaatatctcaaagagcaaatagaattaaacatgacacttgattgtctgattatttggcatgtataaaattatcatgtggcttaatgtgccttaagtgaaaatttaaacttagacctgaaacctttacagttggatgtagcgttgagcttttgcatgttttctgtataataaaccacttttgttttgtttgttttgtcttttaacctacacctttatcattactctaacagatttagggcttctctttctctacagctaagtaagggaatatgtgcaattatgagacatacaaaaaaggaaagggaaaggactttctaagtagcaaatctgtgccatgaagtagatgtggcgtgaagatacagagcctgaggatagtaattttccctgagccacgcacacaggcttttatttcatgccttttctctttctgtgccgtcacctttgagaaaaacgattgcaccttctccaagtctgcctttttaacagctacagttaagttggcaagacttccccagctctgaatatagccatttgccgactccggcctctttgcgagactgactcaaatctgtgatcttctgttcagcatacacatcagcaaagtgagaagatgagcactaaatataggctctattaactttacttttagatttactgccttcaaaaagtgcctattctgagcaacataaacgttattccttacatatgtatgtacacacggtacccagagtcgtactgtgcagccttcaaaaacataccatcagaaagagtaggtgctgagataaggaaactttgccaaatgaaagaaagtcactcacttccaatatcccctctcaagcggctaccgtgaaacgggctgcaaacacattccctgagcatcccttgctgatacagcttctttatatttatatcctactggatggtagcatattgctaaggtttcctgtactctgcttcaagggaatgtaagctttatggcattgaaacatttaggaaaaaaaaagatgtttaagagaattaatagagccgtagtctgtattaggatgtgtgtcatatgtgtgttctataaactaagcatcggtgggtttagagtgttaaagtgtcagcacattccttctccttttgtctctcaggctaacatgagagaaaatagaaaagtcttggctgtggggattggaagctcagggggccaaatgtccttgccagatccttagagcattactttgactcctaaaaatagtagtgtatgttatttgatggcttttgtttccatagttccatcactgacaaaactgtcaatactgttgatggagcagcagcatagcctagagtgatgcattcttacccagaggtggcaataggagagggtccatgtaaataggacgaggtagacagtgcatgattgtaggagaagggttgaagggaggacatgattccaaaaaagatcgttctcaatgtgtcgtctgactcaaccagctggcagattacacttgccaagtcgttccctttccttctaagtcagttggctccatattcacttgaatatgcctctgtttgggcaaagcaagatacctccacttaacctttatccaaggaagctcttggtgtcctcttggtcataaagttgtctcctacctaacccagttttaccaaatggaagtaaaaggggacaaactatggaagatggactccatgccattgcagtcagccaccattctcttttccatataaggagccccattacataagctacgggtgaggttggaacagctatgtttcataatttcaagagtgtgaccaccctgctctagtcatcatcattggatgaatccagttgactctttggcaaaagggtgatacttttcactaaaaatgcctactcttcctgttgatgttccttttctgtttttaccttgtccaatttccacactagtcattttttttattttttagaggatcagattttagcgctggaaaatgagttcaaaaatttcagtgtaatgtcataaggatgttgggatacagagattttttttttccttggaaacaaaaaaatcatctgtatcccatcaccctatgcataattcgt

SEQ ID NO: 418169 - DNA, 3474 bp, Homo sapiens
tgcagcacaccagcatggcacatgtatacatatgtaactaacctgcacattgtgcacatgtaccctaaaacttaaagtataataataatgaaataaaattaaaaaaaaaaaagaaaagtgcctcacctccctgtgaggcttgatgaatattgtggccagtgagtggaaaatgattcttgtcgaatagacagagtattcccaccccaggaatggattaatagaagacacaatttgagcacttctcagaattatctagtatgcctgagtagagactcacatgggtggaatctgtgttgtctcatcagagggaataaaaagacaatgaggtggtaaatgtgaaaaaagcagccttttagaaaaacattattttcaaatacctttataaatcatctaatttatcttcacataatataaagaaaaaactaataaaaattttcgtatttcactttacataatatgttctcccatatttagggatcatacaattgtattgtcttcaaaacacacacacacacacatacacacacacacacacacacacacaccccttccaagaaagctgatccttcagaaaataaatcttatttttaagcacttgggttttcaggccagaaaattaataaatcctaaacctgacccatttttgtaacagctaaaaaggagaagaaaaagctagttaaattttgtgtggatccatttatctcttaaaatatgccaaagcaatttgaggtgggggtggaaacaggtatttatctctcatgcgtgattctctctttatatttctatctgttgggaaaagggtaaagaactattcttggtcattattgatgtattgtgttgccactttgtatggtgcctgctgtgctttatcccgaggcatagcagtaatcgttactatcttgactctttccttcatcacaagagagtaaatatgaagtctgaatgtcgttcctcacccccaaattgtttaactctgcttccaaactagtttaagaaatgcaaaatgggaagagctagcttttcttagatacatttcttccttttttattctttcttgggagacgttaagtataaaagggaaaaagtcagttccttcttctctctctttctctttgggtgacagcaatgctcacttagtaattataaactggaaataggagagtagcttgagcaggttatgatatatctgcccaatgtgtttcattccttcaaacataaactttgagagtaaaagagatttttataatttaaatgccaacgacaggaatggcctcatgttttaactttcaaataataaatggggagttggtatttgggcagagtttgcattttactaatcctatatactttgagcttagtttttagaattgtgtcaaatacatcaacatatcaggattatagtgccaaaaatagttagagtgccttggtcctccctctgtaggcagcaaattgaaactaacatgggaccatgccatccttctagcataatggagaagtctgaactgaggagtatctttgatgaaagacatttaggaccctagaaactaaatcttgtcaccaagactttatagtaaagtagtagcaaaattatttttaaaagactttcttccttttactacccatttcctctcttgggaaagctgatgagcaaattatccaagactcatttctttattaggcaaagtcagaatatttcccctctgaaaatctgaattatgccctcattctttttcaagaaatatctcaaagagcaaatagaattaaacatgacacttgattgtctgattatttggcatgtataaaattatcatgtggcttaatgtgccttaagtgaaaatttaaacttagacctgaaacctttacagttggatgtagcgttgagcttttgcatgttttctgtataataaaccacttttgttttgtttgttttgtcttttaacctacacctttatcattactctaacagatttagggcttctctttctctacagctaagtaagggaatatgtgcaattatgagacatacaaaaaaggaaagggaaaggactttctaagtagcaaatctgtgccatgaagtagatgtggcgtgaagatacagagcctgaggatagtaattttccctgagccacgcacacaggcttttatttcatgccttttctctttctgtgccgtcacctttgagaaaaacgattgcaccttctccaagtctgcctttttaacagctacagttaagttggcaagacttccccagctctgaatatagccatttgccgactccggcctctttgcgagactgactcaaatctgtgatcttctgttcagcatacacatcagcaaagtgagaagatgagcactaaatataggctctattaactttacttttagatttactgccttcaaaaagtgcctattctgagcaacataaacgttattccttacatatgtatgtacacacggtacccagagtcgtactgtgcagccttcaaaaacataccatcagaaagagtaggtgctgagataaggaaactttgccaaatgaaagaaagtcactcacttccaatatcccctctcaagcggctaccgtgaaacgggctgcaaacacattccctgagcatcccttgctgatacagcttctttatatttatatcctactggatggtagcatattgctaaggtttcctgtactctgcttcaagggaatgtaagctttatggcattgaaacatttaggaaaaaaaaagatgtttaagagaattaatagagccgtagtctgtattaggatgtgtgtcatatgtgtgttctataaactaagcatcggtgggtttagagtgttaaagtgtcagcacattccttctccttttgtctctcaggctaacatgagagaaaatagaaaagtcttggctgtggggattggaagctcagggggccaaatgtccttgccagatccttagagcattactttgactcctaaaaatagtagtgtatgttatttgatggcttttgtttccatagttccatcactgacaaaactgtcaatactgttgatggagcagcagcatagcctagagtgatgcattcttacccagaggtggcaataggagagggtccatgtaaataggacgaggtagacagtgcatgattgtaggagaagggttgaagggaggacatgattccaaaaaagatcgttctcaatgtgtcgtctgactcaaccagctggcagattacacttgccaagtcgttccctttccttctaagtcagttggctccatattcacttgaatatgcctctgtttgggcaaagcaagatacctccacttaacctttatccaaggaagctcttggtgtcctcttggtcataaagttgtctcctacctaacccagttttaccaaatggaagtaaaaggggacaaactatggaagatggactccatgccattgcagtcagcagtcagcgacatgatggaccgagctgata

SEQ ID NO: 418170 - DNA, 1932 bp, Homo sapiens
taaaatattaacacctcaggctacctgctgtattctgtcccattgacccctggaattggatttactgcaagtgattgataattcaattatgtggcttttcccctttaatcttgccatttaaattacagtagaaagacaaaatcaagtaaaataaagtgttagataatagaaagagtgttaagaccagcccacttttctcatgtttatgttctttcatttggaccaagaatctccgcatggaggttgatttgccactggggactttggctaagactattaggtttgctttcaactagatgttcctgagacaagcagagggacactgcaattccccttccatgcctgctgttctcccccatgtaagtcttctttgaaattaacggatgtgtctcctttggaacagccccataacaaaagagaactactgatctgagcataggaaagtagaggctctaccacttttcagttgaaaaagcaagactttctctgtgtttctgaaacaaggcataatgttgtcacagaatcagagatccagtctcacttttccacaaatctccaaatctccagtcttatcttgtgtgctctaatggtttggttcaatccctttccaactcttgttttcaaagcatggggcctgagtgttctccactcctcctaagaaaggagcttgggtggaagggaccatgctgacctcctccatcagagggctcttccagtagtattctcggatgcaacctccatttctcagttaccattatttcctgtatcagctttgtccttcctggagggatgcacagtgatccggcccaccactgttgttgtcttgtgcttctgctctttcctatggtttcaggttattttctgggtttcccctattcttcttttatttctttttttttttatatttgctttcctttctactgcttttagatttgcaggagatgcaagtttcagctcaatgtttggcttctctcaatatggaaatttcagaaggacagaggagaggagggaggaagaagaaagtatactcctccagaatttcagtgatctgttgtggcagtccagtggaaggaaggtcttttgaggtcacttagaagcatctttttgggacatccttttgggatctctgtaggctaggcatctcatatcttgagactcacccccagcctccaagcctctctccatttctctaacctatgcattttagagcgagaggaccgcctcactagtgtcaccatcctgccttttctaaaacatgcaggctcacacattctactcctgcttaatgtctgtgttaaacgttttctaaccatttttgttttatttttctgaaaaagttaacccctcccaactcctcacacattggctcttcctcttgagccacaaagttttgattcttgcgatgtatgtgccttattttatgttaatcttgtcaatgagagggaccagttggtgttgcccaatcagcactccaaggctgtgtgtgcaccagccagagagcgcacggtggtagcagagtcgaggctgtcttgtatcctggtttcatgtgttgttttgaactgataggaggatgttctcttctgacaagttacccttgtgtatcctgcagacatgtaaaataaaatacaagttcatttttttcaccttttttagatttttttaaaaaataaaatgtgtaatcctttttttaaaagaaacacatgtaaatacatttaagtattgtaggcatagcgttcagatgtgactggcccaggcgttcctcggacaagcctgcattccccgtgatcacgcccacctcaagcccaggggctgcagcccagccacagatgaactctacctttgctttcagaaccacttagtccttttgtaacaaagaaaaaaaaatgtttcttacaatgtcaataaaaaattctttgtatggaaaaaaaaaat

SEQ ID NO: 418171 - DNA, 945 bp, Homo sapiens
agatgaggaaatacagactaagaagtctaccagcaagaaggcaagaacccaggacttaacactcattcttctgattaatccatccataagaactccctgagcaccaaggtgatgttttaacttcatgttaaaaacccaggcctcctttatacagttcaagaagcagaaaatcaaggtcttttagcgtcttatctagcacacttggtggccttaagtattttgagtttatgttgctttaaattgcacagtttaattgctctcagttccctaacacttaatttttttacatttatatattttttcagtaacacccgaaaaaacaagaaagtaggaaacattgtctcctagctcattatttgaccgtagtgttggaagtagttcatctgatagaaaatggtttctttctagccaaggttcagaaattgcctctcaaggacgggaactggctaatcatttccaaagtgaaggaactccagttatgatcggtaagctgtttcagacactgtttttggtagagtgagtaatatgcaaaacttatcattgatataaatatttaatgttgcataaaatcagtcatttaaaaaattttgaaattaacttttacaccatatgtatggatctctggatattgaaaaaaatttctaaggtggcttaaaggttacaaaaaagattataataaccagaagaagtaaaggctgagaaatggtagctatgttcaaacatttaaagagctgagaacagtattaaaaagaggaaacggtcactcagctgagcttcgtaagtcatgactctgtcataactgggctggctttgtgagattttgcaattacttacctctgtggattttatttgtaaaataagaagattggattagctgatctaaagatgcttaattctttgaagaacaagacctgtcctgtgatgacagaaggcaaggtgagacta

SEQ ID NO: 418172 - DNA, 1588 bp, Homo sapiens
cccgggccccgcccctgggccgtgcggtgacgccacttcagggccggcccgcggaacttttgggcaggtgtcagcgcccgtgtcaccgccacgtcgcggacatggtgatttcagaaagtatggatatactcttcagaataagaggaggccttgatttggcttttcagctagctactcctaatgaaatttttctcaagaaggcactgaaacatgtgttgagtgacctgtcaactaagctgtcttcaaacgcccttgtgttcagaatttgccacagttcagtgtatatatggcctagcagtgacataaacaccattcctggagaactgactgatgcttctgcttgtaagaacatactgcgctttattcaatttgagccagaagaagatataaaaagaaaattcatgagaaagaaggacaaaaagttatcagacatgcatcaaatagtaaatatagatcttatgctggaaatgtcaacctccctggcagctgtaacgcccatcattgaaagggaaagcggaggacaccattatgttaatatgactttacctgtcgatgcagttatatctgttgctccagaagaaacatggggaaaagttcgtaaactcctggttgatgcaattcataatcaactaactgacatggaaaaatgtattttgaaatatatgaaaggaacatctattgtggtccctgaaccactgcactttttattaccagggaaaaaaaatcttgtaacaatttcatatccttcaggaataccagatggccagctgcaggcctataggaaggagttacatgatcttttcaatctgcctcacgacagaccctatttcaaaaggtctaatgcttatcactttccagatgagccatacaaagatggttacattagaaatccacatacttaccttaatccacctaacatggagactggtatgatttatgtggtccagggcatatatggctatcatcattatatgcaggatcgcatagatgacaatggctggggctgtgcttatcgatctctgcagactatctgctcttggttcaaacatcagggatacacagagaggtccattccaacacacagagaaattcagcaggctctagtcgatgccggggacaaaccagcaacatttgtcggatcgcggcaatggattggatctattgaggtgcagctggtactaaaccaattgatcggtataacgtcaaaaatcctgtttgtcagccaaggttcagaaattgcctctcaaggacgggaactggctaatcatttccaaagtgaaggaactccagttatgatcgggggaggagttttggcccacacaatactaggagttgcatggaatgagattacagggcagataaagtttctgattctagatccacattataccggtgctgaagacctgcaagttattttggaaaagggctggtgcggatggaagggcccagatttttggaacaaggatgcatactataacttatgtcttcctcagcgaccaaatatgatttaaaatatcttggagtcaaagactgcagtagagtggtattataaatttgtgaataaagaatcagtttaatttttcacatt

SEQ ID NO: 418173 - DNA, 2452 bp, Homo sapiens
cccgggccccgcccctgggccgtgcggtgacgccacttcagggccggcccgcggaacttttgggcaggtgtcagcgcccgtgtcaccgccacgtcgcggacatggtgatttcagaaagtatggatatactcttcagaataagaggaggccttgatttggcttttcagctagctactcctaatgaaatttttctcaagaaggcactgaaacatgtgttgagtgacctgtcaactaagctgtcttcaaacgcccttgtgttcagaatttgccacagttcagtgtatatatggcctagcagtgacataaacaccattcctggagaactgactgatgcttctgcttgtaagaacatactgcgctttattcaatttgagccagaagaagatataaaaagaaaattcatgagaaagaaggacaaaaagttatcagacatgcatcaaatagtaaatatagatcttatgctggaaatgtcaacctccctggcagctgtaacgcccatcattgaaagggaaagcggaggacaccattatgttaatatgactttacctgtcgatgcagttatatctgttgctccagaagaaacatggggaaaagttcgtaaactcctggttgatgcaattcataatcaactaactgacatggaaaaatgtattttgaaatatatgaaaggaacatctattgtggtccctgaaccactgcactttttattaccagggaaaaaaaatcttgtaacaatttcatatccttcaggaataccagatggccagctgcaggcctataggaaggagttacatgatcttttcaatctgcctcacgacagaccctatttcaaaaggtctaatgcttatcactttccagatgagccatacaaagatggttacattagaaatccacatacttaccttaatccacctaacatggagactggtatgatttatgtggtccagggcatatatggctatcatcattatatgcaggatcgcatagatgacaatggctggggctgtgcttatcgatctctgcagactatctgctcttggttcaaacatcagggatacacagagaggtccattccaacacacagagaaattcagcaggctctagtcgatgccggggacaaaccagcaacatttgtcggatcgcggcaatggattggatctattgaggtgcagctggtactaaaccaattgatcggtataacgtcaaaaatcctgtttgtcagccaaggttcagaaattgcctctcaaggacgggaactggctaatcatttccaaagtgaaggaactccagttatgatcgggggaggagttttggcccacacaatactaggagttgcatggaatgagattacagggcagataaagtttctgattctagatccacattataccggtgctgaagacctgcaagttattttggaaaagggctggtgcggatggaagggcccagatttttggaacaaggatgcatactataacttatgtcttcctcagcgaccaaatatgatttaaaatatcttggagtcaaagactgcagtagagtggtattataaatttgtgaataaagaatcagtttaatttttcacattaaatcctggttctagtttgacgatttaaattatgacctttttcaaaggttgtaaatactgcacggagaatgtattttttagacgttcctttaataacttaaaagacaaagcatacacaaccagcatattataggcatgtaaatacatgtgttcttaaatggatcttcacttggaagaaagtttttcatccttctcagaaggagattagacacaacatatggtaaagccaaaagcaggagcttatagatttgcatgaaatgaaggcgttcttcagacttcttcataacccacgtgacatctgtttttaaaaacacgttaacattaaaaacttttttttaaaaagagttttatccccaaacttccaccatgcagtcccatttttggtctctagactctggtaaatataaccagtactaaaatgttaatgagaatgaaacaatactactagaaatacgagtgtcagtattaaatggaataataaatgctatgcaaacaagagatcactgcgggaggaaaaaagcagcagctctgagttacttaccagcacttccttttcccactggtattttctacacttccgagactccgtttctgtctgagcacggcaacacaatcattcctgtcagggtgttcacttgcttttattgtctgcatacatttaattgttgtaagaaacttggcacagtctggaaatccacatgaccaagcgagatcttcagctgtttgcccgttcttattacataaactgaaaacaggataaaaacggagtgaaatgaaacattgaacttaagtctttttttttatatcttacaagggaattttgggctcatacaaatgttggttgcagaacagaagaggtaaagg

SEQ ID NO: 418174 - DNA, 1999 bp, Homo sapiens
cccgggccccgcccctgggccgtgcggtgacgccacttcagggccggcccgcggaacttttgggcaggtgtcagcgcccgtgtcaccgccacgtcgcggacatggtgatttcagaaagtatggatatactcttcagaataagaggaggccttgatttggcttttcagctagctactcctaatgaaatttttctcaagaaggcactgaaacatgtgttgagtgacctgtcaactaagctgtcttcaaacgcccttgtgttcagaatttgccacagttcagtgtatatatggcctagcagtgacataaacaccattcctggagaactgactgatgcttctgcttgtaagaacatactgcgctttattcaatttgagccagaagaagatataaaaagaaaattcatgagaaagaaggacaaaaagttatcagacatgcatcaaatagtaaatatagatcttatgctggaaatgtcaacctccctggcagctgtaacgcccatcattgaaagggaaagcggaggacaccattatgttaatatgactttacctgtcgatgcagttatatctgttgctccagaagaaacatggggaaaagttcgtaaactcctggttgatgcaattcataatcaactaactgacatggaaaaatgtattttgaaatatatgaaaggaacatctattgtggtccctgaaccactgcactttttattaccagggaaaaaaaatcttgtaacaatttcatatccttcaggaataccagatggccagctgcaggcctataggaaggagttacatgatcttttcaatctgcctcacgacagaccctatttcaaaaggtctaatgcttatcactttccagatgagccatacaaagatggttacattagaaatccacatacttaccttaatccacctaacatggagactggtatgatttatgtggtccagggcatatatggctatcatcattatatgcaggatcgcatagatgacaatggctggggctgtgcttatcgatctctgcagactatctgctcttggttcaaacatcagggatacacagagaggtccattccaacacacagagaaattcagcaggctctagtcgatgccggggacaaaccagcaacatttgtcggatcgcggcaatggattggatctattgaggtgcagctggtactaaaccaattgatcggtataacgtcaaaaatcctgtttgtcagccaaggttcagaaattgcctctcaaggacgggaactggctaatcatttccaaagtgaaggaactccagttatgatcgggggaggagttttggcccacacaatactaggagttgcatggaatgagattacagggcagataaagtttctgattctagatccacattataccggtgctgaagacctgcaagttattttggaaaagggctggtgcggatggaagggcccagatttttggaacaaggatgcatactataacttatgtcttcctcagcgaccaaatatgatttaaaatatcttggagtcaaagactgcagtagagtggtattataaatttgtgaataaagaatcagtttaatttttcacattaaatcctggttctagtttgacgatttaaattatgacctttttcaaaggttgtaaatactgcacggagaatgtattttttagacgttcctttaataacttaaaagacaaagcatacacaaccagcatattataggcatgtaaatacatgtgttcttaaatggatcttcacttggaagaaagtttttcatccttctcagaaggagattagacacaacatatggtaaagaccgtcgcgacggtctttacctgacaatgaccccagggcggagatcgaaattcttcttcacaatctctaatagctctctctcactcttctgagaggtaccataatggtaaatggagatagataatggatgagtaactccaatagcataagagacctgtactagaaccctaccggcacagacgttc

SEQ ID NO: 418175 - DNA, 2555 bp, Homo sapiens
cccgggccccgcccctgggccgtgcggtgacgccacttcagggccggcccgcggaacttttgggcaggtgtcagcgcccgtgtcaccgccacgtcgcggacatggtgatttcagaaagtatggatatactcttcagaataagaggaggccttgatttggcttttcagctagctactcctaatgaaatttttctcaagaaggcactgaaacatgtgttgagtgacctgtcaactaagctgtcttcaaacgcccttgtgttcagaatttgccacagttcagtgtatatatggcctagcagtgacataaacaccattcctggagaactgactgatgcttctgcttgtaagaacatactgcgctttattcaatttgagccagaagaagatataaaaagaaaattcatgagaaagaaggacaaaaagttatcagacatgcatcaaatagtaaatatagatcttatgctggaaatgtcaacctccctggcagctgtaacgcccatcattgaaagggaaagcggaggacaccattatgttaatatgactttacctgtcgatgcagttatatctgttgctccagaagaaacatggggaaaagttcgtaaactcctggttgatgcaattcataatcaactaactgacatggaaaaatgtattttgaaatatatgaaaggaacatctattgtggtccctgaaccactgcactttttattaccagggaaaaaaaatcttgtaacaatttcatatccttcaggaataccagatggccagctgcaggcctataggaaggagttacatgatcttttcaatctgcctcacgacagaccctatttcaaaaggtctaatgcttatcactttccagatgagccatacaaagatggttacattagaaatccacatacttaccttaatccacctaacatggagactggtatgatttatgtggtccagggcatatatggctatcatcattatatgcaggatcgcatagatgacaatggctggggctgtgcttatcgatctctgcagactatctgctcttggttcaaacatcagggatacacagagaggtccattccaacacacagagaaattcagcaggctctagtcgatgccggggacaaaccagcaacatttgtcggatcgcggcaatggattggatctattgaggtgcagctggtactaaaccaattgatcggtataacgtcaaaaatcctgtttgtcagtaacacccgaaaaaacaagaaagtaggaaacattgtctcctagctcattatttgaccgtagtgttggaagtagttcatctgatagaaaatggtttctttctagccaaggttcagaaattgcctctcaaggacgggaactggctaatcatttccaaagtgaaggaactccagttatgatcgggggaggagttttggcccacacaatactaggagttgcatggaatgagattacagggcagataaagtttctgattctagatccacattataccggtgctgaagacctgcaagttattttggaaaagggctggtgcggatggaagggcccagatttttggaacaaggatgcatactataacttatgtcttcctcagcgaccaaatatgatttaaaatatcttggagtcaaagactgcagtagagtggtattataaatttgtgaataaagaatcagtttaatttttcacattaaatcctggttctagtttgacgatttaaattatgacctttttcaaaggttgtaaatactgcacggagaatgtattttttagacgttcctttaataacttaaaagacaaagcatacacaaccagcatattataggcatgtaaatacatgtgttcttaaatggatcttcacttggaagaaagtttttcatccttctcagaaggagattagacacaacatatggtaaagccaaaagcaggagcttatagatttgcatgaaatgaaggcgttcttcagacttcttcataacccacgtgacatctgtttttaaaaacacgttaacattaaaaacttttttttaaaaagagttttatccccaaacttccaccatgcagtcccatttttggtctctagactctggtaaatataaccagtactaaaatgttaatgagaatgaaacaatactactagaaatacgagtgtcagtattaaatggaataataaatgctatgcaaacaagagatcactgcgggaggaaaaaagcagcagctctgagttacttaccagcacttccttttcccactggtattttctacacttccgagactccgtttctgtctgagcacggcaacacaatcattcctgtcagggtgttcacttgcttttattgtctgcatacatttaattgttgtaagaaacttggcacagtctggaaatccacatgaccaagcgagatcttcagctgtttgcccgttcttattacataaactgaaaacaggataaaaacggagtgaaatgaaacattgaacttaagtctttttttttatatcttacaagggaattttgggctcatacaaatgttggttgcagaacagaagaggtaaagg

SEQ ID NO: 418176 - DNA, 2411 bp, Homo sapiens
cccgggccccgcccctgggccgtgcggtgacgccacttcagggccggcccgcggaacttttgggcaggtgtcagcgcccgtgtcaccgccacgtcgcggacatggtgatttcagaaagtatggatatactcttcagaataagaggaggccttgatttggcttttcagctagctactcctaatgaaatttttctcaagaaggcactgaaacatgtgttgagtgacctgtcaactaagctgtcttcaaacgcccttgtgttcagaatttgccacagttcagtgtatatatggcctagcagtgacataaacaccattcctggagaactgactgatgcttctgcttgtaagaacatactgcgctttattcaatttgagccagaagaagatataaaaagaaaattcatgagaaagaaggacaaaaagttatcagacatgctccctggcagctgtaacgcccatcattgaaagggaaagcggaggacaccattatgttaatatgactttacctgtcgatgcagttatatctgttgctccagaagaaacatggggaaaagttcgtaaactcctggttgatgcaattcataatcaactaactgacatggaaaaatgtattttgaaatatatgaaaggaacatctattgtggtccctgaaccactgcactttttattaccagggaaaaaaaatcttgtaacaatttcatatccttcaggaataccagatggccagctgcaggcctataggaaggagttacatgatcttttcaatctgcctcacgacagaccctatttcaaaaggtctaatgcttatcactttccagatgagccatacaaagatggttacattagaaatccacatacttaccttaatccacctaacatggagactggtatgatttatgtggtccagggcatatatggctatcatcattatatgcaggatcgcatagatgacaatggctggggctgtgcttatcgatctctgcagactatctgctcttggttcaaacatcagggatacacagagaggtccattccaacacacagagaaattcagcaggctctagtcgatgccggggacaaaccagcaacatttgtcggatcgcggcaatggattggatctattgaggtgcagctggtactaaaccaattgatcggtataacgtcaaaaatcctgtttgtcagccaaggttcagaaattgcctctcaaggacgggaactggctaatcatttccaaagtgaaggaactccagttatgatcgggggaggagttttggcccacacaatactaggagttgcatggaatgagattacagggcagataaagtttctgattctagatccacattataccggtgctgaagacctgcaagttattttggaaaagggctggtgcggatggaagggcccagatttttggaacaaggatgcatactataacttatgtcttcctcagcgaccaaatatgatttaaaatatcttggagtcaaagactgcagtagagtggtattataaatttgtgaataaagaatcagtttaatttttcacattaaatcctggttctagtttgacgatttaaattatgacctttttcaaaggttgtaaatactgcacggagaatgtattttttagacgttcctttaataacttaaaagacaaagcatacacaaccagcatattataggcatgtaaatacatgtgttcttaaatggatcttcacttggaagaaagtttttcatccttctcagaaggagattagacacaacatatggtaaagccaaaagcaggagcttatagatttgcatgaaatgaaggcgttcttcagacttcttcataacccacgtgacatctgtttttaaaaacacgttaacattaaaaacttttttttaaaaagagttttatccccaaacttccaccatgcagtcccatttttggtctctagactctggtaaatataaccagtactaaaatgttaatgagaatgaaacaatactactagaaatacgagtgtcagtattaaatggaataataaatgctatgcaaacaagagatcactgcgggaggaaaaaagcagcagctctgagttacttaccagcacttccttttcccactggtattttctacacttccgagactccgtttctgtctgagcacggcaacacaatcattcctgtcagggtgttcacttgcttttattgtctgcatacatttaattgttgtaagaaacttggcacagtctggaaatccacatgaccaagcgagatcttcagctgtttgcccgttcttattacataaactgaaaacaggataaaaacggagtgaaatgaaacattgaacttaagtctttttttttatatcttacaagggaattttgggctcatacaaatgttggttgcagaacagaagaggtaaagg

SEQ ID NO: 418177 - DNA, 2089 bp, Homo sapiens
cccgggccccgcccctgggccgtgcggtgacgccacttcagggccggcccgcggaacttttgggcaggtgtcagcgcccgtgtcaccgccacgtcgcggacatggtgatttcagaaagtatggatatactcttcagaataagaggaggccttgatttggcttttcagctagctactcctaatgaaatttttctcaagaaggcactgaaacatgtgttgagtgacctgtcaactaagctgtcttcaaacgcccttgtgttcagaatttgccacagttcagtgtatatatggcctagcagtgacataaacaccattcctggagaactgactgatgcttctgcttgtaagaacatactgcgctttattcaatttgagccagaagaagatataaaaagaaaattcatgagaaagaaggacaaaaagttatcagacatgcatcaaatagtaaatatagatcttatgctggaaatgtcaacctccctggcagctgtaacgcccatcattgaaagggaaagcggaggacaccattatgttaatatgactttacctgtcgatgcagttatatctgttgctccagaagaaacatggggaaaagttcgtaaactcctggttgatgcaattcataatcaactaactgacatggaaaaatgtattttgaaatatatgaaaggaacatctattgtggtccctgaaccactgcactttttattaccagggaaaaaaaatcttgtaacaatttcatatccttcaggaataccagatggccagctgcaggcctataggaaggagttacatgatcttttcaatctgcctcacgacagaccctatttcaaaaggtctaatgcttatcactttccagatgagccatacaaagatggttacattagaaatccacatacttaccttaatccacctaacatggagactggtatgatttatgtggtccagggcatatatggctatcatcattatatgcaggatcgcatagatgacaatggctggggctgtgcttatcgatctctgcagactatctgctcttggttcaaacatcagggatacacagagaggtccattccaacacacagagaaattcagcaggctctagtcgatgccggggacaaaccagcaacatttgtcggatcgcggcaatggattggatctattgaggtgcagctggtactaaaccaattgatcggtataacgtcaaaaatcctgtttgtcagccaaggttcagaaattgcctctcaaggacgggaactggctaatcatttccaaagtgaaggaactccagttatgatcgggggaggagttttggcccacacaatactaggagttgcatggaatgagattacagggcagataaagtttctgattctagatccacattataccggtgctgaagacctgcaagttattttggaaaagcatttggaatttgaagtctataaaaggttttttgactggtgcatgtatcttactgaatatagtagcaatattcttgttctgtagcaaggtgttcattccattcagtatttattaaagtacctaacaagtgccaggcactgtcctaagcactagtattacacgaggtttttcgggagctaaaacctttagggtaggacagagaaggagagtgcaaaaaggactctcgagaaaaaaaaaatggtatctcaggtgcttctacgaggctggtgctgtggtggcccctgccttgcagaaacagtgaaagccgcactgcaggtagatcagtgcgtccagagctaggcgaagaggtgaggctggaaggacacaccaagctcagtcagaaagggtggtcctttgtgaaccaggcatttcgattttttcttaaaggcagggagaagccttaattattttcatcatcaaatttctcttttctggttgactcaaggggctctgcactacatggcattatctaggtaaggtttctgaacaattagagtaagggattgtccctgatttctttctctgagaattgcaatctccatctttgctagttctatttctatagaacttttcaacagcagaaacctccttgctctatttgtatacacaagaaactgtgcagccaa

SEQ ID NO: 418178 - DNA, 1759 bp, Homo sapiens
cccgggccccgcccctgggccgtgcggtgacgccacttcagggccggcccgcggaacttttgggcaggtgtcagcgcccgtgtcaccgccacgtcgcggacatggtgatttcagaaagtatggatatactcttcagaataagaggaggccttgatttggcttttcagctagctactcctaatgaaatttttctcaagaaggcactgaaacatgtgttgagtgacctgtcaactaagctgtcttcaaacgcccttgtgttcagaatttgccacagttcagtgtatatatggcctagcagtgacataaacaccattcctggagaactgactgatgcttctgcttgtaagaacatactgcgctttattcaatttgagccagaagaagatataaaaagaaaattcatgagaaagaaggacaaaaagttatcagacatgcatcaaatagtaaatatagatcttatgctggaaatgtcaacctccctggcagctgtaacgcccatcattgaaagggaaagcggaggacaccattatgttaatatgactttacctgtcgatgcagttatatctgttgctccagaagaaacatggggaaaagttcgtaaactcctggttgatgcaattcataatcaactaactgacatggaaaaatgtattttgaaatatatgaaaggaacatctattgtggtccctgaaccactgcactttttattaccagggaaaaaaaatcttgtaacaatttcatatccttcaggaataccagatggccagctgcaggcctataggaaggagttacatgatcttttcaatctgcctcacgacagaccctatttcaaaaggtctaatgcttatcactttccagatgagccatacaaagatggttacattagaaatccacatacttaccttaatccacctaacatggagactggtatgatttatgtggtccagggcatatatggctatcatcattatatgcaggatcgcatagatgacaatggctggggctgtgcttatcgatctctgcagactatctgctcttggttcaaacatcagggatacacagagaggtccattccaacacacagagaaattcagcaggctctagtcgatgccggggacaaaccagcaacatttgtcggatcgcggcaatggattggatctattgaggtgcagctggtactaaaccaattgatcggtataacgtcaaaaatcctgtttgtcagccaaggttcagaaattgcctctcaaggacgggaactggctaatcatttccaaagtgaaggaactccagttatgatcggtaagctgtttcagacactgtttttggtagagtgagtaatatgcaaaacttatcattgatataaatatttaatgttgcataaaatcagtcatttaaaaaattttgaaattaacttttacaccatatgtatggatctctggatattgaaaaaaatttctaaggtggcttaaaggttacaaaaaagattataataaccagaagaagtaaaggctgagaaatggtagctatgttcaaacatttaaagagctgagaacagtattaaaaagaggaaacggtcactcagctgagcttcgtaagtcatgactctgtcataactgggctggctttgtgagattttgcaattacttacctctgtggattttatttgtaaaataagaagattggattagctgatctaaagatgcttaattctttgaagaacaagacctgtcctgtgatgacagaaggcaaggtgagacta

SEQ ID NO: 418179 - DNA, 1252 bp, Homo sapiens
cccgggccccgcccctgggccgtgcggtgacgccacttcagggccggcccgcggaacttttgggcaggtgtcagcgcccgtgtcaccgccacgtcgcggacatggtgatttcagaaagtatggatatactcttcagaataagaggaggccttgatttggcttttcagctagctactcctaatgaaatttttctcaagaaggcactgaaacatgtgttgagtgacctgtcaactaagctgtcttcaaacgcccttgtgttcagaatttgccacagttcagtgtatatatggcctagcagtgacataaacaccattcctggagaactgactgatgcttctgcttgtaagaacatactgcgctttattcaatttgagccagaagaagatataaaaagaaaattcatgagaaagaaggacaaaaagttatcagacatgcatcaaatagtaaatatagatcttatgctggaaatgtcaacctccctggcagctgtaacgcccatcattgaaagggaaagcggaggacaccattatgttaatatgactttacctgtcgatgcagttatatctgttgctccagaagaaacatggggaaaagttcgtaaactcctggttgatgcaattcataatcaactaactgacatggaaaaatgtattttgaaatatatgaaaggaacatctattgtggtccctgaaccactgcactttttattaccagggaaaaaaaatcttgtaacaatttcatatccttcaggaataccagatggccagctgcaggcctataggaaggagttacatgatcttttcaatctgcctcacgacagaccctatttcaaaaggtctaatgcttatcactttccagatgagccatacaaagatggttacattagaaatccacatacttaccttaatccacctaacatggagactggtatgatttatgtggtccagggcatatatggctatcatcattatatgcaggatcgcatagatgacaatggctggggctgtgcttatcgatctctgcagactatctgctcttggttcaaacatcagggatacacagagaggtccattccaacacacagagaaattcagcaggctctagtcgatgccggggacaaaccagcaacatttgtcggatcgcggcaatggattggatctattgaggtgcagctggtactaaaccaattgatcggtataacgtcaaaaatcctgtttgtcagccagagtgtcgcggggtcctctagagtcac

SEQ ID NO: 418180 - DNA, 1284 bp, Homo sapiens
tggaataacagttacaggtaaattttttttaatgatttttatgatgaattacatacatagaattaaaagttcaaaaacctaccttaaagggtaagatacgttacttttctatgctagtaggaattcaaatccttgaatgataaagccatttagagtcttattccaaggtcctgctgacagagcctgatgtcacgatttccatgacataatcttgtaactttgtaaaaggctttcctttcccgtcttctctatccagggctggtgcggatggaagggcccagatttttggaacaaggatgcatactataacttatgtcttcctcagcgaccaaatatgatttaaaatatcttggagtcaaagactgcagtagagtggtattataaatttgtgaataaagaatcagtttaatttttcacattaaatcctggttctagtttgacgatttaaattatgacctttttcaaaggttgtaaatactgcacggagaatgtattttttagacgttcctttaataacttaaaagacaaagcatacacaaccagcatattataggcatgtaaatacatgtgttcttaaatggatcttcacttggaagaaagtttttcatccttctcagaaggagattagacacaacatatggtaaagccaaaagcaggagcttatagatttgcatgaaatgaaggcgttcttcagacttcttcataacccacgtgacatctgtttttaaaaacacgttaacattaaaaacttttttttaaaaagagttttatccccaaacttccaccatgcagtcccatttttggtctctagactctggtaaatataaccagtactaaaatgttaatgagaatgaaacaatactactagaaatacgagtgtcagtattaaatggaataataaatgctatgcaaacaagagatcactgcgggaggaaaaaagcagcagctctgagttacttaccagcacttccttttcccactggtattttctacacttccgagactccgtttctgtctgagcacggcaacacaatcattcctgtcagggtgttcacttgcttttattgtctgcatacatttaattgttgtaagaaacttggcacagtctggaaatccacatgaccaagcgagatcttcagctgtttgcccgttcttattacataaactgaaaacaggataaaaacggagtgaaatgaaacattgaacttaagtctttttttttatatcttacaagggaattttgggctcatacaaatgttggttgcagaacagaagaggtaaagg

SEQ ID NO: 418181 - DNA, 1400 bp, Homo sapiens
tcgctattcatcggcaccattccaacacacagagaaattcagcaggctctagtcgatgccggggacaaaccagcaacatttgtcggatcgcggcaatggattggatctattgaggtgcagctggtactaaaccaattgatcggtataacgtcaaaaatcctgtttgtcagccaaggttcagaaattgcctctcaaggacgggaactggctaatcatttccaaagtgaaggaactccagttatgatcgggggaggagttttggcccacacaatactaggagttgcatggaatgagattacagggcagataaagtttctgattctagatccacattataccggtgctgaagacctgcaagttattttggaaaagggctggtgcggatggaagggcccagatttttggaacaaggatgcatactataacttatgtcttcctcagcgaccaaatatgatttaaaatatcttggagtcaaagactgcagtagagtggtattataaatttgtgaataaagaatcagtttaatttttcacattaaatcctggttctagtttgacgatttaaattatgacctttttcaaaggttgtaaatactgcacggagaatgtattttttagacgttcctttaataacttaaaagacaaagcatacacaaccagcatattataggcatgtaaatacatgtgttcttaaatggatcttcacttggaagaaagtttttcatccttctcagaaggagattagacacaacatatggtaaagccaaaagcaggagcttatagatttgcatgaaatgaaggcgttcttcagacttcttcataacccacgtgacatctgtttttaaaaacacgttaacattaaaaacttttttttaaaaagagttttatccccaaacttccaccatgcagtcccatttttggtctctagactctggtaaatataaccagtactaaaatgttaatgagaatgaaacaatactactagaaatacgagtgtcagtattaaatggaataataaatgctatgcaaacaagagatcactgcgggaggaaaaaagcagcagctctgagttacttaccagcacttccttttcccactggtattttctacacttccgagactccgtttctgtctgagcacggcaacacaatcattcctgtcagggtgttcacttgcttttattgtctgcatacatttaattgttgtaagaaacttggcacagtctggaaatccacatgaccaagcgagatcttcagctgtttgcccgttcttattacataaactgaaaacaggataaaaacggagtgaaatgaaacattgaacttaagtctttttttttatatcttacaagggaattttgggctcatacaaatgttggttgcagaacagaagaggtaaagg

SEQ ID NO: 418182 - DNA, 1638 bp, Homo sapiens
agatgaggaaatacagactaagaagtctaccagcaagaaggcaagaacccaggacttaacactcattcttctgattaatccatccataagaactccctgagcaccaaggtgatgttttaacttcatgttaaaaacccaggcctcctttatacagttcaagaagcagaaaatcaaggtcttttagcgtcttatctagcacacttggtggccttaagtattttgagtttatgttgctttaaattgcacagtttaattgctctcagttccctaacacttaatttttttacatttatatattttttcagtaacacccgaaaaaacaagaaagtaggaaacattgtctcctagctcattatttgaccgtagtgttggaagtagttcatctgatagaaaatggtttctttctagccaaggttcagaaattgcctctcaaggacgggaactggctaatcatttccaaagtgaaggaactccagttatgatcgggggaggagttttggcccacacaatactaggagttgcatggaatgagattacagggcagataaagtttctgattctagatccacattataccggtgctgaagacctgcaagttattttggaaaagggctggtgcggatggaagggcccagatttttggaacaaggatgcatactataacttatgtcttcctcagcgaccaaatatgatttaaaatatcttggagtcaaagactgcagtagagtggtattataaatttgtgaataaagaatcagtttaatttttcacattaaatcctggttctagtttgacgatttaaattatgacctttttcaaaggttgtaaatactgcacggagaatgtattttttagacgttcctttaataacttaaaagacaaagcatacacaaccagcatattataggcatgtaaatacatgtgttcttaaatggatcttcacttggaagaaagtttttcatccttctcagaaggagattagacacaacatatggtaaagccaaaagcaggagcttatagatttgcatgaaatgaaggcgttcttcagacttcttcataacccacgtgacatctgtttttaaaaacacgttaacattaaaaacttttttttaaaaagagttttatccccaaacttccaccatgcagtcccatttttggtctctagactctggtaaatataaccagtactaaaatgttaatgagaatgaaacaatactactagaaatacgagtgtcagtattaaatggaataataaatgctatgcaaacaagagatcactgcgggaggaaaaaagcagcagctctgagttacttaccagcacttccttttcccactggtattttctacacttccgagactccgtttctgtctgagcacggcaacacaatcattcctgtcagggtgttcacttgcttttattgtctgcatacatttaattgttgtaagaaacttggcacagtctggaaatccacatgaccaagcgagatcttcagctgtttgcccgttcttattacataaactgaaaacaggataaaaacggagtgaaatgaaacattgaacttaagtctttttttttatatcttacaagggaattttgggctcatacaaatgttggttgcagaacagaagaggtaaagg

SEQ ID NO: 418183 - DNA, 1510 bp, Homo sapiens
cccgggccccgcccctgggccgtgcggtgacgccacttcagggccggcccgcggaacttttgggcaggtgtcagcgcccgtgtcaccgccacgtcgcggacatggtgatttcagaaagtatggatatactcttcagaataagaggaggccttgatttggcttttcagctagctactcctaatgaaatttttctcaagaaggcactgaaacatgtgttgagtgacctgtcaactaagctgtcttcaaacgcccttgtgttcagaatttgccacagttcagtgtatatatggcctagcagtgacataaacaccattcctggagaactgactgatgcttctgcttgtaagaacatactgcgctttattcaatttgagccagaagaagatataaaaagaaaattcatgagaaagaaggacaaaaagttatcagacatgcatcaaatagtaaatatagatcttatgctggaaatgtcaacctccctggcagctgtaacgcccatcattgaaagggaaagcggaggacaccattatgttaatatgactttacctgtcgatgcagttatatctgttgctccagaagaaacatggggaaaagttcgtaaactcctggttgatgcaattcataatcaactaactgacatggaaaaatgtattttgaaatatatgaaaggaacatctattgtggtccctgaaccactgcactttttattaccagggaaaaaaaatcttgagttacatgatcttttcaatctgcctcacgacagaccctatttcaaaaggtctaatgcttatcactttccagatgagccatacaaagatggttacattagaaatccacatacttaccttaatccacctaacatggagactggtatgatttatgtgagtccaaagcaagaaaaaacaaacaaacataaaaaagcaggatcgcatagatgacaatggctggggctgtgcttatcgatctctgcagactatctgctcttggttcaaacatcagggatacacagagaggtccattccaacacacagagaaattcagcaggctcaagtacgatagccgagaggacaaaccagcaacaaaaaacggatacgcgacaaaaaaaaagaaacgacatagaaaaacaacaaaaacaaaaccaaagaaacagagaagaaacagtacaaaaaaccgattagtacagccaagagtaacagaaaaagccgacacaagagaacgaaaaacaaagcgaaacaaaaccaaaagaaaaaaaacaccaagaaagagaacaaaagaaagaaagagaggaatcgccagcacaagaacaaaaaagaatcaaaaacagataaaacaatgagcgaagaaaaaataaacgaagaaaccagaaccagcagaaaaaaccaaaactaaaaaaaccaatcaagagagaggattaaaaaagcgaaagatcgaaaagaaagagcccaggaagatgaggaacaggaaaaacgaacaaaaaggaaatatacaaccacattcgatcaaaaaaaaa

SEQ ID NO: 418184 - DNA, 776 bp, Homo sapiens
gtgcctcagggcgcggaatacccgcgtacaaccagcatattataggcatgtaaatacatgtgttcttaaatggatcttcacttggaagaaagtttttcatccttctcagaaggagattagacacaacatatggtaaagccaaaagcaggagcttatagatttgcatgaaatgaaggcgttcttcagacttcttcataacccacgtgacatctgtttttaaaaacacgttaacattaaaaacttttttttaaaaagagttttatccccaaacttccaccatgcagtcccatttttggtctctagactctggtaaatataaccagtactaaaatgttaatgagaatgaaacaatactactagaaatacgagtgtcagtattaaatggaataataaatgctatgcaaacaagagatcactgcgggaggaaaaaagcagcagctctgagttacttaccagcacttccttttcccactggtattttctacacttccgagactccgtttctgtctgagcacggcaacacaatcattcctgtcagggtgttcacttgcttttattgtctgcatacatttaattgttgtaagaaacttggcacagtctggaaatccacatgaccaagcgagatcttcagctgtttgcccgttcttattacataaactgaaaacaggataaaaacggagtgaaatgaaacattgaacttaagtctttttttttatatcttacaagggaattttgggctcatacaaatgttggttgcagaacagaagaggtaaagg

SEQ ID NO: 418185 - DNA, 364 bp, Homo sapiens
agttatatctgttgctccagaagaaacatggggaaagtaagtatttttatagtaccactgccacatttgaatgagggcccttccccaaacccatgtttgtatatcctgtaggtatacctaaggtgtgattttctccttgtttattattaacctaagagccatctattaattaaatggttatttggaggaagtagggtagcatgctaaaacctggaggatttccctttatccacaaagagcaaatacacagtttcttttataatgtataattcagacttcctttagcaaacctggtccaatcaagttttttactatactaaggatatattagctctgtacttttctttattgtagtcactataac

SEQ ID NO: 418186 - DNA, 387 bp, Homo sapiens
gaactaaagtaacagtctaactctaagaacattaaacataattcgggagcatatatagaatatgtacttctatcctaagttaatattttactgtgtttcttctctgtatatagatttatgtggtccagggcatatatggctatcatcattatatgcaggatcgcatagatgacaatggctggggctgtgcttatcgatctctgcagactatctgctcttggttcaaacatcagggatacacagagaggtccattccaacacacagagaaattcagcaggtacagaacataccgttttaaattataatcaactgtatgtttcattagcccttaatataccattgataatttttgttacctcatggtgcagacttatttctgttttgaa

SEQ ID NO: 418187 - DNA, 697 bp, Homo sapiens
tcgctattcatcggcaccattccaacacacagagaaattcagcaggctctagtcgatgccggggacaaaccagcaacatttgtcggatcgcggcaatggattggatctattgaggtgcagctggtactaaaccaattgatcggtataacgtcaaaaatcctgtttgtcagccaaggttcagaaattgcctctcaaggacgggaactggctaatcatttccaaagtgaaggaactccagttatgatcgggggaggagttttggcccacacaatactaggagttgcatggaatgagattacagggcagataaagtttctgattctagatccacattataccggtgctgaagacctgcaagttattttggaaaagggctggtgcggatggaagggcccagatttttggaacaaggatgcatactataacttatgtcttcctcagcgaccaaatatgatttaaaatatcttggagtcaaagactgcagtagagtggtattataaatttgtgaataaagaatcagtttaatttttcacattctctattactccatcttcttatccccctctctctttccctcttcctcttcctctatcttcactctcctccatatgctctttctttctcatccctctccatactctgctcccctctctcccatcttctcttactccccgcctcttgtttcccgcctctctcc

SEQ ID NO: 418188 - DNA, 2209 bp, Homo sapiens
cccgggccccgcccctgggccgtgcggtgacgccacttcagggccggcccgcggaacttttgggcaggtgtcagcgcccgtgtcaccgccacgtcgcggacatggtgatttcagaaagtatggatatactcttcagaataagaggaggccttgatttggcttttcagctagctactcctaatgaaatttttctcaagaaggcactgaaacatgtgttgagtgacctgtcaactaagctgtcttcaaacgcccttgtgttcagaatttgccacagttcagtgtatatatggcctagcagtgacataaacaccattcctggagaactgactgatgcttctgcttgtaagaacatactgcgctttattcaatttgagccagaagaagatataaaaagaaaattcatgagaaagaaggacaaaaagttatcagacatgcatcaaatagtaaatatagatcttatgctggaaatgtcaacctccctggcagctgtaacgcccatcattgaaagggaaagcggaggacaccattatgttaatatgactttacctgtcgatgcagttatatctgttgctccagaagaaacatggggaaaagttcgtaaactcctggttgatgcaattcataatcaactaactgacatggaaaaatgtattttgaaatatatgaaaggaacatctattgtggtccctgaaccactgcactttttattaccagggaaaaaaaatcttgtaacaatttcatatccttcaggaataccagatggccagctgcaggcctataggaaggagttacatgatcttttcaatctgcctcacgacagaccctatttcaaaaggtctaatgcttatcactttccagatgagccatacaaagatggttacattagaaatccacatacttaccttaatccacctaacatggagactggtatgatttatgtggtccagggcatatatggctatcatcattatatgcaggatcgcatagatgacaatggctggggctgtgcttatcgatctctgcagactatctgctcttggttcaaacatcagggatacacagagaggtccattccaacacacagagaaattcagcaggctctagtcgatgccggggacaaaccagcaacatttgtcggatcgcggcaatggattggatctattgaggtgcagctggtactaaaccaattgatcggtataacgtcaaaaatcctgtttgtcagccaaggttcagaaattgcctctcaaggacgggaactggctaatcatttccaaagtgaaggaactccagttatgatcgggggaggagttttggcccacacaatactaggagttgcatggaatgagattacagggcagataaagtttctgattctagatccacattataccggtgctgaagacctgcaagttattttggaaaagggctggtgcggatggaagggcccagatttttggaacaaggatgcatactataacttatgtcttcctcagcgaccaaatatgatttaaaatatcttggagtcaaagactgcagtagagtggtattataaatttgtgaataaagaatcagtttaatttttcacattaaatcctggttctagtttgacgatttaaattatgacctttttcaaaggttgtaaatactgcacggagaatgtattttttagacgttcctttaataacttaaaagacaaagcatacacaaccagcatattataggcatgtaaatacatgtgttcttaaatggatcttcacttggaagaaagtttttcatccttctcagaaggagattagacacaacatatggtaaagccaaaagcaggagcttatagatttgcatgaaatgaaggcgttcttcagacttcttcataacccacgtgacatcagcacttccttttcccactggtattttctacacttccgagactccgtttctgtctgagcacggcaacacaatcattcctgtcagggtgttcacttgcttttattgtctgcatacatttaattgttgtaagaaacttggcacagtctggaaatccacatgaccaagcgagatcttcagctgtttgcccgttcttattacataaactgaaaacaggataaaaacggagtgaaatgaaacattgaacttaagtctttttttttatatcttacaagggaattttgggctcatacaaatgttggttgcagaacagaagaggtaaagg

SEQ ID NO: 418189 - DNA, 2395 bp, Homo sapiens
cccgggccccgcccctgggccgtgcggtgacgccacttcagggccggcccgcggaacttttgggcaggtgtcagcgcccgtgtcaccgccacgtcgcggacatggtgatttcagaaagtatggatatactcttcagaataagaggaggccttgatttggcttttcagctagctactcctaatgaaatttttctcaagaaggcactgaaacatgtgttgagtgacctgtcaactaagctgtcttcaaacgcccttgtgttcagaatttgccacagttcagtgtatatatggcctagcagtgacataaacaccattcctggagaactgactgatgcttctgcttgtaagaacatactgcgctttattcaatttgagccagaagaagatataaaaagaaaattcatgagaaagaaggacaaaaagttatcagacatgcatcaaatagtaaatatagatcttatgctggaaatgtcaacctccctggcagctgtaacgcccatcattgaaagggaaagcggaggacaccattatgttaatatgactttacctgtcgatgcagttatatctgttgctccagaagaaacatggggaaaagttcgtaaactcctggttgatgcaattcataatcaactaactgacatggaaaaatgtattttgaaatatatgaaaggaacatctattgtggtccctgaaccactgcactttttattaccagggaaaaaaaatcttgagttacatgatcttttcaatctgcctcacgacagaccctatttcaaaaggtctaatgcttatcactttccagatgagccatacaaagatggttacattagaaatccacatacttaccttaatccacctaacatggagactggtatgatttatgtggtccagggcatatatggctatcatcattatatgcaggatcgcatagatgacaatggctggggctgtgcttatcgatctctgcagactatctgctcttggttcaaacatcagggatacacagagaggtccattccaacacacagagaaattcagcaggctctagtcgatgccggggacaaaccagcaacatttgtcggatcgcggcaatggattggatctattgaggtgcagctggtactaaaccaattgatcggtataacgtcaaaaatcctgtttgtcagccaaggttcagaaattgcctctcaaggacgggaactggctaatcatttccaaagtgaaggaactccagttatgatcgggggaggagttttggcccacacaatactaggagttgcatggaatgagattacagggcagataaagtttctgattctagatccacattataccggtgctgaagacctgcaagttattttggaaaagggctggtgcggatggaagggcccagatttttggaacaaggatgcatactataacttatgtcttcctcagcgaccaaatatgatttaaaatatcttggagtcaaagactgcagtagagtggtattataaatttgtgaataaagaatcagtttaatttttcacattaaatcctggttctagtttgacgatttaaattatgacctttttcaaaggttgtaaatactgcacggagaatgtattttttagacgttcctttaataacttaaaagacaaagcatacacaaccagcatattataggcatgtaaatacatgtgttcttaaatggatcttcacttggaagaaagtttttcatccttctcagaaggagattagacacaacatatggtaaagccaaaagcaggagcttatagatttgcatgaaatgaaggcgttcttcagacttcttcataacccacgtgacatctgtttttaaaaacacgttaacattaaaaacttttttttaaaaagagttttatccccaaacttccaccatgcagtcccatttttggtctctagactctggtaaatataaccagtactaaaatgttaatgagaatgaaacaatactactagaaatacgagtgtcagtattaaatggaataataaatgctatgcaaacaagagatcactgcgggaggaaaaaagcagcagctctgagttacttaccagcacttccttttcccactggtattttctacacttccgagactccgtttctgtctgagcacggcaacacaatcattcctgtcagggtgttcacttgcttttattgtctgcatacatttaattgttgtaagaaacttggcacagtctggaaatccacatgaccaagcgagatcttcagctgtttgcccgttcttattacataaactgaaaacaggataaaaacggagtgaaatgaaacattgaacttaagtctttttttttatatcttacaagggaattttgggctcatacaaatgttggttgcagaacagaagaggtaaagg

SEQ ID NO: 418190 - DNA, 2071 bp, Homo sapiens
acgccttagacgaggaaacagctgtgaccgatggtcacaaagttatagacatgcatcaaatagtaaatatagatcttatgctggaaatgtcaacctccctggcagctgtaacgcccatcattgaaagggaaagcggaggacaccattatgttaatatgactttacctgtcgatgcagttatatctgttgctccagaagaaacatggggaaaagttcgtaaactcctggttgatgcaattcataatcaactaactgacatggaaaaatgtattttgaaatatatgaaaggaacatctattgtggtccctgaaccactgcactttttattaccagggaaaaaaaatcttgtaacaatttcatatccttcaggaataccagatggccagctgcaggcctataggaaggagttacatgatcttttcaatctgcctcacgacagaccctatttcaaaaggtctaatgcttatcactttccagatgagccatacaaagatggttacattagaaatccacatacttaccttaatccacctaacatggagactggtatgatttatgtggtccagggcatatatggctatcatcattatatgcaggatcgcatagatgacaatggctggggctgtgcttatcgatctctgcagactatctgctcttggttcaaacatcagggatacacagagaggtccattccaacacacagagaaattcagcaggctctagtcgatgccggggacaaaccagcaacatttgtcggatcgcggcaatggattggatctattgaggtgcagctggtactaaaccaattgatcggtataacgtcaaaaatcctgtttgtcagccaaggttcagaaattgcctctcaaggacgggaactggctaatcatttccaaagtgaaggaactccagttatgatcgggggaggagttttggcccacacaatactaggagttgcatggaatgagattacagggcagataaagtttctgattctagatccacattataccggtgctgaagacctgcaagttattttggaaaagggctggtgcggatggaagggcccagatttttggaacaaggatgcatactataacttatgtcttcctcagcgaccaaatatgatttaaaatatcttggagtcaaagactgcagtagagtggtattataaatttgtgaataaagaatcagtttaatttttcacattaaatcctggttctagtttgacgatttaaattatgacctttttcaaaggttgtaaatactgcacggagaatgtattttttagacgttcctttaataacttaaaagacaaagcatacacaaccagcatattataggcatgtaaatacatgtgttcttaaatggatcttcacttggaagaaagtttttcatccttctcagaaggagattagacacaacatatggtaaagccaaaagcaggagcttatagatttgcatgaaatgaaggcgttcttcagacttcttcataacccacgtgacatctgtttttaaaaacacgttaacattaaaaacttttttttaaaaagagttttatccccaaacttccaccatgcagtcccatttttggtctctagactctggtaaatataaccagtactaaaatgttaatgagaatgaaacaatactactagaaatacgagtgtcagtattaaatggaataataaatgctatgcaaacaagagatcactgcgggaggaaaaaagcagcagctctgagttacttaccagcacttccttttcccactggtattttctacacttccgagactccgtttctgtctgagcacggcaacacaatcattcctgtcagggtgttcacttgcttttattgtctgcatacatttaattgttgtaagaaacttggcacagtctggaaatccacatgaccaagcgagatcttcagctgtttgcccgttcttattacataaactgaaaacaggataaaaacggagtgaaatgaaacattgaacttaagtctttttttttatatcttacaagggaattttgggctcatacaaatgttggttgcagaacagaagaggtaaagg

SEQ ID NO: 418191 - DNA, 1691 bp, Homo sapiens
cccgggccccgcccctgggccgtgcggtgacgccacttcagggccggcccgcggaacttttgggcaggtgtcagcgcccgtgtcaccgccacgtcgcggacatggtgatttcagaaagtatggatatactcttcagaataagaggaggccttgatttggcttttcagctagctactcctaatgaaatttttctcaagaaggcactgaaacatgtgttgagtgacctgtcaactaagctgtcttcaaacgcccttgtgttcagaatttgccacagttcagtgtatatatggcctagcagtgacataaacaccattcctggagaactgactgatgcttctgcttgtaagaacatactgcgctttattcaatttgagccagaagaagatataaaaagaaaattcatgagaaagaaggacaaaaagttatcagacatgcatcaaatagtaaatatagatcttatgctggaaatgtcaacctccctggcagctgtaacgcccatcattgaaagggaaagcggaggacaccattatgttaatatgactttacctgtcgatgcagttatatctgttgctccagaagaaacatggggaaaagttcgtaaactcctggttgatgcaattcataatcaactaactgacatggaaaaatgtattttgaaatatatgaaaggaacatctattgtggtccctgaaccactgcactttttattaccagggaaaaaaaatcttgtaacaatttcatatccttcaggaataccagatggccagctgcaggcctataggaaggagttacatgatcttttcaatctgcctcacgacagaccctatttcaaaaggtctaatgcttatcactttccagatgagccatacaaagatggttacattagaaatccacatacttaccttaatccacctaacatggagactggtatgatttatgtggtccagggcatatatggctatcatcattatatgcaggatcgcatagatgacaatggctggggctgtgcttatcgatctctgcagactatctgctcttggttcaaacatcagggatacacagagaggtccattccaacacacagagaaattcagcaggctctagtcgatgccggggacaaaccagcaacatttgtcggatcgcggcaatggattggatctattgaggtgcagctggtactaaaccaattgatcggtataacgtcaaaaatcctgtttgtcagtaacacccgaaaaaacaagaaagtaggaaacattgtctcctagctcattatttgaccgtagtgttggaagtagttcatctgatagaaaatggtttctttctagccaaggttcagaaattgcctctcaaggacgggaactggctaatcatttccaaagtgaaggaactccagttatgatcgggggaggagttttggcccacacaatactaggagttgcatggaatgagattacagggcagataaagtttctgattctagatccacattataccggtgctgaagacctgcaagttattttggaaaagggctggtgcggatggaagggcccagatttttggaacaaggatgcatactataacttatgtcttcctcagcgaccaaatatgatttaaaatatcttggagtcaaagactgcagtagagtggtattataaatttgtgaataaagaatcagtttaatttttcacatt

SEQ ID NO: 418192 - DNA, 1862 bp, Homo sapiens
cccgggccccgcccctgggccgtgcggtgacgccacttcagggccggcccgcggaacttttgggcaggtgtcagcgcccgtgtcaccgccacgtcgcggacatggtgatttcagaaagtatggatatactcttcagaataagaggaggccttgatttggcttttcagctagctactcctaatgaaatttttctcaagaaggcactgaaacatgtgttgagtgacctgtcaactaagctgtcttcaaacgcccttgtgttcagaatttgccacagttcagtgtatatatggcctagcagtgacataaacaccattcctggagaactgactgatgcttctgcttgtaagaacatactgcgctttattcaatttgagccagaagaagatataaaaagaaaattcatgagaaagaaggacaaaaagttatcagacatgcatcaaatagtaaatatagatcttatgctggaaatgtcaacctccctggcagctgtaacgcccatcattgaaagggaaagcggaggacaccattatgttaatatgactttacctgtcgatgcagttatatctgttgctccagaagaaacatggggaaaagttcgtaaactcctggttgatgcaattcataatcaactaactgacatggaaaaatgtattttgaaatatatgaaaggaacatctattgtggtccctgaaccactgcactttttattaccagggaaaaaaaatcttgtaacaatttcatatccttcaggaataccagatggccagctgcaggcctataggaaggagttacatgatcttttcaatctgcctcacgacagaccctatttcaaaaggtctaatgcttatcactttccagatgagccatacaaagatggttacattagaaatccacatacttaccttaatccacctaacatggagactggtatgatttatgtggtccagggcatatatggctatcatcattatatgcaggatcgcatagatgacaatggctggggctgtgcttatcgatctctgcagactatctgctcttggttcaaacatcagggatacacagagaggtccattccaacacacagagaaattcagcaggctctagtcgatgccggggacaaaccagcaacatttgtcggatcgcggcaatggattggatctattgaggtgcagctggtactaaaccaattgatcggtataacgtcaaaaatcctgtttgtcagtaacacccgaaaaaacaagaaagtaggaaacattgtctcctagctcattatttgaccgtagtgttggaagtagttcatctgatagaaaatggtttctttctagccaaggttcagaaattgcctctcaaggacgggaactggctaatcatttccaaagtgaaggaactccagttatgatcggtaagctgtttcagacactgtttttggtagagtgagtaatatgcaaaacttatcattgatataaatatttaatgttgcataaaatcagtcatttaaaaaattttgaaattaacttttacaccatatgtatggatctctggatattgaaaaaaatttctaaggtggcttaaaggttacaaaaaagattataataaccagaagaagtaaaggctgagaaatggtagctatgttcaaacatttaaagagctgagaacagtattaaaaagaggaaacggtcactcagctgagcttcgtaagtcatgactctgtcataactgggctggctttgtgagattttgcaattacttacctctgtggattttatttgtaaaataagaagattggattagctgatctaaagatgcttaattctttgaagaacaagacctgtcctgtgatgacagaaggcaaggtgagacta

SEQ ID NO: 418193 - DNA, 1319 bp, Homo sapiens
tcgtgcgcatgcgcggcaggcccttcgggacgagctggaggcagagcgtgagtacaaagtgatcggcctcggccgcacgtagtagcccccctactccccggccaagtcagggcctccctcttcccgcggagtcgcaaccacgggtagctcgtgtaggtaacggcaggtccaggcctccgcatgagcggagggccccccgcgcgaccttgaatggcccgggcgcgcgcggtcgtgtgggagttgtagtcctccgtccccgtccgcgcggactccgtttcccgtggtgccccgggcggcccgcttccggcgcagttagttacgagtcggcgcacgcggcctcggtccggttgactttgcggagccatggagggcggcttcggctccgatttcgggggctccggcagcgggaagctggacccagggctcataatggagcaggtgaaagtgcagatcgccgtggccaacgcgcaggagctgctgcagaggatgacggacaagtgtttccggaagtgtatagggaaacctgggggctccctggacaactccgagcagaagtgcatcgccatgtgcatggaccgctacatggacgcctggaacaccgtgtctcgcgcctacaactcgcggctgcagcgggaacgagccaacatgtgaccggcgagcgcgggccaccccaccctgttcatttccataaacgtgctttgagaggcggggtccgcatgtacgtactgcctgcccggggcttaggagggtggcaccggtgctgggacacacgggactgtgtcctcgccaccccccgccctgccccctgccagccagtgcagcttggatctcgggggtgtggggccctgtgccttcctgaagtgctggcagcccagtggcacctccttcaggcctttggggtattcccctagtgtgcccaagtcagcctcatattctgggcggacagcttgtctggacttcggagttgggggtggtcagacaccacaggagctgtcacctcctgcggatgggcaaataaattggtggaggacgggaacaaacacaacacacaccaaacaaacaaaaaacataaaacagcaccaaaaaacaaaccccgaggaaacaaaaaaagcacacacacaaagaaaaacagggccacaaaagaaccaaaagaaaagaaacgaggcacccactacaacacgcccaagggcacacgcaccaggacacaactaagaaaccaaaacggagcggaccagggccacctcacgcaccacgccacgaggcacaacagcacccccccgcacacacagagtggacgagacacggacaaacacaacaca

SEQ ID NO: 418194 - DNA, 707 bp, Homo sapiens
tcgtgcgcatgcgcggcaggcccttcgggacgagctggaggcagagcgtgagtacaaagtgatcggcctcggccgcacgtagtagcccccctactccccggccaagtcagggcctccctcttcccgcggagtcgcaaccacgggtagctcgtgtaggtaacggcaggtccaggcctccgcatgagcggagggccccccgcgcgaccttgaatggcccgggcgcgcgcggtcgtgtgggagttgtagtcctccgtccccgtccgcgcggactccgtttcccgtggtgccccgggcggcccgcttccggcgcagttagttacgagtcggcgcacgcggcctcggtccggttgactttgcggagccatggagggcggcttcggctccgatttcgggggctccggcagcgggaagctggacccagggctcataatggagcaggtgaaagtgcagatcgccgtggccaacgcgcaggagctgctgcagaggatgacggacaagtgtttccggaagtgtatagggaaacctgggggctccctggacaactccgagcagaagtgcatcgccatgtgcatggaccgctacatggacgcctggaacaccgtgtctcgcgcctacaactcgcggctgcagcgggaacgagccaacatgtgaccggcgagcgcgggccaccccaccctgttcatttccataaacgtgctttgagaggc

SEQ ID NO: 418195 - DNA, 659 bp, Homo sapiens
tcgtgcgcatgcgcggcaggcccttcgggacgagctggaggcagagcgtgagtacaaagtgatcggcctcggccgcacgtagtagcccccctactccccggccaagtcagggcctccctcttcccgcggagtcgcaaccacgggtagctcgtgtaggtaacggcaggtccaggcctccgcatgagcggagggccccccgcgcgaccttgaatggcccgggcgcgcgcggtcgtgtgggagttgtagtcctccgtccccgtccgcgcggactccgtttcccgtggtgccccgggcggcccgcttccggcgcagttagttacgagtcggcgcacgcggcctcggtccggttgactttgcggagccatggagggcggcttcggctccgatttcgggggctccggcagcgggaagctggacccagggctcataatggagcaggtgaaagtgcagatcgccgtggccaacgcgcaggagctgctgcagaggatgacggaaaaaaaaaaaaaaaaaaaaaaaaaaaaaaaaaaaaaaaaaaaaaaaaaaaaaaaaaaaaaaccccccccctctcttttttttgggcaaaaaaaaaattttaaaaccccccctttttatattttttttctccaaccccaccttttctttttcaccggggaaatatt

SEQ ID NO: 418196 - DNA, 736 bp, Homo sapiens
gcccaagtcagcctcatattctgggcacactaggggaataccccaaaggcctgaaggaggtgccactggggtattcccctagtgtgcccaagtcagcctcatattctgggcggacagcttgtctggacttcggagttgggggtggtcagacaccacaggagctgtcacctcctgcggatgggcaaataaattggtggaggacggaaaaaaaaaaaaaaaaaaaaacaaaaaaaaaaaaaaaaaaaaaacatgcagcacaaatcccctatccacagctggcgtaataaacaaagaggacagcaaaagatcgcccttcccacccctggggtttttttttttttttttaaaaaatttcccatttttttaaaatttggccccaaaaaaaaggggccattgttttaaaaaatttttttttttttaaaaagggggtggtttttcccccccccgaaaaaaaaaacaagaagaaaaagtttgggacccgaattttttcttttttattcaaggggggcgctggagactttaaaaaggtggttttaaaacccaggagaacttttttttagaaaaatagtttttttacccttctggcaaaagagggcttttttttgggggctggtggggtttttttctaaaagtgggaaataacccaaaacacgttttaggtgtttttttgtgccccggccttgggttcaaaacccaaaaaaaggaagttttttttttggttttcttcttttttcta

SEQ ID NO: 418197 - DNA, 381 bp, Homo sapiens
  misc_feature (17)..(17): n is a, c, g, or t
  misc_feature (38)..(38): n is a, c, g, or t
  misc_feature (50)..(50): n is a, c, g, or t
tgattaccgagattatntgcaccaagcatctgcacgtngtcagaggctcntgcaggcagggtccccagcgtcaccctgttggggagagaagaaagggggttcagaggccggtacctcccctacagcagcccttgggtcattggcccctctaggagtgaccctagtgacttcccctgggagccgcattttcactatctggaaaatgggctcaatgcaaaggtggcagacatttatggacacccgccacgtggtcccggagtggaacggtgcctcccactgcagcctctgcctgctctgccgccgaggcccggggatgggatgcggtgggttgcccaataaacggctgtggagtggaaattcctccagagccaaaaaggcaaa

SEQ ID NO: 418198 - DNA, 1565 bp, Homo sapiens
tcgtgcgcatgcgcggcaggcccttcgggacgagctggaggcagagcgtgagtacaaagtgatcggcctcggccgcacgtagtagcccccctactccccggccaagtcagggcctccctcttcccgcggagtcgcaaccacgggtagctcgtgtaggtaacggcaggtccaggcctccgcatgagcggagggccccccgcgcgaccttgaatggcccgggcgcgcgcggtcgtgtgggagttgtagtcctccgtccccgtccgcgcggactccgtttcccgtggtgccccgggcggcccgcttccggcgcagttagttacgagtcggcgcacgcggcctcggtccggttgactttgcggagccatggagggcggcttcggctccgatttcgggggctccggcagcgggaagctggacccagggctcataatggagcaggtgaaagtgcagatcgccgtggccaacgcgcaggagctgctgcagaggatgacggacaagtgtttccggaagtgtatagggaaacctgggggctccctggacaactccgagcagaagtgcatcgccatgtgcatggaccgctacatggacgcctggaacaccgtgtctcgcgcctacaactcgcggctgcagcgggaacgagccaacatgtgaccggcgagcgcgggccaccccaccctgttcatttccataaacgtgctttgagaggcggggtccgcatgtacgtactgcctgcccggggcttaggagggtggcaccggtgctgggacacacgggactgtgtcctcgccaccccccgccctgccccctgccagccagtgcagcttggatctcgggggtgtggggccctgtgccttcctgaagtgctggcagcccagtggcacctccttcaggcctttggggtattcccctagtgtgcccaagtcagcctcatattctgggcggacagcttgtctggacttcggagttgggggtggtcagacaccacaggagctgtcacctcctgcggatgggcaaataaattggtggaggacggaaaaaaaaaaaaaaaaaaaaacaaaaaaaaaaaaaaaaaaaaaacatgcagcacaaatcccctatccacagctggcgtaataaacaaagaggacagcaaaagatcgcccttcccacccctggggtttttttttttttttttaaaaaatttcccatttttttaaaatttggccccaaaaaaaaggggccattgttttaaaaaatttttttttttttaaaaagggggtggtttttcccccccccgaaaaaaaaaacaagaagaaaaagtttgggacccgaattttttcttttttattcaaggggggcgctggagactttaaaaaggtggttttaaaacccaggagaacttttttttagaaaaatagtttttttacccttctggcaaaagagggcttttttttgggggctggtggggtttttttctaaaagtgggaaataacccaaaacacgttttaggtgtttttttgtgccccggccttgggttcaaaacccaaaaaaaggaagttttttttttggttttcttcttttttcta

SEQ ID NO: 418199 - DNA, 1978 bp, Homo sapiens
tcgtgcgcatgcgcggcaggcccttcgggacgagctggaggcagagcgtgagtacaaagtgatcggcctcggccgcacgtagtagcccccctactccccggccaagtcagggcctccctcttcccgcggagtcgcaaccacgggtagctcgtgtaggtaacggcaggtccaggcctccgcatgagcggagggccccccgcgcgaccttgaatggcccgggcgcgcgcggtcgtgtgggagttgtagtcctccgtccccgtccgcgcggactccgtttcccgtggtgccccgggcggcccgcttccggcgcagttagttacgagtcggcgcacgcggcctcggtccggttgactttgcggagccatggagggcggcttcggctccgatttcgggggctccggcagcgggaagctggacccagggctcataatggagcaggtgaaagtgcagatcgccgtggccaacgcgcaggagctgctgcagaggatgacggacaagtgtttccggaagtgtatagggaaacctgggggctccctggacaactccgagcagaagtgcatcgccatgtgcatggaccgctacatggacgcctggaacaccgtgtctcgcgcctacaactcgcggctgcagcgggaacgagccaacatgtgaccggcgagcgcgggccaccccaccctgttcatttccataaacgtgctttgagaggcggggtccgcatgtacgtactgcctgcccggggcttaggagggtggcaccggtgctgggacacacgggactgtgtcctcgccaccccccgccctgccccctgccagccagtgcagcttggatctcgggggtgtggggccctgtgccttcctgaagtgctggcagcccagtggcacctccttcaggcctttggggtattcccctagtgtgcccaagtcagcctcatattctgggcggacagcttgtctggacttcggagttgggggtggtcagacaccacaggagctgtcacctcctgcggatgggcaaataaattggtggaggacggagagaaacctctttatttccctcctgaggggtctctgggaagaggtgacgcgtgtccctggaaccccagctcggagggtctcagcctcccctgggttgggagaagtccatctttccccttagtgccaccgggctgctgagtcacgaggaatgtgttgctgctgccacccctgccccaaaggctaagggggacagccttccccttgtcagggcttgctttgaccctgcttcgttccaccccgggtcctggtggagcaccaggcaggtggtcctcgctgtgacactgaggtgctgagccagtgagctagggtggaggggctgtgtttattggaacaaagggtggtaccaaaatgcatccccatgacccacagcccccccacacccgtccttgggtagggtacggtggggtggggtgttgggtggcctgctgctcctgttgctttcacgtagagtctcggcctgggcagtcacgtggtggtcactcctggatgtgctgtcctatccagcctctcacagctgccacccgggtatagacacctgggaagtggggccggccacagccatagccccagctagtgaccccagttagcacccaccgtccagagggctccctgcaggccaggggtcccccagcgtcaccctgttggggagagaagaaagggggttcagaggccggtacctcccctacagcagcccttgggtcattggcccctctaggagtgaccctagtgacttcccctgggagccgcattttcactatctggaaaatgggctcaatgcaaaggtggcagacatttatggacacccgccacgtggtcccggagtggaacggtgcctcccactgcagcctctgcctgctctgccgccgaggcccggggatgggatgcggtgggttgcccaataaacggctgtggagtggaaattcctccagagccaaaaaggcaaa

SEQ ID NO: 418200 - DNA, 1033 bp, Homo sapiens
tcgtgcgcatgcgcggcaggcccttcgggacgagctggaggcagagcgtgagtacaaagtgatcggcctcggccgcacgtagtagcccccctactccccggccaagtcagggcctccctcttcccgcggagtcgcaaccacgggtagctcgtgtaggtaacggcaggtccaggcctccgcatgagcggagggccccccgcgcgaccttgaatggcccgggcgcgcgcggtcgtgtgggagttgtagtcctccgtccccgtccgcgcggactccgtttcccgtggtgccccgggcggcccgcttccggcgcagttagttacgagtcggcgcacgcggcctcggtccggttgactttgcggagccatggagggcggcttcggctccgatttcgggggctccggcagcgggaagctggacccagggctcataatggagcaggtgaaagtgcagatcgccgtggccaacgcgcaggagctgctgcagaggatgacggacaagtgtttccggaagtgtatagggaaacctgggggctccctggacaactccgagcagaagtgcatcgccatgtgcatggaccgctacatggacgcctggaacaccgtgtctcgcgcctacaactcgcggctgcagcgggaacgagccaacatgtgaccggcgagcgcgggccaccccaccctgttcatttccataaacgtgctttgagaggcggggtccgcatgtacgtactgcctgcccggggcttaggagggtggcaccggtgctgggacacacgggactgtgtcctcgccaccccccgccctgccccctgccagccagtgcagcttggatctcgggggtgtggggccctgtgccttcctgaagtgctggcagcccagtggcacctccttcaggcctttggggtattcccctagtgtgcccaagtcagcctcatattctgggcggacagcttgtctggacttcggagttgggggtggtcagacaccacaggagctgtcacctcctgcggatgggcaaataaattggtggaggacgg

SEQ ID NO: 418201 - DNA, 6129 bp, Homo sapiens
gagggcataattttttctcaattcatatttgcaaattgtttattgagagtcagtgttgtatagagggataaacatagatttggagatacagtcacttgccaagttgcaccgcagattcctctggtataaaatgaaaataatgtgactctacaggattgaataataattaactgaagtagtatatatagtacccatcacagaataggtttgtaacaaatgttaggtttgtaaaaatgttttgtcctgtcataattttaaaataggtaaattggacattttctgtttttctttataacataaatccgatattcacatgcagtttttttccaacttttattttaagttcatgggtgcatgtgcagatgtgaaggttcgttatataagtaaatgtgtgccatggtggttttgctgcacagatcatcccatcacctaggtattaagcccagcgttcattagcaattcttcctgacagctgcagttttgattatgtgcagctctcaattggcttttccccgtttaagatgttagaccagtggttctcagccttgactaattagaatcatgtgaggagcttttagaactcccattgctcaggccaaccctccaatcaattaaattaccatctctgggacttacacatttgtgttttgttttctcttttttgactccctaagtgatttttatatggagccaagattgaaaacagtgttagacacacactttcccaatttatgctttgaaaacaaagaccttagttcagagacttatgagatagggttatgattaggggaagagtaggccccacaagtttcagggtagtgaagattctgaagggtacaagcgataaaggagcctgagtttctgggtgaactcagaaacaaggaatcctagaagggctgagagcagaacagaacctcggaatagtctctgaaataaaagagtggagagtataagaaacagaatggaggcaggccccaggaggattcaatcaggaattctgaccttggggccataaataggtttcatatcttcacagaaagggtttacacaacttttgtatatcattttctgagatgtctgaatcctagaaaaagataaagaacatcagtatgtgaaaaagccaagggctaaggtaatggtaatcagactacagttctagaaatgcctctggatctttaatacatgactggcagctcttctaaacctctatgttacctctattagaatattatttctgatgtagtttgtggagaaacaaagcaggaatggaggagaacactgtatacagtatactttataagcactaaataaatatgtaaaaactctgaaatataatctgagtttatagtcataatgaagattattagctcaataatctagggtagaggtgtccaatctttcggcttccatgggccacgttggaagaagaattaccttgggccacacataaaatacactaacactaacaataactgatgagttaaaaaaaatcacataaaaatctcataatgttttaagaacatttgtgaatttgtgttgagtcacattcaaagacaccttgggccacatgtggcctgtgggctgcaagttggacaagcttgatctagggcaagtgctcaacagtggctgcacagttaaatcgtgtgtaaagctttcaaaaagtaagggtgcctaattccactcctagagattctgatttaattggtctgacatggagttgtaacatcaatatttttgaatttttccatatgattctaatgtgtaaccagcattgagaaccactaatccagaggaaaccaggactcctgcttatcttgcacaacttgggtaccctcaaaatatatggtattggcaaagttaatctgagcctaagttccagcacctgtaaaagatggtacgaatttcctaaaagaggttgttgtgaatatgtactctcctgggtttagtccttagctttgcaagaagtccaaaatcttcaagatgatcagcctcaaatcagggactcactaaccgcaaacaaacttgaaagtggctgataactaactggaaagatattactttaatatgtttctcacaaagcctgtgataatcatttgccatatttgtgatcatagaaatttcttgtccctgccctagaaacattgaatcatgttctccaggggagagcctgggaatctatatttttaactgacaccccagttgatttttatcaaagaagtctgggaaacattgtactttaagttattgtattgtcattctggtattgatttatggtaagaggagatacatatttccatttcctagtttttcttgatgtctgtcatccagggtatccttttcttggtatcaaagaatatgaaaaaccaattataatcagaaagtgacttagtatgcatgaaattagagcatagaaaaggatagttttgagggaacatttcattcatattttgacataacctgctgagttttcctgggcccgcaatagccagtagtgtgcagcctcattttcttcagagtcagcatctttctttccccttgcaagcagtctcctgtttctatgaatagtctttgctcagacaaggccaatatacttggtaataattaatttagcttctttgaaatgattaggtcactttttggtttaaaagattaccatggttgtccccaaaatctttgcatgtaccaatttatttcctcctccctagggtcagaatgattttatatttggcttatgaaatgtattaatttgcttcttctggtcaaagataagtggaaggatgatgagatttttaaaaaattaatgtatcccttgcttctaattctacctacaaagtggaatagtgtgctagttactatatagttcccagtgtatagcttttgactcttttgaagtggtaactagtagttttgttttagaattttgctttcagcttttatcctgagagtggggctcactgaacctctctcctttctaaaatctgtggaaattacttttggtaactaaggcactgcagtgatctcaggtaagagagtaaaaaatttgcctttatttgtttttaatgttttgggacgtttcaggttttggttgggtggaaacagagttggggcaaacaaaaagaggctggttaagagattcagaggcaaaggttggttggccatgctaaatttcaggtgcctgttgcacctccatgtagcaacagtaagtagacagatagcagattcttagggaagaagttaagctagagaagcagtgtggtgtggtgtaaagaattctgggcattcaattaagaggtgtgggctctgagaggctaacactactactaacttgctctgtgactttgaccaagtcatttgacctctctgggccccatctttattggaaaatgtcaagtagatggtctctaataaatttttgtccagttctaacattatgtgattctaaatgtatttatactgaccttcttaacttgaactctttgttttttcagcatttagtatgagaacctatgtttgccatatttgtagtattgcttttacatctttagatatgttccggtcccacatgcaaggaagtgaacatcaaattaaagaatccattgttatcaatctagtgaagaattcaaggaagacacaagactcttaccaaaatgagtgtgcagattacatcaatgtgcagaaagccagaggactagaggccaagacttgtttcagaaagatggaagagagttctttggaaacccgtagatacagagaagtggtcgattccagacccagacatagaatgtttgaacaaagactcccatttgagactttccggacatacgcagcaccatacaatatttcacaagcaatggaaaagcagttacctcattcaaagaagacatatgactctttccaagatgaacttgaagattacatcaaagtacagaaagccagaggactagatccaaagacttgtttcagaaagatgagagagaactctgtggatactcatgggtacagagaaatggttgattctggacccagatcaagaatgtgtgagcaaagattttcacatgaggcttcccagacctaccaacgaccataccatatttcaccagtggaaagccagttacctcagtggctaccaacccattcaaagaggacatatgattctttccaagatgaacttgaagattacataaaagtgcagaaagccagaggactagagccaaaaacttgtttcagaaagataggagatagctctgtagaaacacacaggaacagagaaatggttgatgtcagacccagacatagaatgttggagcaaaagctcccatgtgagactttccagacctattcaggaccatatagtatttcacaagtagtggaaaaccagttacctcattgcttaccagctcatgatagcaaacagagactagattctattagctactgtcaactcaccagagactgtttcccagaaaaaccagtacccttgagccttaatcagcaagaaaataactctggctcatacagtgtagaatctgaagtttacaagcacctctcttcagaaaacaatactgctgaccatcaagcaggtcataaacggaaacatcagaagagaaaacgacacctagaagaaggcaaagaaaggccagagaaagagcagtccaagcataaaaggaaaaagagttatgaagatacagatttagacaaagacaagagcatcagacaaaggaaaagagaggaggatagagtcaaggtcagttcaggaaagcttaagcatcgaaaaaagaaaaaaagccatgatgtaccctccgagaaagaagaacgtaagcacaggaaagagaaaaagaaatctgttgaagaaaggacagaagaggaaatgctttgggatgagtctattcttggattttgaatgtttagttttgtttacccaaggttgaattgaaaaaaaaaaacagtcaatatggatttagaaaaaggaacacctgatgaagaaaaggagaggtagatacagtcagtgtcacttcaggacacttaggttttttttgtataaaaatttaaattgaattaaaagaaggaaaaaaaaagcccaaacttaacctctgagaaaagaacataagaactcaaggagaacataagagaaaaggaaacctgttacagaaaagacaagaatctgtgttttggaatgagtctattcttgggtattgaacttttagttttgtttgcccaaggattaattgaggaaatcagctaagaaaatggactttagacaaaagcaagaggatcagatgaagaaaaggagaggtagatacagtcagtgtcacttcaggaaagctatttaaaaaaacttgaaatttaattgaaagaagaaacaacaacaaaaaagcctaaacctagcctctgaacaacactaacatgagaacacaagaacttaagagaaaaagaaacctactcaagaaaagacagaagagacagtgatttgggatgagtctactctaggattttcaactttttagttttgttccttcaaagttgaaggaaaaaaagtttggttttataaaattcatgttattgtaatttttctaggtggatggctactttaatctctaaaaaagccaagtgaagtaaaagtattcagtatgccttttcctcaagttactttccttcattttcttaaaaaagaaaaaaaattattaaatgtttctcacatatctcacatataatgtaatttccctaaatgaagttgtctctacttctgctcatcaaattgctgtgatagtgaattatttattcatgggagataatttattttaaaggacagaattaccaagcgttacaaaatcagttctttccttggttttgtgttagtgttggtggtattttattgttgtttttctgtgtttatgtgtctcagctttctccaaggaatatgtatgaaataacttaaactgattttttctttgttaaatctaatttgcagtgtatttttgcattttctagttctgaaagtggaaaatgaaacagtctataataaacttagatgatatatagttttaaaacggtctcaaaaagtactgatataaggtcagtctatattctggaaatgtttatattaaagtgttttaatttctaaatattgtt

SEQ ID NO: 418202 - DNA, 3200 bp, Homo sapiens
cggggagggggggcagtagttttaaagtagacacccgcccttgcctcagagaagatggagtcttgctctgtcaccaggctggagtgcagtggcgcaatctcggctcactgcagcctccacctcccgggttcaagcgattcccctgcctcagcctcccaaatagctgggactacagacgccatttggaatgaacaggaaaaggctgaactttttacagataagttttgtcaagtatgtggagtgatgctacagtttgaatcacaaagaatttcacattatgagggtgaaaaacatgctcaaaatgttagtttttattttcaaatgcatggggaacaaaatgaagtgcctggtaagaaaatgaagatgcatgttgagaattttcaggtgcataggtatgaaggagtggacaaaaacaaattttgtgatctctgcaacatgatgtttagctctccacttattgctcagtctcactatgtgggaaaggtccatgctaaaaaactgaagcaattaatggaggaacatgatcaggcatctccatcaggatttcaaccagagatggcatttagtatgagaacctatgtttgccatatttgtagtattgcttttacatctttagatatgttccggtcccacatgcaaggaagtgaacatcaaattaaagaatccattgttatcaatctagtgaagaattcaaggaagacacaagactcttaccaaaatgagtgtgcagattacatcaatgtgcagaaagccagaggactagaggccaagacttgtttcagaaagatggaagagagttctttggaaacccgtagatacagagaagtggtcgattccagacccagacatagaatgtttgaacaaagactcccatttgagactttccggacatacgcagcaccatacaatatttcacaagcaatggaaaagcagttacctcattcaaagaagacatatgactctttccaagatgaacttgaagattacatcaaagtacagaaagccagaggactagatccaaagacttgtttcagaaagatgagagagaactctgtggatactcatgggtacagagaaatggttgattctggacccagatcaagaatgtgtgagcaaagattttcacatgaggcttcccagacctaccaacgaccataccatatttcaccagtggaaagccagttacctcagtggctaccaacccattcaaagaggacatatgattctttccaagatgaacttgaagattacataaaagtgcagaaagccagaggactagagccaaaaacttgtttcagaaagataggagatagctctgtagaaacacacaggaacagagaaatggttgatgtcagacccagacatagaatgttggagcaaaagctcccatgtgagactttccagacctattcaggaccatatagtatttcacaagtagtggaaaaccagttacctcattgcttaccagctcatgatagcaaacagagactagattctattagctactgtcaactcaccagagactgtttcccagaaaaaccagtacccttgagccttaatcagcaagaaaataactctggctcatacagtgtagaatctgaagtttacaagcacctctcttcagaaaacaatactgctgaccatcaagcaggtcataaacggaaacatcagaagagaaaacgacacctagaagaaggcaaagaaaggccagagaaagagcagtccaagcataaaaggaaaaagagttatgaagatacagatttagacaaagacaagagcatcagacaaaggaaaagagaggaggatagagtcaaggtcagttcaggaaagcttaagcatcgaaaaaagaaaaaaagccatgatgtaccctccgagaaagaagaacgtaagcacaggaaagagaaaaagaaatctgttgaagaaaggacagaagaggaaatgctttgggatgagtctattcttggattttgaatgtttagttttgtttacccaaggttgaattgaaaaaaaaaaacagtcaatatggatttagaaaaaggaacacctgatgaagaaaaggagaggtagatacagtcagtgtcacttcaggacacttaggttttttttgtataaaaatttaaattgaattaaaagaaggaaaaaaaaagcccaaacttaacctctgagaaaagaacataagaactcaaggagaacataagagaaaaggaaacctgttacagaaaagacaagaatctgtgttttggaatgagtctattcttgggtattgaacttttagttttgtttgcccaaggattaattgaggaaatcagctaagaaaatggactttagacaaaagcaagaggatcagatgaagaaaaggagaggtagatacagtcagtgtcacttcaggaaagctatttaaaaaaacttgaaatttaattgaaagaagaaacaacaacaaaaaagcctaaacctagcctctgaacaacactaacatgagaacacaagaacttaagagaaaaagaaacctactcaagaaaagacagaagagacagtgatttgggatgagtctactctaggattttcaactttttagttttgttccttcaaagttgaaggaaaaaaagtttggttttataaaattcatgttattgtaatttttctaggtggatggctactttaatctctaaaaaagccaagtgaagtaaaagtattcagtatgccttttcctcaagttactttccttcattttcttaaaaaagaaaaaaaattattaaatgtttctcacatatctcacatataatgtaatttccctaaatgaagttgtctctacttctgctcatcaaattgctgtgatagtgaattatttattcatgggagataatttattttaaaggacagaattaccaagcgttacaaaatcagttctttccttggttttgtgttagtgttggtggtattttattgttgtttttctgtgtttatgtgtctcagctttctccaaggaatatgtatgaaataacttaaactgattttttctttgttaaatctaatttgcagtgtatttttgcattttctagttctgaaagtggaaaatgaaacagtctataataaacttagatgatatatagttttaaaacggtctcaaaaagtactgatataaggtcagtctatattctggaaatgtttatattaaagtgttttaatttctaaatattgtt

SEQ ID NO: 418203 - DNA, 5692 bp, Homo sapiens
gagggcataattttttctcaattcatatttgcaaattgtttattgagagtcagtgttgtatagagggataaacatagatttggagatacagtcacttgccaagttgcaccgcagattcctctggtataaaatgaaaataatgtgactctacaggattgaataataattaactgaagtagtatatatagtacccatcacagaataggtttgtaacaaatgttaggtttgtaaaaatgttttgtcctgtcataattttaaaataggtaaattggacattttctgtttttctttataacataaatccgatattcacatgcagtttttttccaacttttattttaagttcatgggtgcatgtgcagatgtgaaggttcgttatataagtaaatgtgtgccatggtggttttgctgcacagatcatcccatcacctaggtattaagcccagcgttcattagcaattcttcctgacagctgcagttttgattatgtgcagctctcaattggcttttccccgtttaagatgttagaccagtggttctcagccttgactaattagaatcatgtgaggagcttttagaactcccattgctcaggccaaccctccaatcaattaaattaccatctctgggacttacacatttgtgttttgttttctcttttttgactccctaagtgatttttatatggagccaagattgaaaacagtgttagacacacactttcccaatttatgctttgaaaacaaagaccttagttcagagacttatgagatagggttatgattaggggaagagtaggccccacaagtttcagggtagtgaagattctgaagggtacaagcgataaaggagcctgagtttctgggtgaactcagaaacaaggaatcctagaagggctgagagcagaacagaacctcggaatagtctctgaaataaaagagtggagagtataagaaacagaatggaggcaggccccaggaggattcaatcaggaattctgaccttggggccataaataggtttcatatcttcacagaaagggtttacacaacttttgtatatcattttctgagatgtctgaatcctagaaaaagataaagaacatcagtatgtgaaaaagccaagggctaaggtaatggtaatcagactacagttctagaaatgcctctggatctttaatacatgactggcagctcttctaaacctctatgttacctctattagaatattatttctgatgtagtttgtggagaaacaaagcaggaatggaggagaacactgtatacagtatactttataagcactaaataaatatgtaaaaactctgaaatataatctgagtttatagtcataatgaagattattagctcaataatctagggtagaggtgtccaatctttcggcttccatgggccacgttggaagaagaattaccttgggccacacataaaatacactaacactaacaataactgatgagttaaaaaaaatcacataaaaatctcataatgttttaagaacatttgtgaatttgtgttgagtcacattcaaagacaccttgggccacatgtggcctgtgggctgcaagttggacaagcttgatctagggcaagtgctcaacagtggctgcacagttaaatcgtgtgtaaagctttcaaaaagtaagggtgcctaattccactcctagagattctgatttaattggtctgacatggagttgtaacatcaatatttttgaatttttccatatgattctaatgtgtaaccagcattgagaaccactaatccagaggaaaccaggactcctgcttatcttgcacaacttgggtaccctcaaaatatatggtattggcaaagttaatctgagcctaagttccagcacctgtaaaagatggtacgaatttcctaaaagaggttgttgtgaatatgtactctcctgggtttagtccttagctttgcaagaagtccaaaatcttcaagatgatcagcctcaaatcagggactcactaaccgcaaacaaacttgaaagtggctgataactaactggaaagatattactttaatatgtttctcacaaagcctgtgataatcatttgccatatttgtgatcatagaaatttcttgtccctgccctagaaacattgaatcatgttctccaggggagagcctgggaatctatatttttaactgacaccccagttgatttttatcaaagaagtctgggaaacattgtactttaagttattgtattgtcattctggtattgatttatggtaagaggagatacatatttccatttcctagtttttcttgatgtctgtcatccagggtatccttttcttggtatcaaagaatatgaaaaaccaattataatcagaaagtgacttagtatgcatgaaattagagcatagaaaaggatagttttgagggaacatttcattcatattttgacataacctgctgagttttcctgggcccgcaatagccagtagtgtgcagcctcattttcttcagagtcagcatctttctttccccttgcaagcagtctcctgtttctatgaatagtctttgctcagacaaggccaatatacttggtaataattaatttagcttctttgaaatgattaggtcactttttggtttaaaagattaccatggttgtccccaaaatctttgcatgtaccaatttatttcctcctccctagggtcagaatgattttatatttggcttatgaaatgtattaatttgcttcttctggtcaaagataagtggaaggatgatgagatttttaaaaaattaatgtatcccttgcttctaattctacctacaaagtggaatagtgtgctagttactatatagttcccagtgtatagcttttgactcttttgaagtggtaactagtagttttgttttagaattttgctttcagcttttatcctgagagtggggctcactgaacctctctcctttctaaaatctgtggaaattacttttggtaactaaggcactgcagtgatctcaggtaagagagtaaaaaatttgcctttatttgtttttaatgttttgggacgtttcaggttttggttgggtggaaacagagttggggcaaacaaaaagaggctggttaagagattcagaggcaaaggttggttggccatgctaaatttcaggtgcctgttgcacctccatgtagcaacagtaagtagacagatagcagattcttagggaagaagttaagctagagaagcagtgtggtgtggtgtaaagaattctgggcattcaattaagaggtgtgggctctgagaggctaacactactactaacttgctctgtgactttgaccaagtcatttgacctctctgggccccatctttattggaaaatgtcaagtagatggtctctaataaatttttgtccagttctaacattatgtgattctaaatgtatttatactgaccttcttaacttgaactctttgttttttcagcatttagtatgagaacctatgtttgccatatttgtagtattgcttttacatctttagatatgttccggtcccacatgcaaggaagtgaacatcaaattaaagaatccattgttatcaatctagtgaagaattcaaggaagacacaagactcttaccaaaatgagtgtgcagattacatcaatgtgcagaaagccagaggactagaggccaagacttgtttcagaaagatggaagagagttctttggaaacccgtagatacagagaagtggtcgattccagacccagacatagaatgtttgaacaaagactcccatttgagactttccggacatacgcagcaccatacaatatttcacaagcaatggaaaagcagttacctcattcaaagaagacatatgactctttccaagatgaacttgaagattacatcaaagtacagaaagccagaggactagatccaaagacttgtttcagaaagatgagagagaactctgtggatactcatgggtacagagaaatggttgattctggacccagatcaagaatgtgtgagcaaagattttcacatgaggcttcccagacctaccaacgaccataccatatttcaccagtggaaagccagttacctcagtggctaccaacccattcaaagaggacatatgattctttccaagatgaacttgaagattacataaaagtgcaaagaaaggccagagaaagagcagtccaagcataaaaggaaaaagagttatgaagatacagatttagacaaagacaagagcatcagacaaaggaaaagagaggaggatagagtcaaggtcagttcaggaaagcttaagcatcgaaaaaagaaaaaaagccatgatgtaccctccgagaaagaagaacgtaagcacaggaaagagaaaaagaaatctgttgaagaaaggacagaagaggaaatgctttgggatgagtctattcttggattttgaatgtttagttttgtttacccaaggttgaattgaaaaaaaaaaacagtcaatatggatttagaaaaaggaacacctgatgaagaaaaggagaggtagatacagtcagtgtcacttcaggacacttaggttttttttgtataaaaatttaaattgaattaaaagaaggaaaaaaaaagcccaaacttaacctctgagaaaagaacataagaactcaaggagaacataagagaaaaggaaacctgttacagaaaagacaagaatctgtgttttggaatgagtctattcttgggtattgaacttttagttttgtttgcccaaggattaattgaggaaatcagctaagaaaatggactttagacaaaagcaagaggatcagatgaagaaaaggagaggtagatacagtcagtgtcacttcaggaaagctatttaaaaaaacttgaaatttaattgaaagaagaaacaacaacaaaaaagcctaaacctagcctctgaacaacactaacatgagaacacaagaacttaagagaaaaagaaacctactcaagaaaagacagaagagacagtgatttgggatgagtctactctaggattttcaactttttagttttgttccttcaaagttgaaggaaaaaaagtttggttttataaaattcatgttattgtaatttttctaggtggatggctactttaatctctaaaaaagccaagtgaagtaaaagtattcagtatgccttttcctcaagttactttccttcattttcttaaaaaagaaaaaaaattattaaatgtttctcacatatctcacatataatgtaatttccctaaatgaagttgtctctacttctgctcatcaaattgctgtgatagtgaattatttattcatgggagataatttattttaaaggacagaattaccaagcgttacaaaatcagttctttccttggttttgtgttagtgttggtggtattttattgttgtttttctgtgtttatgtgtctcagctttctccaaggaatatgtatgaaataacttaaactgattttttctttgttaaatctaatttgcagtgtatttttgcattttctagttctgaaagtggaaaatgaaacagtctataataaacttagatgatatatagttttaaaacggtctcaaaaagtactgatataaggtcagtctatattctggaaatgtttatattaaagtgttttaatttctaaatattgtt

SEQ ID NO: 418204 - DNA, 4795 bp, Homo sapiens
gagggcataattttttctcaattcatatttgcaaattgtttattgagagtcagtgttgtatagagggataaacatagatttggagatacagtcacttgccaagttgcaccgcagattcctctggtataaaatgaaaataatgtgactctacaggattgaataataattaactgaagtagtatatatagtacccatcacagaataggtttgtaacaaatgttaggtttgtaaaaatgttttgtcctgtcataattttaaaataggtaaattggacattttctgtttttctttataacataaatccgatattcacatgcagtttttttccaacttttattttaagttcatgggtgcatgtgcagatgtgaaggttcgttatataagtaaatgtgtgccatggtggttttgctgcacagatcatcccatcacctaggtattaagcccagcgttcattagcaattcttcctgacagctgcagttttgattatgtgcagctctcaattggcttttccccgtttaagatgttagaccagtggttctcagccttgactaattagaatcatgtgaggagcttttagaactcccattgctcaggccaaccctccaatcaattaaattaccatctctgggacttacacatttgtgttttgttttctcttttttgactccctaagtgatttttatatggagccaagattgaaaacagtgttagacacacactttcccaatttatgctttgaaaacaaagaccttagttcagagacttatgagatagggttatgattaggggaagagtaggccccacaagtttcagggtagtgaagattctgaagggtacaagcgataaaggagcctgagtttctgggtgaactcagaaacaaggaatcctagaagggctgagagcagaacagaacctcggaatagtctctgaaataaaagagtggagagtataagaaacagaatggaggcaggccccaggaggattcaatcaggaattctgaccttggggccataaataggtttcatatcttcacagaaagggtttacacaacttttgtatatcattttctgagatgtctgaatcctagaaaaagataaagaacatcagtatgtgaaaaagccaagggctaaggtaatggtaatcagactacagttctagaaatgcctctggatctttaatacatgactggcagctcttctaaacctctatgttacctctattagaatattatttctgatgtagtttgtggagaaacaaagcaggaatggaggagaacactgtatacagtatactttataagcactaaataaatatgtaaaaactctgaaatataatctgagtttatagtcataatgaagattattagctcaataatctagggtagaggtgtccaatctttcggcttccatgggccacgttggaagaagaattaccttgggccacacataaaatacactaacactaacaataactgatgagttaaaaaaaatcacataaaaatctcataatgttttaagaacatttgtgaatttgtgttgagtcacattcaaagacaccttgggccacatgtggcctgtgggctgcaagttggacaagcttgatctagggcaagtgctcaacagtggctgcacagttaaatcgtgtgtaaagctttcaaaaagtaagggtgcctaattccactcctagagattctgatttaattggtctgacatggagttgtaacatcaatatttttgaatttttccatatgattctaatgtgtaaccagcattgagaaccactaatccagaggaaaccaggactcctgcttatcttgcacaacttgggtaccctcaaaatatatggtattggcaaagttaatctgagcctaagttccagcacctgtaaaagatggtacgaatttcctaaaagaggttgttgtgaatatgtactctcctgggtttagtccttagctttgcaagaagtccaaaatcttcaagatgatcagcctcaaatcagggactcactaaccgcaaacaaacttgaaagtggctgataactaactggaaagatattactttaatatgtttctcacaaagcctgtgataatcatttgccatatttgtgatcatagaaatttcttgtccctgccctagaaacattgaatcatgttctccaggggagagcctgggaatctatatttttaactgacaccccagttgatttttatcaaagaagtctgggaaacattgtactttaagttattgtattgtcattctggtattgatttatggtaagaggagatacatatttccatttcctagtttttcttgatgtctgtcatccagggtatccttttcttggtatcaaagaatatgaaaaaccaattataatcagaaagtgacttagtatgcatgaaattagagcatagaaaaggatagttttgagggaacatttcattcatattttgacataacctgctgagttttcctgggcccgcaatagccagtagtgtgcagcctcattttcttcagagtcagcatctttctttccccttgcaagcagtctcctgtttctatgaatagtctttgctcagacaaggccaatatacttggtaataattaatttagcttctttgaaatgattaggtcactttttggtttaaaagattaccatggttgtccccaaaatctttgcatgtaccaatttatttcctcctccctagggtcagaatgattttatatttggcttatgaaatgtattaatttgcttcttctggtcaaagataagtggaaggatgatgagatttttaaaaaattaatgtatcccttgcttctaattctacctacaaagtggaatagtgtgctagttactatatagttcccagtgtatagcttttgactcttttgaagtggtaactagtagttttgttttagaattttgctttcagcttttatcctgagagtggggctcactgaacctctctcctttctaaaatctgtggaaattacttttggtaactaaggcactgcagtgatctcaggtaagagagtaaaaaatttgcctttatttgtttttaatgttttgggacgtttcaggttttggttgggtggaaacagagttggggcaaacaaaaagaggctggttaagagattcagaggcaaaggttggttggccatgctaaatttcaggtgcctgttgcacctccatgtagcaacagtaagtagacagatagcagattcttagggaagaagttaagctagagaagcagtgtggtgtggtgtaaagaattctgggcattcaattaagaggtgtgggctctgagaggctaacactactactaacttgctctgtgactttgaccaagtcatttgacctctctgggccccatctttattggaaaatgtcaagtagatggtctctaataaatttttgtccagttctaacattatgtgattctaaatgtatttatactgaccttcttaacttgaactctttgttttttcagcatttagtatgagaacctatgtttgccatatttgtagtattgcttttacatctttagatatgttccggtcccacatgcaaggaagtgaacatcaaattaaagaatccattgttatcaatctagtgaagaattcaaggaagacacaagactcttaccaaaatgagtgtgcagattacatcaatgtgcagaaagccagaggactagaggccaagacttgtttcagaaagatggaagagagttctttggaaacccgtagatacagagaagtggtcgattccagacccagacatagaatgtttgaacaaagactcccatttgagactttccggacatacgcagcaccatacaatatttcacaagcaatggaaaagcagttacctcattcaaagaagacatatgactctttccaagatgaacttgaagattacatcaaagtacagaaagccagaggactagatccaaagacttgtttcagaaagatgagagagaactctgtggatactcatgggtacagagaaatggttgattctggacccagatcaagaatgtgtgagcaaagattttcacatgaggcttcccagacctaccaacgaccataccatatttcaccagtggaaagccagttacctcagtggctaccaacccattcaaagaggacatatgattctttccaagatgaacttgaagattacataaaagtgcagaaagccagaggactagagccaaaaacttgtttcagaaagataggagatagctctgtagaaacacacaggaacagagaaatggttgatgtcagacccagacatagaatgttggagcaaaagctcccatgtgagactttccagacctattcaggaccatatagtatttcacaagtagtggaaaaccagttacctcattgcttaccagctcatgatagcaaacagagactagattctattagctactgtcaactcaccagagactgtttcccagaaaaaccagtacccttgagccttaatcagcaagaaaataactctggctcatacagtgtagaatctgaagtttacaagcacctctcttcagaaaacaatactgctgaccatcaagcaggtcataaacggaaacatcagaagagaaaacgacacctagaagaaggcaaagaaaggccagagaaagagcagtccaagcataaaaggaaaaagagttatgaagatacagatttagacaaaagaaccaagagagccttccagaaccaaaaggggaaaaaaggaagaaagggaagggaataaagaagttccaaaaggggtcccaagtttccaagggaa

SEQ ID NO: 418205 - DNA, 6070 bp, Homo sapiens
gagggcataattttttctcaattcatatttgcaaattgtttattgagagtcagtgttgtatagagggataaacatagatttggagatacagtcacttgccaagttgcaccgcagattcctctggtataaaatgaaaataatgtgactctacaggattgaataataattaactgaagtagtatatatagtacccatcacagaataggtttgtaacaaatgttaggtttgtaaaaatgttttgtcctgtcataattttaaaataggtaaattggacattttctgtttttctttataacataaatccgatattcacatgcagtttttttccaacttttattttaagttcatgggtgcatgtgcagatgtgaaggttcgttatataagtaaatgtgtgccatggtggttttgctgcacagatcatcccatcacctaggtattaagcccagcgttcattagcaattcttcctgacagctgcagttttgattatgtgcagctctcaattggcttttccccgtttaagatgttagaccagtggttctcagccttgactaattagaatcatgtgaggagcttttagaactcccattgctcaggccaaccctccaatcaattaaattaccatctctgggacttacacatttgtgttttgttttctcttttttgactccctaagtgatttttatatggagccaagattgaaaacagtgttagacacacactttcccaatttatgctttgaaaacaaagaccttagttcagagacttatgagatagggttatgattaggggaagagtaggccccacaagtttcagggtagtgaagattctgaagggtacaagcgataaaggagcctgagtttctgggtgaactcagaaacaaggaatcctagaagggctgagagcagaacagaacctcggaatagtctctgaaataaaagagtggagagtataagaaacagaatggaggcaggccccaggaggattcaatcaggaattctgaccttggggccataaataggtttcatatcttcacagaaagggtttacacaacttttgtatatcattttctgagatgtctgaatcctagaaaaagataaagaacatcagtatgtgaaaaagccaagggctaaggtaatggtaatcagactacagttctagaaatgcctctggatctttaatacatgactggcagctcttctaaacctctatgttacctctattagaatattatttctgatgtagtttgtggagaaacaaagcaggaatggaggagaacactgtatacagtatactttataagcactaaataaatatgtaaaaactctgaaatataatctgagtttatagtcataatgaagattattagctcaataatctagggtagaggtgtccaatctttcggcttccatgggccacgttggaagaagaattaccttgggccacacataaaatacactaacactaacaataactgatgagttaaaaaaaatcacataaaaatctcataatgttttaagaacatttgtgaatttgtgttgagtcacattcaaagacaccttgggccacatgtggcctgtgggctgcaagttggacaagcttgatctagggcaagtgctcaacagtggctgcacagttaaatcgtgtgtaaagctttcaaaaagtaagggtgcctaattccactcctagagattctgatttaattggtctgacatggagttgtaacatcaatatttttgaatttttccatatgattctaatgtgtaaccagcattgagaaccactaatccagaggaaaccaggactcctgcttatcttgcacaacttgggtaccctcaaaatatatggtattggcaaagttaatctgagcctaagttccagcacctgtaaaagatggtacgaatttcctaaaagaggttgttgtgaatatgtactctcctgggtttagtccttagctttgcaagaagtccaaaatcttcaagatgatcagcctcaaatcagggactcactaaccgcaaacaaacttgaaagtggctgataactaactggaaagatattactttaatatgtttctcacaaagcctgtgataatcatttgccatatttgtgatcatagaaatttcttgtccctgccctagaaacattgaatcatgttctccaggggagagcctgggaatctatatttttaactgacaccccagttgatttttatcaaagaagtctgggaaacattgtactttaagttattgtattgtcattctggtattgatttatggtaagaggagatacatatttccatttcctagtttttcttgatgtctgtcatccagggtatccttttcttggtatcaaagaatatgaaaaaccaattataatcagaaagtgacttagtatgcatgaaattagagcatagaaaaggatagttttgagggaacatttcattcatattttgacataacctgctgagttttcctgggcccgcaatagccagtagtgtgcagcctcattttcttcagagtcagcatctttctttccccttgcaagcagtctcctgtttctatgaatagtctttgctcagacaaggccaatatacttggtaataattaatttagcttctttgaaatgattaggtcactttttggtttaaaagattaccatggttgtccccaaaatctttgcatgtaccaatttatttcctcctccctagggtcagaatgattttatatttggcttatgaaatgtattaatttgcttcttctggtcaaagataagtggaaggatgatgagatttttaaaaaattaatgtatcccttgcttctaattctacctacaaagtggaatagtgtgctagttactatatagttcccagtgtatagcttttgactcttttgaagtggtaactagtagttttgttttagaattttgctttcagcttttatcctgagagtggggctcactgaacctctctcctttctaaaatctgtggaaattacttttggtaactaaggcactgcagtgatctcaggtaagagagtaaaaaatttgcctttatttgtttttaatgttttgggacgtttcaggttttggttgggtggaaacagagttggggcaaacaaaaagaggctggttaagagattcagaggcaaaggttggttggccatgctaaatttcaggtgcctgttgcacctccatgtagcaacagtaagtagacagatagcagattcttagggaagaagttaagctagagaagcagtgtggtgtggtgtaaagaattctgggcattcaattaagaggtgtgggctctgagaggctaacactactactaacttgctctgtgactttgaccaagtcatttgacctctctgggccccatctttattggaaaatgtcaagtagatggtctctaataaatttttgtccagttctaacattatgtgattctaaatgtatttatactgaccttcttaacttgaactctttgttttttcagcatttagtatgagaacctatgtttgccatatttgtagtattgcttttacatctttagatatgttccggtcccacatgcaaggaagtgaacatcaaattaaagaatccattgttatcaatctagtgaagaattcaaggaagacacaagactcttaccaaaatgagtgtgcagattacatcaatgtgcagaaagccagaggactagaggccaagacttgtttcagaaagatggaagagagttctttggaaacccgtagatacagagaagtggtcgattccagacccagacatagaatgtttgaacaaagactcccatttgagactttccggacatacgcagcaccatacaatatttcacaagcaatggaaaagcagttacctcattcaaagaagacatatgactctttccaagatgaacttgaagattacatcaaagtacagaaagccagaggactagatccaaagacttgtttcagaaagatgagagagaactctgtggatactcatgggtacagagaaatggttgattctggacccagatcaagaatgtgtgagcaaagattttcacatgaggcttcccagacctaccaacgaccataccatatttcaccagtggaaagccagttacctcagtggctaccaacccattcaaagaggacatatgattctttccaagatgaacttgaagattacataaaagtgcagaaagccagaggactagagccaaaaacttgtttcagaaagataggagatagctctgtagaaacacacaggaacagagaaatggttgatgtcagacccagacatagaatgttggagcaaaagctcccatgtgagactttccagacctattcaggaccatatagtatttcacaagtagtggaaaaccagttacctcattgcttaccagctcatgatagcaaacagagactagattctattagctactgtcaactcaccagagactgtttcccagaaaaaccagtacccttgagccttaatcagcaagaaaataactctggctcatacagtgtagaatctgaagtttacaagcacctctcttcagaaaacaatactgctgaccatcaagcaggtcataaacggaaacatcagaagagaaaacgacacctagaagaaggcaaagaaaggccagagaaagagcagtccaagcataaaaggaaaaagagttatgaagatacagatttagacaaagacaagagcatcagacaaaggaaaagagaggaggatagagtcaaggtcagttcaggaaagcttaagcatcgaaaaaagaaaaaaagccatgatgtaccctccgagaaagaagaacgtaagcacaggaaagagaaaaagaaatctgttgaagaaaggacagaagaggaaatgctttgggatgagtctattcttggattttgaatgtttagttttgtttacccaaggttgaattgaaaaaaaaaaacagtcaatatggatttagaaaaaggaacacctgatgaagaaaaggagaggtagatacagtcagtgtcacttcaggacacttaggttttttttgtataaaaatttaaattgaattaaaagaaggaaagaaaaggaaacctgttacagaaaagacaagaatctgtgttttggaatgagtctattcttgggtattgaacttttagttttgtttgcccaaggattaattgaggaaatcagctaagaaaatggactttagacaaaagcaagaggatcagatgaagaaaaggagaggtagatacagtcagtgtcacttcaggaaagctatttaaaaaaacttgaaatttaattgaaagaagaaacaacaacaaaaaagcctaaacctagcctctgaacaacactaacatgagaacacaagaacttaagagaaaaagaaacctactcaagaaaagacagaagagacagtgatttgggatgagtctactctaggattttcaactttttagttttgttccttcaaagttgaaggaaaaaaagtttggttttataaaattcatgttattgtaatttttctaggtggatggctactttaatctctaaaaaagccaagtgaagtaaaagtattcagtatgccttttcctcaagttactttccttcattttcttaaaaaagaaaaaaaattattaaatgtttctcacatatctcacatataatgtaatttccctaaatgaagttgtctctacttctgctcatcaaattgctgtgatagtgaattatttattcatgggagataatttattttaaaggacagaattaccaagcgttacaaaatcagttctttccttggttttgtgttagtgttggtggtattttattgttgtttttctgtgtttatgtgtctcagctttctccaaggaatatgtatgaaataacttaaactgattttttctttgttaaatctaatttgcagtgtatttttgcattttctagttctgaaagtggaaaatgaaacagtctataataaacttagatgatatatagttttaaaacggtctcaaaaagtactgatataaggtcagtctatattctggaaatgtttatattaaagtgttttaatttctaaatattgtt

SEQ ID NO: 418206 - DNA, 815 bp, Homo sapiens
tattgatatcgtctttaatttctttcagcaatgttttgtagttttcagggtataatcatttgacctttttggttaaacttattccaaaatattttattccttttgatgttaatgtgaattgaaattctttccttaacttcctttcagattgttcattgttagtgtattgtctaaagaatgatctagaaagagtgaaggggacaggcagaagctggtggttttggagcagaaacatattccctttcctgggttttgattttccctctccctttgcagagagcaggtggctcttccctgacagctagatagactttactggaaaacatggtgccaatgctccagggatccacttaccagggactatgatcctcttgattatgagatttgttccaccagtggctgagttatggatgaaacagacatagacccctctatatgttttagtgatttggggtataaagaacacttgtgctgattgctggaacttccccatcaatcagccaagaatgctctgccagtgggtgagagtctgtgaggcaggagagcttggggacttcccctgtatggtaataggtgtatgaggaagaaacggtgggagcatccaggccatgcggagcaaagagaataatgtcacaggcgatattgtcagagggaagggaaaatcctggtctgtggaagggacacagtcacagtgaccctgtgagccaagttgcaacactgaagtcccagccaaatccccgctgtgttcactgatctggagcctgagacattcacctgtttcttccatcacaagctgtggaacctgagtctcccat

SEQ ID NO: 418207 - DNA, 717 bp, Homo sapiens
  misc_feature (41)..(41): n is a, c, g, or t
  misc_feature (82)..(82): n is a, c, g, or t
  misc_feature (101)..(101): n is a, c, g, or t
  misc_feature (112)..(112): n is a, c, g, or t
  misc_feature (119)..(119): n is a, c, g, or t
  misc_feature (139)..(139): n is a, c, g, or t
  misc_feature (146)..(146): n is a, c, g, or t
  misc_feature (154)..(154): n is a, c, g, or t
  misc_feature (166)..(166): n is a, c, g, or t
  misc_feature (169)..(169): n is a, c, g, or t
  misc_feature (172)..(173): n is a, c, g, or t
  misc_feature (175)..(175): n is a, c, g, or t
  misc_feature (178)..(178): n is a, c, g, or t
  misc_feature (180)..(180): n is a, c, g, or t
  misc_feature (211)..(211): n is a, c, g, or t
  misc_feature (220)..(220): n is a, c, g, or t
  misc_feature (225)..(225): n is a, c, g, or t
  misc_feature (241)..(241): n is a, c, g, or t
  misc_feature (245)..(245): n is a, c, g, or t
  misc_feature (247)..(247): n is a, c, g, or t
  misc_feature (251)..(251): n is a, c, g, or t
  misc_feature (253)..(253): n is a, c, g, or t
aaaaaccaataacaaaaaaaaaaaaaaaccagaaaccaaantaaaccaaaaaaaaaaaaaaaaccaaaaagagaaaaaacanaaacaaaaacaaaaacaancaaaaaaaaanaaaatanaaaaaaaaaaataaaaacanaaaaaanacaaacanaaaataaaaacnacnacnncnacnanaaaaaaaaaaaccaacaaaaaaaaaaaaaanaaaaaaaanaaaanaaaaaaaaaaaaaacnaaananaccnanaaaaaccaaaaaaatactttttcttttcgtgtattcaaggttaaacacccaaacatttaaggatatgttgaaactacaccaatagagcatttcatatcataattaaaatgaatgttaggcttcttgtggccagttaatagttgatgagattggtgacattatttattgccacagcctattgtataaactatgcagagttaaatatttgcttgtaaaatattagccaatgttgtcattattttgatgtatttccttggttatgaccaaaaatatgttgagatactgaaactaatgtctgtgtgtttaaatgtttaccagcaaattgtcttatcatgttaatgagaatgttcaatgcctgtgtggtaaatagtaaatacaatggcataaaagtaactttctctgaagatgtgatgttcaggctgtgaaatatatatgtaaaagaaaaataaatgttatttgttaga

SEQ ID NO: 418208 - DNA, 897 bp, Homo sapiens
tcagatatatacattgtattttctcccactctgcaggttgcctttttactcttgctgtgcagaagtgttttagtttaattaggtcccatttatttatttttgttgcatttgcctttgggttcttggtcatgaattctttaagtcaatgtctagagtagttttttttgatgttatcttctagaatttttatggtttcaagtgttagatttaagtttgacccatcttgagttaatttttgtataaggtgagagatgaggattcagggactaacaggtatttgacactgtccccatcattctcaacatttattttgacctcacatggttttcattagcaacacatgcccatgaataacatcttgtttccctgcagtggctaccacctggggatataaaagcattccttatactcaggaagtcatatcagtttcctggagtggcaatggaaaggagatggggtagaggatgcagagacgggcaggaccatgtgagatggaactgtgtagtttgaccctacccccatcctagttgggaatcactactctctataggtgtgagtgaacaaaaaagataagaatgaataagcaaaatatttgactgaaagacaggttgtccctgatgacgacttataacaatcatttatgatgtatttttgttattgtgtttctttaaaagaaatgtttgcctctgggacacattaatatcacccggaaacagcctcattcatggtgagttaaggtctatgatttttaaaaatataccatgaaggaataatacaccatgaaggaatgctttcttggttttaattagtgaatccagtgagtgtttattgacaggttgaaaatggagaaatatttagaatgaatgactaaaaatttggaaagttaattagcatatc

SEQ ID NO: 418209 - DNA, 768 bp, Homo sapiens
aaattattctttaccactgcaaatgctcattttaaagttggatgccctgttttagccttggaggtactctccaaaattccaaaagtaaccaaaacatctgccttatctgcaaaaaaagatcagcctgacttcatttctcacaggatggatgatgtaccttcacattcaaaagctctgagtgatggcaatggaagttctggcattgaatggtcaaatgtaacttcatcacagtatgactggagtcagccaatagtaaaagttgatgaggaacctcttaatcttgattggggtgaagatcacgacagtgccttagatgaagaggaagacgatgctgttggtttagtgatgaaaagtacagatgccagggaaaaagataaacaatcagatcagaaggcctcagaccctaacatgttattaacacctcaggaagaggatgatcctgaaggtgatactgaagttgatgtgattgctgaacaactaaaattcagagcttgtttaaagatccttatgactgaattaagaacattggctacaggttatgaagtagatggaggaaaactcagatttcaactctataactggcttgaaaaggaaattgctgccttgcatgagatatgtaatcatgaatcagttattaaagagtattccagtaagacatattccaaagtagagagtgatctgctggatcaggaagaaatggtagacaaccaccaccttgggccccatgaaggctacgtagctgagaaatactctcaggagatctgcttt

SEQ ID NO: 418210 - DNA, 4724 bp, Homo sapiens
aaattattctttaccactgcaaatgctcattttaaagttggatgccctgttttagccttggaggtactctccaaaattccaaaagtaaccaaaacatctgccttatctgcaaaaaaagatcagcctgacttcatttctcacaggatggatgatgtaccttcacattcaaaagctctgagtgatggcaatggaagttctggcattgaatggtcaaatgtaacttcatcacagtatgactggagtcagccaatagtaaaagttgatgaggaacctcttaatcttgattggggtgaagatcacgacagtgccttagatgaagaggaagacgatgctgttggtttagtgatgaaaagtacagatgccagggaaaaagataaacaatcagatcagaaggcctcagaccctaacatgttattaacacctcaggaagaggatgatcctgaaggtgatactgaagttgatgtgattgctgaacaactaaaattcagagcttgtttaaagatccttatgactgaattaagaacattggctacaggttatgaagtagatggaggaaaactcagatttcaactctataactggcttgaaaaggaaattgctgccttgcatgagatatgtaatcatgaatcagttattaaagagtattccagtaagacatattccaaagtagagagtgatctgctggatcaggaagaaatggtagacaaaccagatattggttcctatgagcgccatcaaatagaaagaagaagattgcaggccaaacgagagcatgcagaaagacgaaagtcgtggttgcagaaaaaccaagatctcctgagagtatttctcagctactgtagccttcatggggcccaaggtggtggtttggcttcagtaaggatggaactcaaatttttgctacaagaatcacaacaggaaactacagtaaagcagctccagtctccactaccactgcctaccaccctacctctgctttcagcaagtattgcgtcaacaaaaacagtcatagctaatcctgtattgtacttaaataatcacatccatgatatactttatactattgttcagatgaaaacaccacctcatcccagtattgaagatgtgaaggtgcacacacttcattcactagcagcatcactttctgcatcaatttaccaagcattatgtgacagtcatagctacagcagtcaaacagaaggaaatcagtttacaggaatggcttatcaaggacttcttttaagtgatcgtagaagactaaggacagaaagcattgaagaacacgcaacaccaaattcatctcctgctcaatggcctggtgtgagctcacttattaatcttttgagttcagcccaagatgaagaccagccaaaactgaacattttgctatgtgaagctgttgttgctgtttacttaagtttattgatacatgctcttgccacaaattcctccagtgaattatttcggcttgcagcccacccattaaataatcgaatgtgggctgctgtttttggaggcggtgtaaaacttgttgtgaaacctcgaagacaatcagaaaatatttcagcacctcctgtcctttctgaagacatagataaacaccgtaggagatttaacatgagaatgctcgtccctggaaggcctgtaaaagatgctaccccaccaccggtgcctgcagaaagaccatcttacaaagaaaaatttattcctcccgaacttagtatgtgggattattttgttgcaaagccatttcttcctttgtctgatagtggtgttatatatgattctgatgaaagcattcatagtgatgaagaagatgatgcctttttttcagatacacaaatacaggagcaccaagatccaaattcctatagctgggctcttctacatttgacaatggttaaactagcacttcacaatgtcaagaatttctttcctattgctggactggaattctctgagctgcctgtaacatcaccattaggtattgctgtgattaaaaacttggagaactgggaacagatcttgcaagagaaaatggatcagtttgaaggtccaccccctaactatatcaacacatatccaactgacctttcagtgggagctggaccagctattcttcgaaataaagcaatgctagaacctgaaaataccccattcaagtcccgggattcttctgcatttccagtcaaacgactttggcatttccttgttaaacaagaggtccttcaagagacatttattagatatattttcactaagaaaagaaagcagagtgagtctatagaagaacatgtggagcaggtcaaccaaaactgcatagcagaagattgccacatcaaggttgaagctgatctgggctatccaggtggaaaggcgaaagtcatccataaggaatctgatatgatcatggcattttctgttaataaggcaaattgtaatgaaattgttttggcttcaacacatgatgttcaagaacttgatgttacttctctactggcctgtcagtcatacatatggatcggagaagaatatgacagagaatccaaaagttcagatgatgttgattatcgtggttccactacaactctttatcaacccagtgcaacatcctattcagcaagtcaggtgcatccaccttcatctctgccatggctgggcactggacagactagcactggagctagtgtgcttatgaaaaggaatctacataatgttaagagaatgacttcacacccagtccatcaatactatcttacaggtgctcaggacggcagtgtacgaatgtttgaatggacgcggcctcagcaacttgtctgctttcgtcaagctggcaatgcaagagttactagattatattttaattcacaaggcaacaagtgtggtgttgcggatggagagggttttctgagtatctggcaagttaaccaaactgcatcaaatcctaaaccttatatgagttggcagtgccacagtaaagccacaagtgactttgcatttattacctcttcaagtctagttgccacatctggacactccaatgacaatagaaatgtttgcctctgggacacattaatatcacccggaaacagcctcattcatggtttcacgtgccacgatcatggtgccacggtactgcagtatgcacccaaacagcaactcctaatctcggggggtaggaaaggacacgtctgcatttttgacatcaggcaaaggcagctcattcacacgttccaggcccatgactcagctattaaggctctggccttggatccctatgaggaatattttaccacaggttcagcagaaggtaacataaaggtttggagattgacaggccatggcctaattcattcatttaaaagtgaacatgctaagcagtccatatttcgaaacattggggctggagtcatgcagattgacatcatccagggcaatcggctcttctcctgtggtgcagatggcacgctgaaaaccagggttttgcccaatgcttttaacatccctaacagaattcttgacattctataaagattggggttttatttttatatacatttcagttaaaaggcacactacagtcatcactaggcaattctgctttctaagcagttgtattgaaaacagagaatctctgtgtagaatttgaatatgacccaagctgagtattatctaaacaggttggtggaatgaatgcgcatgtaccttattatgctgacatactaaaaaaaataaaacctagtattgtatgaaggatagctattctttacagcatttagcaaacctgattcagaaaacatttgagattagcaaattagtaacttgaaataatgaaaaggacgtttataccaaattaaggaagaaaatgttgctgatttgggtttttcttcctgttcttaccactgactgaagcatgcctgcagtctcctcctctgttgaatgaaggataatcataaggtgtttgttaggagcgctagaccacctggaaaactttcttagctgtggagcagtgcgcagtgaccagttctctgctgtgagaggccgtttccattctttcctgctgaatatttttcctgttagtgtttatactgagctagtactgtaacttgcaaatgagtgcaaatttaaatgcaatgttttactcacaatttgcacattcacattttttggactgctagtttttctatttaaatatttgccttcatgttaggaatgtactatgtgaacatgacatatttgtagttaaccaaacacaccttcttagtccagtttagtactttttcttttcgtgtattcaaggttaaacacccaaacatttaaggatatgttgaaactacaccaatagagcatttcatatcataattaaaatgaatgttaggcttcttgtggccagttaatagttgatgagattggtgacattatttattgccacagcctattgtataaactatgcagagttaaatatttgcttgtaaaatattagccaatgttgtcattattttgatgtatttccttggttatgaccaaaaatatgttgagatactgaaactaatgtctgtgtgtttaaatgtttaccagcaaattgtcttatcatgttaatgagaatgttcaatgcctgtgtggtaaatagtaaatacaatggcataaaagtaactttctctgaagatgtgatgttcaggctgtgaaatatatatgtaaaagaaaaataaatgttatttgttaga

SEQ ID NO: 418211 - DNA, 2852 bp, Homo sapiens
ctatgtttagaaataaatattttaatttgtattttaaatcaacccctatagggcaggaatttatgtagcatcttctgcatctgcttatacaaatgggctttaattttatagattaccagttatgtaacttagatttcttaaaactgtatacagataactaatttttattttgaaatagcttttatgttcttgtgtttatgtaatagtcacattaattttgctcttttggctttgtgttgtgtttatttgatgactgttttattcggtttaattttttcttgattttgcaaattcatttttatcatctttaagtggtggagtggccatttcagcttgaaatatttcactgtctttataatttcattccatgcatgtgttttgtgtttgtgacggtgtggtggtatttagtctatagaagaacatgtggagcaggtcaaccaaaactgcatagcagaagattgccacatcaaggttgaagctgatctgggctatccaggtggaaaggcgaaagtcatccataaggaatctgatatgatcatggcattttctgttaataaggcaaattgtaatgaaattgttttggcttcaacacatgatgttcaagaacttgatgttacttctctactggcctgtcagtcatacatatggatcggagaagaatatgacagagaatccaaaagttcagatgatgttgattatcgtggttccactacaactctttatcaacccagtgcaacatcctattcagcaagtcaggtgcatccaccttcatctctgccatggctgggcactggacagactagcactggagctagtgtgcttatgaaaaggaatctacataatgttaagagaatgacttcacacccagtccatcaatactatcttacaggtgctcaggacggcagtgtacgaatgtttgaatggacgcggcctcagcaacttgtctgctttcgtcaagctggcaatgcaagagttactagattatattttaattcacaaggcaacaagtgtggtgttgcggatggagagggttttctgagtatctggcaagttaaccaaactgcatcaaatcctaaaccttatatgagttggcagtgccacagtaaagccacaagtgactttgcatttattacctcttcaagtctagttgccacatctggacactccaatgacaatagaaatgtttgcctctgggacacattaatatcacccggaaacagcctcattcatggtttcacgtgccacgatcatggtgccacggtactgcagtatgcacccaaacagcaactcctaatctcggggggtaggaaaggacacgtctgcatttttgacatcaggcaaaggcagctcattcacacgttccaggcccatgactcagctattaaggctctggccttggatccctatgaggaatattttaccacaggttcagcagaaggtaacataaaggtttggagattgacaggccatggcctaattcattcatttaaaagtgaacatgctaagcagtccatatttcgaaacattggggctggagtcatgcagattgacatcatccagggcaatcggctcttctcctgtggtgcagatggcacgctgaaaaccagggttttgcccaatgcttttaacatccctaacagaattcttgacattctataaagattggggttttatttttatatacatttcagttaaaaggcacactacagtcatcactaggcaattctgctttctaagcagttgtattgaaaacagagaatctctgtgtagaatttgaatatgacccaagctgagtattatctaaacaggttggtggaatgaatgcgcatgtaccttattatgctgacatactaaaaaaaataaaacctagtattgtatgaaggatagctattctttacagcatttagcaaacctgattcagaaaacatttgagattagcaaattagtaacttgaaataatgaaaaggacgtttataccaaattaaggaagaaaatgttgctgatttgggtttttcttcctgttcttaccactgactgaagcatgcctgcagtctcctcctctgttgaatgaaggataatcataaggtgtttgttaggagcgctagaccacctggaaaactttcttagctgtggagcagtgcgcagtgaccagttctctgctgtgagaggccgtttccattctttcctgctgaatatttttcctgttagtgtttatactgagctagtactgtaacttgcaaatgagtgcaaatttaaatgcaatgttttactcacaatttgcacattcacattttttggactgctagtttttctatttaaatatttgccttcatgttaggaatgtactatgtgaacatgacatatttgtagttaaccaaacacaccttcttagtccagtttagtactttttcttttcgtgtattcaaggttaaacacccaaacatttaaggatatgttgaaactacaccaatagagcatttcatatcataattaaaatgaatgttaggcttcttgtggccagttaatagttgatgagattggtgacattatttattgccacagcctattgtataaactatgcagagttaaatatttgcttgtaaaatattagccaatgttgtcattattttgatgtatttccttggttatgaccaaaaatatgttgagatactgaaactaatgtctgtgtgtttaaatgtttaccagcaaattgtcttatcatgttaatgagaatgttcaatgcctgtgtggtaaatagtaaatacaatggcataaaagtaactttctctgaagatgtgatgttcaggctgtgaaatatatatgtaaaagaaaaataaatgttatttgttaga

SEQ ID NO: 418212 - DNA, 4670 bp, Homo sapiens
aaattattctttaccactgcaaatgctcattttaaagttggatgccctgttttagccttggaggtactctccaaaattccaaaagtaaccaaaacatctgccttatctgcaaaaaaagatcagcctgacttcatttctcacaggatggatgatgtaccttcacattcaaaagctctgagtgatggcaatggaagttctggcattgaatggtcaaatgtaacttcatcacagtatgactggagtcagccaatagtaaaagttgatgaggaacctcttaatcttgattggggtgaagatcacgacagtgccttagatgaagaggaagacgatgctgttggtttagtgatgaaaagtacagatgccagggaaaaagataaacaatcagatcagaaggcctcagaccctaacatgttattaacacctcaggaagaggatgatcctgaaggtgatactgaagttgatgtgattgctgaacaactaaaattcagagcttgtttaaagatccttatgactgaattaagaacattggctacaggttatgaagtagatggaggaaaactcagatttcaactctataactggcttgaaaaggaaattgctgccttgcatgagatatgtaatcatgaatcagttattaaagagtattccagtaagacatattccaaagtagagagtgatctgctggatcaggaagaaatggtagacaaaccagatattggttcctatgagcgccatcaaatagaaagaagaagattgcaggccaaacgagagcatgcagaaagacgaaagtcgtggttgcagaaaaaccaagatctcctgagagtatttctcagctactgtagccttcatggggcccaaggtggtggtttggcttcagtaaggatggaactcaaatttttgctacaagaatcacaacaggaaactacagtaaagcagctccagtctccactaccactgcctaccaccctacctctgctttcagcaagtattgcgtcaacaaaaacagtcatagctaatcctgtattgtacttaaataatcacatccatgatatactttatactattgttcagatgaaaacaccacctcatcccagtattgaagatgtgaaggtgcacacacttcattcactagcagcatcactttctgcatcaatttaccaagcattatgtgacagtcatagctacagcagtcaaacagaaggaaatcagtttacaggaatggcttatcaaggacttcttttaagtgatcgtagaagactaaggacagaaagcattgaagaacacgcaacaccaaattcatctcctgctcaatggcctggtgtgagctcacttattaatcttttgagttcagcccaagatgaagaccagccaaaactgaacattttgctatgtgaagctgttgttgctgtttacttaagtttattgatacatgctcttgccacaaattcctccagtgaattatttcggcttgcagcccacccattaaataatcgaatgtgggctgctgtttttggaggcggtgtaaaacttgttgtgaaacctcgaagacaatcagaaaatatttcagcacctcctgtcctttctgaagacatagataaacaccgtaggagatttaacatgagaatgctcgtccctggaaggcctgtaaaagatgctaccccaccaccggtgcctgcagaaagaccatcttacaaagaaaaatttattcctcccgaacttagtatgtgggattattttgttgcaaagccatttcttcctttgtctgatagtggtgttatatatgattctgatgaaagcattcatagtgatgaagaagatgatgcctttttttcagatacacaaatacaggagcaccaagatccaaattcctatagctgggctcttctacatttgacaatggttaaactagcacttcacaatgtcaagaatttctttcctattgctggactggaattctctgagctgcctgtaacatcaccattaggtattgctgtgattaaaaacttggagaactgggaacagatcttgcaagagaaaatggatcagtttgaaggtccaccccctaactatatcaacacatatccaactgacctttcagtgggagctggaccagctattcttcgaaataaagcaatgctagaacctgaaaataccccattcaagtcccgggattcttctgcatttccagtcaaacgactttggcatttccttgttaaacaagaggtccttcaagagacatttattagatatattttcactaagaaaagaaagcagagtgagtctatagaagaacatgtggagcaggtcaaccaaaactgcatagcagaagattgccacatcaaggttgaagctgatctgggctatccaggtggaaaggcgaaagtcatccataaggaatctgatatgatcatggcattttctgttaataaggcaaattgtaatgaaattgttttggcttcaacacatgatgttcaagaacttgatgttacttctctactggcctgtcagtcatacatatggatcggagaagaatatgacagagaatccaaaagttcagatgatgttgattatcgtggttccactacaactctttatcaacccagtgcaacatcctattcagcaagtcaggtgcatccaccttcatctctgccatggctgggcactggacagactagcactggagctagtgtgcttatgaaaaggaatctacataatgttaagagaatgacttcacacccagtccatcaatactatcttacaggtgctcaggacggcagtgtacgaatgtttgaatggacgcggcctcagcaacttgtctgctttcgtcaagctggcaatgcaagagttactagattatattttaattcacaaggcaacaagtgtggtgttgcggatggagagggttttctgagtatctggcaagttaaccaaactgcatcaaatcctaaaccttatatgagttggcagtgccacagtaaagccacaagtgactttgcatttattacctcttcaagtctagttgccacatctggacactccaatgacaatagaaatgtttgcctctgggacacattaatatcacccggaaacagcctcattcatggtttcacgtgccacgatcatggtgccacggtactgcagtatgcacccaaacagcaactcctaatctcggggggtaggaaaggacacgtctgcatttttgacatcaggcaaaggcagctcattcacacgttccaggcccatgactcagctattaaggctctggccttggatccctatgaggaatattttaccacaggttcagcagaaggtaacataaaggtttggagattgacaggccatggcctaattcattcatttaaaagtgaacatgctaagcagtccatatttcgaaacattggggctggagtcatgcagattgacatcatccagggcaatcggctcttctcctgtggtgcagatggcacgctgaaaaccagggttttgcccaatgcttttaacatccctaacagaattcttgacattctataaagattggggttttatttttatatacatttcagttaaaaggcacactacagtcatcactaggcaattctgctttctaagcagttgtattgaaaacagagaatctctgtgtagaatttgaatatgacccaagctgagtattatctaaacaggttggtggaatgaatgcgcatgtaccttattatgctgacatactaaaaaaaataaaacctagtattgtatgaaggatagctattctttacagcatttagcaaacctgattcagaaaacatttgagattagcaaattagtaacttgaaataatgaaaaggacgtttataccaaattaaggaagaaaatgttgctgatttgggtttttcttcctgttcttaccactgactgaagcatgcctgcagtctcctcctctgttgaatgaaggataatcataaggtgtttgttaggagcgctagaccacctgggccgtttccattctttcctgctgaatatttttcctgttagtgtttatactgagctagtactgtaacttgcaaatgagtgcaaatttaaatgcaatgttttactcacaatttgcacattcacattttttggactgctagtttttctatttaaatatttgccttcatgttaggaatgtactatgtgaacatgacatatttgtagttaaccaaacacaccttcttagtccagtttagtactttttcttttcgtgtattcaaggttaaacacccaaacatttaaggatatgttgaaactacaccaatagagcatttcatatcataattaaaatgaatgttaggcttcttgtggccagttaatagttgatgagattggtgacattatttattgccacagcctattgtataaactatgcagagttaaatatttgcttgtaaaatattagccaatgttgtcattattttgatgtatttccttggttatgaccaaaaatatgttgagatactgaaactaatgtctgtgtgtttaaatgtttaccagcaaattgtcttatcatgttaatgagaatgttcaatgcctgtgtggtaaatagtaaatacaatggcataaaagtaactttctctgaagatgtgatgttcaggctgtgaaatatatatgtaaaagaaaaataaatgttatttgttaga

SEQ ID NO: 418213 - DNA, 1667 bp, Homo sapiens
gacaagaaattgttttgagaaattctctgatgtttttcttcttcaggtttcacgtgccacgatcatggtgccacggtactgcagtatgcacccaaacagcaactcctaatctcggggggtaggaaaggacacgtctgcatttttgacatcaggcaaaggcagctcattcacacgttccaggcccatgactcagctattaaggctctggccttggatccctatgaggaatattttaccacaggttcagcagaaggtaacataaaggtttggagattgacaggccatggcctaattcattcatttaaaagtgaacatgctaagcagtccatatttcgaaacattggggctggagtcatgcagattgacatcatccagggcaatcggctcttctcctgtggtgcagatggcacgctgaaaaccagggttttgcccaatgcttttaacatccctaacagaattcttgacattctataaagattggggttttatttttatatacatttcagttaaaaggcacactacagtcatcactaggcaattctgctttctaagcagttgtattgaaaacagagaatctctgtgtagaatttgaatatgacccaagctgagtattatctaaacaggttggtggaatgaatgcgcatgtaccttattatgctgacatactaaaaaaaataaaacctagtattgtatgaaggatagctattctttacagcatttagcaaacctgattcagaaaacatttgagattagcaaattagtaacttgaaataatgaaaaggacgtttataccaaattaaggaagaaaatgttgctgatttgggtttttcttcctgttcttaccactgactgaagcatgcctgcagtctcctcctctgttgaatgaaggataatcataaggtgtttgttaggagcgctagaccacctggaaaactttcttagctgtggagcagtgcgcagtgaccagttctctgctgtgagaggccgtttccattctttcctgctgaatatttttcctgttagtgtttatactgagctagtactgtaacttgcaaatgagtgcaaatttaaatgcaatgttttactcacaatttgcacattcacattttttggactgctagtttttctatttaaatatttgccttcatgttaggaatgtactatgtgaacatgacatatttgtagttaaccaaacacaccttcttagtccagtttagtactttttcttttcgtgtattcaaggttaaacacccaaacatttaaggatatgttgaaactacaccaatagagcatttcatatcataattaaaatgaatgttaggcttcttgtggccagttaatagttgatgagattggtgacattatttattgccacagcctattgtataaactatgcagagttaaatatttgcttgtaaaatattagccaatgttgtcattattttgatgtatttccttggttatgaccaaaaatatgttgagatactgaaactaatgtctgtgtgtttaaatgtttaccagcaaattgtcttatcatgttaatgagaatgttcaatgcctgtgtggtaaatagtaaatacaatggcataaaagtaactttctctgaagatgtgatgttcaggctgtgaaatatatatgtaaaagaaaaataaatgttatttgttaga

SEQ ID NO: 418214 - DNA, 4671 bp, Homo sapiens
aaattattctttaccactgcaaatgctcattttaaagttggatgccctgttttagccttggaggtactctccaaaattccaaaagtaaccaaaacatctgccttatctgcaaaaaaagatcagcctgacttcatttctcacaggatggatgatgtaccttcacattcaaaagctctgagtgatggcaatggaagttctggcattgaatggtcaaatgtaacttcatcacagtatgactggagtcagccaatagtaaaagttgatgaggaacctcttaatcttgattggggtgaagatcacgacagtgccttagatgaagaggaagacgatgctgttggtttagtgatgaaaagtacagatgccagggaaaaagataaacaatcagatcagaaggcctcagaccctaacatgttattaacacctcaggaagaggatgatcctgaaggtgatactgaagttgatgtgattgctgaacaactaaaattcagagcttgtttaaagatccttatgactgaattaagaacattggctacaggttatgaagtagatggaggaaaactcagatttcaactctataactggcttgaaaaggaaattgctgccttgcatgagatatgtaatcatgaatcagttattaaagagtattccagtaagacatattccaaagtagagagtgatctgctggatcaggaagaaatggtagacaaaccagatattggttcctatgagcgccatcaaatagaaagaagaagattgcaggccaaacgagagcatgcagaaagacgaaagtcgtggttgcagaaaaaccaagatctcctgagagtatttctcagctactgtagccttcatggggcccaaggtggtggtttggcttcagtaaggatggaactcaaatttttgctacaagaatcacaacaggaaactacagtaaagcagctccagtctccactaccactgcctaccaccctacctctgctttcagcaagtattgcgtcaacaaaaacagtcatagctaatcctgtattgtacttaaataatcacatccatgatatactttatactattgttcagatgaaaacaccacctcatcccagtattgaagatgtgaaggtgcacacacttcattcactagcagcatcactttctgcatcaatttaccaagcattatgtgacagtcatagctacagcagtcaaacagaaggaaatcagtttacaggaatggcttatcaaggacttcttttaagtgatcgtagaagactaaggacagaaagcattgaagaacacgcaacaccaaattcatctcctgctcaatggcctggtgtgagctcacttattaatcttttgagttcagcccaagatgaagaccagccaaaactgaacattttgctatgtgaagctgttgttgctgtttacttaagtttattgatacatgctcttgccacaaattcctccagtgaattatttcggcttgcagcccacccattaaataatcgaatgtgggctgctgtttttggaggcggtgtaaaacttgttgtgaaacctcgaagacaatcagaaaatatttcagcacctcctgtcctttctgaagacatagataaacaccgtaggagatttaacatgagaatgctcgtccctggaaggcctgtaaaagatgctaccccaccaccggtgcctgcagaaagaccatcttacaaagaaaaatttattcctcccgaacttagtatgtgggattattttgttgcaaagccatttcttcctttgtctgatagtggtgttatatatgattctgatgaaagcattcatagtgatgaagaagatgatgcctttttttcagatacacaaatacaggagcaccaagatccaaattcctatagctgggctcttctacatttgacaatggttaaactagcacttcacaatgtcaagaatttctttcctattgctggactggaattctctgagctgcctgtaacatcaccattaggtattgctgtgattaaaaacttggagaactgggaacagatcttgcaagagaaaatggatcagtttgaaggtccaccccctaactatatcaacacatatccaactgacctttcagtgggagctggaccagctattcttcgaaataaagcaatgctagaacctgaaaataccccattcaagtcccgggattcttctgcatttccagtcaaacgactttggcatttccttgttaaacaagaggtccttcaagagacatttattagatatattttcactaagaaaagaaagcagagtgagtctatagaagaacatgtggagcaggtcaaccaaaactgcatagcagaagattgccacatcaaggttgaagctgatctgggctatccaggtggaaaggcgaaagtcatccataaggaatctgatatgatcatggcattttctgttaataaggcaaattgtaatgaaattgttttggcttcaacacatgatgttcaagaacttgatgttacttctctactggcctgtcagtcatacatatggatcggagaagaatatgacagagaatccaaaagttcagatgatgttgattatcgtggttccactacaactctttatcaacccagtgcaacatcctattcagcaagtcaggtgcatccaccttcatctctgccatggctgggcactggacagactagcactggagctagtgtgcttatgaaaaggaatctacataatgttaagagaatgacttcacacccagtccatcaatactatcttacaggtgctcaggacggcagtgtacgaatgtttgaatggacgcggcctcagcaacttgtctgctttcgtcaagctggcaatgcaagagttactagattatattttaattcacaaggcaacaagtgtggtgttgcggatggagagggttttctgagtatctggcaagttaaccaaactgcatcaaatcctaaaccttatatgagttggcagtgccacagtaaagccacaagtgactttgcatttattacctcttcaagtctagttgccacatctggacactccaatgacaatagaaatgtttgcctctgggacacattaatatcacccggaaacagcctcattcatggtttcacgtgccacgatcatggtgccacggtactgcagtatgcacccaaacagcaactcctaatctcggggggtaggaaaggacacgtctgcatttttgacatcaggcaaaggcagctcattcacacgttccaggcccatgactcagctattaaggctctggccttggatccctatgaggaatattttaccacaggttcagcagaaggtaacataaaggtttggagattgacaggccatggcctaattcattcatttaaaagtgaacatgctaagcagtccatatttcgaaacattggggctggagtcatgcagattgacatcatccagggcaatcggctcttctcctgtggtgcagatggcacgctgaaaaccagggttttgcccaatgcttttaacatccctaacagaattcttgacattctataaagattggggttttatttttatatacatttcagttaaaaggcacactacagtcatcactaggcaattctgctttctaagcagttgtattgaaaacagagaatctctgtgtagaatttgaatatgacccaagctgagtattatctaaacaggttggtggaatgaatgcgcatgtaccttattatgctgacatactaaaaaaaataaaacctagtattgtatgaaggatagctattctttacagcatttagcaaacctgattcagaaaacatttgagattagcaaattagtaacttgaaataatgaaaaggacgtttataccaaattaaggaagaaaatgttgctgatttgggtttttcttcctgttcttaccactgactgaagcatgcctgcagtctcctcctctgttgaatgaaggataatcataaggtgtttgttaggagcgctagaccacctggaaaactttcttagctgtggagcagtgcgcagtgaccagttctctgctgtgagaggccgtttccattctttcctgctgaatatttttcctgttagtgtttatactgagctagtactgtaacttgcaaatgagtgcaaatttaaatgcaatgttttactcacaatttgcacattcacattttttggactgctagtttttctatttaaatatttgccttcatgttaggaatgtactatgtgaacatgacatatttgtagttaaccaaacacaccttcttagtccagtttagtactttttcttttcgtgtattcaaggttaaacacccaaacatttaaggatatgttgaaactacaccaatagagcatttcatatcataattaaaatgaatgttaggcttcttgtggccagttaatagttgatgagattggtgacattatttattgccacagcctattgtataaactatgcagagttaaatatttgcttcaaaaatatgttgagatactgaaactaatgtctgtgtgtttaaatgtttaccagcaaattgtcttatcatgttaatgagaatgttcaatgcctgtgtggtaaatagtaaatacaatggcataaaagtaactttctctgaagatgtgatgttcaggctgtgaaatatatatgtaaaagaaaaataaatgttatttgttaga

SEQ ID NO: 418215 - DNA, 2524 bp, Homo sapiens
aaattattctttaccactgcaaatgctcattttaaagttggatgccctgttttagccttggaggtactctccaaaattccaaaagtaaccaaaacatctgccttatctgcaaaaaaagatcagcctgacttcatttctcacaggatggatgatgtaccttcacattcaaaagctctgagtgatggcaatggaagttctggcattgaatggtcaaatgtaacttcatcacagtatgactggagtcagccaatagtaaaagttgatgaggaacctcttaatcttgattggggtgaagatcacgacagtgccttagatgaagaggaagacgatgctgttggtttagtgatgaaaagtacagatgccagggaaaaagataaacaatcagatcagaaggcctcagaccctaacatgttattaacacctcaggaagaggatgatcctgaaggtgatactgaagttgatgtgattgctgaacaactaaaattcagagcttgtttaaagatccttatgactgaattaagaacattggctacaggttatgaagtagatggaggaaaactcagatttcaactctataactggcttgaaaaggaaattgctgccttgcatgagatatgtaatcatgaatcagttattaaagagtattccagtaagacatattccaaagtagagagtgatctgctggatcaggaagaaatggtagacaaaccagatattggttcctatgagcgccatcaaatagaaagaagaagattgcaggccaaacgagagcatgcagaaagacgaaagtcgtggttgcagaaaaaccaagatctcctgagagtatttctcagctactgtagccttcatggggcccaaggtggtggtttggcttcagtaaggatggaactcaaatttttgctacaagaatcacaacaggaaactacagtaaagcagctccagtctccactaccactgcctaccaccctacctctgctttcagcaagtattgcgtcaacaaaaacagtcatagctaatcctgtattgtacttaaataatcacatccatgatatactttatactattgttcagatgaaaacaccacctcatcccagtattgaagatgtgaaggtgcacacacttcattcactagcagcatcactttctgcatcaatttaccaagcattatgtgacagtcatagctacagcagtcaaacagaaggaaatcagtttacaggaatggcttatcaaggacttcttttaagtgatcgtagaagactaaggacagaaagcattgaagaacacgcaacaccaaattcatctcctgctcaatggcctggtgtgagctcacttattaatcttttgagttcagcccaagatgaagaccagccaaaactgaacattttgctatgtgaagctgttgttgctgtttacttaagtttattgatacatgctcttgccacaaattcctccagtgaattatttcggcttgcagcccacccattaaataatcgaatgtgggctgctgtttttggaggcggtgtaaaacttgttgtgaaacctcgaagacaatcagaaaatatttcagcacctcctgtcctttctgaagacatagataaacaccgtaggagatttaacatgagaatgctcgtccctggaaggcctgtaaaagatgctaccccaccaccggtgcctgcagaaagaccatcttacaaagaaaaatttattcctcccgaacttagtatgtgggattattttgttgcaaagccatttcttcctttgtctgatagtggtgttatatatgattctgatgaaagcattcatagtgatgaagaagatgatgcctttttttcagatacacaaatacaggagcaccaagatccaaattcctatagctgggctcttctacatttgacaatggttaaactagcacttcacaatgtcaagaatttctttcctattgctggactggaattctctgagctgcctgtaacatcaccattaggtattgctgtgattaaaaacttggagaactgggaacagatcttgcaagagaaaatggatcagtttgaaggtccaccccctaactatatcaacacatatccaactgacctttcagtgggagctggaccagctattcttcgaaataaagcaatgctagaacctgaaaataccccattcaagtcccgggattcttctgcatttccagtcaaacgactttggcatttccttgttaaacaagaggtccttcaagagacatttattagatatattttcactaagaaaagaaagcagagtgaggttgaagctgatctgggctatccaggtggaaaggcgaaagtcatccataaggaatctgatatgatcatggcattttctgttaataagctattttgaggtttcttctttgtggtttgccttccctcctgcttttctccagactcttagaaattgttcatgcttgaggatggtgccatgatagtttctctcctcattttgttgaattcttttttttgttagtatgtgatataactaggatttaata

SEQ ID NO: 418216 - DNA, 381 bp, Homo sapiens
catgtatgttggtactgtatcaaattttatccaatggtaaaataacatcagttgcactttgtttttcgtagagttggcagtgccacagtaaagccacaagtgactttgcatttattacctcttcaagtctagttgccacatctggacactccaatgacaataggtaggttgacagaaaagcaaagtaagaaatataaaaacgttagaaatccatacctttagcaagaatacttttctattagtagggtttttccactctaggcattaaaaaaaaaaactttgttacataattcttatttcagagtgttttttcttaccaaaaagagaaaagcaaaaatgaaagttattcctaatatatgtaatttttattttaaagctatt

SEQ ID NO: 418217 - DNA, 462 bp, Homo sapiens
aacaacaaacttttgtttcaacttgtgcagcaataaagttgtccccaaacaacattaggactaaatttacattttgccaaaagggaaaaaagttaacccagtattaacattgggcgattaggacttgtaccctaagtttttctcatggctacttagtttttaaaataaagattgtcctatgggtacataagaagatttttagttggaatttgtgttaagagaaaagggaatgttcacagtaacacatgaatgtttttcacagttcagatgatgttgattatcgtggttccactacaactctttatcaacccagtgcaacatcctattcagcaagtcaggtgcatccaccttcatctctgccatggctgggcactggacagactagcactggagctagtgtggtatgttatttacttataggtatcatttctggatttggactctgaaaaatcagttggaatc

SEQ ID NO: 418218 - DNA, 406 bp, Homo sapiens
attgctgtgattaaaaacttggagaactgggaacagatcttgcaagagaaaatggatcagtttgaaggtccaccccctaactatatcaacacatatccaactgacctttcagtgggagctggaccagctattcttcgaaataaagcaatgctagaacctgaaaataccccattcaagtaagaaagctcttataatgctgataaagagcgtagcttaacttttctggaagacagtttggctaaatatgccaatatactttaaaacattcataattttgaacctgcagtcctatttttagcagaatacgcttaagaaaaatatcagaaatttgaatagaatttttcccagtattatctgtaattcatagacattccatttacataaaggaaaaagtctttattgtatt

SEQ ID NO: 418219 - DNA, 4661 bp, Homo sapiens
aaattattctttaccactgcaaatgctcattttaaagttggatgccctgttttagccttggaggtactctccaaaattccaaaagtaaccaaaacatctgccttatctgcaaaaaaagatcagcctgacttcatttctcacaggatggatgatgtaccttcacattcaaaagctctgagtgatggcaatggaagttctggcattgaatggtcaaatgtaacttcatcacagtatgactggagtcagccaatagtaaaagttgatgaggaacctcttaatcttgattggggtgaagatcacgacagtgccttagatgaagaggaagacgatgctgttggtttagtgatgaaaagtacagatgccagggaaaaagataaacaatcagatcagaaggcctcagaccctaacatgttattaacacctcaggaagaggatgatcctgaaggtgatactgaagttgatgtgattgctgaacaactaaaattcagagcttgtttaaagatccttatgactgaattaagaacattggctacaggttatgaagtagatggaggaaaactcagatttcaactctataactggcttgaaaaggaaattgctgccttgcatgagatatgtaatcatgaatcagttattaaagagtattccagtaagacatattccaaagtagagagtgatctgctggatcaggaagaaatggtagacaaaccagatattggttcctatgagcgccatcaaatagaaagaagaagattgcaggccaaacgagagcatgcagaaagacgaaagtcgtggttgcagaaaaaccaagatctcctgagagtatttctcagctactgtagccttcatggggcccaaggtggtggtttggcttcagtaaggatggaactcaaatttttgctacaagaatcacaacaggaaactacagtaaagcagctccagtctccactaccactgcctaccaccctacctctgctttcagcaagtattgcgtcaacaaaaacagtcatagctaatcctgtattgtacttaaataatcacatccatgatatactttatactattgttcagatgaaaacaccacctcatcccagtattgaagatgtgaaggtgcacacacttcattcactagcagcatcactttctgcatcaatttaccaagcattatgtgacagtcatagctacagcagtcaaacagaaggaaatcagtttacaggaatggcttatcaaggacttcttttaagtgatcgtagaagactaaggacagaaagcattgaagaacacgcaacaccaaattcatctcctgctcaatggcctggtgtgagctcacttattaatcttttgagttcagcccaagatgaagaccagccaaaactgaacattttgctatgtgaagctgttgttgctgtttacttaagtttattgatacatgctcttgccacaaattcctccagtgaattatttcggcttgcagcccacccattaaataatcgaatgtgggctgctgtttttggaggcggtgtaaaacttgttgtgaaacctcgaagacaatcagaaaatatttcagcacctcctgtcctttctgaagacatagataaacaccgtaggagatttaacatgagaatgctcgtccctggaaggcctgtaaaagatgctaccccaccaccggtgcctgcagaaagaccatcttacaaagaaaaatttattcctcccgaacttagtatgtgggattattttgttgcaaagccatttcttcctttgtctgatagtggtgttatatatgattctgatgaaagcattcatagtgatgaagaagatgatgcctttttttcagatacacaaatacaggagcaccaagatccaaattcctatagctgggctcttctacatttgacaatggttaaactagcacttcacaatgtcaagaatttctttcctattgctggactggaattctctgagctgcctgtaacatcaccattaggtattgctgtgattaaaaacttggagaactgggaacagatcttgcaagagaaaatggatcagtttgaaggtccaccccctaactatatcaacacatatccaactgacctttcagtgggagctggaccagctattcttcgaaataaagcaatgctagaacctgaaaataccccattcaagtcccgggattcttctgcatttccagtcaaacgactttggcatttccttgttaaacaagaggtccttcaagagacatttattagatatattttcactaagaaaagaaagcagagtgaggttgaagctgatctgggctatccaggtggaaaggcgaaagtcatccataaggaatctgatatgatcatggcattttctgttaataaggcaaattgtaatgaaattgttttggcttcaacacatgatgttcaagaacttgatgttacttctctactggcctgtcagtcatacatatggatcggagaagaatatgacagagaatccaaaagttcagatgatgttgattatcgtggttccactacaactctttatcaacccagtgcaacatcctattcagcaagtcaggtgcatccaccttcatctctgccatggctgggcactggacagactagcactggagctagtgtgcttatgaaaaggaatctacataatgttaagagaatgacttcacacccagtccatcaatactatcttacaggtgctcaggacggcagtgtacgaatgtttgaatggacgcggcctcagcaacttgtctgctttcgtcaagctggcaatgcaagagttactagattatattttaattcacaaggcaacaagtgtggtgttgcggatggagagggttttctgagtatctggcaagttaaccaaactgcatcaaatcctaaaccttatatgagttggcagtgccacagtaaagccacaagtgactttgcatttattacctcttcaagtctagttgccacatctggacactccaatgacaatagaaatgtttgcctctgggacacattaatatcacccggaaacagcctcattcatggtttcacgtgccacgatcatggtgccacggtactgcagtatgcacccaaacagcaactcctaatctcggggggtaggaaaggacacgtctgcatttttgacatcaggcaaaggcagctcattcacacgttccaggcccatgactcagctattaaggctctggccttggatccctatgaggaatattttaccacaggttcagcagaaggtaacataaaggtttggagattgacaggccatggcctaattcattcatttaaaagtgaacatgctaagcagtccatatttcgaaacattggggctggagtcatgcagattgacatcatccagggcaatcggctcttctcctgtggtgcagatggcacgctgaaaaccagggttttgcccaatgcttttaacatccctaacagaattcttgacattctataaagattggggttttatttttatatacatttcagttaaaaggcacactacagtcatcactaggcaattctgctttctaagcagttgtattgaaaacagagaatctctgtgtagaatttgaatatgacccaagctgagtattatctaaacaggttggtggaatgaatgcgcatgtaccttattatgctgacatactaaaaaaaataaaacctagtattgtatgaaggatagctattctttacagcatttagcaaacctgattcagaaaacatttgagattagcaaattagtaacttgaaataatgaaaaggacgtttataccaaattaaggaagaaaatgttgctgatttgggtttttcttcctgttcttaccactgactgaagcatgcctgcagtctcctcctctgttgaatgaaggataatcataaggtgtttgttaggagcgctagaccacctggaaaactttcttagctgtggagcagtgcgcagtgaccagttctctgctgtgagaggccgtttccattctttcctgctgaatatttttcctgttagtgtttatactgagctagtactgtaacttgcaaatgagtgcaaatttaaatgcaatgttttactcacaatttgcacattcacattttttggactgctagtttttctatttaaatatttgccttcatgttaggaatgtactatgtgaacatgacatatttgtagttaaccaaacacaccttcttagtccagtttagtactttttcttttcgtgtattcaaggttaaacacccaaacatttaaggatatgttgaaactacaccaatagagcatttcatatcataattaaaatgaatgttaggcttcttgtggccagttaatagttgatgagattggtgacattatttattgccacagcctattgtataaactatgcagagttaaatatttgcttgtaaaatattagccaatgttgtcattattttgatgtatttccttggttatgaccaaaaatatgttgagatactgaaactaatgtctgtgtgtttaaatgtttaccagcaaattgtcttatcatgttaatgagaatgttcaatgcctgtgtggtaaatagtaaatacaatggcataaaagtaactttctctgaagatgtgatgttcaggctgtgaaatatatatgtaaaagaaaaataaatgttatttgttaga

SEQ ID NO: 418220 - DNA, 4671 bp, Homo sapiens
aaattattctttaccactgcaaatgctcattttaaagttggatgccctgttttagccttggaggtactctccaaaattccaaaagtaaccaaaacatctgccttatctgcaaaaaaagatcagcctgacttcatttctcacaggatggatgatgtaccttcacattcaaaagctctgagtgatggcaatggaagttctggcattgaatggtcaaatgtaacttcatcacagtatgactggagtcagccaatagtaaaagttgatgaggaacctcttaatcttgattggggtgaagatcacgacagtgccttagatgaagaggaagacgatgctgttggtttagtgatgaaaagtacagatgccagggaaaaagataaacaatcagatcagaaggcctcagaccctaacatgttattaacacctcaggaagaggatgatcctgaaggtgatactgaagttgatgtgattgctgaacaactaaaattcagagcttgtttaaagatccttatgactgaattaagaacattggctacaggttatgaagtagatggaggaaaactcagatttcaactctataactggcttgaaaaggaaattgctgccttgcatgagatatgtaatcatgaatcagttattaaagagtattccagtaagacatattccaaagtagagagtgatctgctggatcaggaagaaatggtagacaaaccagatattggttcctatgagcgccatcaaatagaaagaagaagattgcaggccaaacgagagcatgcagaaagacgaaagtcgtggttgcagaaaaaccaagatctcctgagagtatttctcagctactgtagccttcatggggcccaaggtggtggtttggcttcagtaaggatggaactcaaatttttgctacaagaatcacaacaggaaactacagtaaagcagctccagtctccactaccactgcctaccaccctacctctgctttcagcaagtattgcgtcaacaaaaacagtcatagctaatcctgtattgtacttaaataatcacatccatgatatactttatactattgttcagatgaaaacaccacctcatcccagtattgaagatgtgaaggtgcacacacttcattcactagcagcatcactttctgcatcaatttaccaagcattatgtgacagtcatagctacagcagtcaaacagaaggaaatcagtttacaggaatggcttatcaaggacttcttttaagtgatcgtagaagactaaggacagaaagcattgaagaacacgcaacaccaaattcatctcctgctcaatggcctggtgtgagctcacttattaatcttttgagttcagcccaagatgaagaccagccaaaactgaacattttgctatgtgaagctgttgttgctgtttacttaagtttattgatacatgctcttgccacaaattcctccagtgaattatttcggcttgcagcccacccattaaataatcgaatgtgggctgctgtttttggaggcggtgtaaaacttgttgtgaaacctcgaagacaatcagaaaatatttcagcacctcctgtcctttctgaagacatagataaacaccgtaggagatttaacatgagaatgctcgtccctggaaggcctgtaaaagatgctaccccaccaccggtgcctgcagaaagaccatcttacaaagaaaaatttattcctcccgaacttagtatgtgggattattttgttgcaaagccatttcttcctttgtctgatagtggtgttatatatgattctgatgaaagcattcatagtgatgaagaagatgatgcctttttttcagatacacaaatacaggagcaccaagatccaaattcctatagctgggctcttctacatttgacaatggttaaactagcacttcacaatgtcaagaatttctttcctattgctggactggaattctctgagctgcctgtaacatcaccattaggtattgctgtgattaaaaacttggagaactgggaacagatcttgcaagagaaaatggatcagtttgaaggtccaccccctaactatatcaacacatatccaactgacctttcagtgggagctggaccagctattcttcgaaataaagcaatgctagaacctgaaaataccccattcaagtcccgggattcttctgcatttccagtcaaacgactttggcatttccttgttaaacaagaggtccttcaagagacatttattagatatattttcactaagaaaagaaagcagagtgagtctatagaagaacatgtggagcaggtcaaccaaaactgcatagcagaagattgccacatcaaggttgaagctgatctgggctatccaggtggaaaggcgaaagtcatccataaggaatctgatatgatcatggcattttctgttaataaggcaaattgtaatgaaattgttttggcttcaacacatgatgttcaagaacttgatgttacttctctactggcctgtcagtcatacatatggatcggagaagaatatgacagagaatccaaaagttcagatgatgttgattatcgtggttccactacaactctttatcaacccagtgcaacatcctattcagcaagtcaggtgcatccaccttcatctctgccatggctgggcactggacagactagcactggagctagtgtgcttatgaaaaggaatctacataatgttaagagaatgacttcacacccagtccatcaatactatcttacaggtgctcaggacggcagtgtacgaatgtttgaatggacgcggcctcagcaacttgtctgctttcgtcaagctggcaatgcaagagttactagattatattttaattcacaaggcaacaagtgtggtgttgcggatggagagggttttctgagtatctggcaagttaaccaaactgcatcaaatcctaaaccttatatgagttggcagtgccacagtaaagccacaagtgactttgcatttattacctcttcaagtctagttgccacatctggacactccaatgacaataggtttcacgtgccacgatcatggtgccacggtactgcagtatgcacccaaacagcaactcctaatctcggggggtaggaaaggacacgtctgcatttttgacatcaggcaaaggcagctcattcacacgttccaggcccatgactcagctattaaggctctggccttggatccctatgaggaatattttaccacaggttcagcagaaggtaacataaaggtttggagattgacaggccatggcctaattcattcatttaaaagtgaacatgctaagcagtccatatttcgaaacattggggctggagtcatgcagattgacatcatccagggcaatcggctcttctcctgtggtgcagatggcacgctgaaaaccagggttttgcccaatgcttttaacatccctaacagaattcttgacattctataaagattggggttttatttttatatacatttcagttaaaaggcacactacagtcatcactaggcaattctgctttctaagcagttgtattgaaaacagagaatctctgtgtagaatttgaatatgacccaagctgagtattatctaaacaggttggtggaatgaatgcgcatgtaccttattatgctgacatactaaaaaaaataaaacctagtattgtatgaaggatagctattctttacagcatttagcaaacctgattcagaaaacatttgagattagcaaattagtaacttgaaataatgaaaaggacgtttataccaaattaaggaagaaaatgttgctgatttgggtttttcttcctgttcttaccactgactgaagcatgcctgcagtctcctcctctgttgaatgaaggataatcataaggtgtttgttaggagcgctagaccacctggaaaactttcttagctgtggagcagtgcgcagtgaccagttctctgctgtgagaggccgtttccattctttcctgctgaatatttttcctgttagtgtttatactgagctagtactgtaacttgcaaatgagtgcaaatttaaatgcaatgttttactcacaatttgcacattcacattttttggactgctagtttttctatttaaatatttgccttcatgttaggaatgtactatgtgaacatgacatatttgtagttaaccaaacacaccttcttagtccagtttagtactttttcttttcgtgtattcaaggttaaacacccaaacatttaaggatatgttgaaactacaccaatagagcatttcatatcataattaaaatgaatgttaggcttcttgtggccagttaatagttgatgagattggtgacattatttattgccacagcctattgtataaactatgcagagttaaatatttgcttgtaaaatattagccaatgttgtcattattttgatgtatttccttggttatgaccaaaaatatgttgagatactgaaactaatgtctgtgtgtttaaatgtttaccagcaaattgtcttatcatgttaatgagaatgttcaatgcctgtgtggtaaatagtaaatacaatggcataaaagtaactttctctgaagatgtgatgttcaggctgtgaaatatatatgtaaaagaaaaataaatgttatttgttaga

SEQ ID NO: 418221 - DNA, 2548 bp, Homo sapiens
ctacatttaaatcttatgggatgtgcataactctaaatagagctgtgctgcagcaactaaaactgctgatgaatgttttctaggttgaagctgatctgggctatccaggtggaaaggcgaaagtcatccataaggaatctgatatgatcatggcattttctgttaataagaaggtaaaagctctcatcattatacacagtgtatttctccttagtgaaattgcttaaatcatcgattctgcctttgctttataggcaaattgtaatgaaattgttttggcttcaacacatgatgttcaagaacttgatgttacttctctactggcctgtcagtcatacatatggatcggagaagaatatgacagagaatccaaaagttcagatgatgttgattatcgtggttccactacaactctttatcaacccagtgcaacatcctattcagcaagtcaggtgcatccaccttcatctctgccatggctgggcactggacagactagcactggagctagtgtgcttatgaaaaggaatctacataatgttaagagaatgacttcacacccagtccatcaatactatcttacaggtgctcaggacggcagtgtacgaatgtttgaatggacgcggcctcagcaacttgtctgctttcgtcaagctggcaatgcaagagttactagattatattttaattcacaaggcaacaagtgtggtgttgcggatggagagggttttctgagtatctggcaagttaaccaaactgcatcaaatcctaaaccttatatgagttggcagtgccacagtaaagccacaagtgactttgcatttattacctcttcaagtctagttgccacatctggacactccaatgacaatagaaatgtttgcctctgggacacattaatatcacccggaaacagcctcattcatggtttcacgtgccacgatcatggtgccacggtactgcagtatgcacccaaacagcaactcctaatctcggggggtaggaaaggacacgtctgcatttttgacatcaggcaaaggcagctcattcacacgttccaggcccatgactcagctattaaggctctggccttggatccctatgaggaatattttaccacaggttcagcagaaggtaacataaaggtttggagattgacaggccatggcctaattcattcatttaaaagtgaacatgctaagcagtccatatttcgaaacattggggctggagtcatgcagattgacatcatccagggcaatcggctcttctcctgtggtgcagatggcacgctgaaaaccagggttttgcccaatgcttttaacatccctaacagaattcttgacattctataaagattggggttttatttttatatacatttcagttaaaaggcacactacagtcatcactaggcaattctgctttctaagcagttgtattgaaaacagagaatctctgtgtagaatttgaatatgacccaagctgagtattatctaaacaggttggtggaatgaatgcgcatgtaccttattatgctgacatactaaaaaaaataaaacctagtattgtatgaaggatagctattctttacagcatttagcaaacctgattcagaaaacatttgagattagcaaattagtaacttgaaataatgaaaaggacgtttataccaaattaaggaagaaaatgttgctgatttgggtttttcttcctgttcttaccactgactgaagcatgcctgcagtctcctcctctgttgaatgaaggataatcataaggtgtttgttaggagcgctagaccacctggaaaactttcttagctgtggagcagtgcgcagtgaccagttctctgctgtgagaggccgtttccattctttcctgctgaatatttttcctgttagtgtttatactgagctagtactgtaacttgcaaatgagtgcaaatttaaatgcaatgttttactcacaatttgcacattcacattttttggactgctagtttttctatttaaatatttgccttcatgttaggaatgtactatgtgaacatgacatatttgtagttaaccaaacacaccttcttagtccagtttagtactttttcttttcgtgtattcaaggttaaacacccaaacatttaaggatatgttgaaactacaccaatagagcatttcatatcataattaaaatgaatgttaggcttcttgtggccagttaatagttgatgagattggtgacattatttattgccacagcctattgtataaactatgcagagttaaatatttgcttgtaaaatattagccaatgttgtcattattttgatgtatttccttggttatgaccaaaaatatgttgagatactgaaactaatgtctgtgtgtttaaatgtttaccagcaaattgtcttatcatgttaatgagaatgttcaatgcctgtgtggtaaatagtaaatacaatggcataaaagtaactttctctgaagatgtgatgttcaggctgtgaaatatatatgtaaaagaaaaataaatgttatttgttaga

SEQ ID NO: 418222 - DNA, 4803 bp, Homo sapiens
aaattattctttaccactgcaaatgctcattttaaagttggatgccctgttttagccttggaggtactctccaaaattccaaaagtaaccaaaacatctgccttatctgcaaaaaaagatcagcctgacttcatttctcacaggatggatgatgtaccttcacattcaaaagctctgagtgatggcaatggaagttctggcattgaatggtcaaatgtaacttcatcacagtatgactggagtcagccaatagtaaaagttgatgaggaacctcttaatcttgattggggtgaagatcacgacagtgccttagatgaagaggaagacgatgctgttggtttagtgatgaaaagtacagatgccagggaaaaagataaacaatcagatcagaaggcctcagaccctaacatgttattaacacctcaggaagaggatgatcctgaaggtgatactgaagttgatgtgattgctgaacaactaaaattcagagcttgtttaaagatccttatgactgaattaagaacattggctacaggttatgaagtagatggaggaaaactcagatttcaactctataactggcttgaaaaggaaattgctgccttgcatgagatatgtaatcatgaatcagttattaaagagtattccagtaagacatattccaaagtagagagtgatctgctggatcaggaagaaatggtagacaaaccagatattggttcctatgagcgccatcaaatagaaagaagaagattgcaggccaaacgagagcatgcagaaagacgaaagtcgtggttgcagaaaaaccaagatctcctgagagtatttctcagctactgtagccttcatggggcccaaggtggtggtttggcttcagtaaggatggaactcaaatttttgctacaagaatcacaacaggaaactacagtaaagcagctccagtctccactaccactgcctaccaccctacctctgctttcagcaagtattgcgtcaacaaaaacagtcatagctaatcctgtattgtacttaaataatcacatccatgatatactttatactattgttcagatgaaaacaccacctcatcccagtattgaagatgtgaaggtgcacacacttcattcactagcagcatcactttctgcatcaatttaccaagcattatgtgacagtcatagctacagcagtcaaacagaaggaaatcagtttacaggaatggcttatcaaggacttcttttaagtgatcgtagaagactaaggacagaaagcattgaagaacacgcaacaccaaattcatctcctgctcaatggcctggtgtgagctcacttattaatcttttgagttcagcccaagatgaagaccagccaaaactgaacattttgctatgtgaagctgttgttgctgtttacttaagtttattgatacatgctcttgccacaaattcctccagtgaattatttcggcttgcagcccacccattaaataatcgaatgtgggctgctgtttttggaggcggtgtaaaacttgttgtgaaacctcgaagacaatcagaaaatatttcagcacctcctgtcctttctgaagacatagataaacaccgtaggagatttaacatgagaatgctcgtccctggaaggcctgtaaaagatgctaccccaccaccggtgcctgcagaaagaccatcttacaaagaaaaatttattcctcccgaacttagtatgtgggattattttgttgcaaagccatttcttcctttgtctgatagtggtgttatatatgattctgatgaaagcattcatagtgatgaagaagatgatgcctttttttcagatacacaaatacaggagcaccaagatccaaattcctatagctgggctcttctacatttgacaatggttaaactagcacttcacaatgtcaagaatttctttcctattgctggactggaattctctgagctgcctgtaacatcaccattaggtattgctgtgattaaaaacttggagaactgggaacagatcttgcaagagaaaatggatcagtttgaaggtccaccccctaactatatcaacacatatccaactgacctttcagtgggagctggaccagctattcttcgaaataaagcaatgctagaacctgaaaataccccattcaagtcccgggattcttctgcatttccagtcaaacgactttggcatttccttgttaaacaagaggtccttcaagagacatttattagatatattttcactaagaaaagaaagcagagtgagtctatagaagaacatgtggagcaggtcaaccaaaactgcatagcagaagattgccacatcaaggttgaagctgatctgggctatccaggtggaaaggcgaaagtcatccataaggaatctgatatgatcatggcattttctgttaataaggcaaattgtaatgaaattgttttggcttcaacacatgatgttcaagaacttgatgttacttctctactggcctgtcagtcatacatatggatcggagaagaatatgacagagaatccaaaagttcagatgatgttgattatcgtggttccactacaactctttatcaacccagtgcaacatcctattcagcaagtcaggtgcatccaccttcatctctgccatggctgggcactggacagactagcactggagctagtgtgcttatgaaaaggaatctacataatgttaagagaatgacttcacacccagtccatcaatactatcttacaggtgctcaggacggcagtgtacgaatgtttgaatggacgcggcctcagcaacttgtctgctttcgtcaagctggcaatgcaagagttactagattatattttaattcacaaggcaacaagtgtggtgttgcggatggagagggttttctgagtatctggcaagttaaccaaactgcatcaaatcctaaaccttatatgagttggcagtgccacagtaaagccacaagtgactttgcatttattacctcttcaagtctagttgccacatctggacactccaatgacaatagaaatgtttgcctctgggacacattaatatcacccggaaacagcctcattcatggtttcacgtgccacgatcatggtgccacggtactgcagtatgcacccaaacagcaactcctaatctcggggggtaggaaaggacacgtctgcatttttgacatcaggcaaaggcagctcattcacacgttccaggcccatgactcagctattaaggctctggccttggatccctatgaggaatattttaccacaggttcagcagaaggtaacataaaggtttggagattgacaggccatggcctaattcattcatttaaaagtgaacatgctaagcagtccatatttcgaaacattggggctggagtcatgcagattgacatcatccagggcaatcggctcttctcctgtggtgcagatggcacgctgaaaaccagggttttgcccaatgcttttaacatccctaacagaattcttgacattctataaagattggggttttatttttatatacatttcagttaaaaggcacactacagtcatcactaggcaattctgctttctaagcagttgtattgaaaacagagaatctctgtgtagaatttgaatatgacccaagctgagtattatctaaacaggttggtggaatgaatgcgcatgtaccttattatgctgacatactaaaaaaaataaaacctagtattgtatgaaggatagctattctttacagcatttagcaaacctgattcagaaaacatttgagattagcaaattagtaacttgaaataatgaaaaggacgtttataccaaattaaggaagaaaatgttgctgatttgggtttttcttcctgttcttaccactgactgaagcatgcctgcagtctcctcctctgttgaatgaaggataatcataaggtgtttgttaggagcgctagaccacctggaaaactttcttagctgtggagcagtgcgcagtgaccagttctctgctgtgagaggccgtttccattctttcctgctgaatatttttcctgttagtgtttatactgagctagtactgtaacttgcaaatgagtgcaaatttaaatgcaatgttttactcacaatttgcacattcacattttttggactgctagtttttctatttaaatatttgccttcatgttaggaatgtactatgtgaacatgacatatttgtagttaaccaaacacaccttcttagtccagtttagtactttttcttttcgtgtattcaaggttaaacacccaaacatttaaggatatgttgaaactacaccaatagagcatttcatatcataattaaaatgaatgttaggcttcttgtggccagttaatagttgatgagattggtgacattatttattgccacagcctattgtataaactatgcagagttaaatatttgcttgtaaaatattagccaatgttgtcattattttgatgtatttccttggttatgaccaaaaatatgttgagatactgaaactaatgtctgtgtgtttaaatgtttaccagcaaattgtcttatcatgttaatgagaatgttcaatgcctgtgtggtaaatagtaaatacaatggcataaaagtaactttctctgaagatgtgatgttcaggctgtgaaatatatatgtaaaagaaaaataaatgttatttgttagagtttttagtttgatactgtttttgaccattgagatttttaatttgataaaatgtttaactgttagagaatttgcaagct

SEQ ID NO: 418223 - DNA, 2950 bp, Homo sapiens
aaattattctttaccactgcaaatgctcattttaaagttggatgccctgttttagccttggaggtactctccaaaattccaaaagtaaccaaaacatctgccttatctgcaaaaaaagatcagcctgacttcatttctcacaggatggatgatgtaccttcacattcaaaagctctgagtgatggcaatggaagttctggcattgaatggtcaaatgtaacttcatcacagtatgactggagtcagccaatagtaaaagttgatgaggaacctcttaatcttgattggggtgaagatcacgacagtgccttagatgaagaggaagacgatgctgttggtttagtgatgaaaagtacagatgccagggaaaaagataaacaatcagatcagaaggcctcagaccctaacatgttattaacacctcaggaagaggatgatcctgaaggtgatactgaagttgatgtgattgctgaacaactaaaattcagagcttgtttaaagatccttatgactgaattaagaacattggctacaggttatgaagtagatggaggaaaactcagatttcaactctataactggcttgaaaaggaaattgctgccttgcatgagatatgtaatcatgaatcagttattaaagagtattccagtaagacatattccaaagtagagagtgatctgctggatcaggaagaaatggtagacaaaccagatattggttcctatgagcgccatcaaatagaaagaagaagattgcaggccaaacgagagcatgcagaaagacgaaagtcgtggttgcagaaaaaccaagatctcctgagagtatttctcagctactgtagccttcatggggcccaaggtggtggtttggcttcagtaaggatggaactcaaatttttgctacaagaatcacaacaggaaactacagtaaagcagctccagtctccactaccactgcctaccaccctacctctgctttcagcaagtattgcgtcaacaaaaacagtcatagctaatcctgtattgtacttaaataatcacatccatgatatactttatactattgttcagatgaaaacaccacctcatcccagtattgaagatgtgaaggtgcacacacttcattcactagcagcatcactttctgcatcaatttaccaagcattatgtgacagtcatagctacagcagtcaaacagaaggaaatcagtttacaggaatggcttatcaaggacttcttttaagtgatcgtagaagactaaggacagaaagcattgaagaacacgcaacaccaaattcatctcctgctcaatggcctggtgtgagctcacttattaatcttttgagttcagcccaagatgaagaccagccaaaactgaacattttgctatgtgaagctgttgttgctgtttacttaagtttattgatacatgctcttgccacaaattcctccagtgaattatttcggcttgcagcccacccattaaataatcgaatgtgggctgctgtttttggaggcggtgtaaaacttgttgtgaaacctcgaagacaatcagaaaatatttcagcacctcctgtcctttctgaagacatagataaacaccgtaggagatttaacatgagaatgctcgtccctggaaggcctgtaaaagatgctaccccaccaccggtgcctgcagaaagaccatcttacaaagaaaaatttattcctcccgaacttagtatgtgggattattttgttgcaaagccatttcttcctttgtctgatagtggtgttatatatgattctgatgaaagcattcatagtgatgaagaagatgatgcctttttttcagatacacaaatacaggagcaccaagatccaaattcctatagctgggctcttctacatttgacaatggttaaactagcacttcacaatgtcaagaatttctttcctattgctggactggaattctctgagctgcctgtaacatcaccattaggtattgctgtgattaaaaacttggagaactgggaacagatcttgcaagagaaaatggatcagtttgaaggtccaccccctaactatatcaacacatatccaactgacctttcagtgggagctggaccagctattcttcgaaataaagcaatgctagaacctgaaaataccccattcaagtcccgggattcttctgcatttccagtcaaacgactttggcatttccttgttaaacaagaggtccttcaagagacatttattagatatattttcactaagaaaagaaagcagagtgaggtattttgagaaaaatattttctattgtaatttttctttagttttctttaacatttctaaggaaatcagtgcttgatttattctgaaattttctttctggttgggtaatagtcaaagttcactaaactaccgtgaactacttttaagataaaaccttataattttcatttcatagcaatgaaacaacataggtactttgataaattacatatattcaagtgaaagttggtactttacagtatttgtcattaggtttttacacataataaacattgtgatggatggcttgaggaatttaatatataagcttactctataatattctccaaatatgtacttaaaatataaaatagccctttaaaagcattttctttacttagcacttagaaatgaacagaatgatgatttgaagcaacaaattcaggatacttttgtgagagaataaactacagaaatagcaaatacaagatgaaggaagattgctcttacaaagcaagacagaggttctgcattgcatggttatttttaagctaatacaattagtaatgtaatagcagacatggttcaagaagaattagcagtttgggagattggcaagtgacctcttccttataaaagtgggaccttttatatgagcatttcagtctgtttggctatttagtgaggtaat

SEQ ID NO: 418224 - DNA, 600 bp, Homo sapiens
ccgggggagaaagcgacgcggccgctcgtaagtgctccggatggaaactggtgcagggggcagcggcgttccgcggccggaagggaagggggaggtgccgaggctgcgcgccggctgctcctccccacccccagcctttgccctgaagggggctggatgggcaaggcggccgcgatggctcgagctcgggcggtggcggcggtggccggaggcggcggtgcctcctcctcctcgccccggcgccggcggtgatccgagcgagcggccgcggcccccgatgagactgctggcgggctggctgtgcctgagcctggcgtccgtgtggctggcgcggaggatgtggacgctgcggagcccgctcacccgctccctgtacgtgaacatgactagcggcccgggtgggccggcggcggccgcgggcggcaggaaggagaaccaccaggtacgggctggggccggggccggggcgggggcgtggcggcccggccttcccgcgctgggcccggctattgtgcgggacggctccgcgagggggcggcccggccctcgcccctccgcctcggccccttggaaagttttccccgcgccttccccgccggg

SEQ ID NO: 418225 - DNA, 122 bp, Homo sapiens
tctcctcatttgtaattcaggaggctctctgagaagagacagcaaagcttcttagatggatcgaaagaccacgagctgggataccaagttctatgaaaagcctgttacattaggcaacaaga

SEQ ID NO: 418226 - DNA, 3043 bp, Homo sapiens
gggaaaggcaacttaatctggtcactggagtgttaaattctgttgcttactttgctatttgggtttgtttggtgattttgagttaaggcattggattatgtgactgttttcttgtctaaaaacaaggatgctgctagctgtttgccttctgatgttgaatctcagtgaaagagaggccagcagagctttctaaatctcggtggtatgtgtgcaacagagagaaattatgcgaatcactccaggctgtctttgttcagagttaccttgatcaaggaacacagatcttcttaaacaacagcattgagaaatcgggctggctatttatccaattatatcattcttttgtgtcatctgtttttagcctgtttatgtctagaacatctatcaatgggttgctaggaagaggctcaatgtttgtgttttcaccagatcagtttcagagactgcttaaaattaatccagactggaaaacccacagacttcttgatttaggtgctggagatggagaagtcacaaaaatcatgagccctcattttgaagaaatctatgccactgagctttctgaaactatgatatggcagcttcagaaaaagaaatacagagtccttggtataaatgaatggcagaatacggggttccagtatgatgtcatcagctgcctgaacttgctggaccgctgtgatcagcccctgactttgttaaaagatatcagaagtgtcttggagccaactagaggcagggtcatccttgcccttgtcctcccctttcatccctatgtggaaaactaggtggcaagtgggagaaaccatcagaaattttggaaatcaaaggacagaactgggaagaacaagtgaatagtctgcctgaagttttcagaaaagctggttttgttatcgaagctttcaccagactaccatacctgtgtgaaggcgacatgtataatgactactacgttctggatgacgctgtctttgttctcaaaccagtataaacacgtggaggtcgaagtcttcagagtccgcaccctccgggatgtgcccttggaagagggtctgtgttcacaattacgtgaagggaggacccttggggaccgccattctaaatatcatgtaggaatttaaaaagccaaaatactaattatttctttgtagtgtgtaaaggaatgtttttaaaagacaaaaacccaactctttgtggatttttatcaactctttactcagagccactctccaatgcaggtcacactccaattatgatggaagatattttttatacttaattgcagtagggactcattcccagacaaagcaatagtcacgacttcatggaaccaatcaatggattgttttttgaagactggcaataaagctgtccattcaattccaaatactggttttaaggtatagccactgatattctttcatgtttagaaattctttctgttattattcaagaaaatgtttttaatcatgctaataaacttttttggagatgactttggcatcatgtttgaattcatataaagctcccctagcattttttattggtttggcttcaggagtacccaaatagtagcattatgagaatgacgcagacaatttgaataggggggaaggaaggcttcagacttgggggaaggggagattattgcaaattgcagtgaacactgagtcagtaaaaaaaaaaaacagaaacaaaaacccagcctcattcagatacagaacttcagggacccctccccccacccccccagttaatgctgctgtgaaaaatgcaaaataacctggttctgactttgtgatcactcatgtcccatacactgaactttgtttttttctggacaatctcaggttctcagaattgaaacattcagttttgtctactgacaaaatgcaactaaaaatgttttaattcaacttcttactctacacttatatacctctctcccagagcttggctcttccctgaaatccttaaaggagtttattatttgccaagaatatggtttgatgaagaccgtgtcagactcatgcattctggaatccgtgagtgcctccaaccataaacccagaaatgctgccatagaggaacccattagcaagatcaataaccatcgtggatattccaaagagcagagcatttaacccagaatctgaaatctcagtaataacagaaatgtcaatatgagattgtggttattaacaatatgttatcctcactactttatttcttttttcatccaggtgtttcattaagtattctcatttatatgctcatagaagtcatcagatcaacacattcactccaacacctgggtataaaggcgaattaaaacctgaagaattactttattattcattaagaactgcattcccacatcctcacaccaatatcttccactgttactgtgcagtcataataagagttgggttatgtgatttatgcaaaattgttattggtgtgttctaatgatttttttccaggaattcaagtaagtgaagtacaaatacttagcaccatagattgtaaaaatagaaagaggaaatgagaaaacttaatgtcgttcttgtacagttgagttttgcttctttataaactgtctgttaaaatcaggggttgctgttagactgtcaagcagaagtgatggatgttcaaggaggcaggttgccccaaagtgttttctaactttcaagtagagaactttatgctctaataagaaaaatacaactcattcttaaccacccccccaaaacagagaaaacacatacatttatgcattttaaagataaaaagtagtttctcaaaaaaatctgaagttctctgaaaaccagcttattaaaagtgctgttttgtggtgaaaattgaaaccaaatccactcacatttcctatcgggtcttgaaattcttggtggtgtgtcaccattccactagatggcagtgttgcttactgagtgtcaatggcttttttccccgtaaatggaatcatgtttttctcccccaaagtacaataaagctgccttgtctgcaccattaaaaaaaaaag

SEQ ID NO: 418227 - DNA, 3235 bp, Homo sapiens
ccgggggagaaagcgacgcggccgctcgtaagtgctccggatggaaactggtgcagggggcagcggcgttccgcggccggaagggaagggggaggtgccgaggctgcgcgccggctgctcctccccacccccagcctttgccctgaagggggctggatgggcaaggcggccgcgatggctcgagctcgggcggtggcggcggtggccggaggcggcggtgcctcctcctcctcgccccggcgccggcggtgatccgagcgagcggccgcggcccccgatgagactgctggcgggctggctgtgcctgagcctggcgtccgtgtggctggcgcggaggatgtggacgctgcggagcccgctcacccgctccctgtacgtgaacatgactagcgtggtatgtgtgcaacagagagaaattatgcgaatcactccaggctgtctttgttcagagttaccttgatcaaggaacacagatcttcttaaacaacagcattgagaaatcgggctggctatttatccaattatatcattcttttgtgtcatctgtttttagcctgtttatgtctagaacatctatcaatgggttgctaggaagaggctcaatgtttgtgttttcaccagatcagtttcagagactgcttaaaattaatccagactggaaaacccacagacttcttgatttaggtgctggagatggagaagtcacaaaaatcatgagccctcattttgaagaaatctatgccactgagctttctgaaactatgatatggcagcttcagaaaaagaaatacagagtccttggtataaatgaatggcagaatacggggttccagtatgatgtcatcagctgcctgaacttgctggaccgctgtgatcagcccctgactttgttaaaagatatcagaagtgtcttggagccaactagaggcagggtcatccttgcccttgtcctcccctttcatccctatgtggaaaactaggtggcaagtgggagaaaccatcagaaattttggaaatcaaaggacagaactgggaagaacaagtgaatagtctgcctgaagttttcagaaaagctggttttgttatcgaagctttcaccagactaccatacctgtgtgaaggcgacatgtataatgactactacgttctggatgacgctgtctttgttctcaaaccagtataaacacgtggaggtcgaagtcttcagagtccgcaccctccgggatgtgcccttggaagagggtctgtgttcacaattacgtgaagggaggacccttggggaccgccattctaaatatcatgtaggaatttaaaaagccaaaatactaattatttctttgtagtgtgtaaaggaatgtttttaaaagacaaaaacccaactctttgtggatttttatcaactctttactcagagccactctccaatgcaggtcacactccaattatgatggaagatattttttatacttaattgcagtagggactcattcccagacaaagcaatagtcacgacttcatggaaccaatcaatggattgttttttgaagactggcaataaagctgtccattcaattccaaatactggttttaaggtatagccactgatattctttcatgtttagaaattctttctgttattattcaagaaaatgtttttaatcatgctaataaacttttttggagatgactttggcatcatgtttgaattcatataaagctcccctagcattttttattggtttggcttcaggagtacccaaatagtagcattatgagaatgacgcagacaatttgaataggggggaaggaaggcttcagacttgggggaaggggagattattgcaaattgcagtgaacactgagtcagtaaaaaaaaaaaacagaaacaaaaacccagcctcattcagatacagaacttcagggacccctccccccacccccccagttaatgctgctgtgaaaaatgcaaaataacctggttctgactttgtgatcactcatgtcccatacactgaactttgtttttttctggacaatctcaggttctcagaattgaaacattcagttttgtctactgacaaaatgcaactaaaaatgttttaattcaacttcttactctacacttatatacctctctcccagagcttggctcttccctgaaatccttaaaggagtttattatttgccaagaatatggtttgatgaagaccgtgtcagactcatgcattctggaatccgtgagtgcctccaaccataaacccagaaatgctgccatagaggaacccattagcaagatcaataaccatcgtggatattccaaagagcagagcatttaacccagaatctgaaatctcagtaataacagaaatgtcaatatgagattgtggttattaacaatatgttatcctcactactttatttcttttttcatccaggtgtttcattaagtattctcatttatatgctcatagaagtcatcagatcaacacattcactccaacacctgggtataaaggcgaattaaaacctgaagaattactttattattcattaagaactgcattcccacatcctcacaccaatatcttccactgttactgtgcagtcataataagagttgggttatgtgatttatgcaaaattgttattggtgtgttctaatgatttttttccaggaattcaagtaagtgaagtacaaatacttagcaccatagattgtaaaaatagaaagaggaaatgagaaaacttaatgtcgttcttgtacagttgagttttgcttctttataaactgtctgttaaaatcaggggttgctgttagactgtcaagcagaagtgatggatgttcaaggaggcaggttgccccaaagtgttttctaactttcaagtagagaactttatgctctaataagaaaaatacaactcattcttaaccacccccccaaaacagagaaaacacatacatttatgcattttaaagataaaaagtagtttctcaaaaaaatctgaagttctctgaaaaccagcttattaaaagtgctgttttgtggtgaaaattgaaaccaaatccactcacatttcctatcgggtcttgaaattcttggtggtgtgtcaccattccactagatggcagtgttgcttactgagtgtcaatggcttttttccccgtaaatggaatcatgtttttctcccccaaagtacaataaagctgccttgtctgcaccattaaaaaaaaaag

SEQ ID NO: 418228 - DNA, 3231 bp, Homo sapiens
ccgggggagaaagcgacgcggccgctcgtaagtgctccggatggaaactggtgcagggggcagcggcgttccgcggccggaagggaagggggaggtgccgaggctgcgcgccggctgctcctccccacccccagcctttgccctgaagggggctggatgggcaaggcggccgcgatggctcgagctcgggcggtggcggcggtggccggaggcggcggtgcctcctcctcctcgccccggcgccggcggtgatccgagcgagcggccgcggcccccgatgagactgctggcgggctggctgtgcctgagcctggcgtccgtgtggctggcgcggaggatgtggacgctgcggagcccgctcacccgctccctgtacgtgaacatgactagcggcccgggtgggccggcggcggccgcgggcggcaggaaggagaaccaccagtggtatgtgtgcaacagagagaaattatgcgaatcactccaggctgtctttgttcagagttaccttgatcaaggaacacagatcttcttaaacaacagcattgagaaatcgggctggctatttatccaattatatcattcttttgtgtcatctgtttttagcctgtttatgtctagaacatctatcaatgggttgctaggaagaggctcaatgtttgtgttttcaccagatcagtttcagagactgcttaaaattaatccagactggaaaacccacagacttcttgatttaggtgctggagatggagaagtcacaaaaatcatgagccctcattttgaagaaatctatgccactgagctttctgaaactatgatatggcagcttcagaaaaagaaatacagagtccttggtataaatgaatggcagaatacggggttccagtatgatgtcatcagctgcctgaacttgctggaccgctgtgatcagcccctgactttgttaaaagatatcagaagtgtcttggagccaactagaggcagggtcatccttgcccttgtcctcccctttcatccctatgtggaaaactaggtggcaagtgggagaaaccatcagaaattttggaaatcaaaggacagaactgggaagaacaagtgaatagtctgcctgaagttttcagcgacatgtataatgactactacgttctggatgacgctgtctttgttctcaaaccagtataaacacgtggaggtcgaagtcttcagagtccgcaccctccgggatgtgcccttggaagagggtctgtgttcacaattacgtgaagggaggacccttggggaccgccattctaaatatcatgtaggaatttaaaaagccaaaatactaattatttctttgtagtgtgtaaaggaatgtttttaaaagacaaaaacccaactctttgtggatttttatcaactctttactcagagccactctccaatgcaggtcacactccaattatgatggaagatattttttatacttaattgcagtagggactcattcccagacaaagcaatagtcacgacttcatggaaccaatcaatggattgttttttgaagactggcaataaagctgtccattcaattccaaatactggttttaaggtatagccactgatattctttcatgtttagaaattctttctgttattattcaagaaaatgtttttaatcatgctaataaacttttttggagatgactttggcatcatgtttgaattcatataaagctcccctagcattttttattggtttggcttcaggagtacccaaatagtagcattatgagaatgacgcagacaatttgaataggggggaaggaaggcttcagacttgggggaaggggagattattgcaaattgcagtgaacactgagtcagtaaaaaaaaaaaacagaaacaaaaacccagcctcattcagatacagaacttcagggacccctccccccacccccccagttaatgctgctgtgaaaaatgcaaaataacctggttctgactttgtgatcactcatgtcccatacactgaactttgtttttttctggacaatctcaggttctcagaattgaaacattcagttttgtctactgacaaaatgcaactaaaaatgttttaattcaacttcttactctacacttatatacctctctcccagagcttggctcttccctgaaatccttaaaggagtttattatttgccaagaatatggtttgatgaagaccgtgtcagactcatgcattctggaatccgtgagtgcctccaaccataaacccagaaatgctgccatagaggaacccattagcaagatcaataaccatcgtggatattccaaagagcagagcatttaacccagaatctgaaatctcagtaataacagaaatgtcaatatgagattgtggttattaacaatatgttatcctcactactttatttcttttttcatccaggtgtttcattaagtattctcatttatatgctcatagaagtcatcagatcaacacattcactccaacacctgggtataaaggcgaattaaaacctgaagaattactttattattcattaagaactgcattcccacatcctcacaccaatatcttccactgttactgtgcagtcataataagagttgggttatgtgatttatgcaaaattgttattggtgtgttctaatgatttttttccaggaattcaagtaagtgaagtacaaatacttagcaccatagattgtaaaaatagaaagaggaaatgagaaaacttaatgtcgttcttgtacagttgagttttgcttctttataaactgtctgttaaaatcaggggttgctgttagactgtcaagcagaagtgatggatgttcaaggaggcaggttgccccaaagtgttttctaactttcaagtagagaactttatgctctaataagaaaaatacaactcattcttaaccacccccccaaaacagagaaaacacatacatttatgcattttaaagataaaaagtagtttctcaaaaaaatctgaagttctctgaaaaccagcttattaaaagtgctgttttgtggtgaaaattgaaaccaaatccactcacatttcctatcgggtcttgaaattcttggtggtgtgtcaccattccactagatggcagtgttgcttactgagtgtcaatggcttttttccccgtaaatggaatcatgtttttctcccccaaagtacaataaagctgccttgtctgcaccattaaaaaaaaaag

SEQ ID NO: 418229 - DNA, 1791 bp, Homo sapiens
  misc_feature (1736)..(1736): n is a, c, g, or t
ccgggggagaaagcgacgcggccgctcgtaagtgctccggatggaaactggtgcagggggcagcggcgttccgcggccggaagggaagggggaggtgccgaggctgcgcgccggctgctcctccccacccccagcctttgccctgaagggggctggatgggcaaggcggccgcgatggctcgagctcgggcggtggcggcggtggccggaggcggcggtgcctcctcctcctcgccccggcgccggcggtgatccgagcgagcggccgcggcccccgatgagactgctggcgggctggctgtgcctgagcctggcgtccgtgtggctggcgcggaggatgtggacgctgcggagcccgctcacccgctccctgtacgtgaacatgactagcggcccgggtgggccggcggcggccgcgggcggcaggaaggagaaccaccagtggtatgtgtgcaacagagagaaattatgcgaatcactccaggctgtctttgttcagagttaccttgatcaaggaacacagatcttcttaaacaacagcattgagaaatcgggctggctatttatccaattatatcattcttttgtgtcatctgtttttagcctgtttatgtctagaacatctatcaatgggttgctaggaagaggctcaatgtttgtgttttcaccagatcagtttcagagactgcttaaaattaatccagactggaaaacccacagacttcttgatttaggtgctggagatggagaagtcacaaaaatcatgagccctcattttgaagaaatctatgccactgagctttctgaaactatgatatggcagcttcagaaaaagaaatacagagtccttggtataaatgaatggcagaatacggggttccagtatgatgtcatcagctgcctgaacttgctggaccgctgtgatcagcccctgactttgttaaaagatatcagaagtgtcttggagccaactagaggcagggtcatccttgcccttgtcctcccctttcatccctatgtggaaaactaggtggcaagtgggagaaaccatcagaaattttggaaatcaaaggacagaactgggaagaacaagtgaatagtctgcctgaagttttcagaaaagctggttttgttatcgaagctttcaccagactaccatacctgtgtgaaggcgacatgtataatgactactacgttctggatgacgctgtctttgttctcaaaccagtataaacacgtggaggtcgaagtcttcagagtccgcaccctccgggatgtgcccttggaagagggtctgtgttcacaattacgtgaagggaggacccttggggaccgccattctaaatatcatgtaggaatttaaaaagccaaaatactaattatttctttgtagtgtgtaaaggaatgtttttaaaagacaaaaacccaactctttgtggatttttatcaactctttactcagagccactctccaatgcaggtcacactccaattatgatggaagatattttttatacttaattgcagtagggactcattcccagacaaagcaatagtcacgacttcatggaaccaatcaatggattgttttttgaagactggcaataaagctgtccattcaattccaaatactggttttaaggtatagccactgatattctttcatgtttagaaattctttctgttattattcaagaaaatgtttttaatcatgctaataaacttttttggagagngatcggccgaccccccccccccccgcggacaccccctccccaccgcccgcctacc

SEQ ID NO: 418230 - DNA, 1953 bp, Homo sapiens
ccgggggagaaagcgacgcggccgctcgtaagtgctccggatggaaactggtgcagggggcagcggcgttccgcggccggaagggaagggggaggtgccgaggctgcgcgccggctgctcctccccacccccagcctttgccctgaagggggctggatgggcaaggcggccgcgatggctcgagctcgggcggtggcggcggtggccggaggcggcggtgcctcctcctcctcgccccggcgccggcggtgatccgagcgagcggccgcggcccccgatgagactgctggcgggctggctgtgcctgagcctggcgtccgtgtggctggcgcggaggatgtggacgctgcggagcccgctcacccgctccctgtacgtgaacatgactagcggcccgggtgggccggcggcggccgcgggcggcaggaaggagaaccaccagtggtatgtgtgcaacagagagaaattatgcgaatcactccaggctgtctttgttcagagttaccttgatcaaggaacacagatcttcttaaacaacagcattgagaaatcgggctggctatttatccaattatatcattcttttgtgtcatctgtttttagcctgtttatgtctagaacatctatcaatgggttgctaggaagaggctcaatgtttgtgttttcaccagatcagtttcagagactgcttaaaattaatccagactggaaaacccacagacttcttgatttaggtgctggagatggagaagtcacaaaaatcatgagccctcattttgaagaaatctatgccactgagctttctgaaactatgatatggcagcttcagaaaaagaaatacagagtccttggtataaatgaatggcagaatacggggttccagtatgatgtcatcagctgcctgaacttgctggaccgctgtgatcagcccctgactttgttaaaagatatcagaagtgtcttggagccaactagaggcagggtcatccttgcccttgtcctcccctttcatccctatgtggaaaactaggtggcaagtgggagaaaccatcagaaattttggaaatcaaaggacagaactgggaagaacaagtgaatagtctgcctgaagttttcagaaaagctggttttgttatcgaagctttcaccagactaccatacctgtgtgaaggcgacatgtataatgactactacgttctggatgacgctgtctttgttctcaaaccagtataaacacgtggaggtcgaagtcttcagagtccgcaccctccgggatgtgcccttggaagagggtctgtgttcacaattacgtgaagggaggacccttggggaccgccattctaaatatcatgtaggaatttaaaaagccaaaatactaattatttctttgtagtgtgtaaaggaatgtttttaaaagacaaaaacccaactctttgtggatttttatcaactctttactcagagccactctccaatgcaggtcacactccaattatgatggaagatattttttatacttaattgcagtagggactcattcccagacaaagcaatagtcacgacttcatggaaccaatcaatggattgttttttgaagactggcaataaagctgtccattcaattccaaatactggttttaaggtatagccactgatattctttcatgtttagaaattctttctgttattattcaagaaaatgtttttaatcatgctaataaacttttttggagacaaaaaaaaaaaaaaaaaaaaaacaaaatgtttgtggggcggcgcctgtgggcccctttaaaaaaaaggttttcttaagacaccattctgggtgtgggcggcgcgggccccaaatagggctagtggcaacagtgtggcataaagggggttcccctaagggaagaatcgggggccaaggcaacaaggggggtggggatttccttctcccaatttaaaacc

SEQ ID NO: 418231 - DNA, 3231 bp, Homo sapiens
ccgggggagaaagcgacgcggccgctcgtaagtgctccggatggaaactggtgcagggggcagcggcgttccgcggccggaagggaagggggaggtgccgaggctgcgcgccggctgctcctccccacccccagcctttgccctgaagggggctggatgggcaaggcggccgcgatggctcgagctcgggcggtggcggcggtggccggaggcggcggtgcctcctcctcctcgccccggcgccggcggtgatccgagcgagcggccgcggcccccgatgagactgctggcgggctggctgtgcctgagcctggcgtccgtgtggctggcgcggaggatgtggacgctgcggagcccgctcacccgctccctgtacgtgaacatgactagcggcccgggtgggccggcggcggccgcgggcggcaggaaggagaaccaccagtggtatgtgtgcaacagagagaaattatgcgaatcactccaggctgtctttgttcagagttaccttgatcaaggaacacagatcttcttaaacaacagcattgagaaatcgggctggctatttatccaattatatcattcttttgtgtcatctgtttttagcctgtttatgtctagaacatctatcaatgggttgctaggaagaggctcaatgtttgtgttttcaccagatcagtttcagagactgcttaaaattaatccagactggaaaacccacagacttcttgatttaggtgctggagatggagaagtcacaaaaatcatgagccctcattttgaagaaatctatgccactgagctttctgaaactatgatatggcagcttcagaaaaagaaatacagagtccttggtataaatgaatggcagaatacggggttccagtatgatgtcatcagctgcctgaacttgctggaccgctgtgatcagcccctgactttgttaaaagatatcagaagtgtcttggagccaactagaggcagggtcatccttgcccttgtcctcccctttcatccctatgtggaaaactaggtggcaagtgggagaaaccatcagaaattttggaaatcaaaggacagaactgggaagaacaagtgaatagtctgcctgaagttttcagaaaagctggttttgttatcgaagctttcaccagactaccatacctgtgtgaaggcgacatgtataatgactactacgttctggatgacgctgtctttgttctcaaaccagtataaacacgtggaggtcgaagtcttcagagtccgcaccctccgggatgtgcccttggaagagggtctgtgttcacaattacgtgaagggaggacccttggggaccgccattctaaatatcatgtaggaatttaaaaagccaaaatactaattatttctttgtagtgtgtaaaggaatgtttttaaaagacaatgcaggtcacactccaattatgatggaagatattttttatacttaattgcagtagggactcattcccagacaaagcaatagtcacgacttcatggaaccaatcaatggattgttttttgaagactggcaataaagctgtccattcaattccaaatactggttttaaggtatagccactgatattctttcatgtttagaaattctttctgttattattcaagaaaatgtttttaatcatgctaataaacttttttggagatgactttggcatcatgtttgaattcatataaagctcccctagcattttttattggtttggcttcaggagtacccaaatagtagcattatgagaatgacgcagacaatttgaataggggggaaggaaggcttcagacttgggggaaggggagattattgcaaattgcagtgaacactgagtcagtaaaaaaaaaaaacagaaacaaaaacccagcctcattcagatacagaacttcagggacccctccccccacccccccagttaatgctgctgtgaaaaatgcaaaataacctggttctgactttgtgatcactcatgtcccatacactgaactttgtttttttctggacaatctcaggttctcagaattgaaacattcagttttgtctactgacaaaatgcaactaaaaatgttttaattcaacttcttactctacacttatatacctctctcccagagcttggctcttccctgaaatccttaaaggagtttattatttgccaagaatatggtttgatgaagaccgtgtcagactcatgcattctggaatccgtgagtgcctccaaccataaacccagaaatgctgccatagaggaacccattagcaagatcaataaccatcgtggatattccaaagagcagagcatttaacccagaatctgaaatctcagtaataacagaaatgtcaatatgagattgtggttattaacaatatgttatcctcactactttatttcttttttcatccaggtgtttcattaagtattctcatttatatgctcatagaagtcatcagatcaacacattcactccaacacctgggtataaaggcgaattaaaacctgaagaattactttattattcattaagaactgcattcccacatcctcacaccaatatcttccactgttactgtgcagtcataataagagttgggttatgtgatttatgcaaaattgttattggtgtgttctaatgatttttttccaggaattcaagtaagtgaagtacaaatacttagcaccatagattgtaaaaatagaaagaggaaatgagaaaacttaatgtcgttcttgtacagttgagttttgcttctttataaactgtctgttaaaatcaggggttgctgttagactgtcaagcagaagtgatggatgttcaaggaggcaggttgccccaaagtgttttctaactttcaagtagagaactttatgctctaataagaaaaatacaactcattcttaaccacccccccaaaacagagaaaacacatacatttatgcattttaaagataaaaagtagtttctcaaaaaaatctgaagttctctgaaaaccagcttattaaaagtgctgttttgtggtgaaaattgaaaccaaatccactcacatttcctatcgggtcttgaaattcttggtggtgtgtcaccattccactagatggcagtgttgcttactgagtgtcaatggcttttttccccgtaaatggaatcatgtttttctcccccaaagtacaataaagctgccttgtctgcaccattaaaaaaaaaag

SEQ ID NO: 418232 - DNA, 2911 bp, Homo sapiens
ccgggggagaaagcgacgcggccgctcgtaagtgctccggatggaaactggtgcagggggcagcggcgttccgcggccggaagggaagggggaggtgccgaggctgcgcgccggctgctcctccccacccccagcctttgccctgaagggggctggatgggcaaggcggccgcgatggctcgagctcgggcggtggcggcggtggccggaggcggcggtgcctcctcctcctcgccccggcgccggcggtgatccgagcgagcggccgcggcccccgatgagactgctggcgggctggctgtgcctgagcctggcgtccgtgtggctggcgcggaggatgtggacgctgcggagcccgctcacccgctccctgtacgtgaacatgactagcggcccgggtgggccggcggcggccgcgggcggcaggaaggagaaccaccagtggtatgtgtgcaacagagagaaattatgcgaatcactccaggctgtctttgttcagagttaccttgatcaaggaacacagatcttcttaaacaacagcattgagaaatcgggctggctatttatccaattatatcagaagtgtcttggagccaactagaggcagggtcatccttgcccttgtcctcccctttcatccctatgtggaaaactaggtggcaagtgggagaaaccatcagaaattttggaaatcaaaggacagaactgggaagaacaagtgaatagtctgcctgaagttttcagaaaagctggttttgttatcgaagctttcaccagactaccatacctgtgtgaaggcgacatgtataatgactactacgttctggatgacgctgtctttgttctcaaaccagtataaacacgtggaggtcgaagtcttcagagtccgcaccctccgggatgtgcccttggaagagggtctgtgttcacaattacgtgaagggaggacccttggggaccgccattctaaatatcatgtaggaatttaaaaagccaaaatactaattatttctttgtagtgtgtaaaggaatgtttttaaaagacaaaaacccaactctttgtggatttttatcaactctttactcagagccactctccaatgcaggtcacactccaattatgatggaagatattttttatacttaattgcagtagggactcattcccagacaaagcaatagtcacgacttcatggaaccaatcaatggattgttttttgaagactggcaataaagctgtccattcaattccaaatactggttttaaggtatagccactgatattctttcatgtttagaaattctttctgttattattcaagaaaatgtttttaatcatgctaataaacttttttggagatgactttggcatcatgtttgaattcatataaagctcccctagcattttttattggtttggcttcaggagtacccaaatagtagcattatgagaatgacgcagacaatttgaataggggggaaggaaggcttcagacttgggggaaggggagattattgcaaattgcagtgaacactgagtcagtaaaaaaaaaaaacagaaacaaaaacccagcctcattcagatacagaacttcagggacccctccccccacccccccagttaatgctgctgtgaaaaatgcaaaataacctggttctgactttgtgatcactcatgtcccatacactgaactttgtttttttctggacaatctcaggttctcagaattgaaacattcagttttgtctactgacaaaatgcaactaaaaatgttttaattcaacttcttactctacacttatatacctctctcccagagcttggctcttccctgaaatccttaaaggagtttattatttgccaagaatatggtttgatgaagaccgtgtcagactcatgcattctggaatccgtgagtgcctccaaccataaacccagaaatgctgccatagaggaacccattagcaagatcaataaccatcgtggatattccaaagagcagagcatttaacccagaatctgaaatctcagtaataacagaaatgtcaatatgagattgtggttattaacaatatgttatcctcactactttatttcttttttcatccaggtgtttcattaagtattctcatttatatgctcatagaagtcatcagatcaacacattcactccaacacctgggtataaaggcgaattaaaacctgaagaattactttattattcattaagaactgcattcccacatcctcacaccaatatcttccactgttactgtgcagtcataataagagttgggttatgtgatttatgcaaaattgttattggtgtgttctaatgatttttttccaggaattcaagtaagtgaagtacaaatacttagcaccatagattgtaaaaatagaaagaggaaatgagaaaacttaatgtcgttcttgtacagttgagttttgcttctttataaactgtctgttaaaatcaggggttgctgttagactgtcaagcagaagtgatggatgttcaaggaggcaggttgccccaaagtgttttctaactttcaagtagagaactttatgctctaataagaaaaatacaactcattcttaaccacccccccaaaacagagaaaacacatacatttatgcattttaaagataaaaagtagtttctcaaaaaaatctgaagttctctgaaaaccagcttattaaaagtgctgttttgtggtgaaaattgaaaccaaatccactcacatttcctatcgggtcttgaaattcttggtggtgtgtcaccattccactagatggcagtgttgcttactgagtgtcaatggcttttttccccgtaaatggaatcatgtttttctcccccaaagtacaataaagctgccttgtctgcaccattaaaaaaaaaag

SEQ ID NO: 418233 - DNA, 1148 bp, Homo sapiens
ccgggggagaaagcgacgcggccgctcgtaagtgctccggatggaaactggtgcagggggcagcggcgttccgcggccggaagggaagggggaggtgccgaggctgcgcgccggctgctcctccccacccccagcctttgccctgaagggggctggatgggcaaggcggccgcgatggctcgagctcgggcggtggcggcggtggccggaggcggcggtgcctcctcctcctcgccccggcgccggcggtgatccgagcgagcggccgcggcccccgatgagactgctggcgggctggctgtgcctgagcctggcgtccgtgtggctggcgcggaggatgtggacgctgcggagcccgctcacccgctccctgtacgtgaacatgactagcggcccgggtgggccggcggcggccgcgggcggcaggaaggagaaccaccagtggtatgtgtgcaacagagagaaattatgcgaatcactccaggctgtctttgttcagagttaccttgatcaaggaacacagatcttcttaaacaacagcattgagaaatcgggctggctatttatccaattatatcattcttttgtgtcatctgtttttagcctgtttatgtctagaacatctatcaatgggttgctaggaagaggctcaatgtttgtgttttcaccagatcagtttcagagactgcttaaaattaatccagactggaaaacccacagacttcttgatttaggtgctggagatggagaagtcacaaaaatcatgagccctcattttgaagaaatctatgccactgagctttctgaaactatgatatggcagcttcagaaaaagaaatacagagtccttggtataaatgaatggcagaatacggggttccagtatgatgtcatcagctgcctgaacttgctggaccgctgtgatcagcccctgactttgttaaaagatatcagaagtgtcttggagccaactagaggcagggtcatccttgcccttgtcctcccctttcatccctatgtggaaaactgtaagtgtggtcagtcaggctagctcttactgaggatagctgtttattggtatttgtgattttgtgctgtgtacaattaaatattgtctagtatgtcttataatagcctgcagtttaaag

SEQ ID NO: 418234 - DNA, 2254 bp, Homo sapiens
atcacttgtttgttcaagaatttaactgaatgttcttatttgtattagtagaggtggcaagtgggagaaaccatcagaaattttggaaatcaaaggacagaactgggaagaacaagtgaatagtctgcctgaagttttcagaaaagctggttttgttatcgaagctttcaccagactaccatacctgtgtgaaggcgacatgtataatgactactacgttctggatgacgctgtctttgttctcaaaccagtataaacacgtggaggtcgaagtcttcagagtccgcaccctccgggatgtgcccttggaagagggtctgtgttcacaattacgtgaagggaggacccttggggaccgccattctaaatatcatgtaggaatttaaaaagccaaaatactaattatttctttgtagtgtgtaaaggaatgtttttaaaagacaatgcaggtcacactccaattatgatggaagatattttttatacttaattgcagtagggactcattcccagacaaagcaatagtcacgacttcatggaaccaatcaatggattgttttttgaagactggcaataaagctgtccattcaattccaaatactggttttaaggtatagccactgatattctttcatgtttagaaattctttctgttattattcaagaaaatgtttttaatcatgctaataaacttttttggagatgactttggcatcatgtttgaattcatataaagctcccctagcattttttattggtttggcttcaggagtacccaaatagtagcattatgagaatgacgcagacaatttgaataggggggaaggaaggcttcagacttgggggaaggggagattattgcaaattgcagtgaacactgagtcagtaaaaaaaaaaaacagaaacaaaaacccagcctcattcagatacagaacttcagggacccctccccccacccccccagttaatgctgctgtgaaaaatgcaaaataacctggttctgactttgtgatcactcatgtcccatacactgaactttgtttttttctggacaatctcaggttctcagaattgaaacattcagttttgtctactgacaaaatgcaactaaaaatgttttaattcaacttcttactctacacttatatacctctctcccagagcttggctcttccctgaaatccttaaaggagtttattatttgccaagaatatggtttgatgaagaccgtgtcagactcatgcattctggaatccgtgagtgcctccaaccataaacccagaaatgctgccatagaggaacccattagcaagatcaataaccatcgtggatattccaaagagcagagcatttaacccagaatctgaaatctcagtaataacagaaatgtcaatatgagattgtggttattaacaatatgttatcctcactactttatttcttttttcatccaggtgtttcattaagtattctcatttatatgctcatagaagtcatcagatcaacacattcactccaacacctgggtataaaggcgaattaaaacctgaagaattactttattattcattaagaactgcattcccacatcctcacaccaatatcttccactgttactgtgcagtcataataagagttgggttatgtgatttatgcaaaattgttattggtgtgttctaatgatttttttccaggaattcaagtaagtgaagtacaaatacttagcaccatagattgtaaaaatagaaagaggaaatgagaaaacttaatgtcgttcttgtacagttgagttttgcttctttataaactgtctgttaaaatcaggggttgctgttagactgtcaagcagaagtgatggatgttcaaggaggcaggttgccccaaagtgttttctaactttcaagtagagaactttatgctctaataagaaaaatacaactcattcttaaccacccccccaaaacagagaaaacacatacatttatgcattttaaagataaaaagtagtttctcaaaaaaatctgaagttctctgaaaaccagcttattaaaagtgctgttttgtggtgaaaattgaaaccaaatccactcacatttcctatcgggtcttgaaattcttggtggtgtgtcaccattccactagatggcagtgttgcttactgagtgtcaatggcttttttccccgtaaatggaatcatgtttttctcccccaaagtacaataaagctgccttgtctgcaccattaaaaaaaaaag

SEQ ID NO: 418235 - DNA, 758 bp, Homo sapiens
ccgggggagaaagcgacgcggccgctcgtaagtgctccggatggaaactggtgcagggggcagcggcgttccgcggccggaagggaagggggaggtgccgaggctgcgcgccggctgctcctccccacccccagcctttgccctgaagggggctggatgggcaaggcggccgcgatggctcgagctcgggcggtggcggcggtggccggaggcggcggtgcctcctcctcctcgccccggcgccggcggtgatccgagcgagcggccgcggcccccgatgagactgctggcgggctggctgtgcctgagcctggcgtccgtgtggctggcgcggaggatgtggacgctgcggagcccgctcacccgctccctgtacgtgaacatgactagcggcccgggtgggccggcggcggccgcgggcggcaggaaggagaaccaccagtggtatgtgtgcaacagagagaaattatgcgaatcactccaggctgtctttgttcagagttaccttgatcaaggaacacagatcttcttaaacaacagcattgagaaatcgggctggctatttatccaattatatcattcttttgtgtcatctgtttttagcctgtttatgtctagaacatctatcaatgggttgctaggaagaggctcaatgtttgtgttttcaccagatcagtttcagagactgcttaaaattaatccagactggaaaacccacagacttctccatctccagcacctaaatccagactggaaaa

SEQ ID NO: 418236 - DNA, 3285 bp, Homo sapiens
ccgggggagaaagcgacgcggccgctcgtaagtgctccggatggaaactggtgcagggggcagcggcgttccgcggccggaagggaagggggaggtgccgaggctgcgcgccggctgctcctccccacccccagcctttgccctgaagggggctggatgggcaaggcggccgcgatggctcgagctcgggcggtggcggcggtggccggaggcggcggtgcctcctcctcctcgccccggcgccggcggtgatccgagcgagcggccgcggcccccgatgagactgctggcgggctggctgtgcctgagcctggcgtccgtgtggctggcgcggaggatgtggacgctgcggagcccgctcacccgctccctgtacgtgaacatgactagcggcccgggtgggccggcggcggccgcgggcggcaggaaggagaaccaccagtggtatgtgtgcaacagagagaaattatgcgaatcactccaggctgtctttgttcagagttaccttgatcaaggaacacagatcttcttaaacaacagcattgagaaatcgggctggctatttatccaattatatcattcttttgtgtcatctgtttttagcctgtttatgtctagaacatctatcaatgggttgctaggaagaggctcaatgtttgtgttttcaccagatcagtttcagagactgcttaaaattaatccagactggaaaacccacagacttcttgatttaggtgctggagatggagaagtcacaaaaatcatgagccctcattttgaagaaatctatgccactgagctttctgaaactatgatatggcagcttcagaaaaagaaatacagagtccttggtataaatgaatggcagaatacggggttccagtatgatgtcatcagctgcctgaacttgctggaccgctgtgatcagcccctgactttgttaaaagatatcagaagtgtcttggagccaactagaggcagggtcatccttgcccttgtcctcccctttcatccctatgtggaaaactaggtggcaagtgggagaaaccatcagaaattttggaaatcaaaggacagaactgggaagaacaagtgaatagtctgcctgaagttttcagaaaagctggttttgttatcgaagctttcaccagactaccatacctgtgtgaaggcgacatgtataatgactactacgttctggatgacgctgtctttgttctcaaaccagtataaacacgtggaggtcgaagtcttcagagtccgcaccctccgggatgtgcccttggaagagggtctgtgttcacaattacgtgaagggaggacccttggggaccgccattctaaatatcatgtaggaatttaaaaagccaaaatactaattatttctttgtagtgtgtaaaggaatgtttttaaaagacaaaaacccaactctttgtggatttttatcaactctttactcagagccactctccaatgcaggtcacactccaattatgatggaagatattttttatacttaattgcagtagggactcattcccagacaaagcaatagtcacgacttcatggaaccaatcaatggattgttttttgaagactggcaataaagctgtccattcaattccaaatactggttttaaggtatagccactgatattctttcatgtttagaaattctttctgttattattcaagaaaatgtttttaatcatgctaataaacttttttggagatgactttggcatcatgtttgaattcatataaagctcccctagcattttttattggtttggcttcaggagtacccaaatagtagcattatgagaatgacgcagacaatttgaataggggggaaggaaggcttcagacttgggggaaggggagattattgcaaattgcagtgaacactgagtcagtaaaaaaaaaaaacagaaacaaaaacccagcctcattcagatacagaacttcagggacccctccccccacccccccagttaatgctgctgtgaaaaatgcaaaataacctggttctgactttgtgatcactcatgtcccatacactgaactttgtttttttctggacaatctcaggttctcagaattgaaacattcagttttgtctactgacaaaatgcaactaaaaatgttttaattcaacttcttactctacacttatatacctctctcccagagcttggctcttccctgaaatccttaaaggagtttattatttgccaagaatatggtttgatgaagaccgtgtcagactcatgcattctggaatccgtgagtgcctccaaccataaacccagaaatgctgccatagaggaacccattagcaagatcaataaccatcgtggatattccaaagagcagagcatttaacccagaatctgaaatctcagtaataacagaaatgtcaatatgagattgtggttattaacaatatgttatcctcactactttatttcttttttcatccaggtgtttcattaagtattctcatttatatgctcatagaagtcatcagatcaacacattcactccaacacctgggtataaaggcgaattaaaacctgaagaattactttattattcattaagaactgcattcccacatcctcacaccaatatcttccactgttactgtgcagtcataataagagttgggttatgtgatttatgcaaaattgttattggtgtgttctaatgatttttttccaggaattcaagtaagtgaagtacaaatacttagcaccatagattgtaaaaatagaaagaggaaatgagaaaacttaatgtcgttcttgtacagttgagttttgcttctttataaactgtctgttaaaatcaggggttgctgttagactgtcaagcagaagtgatggatgttcaaggaggcaggttgccccaaagtgttttctaactttcaagtagagaactttatgctctaataagaaaaatacaactcattcttaaccacccccccaaaacagagaaaacacatacatttatgcattttaaagataaaaagtagtttctcaaaaaaatctgaagttctctgaaaaccagcttattaaaagtgctgttttgtggtgaaaattgaaaccaaatccactcacatttcctatcgggtcttgaaattcttggtggtgtgtcaccattccactagatggcagtgttgcttactgagtgtcaatggcttttttccccgtaaatggaatcatgtttttctcccccaaagtacaataaagctgccttgtctgcaccattaaaaaaaaaag

SEQ ID NO: 418237 - DNA, 3001 bp, Homo sapiens
  misc_feature (46)..(46): n is a, c, g, or t
  misc_feature (78)..(78): n is a, c, g, or t
tgcttaaggtatgggttgctggcgtaagaggtagaggggaggctanctgaacgactctcttattttccaccgctacangaggctctctgagaagagacagcaaagcttcttagatggatcgaaagaccacgagctgggataccaagttctatgaaaagtggtatgtgtgcaacagagagaaattatgcgaatcactccaggctgtctttgttcagagttaccttgatcaaggaacacagatcttcttaaacaacagcattgagaaatcgggctggctatttatccaattatatcattcttttgtgtcatctgtttttagcctgtttatgtctagaacatctatcaatgggttgctaggaagaggctcaatgtttgtgttttcaccagatcagtttcagagactgcttaaaattaatccagactggaaaacccacagacttcttgatttaggtgctggagatggagaagtcacaaaaatcatgagccctcattttgaagaaatctatgccactgagctttctgaaactatgatatggcagcttcagaaaaagaaatacagagtccttggtataaatgaatggcagaatacggggttccagtatgatgtcatcagctgcctgaacttgctggaccgctgtgatcagcccctgactttgttaaaagatatcagaagtgtcttggagccaactagaggcagggtcatccttgcccttgtcctcccctttcatccctatgtggaaaactaggtggcaagtgggagaaaccatcagaaattttggaaatcaaaggacagaactgggaagaacaagtgaatagtctgcctgaagttttcagaaaagctggttttgttatcgaagctttcaccagactaccatacctgtgtgaaggcgacatgtataatgactactacgttctggatgacgctgtctttgttctcaaaccagtataaacacgtggaggtcgaagtcttcagagtccgcaccctccgggatgtgcccttggaagagggtctgtgttcacaattacgtgaagggaggacccttggggaccgccattctaaatatcatgtaggaatttaaaaagccaaaatactaattatttctttgtagtgtgtaaaggaatgtttttaaaagacaaaaacccaactctttgtggatttttatcaactctttactcagagccactctccaatgcaggtcacactccaattatgatggaagatattttttatacttaattgcagtagggactcattcccagacaaagcaatagtcacgacttcatggaaccaatcaatggattgttttttgaagactggcaataaagctgtccattcaattccaaatactggttttaaggtatagccactgatattctttcatgtttagaaattctttctgttattattcaagaaaatgtttttaatcatgctaataaacttttttggagatgactttggcatcatgtttgaattcatataaagctcccctagcattttttattggtttggcttcaggagtacccaaatagtagcattatgagaatgacgcagacaatttgaataggggggaaggaaggcttcagacttgggggaaggggagattattgcaaattgcagtgaacactgagtcagtaaaaaaaaaaaacagaaacaaaaacccagcctcattcagatacagaacttcagggacccctccccccacccccccagttaatgctgctgtgaaaaatgcaaaataacctggttctgactttgtgatcactcatgtcccatacactgaactttgtttttttctggacaatctcaggttctcagaattgaaacattcagttttgtctactgacaaaatgcaactaaaaatgttttaattcaacttcttactctacacttatatacctctctcccagagcttggctcttccctgaaatccttaaaggagtttattatttgccaagaatatggtttgatgaagaccgtgtcagactcatgcattctggaatccgtgagtgcctccaaccataaacccagaaatgctgccatagaggaacccattagcaagatcaataaccatcgtggatattccaaagagcagagcatttaacccagaatctgaaatctcagtaataacagaaatgtcaatatgagattgtggttattaacaatatgttatcctcactactttatttcttttttcatccaggtgtttcattaagtattctcatttatatgctcatagaagtcatcagatcaacacattcactccaacacctgggtataaaggcgaattaaaacctgaagaattactttattattcattaagaactgcattcccacatcctcacaccaatatcttccactgttactgtgcagtcataataagagttgggttatgtgatttatgcaaaattgttattggtgtgttctaatgatttttttccaggaattcaagtaagtgaagtacaaatacttagcaccatagattgtaaaaatagaaagaggaaatgagaaaacttaatgtcgttcttgtacagttgagttttgcttctttataaactgtctgttaaaatcaggggttgctgttagactgtcaagcagaagtgatggatgttcaaggaggcaggttgccccaaagtgttttctaactttcaagtagagaactttatgctctaataagaaaaatacaactcattcttaaccacccccccaaaacagagaaaacacatacatttatgcattttaaagataaaaagtagtttctcaaaaaaatctgaagttctctgaaaaccagcttattaaaagtgctgttttgtggtgaaaattgaaaccaaatccactcacatttcctatcgggtcttgaaattcttggtggtgtgtcaccattccactagatggcagtgttgcttactgagtgtcaatggcttttttccccgtaaatggaatcatgtttttctcccccaaagtacaataaagctgccttgtctgcaccattaaaaaaaaaag

SEQ ID NO: 418238 - DNA, 3214 bp, Homo sapiens
ccgggggagaaagcgacgcggccgctcgtaagtgctccggatggaaactggtgcagggggcagcggcgttccgcggccggaagggaagggggaggtgccgaggctgcgcgccggctgctcctccccacccccagcctttgccctgaagggggctggatgggcaaggcggccgcgatggctcgagctcgggcggtggcggcggtggccggaggcggcggtgcctcctcctcctcgccccggcgccggcggtgatccgagcgagcggccgcggcccccgatgagactgctggcgggctggctgtgcctgagcctggcgtccgtgtggctggcgcggaggatgtggacgctgcggagcccgctcacccgctccctggtatgtgtgcaacagagagaaattatgcgaatcactccaggctgtctttgttcagagttaccttgatcaaggaacacagatcttcttaaacaacagcattgagaaatcgggctggctatttatccaattatatcattcttttgtgtcatctgtttttagcctgtttatgtctagaacatctatcaatgggttgctaggaagaggctcaatgtttgtgttttcaccagatcagtttcagagactgcttaaaattaatccagactggaaaacccacagacttcttgatttaggtgctggagatggagaagtcacaaaaatcatgagccctcattttgaagaaatctatgccactgagctttctgaaactatgatatggcagcttcagaaaaagaaatacagagtccttggtataaatgaatggcagaatacggggttccagtatgatgtcatcagctgcctgaacttgctggaccgctgtgatcagcccctgactttgttaaaagatatcagaagtgtcttggagccaactagaggcagggtcatccttgcccttgtcctcccctttcatccctatgtggaaaactaggtggcaagtgggagaaaccatcagaaattttggaaatcaaaggacagaactgggaagaacaagtgaatagtctgcctgaagttttcagaaaagctggttttgttatcgaagctttcaccagactaccatacctgtgtgaaggcgacatgtataatgactactacgttctggatgacgctgtctttgttctcaaaccagtataaacacgtggaggtcgaagtcttcagagtccgcaccctccgggatgtgcccttggaagagggtctgtgttcacaattacgtgaagggaggacccttggggaccgccattctaaatatcatgtaggaatttaaaaagccaaaatactaattatttctttgtagtgtgtaaaggaatgtttttaaaagacaaaaacccaactctttgtggatttttatcaactctttactcagagccactctccaatgcaggtcacactccaattatgatggaagatattttttatacttaattgcagtagggactcattcccagacaaagcaatagtcacgacttcatggaaccaatcaatggattgttttttgaagactggcaataaagctgtccattcaattccaaatactggttttaaggtatagccactgatattctttcatgtttagaaattctttctgttattattcaagaaaatgtttttaatcatgctaataaacttttttggagatgactttggcatcatgtttgaattcatataaagctcccctagcattttttattggtttggcttcaggagtacccaaatagtagcattatgagaatgacgcagacaatttgaataggggggaaggaaggcttcagacttgggggaaggggagattattgcaaattgcagtgaacactgagtcagtaaaaaaaaaaaacagaaacaaaaacccagcctcattcagatacagaacttcagggacccctccccccacccccccagttaatgctgctgtgaaaaatgcaaaataacctggttctgactttgtgatcactcatgtcccatacactgaactttgtttttttctggacaatctcaggttctcagaattgaaacattcagttttgtctactgacaaaatgcaactaaaaatgttttaattcaacttcttactctacacttatatacctctctcccagagcttggctcttccctgaaatccttaaaggagtttattatttgccaagaatatggtttgatgaagaccgtgtcagactcatgcattctggaatccgtgagtgcctccaaccataaacccagaaatgctgccatagaggaacccattagcaagatcaataaccatcgtggatattccaaagagcagagcatttaacccagaatctgaaatctcagtaataacagaaatgtcaatatgagattgtggttattaacaatatgttatcctcactactttatttcttttttcatccaggtgtttcattaagtattctcatttatatgctcatagaagtcatcagatcaacacattcactccaacacctgggtataaaggcgaattaaaacctgaagaattactttattattcattaagaactgcattcccacatcctcacaccaatatcttccactgttactgtgcagtcataataagagttgggttatgtgatttatgcaaaattgttattggtgtgttctaatgatttttttccaggaattcaagtaagtgaagtacaaatacttagcaccatagattgtaaaaatagaaagaggaaatgagaaaacttaatgtcgttcttgtacagttgagttttgcttctttataaactgtctgttaaaatcaggggttgctgttagactgtcaagcagaagtgatggatgttcaaggaggcaggttgccccaaagtgttttctaactttcaagtagagaactttatgctctaataagaaaaatacaactcattcttaaccacccccccaaaacagagaaaacacatacatttatgcattttaaagataaaaagtagtttctcaaaaaaatctgaagttctctgaaaaccagcttattaaaagtgctgttttgtggtgaaaattgaaaccaaatccactcacatttcctatcgggtcttgaaattcttggtggtgtgtcaccattccactagatggcagtgttgcttactgagtgtcaatggcttttttccccgtaaatggaatcatgtttttctcccccaaagtacaataaagctgccttgtctgcaccattaaaaaaaaaag

SEQ ID NO: 418239 - DNA, 3094 bp, Homo sapiens
ccgggggagaaagcgacgcggccgctcgtaagtgctccggatggaaactggtgcagggggcagcggcgttccgcggccggaagggaagggggaggtgccgaggctgcgcgccggctgctcctccccacccccagcctttgccctgaagggggctggatgggcaaggcggccgcgatggctcgagctcgggcggtggcggcggtggccggaggcggcggtgcctcctcctcctcgccccggcgccggcggtgatccgagcgagcggccgcggcccccgatgagactgctggcgggctggctgtgcctgagcctggcgtccgtgtggctggcgcggaggatgtggacgctgcggagcccgctcacccgctccctgtacgtgaacatgactagcggcccgggtgggccggcggcggccgcgggcggcaggaaggagaaccaccaggttgctaggaagaggctcaatgtttgtgttttcaccagatcagtttcagagactgcttaaaattaatccagactggaaaacccacagacttcttgatttaggtgctggagatggagaagtcacaaaaatcatgagccctcattttgaagaaatctatgccactgagctttctgaaactatgatatggcagcttcagaaaaagaaatacagagtccttggtataaatgaatggcagaatacggggttccagtatgatgtcatcagctgcctgaacttgctggaccgctgtgatcagcccctgactttgttaaaagatatcagaagtgtcttggagccaactagaggcagggtcatccttgcccttgtcctcccctttcatccctatgtggaaaactaggtggcaagtgggagaaaccatcagaaattttggaaatcaaaggacagaactgggaagaacaagtgaatagtctgcctgaagttttcagaaaagctggttttgttatcgaagctttcaccagactaccatacctgtgtgaaggcgacatgtataatgactactacgttctggatgacgctgtctttgttctcaaaccagtataaacacgtggaggtcgaagtcttcagagtccgcaccctccgggatgtgcccttggaagagggtctgtgttcacaattacgtgaagggaggacccttggggaccgccattctaaatatcatgtaggaatttaaaaagccaaaatactaattatttctttgtagtgtgtaaaggaatgtttttaaaagacaaaaacccaactctttgtggatttttatcaactctttactcagagccactctccaatgcaggtcacactccaattatgatggaagatattttttatacttaattgcagtagggactcattcccagacaaagcaatagtcacgacttcatggaaccaatcaatggattgttttttgaagactggcaataaagctgtccattcaattccaaatactggttttaaggtatagccactgatattctttcatgtttagaaattctttctgttattattcaagaaaatgtttttaatcatgctaataaacttttttggagatgactttggcatcatgtttgaattcatataaagctcccctagcattttttattggtttggcttcaggagtacccaaatagtagcattatgagaatgacgcagacaatttgaataggggggaaggaaggcttcagacttgggggaaggggagattattgcaaattgcagtgaacactgagtcagtaaaaaaaaaaaacagaaacaaaaacccagcctcattcagatacagaacttcagggacccctccccccacccccccagttaatgctgctgtgaaaaatgcaaaataacctggttctgactttgtgatcactcatgtcccatacactgaactttgtttttttctggacaatctcaggttctcagaattgaaacattcagttttgtctactgacaaaatgcaactaaaaatgttttaattcaacttcttactctacacttatatacctctctcccagagcttggctcttccctgaaatccttaaaggagtttattatttgccaagaatatggtttgatgaagaccgtgtcagactcatgcattctggaatccgtgagtgcctccaaccataaacccagaaatgctgccatagaggaacccattagcaagatcaataaccatcgtggatattccaaagagcagagcatttaacccagaatctgaaatctcagtaataacagaaatgtcaatatgagattgtggttattaacaatatgttatcctcactactttatttcttttttcatccaggtgtttcattaagtattctcatttatatgctcatagaagtcatcagatcaacacattcactccaacacctgggtataaaggcgaattaaaacctgaagaattactttattattcattaagaactgcattcccacatcctcacaccaatatcttccactgttactgtgcagtcataataagagttgggttatgtgatttatgcaaaattgttattggtgtgttctaatgatttttttccaggaattcaagtaagtgaagtacaaatacttagcaccatagattgtaaaaatagaaagaggaaatgagaaaacttaatgtcgttcttgtacagttgagttttgcttctttataaactgtctgttaaaatcaggggttgctgttagactgtcaagcagaagtgatggatgttcaaggaggcaggttgccccaaagtgttttctaactttcaagtagagaactttatgctctaataagaaaaatacaactcattcttaaccacccccccaaaacagagaaaacacatacatttatgcattttaaagataaaaagtagtttctcaaaaaaatctgaagttctctgaaaaccagcttattaaaagtgctgttttgtggtgaaaattgaaaccaaatccactcacatttcctatcgggtcttgaaattcttggtggtgtgtcaccattccactagatggcagtgttgcttactgagtgtcaatggcttttttccccgtaaatggaatcatgtttttctcccccaaagtacaataaagctgccttgtctgcaccattaaaaaaaaaag

SEQ ID NO: 418240 - DNA, 3075 bp, Homo sapiens
ccgggggagaaagcgacgcggccgctcgtaagtgctccggatggaaactggtgcagggggcagcggcgttccgcggccggaagggaagggggaggtgccgaggctgcgcgccggctgctcctccccacccccagcctttgccctgaagggggctggatgggcaaggcggccgcgatggctcgagctcgggcggtggcggcggtggccggaggcggcggtgcctcctcctcctcgccccggcgccggcggtgatccgagcgagcggccgcggcccccgatgagactgctggcgggctggctgtgcctgagcctggcgtccgtgtggctggcgcggaggatgtggacgctgcggagcccgctcacccgctccctgtacgtgaacatgactagcggcccgggtgggccggcggcggccgcgggcggcaggaaggagaaccaccagtggtatgtgtgcaacagagagaaattatgcgaatcactccaggctgtctttgttcagagttaccttgatcaaggaacacagatcttcttaaacaacagcattgagaaatcgggctggctatttatccaattatatcattcttttgtgtcatctgtttttagcctgtttatgtctagaacatctatcaatggagtccttggtataaatgaatggcagaatacggggttccagtatgatgtcatcagctgcctgaacttgctggaccgctgtgatcagcccctgactttgttaaaagatatcagaagtgtcttggagccaactagaggcagggtcatccttgcccttgtcctcccctttcatccctatgtggaaaactaggtggcaagtgggagaaaccatcagaaattttggaaatcaaaggacagaactgggaagaacaagtgaatagtctgcctgaagttttcagaaaagctggttttgttatcgaagctttcaccagactaccatacctgtgtgaaggcgacatgtataatgactactacgttctggatgacgctgtctttgttctcaaaccagtataaacacgtggaggtcgaagtcttcagagtccgcaccctccgggatgtgcccttggaagagggtctgtgttcacaattacgtgaagggaggacccttggggaccgccattctaaatatcatgtaggaatttaaaaagccaaaatactaattatttctttgtagtgtgtaaaggaatgtttttaaaagacaaaaacccaactctttgtggatttttatcaactctttactcagagccactctccaatgcaggtcacactccaattatgatggaagatattttttatacttaattgcagtagggactcattcccagacaaagcaatagtcacgacttcatggaaccaatcaatggattgttttttgaagactggcaataaagctgtccattcaattccaaatactggttttaaggtatagccactgatattctttcatgtttagaaattctttctgttattattcaagaaaatgtttttaatcatgctaataaacttttttggagatgactttggcatcatgtttgaattcatataaagctcccctagcattttttattggtttggcttcaggagtacccaaatagtagcattatgagaatgacgcagacaatttgaataggggggaaggaaggcttcagacttgggggaaggggagattattgcaaattgcagtgaacactgagtcagtaaaaaaaaaaaacagaaacaaaaacccagcctcattcagatacagaacttcagggacccctccccccacccccccagttaatgctgctgtgaaaaatgcaaaataacctggttctgactttgtgatcactcatgtcccatacactgaactttgtttttttctggacaatctcaggttctcagaattgaaacattcagttttgtctactgacaaaatgcaactaaaaatgttttaattcaacttcttactctacacttatatacctctctcccagagcttggctcttccctgaaatccttaaaggagtttattatttgccaagaatatggtttgatgaagaccgtgtcagactcatgcattctggaatccgtgagtgcctccaaccataaacccagaaatgctgccatagaggaacccattagcaagatcaataaccatcgtggatattccaaagagcagagcatttaacccagaatctgaaatctcagtaataacagaaatgtcaatatgagattgtggttattaacaatatgttatcctcactactttatttcttttttcatccaggtgtttcattaagtattctcatttatatgctcatagaagtcatcagatcaacacattcactccaacacctgggtataaaggcgaattaaaacctgaagaattactttattattcattaagaactgcattcccacatcctcacaccaatatcttccactgttactgtgcagtcataataagagttgggttatgtgatttatgcaaaattgttattggtgtgttctaatgatttttttccaggaattcaagtaagtgaagtacaaatacttagcaccatagattgtaaaaatagaaagaggaaatgagaaaacttaatgtcgttcttgtacagttgagttttgcttctttataaactgtctgttaaaatcaggggttgctgttagactgtcaagcagaagtgatggatgttcaaggaggcaggttgccccaaagtgttttctaactttcaagtagagaactttatgctctaataagaaaaatacaactcattcttaaccacccccccaaaacagagaaaacacatacatttatgcattttaaagataaaaagtagtttctcaaaaaaatctgaagttctctgaaaaccagcttattaaaagtgctgttttgtggtgaaaattgaaaccaaatccactcacatttcctatcgggtcttgaaattcttggtggtgtgtcaccattccactagatggcagtgttgcttactgagtgtcaatggcttttttccccgtaaatggaatcatgtttttctcccccaaagtacaataaagctgccttgtctgcaccattaaaaaaaaaag

SEQ ID NO: 418241 - DNA, 2450 bp, Homo sapiens
ccgggggagaaagcgacgcggccgctcgtaagtgctccggatggaaactggtgcagggggcagcggcgttccgcggccggaagggaagggggaggtgccgaggctgcgcgccggctgctcctccccacccccagcctttgccctgaagggggctggatgggcaaggcggccgcgatggctcgagctcgggcggtggcggcggtggccggaggcggcggtgcctcctcctcctcgccccggcgccggcggtgatccgagcgagcggccgcggcccccgatgagactgctggcgggctggctgtgcctgagcctggcgtccgtgtggctggcgcggaggatgtggacgctgcggagcccgctcacccgctcccgctgtctttgttctcaaaccagtataaacacgtggaggtcgaagtcttcagagtccgcaccctccgggatgtgcccttggaagagggtctgtgttcacaattacgtgaagggaggacccttggggaccgccattctaaatatcatgtaggaatttaaaaagccaaaatactaattatttctttgtagtgtgtaaaggaatgtttttaaaagacaaaaacccaactctttgtggatttttatcaactctttactcagagccactctccaatgcaggtcacactccaattatgatggaagatattttttatacttaattgcagtagggactcattcccagacaaagcaatagtcacgacttcatggaaccaatcaatggattgttttttgaagactggcaataaagctgtccattcaattccaaatactggttttaaggtatagccactgatattctttcatgtttagaaattctttctgttattattcaagaaaatgtttttaatcatgctaataaacttttttggagatgactttggcatcatgtttgaattcatataaagctcccctagcattttttattggtttggcttcaggagtacccaaatagtagcattatgagaatgacgcagacaatttgaataggggggaaggaaggcttcagacttgggggaaggggagattattgcaaattgcagtgaacactgagtcagtaaaaaaaaaaaacagaaacaaaaacccagcctcattcagatacagaacttcagggacccctccccccacccccccagttaatgctgctgtgaaaaatgcaaaataacctggttctgactttgtgatcactcatgtcccatacactgaactttgtttttttctggacaatctcaggttctcagaattgaaacattcagttttgtctactgacaaaatgcaactaaaaatgttttaattcaacttcttactctacacttatatacctctctcccagagcttggctcttccctgaaatccttaaaggagtttattatttgccaagaatatggtttgatgaagaccgtgtcagactcatgcattctggaatccgtgagtgcctccaaccataaacccagaaatgctgccatagaggaacccattagcaagatcaataaccatcgtggatattccaaagagcagagcatttaacccagaatctgaaatctcagtaataacagaaatgtcaatatgagattgtggttattaacaatatgttatcctcactactttatttcttttttcatccaggtgtttcattaagtattctcatttatatgctcatagaagtcatcagatcaacacattcactccaacacctgggtataaaggcgaattaaaacctgaagaattactttattattcattaagaactgcattcccacatcctcacaccaatatcttccactgttactgtgcagtcataataagagttgggttatgtgatttatgcaaaattgttattggtgtgttctaatgatttttttccaggaattcaagtaagtgaagtacaaatacttagcaccatagattgtaaaaatagaaagaggaaatgagaaaacttaatgtcgttcttgtacagttgagttttgcttctttataaactgtctgttaaaatcaggggttgctgttagactgtcaagcagaagtgatggatgttcaaggaggcaggttgccccaaagtgttttctaactttcaagtagagaactttatgctctaataagaaaaatacaactcattcttaaccacccccccaaaacagagaaaacacatacatttatgcattttaaagataaaaagtagtttctcaaaaaaatctgaagttctctgaaaaccagcttattaaaagtgctgttttgtggtgaaaattgaaaccaaatccactcacatttcctatcgggtcttgaaattcttggtggtgtgtcaccattccactagatggcagtgttgcttactgagtgtcaatggcttttttccccgtaaatggaatcatgtttttctcccccaaagtacaataaagctgccttgtctgcaccattaaaaaaaaaag

SEQ ID NO: 418242 - DNA, 906 bp, Homo sapiens
  misc_feature (886)..(886): n is a, c, g, or t
ccgggggagaaagcgacgcggccgctcgtaagtgctccggatggaaactggtgcagggggcagcggcgttccgcggccggaagggaagggggaggtgccgaggctgcgcgccggctgctcctccccacccccagcctttgccctgaagggggctggatgggcaaggcggccgcgatggctcgagctcgggcggtggcggcggtggccggaggcggcggtgcctcctcctcctcgccccggcgccggcggtgatccgagcgagcggccgcggcccccgatgagactgctggcgggctggctgtgcctgagcctggcgtccgtgtggctggcgcggaggatgtggacgctgcggagcccgctcacccgctccctgtacgtgaacatgactagcggcccgggtgggccggcggcggccgcgggcggcaggaaggagaaccaccagtggtatgtgtgcaacagagagaaattatgcgaatcactccaggctgtctttgttcagagttaccttgatcaaggaacacagatcttcttaaacaacagcattgagaaatcgggctggctatttatccaattatatcattcttttgtgtcatctgtttttagcctgtttatgtctagaacatctatcaatgggttgctaggaagaggctcaatgtttgtgttttcaccagatcagtttcagagactgcttaaaattaatccagactggaaaacccacagacttcttgatttaggtgctggagatggagaagtcacaaaaatcatgagccctcattttgaagaaatctatgccactgagctttctgaaactatgatatggcagcttcagaaaaagaaatacagatccttggtataaatggacatggccagcacattaccgggcggntttcacacgctaatggaaac

SEQ ID NO: 418243 - DNA, 4292 bp, Homo sapiens
agtctcattggcagaggcgggaccgacggtgtgtgcggaacatggcggagcgcggcaggaagcggccgtgcggcccgggtgaacacggccaaaggattgagtggcgaaaatggaagcaacagaagaaagaggagaaaaaaaaatggaaggatctcaagctgatgaaaaaactggagcggcagcgggcacaggaggaacaggcaaagcgcctggaagaggaggaggcagcggcagagaaggaggaccgcgggcggccctacacactgagcgtagccctgccgggctccatcctggacaatgctcagtcgccggagcttcgcacctacttggccggtcagattgccagagcctgtgccatcttctgtgtggatgagatcgtggtgtttgatgaggagggccaggatgccaagactgtggagggggaattcacaggagttgggaagaaggggcaggcgtgcgtacagctggcccggatcctgcagtacctggagtgtccacagtacctgaggaaggcgttcttccccaagcaccaggatctacagtttgcagggctcctgaaccccctggacagcccccaccacatgcgtcaggatgaggaatccgagttccgagagggcatcgtggtggatcggcccacccggccaggccacggctcctttgtcaactgtggcatgaaaaaggaggtgaagattgacaagaacctggagcccgggcttcgggtgactgtgcgactgaaccagcagcagcacccagactgcaagacctaccatggcaaagtggtatcatcgcaggaccctcgcaccaaagctggtctctactggggctacaccgtccgactggcttcctgcctcagtgctgtgtttgctgaggcccccttccaagatgggtatgacctgaccatcgggacgtcagagcgcggctcagatgtggcctctgcccagcttcccaacttcaggcatgctcttgtggtgttcgggggcctccagggtctggaagctggagcggatgctgaccccaacctggaggtggctgaacccagtgtcctctttgacctgtacgtcaatacctgtcctggccagggtagccgtaccatccgcacggaggaagccatcctcatctccctggccgccctgcagcctggcctcatccaggcgggtgcccggcacacctgaaagttctaaggggccgaggacatcagtgaagcagcagtgaaaccaggggctctgcaggtcacttgggacggacgccaccagacttgtctccaaaaatcaccacctttaatactccccggcctgcacacacccacagtctcactgggctccaccctcacttactgcccgccgtgatggccttgaggctgcctgcccgcgccaggatgtttggcacaaagagcagccccgaagcccgctcaatgctctcgatgggcaccaggaagcgctccagtgggatggcctcatccacaggtgcgttgggcatcacgtaggtgcggagctcaatttgcccacctgctgcctccaggatcagcaccttgaagaagtgtgtgggcactgccacgtggttcttgccgatgacctggtactttacgtaggatttcccatcagcctctgtcctgtgggcagacccaggcacacgtgggcagggggcctggatgaacccaaagccacctcttccaggcagccttccctgatctgtcctctaacttctgtcaacctgcaggaccacgccctcactgtgagacttctgtagcctgcctggctcctccttgaggctggaactctctccagggtggttaactctttccctctgttttccttatgcccaacactgggtcaggcagagtgggcgacaataaacgctgctaggagaatcgagccttctgaatattcacattcgtctgaggggagacttaacgactgtccatctctccccacagaggtgagcaacaagtgggcaaggaccatgacaggtgatatcccagcaccagcacaggtgccaggacaccggacgggggctccccctcagcagagtctcctcccttccaccaggccctaggaggcacctgctaatgaaatttgatcagtgccccaaccaccgccttggccagcctatgccgagcccttaccatggaccaggccctggggaagcatgtgacatcaaccaagaggtcacaggttttgcagagggggacacaggtcatttgcccacagcaccaaggaactaggtgatgaggcctggactccatcccgagcctgtggattccagagtgagctgctcagcctggacctgttgcctctcagccccagccctctgcaggccagaaaaaccacggagcacacccagaggtgctcagttgcttccacctgagaggcagggctgcacaggagcaagagtggaggccctgggtcaggcagatctagattcaaactcccgagaagggtggagggaagtgctccaagcagagcagagactgaaggcgggagagcctggtgcaccgcggacctgcagggggaaggcgtgagagctcggtgcactggggacctgcatggggaaggcgggagagctcggtgcactggggacctgcatggggaaggcgtgagagctcggtgcactggggacctgcatggggaaggcgggagagctcggtgcacctcggacctgcagagggaaggtgggagagcttggtgcaccgcagacctgcagggggaaggcgggagagcttggtgcactgcagacctgcggggggaaggtgggagagcttggtgcactgcagacctgcggggggttccatattggcagaacaagattgggtgggcatgccaagaggtgacagcagggagaagcgggggcagattcagggcctgctgctgcccatgggcagaggagagatggtcaggggtacccgacaggtctttggctgtggaggtggaatgaggggactcgaggcagggaagctgacaggcttgccaagaaaccagatgagtagggaactggtattgacccagagcctggggcaagcctggccctgtgagtggcagtaggggcctcaggtgagtgggaggttctgccgcccccctggtttccaccttacctgggcaggaagagtggccctgtgcagacatagacgttttggtagctgcgggtcaagctgcggctatatttctccaggttgttccaggcattctggttgaggtggggcacctggtaggagagatagggcttagcaggactgtggctgggacccttcctcctctatcagagggccgccccaggtcctgaggggatggacaggctcagagatatccagtgagacaagcggggggaaactgaggctcaaggaatgaaagtcactccctgaaacccagggctgatagagtgctagccaccaccctctgtccctcccacagcccaggtgtcaaagtcttttctcagctcccaagagtcgaatgaaggaagagcctgtctccacctttcagagaggactgaggcctgtccccagccccacccagggtctcctgggaagaccagcccttccaactaccaacccgttccttttcccagtctgagccacaggaagagcctagcggggaatgccatgaatcgacctccatcctgagctctccaggcctgggacaatggaaagtggatagggggctgtcttcccagaaggaagctgggtcagaggttggtgccccatgggctccacccagagccccatggcagtctccatccattggtgccaggacctgctgggaacaggctgagagggtggttggcccagtgcacagtgcctggcactaacaacctgatcgtgggccaggtgtctgcctcgaaactgcctgaaggcaggcagggtaggacaatgtctggaggctcacggttttatagactaggggtccccaacccctgggctacagaccggtaccagaaccgggccacacagcaggaggtgagcagcaggcgagcaagggaagcttcatctgtatttacagccacccccccattgatcccacagcagcctgagctccgcctcctgtcagatcagtggcggctggagattgtcataggagctggaaccctatggtgaactgcgcatgtgaggaggttgcgcgcttcttttgaaaacctaatgcctgatctgtcgttgttgcccatcacctccagataggactgtctagttgcaggaaaacaagctcagggctcccacggatcctacattactgtgagttgtatatttcactatatgttacaatgtaataataatagaaataaaatgtacataaatgtaaagcact

SEQ ID NO: 418244 - DNA, 1871 bp, Homo sapiens
agtctcattggcagaggcgggaccgacggtgtgtgcggaacatggcggagcgcggcaggaagcggccgtgcggcccgggtgaacacggccaaaggattgagtggcgaaaatggaagcaacagaagaaagaggagaaaaaaaaatggaaggatctcaagctgatgaaaaaactggagcggcagcgggcacaggaggaacaggcaaagcgcctggaagaggaggaggcagcggcagagaaggaggaccgcgggcggccctacacactgagcgtagccctgccgggctccatcctggacaatgctcagtcgccggagcttcgcacctacttggccggtcagattgccagagcctgtgccatcttctgtgtggatgagatcgtggtgtttgatgaggagggccaggatgccaagactgtggagggggaattcacaggagttgggaagaaggggcaggcgtgcgtacagctggcccggatcctgcagtacctggagtgtccacagtacctgaggaaggcgttcttccccaagcaccaggatctacagtttgcagggctcctgaaccccctggacagcccccaccacatgcgtcaggatgaggaatccgagttccgagagggcatcgtggtggatcggcccacccggccaggccacggctcctttgtcaactgtggcatgaaaaaggaggtgaagattgacaagaacctggagcccgggcttcgggtgactgtgcgactgaaccagcagcagcacccagactgcaagacctaccatggcaaagtggtatcatcgcaggaccctcgcaccaaagctggtctctactggggctacaccgtccgactggcttcctgcctcagtgctgtgtttgctgaggcccccttccaagatgggtatgacctgaccatcgggacgtcagagcgcggctcagatgtggcctctgcccagcttcccaacttcaggcatgctcttgtggtgttcgggggcctccagggtctggaagctggagcggatgctgaccccaacctggaggtggctgaacccagtgtcctctttgacctgtacgtcaatacctgtcctggccagggtagccgtaccatccgcacggaggaagccatcctcatctccctggccgccctgcagcctggcctcatccaggcgggtgcccggcacacctgaaagttctaaggggccgaggacatcagtgaagcagcagtgaaaccaggggctctgcaggtcacttgggacggacgccaccagacttgtctccaaaaatcaccacctttaatactccccggcctgcacacacccacagtctcactgggctccaccctcacttactgcccgccgtgatggccttgaggctgcctgcccgcgccaggatgtttggcacaaagagcagccccgaagcccgctcaatgctctcgatgggcaccaggaagcgctccagtgggatggcctcatccacaggtgcgttgggcatcacgtaggtgcggagctcaatttgcccacctgctgcctccaggatcagcaccttgaagaagtgtgtgggcactgccacgtggttcttgccgatgacctggtactttacgtaggatttcccatcagcctctgtcctgtgggcagacccaggcacacgtgggcagggggcctggatgaacccaaagccacctcttccaggcagccttccctgatctgtcctctaacttctgtcaacctgcaggaccacgccctcactgtgagacttctgtagcctgcctggctcctccttgaggctggaactctctccagggtggttaactctttccctctgttttccttatgcccaacactgggtcaggcagagtgggcgacaataaacgctgctaggagaatcga

SEQ ID NO: 418245 - DNA, 2552 bp, Homo sapiens
agtctcattggcagaggcgggaccgacggtgtgtgcggaacatggcggagcgcggcaggaagcggccgtgcggcccgggtgaacacggccaaaggattgagtggcgaaaatggaagcaacagaagaaagaggagaaaaaaaaatggaaggatctcaagctgatgaaaaaactggagcggcagcgggcacaggaggaacaggcaaagcgcctggaagaggaggaggcagcggcagagaaggaggaccgcgggcggccctacacactgagcgtagccctgccgggctccatcctggacaatgctcagtcgccggagcttcgcacctacttggccggtcagattgccagagcctgtgccatcttctgtgtggatgagatcgtggtgtttgatgaggagggccaggatgccaagactgtggagggggaattcacaggagttgggaagaaggggcaggcgtgcgtacagctggcccggatcctgcagtacctggagtgtccacagtacctgaggaaggcgttcttccccaagcaccaggatctacagtttgcagggctcctgaaccccctggacagcccccaccacatgcgtcaggatgaggaatccgagttccgagagggcatcgtggtggatcggcccacccggccaggccacggctcctttgtcaactgtggcatgaaaaaggaggtgaagattgacaagaacctggagcccgggcttcgggtgactgtgcgactgaaccagcagcagcacccagactgcaagacctaccatggcaaagtggtatcatcgcaggaccctcgcaccaaagctggtctctactggggctacaccgtccgactggcttcctgcctcagtgctgtgtttgctgaggcccccttccaagatgggtatgacctgaccatcgggacgtcagagcgcggctcagatgtggcctctgcccagcttcccaacttcaggcatgctcttgtggtgttcgggggcctccagggtctggaagctggagcggatgctgaccccaacctggaggtggctgaacccagtgtcctctttgacctgtacgtcaatacctgtcctggccagggtagccgtaccatccgcacggaggaagccatcctcatctccctggccgccctgcagcctggcctcatccaggcgggtgcccggcacacctgaaagttctaaggggccgaggacatcagtgaagcagcagtgaaaccaggggctctgcaggtcacttgggacggacgccaccagacttgtctccaaaaatcaccacctttaatactccccggcctgcacacacccacagtctcactgggctccaccctcacttactgcccgccgtgatggccttgaggctgcctgcccgcgccaggatgtttggcacaaagagcagccccgaagcccgctcaatgctctcgatgggcaccaggaagcgctccagtgggatggcctcatccacaggtgcgttgggcatcacgtaggtgcggagctcaatttgcccacctgctgcctccaggatcagcaccttgaagaagtgtgtgggcactgccacgtggttcttgccgatgacctggtactttacgtaggatttcccatcagcctctgtcctgtgggcagacccaggcacacgtgggcagggggcctggatgaacccaaagccacctcttccaggcagccttccctgatctgtcctctaacttctgtcaacctgcaggaccacgccctcactgtgagacttctgtagcctgcctggctcctccttgaggctggaactctctccagggtggttaactctttccctctgttttccttatgcccaacactgggtcaggcagagtgggcgacaataaacgctgctaggagaatcgagccttctgaatattcacattcgtctgaggggagacttaacgactgtccatctctccccacagaggtgagcaacaagtgggcaaggaccatgacaggtgatatcccagcaccagcacaggtgccaggacaccggacgggggctccccctcagcagagtctcctcccttccaccaggccctaggaggcacctgctaatgaaatttgatcagtgccccaaccaccgccttggccagcctatgccgagcccttaccatggaccaggccctggggaagcatgtgacatcaaccaagaggtcacaggttttgcagagggggacacaggtcatttgcccacagcaccaaggaactaggtgatgaggcctggactccatcccgagcctgtggattccagagtgagctgctcagcctggacctgttgcctctcagccccagccctctgcaggccagaaaaaccacggagcacacccagaggtgctcagttgcttccacctgagaggcagggctgcacaggagcaagagtggaggccctgggtcaggcagatctagattcaaactcccgagaagggtggagggaagtgctccaagcagagcagagactgaaggcgggagagcctggtgcaccgcggacctgggcaggaagagtggccctgtgcagaccggggagtattaaaggtggtgatt

SEQ ID NO: 418246 - DNA, 4215 bp, Homo sapiens
gtcttgaggatcccggtcattttctacacgagaaattgagcacagaagaaagaggagaaaaaaaaatggaaggatctcaagctgatgaaaaaactggagcggcagcgggcacaggaggaacaggcaaagcgcctggaagaggaggaggcagcggcagagaaggaggaccgcgggcggccctacacactgagcgtagccctgccgggctccatcctggacaatgctcagtcgccggagcttcgcacctacttggccggtcagattgccagagcctgtgccatcttctgtgtggatgagatcgtggtgtttgatgaggagggccaggatgccaagactgtggagggggaattcacaggagttgggaagaaggggcaggcgtgcgtacagctggcccggatcctgcagtacctggagtgtccacagtacctgaggaaggcgttcttccccaagcaccaggatctacagtttgcagggctcctgaaccccctggacagcccccaccacatgcgtcaggatgaggaatccgagttccgagagggcatcgtggtggatcggcccacccggccaggccacggctcctttgtcaactgtggcatgaaaaaggaggtgaagattgacaagaacctggagcccgggcttcgggtgactgtgcgactgaaccagcagcagcacccagactgcaagacctaccatggcaaagtggtatcatcgcaggaccctcgcaccaaagctggtctctactggggctacaccgtccgactggcttcctgcctcagtgctgtgtttgctgaggcccccttccaagatgggtatgacctgaccatcgggacgtcagagcgcggctcagatgtggcctctgcccagcttcccaacttcaggcatgctcttgtggtgttcgggggcctccagggtctggaagctggagcggatgctgaccccaacctggaggtggctgaacccagtgtcctctttgacctgtacgtcaatacctgtcctggccagggtagccgtaccatccgcacggaggaagccatcctcatctccctggccgccctgcagcctggcctcatccaggcgggtgcccggcacacctgaaagttctaaggggccgaggacatcagtgaagcagcagtgaaaccaggggctctgcaggtcacttgggacggacgccaccagacttgtctccaaaaatcaccacctttaatactccccggcctgcacacacccacagtctcactgggctccaccctcacttactgcccgccgtgatggccttgaggctgcctgcccgcgccaggatgtttggcacaaagagcagccccgaagcccgctcaatgctctcgatgggcaccaggaagcgctccagtgggatggcctcatccacaggtgcgttgggcatcacgtaggtgcggagctcaatttgcccacctgctgcctccaggatcagcaccttgaagaagtgtgtgggcactgccacgtggttcttgccgatgacctggtactttacgtaggatttcccatcagcctctgtcctgtgggcagacccaggcacacgtgggcagggggcctggatgaacccaaagccacctcttccaggcagccttccctgatctgtcctctaacttctgtcaacctgcaggaccacgccctcactgtgagacttctgtagcctgcctggctcctccttgaggctggaactctctccagggtggttaactctttccctctgttttccttatgcccaacactgggtcaggcagagtgggcgacaataaacgctgctaggagaatcgagccttctgaatattcacattcgtctgaggggagacttaacgactgtccatctctccccacagaggtgagcaacaagtgggcaaggaccatgacaggtgatatcccagcaccagcacaggtgccaggacaccggacgggggctccccctcagcagagtctcctcccttccaccaggccctaggaggcacctgctaatgaaatttgatcagtgccccaaccaccgccttggccagcctatgccgagcccttaccatggaccaggccctggggaagcatgtgacatcaaccaagaggtcacaggttttgcagagggggacacaggtcatttgcccacagcaccaaggaactaggtgatgaggcctggactccatcccgagcctgtggattccagagtgagctgctcagcctggacctgttgcctctcagccccagccctctgcaggccagaaaaaccacggagcacacccagaggtgctcagttgcttccacctgagaggcagggctgcacaggagcaagagtggaggccctgggtcaggcagatctagattcaaactcccgagaagggtggagggaagtgctccaagcagagcagagactgaaggcgggagagcctggtgcaccgcggacctgcagggggaaggcgtgagagctcggtgcactggggacctgcatggggaaggcgggagagctcggtgcactggggacctgcatggggaaggcgtgagagctcggtgcactggggacctgcatggggaaggcgggagagctcggtgcacctcggacctgcagagggaaggtgggagagcttggtgcaccgcagacctgcagggggaaggcgggagagcttggtgcactgcagacctgcggggggaaggtgggagagcttggtgcactgcagacctgcggggggttccatattggcagaacaagattgggtgggcatgccaagaggtgacagcagggagaagcgggggcagattcagggcctgctgctgcccatgggcagaggagagatggtcaggggtacccgacaggtctttggctgtggaggtggaatgaggggactcgaggcagggaagctgacaggcttgccaagaaaccagatgagtagggaactggtattgacccagagcctggggcaagcctggccctgtgagtggcagtaggggcctcaggtgagtgggaggttctgccgcccccctggtttccaccttacctgggcaggaagagtggccctgtgcagacatagacgttttggtagctgcgggtcaagctgcggctatatttctccaggttgttccaggcattctggttgaggtggggcacctggtaggagagatagggcttagcaggactgtggctgggacccttcctcctctatcagagggccgccccaggtcctgaggggatggacaggctcagagatatccagtgagacaagcggggggaaactgaggctcaaggaatgaaagtcactccctgaaacccagggctgatagagtgctagccaccaccctctgtccctcccacagcccaggtgtcaaagtcttttctcagctcccaagagtcgaatgaaggaagagcctgtctccacctttcagagaggactgaggcctgtccccagccccacccagggtctcctgggaagaccagcccttccaactaccaacccgttccttttcccagtctgagccacaggaagagcctagcggggaatgccatgaatcgacctccatcctgagctctccaggcctgggacaatggaaagtggatagggggctgtcttcccagaaggaagctgggtcagaggttggtgccccatgggctccacccagagccccatggcagtctccatccattggtgccaggacctgctgggaacaggctgagagggtggttggcccagtgcacagtgcctggcactaacaacctgatcgtgggccaggtgtctgcctcgaaactgcctgaaggcaggcagggtaggacaatgtctggaggctcacggttttatagactaggggtccccaacccctgggctacagaccggtaccagaaccgggccacacagcaggaggtgagcagcaggcgagcaagggaagcttcatctgtatttacagccacccccccattgatcccacagcagcctgagctccgcctcctgtcagatcagtggcggctggagattgtcataggagctggaaccctatggtgaactgcgcatgtgaggaggttgcgcgcttcttttgaaaacctaatgcctgatctgtcgttgttgcccatcacctccagataggactgtctagttgcaggaaaacaagctcagggctcccacggatcctacattactgtgagttgtatatttcactatatgttacaatgtaataataatagaaataaaatgtacataaatgtaaagcact

SEQ ID NO: 418247 - DNA, 4068 bp, Homo sapiens
ctgggaacatccctcccctgctcagggcggccctacacactgagcgtagccctgccgggctccatcctggacaatgctcagtcgccggagcttcgcacctacttggccggtcagattgccagagcctgtgccatcttctgtgtggatgagatcgtggtgtttgatgaggagggccaggatgccaagactgtggagggggaattcacaggagttgggaagaaggggcaggcgtgcgtacagctggcccggatcctgcagtacctggagtgtccacagtacctgaggaaggcgttcttccccaagcaccaggatctacagtttgcagggctcctgaaccccctggacagcccccaccacatgcgtcaggatgaggaatccgagttccgagagggcatcgtggtggatcggcccacccggccaggccacggctcctttgtcaactgtggcatgaaaaaggaggtgaagattgacaagaacctggagcccgggcttcgggtgactgtgcgactgaaccagcagcagcacccagactgcaagacctaccatggcaaagtggtatcatcgcaggaccctcgcaccaaagctggtctctactggggctacaccgtccgactggcttcctgcctcagtgctgtgtttgctgaggcccccttccaagatgggtatgacctgaccatcgggacgtcagagcgcggctcagatgtggcctctgcccagcttcccaacttcaggcatgctcttgtggtgttcgggggcctccagggtctggaagctggagcggatgctgaccccaacctggaggtggctgaacccagtgtcctctttgacctgtacgtcaatacctgtcctggccagggtagccgtaccatccgcacggaggaagccatcctcatctccctggccgccctgcagcctggcctcatccaggcgggtgcccggcacacctgaaagttctaaggggccgaggacatcagtgaagcagcagtgaaaccaggggctctgcaggtcacttgggacggacgccaccagacttgtctccaaaaatcaccacctttaatactccccggcctgcacacacccacagtctcactgggctccaccctcacttactgcccgccgtgatggccttgaggctgcctgcccgcgccaggatgtttggcacaaagagcagccccgaagcccgctcaatgctctcgatgggcaccaggaagcgctccagtgggatggcctcatccacaggtgcgttgggcatcacgtaggtgcggagctcaatttgcccacctgctgcctccaggatcagcaccttgaagaagtgtgtgggcactgccacgtggttcttgccgatgacctggtactttacgtaggatttcccatcagcctctgtcctgtgggcagacccaggcacacgtgggcagggggcctggatgaacccaaagccacctcttccaggcagccttccctgatctgtcctctaacttctgtcaacctgcaggaccacgccctcactgtgagacttctgtagcctgcctggctcctccttgaggctggaactctctccagggtggttaactctttccctctgttttccttatgcccaacactgggtcaggcagagtgggcgacaataaacgctgctaggagaatcgagccttctgaatattcacattcgtctgaggggagacttaacgactgtccatctctccccacagaggtgagcaacaagtgggcaaggaccatgacaggtgatatcccagcaccagcacaggtgccaggacaccggacgggggctccccctcagcagagtctcctcccttccaccaggccctaggaggcacctgctaatgaaatttgatcagtgccccaaccaccgccttggccagcctatgccgagcccttaccatggaccaggccctggggaagcatgtgacatcaaccaagaggtcacaggttttgcagagggggacacaggtcatttgcccacagcaccaaggaactaggtgatgaggcctggactccatcccgagcctgtggattccagagtgagctgctcagcctggacctgttgcctctcagccccagccctctgcaggccagaaaaaccacggagcacacccagaggtgctcagttgcttccacctgagaggcagggctgcacaggagcaagagtggaggccctgggtcaggcagatctagattcaaactcccgagaagggtggagggaagtgctccaagcagagcagagactgaaggcgggagagcctggtgcaccgcggacctgcagggggaaggcgtgagagctcggtgcactggggacctgcatggggaaggcgggagagctcggtgcactggggacctgcatggggaaggcgtgagagctcggtgcactggggacctgcatggggaaggcgggagagctcggtgcacctcggacctgcagagggaaggtgggagagcttggtgcaccgcagacctgcagggggaaggcgggagagcttggtgcactgcagacctgcggggggaaggtgggagagcttggtgcactgcagacctgcggggggttccatattggcagaacaagattgggtgggcatgccaagaggtgacagcagggagaagcgggggcagattcagggcctgctgctgcccatgggcagaggagagatggtcaggggtacccgacaggtctttggctgtggaggtggaatgaggggactcgaggcagggaagctgacaggcttgccaagaaaccagatgagtagggaactggtattgacccagagcctggggcaagcctggccctgtgagtggcagtaggggcctcaggtgagtgggaggttctgccgcccccctggtttccaccttacctgggcaggaagagtggccctgtgcagacatagacgttttggtagctgcgggtcaagctgcggctatatttctccaggttgttccaggcattctggttgaggtggggcacctggtaggagagatagggcttagcaggactgtggctgggacccttcctcctctatcagagggccgccccaggtcctgaggggatggacaggctcagagatatccagtgagacaagcggggggaaactgaggctcaaggaatgaaagtcactccctgaaacccagggctgatagagtgctagccaccaccctctgtccctcccacagcccaggtgtcaaagtcttttctcagctcccaagagtcgaatgaaggaagagcctgtctccacctttcagagaggactgaggcctgtccccagccccacccagggtctcctgggaagaccagcccttccaactaccaacccgttccttttcccagtctgagccacaggaagagcctagcggggaatgccatgaatcgacctccatcctgagctctccaggcctgggacaatggaaagtggatagggggctgtcttcccagaaggaagctgggtcagaggttggtgccccatgggctccacccagagccccatggcagtctccatccattggtgccaggacctgctgggaacaggctgagagggtggttggcccagtgcacagtgcctggcactaacaacctgatcgtgggccaggtgtctgcctcgaaactgcctgaaggcaggcagggtaggacaatgtctggaggctcacggttttatagactaggggtccccaacccctgggctacagaccggtaccagaaccgggccacacagcaggaggtgagcagcaggcgagcaagggaagcttcatctgtatttacagccacccccccattgatcccacagcagcctgagctccgcctcctgtcagatcagtggcggctggagattgtcataggagctggaaccctatggtgaactgcgcatgtgaggaggttgcgcgcttcttttgaaaacctaatgcctgatctgtcgttgttgcccatcacctccagataggactgtctagttgcaggaaaacaagctcagggctcccacggatcctacattactgtgagttgtatatttcactatatgttacaatgtaataataatagaaataaaatgtacataaatgtaaagcact

SEQ ID NO: 418248 - DNA, 2430 bp, Homo sapiens
aaatacggctaggtacgaggctgggggtttaattcggccgaggcttaacgactgtccatctctccccacagaggtgagcaacaagtgggcaaggaccatgacaggtgatatcccagcaccagcacaggtgccaggacaccggacgggggctccccctcagcagagtctcctcccttccaccaggccctaggaggcacctgctaatgaaatttgatcagtgccccaaccaccgccttggccagcctatgccgagcccttaccatggaccaggccctggggaagcatgtgacatcaaccaagaggtcacaggttttgcagagggggacacaggtcatttgcccacagcaccaaggaactaggtgatgaggcctggactccatcccgagcctgtggattccagagtgagctgctcagcctggacctgttgcctctcagccccagccctctgcaggccagaaaaaccacggagcacacccagaggtgctcagttgcttccacctgagaggcagggctgcacaggagcaagagtggaggccctgggtcaggcagatctagattcaaactcccgagaagggtggagggaagtgctccaagcagagcagagactgaaggcgggagagcctggtgcaccgcggacctgcagggggaaggcgtgagagctcggtgcactggggacctgcatggggaaggcgggagagctcggtgcactggggacctgcatggggaaggcgtgagagctcggtgcactggggacctgcatggggaaggcgggagagctcggtgcacctcggacctgcagagggaaggtgggagagcttggtgcaccgcagacctgcagggggaaggcgggagagcttggtgcactgcagacctgcggggggaaggtgggagagcttggtgcactgcagacctgcggggggttccatattggcagaacaagattgggtgggcatgccaagaggtgacagcagggagaagcgggggcagattcagggcctgctgctgcccatgggcagaggagagatggtcaggggtacccgacaggtctttggctgtggaggtggaatgaggggactcgaggcagggaagctgacaggcttgccaagaaaccagatgagtagggaactggtattgacccagagcctggggcaagcctggccctgtgagtggcagtaggggcctcaggtgagtgggaggttctgccgcccccctggtttccaccttacctgggcaggaagagtggccctgtgcagacatagacgttttggtagctgcgggtcaagctgcggctatatttctccaggttgttccaggcattctggttgaggtggggcacctggtaggagagatagggcttagcaggactgtggctgggacccttcctcctctatcagagggccgccccaggtcctgaggggatggacaggctcagagatatccagtgagacaagcggggggaaactgaggctcaaggaatgaaagtcactccctgaaacccagggctgatagagtgctagccaccaccctctgtccctcccacagcccaggtgtcaaagtcttttctcagctcccaagagtcgaatgaaggaagagcctgtctccacctttcagagaggactgaggcctgtccccagccccacccagggtctcctgggaagaccagcccttccaactaccaacccgttccttttcccagtctgagccacaggaagagcctagcggggaatgccatgaatcgacctccatcctgagctctccaggcctgggacaatggaaagtggatagggggctgtcttcccagaaggaagctgggtcagaggttggtgccccatgggctccacccagagccccatggcagtctccatccattggtgccaggacctgctgggaacaggctgagagggtggttggcccagtgcacagtgcctggcactaacaacctgatcgtgggccaggtgtctgcctcgaaactgcctgaaggcaggcagggtaggacaatgtctggaggctcacggttttatagactaggggtccccaacccctgggctacagaccggtaccagaaccgggccacacagcaggaggtgagcagcaggcgagcaagggaagcttcatctgtatttacagccacccccccattgatcccacagcagcctgagctccgcctcctgtcagatcagtggcggctggagattgtcataggagctggaaccctatggtgaactgcgcatgtgaggaggttgcgcgcttcttttgaaaacctaatgcctgatctgtcgttgttgcccatcacctccagataggactgtctagttgcaggaaaacaagctcagggctcccacggatcctacattactgtgagttgtatatttcactatatgttacaatgtaataataatagaaataaaatgtacataaatgtaaagcact

SEQ ID NO: 418249 - DNA, 1501 bp, Homo sapiens
cacgaggcgactgtccatctctccccacagaggtgacagcagggagaagcgggggcagattcagggcctgctgctgcccatgggcagaggagagatggtcaggggtacccgacaggtctttggctgtggaggtggaatgaggggactcgaggcagggaagctgacaggcttgccaagaaaccagatgagtagggaactggtattgacccagagcctggggcaagcctggccctgtgagtggcagtaggggcctcaggtgagtgggaggttctgccgcccccctggtttccaccttacctgggcaggaagagtggccctgtgcagacatagacgttttggtagctgcgggtcaagctgcggctatatttctccaggttgttccaggcattctggttgaggtggggcacctggtaggagagatagggcttagcaggactgtggctgggacccttcctcctctatcagagggccgccccaggtcctgaggggatggacaggctcagagatatccagtgagacaagcggggggaaactgaggctcaaggaatgaaagtcactccctgaaacccagggctgatagagtgctagccaccaccctctgtccctcccacagcccaggtgtcaaagtcttttctcagctcccaagagtcgaatgaaggaagagcctgtctccacctttcagagaggactgaggcctgtccccagccccacccagggtctcctgggaagaccagcccttccaactaccaacccgttccttttcccagtctgagccacaggaagagcctagcggggaatgccatgaatcgacctccatcctgagctctccaggcctgggacaatggaaagtggatagggggctgtcttcccagaaggaagctgggtcagaggttggtgccccatgggctccacccagagccccatggcagtctccatccattggtgccaggacctgctgggaacaggctgagagggtggttggcccagtgcacagtgcctggcactaacaacctgatcgtgggccaggtgtctgcctcgaaactgcctgaaggcaggcagggtaggacaatgtctggaggctcacggttttatagactaggggtccccaacccctgggctacagaccggtaccagaaccgggccacacagcaggaggtgagcagcaggcgagcaagggaagcttcatctgtatttacagccacccccccattgatcccacagcagcctgagctccgcctcctgtcagatcagtggcggctggagattgtcataggagctggaaccctatggtgaactgcgcatgtgaggaggttgcgcgcttcttttgaaaacctaatgcctgatctgtcgttgttgcccatcacctccagataggactgtctagttgcaggaaaacaagctcagggctcccacggatcctacattactgtgagttgtatatttcactatatgttacaatgtaataataatagaaataaaatgtacataaatgtaaagcact

SEQ ID NO: 418250 - DNA, 664 bp, Homo sapiens
agtctcattggcagaggcgggaccgacggtgtgtgcggaacatggcggagcgcggcaggaagcggccgtgcggcccgggtgaacacggccaaaggattgagtggcgaaaatggaagcaacagaagaaagaggagaaaaaaaaatggaaggatctcaagctgatgaaaaaactggagcggcagcgggcacaggaggaacaggcaaagcgcctggaagaggaggaggcagcggcagagaaggaggaccgcgggcggccctacacactgagcgtagccctgccgggctccatcctggacaatgctcagtcgccggagcttcgcacctacttggccggtcagattgccagagcctgtgccatcttctgtgtggatgagatcgtggtgtttgatgaggagggccaggatgccaagactgtggagggggaattcacaggagttgggaagaaggggcaggcgtgcgtacagctggcccggatcctgcagtacctggagtgtccacagtacctgaggaaggcgttcttccccaagcaccaggatctacagtttgcagtcctccttgaggctggaactctctccagggtggttaactctttccctctgttttccttatgcccaacactgggtcaggcagagtgggcgacaataaacgctgctaggagaatcga

SEQ ID NO: 418251 - DNA, 700 bp, Homo sapiens
ccgctccagggtccccactgcaccctgtgtgccctagcacttcccagactcttcccggctctgcctccacagggctcctgaaccccctggacagcccccaccacatgcgtcaggatgaggaatccgagttccgagagggcatcgtggtggatcggcccacccggccaggccacggctcctttgtcaactgtggcatgaaaaaggaggtgaagattgacaagaacctggagcccgggcttcgggtgactgtgcgactgaaccagcagcagcacccagactgcaagacctaccatggcaaagtggtatcatcgcaggaccctcgcaccaaagctggtctctactggggctacaccgtccgactggcttcctgcctcagtgctgtgtttgctgaggcccccttccaagatgggtatgacctgaccatcgggacgtcagagcgcggctcagatgtggcctctgcccagcttcccaacttcaggcatgctcttgtggtgttcgggggcctccagggtctggaagctggagcggatgctgaccccaacctggaggtggctgaacccagtgtcctctttgacctgtacgtcaatacctgtcctggccagggtagccgtaccatccgcacggagggaagccttcctaatctccctgggcggcctgcacccttggcctaacccaagccgggtgccccggaacacctgaa

SEQ ID NO: 418252 - DNA, 4202 bp, Homo sapiens
agtctcattggcagaggcgggaccgacggtgtgtgcggaacatggcggagcgcggcaggaagcggccgtgcggcccgggtgaacacggccaaaggattgagtggcgaaaatggaagcaacagaagaaagaggagaaaaaaaaatggaaggatctcaagctgatgaaaaaactggagcggcagcgggcacaggaggaacaggcaaagcgcctggaagaggaggaggcagcggcagagaaggaggaccgcgggcggccctacacactgagcgtagccctgccgggctccatcctggacaatgctcagtcgccggagcttcgcacctacttggccggtcagattgccagagcctgtgccatcttctgtgtggatgagatcgtggtgtttgatgaggagggccaggatgccaagactgtggagggggaattcacaggagttgggaagaaggggcaggcgtgcgtacagctggcccggatcctgcagtacctggagtgtccacagtacctgaggaaggcgttcttccccaagcaccaggatctacagtttgcagggctcctgaaccccctggacagcccccaccacatgcgtcaggatgaggaatccgagttccgagagggcatcgtggtggatcggcccacccggccaggccacggctcctttgtcaactgtggcatgaaaaaggaggtgaagattgacaagaacctggagcccgggcttcgggtgactgtgcgactgaaccagcagcagcacccagactgcaagacctaccatggcaaagtggtatcatcgcaggaccctcgcaccaaagctggtctctactggggctacaccgtccgactggcttcctgcctcagtgctgtgtttgctgaggcccccttccaagatgggtatgacctgaccatcgggacgtcagagcgcggctcagatgtggcctctgcccagcttcccaacttcaggcatgctcttgtggtgttcgggggcctccagggtctggaagctggagcggatgctgaccccaacctggaggtggctgaacccagtgtcctctttgacctgtacgtcaatacctgtcctggccagggtagccgtaccatccgcacggaggaagccatcctcatctccctggccgccctgcagcctggcctcatccaggcgggtgcccggcacacctgaaagttctaaggggccgaggacatcagtgaagcagcagtgaaaccaggggctctgcaggtcacttgggacggacgccaccagacttgtctccaaaaatcaccacctttaatactccccggcctgcacacacccacagtctcactgggctccaccctcacttactgcccgccgtgatggccttgaggctgcctgcccgcgccaggatgtttggcacaaagagcagccccgaagcccgctcaatgctctcgatgggcaccaggaagcgctccagtgggatggcctcatccacaggtgcgttgggcatcacgtaggtgcggagctcaatttgcccacctgctgcctccaggatcagcaccttgaagaagtgtgtgggcactgccacgtggttcttgccgatgacctggtactttacgtaggatttcccatcagcctctgtcctgtgggcagacccaggcacacgtgggcagggggcctggatgaacccaaagccacctcttccaggcagccttccctgatctgtcctctaacttctgtcaacctgcaggaccacgccctcactgtgagacttctgtagcctgcctggctcctccttgaggctggaactctctccagggtggttaactctttccctctgttttccttatgcccaacactgggtcaggcagagtgggcgacaataaacgctgctaggagaatcgagccttctgaatattcacattcgtctgaggggagacttaacgactgtccatctctccccacagaggtgagcaacaagtgggcaaggaccatgacaggtgatatcccagcaccagcacaggtgccaggacaccggacgggggctccccctcagcagagtctcctcccttccaccaggccctaggaggcacctgctaatgaaatttgatcagtgccccaaccaccgccttggccagcctatgccgagcccttaccatggaccaggccctggggaagcatgtgacatcaaccaagaggtcacaggttttgcagagggggacacaggtcatttgcccacagcaccaaggaactaggtgatgaggcctggactccatcccgagcctgtggattccagagtgagctgctcagcctggacctgttgcctctcagccccagccctctgcaggccagaaaaaccacggagcacacccagaggtgctcagttgcttccacctgagaggcagggctgcacaggagcaagagtggaggccctgggtcaggcagatctagattcaaactcccgagaagggtggagggaagtgctccaagcagagcagagactgaaggcgggagagcctggtgcaccgcggacctgcagggggaaggcgtgagagctcggtgcactggggacctgcatggggaaggcgggagagctcggtgcactggggacctgcatggggaaggcgtgagagctcggtgcactggggacctgcatggggaaggcgggagagctcggtgcacctcggacctgcagagggaaggtgggagagcttggtgcaccgcagacctgcagggggaaggcgggagagcttggtgcactgcagacctgcggggggaaggtgggagagcttggtgcactgcagacctgcggggggttccatattggcagaacaagattgggtgggcatgccaagaggtgacagcagggagaagcgggggcagattcagggcctgctgctgcccatgggcagaggagagatggtcaggggtacccgacaggtctttggctgtggaggtggaatgaggggactcgaggcagggaagctgacaggcttgccaagaaaccagatgagtagggaactggtattgacccagagcctggggcaagcctggccctgtgagtggcagtaggggcctcaggtgagtgggaggttctgccgcccccctggtttccaccttacctgggcaggaagagtggccctgtgcagacatagacgttttggtagctgcgggtcaagctgcggctatatttctccaggttgttccaggcattctggttgaggtggggcacctggtaggagagatagggcttagcaggactgtggctgggacccttcctcctctatcagagggccgccccaggtcctgaggggatggacaggctcagagatatccagtgagacaagcggggggaaactgaggctcaaggaatgaaagtcactccctgaaacccagggctgatagagtgctagccaccaccctctgtccctcccacagcccaggtgtcaaagtcttttctcagctcccaagagtcgaatgaaggaagagcctgtctccacctttcagagaggactgaggcctgtccccagccccacccagggtctcctgggaagaccagcccttccaactaccaacccgttccttttcccagtctgagccacaggaagagcctagcggggaatgccatgaatcgacctccatcctgagctctccaggcctgggacaatggaaagtggatagggggctgtcttcccagaaggaagctgggtcagaggttggtgccccatgggctccacccagagccccatggcagtctccatccattggtgccaggacctgctgggaacaggctgagagggtggttggcccagtgcacagtgcctggcactaacaacctgatcgtgggccaggtgtctgcctcgaaactgcctgaaggcaggcagggtaggacaatgtctggaggctcacggttttatagactaggggtccccaacccctgggctacagaccggtaccagaaccggctccgcctcctgtcagatcagtggcggctggagattgtcataggagctggaaccctatggtgaactgcgcatgtgaggaggttgcgcgcttcttttgaaaacctaatgcctgatctgtcgttgttgcccatcacctccagataggactgtctagttgcaggaaaacaagctcagggctcccacggatcctacattactgtgagttgtatatttcactatatgttacaatgtaataataatagaaataaaatgtacataaatgtaaagcact

SEQ ID NO: 418253 - DNA, 1177 bp, Homo sapiens
agtctcattggcagaggcgggaccgacggtgtgtgcggaacatggcggagcgcggcaggaagcggccgtgcggcccgggtgaacacggccaaaggattgagtggcgaaaatggaagcaacagaagaaagaggagaaaaaaaaatggaaggatctcaagctgatgaaaaaactggagcggcagcgggcacaggaggaacaggcaaagcgcctggaagaggaggaggcagcggcagagaaggaggaccgcgggcggccctacacactgagcgtagccctgccgggctccatcctggacaatgctcagtcgccggagcttcgcacctacttggccggtcagattgccagagcctgtgccatcttctgtgtggatgagatcgtggtgtttgatgaggagggccaggatgccaagactgtggagggggaattcacaggagttgggaagaaggggcaggcgtgcgtacagctggcccggatcctgcagtacctggagtgtccacagtacctgaggaaggcgttcttccccaagcaccaggatctacagtttgcagggctcctgaaccccctggacagcccccaccacatgcgtcaggatgaggaatccgagttccgagagggcatcgtggtggatcggcccacccggccaggccacggctcctttgtcaactgtggcatgaaaaaggaggtgaagattgacaagaacctggagcccgggcttcgggtgactgtgcgactgaaccagcagcagcacccagactgcaagacctaccatggcaaagtggtatcatcgcaggaccctcgcaccaaagctggtctctactggggctacaccgtccgactggcttcctgcctcagtgctgtgtttgctgaggcccccttccaagatgggtatgacctgaccatcgggacgtcagagcgcggctcagatgtggcctctgcccagcttcccaacttcaggcatgctcttgtggtgttcgggggcctccagggtctggaagctggagcggatgctgaccccaacctggaggtggctgaacccagtgtcctctttgacctgtacgtcaatacctgtcctggccagggtagccgtaccatccgcacggagggaagccttcctaatctccctgggcggcctgcacccttggcctaacccaagccgggtgccccggaacacctgaa

SEQ ID NO: 418254 - DNA, 3815 bp, Homo sapiens
ccgctccagggtccccactgcaccctgtgtgccctagcacttcccagactcttcccggctctgcctccacagggctcctgaaccccctggacagcccccaccacatgcgtcaggatgaggaatccgagttccgagagggcatcgtggtggatcggcccacccggccaggccacggctcctttgtcaactgtggcatgaaaaaggaggtgaagattgacaagaacctggagcccgggcttcgggtgactgtgcgactgaaccagcagcagcacccagactgcaagacctaccatggcaaagtggtatcatcgcaggaccctcgcaccaaagctggtctctactggggctacaccgtccgactggcttcctgcctcagtgctgtgtttgctgaggcccccttccaagatgggtatgacctgaccatcgggacgtcagagcgcggctcagatgtggcctctgcccagcttcccaacttcaggcatgctcttgtggtgttcgggggcctccagggtctggaagctggagcggatgctgaccccaacctggaggtggctgaacccagtgtcctctttgacctgtacgtcaatacctgtcctggccagggtagccgtaccatccgcacggaggaagccatcctcatctccctggccgccctgcagcctggcctcatccaggcgggtgcccggcacacctgaaagttctaaggggccgaggacatcagtgaagcagcagtgaaaccaggggctctgcaggtcacttgggacggacgccaccagacttgtctccaaaaatcaccacctttaatactccccggcctgcacacacccacagtctcactgggctccaccctcacttactgcccgccgtgatggccttgaggctgcctgcccgcgccaggatgtttggcacaaagagcagccccgaagcccgctcaatgctctcgatgggcaccaggaagcgctccagtgggatggcctcatccacaggtgcgttgggcatcacgtaggtgcggagctcaatttgcccacctgctgcctccaggatcagcaccttgaagaagtgtgtgggcactgccacgtggttcttgccgatgacctggtactttacgtaggatttcccatcagcctctgtcctgtgggcagacccaggcacacgtgggcagggggcctggatgaacccaaagccacctcttccaggcagccttccctgatctgtcctctaacttctgtcaacctgcaggaccacgccctcactgtgagacttctgtagcctgcctggctcctccttgaggctggaactctctccagggtggttaactctttccctctgttttccttatgcccaacactgggtcaggcagagtgggcgacaataaacgctgctaggagaatcgagccttctgaatattcacattcgtctgaggggagacttaacgactgtccatctctccccacagaggtgagcaacaagtgggcaaggaccatgacaggtgatatcccagcaccagcacaggtgccaggacaccggacgggggctccccctcagcagagtctcctcccttccaccaggccctaggaggcacctgctaatgaaatttgatcagtgccccaaccaccgccttggccagcctatgccgagcccttaccatggaccaggccctggggaagcatgtgacatcaaccaagaggtcacaggttttgcagagggggacacaggtcatttgcccacagcaccaaggaactaggtgatgaggcctggactccatcccgagcctgtggattccagagtgagctgctcagcctggacctgttgcctctcagccccagccctctgcaggccagaaaaaccacggagcacacccagaggtgctcagttgcttccacctgagaggcagggctgcacaggagcaagagtggaggccctgggtcaggcagatctagattcaaactcccgagaagggtggagggaagtgctccaagcagagcagagactgaaggcgggagagcctggtgcaccgcggacctgcagggggaaggcgtgagagctcggtgcactggggacctgcatggggaaggcgggagagctcggtgcactggggacctgcatggggaaggcgtgagagctcggtgcactggggacctgcatggggaaggcgggagagctcggtgcacctcggacctgcagagggaaggtgggagagcttggtgcaccgcagacctgcagggggaaggcgggagagcttggtgcactgcagacctgcggggggaaggtgggagagcttggtgcactgcagacctgcggggggttccatattggcagaacaagattgggtgggcatgccaagaggtgacagcagggagaagcgggggcagattcagggcctgctgctgcccatgggcagaggagagatggtcaggggtacccgacaggtctttggctgtggaggtggaatgaggggactcgaggcagggaagctgacaggcttgccaagaaaccagatgagtagggaactggtattgacccagagcctggggcaagcctggccctgtgagtggcagtaggggcctcaggtgagtgggaggttctgccgcccccctggtttccaccttacctgggcaggaagagtggccctgtgcagacatagacgttttggtagctgcgggtcaagctgcggctatatttctccaggttgttccaggcattctggttgaggtggggcacctggtaggagagatagggcttagcaggactgtggctgggacccttcctcctctatcagagggccgccccaggtcctgaggggatggacaggctcagagatatccagtgagacaagcggggggaaactgaggctcaaggaatgaaagtcactccctgaaacccagggctgatagagtgctagccaccaccctctgtccctcccacagcccaggtgtcaaagtcttttctcagctcccaagagtcgaatgaaggaagagcctgtctccacctttcagagaggactgaggcctgtccccagccccacccagggtctcctgggaagaccagcccttccaactaccaacccgttccttttcccagtctgagccacaggaagagcctagcggggaatgccatgaatcgacctccatcctgagctctccaggcctgggacaatggaaagtggatagggggctgtcttcccagaaggaagctgggtcagaggttggtgccccatgggctccacccagagccccatggcagtctccatccattggtgccaggacctgctgggaacaggctgagagggtggttggcccagtgcacagtgcctggcactaacaacctgatcgtgggccaggtgtctgcctcgaaactgcctgaaggcaggcagggtaggacaatgtctggaggctcacggttttatagactaggggtccccaacccctgggctacagaccggtaccagaaccgggccacacagcaggaggtgagcagcaggcgagcaagggaagcttcatctgtatttacagccacccccccattgatcccacagcagcctgagctccgcctcctgtcagatcagtggcggctggagattgtcataggagctggaaccctatggtgaactgcgcatgtgaggaggttgcgcgcttcttttgaaaacctaatgcctgatctgtcgttgttgcccatcacctccagataggactgtctagttgcaggaaaacaagctcagggctcccacggatcctacattactgtgagttgtatatttcactatatgttacaatgtaataataatagaaataaaatgtacataaatgtaaagcact

SEQ ID NO: 418255 - DNA, 3132 bp, Homo sapiens
ccgcgcccctcccctcacgggctctggccttaaccagagctcgcggactggcggggacaggtcccacctcctggctcccaggacgggtctgcaccaacctcagtttcggggctgcggctcacagaagtctaacctgcccgggacgcccgcaccaactcctgcgcgcggtccttccaaccctcctgctaccatgaagattgcagtgattggacagagcctgtttggccaggaagtttactgccacctgaggaaggagggccacgaagtggtgggtgtgttcactgttccagacaaggatggaaaggccgaccccctgggtctggaagctgagaaggatggagtgccggtattcaagtactcccggtggcgtgcaaaaggacaggctttgcctgatgtggtggcaaaataccaggctttgggggccgagctcaacgtcctgcccttctgcagccaattcatccccatggagataatcagtgccccccggcatggctccatcatctatcacccgtcactgctccctaggcaccgaggggcctcggccatcaactggaccctcattcacggagataagaaaggggggttttccatcttctgggcggatgatggtctggacaccggagacctgctgctgcagaaggagtgtgaggtgctcccggacgacaccgtgagcacgctgtacaaccgcttcctcttccctgaaggcatcaaagggatggtgcaggccgtgaggctgatcgctgagggcaaagcccccagactccctcagcctgaggaaggagccacctatgaggggattcagaagaaggagacagccaagatcaactgggaccagccggcagaggccattcacaactggatccgcgggaacgacaaggtgccgggagcctggacagaggcctgtgaacagaaactgacatttttcaactcaacgctgaacacttcaggcctggtgcccgagggagacgctttgcccatcccaggagcccatcggccaggggtggtcaccaaagcaggactcatcctctttgggaatgatgacaaaatgctgctggtgaagaatattcagctggaggatggcaaaatgatcctggcctcgaacttctttaagggggcagccagcagtgtccttgagctgacagaggcagagctggttactgcggaggctgtgcggagtgtttggcagcggatcctccccaaagtcctggaggttgaagactccactgatttcttcaagtcaggggccgcgtctgtggacgttgtgaggctggtggaggaagtgaaggagctgtgtgatggcctggagttagaaaatgaagatgtgtacatggcatccacctttggggacttcatccagctgttagtgaggaagctgcgaggggacgatgaggagggcgagtgcagcattgactacgtggaaatggcagtgaacaagcgcactgtccgcatgccccaccagctcttcattgggggggagttcgtggatgccgagggcgccaagacctctgagaccatcaatcccaccgatggaagtgtcatctgccaggtatccctggcccaagtcaccgacgtcgacaaggcagtggccgcagccaaggatgcctttgagaatggacggtgggggaagatcagtgcgcgggaccggggccggctgatgtacaggttggcagatctcatggagcagcaccaggaggagctggccaccattgaggccctggatgcgggtgccgtctacacgctggccctgaagacccacgtgggcatgtccatccagaccttccgatactttgctggctggtgtgacaagatccagggctccaccatccccatcaaccaggccagacccaaccgcaacctgaccttgaccaggaaggagcctgttggggtttgtggcatcatcatcccctggaactatcccctgatgatgctgtcctggaagacagctgcctgcctggctgccgggaacacagtggtgatcaagcctgctcaggtgaccccactcacagccttgaagtttgcagagctgacattaaaggccggcattcccaaaggtgtggttaacgtcctcccaggatctggctccctggtcggccagagactctcagaccatcctgatgtgaggaaaatcgggttcacaggctccacagaggtgggcaagcacatcatgaaaagctgtgccataagtaacgtgaagaaggtgtccctggaactgggcgggaagtcacccctcatcatctttgctgactgtgacctcaacaaggctgtgcagatggggatgagttctgttttcttcaacaaaggagagaattgcattgcagcaggccgactctttgtggaggactccattcatgatgagttcgtgcggagagtggtagaagaggtgcggaagatgaaggtgggcaacccgctggacagggacaccgaccacgggccgcagaatcaccatgcccaccttgtgaagctgatggagtactgccagcatggcgtgaaggaaggggccacactggtctgcggcgggaatcaggtccctcggccagggttcttctttgagccaactgttttcacagacgtggaagaccacatgttcatagccaaggaggagtccttcgggcctgtcatgatcatctctcggtttgctgatggggacttggatgccgtgctgtctcgggccaatgccacggaatttggcctggcttctggtgtcttcaccagggacatcaacaaggccctgtatgtcagtgacaagctccaggcaggcactgtgtttgtcaacacgtacaacaagaccgacgtggccgctcccttcggaggattcaaacagtctggatttggcaaagatctaggagaggcggctctgaacgagtacctgcgggtcaagacagtgaccttcgaatactgaagaaaggtctttgtgagaagaaagtccctgcccctccctcgtggctggggccccctccctcttgagcctgggtgcacagcacctcccacctggggggctagtggaagccctcctgcctgcacaccatgtctgcatcttggacgccctctgtccagtcagaagcagcccttggctgggtgaggtgtgcccctcccagggagaataaagcttctgaagagagaaaaaccacatct

SEQ ID NO: 418256 - DNA, 396 bp, Homo sapiens
gagggggacaccgaccacgggccgcaagcacatcatgaaaagctgtgccataagtaacgtgaagaaggtgtccctggaactgggcgggaagtcacccctcatcatctttgctgactgtgacctcaacaaggctgtgcagatgacagtgaccttcgaatactgaagaaaggtctttgtgagaagaaagtccctgcccctccctcgtggctggggccccctccctcttgagcctgggtgcacagcacctcccacctggggggctagtggaagccctcctgcctgcacaccatgtctgcatcttggacgccctctgtccagtcagaagcagcccttggctgggtgaggtgtgcccctcccagggagaataaagcttctgaagagagaaaaaccacatct

SEQ ID NO: 418257 - DNA, 549 bp, Homo sapiens
gagcattttgagggcctcagacccccagtgaacctgtgcagtcctggaggtgggctcctgcctccccagcaccagggggaccactctgattcccccctccctcccgcccacaggctccctggtcggccagagactctcagaccatcctgatgtgaggaaaatcgggttcacaggctccacagaggtgggcaagcacatcatgaaaagaggtgcgtggctgggggtggagcagaggaggggctgctgtgggctgcgcctgggacatggcagtgctgtcccaggagctgtgtcctgcttcccaggctccagggcacagccacttccgtggccctgctgggctctatgcaaacgctgaagaggcatctgcctttctggcaaagccccggggaggcctgggcggagacctgtggagccctgtcagaccagcaaggggctggatcgagaggtgctgagagtataaaacacgcatggatttcaagaactgagcacccacaaaactaaaaaacgaaatcatgctatgaacctcaaatatacacagtaaaatttatt

SEQ ID NO: 418258 - DNA, 3083 bp, Homo sapiens
ccgcgcccctcccctcacgggctctggccttaaccagagctcgcggactggcggggacaggtcccacctcctggctcccaggacgggtctgcaccaacctcagtttcggggctgcggctcacagaagtctaacctgcccgggacgcccgcaccaactcctgcgcgcggtccttccaaccctcctgctaccatgaagattgcagtgattggacagagcctgtttggccaggaagtttactgccacctgaggaaggagggccacgaagtggtgggtgtgttcactgttccagacaaggatggaaaggccgaccccctgggtctggaagctgagaaggatggagtgccggtattcaagtactcccggtggcgtgcaaaaggacaggctttgcctgatgtggtggcaaaataccaggctttgggggccgagctcaacgtcctgcccttctgcagccaattcatccccatggagataatcagtgccccccggcatggctccatcatctatcacccgtcactgctccctaggcaccgaggggcctcggccatcaactggaccctcattcacggagataagaaaggggggttttccatcttctgggcggatgatggtctggacaccggagacctgctgctgcagaaggagtgtgaggtgctcccggacgacaccgtgagcacgctgtacaaccgcttcctcttccctgaaggcatcaaagggatggtgcaggccgtgaggctgatcgctgagggcaaagcccccagactccctcagcctgaggaaggagccacctatgaggggattcagaagaaggagacagccaagatcaactgggaccagccggcagaggccattcacaactggatccgcgggaacgacaaggtgccgggagcctggacagaggcctgtgaacagaaactgacatttttcaactcaacgctgaacacttcaggcctggtgcccgagggagacgctttgcccatcccaggagcccatcggccaggggtggtcaccaaagcaggactcatcctctttgggaatgatgacaaaatgctgctggtgaagaatattcagctggaggatggcaaaatgatcctggcctcgaacttctttaagggggcagccagcagtgtccttgagctgacagaggcagagctggttactgcggaggctgtgcggagtgtttggcagcggatcctccccaaagtcctggaggttgaagactccactgatttcttcaagtcaggggccgcgtctgtggacgttgtgaggctggtggaggaagtgaaggagctgtgtgatggcctggagttagaaaatgaagatgtgtacatggcatccacctttggggacttcatccagctgttagtgaggaagctgcgaggggacgatgaggagggcgagtgcagcattgactacgtggaaatggcagtgaacaagcgcactgtccgcatgccccaccagctcttcattgggggggagttcgtggatgccgagggcgccaagacctctgagaccatcaatcccaccgatggaagtgtcatctgccaggtatccctggcccaagtcaccgacgtcgacaaggcagtggccgcagccaaggatgcctttgagaatggacggtgggggaagatcagtgcgcgggaccggggccggctgatgtacaggttggcagatctcatggagcagcaccaggaggagctggccaccattgaggccctggatgcgggtgccgtctacacgctggccctgaagacccacgtgggcatgtccatccagaccttccgatactttgctggctggtgtgacaagatccagggctccaccatccccatcaaccaggccagacccaaccgcaacctgaccttgaccaggaaggagcctgttggggtttgtggcatcatcatcccctggaactatcccctgatgatgctgtcctggaagacagctgcctgcctggctgccgggaacacagtggtgatcaagcctgctcaggtgaccccactcacagccttgaagtttgcagagctgacattaaaggccggcattcccaaaggtgtggttaacgtcctcccaggatctggctccctggtcggccagagactctcagaccatcctgatgtgaggaaaatcgggttcacaggctccacagaggtgggcaagcacatcatgaaaagtcacccctcatcatctttgctgactgtgacctcaacaaggctgtgcagatggggatgagttctgttttcttcaacaaaggagagaattgcattgcagcaggccgactctttgtggaggactccattcatgatgagttcgtgcggagagtggtagaagaggtgcggaagatgaaggtgggcaacccgctggacagggacaccgaccacgggccgcagaatcaccatgcccaccttgtgaagctgatggagtactgccagcatggcgtgaaggaaggggccacactggtctgcggcgggaatcaggtccctcggccagggttcttctttgagccaactgttttcacagacgtggaagaccacatgttcatagccaaggaggagtccttcgggcctgtcatgatcatctctcggtttgctgatggggacttggatgccgtgctgtctcgggccaatgccacggaatttggcctggcttctggtgtcttcaccagggacatcaacaaggccctgtatgtcagtgacaagctccaggcaggcactgtgtttgtcaacacgtacaacaagaccgacgtggccgctcccttcggaggattcaaacagtctggatttggcaaagatctaggagaggcggctctgaacgagtacctgcgggtcaagacagtgaccttcgaatactgaagaaaggtctttgtgagaagaaagtccctgcccctccctcgtggctggggccccctccctcttgagcctgggtgcacagcacctcccacctggggggctagtggaagccctcctgcctgcacaccatgtctgcatcttggacgccctctgtccagtcagaagcagcccttggctgggtgaggtgtgcccctcccagggagaataaagcttctgaagagagaaaaaccacatct

SEQ ID NO: 418259 - DNA, 2602 bp, Homo sapiens
gccgtgacctgtggtcacatggcctgagcggcagggcggctcagtcacctgggcagctggtactgctgagaggcagggtggcaggctatgggccggagcccacagctgcaggaggggcccggggatcatatgtgagggctgcttgcccctgcccgaggacaggctggcagggacggccacaggcagaggtgcaggccgtgaggctgatcgctgagggcaaagcccccagactccctcagcctgaggaaggagccacctatgaggggattcagaagaaggagacagccaagatcaactgggaccagccggcagaggccattcacaactggatccgcgggaacgacaaggtgccgggagcctggacagaggcctgtgaacagaaactgacatttttcaactcaacgctgaacacttcaggcctggtgcccgagggagacgctttgcccatcccaggagcccatcggccaggggtggtcaccaaagcaggactcatcctctttgggaatgatgacaaaatgctgctggtgaagaatattcagctggaggatggcaaaatgatcctggcctcgaacttctttaagggggcagccagcagtgtccttgagctgacagaggcagagctggttactgcggaggctgtgcggagtgtttggcagcggatcctccccaaagtcctggaggttgaagactccactgatttcttcaagtcaggggccgcgtctgtggacgttgtgaggctggtggaggaagtgaaggagctgtgtgatggcctggagttagaaaatgaagatgtgtacatggcatccacctttggggacttcatccagctgttagtgaggaagctgcgaggggacgatgaggagggcgagtgcagcattgactacgtggaaatggcagtgaacaagcgcactgtccgcatgccccaccagctcttcattgggggggagttcgtggatgccgagggcgccaagacctctgagaccatcaatcccaccgatggaagtgtcatctgccaggtatccctggcccaagtcaccgacgtcgacaaggcagtggccgcagccaaggatgcctttgagaatggacggtgggggaagatcagtgcgcgggaccggggccggctgatgtacaggttggcagatctcatggagcagcaccaggaggagctggccaccattgaggccctggatgcgggtgccgtctacacgctggccctgaagacccacgtgggcatgtccatccagaccttccgatactttgctggctggtgtgacaagatccagggctccaccatccccatcaaccaggccagacccaaccgcaacctgaccttgaccaggaaggagcctgttggggtttgtggcatcatcatcccctggaactatcccctgatgatgctgtcctggaagacagctgcctgcctggctgccgggaacacagtggtgatcaagcctgctcaggtgaccccactcacagccttgaagtttgcagagctgacattaaaggccggcattcccaaaggtgtggttaacgtcctcccaggatctggctccctggtcggccagagactctcagaccatcctgatgtgaggaaaatcgggttcacaggctccacagaggtgggcaagcacatcatgaaaagctgtgccataagtaacgtgaagaaggtgtccctggaactgggcgggaagtcacccctcatcatctttgctgactgtgacctcaacaaggctgtgcagatggggatgagttctgttttcttcaacaaaggagagaattgcattgcagcaggccgactctttgtggaggactccattcatgatgagttcgtgcggagagtggtagaagaggtgcggaagatgaaggtgggcaacccgctggacagggacaccgaccacgggccgcagaatcaccatgcccaccttgtgaagctgatggagtactgccagcatggcgtgaaggaaggggccacactggtctgcggcgggaatcaggtccctcggccagggttcttctttgagccaactgttttcacagacgtggaagaccacatgttcatagccaaggaggagtccttcgggcctgtcatgatcatctctcggtttgctgatggggacttggatgccgtgctgtctcgggccaatgccacggaatttggcctggcttctggtgtcttcaccagggacatcaacaaggccctgtatgtcagtgacaagctccaggcaggcactgtgtttgtcaacacgtacaacaagaccgacgtggccgctcccttcggaggattcaaacagtctggatttggcaaagatctaggagaggcggctctgaacgagtacctgcgggtcaagacagtgaccttcgaatactgaagaaaggtctttgtgagaagaaagtccctgcccctccctcgtggctggggccccctccctcttgagcctgggtgcacagcacctcccacctggggggctagtggaagccctcctgcctgcacaccatgtctgcatcttggacgccctctgtccagtcagaagcagcccttggctgggtgaggtgtgcccctcccagggagaataaagcttctgaagagagaaaaaccacatct

SEQ ID NO: 418260 - DNA, 2897 bp, Homo sapiens
ccgcgcccctcccctcacgggctctggccttaaccagagctcgcggactggcggggacaggtcccacctcctggctcccaggacgggtctgcaccaacctcagtttcggggctgcggctcacagaagtctaacctgcccgggacgcccgcaccaactcctgcgcgcggtccttccaaccctcctgctaccatgaagattgcagtgattggacagagcctgtttggccaggaagtttactgccacctgaggaaggagggccacgaagtggtgggtgtgttcactgttccagacaaggatggaaaggccgaccccctgggaccctcattcacggagataagaaaggggggttttccatcttctgggcggatgatggtctggacaccggagacctgctgctgcagaaggagtgtgaggtgctcccggacgacaccgtgagcacgctgtacaaccgcttcctcttccctgaaggcatcaaagggatggtgcaggccgtgaggctgatcgctgagggcaaagcccccagactccctcagcctgaggaaggagccacctatgaggggattcagaagaaggagacagccaagatcaactgggaccagccggcagaggccattcacaactggatccgcgggaacgacaaggtgccgggagcctggacagaggcctgtgaacagaaactgacatttttcaactcaacgctgaacacttcaggcctggtgcccgagggagacgctttgcccatcccaggagcccatcggccaggggtggtcaccaaagcaggactcatcctctttgggaatgatgacaaaatgctgctggtgaagaatattcagctggaggatggcaaaatgatcctggcctcgaacttctttaagggggcagccagcagtgtccttgagctgacagaggcagagctggttactgcggaggctgtgcggagtgtttggcagcggatcctccccaaagtcctggaggttgaagactccactgatttcttcaagtcaggggccgcgtctgtggacgttgtgaggctggtggaggaagtgaaggagctgtgtgatggcctggagttagaaaatgaagatgtgtacatggcatccacctttggggacttcatccagctgttagtgaggaagctgcgaggggacgatgaggagggcgagtgcagcattgactacgtggaaatggcagtgaacaagcgcactgtccgcatgccccaccagctcttcattgggggggagttcgtggatgccgagggcgccaagacctctgagaccatcaatcccaccgatggaagtgtcatctgccaggtatccctggcccaagtcaccgacgtcgacaaggcagtggccgcagccaaggatgcctttgagaatggacggtgggggaagatcagtgcgcgggaccggggccggctgatgtacaggttggcagatctcatggagcagcaccaggaggagctggccaccattgaggccctggatgcgggtgccgtctacacgctggccctgaagacccacgtgggcatgtccatccagaccttccgatactttgctggctggtgtgacaagatccagggctccaccatccccatcaaccaggccagacccaaccgcaacctgaccttgaccaggaaggagcctgttggggtttgtggcatcatcatcccctggaactatcccctgatgatgctgtcctggaagacagctgcctgcctggctgccgggaacacagtggtgatcaagcctgctcaggtgaccccactcacagccttgaagtttgcagagctgacattaaaggccggcattcccaaaggtgtggttaacgtcctcccaggatctggctccctggtcggccagagactctcagaccatcctgatgtgaggaaaatcgggttcacaggctccacagaggtgggcaagcacatcatgaaaagctgtgccataagtaacgtgaagaaggtgtccctggaactgggcgggaagtcacccctcatcatctttgctgactgtgacctcaacaaggctgtgcagatggggatgagttctgttttcttcaacaaaggagagaattgcattgcagcaggccgactctttgtggaggactccattcatgatgagttcgtgcggagagtggtagaagaggtgcggaagatgaaggtgggcaacccgctggacagggacaccgaccacgggccgcagaatcaccatgcccaccttgtgaagctgatggagtactgccagcatggcgtgaaggaaggggccacactggtctgcggcgggaatcaggtccctcggccagggttcttctttgagccaactgttttcacagacgtggaagaccacatgttcatagccaaggaggagtccttcgggcctgtcatgatcatctctcggtttgctgatggggacttggatgccgtgctgtctcgggccaatgccacggaatttggcctggcttctggtgtcttcaccagggacatcaacaaggccctgtatgtcagtgacaagctccaggcaggcactgtgtttgtcaacacgtacaacaagaccgacgtggccgctcccttcggaggattcaaacagtctggatttggcaaagatctaggagaggcggctctgaacgagtacctgcgggtcaagacagtgaccttcgaatactgaagaaaggtctttgtgagaagaaagtccctgcccctccctcgtggctggggccccctccctcttgagcctgggtgcacagcacctcccacctggggggctagtggaagccctcctgcctgcacaccatgtctgcatcttggacgccctctgtccagtcagaagcagcccttggctgggtgaggtgtgcccctcccagggagaataaagcttctgaagagagaaaaaccacatct

SEQ ID NO: 418261 - DNA, 2991 bp, Homo sapiens
taattgctgccttattccttctccaggtccttccaaccctcctgctaccatgaagattgcagtgattggacagagcctgtttggccaggaagtttactgccacctgaggaaggagggccacgaagtggtgggtgtgttcactgttccagacaaggatggaaaggccgaccccctgggtctggaagctgagaaggatggagtgccggtattcaagtactcccggtggcgtgcaaaaggacaggctttgcctgatgtggtggcaaaataccaggctttgggggccgagctcaacgtcctgcccttctgcagccaattcatccccatggagataatcagtgccccccggcatggctccatcatctatcacccgtcactgctccctaggcaccgaggggcctcggccatcaactggaccctcattcacggagataagaaaggggggttttccatcttctgggcggatgatggtctggacaccggagacctgctgctgcagaaggagtgtgaggtgctcccggacgacaccgtgagcacgctgtacaaccgcttcctcttccctgaaggcatcaaagggatggtgcaggccgtgaggctgatcgctgagggcaaagcccccagactccctcagcctgaggaaggagccacctatgaggggattcagaagaaggagacagccaagatcaactgggaccagccggcagaggccattcacaactggatccgcgggaacgacaaggtgccgggagcctggacagaggcctgtgaacagaaactgacatttttcaactcaacgctgaacacttcaggcctggtgcccgagggagacgctttgcccatcccaggagcccatcggccaggggtggtcaccaaagcaggactcatcctctttgggaatgatgacaaaatgctgctggtgaagaatattcagctggaggatggcaaaatgatcctggcctcgaacttctttaagggggcagccagcagtgtccttgagctgacagaggcagagctggttactgcggaggctgtgcggagtgtttggcagcggatcctccccaaagtcctggaggttgaagactccactgatttcttcaagtcaggggccgcgtctgtggacgttgtgaggctggtggaggaagtgaaggagctgtgtgatggcctggagttagaaaatgaagatgtgtacatggcatccacctttggggacttcatccagctgttagtgaggaagctgcgaggggacgatgaggagggcgagtgcagcattgactacgtggaaatggcagtgaacaagcgcactgtccgcatgccccaccagctcttcattgggggggagttcgtggatgccgagggcgccaagacctctgagaccatcaatcccaccgatggaagtgtcatctgccaggtatccctggcccaagtcaccgacgtcgacaaggcagtggccgcagccaaggatgcctttgagaatggacggtgggggaagatcagtgcgcgggaccggggccggctgatgtacaggttggcagatctcatggagcagcaccaggaggagctggccaccattgaggccctggatgcgggtgccgtctacacgctggccctgaagacccacgtgggcatgtccatccagaccttccgatactttgctggctggtgtgacaagatccagggctccaccatccccatcaaccaggccagacccaaccgcaacctgaccttgaccaggaaggagcctgttggggtttgtggcatcatcatcccctggaactatcccctgatgatgctgtcctggaagacagctgcctgcctggctgccgggaacacagtggtgatcaagcctgctcaggtgaccccactcacagccttgaagtttgcagagctgacattaaaggccggcattcccaaaggtgtggttaacgtcctcccaggatctggctccctggtcggccagagactctcagaccatcctgatgtgaggaaaatcgggttcacaggctccacagaggtgggcaagcacatcatgaaaagctgtgccataagtaacgtgaagaaggtgtccctggaactgggcgggaagtcacccctcatcatctttgctgactgtgacctcaacaaggctgtgcagatggggatgagttctgttttcttcaacaaaggagagaattgcattgcagcaggccgactctttgtggaggactccattcatgatgagttcgtgcggagagtggtagaagaggtgcggaagatgaaggtgggcaacccgctggacagggacaccgaccacgggccgcagaatcaccatgcccaccttgtgaagctgatggagtactgccagcatggcgtgaaggaaggggccacactggtctgcggcgggaatcaggtccctcggccagggttcttctttgagccaactgttttcacagacgtggaagaccacatgttcatagccaaggaggagtccttcgggcctgtcatgatcatctctcggtttgctgatggggacttggatgccgtgctgtctcgggccaatgccacggaatttggcctggcttctggtgtcttcaccagggacatcaacaaggccctgtatgtcagtgacaagctccaggcaggcactgtgtttgtcaacacgtacaacaagaccgacgtggccgctcccttcggaggattcaaacagtctggatttggcaaagatctaggagaggcggctctgaacgagtacctgcgggtcaagacagtgaccttcgaatactgaagaaaggtctttgtgagaagaaagtccctgcccctccctcgtggctggggccccctccctcttgagcctgggtgcacagcacctcccacctggggggctagtggaagccctcctgcctgcacaccatgtctgcatcttggacgccctctgtccagtcagaagcagcccttggctgggtgaggtgtgcccctcccagggagaataaagcttctgaagagagaaaaaccacatct

SEQ ID NO: 418262 - DNA, 1272 bp, Homo sapiens
cacgcgtcgcggacgcgtccgccaggtttgtggcatcatcatcccctggaactatcccctgatgatgctgtcctggaagacagctgcctgcctggctgccgggaacacagtggtgatcaagcctgctcaggtgaccccactcacagccttgaagtttgcagagctgacattaaaggccggcattcccaaaggtgtggttaacgtcctcccaggatctggctccctggtcggccagagactctcagaccatcctgatgtgaggaaaatcgggttcacaggctccacagaggtgggcaagcacatcatgaaaagctgtgccataagtaacgtgaagaaggtgtccctggaactgggcgggaagtcacccctcatcatctttgctgactgtgacctcaacaaggctgtgcagatggggatgagttctgttttcttcaacaaaggagagaattgcattgcagcaggccgactctttgtggaggactccattcatgatgagttcgtgcggagagtggtagaagaggtgcggaagatgaaggtgggcaacccgctggacagggacaccgaccacgggccgcagaatcaccatgcccaccttgtgaagctgatggagtactgccagcatggcgtgaaggaaggggccacactggtctgcggcgggaatcaggtccctcggccagggttcttctttgagccaactgttttcacagacgtggaagaccacatgttcatagccaaggaggagtccttcgggcctgtcatgatcatctctcggtttgctgatggggacttggatgccgtgctgtctcgggccaatgccacggaatttggcctggcttctggtgtcttcaccagggacatcaacaaggccctgtatgtcagtgacaagctccaggcaggcactgtgtttgtcaacacgtacaacaagaccgacgtggccgctcccttcggaggattcaaacagtctggatttggcaaagatctaggagaggcggctctgaacgagtacctgcgggtcaagacagtgaccttcgaatactgaagaaaggtctttgtgagaagaaagtccctgcccctccctcgtggctggggccccctccctcttgagcctgggtgcacagcacctcccacctggggggctagtggaagccctcctgcctgcacaccatgtctgcatcttggacgccctctgtccagtcagaagcagcccttggctgggtgaggtgtgcccctcccagggagaataaagcttctgaagagagaaaaaccacatct

SEQ ID NO: 418263 - DNA, 3377 bp, Homo sapiens
ccgcgcccctcccctcacgggctctggccttaaccagagctcgcggactggcggggacaggtcccacctcctggctcccaggacgggtctgcaccaacctcagtttcggggctgcggctcacagaagtctaacctgcccgggacgcccgcaccaactcctgcgcgcggtccttccaaccctcctgctaccatgaagattgcagtgattggacagagcctgtttggccaggaagtttactgccacctgaggaaggagggccacgaagtggtgggtgtgttcactgttccagacaaggatggaaaggccgaccccctgggtctggaagctgagaaggatggagtgccggtattcaagtactcccggtggcgtgcaaaaggacaggctttgcctgatgtggtggcaaaataccaggctttgggggccgagctcaacgtcctgcccttctgcagccaattcatccccatggagataatcagtgccccccggcatggctccatcatctatcacccgtcactgctccctaggcaccgaggggcctcggccatcaactggaccctcattcacggagataagaaaggggggttttccatcttctgggcggatgatggtctggacaccggagacctgctgctgcagaaggagtgtgaggtgctcccggacgacaccgtgagcacgctgtacaaccgcttcctcttccctgaaggcatcaaagggatggtgcaggccgtgaggctgatcgctgagggcaaagcccccagactccctcagcctgaggaaggagccacctatgaggggattcagaagaaggagacagccaagatcaactgggaccagccggcagaggccattcacaactggatccgcgggaacgacaaggtgccgggagcctggacagaggcctgtgaacagaaactgacatttttcaactcaacgctgaacacttcaggcctggtgcccgagggagacgctttgcccatcccaggagcccatcggccaggggtggtcaccaaagcaggactcatcctctttgggaatgatgacaaaatggtaagggcacggctgtgggtcacttgcctgctcaaagccacccatgctcctgtccttggactcaggcctcacaggaagaccctaggctcctctggagaaaatggaaaaaaccagacccaggaaggaacactgaccctgatttgtccctgaccacccggctggtcctgagcacagggtgtccgaggcagtttacccacttctctgttctgggaaagctgggctccctacccttcctggctaggcacccatctccaggctgagtgccctgtgtgggtgtcaggcaacctagaatcagagagaagccctcccagggagcctgggttcagggcctctctttggtctatcagaaacacctctgggtgtggggtcattaagcctctgtgcctcagctcccatctctttgaacggcgatgccatggtaacttagcacgtgcagagccttgggagccatgccggccacctgctcttgttattagcagactacaactcacggtaccagcaaacactgatggagcaccttttataccagaacaatgtatatgcgttaaatttaatctgcctaacaacactatgagatatgtataaatattatatccttatagaggaaaaaaacagagatttaaataacttgtccaggatcatccaagctagcccgtggcagagctgggattcagactctgaaattctggctccaaagccgtgatgctggtcttggccatggtagcttcctgttcatatgcactctactactccttctcacatgagcagccgggggtagggagagggcaggcagggatcttcccacacactgacagggtccggacaaaccccatgggcgtggtacccccagccgtgttgctgtgtccggcctaccagagtgaggcgtggcagtatggggcctggcctttgctcgctcttggtgtccagtctgccatgctcccctgtcagaaggtctaggctgctgttgatgtctgcaatgtagtgttttgggtatccaagattgatatatgcagttgcaagagaatatctgtctgtggtcaggttccctagaagcagcatctaaggtaaaaattcttgtgcaagtgatttattgagggaatgttccagaaaatcatgcgaggcagtaagggcagaggaaagcaaagcaaaagtaaaggttcaggagaagtctagcctggggctgctcccagggtgggttttggagtattaactgcaccctccaattatacctgcctgtccccacctctgtcagcctttggtttcagtggcccctggggtggggtggaggacccaccaggcataatccctcggcctctttgtgtacaggagctcttatccatccacagcaagcaaggatgggacagtgcaggccgttatcatccagcccttgctgcagctggaggacagggcaccagccacaggggtctgagcagggcacccacagcatctgtccagagacctgcaaagacaggaatgcaaagaaggcaattaagtgtcttaagaggaagctggggttatcagctctctcacaagagctttgtccactgtccagaggtggtcagggtgggaggggagtgaggagagaccagctgagcacacacaccctgctccccacagatcaacccagaagaccctgggttgaagcatctctcagccacgccctgtggagtctggctgggctttagcttgcagaaagctccagaacatctttgaaaggcaatggggcgagggtcaggccgagaggcaagttccagttctggcagagcatgcatacagagtaccattcttacacagccactcttaacgcacagtgacatgcacccacccatgagcttatccataactctttttgtacatgtgttttttttcctggcccctaacaaaagcatttgttgaaaaactattgataaacaagcaggccccaaacaattcaaacatcttattaaatacagtaaatctgaggcagacactagagtagcccagagtcatgagctacaatgggggcagttcatgtctggcagccagaatccccttgaactgatggctggacgcaggctctacctgggaccagcttgaagtgctatcctgaagctgcagactgcagggccggccagaccctttttcagcctctcctcttcccacctctgtatcccacacaggcatctggtgatgttctccaggtgtttctgtggcagttctgggagctactgggtgattgcaagattagtttttttttctaagttgactttctatgtggtgcctgaatgacgttttctttttttgttcagtaggaatccttttttatagaagtaataaagtcattacactt

SEQ ID NO: 418264 - DNA, 1434 bp, Homo sapiens
ccgcgcccctcccctcacgggctctggccttaaccagagctcgcggactggcggggacaggtcccacctcctggctcccaggacgggtctgcaccaacctcagtttcggggctgcggctcacagaagtctaacctgcccgggacgcccgcaccaactcctgcgcgcggtccttccaaccctcctgctaccatgaagattgcagtgattggacagagcctgtttggccaggaagtttactgccacctgaggaaggagggccacgaagtggtgggtgtgttcactgttccagacaaggatggaaaggccgaccccctgggtctggaagctgagaaggatggagtgccggtattcaagtactcccggtggcgtgcaaaaggacaggctttgcctgatgtggtggcaaaataccaggctttgggggccgagctcaacgtcctgcccttctgcagccaattcatccccatggagataatcagtgccccccggcatggctccatcatctatcacccgtcactgctccctaggcaccgaggggcctcggccatcaactggaccctcattcacggagataagaaaggggggttttccatcttctgggcggatgatggtctggacaccggagacctgctgctgcagaaggagtgtgaggtgctcccggacgacaccgtgagcacgctgtacaaccgcttcctcttccctgaaggcatcaaagggatggtgcaggccgtgaggctgatcgctgagggcaaagcccccagactccctcagcctgaggaaggagccacctatgaggggattcagaagaaggagacagccaagatcaactgggaccagccggcagaggccattcacaactggatccgcgggaacgacaaggtgccgggagcctggacagaggcctgtgaacagaaactgacatttttcaactcaacgctgaacacttcaggcctggtgcccgagggagacgctttgcccatcccaggagcccatcggccaggggtggtcaccaaagcaggactcatcctctttgggaatgatgacaaaatgctgctggtgaagaatattcagctggaggatggcaaaatgatcctggcctcgaacttctttaagggggcagccagcagtgtccttgagctgacagaggcagagctggttactgcggaggctgtgcggagtgtttggcagcggatcctccccaaagtcctggaggttgaagactccactgatttcttcaagtcaggggccgcgtctgtggacgttgtgaggctggtggaggaagtgaaggagctgtgtgatggcctggagttagaaaatgaagatgtgtacatggcatccacctttggggacttcatccatcagaagcagcccttggctgggtgaggtgtgcccctcccagggagaataaagcttctgaagagagaaaaaccacatct

SEQ ID NO: 418265 - DNA, 991 bp, Homo sapiens
ccgcgcccctcccctcacgggctctggccttaaccagagctcgcggactggcggggacaggtcccacctcctggctcccaggacgggtctgcaccaacctcagtttcggggctgcggctcacagaagtctaacctgcccgggacgcccgcaccaactcctgcgcgcggtccttccaaccctcctgctaccatgaagattgcagtgattggacagagcctgtttggccaggaagtttactgccacctgaggaaggagggccacgaagtggtgggtgtgttcactgttccagacaaggatggaaaggccgaccccctgggtctggaagctgagaaggatggagtgccggtattcaagtactcccggtggcgtgcaaaaggacaggctttgcctgatgtggtggcaaaataccaggctttgggggccgagctcaacgtcctgcccttctgcagccaattcatccccatggagataatcagtgccccccggcatggctccatcatctatcacccgtcactgctccctaggcaccgaggggcctcggccatcaactggaccctcattcacggagataagaaaggggggttttccatcttctgggcggatgatggtctggacaccggagacctgctgctgcagaaggagtgtgaggtgctcccggacgacaccgtgagcacgctgtacaaccgcttcctcttccctgaaggcatcaaagggatggtgcaggccgtgaggctgatcgctgagggcaaagcccccagactccctcagcctgaggaaggagccacctatgaggggattcagaagaaggagacagccaagatcaactgggaccagccggcagaggccattcacaactggatccgcgggaacgacaaggtgccgggagcctggacagaggcctgtgaacaggtgtgtccctgcatggctggaatccagccacgtgcattggtgtatcccactggccattaaactgtcacacatgtttgaact

SEQ ID NO: 418266 - DNA, 436 bp, Homo sapiens
cgtgagtacccgggtgcaagatatcagtctttcctctgtatctaatccccgaatgtcttcgactgagcaggagtggccaatgaggcgctggagatgtggccgctcccttcggaggattcaaacagtctggatttggcaaagatctaggagaggcggctctgaacgagtacctgcgggtcaagacagtgaccttcgaatactgaagaaaggtctttgtgagaagaaagtccctgcccctccctcgtggctggggccccctccctcttgagcctgggtgcacagcacctcccacctggggggctagtggaagccctcctgcctgcacaccatgtctgcatcttggacgccctctgtccagtcagaagcagcccttggctgggtgaggtgtgcccctcccagggagaataaagcttctgaagagagaaaaaccacatct

SEQ ID NO: 418267 - DNA, 690 bp, Homo sapiens
agggctgcttgcccctgcccgaggacaggctggcagggacggccacaggcagaggtgctgtccaggcatgcagcaggagggaaggaggccctggggagcccttgctgtttgggcgcagcaggaagagcagctgcagtgtccactgtcccctcgtcctcctcagctcctggccactgccttttatttttcggttgtgttaaacttgtcttccccacagattgaccagctcacaaaaatagtgaacaaagtagagttgctggagatttagtggtacagagagggagcttacctgtgcttcccacggcaagcaactcaaatactccttgaagctgcactgtccaacaaggcagccactggtaacatgcagctattaaatcaattaaaatgaattatactgaaaaattcagttcctcagtctcagccacattctaagtcccctggccaccgtgttggaccgtgcagacttggaactcatccatcaccacagagggctccattgggcagccctgcctcagatgctctgacacccggtcacttcccattcttggcacctcccggtctcttccctcaggctcttgctcacgtgggcccagactccttggctctccttctccctctctgattcctttcccaccaccttcctctttcctgtcacagagaaacaacttcctgcttcatctcagacctcca

SEQ ID NO: 418268 - DNA, 938 bp, Homo sapiens
  misc_feature (72)..(72): n is a, c, g, or t
  misc_feature (81)..(81): n is a, c, g, or t
agcggactttctggagacccgccctcgccaacatggcggcgcccagttggggcgggttcgttcgcttcgcgntttggccanggcgggggtctgggctttaggcaggtagtatttagtttcacaatgtttggggacctgtttgaagaggagtattccactgtgtctaataatcagtatggaaaagggaagaaattaaagactaaagctttggagccacctgctcctagagaattcaccaatttaagcggaatcagaaatcagggtggaacctgttacctcaattcccttcttcagactcttcatttcacacctgaattcagagaagctctattttctcttggcccagaagagcttggtttgtttgaagataaggataaacccgatgcaaaggttcgaatcatccctttacagttacagcgcttgtttgctcagcttctgctcttagaccaggaagctgcatccacagcagacctcactgacagctttgggtggaccagtaatgaggaaatgaggcaacatgatgtgcaggaactgaatcgaatcctcttcagcgctttggaaacttctttagttgggacctccggtcatgacctcatctatcgtctgtaccatggaaccattgttaaccagattgtttgtaaagaatgtaagaacgttagcgagaggcaggtaaatatgccagagtattttagtaataagttatgttgtaaattataatccatgtaattaaatgtatgatatataccacacaaggattaaagtgtttattactaaaagtaatttattgagtttttttttcttctaactacacctaaatcatgagcctataatccagatttctccatgtagattgaaagaagcaaatatcttgaaacttaatcttttattcagtaccctaatatttggaaaatagatttgggggatatttacaaatagaa

SEQ ID NO: 418269 - DNA, 885 bp, Homo sapiens
  misc_feature (72)..(72): n is a, c, g, or t
  misc_feature (81)..(81): n is a, c, g, or t
agcggactttctggagacccgccctcgccaacatggcggcgcccagttggggcgggttcgttcgcttcgcgntttggccanggcgggggtctgggctttaggcaggtagtatttagtttcacaatgtttggggacctgtttgaagaggagtattccactgtgtctaataatcagtatggaaaagggaagaaattaaagactaaagctttggagccacctgctcctagagaattcaccaatttaagcggaatcagaaatcagggtggaacctgttacctcaattcccttcttcagactcttcatttcacacctgaattcagagaagctctattttctcttggcccagaagagcttggtttgtttgaagataaggataaacccgatgcaaaggttcgaatcatccctttacagttacagcgcttgtttgctcagcttctgctcttagaccaggaagctgcatccacagcagacctcactgacagctttgggtggaccagtaatgaggaaatgaggcaacatgatgtgcaggaactgaatcgaatcctcttcagcgctttggaaacttctttagttgggacctccggtcatgacctcatctatcgtctgtagtcgcccaggtcctgaagaagcttgctgtcttcgatacgtggagctccttggcggtccacattgcaatggacaacactgttgtgatggaggaatcagaaggttgtgcaggacagcgtaccctgtgcaggcgccactgcgtatcctgcagattccagaccgggcacttgcaacggattccctgccggagctgaggtcaccaaacaggacgtccgccaatggagacccatggtacttctcatcccctgcgactggggctcacggaaatcaacgaggctc

SEQ ID NO: 418270 - DNA, 1164 bp, Homo sapiens
ctgtcgcccaggctggagtgcagtggcgtgatcatggctcaactacagcctcaacctcctgggctcaagtgatcctcccacctcagcctcctgtgtagctgggacctcaggcatgtgccacgacaccaggctaattttttgttttgacgaggtctccctatgttgcccagtctggtcgcgaactcctagcctcaagcaatccttccaccttggcctcccaaagtgctgggttactggcgtgagccactgtgcctggccaaggctgcttttaatcggttctgattaccaccccaaagtgactggcatgagaatcttaaccccgtctgaacagagggaaatttctttggcagtttggccatcttcccagagccagacctacatgtttagtaagaaatgactcaagtatctaaataatcaccgcagcaaggattctcattttttccccttttccaaaagtttgggtgttcttataagtactcagaaaacaattctttgcttaagaaaaaagcttaaaattgggggaaaaaaaattcaagaaaattaaatgttatgtcactcaatattatcttgtttcacttattatcagggaatataaactaggacggagaattgagatctgcttagagccccttcagaaaggcgaaaacttggggtaagaaattctcctgtgcatctgaagtgacacacacgtatcttaacctcgtttgccttttgaagctttaacaacttcatagtgtagcattttttttcactgcttctaagtagcctagcaacttgaaacagagtgtgtgctagaaatatgtttgtatgtctgggcatctaaaacttgggacttattctcccataaaaacagtaagggagaattaatttttcagtaatcaccaggtgcatattgaccccatgatggccctgaagtgtcagcaagaggcccacccgcagctgttgtcagtgtgttcggacagtctgccatccaacggattcatcattgctcccgtcgctctgcccccttattctactttcttcatcctagtatcacctgacatatctgtacttactgatttatttgttagtatctgtctcccactactagaatataagtacttggtttattcattgctatatccttaatacctagaatagtaattgtgcccatgtcatagtcaa

SEQ ID NO: 418271 - DNA, 810 bp, Homo sapiens
tacagcccccagagtcaagggcataactgcctacctcgagcccgctctcctcctgccagctgccgggctatcaagccaggcctctctcaccctgtccctctctgccacatcgtacctgctcaggccgccacctctttccttttctcccgcactgaggaagttccctaccacgtctgggggggctctgctgtgtaccgagaatgggatcttcacttccgctcttcattccaagattaaaggaaattgaaatgcggaataagagtttgccactagcatccagcatttagggaaaaatctctccttataaaaaccagaaaagctggaggagaagctttgcccattatgcctcaagttaccacgtggttttgtttgtttgtttggatctggcgcttgacggttttctggtacagcccccaggacgtgctgctgaggacacaggtgcgaaccaccacgaccgggtagtttttgtactttgtagtagagatgaggtttcaccacgttggccaggatggtatcaaacctgcggacctcaagtgatccacccggctcggcctaccaaagtacagcgcatgagccaattcgcccagtgataaatgcttgttttaagcttctggctttgggctggtgtgataggcagctcactgggcagtgctgacgggtacaatcagatgaaccctgaggcccctggaagcttcgagtgtctatgagggacctttaccagcctttcagccaaattggtagacccacttctctggactcggatgctgcattgattgagcaaaggatactgactcccctgggaagtttcca

SEQ ID NO: 418272 - DNA, 5716 bp, Homo sapiens
  misc_feature (72)..(72): n is a, c, g, or t
  misc_feature (81)..(81): n is a, c, g, or t
agcggactttctggagacccgccctcgccaacatggcggcgcccagttggggcgggttcgttcgcttcgcgntttggccanggcgggggtctgggctttaggcaggtagtatttagtttcacaatgtttggggacctgtttgaagaggagtattccactgtgtctaataatcagtatggaaaagggaagaaattaaagactaaagctttggagccacctgctcctagagaattcaccaatttaagcggaatcagaaatcagggtggaacctgttacctcaattcccttcttcagactcttcatttcacacctgaattcagagaagctctattttctcttggcccagaagagcttggtttgtttgaagataaggataaacccgatgcaaaggttcgaatcatccctttacagttacagcgcttgtttgctcagcttctgctcttagaccaggaagctgcatccacagcagacctcactgacagctttgggtggaccagtaatgaggaaatgaggcaacatgatgtgcaggaactgaatcgaatcctcttcagcgctttggaaacttctttagttgggacctccggtcatgacctcatctatcgtctgtaccatggaaccattgttaaccagattgtttgtaaagaatgtaagaacgttagcgagaggcaggaagacttcttagatctaacagtagcagtcaaaaatgtatccggtttggaagatgctctctggaacatgtatgtagaagaggaagtttttgattgtgacaacttgtaccactgtggaacttgtgacaggctggttaaagcagcaaagtcggccaaattacgtaagctgcctccttttcttactgtttcattactaagatttaattttgattttgtgaaatgcgaacgctacaaggaaactagctgttatacattccctctccggattaatctcaagcccttttgtgaacagagtgaattggatgacttagaatatatatatgacctcttctcagttattatacacaaaggtggctgctacggaggccattaccatgtatatattaaagatgttgatcatttgggaaactggcagtttcaagaggaaaaaagtaaaccagatgtgaatctgaaagatctccagagtgaagaagagattgatcatccactgatgattctaaaagcaatcttattagaggaggagaataatctaattcctgttgatcagctgggccagaaacttttgaaaaagataggaatatcttggaacaagaagtacagaaaacagcatggaccattgcggaagttcttacaggctccattctcagatatttctactcagttcagatgaaagtacagttcgtctcttgaagaatagttctctccaggctgagtctgatttccaaaggaatgaccagcaaattttcaagatgcttcctccagaatccccaggtttaaacaatagcatctcctgtccccactggtttgatataaatgattctaaagtccagccaatcagggaaaaggatattgaacagcaatttcagggtaaagaaagtgcctacatgttgttttatcggaaatcccagttgcagagaccccctgaagctcgagctaatccaagatatggggttccatgtcatttactgaatgaaatggatgcagctaacattgaactgcaaaccaaaagggcagaatgtgattctgcaaacaatacttttgaattgcatcttcacctgggccctcagtatcatttcttcaatggggctctgcacccagtagtctctcaaacagaaagcgtgtgggatttgacctttgataaaagaaaaactttaggagatctccggcagtcaatatttcagctgttagaattttgggaaggagacatggttcttagtgttgcaaagcttgtaccagcaggacttcacatttaccagtcacttggcggggatgaactgacactgtgtgaaactgaaattgctgatggggaagacatctttgtgtggaatggggtggaggttggtggagtccacattcaaactggtattgactgcgaacctctacttttaaatgttcttcatctagacacaagcagtgatggagaaaagtgttgtcaggtgatagaatctccacatgtctttccagctaatgcagaagtgggcactgtcctcacagccttagcaatcccagcaggtgtcatcttcatcaacagtgctggatgtccaggtggggagggttggacggccatccccaaggaagacatgaggaagacgttcagggagcaagggctcagaaatggaagctcaattttaattcaggattctcatgatgataacagcttgttgaccaaggaagagaaatgggtcactagtatgaatgagattgactggctccacgttaaaaatttatgccagttagaatctgaagagaagcaagttaaaatatcagcaactgttaacacaatggtgtttgatattcgaattaaagccataaaggaattaaaattaatgaaggaactagctgacaacagctgtttgagacctattgatagaaatgggaagcttctttgtccagtgccggacagctatactttgaaggaagcagaattgaagatgggaagttcattgggactgtgtcttggaaaagcaccaagttcgtctcagttgttcctgttttttgcaatggggagtgacgttcaacctgggacagaaatggaaatcgtagtagaagaaacaatatctgtgagagattgtttaaagttaatgctgaagaaatctggcctacaaggagatgcctggcatttacgaaaaatggattggtgctatgaagctggagagcctttatgtgaagaagatgcaacactgaaagaacttctgatatgttctggagatactttgcttttaattgaaggacaacttcctcctctgggtttcctgaaggtgcccatctggtggtaccagcttcagggtccctcaggacactgggagagtcatcaggaccagaccaactgtacttcgtcttggggcagagtttggagagccacttccagccaaggtgcttctgggaacgagcctgcgcaagtttctctcctctacttgggagacatagagatctcagaagatgccacgctggcggagctgaagtctcaggccatgaccttgcctcctttcctggagttcggtgtcccgtccccagcccacctcagagcctggacggtggagaggaagcgcccaggcaggcttttacgaactgaccggcagccactcagggaatataaactaggacggagaattgagatctgcttagagccccttcagaaaggcgaaaacttgggcccccaggacgtgctgctgaggacacaggtgcgcatccctggtgagaggacctatgcccctgccctggacctggtgtggaacgcggcccagggtgggactgccggctccctgaggcagagagttgccgatttctatcgtcttcccgtggagaagattgaaattgccaaatactttcccgaaaagttcgagtggcttccgatatctagctggaaccaacaaataaccaagaggaaaaagaaaaaaaaacaagattatttgcaaggggcaccgtattacttgaaagacggagatactattggtgttaagaatctcctgattgacgacgatgatgatttcagtacaatcagagatgacactggaaaagaaaagcagaaacaacgggccctggggagaaggaaaagccaagaagccctccatgagcagagcagctacatcctctccagtgcagagacgcctgcccggccccgagccccggaaacttctctctccatccacgtggggagcttcagataaccgcgccgctgcacggctctactcccgatgaactctccggctgatgccacaaacgtgggtttcctgggcatggggactggctgcctggcgcctccaatcccaaatcctctgcttcctttgagcacagggacggctcctctgaggcctggccagtgcatgtagtcacttagctctgcaacacgtggcagccacgggggctggtgcagctctggatgtcgcccacccagctgccagtaggtgctgggctctctcacacagcacccggccccagctgcctttttttttcttttaaccagaaaatgcacaacgtgtgcgtgaaccgcaggtatggaggcagcggcatgccgttgctccgctgtgggaggtgtgtggggtcaggccagccactttcctccgtgttcagatgactctcgttcgccctgaccggcttctcacagtgtctcaggccactgcgccaccgcgctggtgctgagcagaagcgggcagaagtggggtctgctttcaggacttcatttcccccactcgttccggccccgcatgctccacgtctgccctttggtctgagttaaaactgcgatgctgaaaagtgcgagctctttccacgaggaggagccacacagggtggcctccgagggtgagtcgctctgctaagcaagggcagccgctgcacgtcagcccgcaggccaagggtccagcttatcctgggtgctctgtgatcagaaggtccttggatcccgaggactgcagctgctgccgtccacagcgcctcagcctctcttcctgtgtggaagcggggcaggcagggctgtggcagacaggcctggcatagcccaggttccaggtgtcctgggcagcctgaccggtttcctgagtagcctcaatgaaaacacctgagaaaaagaaaatgtaaactaaggaagggttttcccacttaatccaacccagatttctattcaacttaaaggatttaattggcatttgtgagaaataatagtacctgtgtcactgagttgattgatttgggacatagacggttgactttcccagacagcagcttagcggaaagcagcatcccgaagacggtgtcgcatgtcctgagcctgcttgtcacctgggcctcacggtttctcgtcagccccgtcactgatgggaagcagcactgaagtgtgagggcagaaaggacaccgctggagtcaggcgctcccctgcctgtgacccttttccaacaagctgatgctgagccagcggcctgctttgtccctcatactcctcccaacagtccaaacccctaccagacagaagccacgtcgcttctgcacacgtgtctgagagcgtctgccatagacgtctgtgcgtttccgtgaagcactgcgccctaaggacccaactctgactagcagctgcctcccactcccaaacactaaccccgctcaggagactcgcactgggtgtagactgcgtctttgcagagggagatgatagaggcttctgatgacgccagagctgtaagtgtcgtgacgagctgggcgcccagcccttcttaagctgttctgtttctgtggctttaactgacatatttctgtagcatctgccttcatctcatctcagcgtaatgaaatattaatgaaatcgctgaaaagctttgccttcgagaggccagaagcctcgcggaatgtctgcaagtccaaagacgcgtgtgggttgtgccctgaagtgccgtccagcaggcgcgtgcggccgggccggcctgtgcgtgtggcctttgccttcttccctttcttcctgttttctgtttttttaatttggggattgagaaagctgtacgattttgttaaagaaaaaaataaaccattttttaaagttgtaaaaaaaaaaagcttt

SEQ ID NO: 418273 - DNA, 5662 bp, Homo sapiens
  misc_feature (72)..(72): n is a, c, g, or t
  misc_feature (81)..(81): n is a, c, g, or t
agcggactttctggagacccgccctcgccaacatggcggcgcccagttggggcgggttcgttcgcttcgcgntttggccanggcgggggtctgggctttaggcaggtagtatttagtttcacaatgtttggggacctgtttgaagaggagtattccactgtgtctaataatcagtatggaaaagggaagaaattaaagactaaagctttggagccacctgctcctagagaattcaccaatttaagcggaatcagaaatcagggtggaacctgttacctcaattcccttcttcagactcttcatttcacacctgaattcagagaagctctattttctcttggcccagaagagcttggtttgtttgaagataaggataaacccgatgcaaaggttcgaatcatccctttacagttacagcgcttgtttgctcagcttctgctcttagaccaggaagctgcatccacagcagacctcactgacagctttgggtggaccagtaatgaggaaatgaggcaacatgatgtgcaggaactgaatcgaatcctcttcagcgctttggaaacttctttagttgggacctccggtcatgacctcatctatcgtctgtaccatggaaccattgttaaccagattgtttgtaaagaatgtaagaacgttagcgagaggcaggaagacttcttagatctaacagtagcagtcaaaaatgtatccggtttggaagatgctctctggaacatgtatgtagaagaggaagtttttgattgtgacaacttgtaccactgtggaacttgtgacaggctggttaaagcagcaaagtcggccaaattacgtaagctgcctccttttcttactgtttcattactaagatttaattttgattttgtgaaatgcgaacgctacaaggaaactagctgttatacattccctctccggattaatctcaagcccttttgtgaacagagtgaattggatgacttagaatatatatatgacctcttctcagttattatacacaaaggtggctgctacggaggccattaccatgtatatattaaagatgttgatcatttgggaaactggcagtttcaagaggaaaaaagtaaaccagatgtgaatctgaaagatctccagagtgaagaagagattgatcatccactgatgattctaaaagcaatcttattagaggaggagaataatctaattcctgttgatcagctgggccagaaacttttgaaaaagataggaatatcttggaacaagaagtacagaaaacagcatggaccattgcggaagttcttacaggctccattctcagatatttctactcagttcagatgaaagtacagttcgtctcttgaagaatagttctctccaggctgagtctgatttccaaaggaatgaccagcaaattttcaagatgcttcctccagaatccccaggtttaaacaatagcatctcctgtccccactggtttgatataaatgattctaaagtccagccaatcagggaaaaggatattgaacagcaatttcagggtaaagaaagtgcctacatgttgttttatcggaaatcccagttgcagagaccccctgaagctcgagctaatccaagatatggggttccatgtcatttactgaatgaaatggatgcagctaacattgaactgcaaaccaaaagggcagaatgtgattctgcaaacaatacttttgaattgcatcttcacctgggccctcagtatcatttcttcaatggggctctgcacccagtagtctctcaaacagaaagcgtgtgggatttgacctttgataaaagaaaaactttaggagatctccggcagtcaatatttcagctgttagaattttgggaaggagacatggttcttagtgttgcaaagcttgtaccagcaggacttcacatttaccagtcacttggcggggatgaactgacactgtgtgaaactgaaattgctgatggggaagacatctttgtgtggaatggggtggaggttggtggagtccacattcaaactggtattgactgcgaacctctacttttaaatgttcttcatctagacacaagcagtgatggagaaaagtgttgtcaggtgatagaatctccacatgtctttccagctaatgcagaagtgggcactgtcctcacagccttagcaatcccagcaggtgtcatcttcatcaacagtgctggatgtccaggtggggagggttggacggccatccccaaggaagacatgaggaagacgttcagggagcaagggctcagaaatggaagctcaattttaattcaggattctcatgatgataacagcttgttgaccaaggaagagaaatgggtcactagtatgaatgagattgactggctccacgttaaaaatttatgccagttagaatctgaagagaagcaagttaaaatatcagcaactgttaacacaatggtgtttgatattcgaattaaagccataaaggaattaaaattaatgaaggaactagctgacaacagctgtttgagacctattgatagaaatgggaagcttctttgtccagtgccggacagctatactttgaaggaagcagaattgaagatgggaagttcattgggactgtgtcttggaaaagcaccaagttcgtctcagttgttcctgttttttgcaatggggagtgacgttcaacctgggacagaaatggaaatcgtagtagaagaaacaatatctgtgagagattgtttaaagttaatgctgaagaaatctggcctacaaggagatgcctggcatttacgaaaaatggattggtgctatgaagctggagagcctttatgtgaagaagatgcaacactgaaagaacttctgatatgttctggagatactttgcttttaattgaaggacaacttcctcctctgggtttcctgaaggtgcccatctggtggtaccagcttcagggtccctcaggacactgggagagtcatcaggaccagaccaactgtacttcgtcttggggcagagtttggagagccacttccagccaaggtgcttctgggaacgagcctgcgcaagtttctctcctctacttgggagacatagagatctcagaagatgccacgctggcggagctgaagtctcaggccatgaccttgcctcctttcctggagttcggtgtcccgtccccagcccacctcagagcctggacggtggagaggaagcgcccaggcaggcttttacgaactgaccggcagccactcagggaatataaactaggacggagaattgagatctgcttagagccccttcagaaaggcgaaaacttgggcccccaggacgtgctgctgaggacacaggtgcgcatccctggtgagaggacctatgcccctgccctggacctggtgtggaacgcggcccagggtgggactgccggctccctgaggcagagagttgccgatttctatcgtcttcccgtggagaagattgaaattgccaaatactttcccgaaaagttcgagtggcttccgatatctagctggaaccaacaaataaccaagaggaaaaagaaaaaaaaacaagattatttgcaaggggcaccgtattacttgaaagacggagatactattggtgttaagaatctcctgattgacgacgatgatgatttcagtacaatcagagatgacactggaaaagaaaagcagaaacaacgggccctggggagaaggaaaagccaagaagccctccatgagcagagcagctacatcctctccagtgcagagacgcctgcccggccccgagccccggaaacttctctctccatccacgtggggagcttcagataaccgcgccgctgcacggctctactcccgatgaactctccggctgatgccacaaacgtgggtttcctgggcatggggactggctgcctggcgcctccaatcccaaatcctctgcttcctttgagcacagggacggctcctctgaggcctggccagtgcatgtagtcacttagctctgcaacacgtggcagccacgggggctggtgcagctctggatgtcgcccacccagctgccagtaggtgctgggctctctcacacagcacccggccccagctgcctttttttttcttttaaccagaaaatgcacaacgtgtgcgtgaaccgcaggtatggaggcagcggcatgccgttgctccgctgtgggaggtgtgtggggtcaggccagccactttcctccgtgttcagatgactctcgttcgccctgaccggcttctcacagtgtctcaggccactgcgccaccgcgctggtgctgagcagaagcgggcagaagtggggtctgctttcaggacttcatttcccccactcgttccggccccgcatgctccacgtctgccctttggtctgagttaaaactgcgatgctgaaaagtgcgagctctttccacgaggaggagccacacagggtggcctccgagggtgagtcgctctgctaagcaagggcagccgctgcacgtcagcccgcaggccaagggtccagcttatcctgggtgctctgtgatcagaaggtccttggatcccgaggactgcagctgctgccgtccacagcgcctcagcctctcttcctgtgtggaagcggggcaggcagggctgtggcagacaggcctggcatagcccaggttccaggtgtcctgggcagcctgaccggtttcctgagtagcctcaatgaaaacacctgagaaaaagaaattaaaggatttaattggcatttgtgagaaataatagtacctgtgtcactgagttgattgatttgggacatagacggttgactttcccagacagcagcttagcggaaagcagcatcccgaagacggtgtcgcatgtcctgagcctgcttgtcacctgggcctcacggtttctcgtcagccccgtcactgatgggaagcagcactgaagtgtgagggcagaaaggacaccgctggagtcaggcgctcccctgcctgtgacccttttccaacaagctgatgctgagccagcggcctgctttgtccctcatactcctcccaacagtccaaacccctaccagacagaagccacgtcgcttctgcacacgtgtctgagagcgtctgccatagacgtctgtgcgtttccgtgaagcactgcgccctaaggacccaactctgactagcagctgcctcccactcccaaacactaaccccgctcaggagactcgcactgggtgtagactgcgtctttgcagagggagatgatagaggcttctgatgacgccagagctgtaagtgtcgtgacgagctgggcgcccagcccttcttaagctgttctgtttctgtggctttaactgacatatttctgtagcatctgccttcatctcatctcagcgtaatgaaatattaatgaaatcgctgaaaagctttgccttcgagaggccagaagcctcgcggaatgtctgcaagtccaaagacgcgtgtgggttgtgccctgaagtgccgtccagcaggcgcgtgcggccgggccggcctgtgcgtgtggcctttgccttcttccctttcttcctgttttctgtttttttaatttggggattgagaaagctgtacgattttgttaaagaaaaaaataaaccattttttaaagttgtaaaaaaaaaaagcttt

SEQ ID NO: 418274 - DNA, 5433 bp, Homo sapiens
  misc_feature (72)..(72): n is a, c, g, or t
  misc_feature (81)..(81): n is a, c, g, or t
agcggactttctggagacccgccctcgccaacatggcggcgcccagttggggcgggttcgttcgcttcgcgntttggccanggcgggggtctgggctttaggcaggtagtatttagtttcacaatgtttggggacctgtttgaagaggagtattccactgtgtctaataatcagtatggaaaagggaagaaattaaagactaaagctttggagccacctgctcctagagaattcaccaatttaagcggaatcagaaatcagggtggaacctgttacctcaattcccttcttcagactcttcatttcacacctgaattcagagaagctctattttctcttggcccagaagagcttggtttgtttgaagataaggataaacccgatgcaaaggttcgaatcatccctttacagttacagcgcttgtttgctcagcttctgctcttagaccaggaagctgcatccacagcagacctcactgacagctttgggtggaccagtaatgaggaaatgaggcaacatgatgtgcaggaactgaatcgaatcctcttcagcgctttggaaacttctttagttgggacctccggtcatgacctcatctatcgtctgtaccatggaaccattgttaaccagattgtttgtaaagaatgtaagaacgttagcgagaggcaggaagacttcttagatctaacagtagcagtcaaaaatgtatccggtttggaagatgctctctggaacatgtatgtagaagaggaagtttttgattgtgacaacttgtaccactgtggaacttgtgacaggctggttaaagcagcaaagtcggccaaattacgtaagctgcctccttttcttactgtttcattactaagatttaattttgattttgtgaaatgcgaacgctacaaggaaactagctgttatacattccctctccggattaatctcaagcccttttgtgaacagagtgaattggatgacttagaatatatatatgacctcttctcagttattatacacaaaggtggctgctacggaggccattaccatgtatatattaaagatgttgatcatttgggaaactggcagtttcaagaggaaaaaagtaaaccagatgtgaatctgaaagatctccagagtgaagaagagattgatcatccactgatgattctaaaagcaatcttattagaggaggagaataatctaattcctgttgatcagctgggccagaaacttttgaaaaagataggaatatcttggaacaagaagtacagaaaacagcatggaccattgcggaagttcttacaggctccattctcagatatttctactcagttcagatgaaagtacagttcgtctcttgaagaatagttctctccaggctgagtctgatttccaaaggaatgaccagcaaattttcaagatgcttcctccagaatccccaggtttaaacaatagcatctcctgtccccactggtttgatataaatgattctaaagtccagccaatcagggaaaaggatattgaacagcaatttcagggtaaagaaagtgcctacatgttgttttatcggaaatcccagttgcagagaccccctgaagctcgagctaatccaagatatggggttccatgtcatttactgaatgaaatggatgcagctaacattgaactgcaaaccaaaagggcagaatgtgattctgcaaacaatacttttgaattgcatcttcacctgggccctcagtatcatttcttcaatggggctctgcacccagtagtctctcaaacagaaagcgtgtgggatttgacctttgataaaagaaaaactttaggagatctccggcagtcaatatttcagctgttagaattttgggaaggagacatggttcttagtgttgcaaagcttgtaccagcaggacttcacatttaccagtcacttggcgggagggttggacggccatccccaaggaagacatgaggaagacgttcagggagcaagggctcagaaatggaagctcaattttaattcaggattctcatgatgataacagcttgttgaccaaggaagagaaatgggtcactagtatgaatgagattgactggctccacgttaaaaatttatgccagttagaatctgaagagaagcaagttaaaatatcagcaactgttaacacaatggtgtttgatattcgaattaaagccataaaggaattaaaattaatgaaggaactagctgacaacagctgtttgagacctattgatagaaatgggaagcttctttgtccagtgccggacagctatactttgaaggaagcagaattgaagatgggaagttcattgggactgtgtcttggaaaagcaccaagttcgtctcagttgttcctgttttttgcaatggggagtgacgttcaacctgggacagaaatggaaatcgtagtagaagaaacaatatctgtgagagattgtttaaagttaatgctgaagaaatctggcctacaaggagatgcctggcatttacgaaaaatggattggtgctatgaagctggagagcctttatgtgaagaagatgcaacactgaaagaacttctgatatgttctggagatactttgcttttaattgaaggacaacttcctcctctgggtttcctgaaggtgcccatctggtggtaccagcttcagggtccctcaggacactgggagagtcatcaggaccagaccaactgtacttcgtcttggggcagagtttggagagccacttccagccaaggtgcttctgggaacgagcctgcgcaagtttctctcctctacttgggagacatagagatctcagaagatgccacgctggcggagctgaagtctcaggccatgaccttgcctcctttcctggagttcggtgtcccgtccccagcccacctcagagcctggacggtggagaggaagcgcccaggcaggcttttacgaactgaccggcagccactcagggaatataaactaggacggagaattgagatctgcttagagccccttcagaaaggcgaaaacttgggcccccaggacgtgctgctgaggacacaggtgcgcatccctggtgagaggacctatgcccctgccctggacctggtgtggaacgcggcccagggtgggactgccggctccctgaggcagagagttgccgatttctatcgtcttcccgtggagaagattgaaattgccaaatactttcccgaaaagttcgagtggcttccgatatctagctggaaccaacaaataaccaagaggaaaaagaaaaaaaaacaagattatttgcaaggggcaccgtattacttgaaagacggagatactattggtgttaagaatctcctgattgacgacgatgatgatttcagtacaatcagagatgacactggaaaagaaaagcagaaacaacgggccctggggagaaggaaaagccaagaagccctccatgagcagagcagctacatcctctccagtgcagagacgcctgcccggccccgagccccggaaacttctctctccatccacgtggggagcttcagataaccgcgccgctgcacggctctactcccgatgaactctccggctgatgccacaaacgtgggtttcctgggcatggggactggctgcctggcgcctccaatcccaaatcctctgcttcctttgagcacagggacggctcctctgaggcctggccagtgcatgtagtcacttagctctgcaacacgtggcagccacgggggctggtgcagctctggatgtcgcccacccagctgccagtaggtgctgggctctctcacacagcacccggccccagctgcctttttttttcttttaaccagaaaatgcacaacgtgtgcgtgaaccgcaggtatggaggcagcggcatgccgttgctccgctgtgggaggtgtgtggggtcaggccagccactttcctccgtgttcagatgactctcgttcgccctgaccggcttctcacagtgtctcaggccactgcgccaccgcgctggtgctgagcagaagcgggcagaagtggggtctgctttcaggacttcatttcccccactcgttccggccccgcatgctccacgtctgccctttggtctgagttaaaactgcgatgctgaaaagtgcgagctctttccacgaggaggagccacacagggtggcctccgagggtgagtcgctctgctaagcaagggcagccgctgcacgtcagcccgcaggccaagggtccagcttatcctgggtgctctgtgatcagaaggtccttggatcccgaggactgcagctgctgccgtccacagcgcctcagcctctcttcctgtgtggaagcggggcaggcagggctgtggcagacaggcctggcatagcccaggttccaggtgtcctgggcagcctgaccggtttcctgagtagcctcaatgaaaacacctgagaaaaagaaaatgtaaactaaggaagggttttcccacttaatccaacccagatttctattcaacttaaaggatttaattggcatttgtgagaaataatagtacctgtgtcactgagttgattgatttgggacatagacggttgactttcccagacagcagcttagcggaaagcagcatcccgaagacggtgtcgcatgtcctgagcctgcttgtcacctgggcctcacggtttctcgtcagccccgtcactgatgggaagcagcactgaagtgtgagggcagaaaggacaccgctggagtcaggcgctcccctgcctgtgacccttttccaacaagctgatgctgagccagcggcctgctttgtccctcatactcctcccaacagtccaaacccctaccagacagaagccacgtcgcttctgcacacgtgtctgagagcgtctgccatagacgtctgtgcgtttccgtgaagcactgcgccctaaggacccaactctgactagcagctgcctcccactcccaaacactaaccccgctcaggagactcgcactgggtgtagactgcgtctttgcagagggagatgatagaggcttctgatgacgccagagctgtaagtgtcgtgacgagctgggcgcccagcccttcttaagctgttctgtttctgtggctttaactgacatatttctgtagcatctgccttcatctcatctcagcgtaatgaaatattaatgaaatcgctgaaaagctttgccttcgagaggccagaagcctcgcggaatgtctgcaagtccaaagacgcgtgtgggttgtgccctgaagtgccgtccagcaggcgcgtgcggccgggccggcctgtgcgtgtggcctttgccttcttccctttcttcctgttttctgtttttttaatttggggattgagaaagctgtacgattttgttaaagaaaaaaataaaccattttttaaagttgtaaaaaaaaaaagcttt

SEQ ID NO: 418275 - DNA, 3179 bp, Homo sapiens
tcatattatcaaaatttttttaagtgccggacagctatactttgaaggaagcagaattgaagatgggaagttcattgggactgtgtcttggaaaagcaccaagttcgtctcagttgttcctgttttttgcaatggggagtgacgttcaacctgggacagaaatggaaatcgtagtagaagaaacaatatctgtgagagattgtttaaagttaatgctgaagaaatctggcctacaaggagatgcctggcatttacgaaaaatggattggtgctatgaagctggagagcctttatgtgaagaagatgcaacactgaaagaacttctgatatgttctggagatactttgcttttaattgaaggacaacttcctcctctgggtttcctgaaggtgcccatctggtggtaccagcttcagggtccctcaggacactgggagagtcatcaggaccagaccaactgtacttcgtcttggggcagagtttggagagccacttccagccaaggtgcttctgggaacgagcctgcgcaagtttctctcctctacttgggagacatagagatctcagaagatgccacgctggcggagctgaagtctcaggccatgaccttgcctcctttcctggagttcggtgtcccgtccccagcccacctcagagcctggacggtggagaggaagcgcccaggcaggcttttacgaactgaccggcagccactcagggaatataaactaggacggagaattgagatctgcttagagccccttcagaaaggcgaaaacttgggcccccaggacgtgctgctgaggacacaggtgcgcatccctggtgagaggacctatgcccctgccctggacctggtgtggaacgcggcccagggtgggactgccggctccctgaggcagagagttgccgatttctatcgtcttcccgtggagaagattgaaattgccaaatactttcccgaaaagttcgagtggcttccgatatctagctggaaccaacaaataaccaagaggaaaaagaaaaaaaaacaagattatttgcaaggggcaccgtattacttgaaagacggagatactattggtgttaagaatctcctgattgacgacgatgatgatttcagtacaatcagagatgacactggaaaagaaaagcagaaacaacgggccctggggagaaggaaaagccaagaagccctccatgagcagagcagctacatcctctccagtgcagagacgcctgcccggccccgagccccggaaacttctctctccatccacgtggggagcttcagataaccgcgccgctgcacggctctactcccgatgaactctccggctgatgccacaaacgtgggtttcctgggcatggggactggctgcctggcgcctccaatcccaaatcctctgcttcctttgagcacagggacggctcctctgaggcctggccagtgcatgtagtcacttagctctgcaacacgtggcagccacgggggctggtgcagctctggatgtcgcccacccagctgccagtaggtgctgggctctctcacacagcacccggccccagctgcctttttttttcttttaaccagaaaatgcacaacgtgtgcgtgaaccgcaggtatggaggcagcggcatgccgttgctccgctgtgggaggtgtgtggggtcaggccagccactttcctccgtgttcagatgactctcgttcgccctgaccggcttctcacagtgtctcaggccactgcgccaccgcgctggtgctgagcagaagcgggcagaagtggggtctgctttcaggacttcatttcccccactcgttccggccccgcatgctccacgtctgccctttggtctgagttaaaactgcgatgctgaaaagtgcgagctctttccacgaggaggagccacacagggtggcctccgagggtgagtcgctctgctaagcaagggcagccgctgcacgtcagcccgcaggccaagggtccagcttatcctgggtgctctgtgatcagaaggtccttggatcccgaggactgcagctgctgccgtccacagcgcctcagcctctcttcctgtgtggaagcggggcaggcagggctgtggcagacaggcctggcatagcccaggttccaggtgtcctgggcagcctgaccggtttcctgagtagcctcaatgaaaacacctgagaaaaagaaaatgtaaactaaggaagggttttcccacttaatccaacccagatttctattcaacttaaaggatttaattggcatttgtgagaaataatagtacctgtgtcactgagttgattgatttgggacatagacggttgactttcccagacagcagcttagcggaaagcagcatcccgaagacggtgtcgcatgtcctgagcctgcttgtcacctgggcctcacggtttctcgtcagccccgtcactgatgggaagcagcactgaagtgtgagggcagaaaggacaccgctggagtcaggcgctcccctgcctgtgacccttttccaacaagctgatgctgagccagcggcctgctttgtccctcatactcctcccaacagtccaaacccctaccagacagaagccacgtcgcttctgcacacgtgtctgagagcgtctgccatagacgtctgtgcgtttccgtgaagcactgcgccctaaggacccaactctgactagcagctgcctcccactcccaaacactaaccccgctcaggagactcgcactgggtgtagactgcgtctttgcagagggagatgatagaggcttctgatgacgccagagctgtaagtgtcgtgacgagctgggcgcccagcccttcttaagctgttctgtttctgtggctttaactgacatatttctgtagcatctgccttcatctcatctcagcgtaatgaaatattaatgaaatcgctgaaaagctttgccttcgagaggccagaagcctcgcggaatgtctgcaagtccaaagacgcgtgtgggttgtgccctgaagtgccgtccagcaggcgcgtgcggccgggccggcctgtgcgtgtggcctttgccttcttccctttcttcctgttttctgtttttttaatttggggattgagaaagctgtacgattttgttaaagaaaaaaataaaccattttttaaagttgtaaaaaaaaaaagcttt

SEQ ID NO: 418276 - DNA, 2776 bp, Homo sapiens
gctgctgttgtgtcccttgttgtactgttagagcgggctctgccctggtgaattctactcccatggaagttaattccaaagtttcattttttaaacatgatgattaaaaagaagcttttgactcagatttagagagagggaactcacttctttctcaaggtgatttcagtgcagaggaatatgaagaccgctcagggccatgaccttgcctcctttcctggagttcggtgtcccgtccccagcccacctcagagcctggacggtggagaggaagcgcccaggcaggcttttacgaactgaccggcagccactcagggaatataaactaggacggagaattgagatctgcttagagccccttcagaaaggcgaaaacttgggcccccaggacgtgctgctgaggacacaggtgcgcatccctggtgagaggacctatgcccctgccctggacctggtgtggaacgcggcccagggtgggactgccggctccctgaggcagagagttgccgatttctatcgtcttcccgtggagaagattgaaattgccaaatactttcccgaaaagttcgagtggcttccgatatctagctggaaccaacaaataaccaagaggaaaaagaaaaaaaaacaagattatttgcaaggggcaccgtattacttgaaagacggagatactattggtgttaagaatctcctgattgacgacgatgatgatttcagtacaatcagagatgacactggaaaagaaaagcagaaacaacgggccctggggagaaggaaaagccaagaagccctccatgagcagagcagctacatcctctccagtgcagagacgcctgcccggccccgagccccggaaacttctctctccatccacgtggggagcttcagataaccgcgccgctgcacggctctactcccgatgaactctccggctgatgccacaaacgtgggtttcctgggcatggggactggctgcctggcgcctccaatcccaaatcctctgcttcctttgagcacagggacggctcctctgaggcctggccagtgcatgtagtcacttagctctgcaacacgtggcagccacgggggctggtgcagctctggatgtcgcccacccagctgccagtaggtgctgggctctctcacacagcacccggccccagctgcctttttttttcttttaaccagaaaatgcacaacgtgtgcgtgaaccgcaggtatggaggcagcggcatgccgttgctccgctgtgggaggtgtgtggggtcaggccagccactttcctccgtgttcagatgactctcgttcgccctgaccggcttctcacagtgtctcaggccactgcgccaccgcgctggtgctgagcagaagcgggcagaagtggggtctgctttcaggacttcatttcccccactcgttccggccccgcatgctccacgtctgccctttggtctgagttaaaactgcgatgctgaaaagtgcgagctctttccacgaggaggagccacacagggtggcctccgagggtgagtcgctctgctaagcaagggcagccgctgcacgtcagcccgcaggccaagggtccagcttatcctgggtgctctgtgatcagaaggtccttggatcccgaggactgcagctgctgccgtccacagcgcctcagcctctcttcctgtgtggaagcggggcaggcagggctgtggcagacaggcctggcatagcccaggttccaggtgtcctgggcagcctgaccggtttcctgagtagcctcaatgaaaacacctgagaaaaagaaaatgtaaactaaggaagggttttcccacttaatccaacccagatttctattcaacttaaaggatttaattggcatttgtgagaaataatagtacctgtgtcactgagttgattgatttgggacatagacggttgactttcccagacagcagcttagcggaaagcagcatcccgaagacggtgtcgcatgtcctgagcctgcttgtcacctgggcctcacggtttctcgtcagccccgtcactgatgggaagcagcactgaagtgtgagggcagaaaggacaccgctggagtcaggcgctcccctgcctgtgacccttttccaacaagctgatgctgagccagcggcctgctttgtccctcatactcctcccaacagtccaaacccctaccagacagaagccacgtcgcttctgcacacgtgtctgagagcgtctgccatagacgtctgtgcgtttccgtgaagcactgcgccctaaggacccaactctgactagcagctgcctcccactcccaaacactaaccccgctcaggagactcgcactgggtgtagactgcgtctttgcagagggagatgatagaggcttctgatgacgccagagctgtaagtgtcgtgacgagctgggcgcccagcccttcttaagctgttctgtttctgtggctttaactgacatatttctgtagcatctgccttcatctcatctcagcgtaatgaaatattaatgaaatcgctgaaaagctttgccttcgagaggccagaagcctcgcggaatgtctgcaagtccaaagacgcgtgtgggttgtgccctgaagtgccgtccagcaggcgcgtgcggccgggccggcctgtgcgtgtggcctttgccttcttccctttcttcctgttttctgtttttttaatttggggattgagaaagctgtacgattttgttaaagaaaaaaataaaccattttttaaagttgtaaaaaaaaaaagcttt

SEQ ID NO: 418277 - DNA, 2805 bp, Homo sapiens
tacagcccccagagtcaagggcataactgcctacctcgagcccgctctcctcctgccagctgccgggctatcaagccaggcctctctcaccctgtccctctctgccacatcgtacctgctcaggccgccacctctttccttttctcccgcactgaggaagttccctaccacgtctgggggggctctgctgtgtaccgagaatgggatcttcacttccgctcttcattccaagattaaaggaaattgaaatgcggaataagagtttgccactagcatccagcatttagggaaaaatctctccttataaaaaccagaaaagctggaggagaagctttgcccattatgcctcaagttaccacgtggttttgtttgtttgtttggatctggcgcttgacggttttctggtacagcccccaggacgtgctgctgaggacacaggtgcgcatccctggtgagaggacctatgcccctgccctggacctggtgtggaacgcggcccagggtgggactgccggctccctgaggcagagagttgccgatttctatcgtcttcccgtggagaagattgaaattgccaaatactttcccgaaaagttcgagtggcttccgatatctagctggaaccaacaaataaccaagaggaaaaagaaaaaaaaacaagattatttgcaaggggcaccgtattacttgaaagacggagatactattggtgttaagaatctcctgattgacgacgatgatgatttcagtacaatcagagatgacactggaaaagaaaagcagaaacaacgggccctggggagaaggaaaagccaagaagccctccatgagcagagcagctacatcctctccagtgcagagacgcctgcccggccccgagccccggaaacttctctctccatccacgtggggagcttcagataaccgcgccgctgcacggctctactcccgatgaactctccggctgatgccacaaacgtgggtttcctgggcatggggactggctgcctggcgcctccaatcccaaatcctctgcttcctttgagcacagggacggctcctctgaggcctggccagtgcatgtagtcacttagctctgcaacacgtggcagccacgggggctggtgcagctctggatgtcgcccacccagctgccagtaggtgctgggctctctcacacagcacccggccccagctgcctttttttttcttttaaccagaaaatgcacaacgtgtgcgtgaaccgcaggtatggaggcagcggcatgccgttgctccgctgtgggaggtgtgtggggtcaggccagccactttcctccgtgttcagatgactctcgttcgccctgaccggcttctcacagtgtctcaggccactgcgccaccgcgctggtgctgagcagaagcgggcagaagtggggtctgctttcaggacttcatttcccccactcgttccggccccgcatgctccacgtctgccctttggtctgagttaaaactgcgatgctgaaaagtgcgagctctttccacgaggaggagccacacagggtggcctccgagggtgagtcgctctgctaagcaagggcagccgctgcacgtcagcccgcaggccaagggtccagcttatcctgggtgctctgtgatcagaaggtccttggatcccgaggactgcagctgctgccgtccacagcgcctcagcctctcttcctgtgtggaagcggggcaggcagggctgtggcagacaggcctggcatagcccaggttccaggtgtcctgggcagcctgaccggtttcctgagtagcctcaatgaaaacacctgagaaaaagaaaatgtaaactaaggaagggttttcccacttaatccaacccagatttctattcaacttaaaggatttaattggcatttgtgagaaataatagtacctgtgtcactgagttgattgatttgggacatagacggttgactttcccagacagcagcttagcggaaagcagcatcccgaagacggtgtcgcatgtcctgagcctgcttgtcacctgggcctcacggtttctcgtcagccccgtcactgatgggaagcagcactgaagtgtgagggcagaaaggacaccgctggagtcaggcgctcccctgcctgtgacccttttccaacaagctgatgctgagccagcggcctgctttgtccctcatactcctcccaacagtccaaacccctaccagacagaagccacgtcgcttctgcacacgtgtctgagagcgtctgccatagacgtctgtgcgtttccgtgaagcactgcgccctaaggacccaactctgactagcagctgcctcccactcccaaacactaaccccgctcaggagactcgcactgggtgtagactgcgtctttgcagagggagatgatagaggcttctgatgacgccagagctgtaagtgtcgtgacgagctgggcgcccagcccttcttaagctgttctgtttctgtggctttaactgacatatttctgtagcatctgccttcatctcatctcagcgtaatgaaatattaatgaaatcgctgaaaagctttgccttcgagaggccagaagcctcgcggaatgtctgcaagtccaaagacgcgtgtgggttgtgccctgaagtgccgtccagcaggcgcgtgcggccgggccggcctgtgcgtgtggcctttgccttcttccctttcttcctgttttctgtttttttaatttggggattgagaaagctgtacgattttgttaaagaaaaaaataaaccattttttaaagttgtaaaaaaaaaaagcttt

SEQ ID NO: 418278 - DNA, 1943 bp, Homo sapiens
gggtccttggatcccgaggactgcagctgctgccgtccacagcgcctcagcctctcttcctgtgtggaagcggggcaggcagggctgtggcagacaggcctggcatagcccaggttccaggtttcctgggcatggggactggctgcctggcgcctccaatcccaaatcctctgcttcctttgagcacagggacggctcctctgaggcctggccagtgcatgtagtcacttagctctgcaacacgtggcagccacgggggctggtgcagctctggatgtcgcccacccagctgccagtaggtgctgggctctctcacacagcacccggccccagctgcctttttttttcttttaaccagaaaatgcacaacgtgtgcgtgaaccgcaggtatggaggcagcggcatgccgttgctccgctgtgggaggtgtgtggggtcaggccagccactttcctccgtgttcagatgactctcgttcgccctgaccggcttctcacagtgtctcaggccactgcgccaccgcgctggtgctgagcagaagcgggcagaagtggggtctgctttcaggacttcatttcccccactcgttccggccccgcatgctccacgtctgccctttggtctgagttaaaactgcgatgctgaaaagtgcgagctctttccacgaggaggagccacacagggtggcctccgagggtgagtcgctctgctaagcaagggcagccgctgcacgtcagcccgcaggccaagggtccagcttatcctgggtgctctgtgatcagaaggtccttggatcccgaggactgcagctgctgccgtccacagcgcctcagcctctcttcctgtgtggaagcggggcaggcagggctgtggcagacaggcctggcatagcccaggttccaggtgtcctgggcagcctgaccggtttcctgagtagcctcaatgaaaacacctgagaaaaagaaaatgtaaactaaggaagggttttcccacttaatccaacccagatttctattcaacttaaaggatttaattggcatttgtgagaaataatagtacctgtgtcactgagttgattgatttgggacatagacggttgactttcccagacagcagcttagcggaaagcagcatcccgaagacggtgtcgcatgtcctgagcctgcttgtcacctgggcctcacggtttctcgtcagccccgtcactgatgggaagcagcactgaagtgtgagggcagaaaggacaccgctggagtcaggcgctcccctgcctgtgacccttttccaacaagctgatgctgagccagcggcctgctttgtccctcatactcctcccaacagtccaaacccctaccagacagaagccacgtcgcttctgcacacgtgtctgagagcgtctgccatagacgtctgtgcgtttccgtgaagcactgcgccctaaggacccaactctgactagcagctgcctcccactcccaaacactaaccccgctcaggagactcgcactgggtgtagactgcgtctttgcagagggagatgatagaggcttctgatgacgccagagctgtaagtgtcgtgacgagctgggcgcccagcccttcttaagctgttctgtttctgtggctttaactgacatatttctgtagcatctgccttcatctcatctcagcgtaatgaaatattaatgaaatcgctgaaaagctttgccttcgagaggccagaagcctcgcggaatgtctgcaagtccaaagacgcgtgtgggttgtgccctgaagtgccgtccagcaggcgcgtgcggccgggccggcctgtgcgtgtggcctttgccttcttccctttcttcctgttttctgtttttttaatttggggattgagaaagctgtacgattttgttaaagaaaaaaataaaccattttttaaagttgtaaaaaaaaaaagcttt

SEQ ID NO: 418279 - DNA, 2702 bp, Homo sapiens
  misc_feature (72)..(72): n is a, c, g, or t
  misc_feature (81)..(81): n is a, c, g, or t
agcggactttctggagacccgccctcgccaacatggcggcgcccagttggggcgggttcgttcgcttcgcgntttggccanggcgggggtctgggctttaggcaggtagtatttagtttcacaatgtttggggacctgtttgaagaggagtattccactgtgtctaataatcagtatggaaaagggaagaaattaaagactaaagctttggagccacctgctcctagagaattcaccaatttaagcggaatcagaaatcagggtggaacctgttacctcaattcccttcttcagactcttcatttcacacctgaattcagagaagctctattttctcttggcccagaagagcttggtttgtttgaagataaggataaacccgatgcaaaggttcgaatcatccctttacagttacagcgcttgtttgctcagcttctgctcttagaccaggaagctgcatccacagcagacctcactgacagctttgggtggaccagtaatgaggaaatgaggcaacatgatgtgcaggaactgaatcgaatcctcttcagcgctttggaaacttctttagttgggacctccggtcatgacctcatctatcgtctgtaccatggaaccattgttaaccagattgtttgtaaagaatgtaagaacgttagcgagaggcaggaagacttcttagatctaacagtagcagtcaaaaatgtatccggtttggaagatgctctctggaacatgtatgtagaagaggaagtttttgattgtgacaacttgtaccactgtggaacttgtgacaggctggttaaagcagcaaagtcggccaaattacgtaagctgcctccttttcttactgtttcattactaagatttaattttgattttgtgaaatgcgaacgctacaaggaaactagctgttatacattccctctccggattaatctcaagcccttttgtgaacagagtgaattggatgacttagaatatatatatgacctcttctcagttattatacacaaaggtggctgctacggaggccattaccatgtatatattaaagatgttgatcatttgggaaactggcagtttcaagaggaaaaaagtaaaccagatgtgaatctgaaagatctccagagtgaagaagagattgatcatccactgatgattctaaaagcaatcttattagaggaggagaataatctaattcctgttgatcagctgggccagaaacttttgaaaaagataggaatatcttggaacaagaagtacagaaaacagcatggaccattgcggaagttcttacaggctccattctcagatatttctactcagttcagatgaaagtacagttcgtctcttgaagaatagttctctccaggctgagtctgatttccaaaggaatgaccagcaaattttcaagatgcttcctccagaatccccaggtttaaacaatagcatctcctgtccccactggtttgatataaatgattctaaagtccagccaatcagggaaaaggatattgaacagcaatttcagggtaaagaaagtgcctacatgttgttttatcggaaatcccagttgcagagaccccctgaagctcgagctaatccaagatatggggttccatgtcatttactgaatgaaatggatgcagctaacattgaactgcaaaccaaaagggcagaatgtgattctgcaaacaatacttttgaattgcatcttcacctgggccctcagtatcatttcttcaatggggctctgcacccagtagtctctcaaacagaaagcgtgtgggatttgacctttgataaaagaaaaactttaggagatctccggcagtcaatatttcagctgttagaattttgggaaggagacatggttcttagtgttgcaaagcttgtaccagcaggacttcacatttaccagtcacttggcggggatgaactgacactgtgtgaaactgaaattgctgatggggaagacatctttgtgtggaatggggtggaggttggtggagtccacattcaaactggtattgactgcgaacctctacttttaaatgttcttcatctagacacaagcagtgatggagaaaagtgttgtcaggtgatagaatctccacatgtctttccagctaatgcagaagtgggcactgtcctcacagccttagcaatcccagcaggtgtcatcttcatcaacagtgctggatgtccaggtggggagggttggacggccatccccaaggaagacatgaggaagacgttcagggagcaagggctcagaaatggaagctcaattttaattcaggattctcatgatgataacagcttgttgaccaaggaagagaaatgggtcactagtatgaatgagattgactggctccacgttaaaaatttatgccagttagaatctgaagagaagcaagttaaaatatcagcaactgttaacacaatggtgtttgatattcgaattaaagccataaaggaattaaaattaatgaaggaactaggtaatcatttacattttcttttcggttcttagtttagcttaattttggtcttgaattgaagaaaatataggagaatacaaaaaacagtttagggagaactcacatacctaccacccaaaatggacaaatattaacattttgtcatatgtttgtttttgtttgaaacattataaatgaagttaaagtcccctgtgt

SEQ ID NO: 418280 - DNA, 488 bp, Homo sapiens
attgtggtttatatttcctcataaaacagattttattgtatctttggtaaattcataaacttttcttatatttttctgatagattttaagctaaattatagttcaatttcaaaagaaggataatttagtgttatgaacttcacaacatctaatcaggagatctacatctttatttgtaatgttttagaaaacatatatctgattattcccaatatatatgtgagttgatgatgtgtttgtaaacctctgaaattgtttttcaatattatattcatgtctatttcaggaagacttcttagatctaacagtagcagtcaaaaatgtatccggtttggaagatgctctctggaacatgtatgtagaagaggaagtttttgattgtgacaacttgtaccactgtggaacttgtgacaggctggttaaagcagcaaaggtaaagacagataactgctttttcccagggtccccactttgtagttagtacaagt

SEQ ID NO: 418281 - DNA, 297 bp, Homo sapiens
ttaaaacagttttctcttggaattcatggtgacagaactgaatttttgctattgactgaaaaattaaagtgactaattgtggcacatagaagaaaaattgttactttggtgggatggagaactttattgtaagccagatatctttggtttgagataaaacacagtgtctgttataaaaacacagtatttatgtatttttgtgcctctttaaagggcagaatgtgattctgcaaacaatacttttgaattgcatcttcacctgggccctcagtatcatttcttcaatggggctctgca

SEQ ID NO: 418282 - DNA, 477 bp, Homo sapiens
cagaggctcttgagtggaattttaataacctatttacaatatcaaaacatggcaatgtatttcagaaacacaaaataagtttcaagttccttgtaaacatcccgctctgtcctttggaaggtgcttctgggaacgagcctgcgcaagtttctctcctctacttgggagacatagagatctcagaagatgccacgctggcggagctgaagtctcaggtcagacttcttcctgcaccataacttagtggtaatgtggcttcttccagtgagatattaatatattcttctatctccttttccctcaattacagtctgttctgatatggcatttgtcatatgccatgttcagtggtaagtacccgcaggcaatacacgcccatggtgcagacggctcctcgtggcctcactggtccctcctctgacaggcatgctgtgcttttgtttcaatctatcctcagtgacttgcggcttttgttca

SEQ ID NO: 418283 - DNA, 540 bp, Homo sapiens
ctgtctgtgcaattgcaaatgcacgtccttgtggcctataaaattggagtgtattttggggtcttcgtgaacccctcaccctgacacccactgcatccatgagtcaatgacagtgtctgtgtctctgcagccaagaagccctccatgagcagagcagctacatcctctccagtgcagagacgcctgcccggccccgagccccggaaacttctctctccatccacgtggggagcttcagataaccgcgccgctgcacggctctactcccgatgaactctccggctgatgccacaaacgtgggtttcctgggcatggggactggctgcctggcgcctccaatcccaaatcctctgcttcctttgagcacagggacggctcctctgaggcctggccagtgcatgtagtcacttagctctgcaacacgtggcagccacgggggctggtgcagctctggatgtcgcccacccagctgccagtaggtgctgggctctctcacacagcacccggccccagctgcctttttttttcttttaaccagaa

SEQ ID NO: 418284 - DNA, 448 bp, Homo sapiens
actgtcccaagttgctaagtgaacagaactatctcagcatcagaatgagaaagcctgagaagaaagaaccaaccacaagcacacaggaaggaaagcgcaggaggtgaaaatgcttttttggccagggtagtaagaattagaggttaatgcagggactgtaaaaccaccttttctgcttcaatatctaattcctgtgtagctttgttcattgcatttattaaacaaatgttgtataaccaatactaaatgtactactgagcttcggtgagttaagttatgaaactttcaaatccttcatcatgtcagttccaatgaggtggggatgcaccacccatgtgcgcccccataaccccacccctgcccaccccacccccacccccaccaagggcgcaagagtagcggtccaagcctgcaactcatctttcattaaaggcttctctctcaccag

SEQ ID NO: 418285 - DNA, 786 bp, Homo sapiens
cctcagagaaccccaggctgaggccccacacacagagggggatccaggttgagacccccagagaagagtcctggattgaaatccctctgtgggttctcagactcccaagactaagtttctcactgagggtcctctcagtgaggccccatggaggagccacagactaagaccccctcagcagaattccccccttaccgggctcaaccagcacagccagccacagctccagcagccacatttgcaaccttggccatctgtccagaacctgctcccacctcaggcccaggccaaccgtgcactgctgcaatgggctctgagctggagacggcgatggagaccctcatcaacgtgttccacgcccactcgggcaaagagggggacaagtacaagctgagcaagaaggagctgaaagagctgctgcagacggagctctctggcttcctggatgcccagaaggatgtggatgctgtggacaaggtgatgaaggagctagacgagaatggagacggggaggtggacttccaggagtatgtggtgcttgtggctgctctcacagtggcctgtaacaatttcttctgggagaacagttgagcagacagccacattgggcagcgcccttcctctccaccctcccagacctgcctcttccccctgcttccacctcaccccacttatccctctccataaccccacccctgcccaccccacccccacccccaccaagggcgcaagagtagcggtccaagcctgcaactcatctttcattaaaggcttctctctcaccag

SEQ ID NO: 418286 - DNA, 627 bp, Homo sapiens
  misc_feature (69)..(70): n is a, c, g, or t
  misc_feature (74)..(75): n is a, c, g, or t
  misc_feature (82)..(82): n is a, c, g, or t
actagttctagatcgcgatctagaactagtcggacgcgtgggtccggacgcgtgggtcgacccacgcgnncgcnnacgcgtnggaccttggccatctgtccagaacctgctcccacctcaggcccaggccaaccgtgcactgctgcaatgggctctgagctggagacggcgatggagaccctcatcaacgtgttccacgcccactcgggcaaagagggggacaagtacaagctgagcaagaaggagctgaaagagctgctgcagacggagctctctggcttcctggatgcccagaaggatgtggatgctgtggacaaggtgatgaaggagctagacgagaatggagacggggaggtggacttccaggagtatgtggtgcttgtggctgctctcacagtggcctgtaacaatttcttctgggagaacagttgagcagacagccacattgggcagcgcccttcctctccaccctcccagacctgcctcttccccctgcttccacctcaccccacttatccctctccataaccccacccctgcccaccccacccccacccccaccaagggcgcaagagtagcggtccaagcctgcaactcatctttcattaaaggcttctctctcaccag

SEQ ID NO: 418287 - DNA, 934 bp, Homo sapiens
cctcagagaaccccaggctgaggccccacacacagagggggatccaggttgagacccccagagaagagtcctggattgaaatccctctgtgggttctcagactcccaagactaagtttctcactgagggtcctctcagtgaggccccatggaggagccacagactaagaccccctcagcagaattccccccttaccgggctcaaccagcacagccagccacagctccagcagccacatttgcaaccttggccatctgtccagaacctgctcccacctcaggcccaggccaaccgtgcactgctgcaatgggctctgagctggagacggcgatggagaccctcatcaacgtgttccacgcccactcgggcaaagagggggacaagtacaagctgagcaagaaggagctgaaagagctgctgcagacggagctctctggcttcctggatgcccagaaggatgtggatgctgtggacaaggtgatgaaggagctagacgagaatggagacggggaggtggacttccaggagtatgtggtgcttgtggctgctctcacagtggcctgtaacaatttcttctgggagaacagttgagcagacagccacattgggcagcgcccttcctctccaccctcccagacctgcctcttccccctgcttccacctcaccccacttatccctctccataaccccacccctgcccaccccacccccacccccaccaagggcgcaagagtagcggtccaagcctgcaactcatctttcattaaaggcttctctctcaccaggtttcgccttcgattattcacgattcgttcacttgctttccgaccttctcttgatcttagttcttctactacgcattctctcgtcccgattccaaatcttctctccgtctttctcttcttcaacttccttcttcacttccctaccccg

SEQ ID NO: 418288 - DNA, 604 bp, Homo sapiens
  misc_feature (69)..(70): n is a, c, g, or t
  misc_feature (74)..(75): n is a, c, g, or t
  misc_feature (82)..(82): n is a, c, g, or t
actagttctagatcgcgatctagaactagtcggacgcgtgggtccggacgcgtgggtcgacccacgcgnncgcnnacgcgtnggacccacgcgtccgcggacgcgtgggtcgtgcactgctgcaatgggctctgagctggagacggcgatggagaccctcatcaacgtgttccacgcccactcgggcaaagagggggacaagtacaagctgagcaagaaggagctgaaagagctgctgcagacggagctctctggcttcctggatgcccagaaggatgtggatgctgtggacaaggtgatgaaggagctagacgagaatggagacggggaggtggacttccaggagtatgtggtgcttgtggctgctctcacagtggcctgtaacaatttcttctgggagaacagttgagcagacagccacattgggcagcgcccttcctctccaccctcccagacctgcctcttccccctgcttccacctcaccccacttatccctctccataaccccacccctgcccaccccacccccacccccaccaagggcgcaagagtagcggtccaagcctgcaactcatctttcattaaaggcttctctctcaccag

SEQ ID NO: 418289 - DNA, 946 bp, Homo sapiens
cctcagagaaccccaggctgaggccccacacacagagggggatccaggttgagacccccagagaagagtcctggattgaaatccctctgtgggttctcagactcccaagactaagtttctcactgagggtcctctcagtgaggccccatggaggagccacagactaagaccccctcagcagaattccccccttaccgggctcaaccagcacagccagccacagctccagcagccacatttgcaaccttggccatctgtccagaacctgctcccacctcaggcccaggccaaccgtgcactgctgcaatgggctctgagctggagacggcgatggagaccctcatcaacgtgttccacgcccactcgggcaaagagggggacaagtacaagctgagcaagaaggagctgaaagagctgctgcagacggagctctctggcttcctggatgcccagaaggatgtggatgctgtggacaaggtgatgaaggagctagacgagaatggagacggggaggtggacttccaggagtatgtggtgcttgtggctgctctcacagtggcctgtaacaatttcttctgggagaacagttgagcagacagccacattgggcagcgcccttcctctccaccctcccagacctgcctcttccccctgcttccacctcaccccacttatccctctattacgaccatctatcccgtatatataccatctcccatttatcaccaacacagtgggcaggtaaataagtgggaaggagaaggaagtgttctctgtctcttcctcactttgactggtcttattcccacatggtttctttagccaggactgttctactcagcctctgttggaagaaaacttcccacagggctgcactagcacagccagcctttgcttttacagcctgctcttgcctatttaccataccagtgtatgtatccttcca

SEQ ID NO: 418290 - DNA, 738 bp, Homo sapiens
gtctcggctctacctggttctctcggctctacctgtctctcggctctaccttgtctcccgtgcactgctgcaatgggctctgagctggagacggcgatggagaccctcatcaacgtgttccacgcccactcgggcaaagagggggacaagtacaagctgagcaagaaggagctgaaagagctgctgcagacggagctctctggcttcctggatgtgaaagagcttatgctgtaggcaacagaagccctcaagacctttgaggaggcctagaagagtcccataattcaatgcagttcctctcgctcatctttgcctcctgctcctcaaccacccccttgcctctgactcagtgctgtacccttccctatacacctccctcttcctctcctcccaccacaggcccagaaggatgtggatgctgtggacaaggtgatgaaggagctagacgagaatggagacggggaggtggacttccaggagtatgtggtgcttgtggctgctctcacagtggcctgtaacaatttcttctgggagaacagttgagcagacagccacattgggcagcgcccttcctctccaccctcccagacctgcctcttccccctgcttccacctcaccccacttatccctctccataaccccacccctgcccaccccacccccacccccaccaagggcgcaagagtagcggtccaagcctgcaactcatctttcattaaaggcttctctctcaccag

SEQ ID NO: 418291 - DNA, 605 bp, Homo sapiens
taaagctcctagtgtagtgcttgctttattataggcactgaacatacggtaactggtgtcattattattcattctgccaggtgaaagagcttatgctgtaggcaacagaagccctcaagacctttgaggaggcctagaagagtcccataattcaatgcagttcctctcgctcatctttgcctcctgctcctcaaccacccccttgcctctgactcagtgctgtacccttccctatacacctccctcttcctctcctcccaccacaggcccagaaggatgtggatgctgtggacaaggtgatgaaggagctagacgagaatggagacggggaggtggacttccaggagtatgtggtgcttgtggctgctctcacagtggcctgtaacaatttcttctgggagaacagttgagcagacagccacattgggcagcgcccttcctctccaccctcccagacctgcctcttccccctgcttccacctcaccccacttatccctctccataaccccacccctgcccaccccacccccacccccaccaagggcgcaagagtagcggtccaagcctgcaactcatctttcattaaaggcttctctctcaccag

SEQ ID NO: 418292 - DNA, 972 bp, Homo sapiens
  misc_feature (69)..(70): n is a, c, g, or t
  misc_feature (74)..(75): n is a, c, g, or t
  misc_feature (82)..(82): n is a, c, g, or t
  misc_feature (696)..(696): n is a, c, g, or t
  misc_feature (702)..(702): n is a, c, g, or t
  misc_feature (705)..(705): n is a, c, g, or t
  misc_feature (709)..(710): n is a, c, g, or t
  misc_feature (719)..(720): n is a, c, g, or t
  misc_feature (760)..(761): n is a, c, g, or t
actagttctagatcgcgatctagaactagtcggacgcgtgggtccggacgcgtgggtcgacccacgcgnncgcnnacgcgtnggaccttggccatctgtccagaacctgctcccacctcaggcccaggccaaccgtgcactgctgcaatgggctctgagctggagacggcgatggagaccctcatcaacgtgttccacgcccactcgggcaaagagggggacaagtacaagctgagcaagaaggagctgaaagagctgctgcagacggagctctctggcttcctggatgcccagaaggatgtggatgctgtggacaaggtgatgaaggagctagacgagaatggagacggggaggtggacttccaggagtatgtggtgcttgtggctgctctcacagtggcctgtaacaatttcttctgggagaacagttgagcagacagccacattgggcagcgcccttcctctccaccacatcccagacctgacttcattccaccctgctatacatctaaccacacattatacctctccaataaaccccacaccataaccaaccacaaaagaaaaaaacaacaaaaaaagcaaaaatacaaaacacaaacaaggaacaacataaacacataaagggatccagcgcaacaggacggacgcacagaagacgagaaaaaaaaaagaggggccgaaaaaaaacgaggnaagganaangaannaaagaaagnnaggaaagggaagaagaaagaaggggcggggaacaaaaaanngggggagaacagggaagcaaacagcaacaaggggaagggccattcctagccaccctcccagacctgcctcttccccctgcttccacctcaccccacttatccctctccataaccccacccctgcccaccccacccccacccccaccaagggcgcaagagtagcggtccaagcctgcaactcatctttcattaaaggcttctctctcaccag

SEQ ID NO: 418293 - DNA, 499 bp, Homo sapiens
  misc_feature (69)..(70): n is a, c, g, or t
  misc_feature (74)..(75): n is a, c, g, or t
  misc_feature (82)..(82): n is a, c, g, or t
actagttctagatcgcgatctagaactagtcggacgcgtgggtccggacgcgtgggtcgacccacgcgnncgcnnacgcgtnggaccttggccatctgtccagaacctgctcccacctcaggcccaggccaaccgtgcactgctgcaatgggctctgagctggagacggcgatggagaccctcatcaacgtgttccacgcccactcgggcaaagagggggacaagtacaagctgagcaagaaggagctgaaagagctgctgcagacggagctctctggcttcctggatgcccagaaggatgtggatgctgtggacaaggtgatgaaggagctagacgagaatggagacggggaggtggacttccaggagtatgtggtgcttgtggctgctctcacagtggcctgtaacaatttcttctgggagaacagtttgatgcaagaccaggccactatttgggggcaaggtgtcctcctttccttttgttgccaaacgcattttc

SEQ ID NO: 418294 - DNA, 890 bp, Homo sapiens
  misc_feature (614)..(614): n is a, c, g, or t
  misc_feature (620)..(620): n is a, c, g, or t
  misc_feature (623)..(623): n is a, c, g, or t
  misc_feature (627)..(628): n is a, c, g, or t
  misc_feature (637)..(638): n is a, c, g, or t
  misc_feature (678)..(679): n is a, c, g, or t
ggctccctgaagtatctcgggcccctcggggtgcacaagcaacacgaggcaggtgcactgctgcaatgggctctgagctggagacggcgatggagaccctcatcaacgtgttccacgcccactcgggcaaagagggggacaagtacaagctgagcaagaaggagctgaaagagctgctgcagacggagctctctggcttcctggatgcccagaaggatgtggatgctgtggacaaggtgatgaaggagctagacgagaatggagacggggaggtggacttccaggagtatgtggtgcttgtggctgctctcacagtggcctgtaacaatttcttctgggagaacagttgagcagacagccacattgggcagcgcccttcctctccaccacatcccagacctgacttcattccaccctgctatacatctaaccacacattatacctctccaataaaccccacaccataaccaaccacaaaagaaaaaaacaacaaaaaaagcaaaaatacaaaacacaaacaaggaacaacataaacacataaagggatccagcgcaacaggacggacgcacagaagacgagaaaaaaaaaagaggggccgaaaaaaaacgaggnaagganaangaannaaagaaagnnaggaaagggaagaagaaagaaggggcggggaacaaaaaanngggggagaacagggaagcaaacagcaacaaggggaagggccattcctagccaccctcccagacctgcctcttccccctgcttccacctcaccccacttatccctctccataaccccacccctgcccaccccacccccacccccaccaagggcgcaagagtagcggtccaagcctgcaactcatctttcattaaaggcttctctctcaccag

SEQ ID NO: 418295 - DNA, 593 bp, Homo sapiens
ggactgttgaagacaggtctccacacacagctccagcagccacatttgcaaccttggccatctgtccagaacctgctcccacctcaggcccaggccaaccgtgcactgctgcaatgggctctgagctggagacggcgatggagaccctcatcaacgtgttccacgcccactcgggcaaagagggggacaagtacaagctgagcaagaaggagctgaaagagctgctgcagacggagctctctggcttcctggatgcccagaaggatgtggatgctgtggacaaggtgatgaaggagctagacgagaatggagacggggaggtggacttccaggagtatgtggtgcttgtggctgctctcacagtggcctgtaacaatttcttctgggagaacagttgagcagacagccacattgggcagcgcccttcctctccaccctcccagacctgcctcttccccctgcttccacctcaccccacttatccctctccataaccccacccctgcccaccccacccccacccccaccaagggcgcaagagtagcggtccaagcctgcaactcatctttcattaaaggcttctctctcaccag

SEQ ID NO: 418296 - DNA, 1131 bp, Homo sapiens
cctcagagaaccccaggctgaggccccacacacagagggggatccaggttgagacccccagagaagagtcctggattgaaatccctctgtgggttctcagactcccaagactaagtttctcactgagggtcctctcagtgaggccccatggaggagccacagactaagaccccctcagcagaattccccccttaccgggctcaaccagcacagccagccacagctccagcagccacatttgcaaccttggccatctgtccagaacctgctcccacctcaggcccaggccaaccgtgcactgctgcaatgggctctgagctggagacggcgatggagaccctcatcaacgtgttccacgcccactcgggcaaagagggggacaagtacaagctgagcaagaaggagctgaaagagctgctgcagacggagctctctggcttcctggatgcccagaaggatgtggatgctgtggacaaggtgatgaaggagctagacgagaatggagacggggaggtggacttccaggagtatgtggtgcttgtggctgctctcacagtggcctgtaacaatttcttctgggagaacagttgagcagacagccacattgggcagcgcccttcctctccaccctcccagacctgcctcttccccctgcttccacctcaccccacttatccctctccataaccccacccctgcccaccccacccccacccccaccaagggcgcaagagtagcggtccaagcctgcaactcatctttcattaaaggcttctctctcaccagaaaaaaaatgcttacagttaataatacaccgagttattaccgatcaacaagtaacaccgatacccaagtgacctaacaagaacaagaaaagccgcctccatgggggacgccaaggagttggcggaccaagagcctggaatagccatatacgccataacaggggcgtcacctgctcaaccaaacacgcacaccgggaatccagttgtgaataaggacagcaatagagctatagagacttcacgcagccacagagttagcagataatcgggcattattcatgatgcactagagccagacacgacatacactattttagtactcatgaaccacgcaccgaaccgcatc

SEQ ID NO: 418297 - DNA, 813 bp, Homo sapiens
  misc_feature (69)..(70): n is a, c, g, or t
  misc_feature (74)..(75): n is a, c, g, or t
  misc_feature (82)..(82): n is a, c, g, or t
actagttctagatcgcgatctagaactagtcggacgcgtgggtccggacgcgtgggtcgacccacgcgnncgcnnacgcgtnggaccttggccatctgtccagaacctgctcccacctcaggcccaggccaaccgtgcactgctgcaatgggctctgagctggagacggcgatggagaccctcatcaacgtgttccacgcccactcgggcaaagagggggacaagtacaagctgagcaagaaggagctgaaagagctgctgcagacggagctctctggcttcctggatgtgaaagagcttatgctgtaggcaacagaagccctcaagacctttgaggaggcctagaagagtcccataattcaatgcagttcctctcgctcatctttgcctcctgctcctcaaccacccccttgcctctgactcagtgctgtacccttccctatacacctccctcttcctctcctcccaccacaggcccagaaggatgtggatgctgtggacaaggtgatgaaggagctagacgagaatggagacggggaggtggacttccaggagtatgtggtgcttgtggctgctctcacagtggcctgtaacaatttcttctgggagaacagttgagcagacagccacattgggcagcgcccttcctctccaccctcccagacctgcctcttccccctgcttccacctcaccccacttatccctctccataaccccacccctgcccaccccacccccacccccaccaagggcgcaagagtagcggtccaagcctgcaactcatctttcattaaaggcttctctctcaccag

SEQ ID NO: 418298 - DNA, 713 bp, Homo sapiens
  misc_feature (69)..(70): n is a, c, g, or t
  misc_feature (74)..(75): n is a, c, g, or t
  misc_feature (82)..(82): n is a, c, g, or t
actagttctagatcgcgatctagaactagtcggacgcgtgggtccggacgcgtgggtcgacccacgcgnncgcnnacgcgtnggaccttggccatctgtccagaacctgctcccacctcaggcccaggccaaccggagccctcaagtccctgccaaggccccctctgtctcccaggtgttgggaagggtcccagccctcccctgcctcgcctcctgtggggtgcactgctgcaatgggctctgagctggagacggcgatggagaccctcatcaacgtgttccacgcccactcgggcaaagagggggacaagtacaagctgagcaagaaggagctgaaagagctgctgcagacggagctctctggcttcctggatgcccagaaggatgtggatgctgtggacaaggtgatgaaggagctagacgagaatggagacggggaggtggacttccaggagtatgtggtgcttgtggctgctctcacagtggcctgtaacaatttcttctgggagaacagttgagcagacagccacattgggcagcgcccttcctctccaccctcccagacctgcctcttccccctgcttccacctcaccccacttatccctctccataaccccacccctgcccaccccacccccacccccaccaagggcgcaagagtagcggtccaagcctgcaactcatctttcattaaaggcttctctctcaccag

SEQ ID NO: 418299 - DNA, 849 bp, Homo sapiens
cctcagagaaccccaggctgaggccccacacacagagggggatccaggttgagacccccagagaagagtcctggattgaaatccctctgtgggttctcagactcccaagactaagtttctcactgagggtcctctcagtgaggccccatggaggagccacagactaagaccccctcagcagaattccccccttaccgggctcaaccagcacagccagccacagctccagcagccacatttgcaaccttggccatctgtccagaacctgctcccacctcaggcccaggccaaccgtgcactgctgcaatgggctctgagctggagacggcgatggagaccctcatcaacgtgttccacgcccactcgggcaaagagggggacaagtacaagctgagcaagaaggagctgaaagagctgctgcagacggagctctctggcttcctggatgcccagaaggatgtggatgctgtggacaaggtgatgaaggagctagacgagaatggagacggggaggtggacttccaggagtatgtggtgcttgtggctgctctcacagtggcctgtaacaatttcttctgggagaacagttgagcagacagccacattgggcagcgcccttcctctccaccctcccagacctgcctcttccccctgcttccacctcaccccacttatccctcttggctgatgcccttgcacatggagctgatgtcgactgggtcaaagggggacaagataatgccacaccgagtgatccaggccacagctgctacttctcttctggcctgtgagtatctcatccagaacggggcgaacgtgaaccaagcggacagtgcgggcaggggccag

SEQ ID NO: 418300 - DNA, 516 bp, Homo sapiens
aagggcaggccgggtgagcagacggatcggccgactagacagccaaccagcaacaacgaactgagctcgcatactaccgcttacgcatctaaccaaccgcccatctagctaacccgagcccctccaccgtcaactcaggttcggccggtccccggcccgcctgccggagccgtggtggcagccccgggaggagcactggcgtctgtttccttcggtgagctagacgagaatggagacggggaggtggacttccaggagtatgtggtgcttgtggctgctctcacagtggcctgtaacaatttcttctgggagaacagttgagcagacagccacattgggcagcgcccttcctctccaccctcccagacctgcctcttccccctgcttccacctcaccccacttatccctctccataaccccacccctgcccaccccacccccacccccaccaagggcgcaagagtagcggtccaagcctgcaactcatctttcattaaaggcttctctctcaccag

SEQ ID NO: 418301 - DNA, 572 bp, Homo sapiens
  misc_feature (69)..(70): n is a, c, g, or t
  misc_feature (74)..(75): n is a, c, g, or t
  misc_feature (82)..(82): n is a, c, g, or t
actagttctagatcgcgatctagaactagtcggacgcgtgggtccggacgcgtgggtcgacccacgcgnncgcnnacgcgtnggaccttggccatctgtccagaacctgctcccacctcaggcccaggccaaccgtgcactgctgcaatgggctctgagctggagacggcgatggagaccctcatcaacgtgttccacgcccactcgggcaaagagggggacaagtacaagctgagcaagaaggagctgaaagagctgctgcagacggagctctctggcttcctggatgcccagaaggatgtggatgctgtggacaaggtgatgaaggagctagacgagaatggagacgtaacaatttcttctgggagaacagttgagcagacagccacattgggcagcgcccttcctctccaccctcccagacctgcctcttccccctgcttccacctcaccccacttatccctctccataaccccacccctgcccaccccacccccacccccaccaagggcgcaagagtagcggtccaagcctgcaactcatctttcattaaaggcttctctctcaccag

SEQ ID NO: 418302 - DNA, 600 bp, Homo sapiens
  misc_feature (77)..(77): n is a, c, g, or t
ggagcttccggatagctgaacgcatggaggctgacaggacagtgaaggagaactcatccacgcgctgggcagtggtngcaccccaactccacaggaacggaagctcctccagatcttgccttgtgttatctttccatctggctatttatttgcatcctttttaaatgtaagtaagtgcttccatgagttccgtgagctcctccagcaaattaatcaaccccgaagagggtggggtcatggtaaccccaacttgaagccagctggtcagacattctggaagcccagactcgtgactggtgggaaggagggagcagttctgtggaactgattcctcaacctgtggtttctgaggctatttccaggtagatggtgtcacagttgaattaactggtggacacccggctgtgtccactgcagaactaattgcttacttggtgtgtgggaagaaacccctacatattttgtcacagaagtcttctgtattattatggtgtaagagaacaggaaaaatgcatgttgactgttttttccacactccagcctgggcaacagagtgagactccatctaaaacaaacacgcacacaccaccaccaccccac

SEQ ID NO: 418303 - DNA, 707 bp, Homo sapiens
ggagcttccggatagctgaacgcatggaggctgacaggacatgaagggatgtgtgaaaaggtaggaatgagtgggtaagcggaggaggacagtgctgctcacagaagttcatgagctaaatggtaaagtgagtcctaggcctttgatggatacgagggaaagaaggtatgttactccctcagccttacccataggagaagtaatgtgaactgattttaggagcaaacaggaaacttacccccaaatctcactctagtatactagaaatcctttacttttgtatcttttaactaaaaaaaaaaaaaaaaaaaataaaaacaaaaccatggttctgggcgcgccctgtgggcccttcagaagaacgttttttaaaaaccactgtctgtttgtggcgcgcgcgcggggcgcccatgtatggtgatagtgtgtgacaacgtgtctggcaatagcgcggtgttcccctgaaaggaacaccgtgggacagagcgacaaaacaagggtgtgcgtggggaatttctcctaccaccatatataaaagaaaagcgccccggggggggacaacaagcggagtgttgctctgtgaagacaaaaactctcccaaaatggggaattccgagagaggggactcaaaaacacggggggacctcttatcagcaaggagagagctcccaaggcagacagacctaagattattcaaaattaagccc

SEQ ID NO: 418304 - DNA, 2690 bp, Homo sapiens
  misc_feature (77)..(77): n is a, c, g, or t
ggagcttccggatagctgaacgcatggaggctgacaggacagtgaaggagaactcatccacgcgctgggcagtggtngcaccccaactccacaggaacggaagctcctccagatcttgccttgtgttatctttccatctggctatttatttgcatcctttttaaatgtaagtaagtgcttccatgagttccgtgagctcctccagcaaattaatcaaccccgaagagggtggggtcatggtaaccccaacttgaagccagctggtcagacattctggaagcccagactcgtgactggtgggaaggagggagcagttctgtggaactgattcctcaacctgtggtttctgaggctatttccaggtagatggtgtcacagttgaattaactggtggacacccggctgtgtccactgcagaactaattgcttacttggtgtgtgggaagaaacccctacatattttgtcacagaagtcttctgtattattatggtgtaagagaacaggaaaaatgcatgttgactgttttttccacactcccagtccacaaaagttttctccacttatgaacaaataatgtgtgtgtgtgtttttttgtttttttgtttttttgtttttcctgagacagggtctcactctgtcatccaggctggggtgcagtggtgtgatcatggctcactgcagcttcaatctcccaggtccaagtgatccttctacctcagcctcccaagtagctgggaccacaggtgtgtgccaccatacccagttaatttttaaattttttgtagagacagggtctccctatgttgcccaggctggttttgaacttctgaagcgatcctctcacctcagcctccaaaagtcctgggataacaggcatgagccactgtgcctggccatgaatacaaagaattttaacagacacaagatgcagatatgaaggaatagatgaatgaatagacgcgtgctggacaggatggagtgaagggatgtgtgaaaaggtaggaatgagtgggtaagcggaggaggacagtgctgctcacagaagttcatgagctaaatggtaaagtgagtcctaggcctttgatggatacgagggaaagaaggtatgttactccctcagccttacccataggagaagtaatgtgaactgattttaggagcaaacaggaaacttacccccaaatctcactctagtatactagaaatcctttacttttgtatcttttaactaagagggaaataaataacattgtcagaccctcatttcacagatgaggaaacttaggcctacaaagggcaagtggtttgccaaaatgtaacaagtgggtttggagctacaatgggactagagcttaggtctcttaattcccattccttgctcttttcaccacccaaagctgacactagaaggaatgactacggtgcagaatttccaaaccctaatttgaggaaattccccaaggggactttttcatgcaagctggagagcctcaaaaatgcaatgaatgcctaggaaggttctaagggccctaatattctaacctgaacactagaaagcagggcaagcagcatagtggggaagcaggggactgggacccccgtccctgagaatggaagtaataggcaagaagccaaggggcttcccaggacaagctaaaaaagagcagatccagactacaactacagaatcctgtaagattctgaaactttgtcacttcctttctaaggcttccttcctaagcctctctgtgaaactctttgaaaaggggtatgtgggctagcctgcaaggacagccagaagggagaaggatcacatccccctccgtggccaggctctgagagacagaaatccagtgaaggacagagcatggggctgagtgtctgtagcccactgcattgagggcaggagagctcagggcaggtctgagtcatcaccattttctgtgtgtttcttcctaataagtgaaataatgtgtagtgtctagcacggtgcctgacagctcacagaaaatccccaacttcccctcccccaccgccatgccttctaactctcggtgagatgaacatctctactgggaggggaagccattgagggaagaaatgctggcaccttgacatttggggaaagaaagggaaggaattgttttccaagtatctactttgtgccagaaatggtgttgggcaatttactgattgcctcatttaatcctttgacgtatcctaggagttaggtattctcagccccatttccagaaagcaaaccaaggtgaaaaagagttaataatttgttcaaagacatatggaaaagtgccaggcatggtggctcacgcctgtaatcctagcactttgggaggccaaggcgggcagatcacttgaggtcaggagttcaagaccagcctggccaacaaggcgaaatgctgtctcgactaaaaatacaaaaattagccagaaatcacttgaatctgggaggcggaagttgcagtaagccaagatcgtgccactgcactccagcctgggcaacagagtgagactccatctaaaaaaaaaaaaaaaaagtcatacagaaagggttggatgtggtggctcacacctgtaatcccagcactttgggaggccaaagtgagaggatcacgtgaagctaggagtttgagaccagcctaggcaacatagtgagatcccctctttaggg

SEQ ID NO: 418305 - DNA, 2267 bp, Homo sapiens
  misc_feature (77)..(77): n is a, c, g, or t
ggagcttccggatagctgaacgcatggaggctgacaggacagtgaaggagaactcatccacgcgctgggcagtggtngcaccccaactccacaggaacggaagctcctccagatcttgccttgtgttatctttccatctggctatttatttgcatcctttttaaatgtaagtaagtgcttccatgagttccgtgagctcctccagcaaattaatcaaccccgaagagggtggggtcatggtaaccccaacttgaagccagctggtcagacattctggaagcccagactcgtgactggtgggaaggagggagcagttctgtggaactgattcctcaacctgtggtttctgaggctatttccaggtagatggtgtcacagttgaattaactggtggacacccggctgtgtccactgcagaactaattgcttacttggtgtgtgggaagaaacccctacatattttgtcacagaagtcttctgtattattatggtgtaagagaacaggaaaaatgcatgttgactgttttttccacactcccagtccacaaaagttttctccacttatgaacaaataatgtgtgtgtgtgtttttttgtttttttgtttttttgtttttcctgagacagggtctcactctgtcatccaggctggggtgcagtggtgtgatcatggctcactgcagcttcaatctcccaggtccaagtgatccttctacctcagcctcccaagtagctgggaccacaggtgtgtgccaccatacccagttaatttttaaattttttgtagagacagggtctccctatgttgcccaggctggttttgaacttctgaagcgatcctctcacctcagcctccaaaagtcctgggataacaggcatgagccactgtgcctggccatgaatacaaagaattttaacagacacaagatgcagatatgaaggaatagatgaatgaatagacgcgtgctggacaggatggagtgaagggatgtgtgaaaaggtaggaatgagtgggtaagcggaggaggacagtgctgctcacagaagttcatgagctaaatggtaaagtgagtcctaggcctttgatggatacgagggaaagaaggtatgttactccctcagccttacccataggagaagtaatgtgaactgattttaggagcaaacaggaaacttacccccaaatctcactctagtatactagaaatcctttacttttgtatcttttaactaagagggaaataaataacattgtcagaccctcatttcacagatgaggaaacttaggcctacaaagggcaagtggtttgccaaaatgtaacaagtgggtttggagctacaatgggactagagcttaggtctcttaattcccattccttgctcttttcaccacccaaagctgacactagaaggaatgactacggtgcagaatttccaaaccctaatttgaggaaattccccaaggggactttttcatgcaagctggagagcctcaaaaatgcaatgaatgcctaggaaggttctaagggccctaatattctaacctgaacactagaaagcagggcaagcagcatagtggggaagcaggggactgggacccccgtccctgagaatggaagtaataggcaagaagccaaggggcttcccaggacaagctaaaaaagagcagatccagactacaactacagaatcctgtaagattctgaaactttgtcacttcctttctaaggcttccttcctaagcctctctgtgaaactctttgaaaaggggtatgtgggctagcctgcaaggacagccagaagggagaaggatcacatccccctccgtggccaggctctgagagacagaaatccagtgaaggacagagcatggggctgagtgtctgtagcccactgcattgagggcaggagagctcagggcaggtctgagtcatcaccattttctgtgtgtttcttcctaataagtgaaataatgtgtagtgtctagcacggtgcctgacagctcacagaaaatccccaacttcccctcccccaccgccatgccttctaactctcggtgagatgaacatctctactgggaggggaagccattgagggaagaaatgctggcaccttgacatttggggaaagaaagggaaggaattgttttccaagtatctactttgtgccagaaatggtgttgggcaatttactgattgcctcatttaatcctttgacgtatcctaggagttaggtattctcagcggctcaaacggtaccggctcattc

SEQ ID NO: 418306 - DNA, 821 bp, Homo sapiens
  misc_feature (77)..(77): n is a, c, g, or t
ggagcttccggatagctgaacgcatggaggctgacaggacagtgaaggagaactcatccacgcgctgggcagtggtngcaccccaactccacaggaacggaagctcctccagatcttgccttgtgttatctttccatctggctatttatttgcatcctttttaaatgtaagtaagtgcttccatgagttccgtgagctcctccagcaaattaatcaaccccgaagagggtggggtcatggtaaccccaacttgaagccagctggtcagacattctggaagcccagactcgtgactggtgggaaggagggagcagttctgtggaactgattcctcaacctgtggtttctgaggctatttccaggtagatggtgtcacagttgaattaactggtggacacccggctgtgtccactgcagaactaattgcttacttggtgtgtgggaagaaacccctacatattttgtcacagaagtcttctgtattattatggtgtaagagaacaggaaaaatgcatgttgactgttttttccacactcccagtccacaaaagttttctccacttatgaacaaataatgtgtgtgtgtgtttttttgtttttttgtttttttgtttttcctgagacagggtctcactctgtcatccaggctggggtgcagtggtgtgatcatggctcactgcagcttcaatctcccaggtccaagtgatccttctacctcagcctcccaagtagctgggaccacaggtgtgtgccaccatacccagttaatttttaaattttttgtagagacagggcaacatagtgagatcccctctttaggg

SEQ ID NO: 418307 - DNA, 812 bp, Homo sapiens
  misc_feature (77)..(77): n is a, c, g, or t
ggagcttccggatagctgaacgcatggaggctgacaggacagtgaaggagaactcatccacgcgctgggcagtggtngcaccccaactccacaggaacggaagctcctccagatcttgccttgtgttatctttccatctggctatttatttgcatcctttttaaatgtaagtaagtgcttccatgagttccgtgagctcctccagcaaattaatcaaccccgaagagggtggggtcatggtaaccccaacttgaagccagctggtcagacattctggaagcccagactcgtgactggtgggaaggagggagcagttctgtggaactgattcctcaacctgtggtttctgaggctatttccaggtagatggtgtcacagttgaattaactggtggacacccggctgtgtccactgcagaactaattgcttacttggtgtgtgggaagaaacccctacatattttgtcacagaagtcttctgtattattatggtgtaagagaacaggaaaaatgcatgttgactgttttttccacactcccagtccacaaaagttttctccacttatgaacaaataatgtgtgtgtgtgtttttttgtttttttgtttttttgtttttcctgagacagggttccagcctgggcaacagagtgagactccatctaaaaaaaaaaaaaaaaagtcatacagaaagggttggatgtggtggctcacacctgtaatcccagcactttgggaggccaaagtgagaggatcacgtgaagctaggagtttgagaccagcctaggcaacatagtgagatcccctctttaggg

SEQ ID NO: 418308 - DNA, 3157 bp, Homo sapiens
ccaacttgtccatcggtggatgaatgcaccaagaatctgcagcgagtatgacgaggaggaggtggactatgaggagtcggacagcgatgagtcctggaccacagagagtgccatcagctccgaagccatcctcagctccatgtgcatgaatggaggggaagagaagccttttgcctgcccagttcctggatgtaaaaagagatacaagaatgtgaatggcataaagtatcacgctaagaatggtcacagaacacagattcgtgtccgcaaaccattcaagtgtcgctgtgggaagagttacaagacagctcagggcctgcggcaccacacaatcaatttccatcccccggtgtcggctgagattatcaggaagatgcagcaataacatgctggtcataactgtgccaagaaatcctcaccagcagttgctgattttgaaaacagccaccttttttcaggggaagcattcagcaaccctttaaagaaaaagaattaaatgcatgctttaaattttttctgtaattttggaatgatgtatctttgtagagttaatgattttgtacatttgcacatgtaatcatcatacccattttcattactttgatataaggtgctaaacaaaaaaagctctaggttcttcagcacatttcccccaaaacaaaataaaattgagggcatgttgcatattgttgaattgtattgcggtggtatcaacctggggggaggaggggctggcactgagatttttttttcaagattgtaatgtgattgaagttttcaacacatcaactcacatatgttcaaaaccaaaataataccttcattatcaaactggttaccatgccttacataatggagttagtatttgtgagtagaaagactttaggtaatggaaatataaataagaaagaatgtttaacataatatgctaaaaatattttcatatttaaataacatacgtaaaggtgtgctttctgtgttttatattatcttgcaaatccttttgccctttaaaaagctgaaaatcttgccatctgacttactagtcattttagtgttataaatggcattttgtacaaaatagtctattcagttcgttcattcatttaacacacattgattgagtgcctgctgggtacaagggattcaatttatgcctattgatatctgcggaccaagatacccatttagtgaaatacttttttccctgaaatctgttagaaaagactttgaaatacttcagtgcaaagtgtgtgtgtgtgaagtttagttatatcttcatcttcagatgaagttttaaagcactttgtagttctctattgccaacaatttaatgtttatgtgttgccaattcttgcaaccactgccctaccaaacctgtgggttgcaaatcagaactaaaattctaagcacgtttcaaagatgaacacttttgttaagacccctattgcctcttcttcatgctcattttttactttttttaaaaggtacttttctcatcacattgtagagaggtctgcattctcattggaaatgtctgtttagctttataaaacaaacactttgctgaaataggaaaatgagccttattgacaattaagtgcttcttgcagcaggtggtcaaagaaaagcatgactaatacgacctattagagtaatctacatctggaccattccttaagtttttcctcaccgacagtaccatcatgccttgagtgttcttttctcccaagtgctattccttaaacacgagagtttaccagttgcctaataatgcaataaaaaatgctttgagatagctaactgcccataaaacaaactcaaattgcttataaagtttcttcccatgttcccatttgatgaaaagtcttacatcacatataactgggaagcaggggtccctcctcaattttcagacattttgaaaggatgacagttctgtttgttagatgagtaaacctctatattcataagttctaaaatccttcattatgagggattcaaagtatttataaaaacactgccctctaaaaatttcctcagatctgaagtatggtcttggtcctgaatatacagtgttatcctatgtttaaaagggtgatccagacatgagacgcaactagttggtgcataagaaggccccacttggctatttcatatctacctacaattgaccaaaaaaaattttttaggccagcaattattatttagcttcgctctttctagtgcaagaaactgcaggctggatcagtagttcaacagctaaacagtcataaaatagtcattgtgcatgttaaatttctttcaatgctttcaaagataaattccaatttctatttacttattcattgtgacagtattactaaacaggtaaggatgggaatattttgttatactgtgtatagtgaatgtattgtactgtgtctgtgaaaactgtgctttaaattatattttcatatgttttgttggggacagagcacattaagtctgaaagcaacagaggtttgttttagaactgaaggcaatttaatcaaaattcctgtcaagaaaagctgcttataaatgtaaatgaaatcacatttaaaataaactgcctctgacccaaaaataaatatggctctttattttccttagtgtccattatgaaaaccagtatcaagtttaccatggaaattaatatatccattcagttcctcattctaaggctgttcagttgatgcatgtagactttattcccttacatttttgcttagattagattaggctgtattacttttctgtcaataacaaattaagcttggacttacttacttaaactattttaaaataagttctaggctagtaagatgaacagtgtctactactataataaatattccaaggatacttttggattaacatggtccataattattaactccaacaaaaatgctcccattgttgaacatattttacctaagtatataacctatctggaagctgaaagtctccaaagctattgcttcctaggactgctgtgtcctaacagctggcatatgaatgcctcatactgggttgccctagactcaaaaaactttttaaaggattctaacaatatacaaactctgcttccacaaacaaatacaagtgacgacatgatatgctgcagttcacatat

SEQ ID NO: 418309 - DNA, 3008 bp, Homo sapiens
tccctcgcccgcccggcgctcgcagagccgacaccagggggctctcgatgtagcaccatgacaggcatcgccgccgcctccttcttctccaatacctgccgattcgggggctgcggactccacttccccaccctggccgacctcatcgagcacatcgaggacaaccacatcgatacagatccacgggttttagaaaaacaagaattacagcagccaacctatgttgccctgagttacataaatagattcatgacagatgctgcccgccgagagcaggagtccctaaagaagaagattcagccgaagctctcgctgactctgtccagctcagtgtctcgagggaatgtgtccactcccccacgccacagcagtggaagccttactccccccgtgaccccacccatcaccccctcctcttcattccgcagcagcactccgacaggcagcgagtatgacgaggaggaggtggactatgaggagtcggacagcgatgagtcctggaccacagagagtgccatcagctccgaagccatcctcagctccatgtgcatgaatggaggggaagagaagccttttgcctgcccagttcctggatgtaaaaagagatacaagaatgtgaatggcataaagtatcacgctaagaatggtcacagaacacagattcgtgtccgcaaaccattcaagtgtcgctgtgggaagagttacaagacagctcagggcctgcggcaccacacaatcaatttccatcccccggtgtcggctgagattatcaggaagatgcagcaataacatgctggtcataactgtgccaagaaatcctcaccagcagttgctgattttgaaaacagccaccttttttcaggggaagcattcagcaaccctttaaagaaaaagaattaaatgcatgctttaaattttttctgtaattttggaatgatgtatctttgtagagttaatgattttgtacatttgcacatgtaatcatcatacccattttcattactttgatataaggtgctaaacaaaaaaagctctaggttcttcagcacatttcccccaaaacaaaataaaattgagggcatgttgcatattgttgaattgtattgcggtggtatcaacctggggggaggaggggctggcactgagatttttttttcaagattgtaatgtgattgaagttttcaacacatcaactcacatatgttcaaaaccaaaataataccttcattatcaaactggttaccatgccttacataatggagttagtatttgtgagtagaaagactttaggtaatggaaatataaataagaaagaatgtttaacataatatgctaaaaatattttcatatttaaataacatacgtaaaggtgtgctttctgtgttttatattatcttgcaaatccttttgccctttaaaaagctgaaaatcttgccatctgacttactagtcattttagtgttataaatggcattttgtacaaaatagtctattcagttcgttcattcatttaacacacattgattgagtgcctgctgggtacaagggattcaatttatgcctattgatatctgcggaccaagatacccatttagtgaaatacttttttccctgaaatctgttagaaaagactttgaaatacttcagtgcaaagtgtgtgtgtgtgaagtttagttatatcttcatcttcagatgaagttttaaagcactttgtagttctctattgccaacaatttaatgtttatgtgttgccaattcttgcaaccactgccctaccaaacctgtgggttgcaaatcagaactaaaattctaagcacgtttcaaagatgaacacttttgttaagacccctattgcctcttcttcatgctcattttttactttttttaaaaggtacttttctcatcacattgtagagaggtctgcattctcattggaaatgtctgtttagctttataaaacaaacactttgctgaaataggaaaatgagccttattgacaattaagtgcttcttgcagcaggtggtcaaagaaaagcatgactaatacgacctattagagtaatctacatctggaccattccttaagtttttcctcaccgacagtaccatcatgccttgagtgttcttttctcccaagtgctattccttaaacacgagagtttaccagttgcctaataatgcaataaaaaatgctttgagatagctaactgcccataaaacaaactcaaattgcttataaagtttcttcccatgttcccatttgatgaaaagtcttacatcacatataactgggaagcaggggtccctcctcaattttcagacattttgaaaggatgacagttctgtttgttagatgagtaaacctctatattcataagttctaaaatccttcattatgagggattcaaagtatttataaaaacactgccctctaaaaatttcctcagatctgaagtatggtcttggtcctgaatatacagtgttatcctatgtttaaaagggtgatccagacatgagacgcaactagttggtgcataagaaggccccacttggctatttcatatctacctacaattgaccaaaaaaaattttttaggccagcaattattatttagcttcgctctttctagtgcaagaaactgcaggctggatcagtagttcaacagctaaacagtcataaaatagtcattgtgcatgttaaatttctttcaatgctttcaaagataaattccaatttctatttacttattcattgtgacagtattactaaacaggtaaggatgggaatattttgttatactgtgtatagtgaatgtattgtactgtgtctgtgaaaactgtgctttaaattatattttcatatgttttgttggggacagagcacattaagtctgaaagcaacagaggtttgttttagaactgaaggcaatttaatcaaaattcctgtcaagaaaagctgcttataaatgtaaatgaaatcacatttaaaataaactgcctctgaccca

SEQ ID NO: 418310 - DNA, 3561 bp, Homo sapiens
tccctcgcccgcccggcgctcgcagagccgacaccagggggctctcgatgtagcaccatgacaggcatcgccgccgcctccttcttctccaatacctgccgattcgggggctgcggactccacttccccaccctggccgacctcatcgagcacatcgaggacaaccacatcgatacagatccacgggttttagaaaaacaagaattacagcagccaacctatgttgccctgagttacataaatagattcatgacagatgctgcccgccgagagcaggagtccctaaagaagaagattcagccgaagctctcgctgactctgtccagctcagtgtctcgagggaatgtgtccactcccccacgccacagcagtggaagccttactccccccgtgaccccacccatcaccccctcctcttcattccgcagcagcactccgacaggcagcgagtatgacgaggaggaggtggactatgaggagtcggacagcgatgagtcctggaccacagagagtgccatcagctccgaagccatcctcagctccatgtgcatgaatggaggggaagagaagccttttgcctgcccagttcctggatgtaaaaagagatacaagaatgtgaatggcataaagtatcacgctaagaatggtcacagaacacagattcgtgtccgcaaaccattcaagtgtcgctgtgggaagagttacaagacagctcagggcctgcggcaccacacaatcaatttccatcccccggtgtcggctgagattatcaggaagatgcagcaataacatgctggtcataactgtgccaagaaatcctcaccagcagttgctgattttgaaaacagccaccttttttcaggggaagcattcagcaaccctttaaagaaaaagaattaaatgcatgctttaaattttttctgtaattttggaatgatgtatctttgtagagttaatgattttgtacatttgcacatgtaatcatcatacccattttcattactttgatataaggtgctaaacaaaaaaagctctaggttcttcagcacatttcccccaaaacaaaataaaattgagggcatgttgcatattgttgaattgtattgcggtggtatcaacctggggggaggaggggctggcactgagatttttttttcaagattgtaatgtgattgaagttttcaacacatcaactcacatatgttcaaaaccaaaataataccttcattatcaaactggttaccatgccttacataatggagttagtatttgtgagtagaaagactttaggtaatggaaatataaataagaaagaatgtttaacataatatgctaaaaatattttcatatttaaataacatacgtaaaggtgtgctttctgtgttttatattatcttgcaaatccttttgccctttaaaaagctgaaaatcttgccatctgacttactagtcattttagtgttataaatggcattttgtacaaaatagtctattcagttcgttcattcatttaacacacattgattgagtgcctgctgggtacaagggattcaatttatgcctattgatatctgcggaccaagatacccatttagtgaaatacttttttccctgaaatctgttagaaaagactttgaaatacttcagtgcaaagtgtgtgtgtgtgaagtttagttatatcttcatcttcagatgaagttttaaagcactttgtagttctctattgccaacaatttaatgtttatgtgttgccaattcttgcaaccactgccctaccaaacctgtgggttgcaaatcagaactaaaattctaagcacgtttcaaagatgaacacttttgttaagacccctattgcctcttcttcatgctcattttttactttttttaaaaggtacttttctcatcacattgtagagaggtctgcattctcattggaaatgtctgtttagctttataaaacaaacactttgctgaaataggaaaatgagccttattgacaattaagtgcttcttgcagcaggtggtcaaagaaaagcatgactaatacgacctattagagtaatctacatctggaccattccttaagtttttcctcaccgacagtaccatcatgccttgagtgttcttttctcccaagtgctattccttaaacacgagagtttaccagttgcctaataatgcaataaaaaatgctttgagatagctaactgcccataaaacaaactcaaattgcttataaagtttcttcccatgttcccatttgatgaaaagtcttacatcacatataactgggaagcaggggtccctcctcaattttcagacattttgaaaggatgacagttctgtttgttagatgagtaaacctctatattcataagttctaaaatccttcattatgagggattcaaagtatttataaaaacactgccctctaaaaatttcctcagatctgaagtatggtcttggtcctgaatatacagtgttatcctatgtttaaaagggtgatccagacatgagacgcaactagttggtgcataagaaggccccacttggctatttcatatctacctacaattgaccaaaaaaaattttttaggccagcaattattatttagcttcgctctttctagtgcaagaaactgcaggctggatcagtagttcaacagctaaacagtcataaaatagtcattgtgcatgttaaatttctttcaatgctttcaaagataaattccaatttctatttacttattcattgtgacagtattactaaacaggtaaggatgggaatattttgttatactgtgtatagtgaatgtattgtactgtgtctgtgaaaactgtgctttaaattatattttcatatgttttgttggggacagagcacattaagtctgaaagcaacagaggtttgttttagaactgaaggcaatttaatcaaaattcctgtcaagaaaagctgcttataaatgtaaatgaaatcacatttaaaataaactgcctctgacccaaaaataaatatggctctttattttccttagtgtccattatgaaaaccagtatcaagtttaccatggaaattaatatatccattcagttcctcattctaaggctgttcagttgatgcatgtagactttattcccttacatttttgcttagattagattaggctgtattacttttctgtcaataacaaattaagcttggacttacttacttaaactattttaaaataagttctaggctagtaagatgaacagtgtctactactataataaatattccaaggatacttttggattaacatggtccataattattaactccaacaaaaatgctcccattgttgaacatattttacctaagtatataacctatctggaagctgaaagtctccaaagctattgcttcctaggactgctgtgtcctaacagctggcatatgaatgcctcatactgggttgccctagactcaaaaaactttttaaaggattctaacaatatacaaactctgcttccacaaacaaatacaagtgacgacatgatatgctgcagttcacatat

SEQ ID NO: 418311 - DNA, 1088 bp, Homo sapiens
tccctcgcccgcccggcgctcgcagagccgacaccagggggctctcgatgtagcaccatgacaggcatcgccgccgcctccttcttctccaatacctgccgattcgggggctgcggactccacttccccaccctggccgacctcatcgagcacatcgaggacaaccacatcgatacagatccacgggttttagaaaaacaagaattacagcagccaacctatgttgccctgagttacataaatagattcatgacagatgctgcccgccgagagcaggagtccctaaagaagaagattcagccgaagctctcgctgactctgtccagctcagtgtctcgagggaatgtgtccactcccccacgccacagcagtggaagccttactccccccgtgaccccacccatcaccccctcctcttcattccgcagcagcactccgacaggcagcgagtatgacgaggaggaggtggactatgaggagtcggacagcgatgagtcctggaccacagagagtgccatcagctccgaagccatcctcagctccatgtgcatgaatggaggggaagagaagccttttgcctgcccagttcctggatgtaaaaagagatacaagaatgtgaatggcataaagtatcacgctaagaatggtcacagaacacagattcgtgtccgcaaaccattcaagtgtcgctgtgggaagagttacaagacagctcagggcctgcggcaccacacaatcaatttccatcccccggtgtcggctgagattatcaggaagatgcagcaataacatgctggtcataactgtgccaagaaatcctcaccagcagttgctgattttgaaaacagccaccttttttcaggggaagcattcagcaaccctttaaagaaaaagaattaaatgcatgctttaaattttttctgtaattttggaatgatgtatctttgtagagttaatgattttgtacatttgcacatgtaatcatcatacccattttcattactttgatataaggtgctaaacaaaaaaagctctaggttcttcagcacatttcccccaaaacaaaataaaattgagggcatgttgca

SEQ ID NO: 418312 - DNA, 3119 bp, Homo sapiens
gttttagggacagactgcttccgggtcgaagggcttgcttccggagagcgggaaggctaaaacgcggtagctaaactgcagccaactttggttgtgtgtggaaaaggctttagccatggacaggagtggctttggagagatatcatcccctgtaatccgggaggcagaggtgacacggactgcacggaaacagagtgctcagaaaagagttttacttcaggcatctcaagatgaaaattttggtaatactacaccaagaaaccaggttatccctcgaactcctagctcatttcgacagccttttaccccaacaagccgaagcttactaaggcagccagatatttcctgcattcttggaacaggagggaagtcgccccgacttacgcagtcttcagggttctttggaaatctctccatggttactaatctggatgacagtaactgggcagctgcattttcatcacagcgttccgggctgttcacaaacacagagccccacagtataacagaagatgtaactatcagtgctgttatgttacgtgaggatgatcctggagaagctgcatccatgagtatgttttctgatttcctgcagtcttttctgaagcactcttcgagtacagtttttgatcttgtggaagagtatgaaaacatctgtggtagtcaggtgaatatactgagtaaaatagtgagtcgagcaacacctggacttcaaaaattttcaaaaacagccagtatgctctggcttcttcaacaggagatggtcacatggaggctgctggcttctttgtatagagacagaatacagtctgcattagaagaggaaagtgtattcgcagttactgctgttaatgccagtgaaaaaacagttgtggaagcgttatttcagagggattcacttgttcgacaaagtcagctggtggtagattggttagagagtattgccaaagatgaaattggagaattttctgataatattgagttttatgcaaaatcagtatattgggaaaatactctgcataccttaaaacaacggcagctgacttcttacgttggaagtgttcgtccgcttgtcactgaattggaccctgatgctcccataagacagaaaatgccccttgatgatctggatagagaagatgaagttagattactcaaatatctctttactctaatccgtgctggaatgacagaagaggcacaacgactctgtaaacgctgtggtcaagcatggagagctgcaacacttgaaggctggaaactgtaccatgaccctaatgttaatggaggaacagaattagaacctgttgaagggaatccatatagacgcatttggaaaataagttgctggagaatggcagaagatgagctttttaatagatacgagagagcaatttatgcagctttaagtgggaatcttaagcagctgcttcctgtctgtgacacctgggaagacacagtttgggcctacttccgggtgatggtggacagtctggtagaacaggagatccagacatcagtagcaactctggatgaaactgaagaactccctagagaatatctgggagcaaactggacgttagaaaaggtttttgaggaacttcaagctactgacaaaaagagagttctggaagagaatcaagaacattatcatatagttcaaaagtttcttatcctgggagacattgatggtttgatggatgagtttagcaaatggctttccaaaagcagaaacaatctacctggacacctgcttcgctttatgactcaccttattttgtttttccgtactctgggactacagaccaaggaggaagtttctattgaagttttaaagacatacatacagcttttaataagagagaaacatacaaatcttatagcattttatacctgtcatttgcctcaagacctagctgttgcccagtatgcattatttttggaaagtgttacagaatttgaacagcgccaccattgcctggagttggctaaagaagcagatttggatgttgcaacaataacaaaaactgtagttgagaatattcgaaagaaagataatggtgaatttagtcatcatgacctggccccagccctagatactggcactactgaggaggatcgtttaaaaattgatgtaattgactggttggtatttgacccagcgcagagggcagaagcactgaaacaaggcaatgcaattatgagaaaattcttggcatcaaaaaagcacgaagctgcaaaagaagtatttgtgaaaattcctcaggattctatagcagaaatctataatcagtgcgaggaacaaggaatggaaagtccacttcctgctgaagatgataatgctatccgagaacatttgtgcatcagagcttatttggaagcccatgaaacctttaatgagtggtttaagcatatgaattcagttccacaaaaacctgctttgatacctcaaccaacttttactgagaaagtggctcatgaacacaaagaaaagaaatatgaaatggattttggtatttggaaagggcatttggatgccctaactgctgatgtgaaggagaaaatgtataacgtcttgttgtttgttgatggagggtggatggtggatgttagagaggatgccaaagaagaccatgaaagaacacatcaaatggtcttactgagaaagctttgtctgccaatgttgtgttttctgcttcatacgatattgcacagtactggtcagtatcaggaatgcctacagttagcagatatggtatcctctgagcgccacaaactgtacctggtattttctaaggaagagctaaggaagttgctgcagaagctcagagagtcctctctaatgctcctagaccagggacttgacccattagggtatgaaattcagttatagtttaatctttgtaatctcactaattttcatgataaatgaagtttttaataaaatatacttgttattagtaattttttcttttgcattaccatgtaaaatttagacatttgaattttgtacttttcagaatattatcgtgacactttcaacatgtagggatatcagcgtttctctgtgtgcttgttaataaaactatataaaaattaaaattttctgtttttacaaa

SEQ ID NO: 418313 - DNA, 879 bp, Homo sapiens
  misc_feature (25)..(25): n is a, c, g, or t
taggctaggtacgaggctgggtgtngggcttgcttccggagagcgggaaggctaaaacgcggtagctaaactgcagccaactttggttgtgtgtggaaaaggctttagccatggacaggagtggctttggagagatatcatcccctgtaatccgggaggcagaggtgacacggactgcacggaaacagagtgctcagaaaagagttttacttcaggcatctcaagatgaaaattttggtaatactacaccaagaaaccaggttatccctcgaactcctagctcatttcgacagccttttaccccaacaagccgaagcttactaaggcagccagatatttcctgcattcttggaacaggagggaagtcgccccgacttacgcagtcttcagggttctttggaaatctctccatggttactaatctggatgacagtaactgggcagctgcattttcatcacagcgttccgggctgttcacaaacacagagccccacagtataacagaagatgtaactatcagtgctgttatgttacgtgaggatgatcctggagaagctgcatccatgagtatgttttctgatttcctgcagtcttttctgaagcactcttcgagtacagtttttgatcttgtggaagagtatgaaaacatctgtggtagtcaggtgaatatactgagtaaaatagtgagtcgagcaacacctggacttcaaaaattttcaaaaacagccagtatgctctggcttcttcaacaggagatggtcacatggaggctgctggcttctttgtatagagaccgaatacaggctgcttagaagaggaaagtgtttcgaggtatggggaatgccggggaaaaacgggggggagggatcaggggtcacg

SEQ ID NO: 418314 - DNA, 589 bp, Homo sapiens
tccagttttaatgttttaatgtttgtacttttttcccaaaatgtgtgtatatttgtaagcagttagaaatatatagactgactctgagaattcaccttgaaattcctgaaccactctaatttactaggctctggctacataaatcttaaagaggcatttcttcttatatgaagctaatcagatcgattaggtaactaagttcatacttgtctacttgtctttgttctcattcttatttctctttttaaaaatcaggtattttctaaggaagagctaaggaagttgctgcagaagctcagagagtcctctctaatgctcctagaccagggacttgacccattagggtatgaaattcagttatagtttaatctttgtaatctcactaattttcatgataaatgaagtttttaataaaatatacttgttattagtaattttttcttttgcattaccatgtaaaatttagacatttgaattttgtacttttcagaatattatcgtgacactttcaacatgtagggatatcagcgtttctctgtgtgcttgttaataaaactatataaaaattaaaattttctgtttttacaaa

SEQ ID NO: 418315 - DNA, 3287 bp, Homo sapiens
  misc_feature (138)..(139): n is a, c, g, or t
agcgggctgttcgctcctggggtgggcggggtaggtagcgcggcgttcgaaatgctaagtgaccagcctgagatcacaaagccagtcagtgaagatactgggatctcagcccagactttctgattacaagtgccagcnnagattctgagttccctctatgatctgggtactgtgctagccgcctacaacaaagatcagttattcaagatccttcccctcggggaattagttgtgtaatggagacaaccaagcagtgtaaagtggagtggctttggagagatatcatcccctgtaatccgggaggcagaggtgacacggactgcacggaaacagagtgctcagaaaagagttttacttcaggcatctcaagatgaaaattttggtaatactacaccaagaaaccaggttatccctcgaactcctagctcatttcgacagccttgttctttctaccaaccttttgtttatagttaccccaacaagccgaagcttactaaggcagccagatatttcctgcattcttggaacaggagggaagtcgccccgacttacgcagtcttcagggttctttggaaatctctccatggttactaatctggatgacagtaactgggcagctgcattttcatcacagcgttccgggctgttcacaaacacagagccccacagtataacagaagatgtaactatcagtgctgttatgttacgtgaggatgatcctggagaagctgcatccatgagtatgttttctgatttcctgcagtcttttctgaagcactcttcgagtacagtttttgatcttgtggaagagtatgaaaacatctgtggtagtcaggtgaatatactgagtaaaatagtgagtcgagcaacacctggacttcaaaaattttcaaaaacagccagtatgctctggcttcttcaacaggagatggtcacatggaggctgctggcttctttgtatagagacagaatacagtctgcattagaagaggaaagtgtattcgcagttactgctgttaatgccagtgaaaaaacagttgtggaagcgttatttcagagggattcacttgttcgacaaagtcagctggtggtagattggttagagagtattgccaaagatgaaattggagaattttctgataatattgagttttatgcaaaatcagtatattgggaaaatactctgcataccttaaaacaacggcagctgacttcttacgttggaagtgttcgtccgcttgtcactgaattggaccctgatgctcccataagacagaaaatgccccttgatgatctggatagagaagatgaagttagattactcaaatatctctttactctaatccgtgctggaatgacagaagaggcacaacgactctgtaaacgctgtggtcaagcatggagagctgcaacacttgaaggctggaaactgtaccatgaccctaatgttaatggaggaacagaattagaacctgttgaagggaatccatatagacgcatttggaaaataagttgctggagaatggcagaagatgagctttttaatagatacgagagagcaatttatgcagctttaagtgggaatcttaagcagctgcttcctgtctgtgacacctgggaagacacagtttgggcctacttccgggtgatggtggacagtctggtagaacaggagatccagacatcagtagcaactctggatgaaactgaagaactccctagagaatatctgggagcaaactggacgttagaaaaggtttttgaggaacttcaagctactgacaaaaagagagttctggaagagaatcaagaacattatcatatagttcaaaagtttcttatcctgggagacattgatggtttgatggatgagtttagcaaatggctttccaaaagcagaaacaatctacctggacacctgcttcgctttatgactcaccttattttgtttttccgtactctgggactacagaccaaggaggaagtttctattgaagttttaaagacatacatacagcttttaataagagagaaacatacaaatcttatagcattttatacctgtcatttgcctcaagacctagctgttgcccagtatgcattatttttggaaagtgttacagaatttgaacagcgccaccattgcctggagttggctaaagaagcagatttggatgttgcaacaataacaaaaactgtagttgagaatattcgaaagaaagataatggtgaatttagtcatcatgacctggccccagccctagatactggcactactgaggaggatcgtttaaaaattgatgtaattgactggttggtatttgacccagcgcagagggcagaagcactgaaacaaggcaatgcaattatgagaaaattcttggcatcaaaaaagcacgaagctgcaaaagaagtatttgtgaaaattcctcaggattctatagcagaaatctataatcagtgcgaggaacaaggaatggaaagtccacttcctgctgaagatgataatgctatccgagaacatttgtgcatcagagcttatttggaagcccatgaaacctttaatgagtggtttaagcatatgaattcagttccacaaaaacctgctttgatacctcaaccaacttttactgagaaagtggctcatgaacacaaagaaaagaaatatgaaatggattttggtatttggaaagggcatttggatgccctaactgctgatgtgaaggagaaaatgtataacgtcttgttgtttgttgatggagggtggatggtggatgttagagaggatgccaaagaagaccatgaaagaacacatcaaatggtcttactgagaaagctttgtctgccaatgttgtgttttctgcttcatacgatattgcacagtactggtcagtatcaggaatgcctacagttagcagatatggtatcctctgagcgccacaaactgtacctggtattttctaaggaagagctaaggaagttgctgcagaagctcagagagtcctctctaatgctcctagaccagggacttgacccattagggtatgaaattcagttatagtttaatctttgtaatctcactaattttcatgataaatgaagtttttaataaaatatacttgttattagtaattttttcttttgcattaccatgtaaaatttagacatttgaattttgtacttttcagaatattatcgtgacactttcaacatgtagggatatcagcgtttctctgtgtgcttgttaataaaactatataaaaattaaaattttctgtttttacaaa

SEQ ID NO: 418316 - DNA, 3259 bp, Homo sapiens
  misc_feature (138)..(139): n is a, c, g, or t
agcgggctgttcgctcctggggtgggcggggtaggtagcgcggcgttcgaaatgctaagtgaccagcctgagatcacaaagccagtcagtgaagatactgggatctcagcccagactttctgattacaagtgccagcnnagattctgagttccctctatgatctgggtactgtgctagccgcctacaacaaagatcagttattcaagatccttcccctcggggaattagttgtgtaatggagacaaccaagcagtgtaaagtggagtggctttggagagatatcatcccctgtaatccgggaggcagaggtgacacggactgcacggaaacagagtgctcagaaaagagttttacttcaggcatctcaagatgaaaattttggtaatactacaccaagaaaccaggttatccctcgaactcctagctcatttcgacagccttttaccccaacaagccgaagcttactaaggcagccagatatttcctgcattcttggaacaggagggaagtcgccccgacttacgcagtcttcagggttctttggaaatctctccatggttactaatctggatgacagtaactgggcagctgcattttcatcacagcgttccgggctgttcacaaacacagagccccacagtataacagaagatgtaactatcagtgctgttatgttacgtgaggatgatcctggagaagctgcatccatgagtatgttttctgatttcctgcagtcttttctgaagcactcttcgagtacagtttttgatcttgtggaagagtatgaaaacatctgtggtagtcaggtgaatatactgagtaaaatagtgagtcgagcaacacctggacttcaaaaattttcaaaaacagccagtatgctctggcttcttcaacaggagatggtcacatggaggctgctggcttctttgtatagagacagaatacagtctgcattagaagaggaaagtgtattcgcagttactgctgttaatgccagtgaaaaaacagttgtggaagcgttatttcagagggattcacttgttcgacaaagtcagctggtggtagattggttagagagtattgccaaagatgaaattggagaattttctgataatattgagttttatgcaaaatcagtatattgggaaaatactctgcataccttaaaacaacggcagctgacttcttacgttggaagtgttcgtccgcttgtcactgaattggaccctgatgctcccataagacagaaaatgccccttgatgatctggatagagaagatgaagttagattactcaaatatctctttactctaatccgtgctggaatgacagaagaggcacaacgactctgtaaacgctgtggtcaagcatggagagctgcaacacttgaaggctggaaactgtaccatgaccctaatgttaatggaggaacagaattagaacctgttgaagggaatccatatagacgcatttggaaaataagttgctggagaatggcagaagatgagctttttaatagatacgagagagcaatttatgcagctttaagtgggaatcttaagcagctgcttcctgtctgtgacacctgggaagacacagtttgggcctacttccgggtgatggtggacagtctggtagaacaggagatccagacatcagtagcaactctggatgaaactgaagaactccctagagaatatctgggagcaaactggacgttagaaaaggtttttgaggaacttcaagctactgacaaaaagagagttctggaagagaatcaagaacattatcatatagttcaaaagtttcttatcctgggagacattgatggtttgatggatgagtttagcaaatggctttccaaaagcagaaacaatctacctggacacctgcttcgctttatgactcaccttattttgtttttccgtactctgggactacagaccaaggaggaagtttctattgaagttttaaagacatacatacagcttttaataagagagaaacatacaaatcttatagcattttatacctgtcatttgcctcaagacctagctgttgcccagtatgcattatttttggaaagtgttacagaatttgaacagcgccaccattgcctggagttggctaaagaagcagatttggatgttgcaacaataacaaaaactgtagttgagaatattcgaaagaaagataatggtgaatttagtcatcatgacctggccccagccctagatactggcactactgaggaggatcgtttaaaaattgatgtaattgactggttggtatttgacccagcgcagagggcagaagcactgaaacaaggcaatgcaattatgagaaaattcttggcatcaaaaaagcacgaagctgcaaaagaagtatttgtgaaaattcctcaggattctatagcagaaatctataatcagtgcgaggaacaaggaatggaaagtccacttcctgctgaagatgataatgctatccgagaacatttgtgcatcagagcttatttggaagcccatgaaacctttaatgagtggtttaagcatatgaattcagttccacaaaaacctgctttgatacctcaaccaacttttactgagaaagtggctcatgaacacaaagaaaagaaatatgaaatggattttggtatttggaaagggcatttggatgccctaactgctgatgtgaaggagaaaatgtataacgtcttgttgtttgttgatggagggtggatggtggatgttagagaggatgccaaagaagaccatgaaagaacacatcaaatggtcttactgagaaagctttgtctgccaatgttgtgttttctgcttcatacgatattgcacagtactggtcagtatcaggaatgcctacagttagcagatatggtatcctctgagcgccacaaactgtacctggtattttctaaggaagagctaaggaagttgctgcagaagctcagagagtcctctctaatgctcctagaccagggacttgacccattagggtatgaaattcagttatagtttaatctttgtaatctcactaattttcatgataaatgaagtttttaataaaatatacttgttattagtaattttttcttttgcattaccatgtaaaatttagacatttgaattttgtacttttcagaatattatcgtgacactttcaacatgtagggatatcagcgtttctctgtgtgcttgttaataaaactatataaaaattaaaattttctgtttttacaaa

SEQ ID NO: 418317 - DNA, 2217 bp, Homo sapiens
  misc_feature (28)..(28): n is a, c, g, or t
aagaggcatgagtacgagcctggggttnatatcggccgaggccaagagatgaaattggagaattttctgataatattgagttttatgcaaaatcagtatattgggaaaatactctgcataccttaaaacaacggcagctgacttcttacgttggaagtgttcgtccgcttgtcactgaattggaccctgatgctcccataagacagaaaatgccccttgatgatctggatagagaagatgaagttagattactcaaatatctctttactctaatccgtgctggaatgacagaagaggcacaacgactctgtaaacgctgtggtcaagcatggagagctgcaacacttgaaggctggaaactgtaccatgaccctaatgttaatggaggaacagaattagaacctgttgaagggaatccatatagacgcatttggaaaataagttgctggagaatggcagaagatgagctttttaatagatacgagagagcaatttatgcagctttaagtgggaatcttaagcagctgcttcctgtctgtgacacctgggaagacacagtttgggcctacttccgggtgatggtggacagtctggtagaacaggagatccagacatcagtagcaactctggatgaaactgaagaactccctagagaatatctgggagcaaactggacgttagaaaaggtttttgaggaacttcaagctactgacaaaaagagagttctggaagagaatcaagaacattatcatatagttcaaaagtttcttatcctgggagacattgatggtttgatggatgagtttagcaaatggctttccaaaagcagaaacaatctacctggacacctgcttcgctttatgactcaccttattttgtttttccgtactctgggactacagaccaaggaggaagtttctattgaagttttaaagacatacatacagcttttaataagagagaaacatacaaatcttatagcattttatacctgtcatttgcctcaagacctagctgttgcccagtatgcattatttttggaaagtgttacagaatttgaacagcgccaccattgcctggagttggctaaagaagcagatttggatgttgcaacaataacaaaaactgtagttgagaatattcgaaagaaagataatggtgaatttagtcatcatgacctggccccagccctagatactggcactactgaggaggatcgtttaaaaattgatgtaattgactggttggtatttgacccagcgcagagggcagaagcactgaaacaaggcaatgcaattatgagaaaattcttggcatcaaaaaagcacgaagctgcaaaagaagtatttgtgaaaattcctcaggattctatagcagaaatctataatcagtgcgaggaacaaggaatggaaagtccacttcctgctgaagatgataatgctatccgagaacatttgtgcatcagagcttatttggaagcccatgaaacctttaatgagtggtttaagcatatgaattcagttccacaaaaacctgctttgatacctcaaccaacttttactgagaaagtggctcatgaacacaaagaaaagaaatatgaaatggattttggtatttggaaagggcatttggatgccctaactgctgatgtgaaggagaaaatgtataacgtcttgttgtttgttgatggagggtggatggtggatgttagagaggatgccaaagaagaccatgaaagaacacatcaaatggtcttactgagaaagctttgtctgccaatgttgtgttttctgcttcatacgatattgcacagtactggtcagtatcaggaatgcctacagttagcagatatggtatcctctgagcgccacaaactgtacctggtattttctaaggaagagctaaggaagttgctgcagaagctcagagagtcctctctaatgctcctagaccagggacttgacccattagggtatgaaattcagttatagtttaatctttgtaatctcactaattttcatgataaatgaagtttttaataaaatatacttgttattagtaattttttcttttgcattaccatgtaaaatttagacatttgaattttgtacttttcagaatattatcgtgacactttcaacatgtagggatatcagcgtttctctgtgtgcttgttaataaaactatataaaaattaaaattttctgtttttacaaa

SEQ ID NO: 418318 - DNA, 3049 bp, Homo sapiens
gttttagggacagactgcttccgggtcgaagggcttgcttccggagagcgggaaggctaaaacgcggtagctaaactgcagccaactttggttgtgtgtggaaaaggctttagccatggacaggagtggctttggagagatatcatcccctgtaatccgggaggcagaggtgacacggactgcacggaaacagagtgctcagaaaagagttttacttcaggcatctcaagatgaaaattttggtaatactacaccaagaaaccaggttatccctcgaactcctagctcatttcgacagccttttaccccaacaagccgaagcttactaaggcagccagatatttcctgcattcttggaacaggagggaagtcgccccgacttacgcagtcttcagggttctttggaaatctctccatggttactaatctggatgacagtaactgggcagctgcattttcatcacagcgttccgggctgttcacaaacacagagccccacagtataacagaagatgtaactatcagtgctgttatgttacgtgaggatgatcctggagaagctgcatccatgagtatgttttctgatttcctgcagtcttttctgaagcactcttcgagtacagtttttgatcttgtggaagagtatgaaaacatctgtggtagtcaggtgaatatactgagtaaaatagtgagtcgagcaacacctggacttcaaaaattttcaaaaacagccagtatgctctggcttcttcaacaggagatggtcacatggaggctgctggcttctttgtatagagacagaatacagtctgcattagaagaggaaagtgtattcgcagttactgctgttaatgccagtgaaaaaacagttgtggaagcgttatttcagagggattcacttgttcgacaaagtcagctggtggtagattggttagagagtattgccaaagatgaaattggagaattttctgataatattgagttttatgcaaaatcagtatattgggaaaatactctgcataccttaaaacaacggcagctgacttcttacgttggaagtgttcgtccgcttgtcactgaattggaccctgatgctcccataagacagaaaatgccccttgatgatctggatagagaagatgaagttagattactcaaatatctctttactctaatccgtgctggaatgacagaagaggcacaacgactctgtaaacgctgtggtcaagcatggagagctgcaacacttgaaggctggaaactgtaccatgaccctaatgttaatggaggaacagaattagaacctgttgaagggaatccatatagacgcatttggaaaataagttgctggagaatggcagaagatgagctttttaatagatacgagagagcaatttatgcagctttaagtgggaatcttaagcagctgcttcctgtctgtgacacctgggaagacacagtttgggcctacttccgggtgatggtggacagtctggtagaacaggagatccagacatcagtagcaactctggatgaaactgaagaactccctagagaatatctgggagcaaactggacgttagaaaaggtttttgaggaacttcaagctactgacaaaaaggtttgatggatgagtttagcaaatggctttccaaaagcagaaacaatctacctggacacctgcttcgctttatgactcaccttattttgtttttccgtactctgggactacagaccaaggaggaagtttctattgaagttttaaagacatacatacagcttttaataagagagaaacatacaaatcttatagcattttatacctgtcatttgcctcaagacctagctgttgcccagtatgcattatttttggaaagtgttacagaatttgaacagcgccaccattgcctggagttggctaaagaagcagatttggatgttgcaacaataacaaaaactgtagttgagaatattcgaaagaaagataatggtgaatttagtcatcatgacctggccccagccctagatactggcactactgaggaggatcgtttaaaaattgatgtaattgactggttggtatttgacccagcgcagagggcagaagcactgaaacaaggcaatgcaattatgagaaaattcttggcatcaaaaaagcacgaagctgcaaaagaagtatttgtgaaaattcctcaggattctatagcagaaatctataatcagtgcgaggaacaaggaatggaaagtccacttcctgctgaagatgataatgctatccgagaacatttgtgcatcagagcttatttggaagcccatgaaacctttaatgagtggtttaagcatatgaattcagttccacaaaaacctgctttgatacctcaaccaacttttactgagaaagtggctcatgaacacaaagaaaagaaatatgaaatggattttggtatttggaaagggcatttggatgccctaactgctgatgtgaaggagaaaatgtataacgtcttgttgtttgttgatggagggtggatggtggatgttagagaggatgccaaagaagaccatgaaagaacacatcaaatggtcttactgagaaagctttgtctgccaatgttgtgttttctgcttcatacgatattgcacagtactggtcagtatcaggaatgcctacagttagcagatatggtatcctctgagcgccacaaactgtacctggtattttctaaggaagagctaaggaagttgctgcagaagctcagagagtcctctctaatgctcctagaccagggacttgacccattagggtatgaaattcagttatagtttaatctttgtaatctcactaattttcatgataaatgaagtttttaataaaatatacttgttattagtaattttttcttttgcattaccatgtaaaatttagacatttgaattttgtacttttcagaatattatcgtgacactttcaacatgtagggatatcagcgtttctctgtgtgcttgttaataaaactatataaaaattaaaattttctgtttttacaaa

SEQ ID NO: 418319 - DNA, 2086 bp, Homo sapiens
aaaggagctcagacaatttctgtccagcaacatgacagcaagctcaggctggaccctgatgctcccataagacagaaaatgccccttgatgatctggatagagaagatgaagttagattactcaaatatctctttactctaatccgtgctggaatgacagaagaggcacaacgactctgtaaacgctgtggtcaagcatggagagctgcaacacttgaaggctggaaactgtaccatgaccctaatgttaatggaggaacagaattagaacctgttgaagggaatccatatagacgcatttggaaaataagttgctggagaatggcagaagatgagctttttaatagatacgagagagcaatttatgcagctttaagtgggaatcttaagcagctgcttcctgtctgtgacacctgggaagacacagtttgggcctacttccgggtgatggtggacagtctggtagaacaggagatccagacatcagtagcaactctggatgaaactgaagaactccctagagaatatctgggagcaaactggacgttagaaaaggtttttgaggaacttcaagctactgacaaaaagagagttctggaagagaatcaagaacattatcatatagttcaaaagtttcttatcctgggagacattgatggtttgatggatgagtttagcaaatggctttccaaaagcagaaacaatctacctggacacctgcttcgctttatgactcaccttattttgtttttccgtactctgggactacagaccaaggaggaagtttctattgaagttttaaagacatacatacagcttttaataagagagaaacatacaaatcttatagcattttatacctgtcatttgcctcaagacctagctgttgcccagtatgcattatttttggaaagtgttacagaatttgaacagcgccaccattgcctggagttggctaaagaagcagatttggatgttgcaacaataacaaaaactgtagttgagaatattcgaaagaaagataatggtgaatttagtcatcatgacctggccccagccctagatactggcactactgaggaggatcgtttaaaaattgatgtaattgactggttggtatttgacccagcgcagagggcagaagcactgaaacaaggcaatgcaattatgagaaaattcttggcatcaaaaaagcacgaagctgcaaaagaagtatttgtgaaaattcctcaggattctatagcagaaatctataatcagtgcgaggaacaaggaatggaaagtccacttcctgctgaagatgataatgctatccgagaacatttgtgcatcagagcttatttggaagcccatgaaacctttaatgagtggtttaagcatatgaattcagttccacaaaaacctgctttgatacctcaaccaacttttactgagaaagtggctcatgaacacaaagaaaagaaatatgaaatggattttggtatttggaaagggcatttggatgccctaactgctgatgtgaaggagaaaatgtataacgtcttgttgtttgttgatggagggtggatggtggatgttagagaggatgccaaagaagaccatgaaagaacacatcaaatggtcttactgagaaagctttgtctgccaatgttgtgttttctgcttcatacgatattgcacagtactggtcagtatcaggaatgcctacagttagcagatatggtatcctctgagcgccacaaactgtacctggtattttctaaggaagagctaaggaagttgctgcagaagctcagagagtcctctctaatgctcctagaccagggacttgacccattagggtatgaaattcagttatagtttaatctttgtaatctcactaattttcatgataaatgaagtttttaataaaatatacttgttattagtaattttttcttttgcattaccatgtaaaatttagacatttgaattttgtacttttcagaatattatcgtgacactttcaacatgtagggatatcagcgtttctctgtgtgcttgttaataaaactatataaaaattaaaattttctgtttttacaaa

SEQ ID NO: 418320 - DNA, 3164 bp, Homo sapiens
gttttagggacagactgcttccgggtcgaagggcttgcttccggagagcgggaaggctaaaacgcggtagctaaactgcagccaactttggttgtgtgtggaaaaggctttagccatggacaggagtggctttggagagatatcatcccctgtaatccgggaggcagaggtgacacggactgcacggaaacagagtgctcagaaaagagttttacttcaggcatctcaagatgaaaattttggtaatactacaccaagaaaccaggttatccctcgaactcctagctcatttcgacagccttttaccccaacaagccgaagcttactaaggcagccagatatttcctgcattcttggaacaggagggaagtcgccccgacttacgcagtcttcagggttctttggaaatctctccatggttactaatctggatgacagtaactgggcagctgcattttcatcacagcgttccgggctgttcacaaacacagagccccacagtataacagaagatgtaactatcagtgctgttatgttacgtgaggatgatcctggagaagctgcatccatgagtatgttttctgatttcctgcagtcttttctgaagcactcttcgagtacagtttttgatcttgtggaagagtatgaaaacatctgtggtagtcaggtgaatatactgagtaaaatagtgagtcgagcaacacctggacttcaaaaattttcaaaaacagccagtatgctctggcttcttcaacaggagatggtcacatggaggctgctggcttctttgtatagagacagaatacagtctgcattagaagaggaaagtgtattcgcagttactgctgttaatgccagtgaaaaaacagttgtggaagcgttatttcagagggattcacttgttcgacaaagtcagctggtggtagattggttagagagtattgccaaagatgaaattggagaattttctgataatattgagttttatgcaaaatcagtatattgggaaaatactctgcataccttaaaacaacggcagctgacttcttacgttggaagtgttcgtccgcttgtcactgaattggaccctgatgctcccataagacagaaaatgccccttgatgatctggatagagaagatgaagttagattactcaaatatctctttactctaatccgtgctggaatgacagaagaggcacaacgactctgtaaacgctgtggtcaagcatggagagctgcaacacttgaaggctggaaactgtaccatgaccctaatgttaatggaggaacagaattagaacctgttgaagggaatccatatagacgcatttggaaaataagttgctggagaatggcagaagatgagctttttaatagatacgagagagcaatttatgcagctttaagtgggaatcttaagcagctgcttcctgtctgtgacacctgggaagacacagtttgggcctacttccgggtgatggtggacagtctggtagaacaggagatccagacatcagtagcaactctggatgaaactgaagaactccctagagaatatctgggagcaaactggacgttagaaaaggtttttgaggaacttcaagctactgacaaaaagagagttctggaagagaatcaagaacattatcatatagttcaaaagtttcttatcctgggagacattgatggtttgatggatgagtttagcaaatggctttccaaaagcagaaacaatctacctggacacctgcttcgctttatgactcaccttattttgtttttccgtactctgggactacagaccaaggaggaagtttctattgaagttttaaagacatacatacagcttttaataagagagaaacatacaaatcttatagcattttatacctgtcatttgcctcaagacctagctgttgcccagtatgcattatttttggaaagtgttacagaatttgaacagcgccaccattgcctggagttggctaaagaagcagatttggatgttgcaacaataacaaaaactgtagttgagaatattcgaaagaaagataatggtgaatttagtcatcatgacctggccccagccctagatactggcactactgaggaggatcgtttaaaaattgatgtaattgactggttggtatttgacccagcgcagagggcagaagcactgaaacaaggcaatgcaattatgagaaaattcttggcatcaaaaaagcacgaagctgcaaaagaagtatttgtgaaaattcctcaggattctatagcagaaatctataatcagtgcgaggaacaaggaatggaaagtccacttcctgctgaagatgataatgctatccgagaacatttgtgcatcagagcttatttggaagcccatgaaacctttaatgagtggtttaagcatatgaattcagttccacaaaaacctgctttgatacctcaaccaacttttactgagaaagtggctcatgaacacaaagaaaagaaatatgaaatggattttggtatttggaaagggcatttggatgccctaactgctgatgtgaaggagaaaatgtataacgtcttgttgtttgttgatggagggtggatggtggatgttagagaggatgccaaagaagaccatgaaagaacacatcaaatggtcttactgagaaagctttgtctgccaatgttgtgttttctgcttcatacgatattgcacagtactggtcagtatcaggaatgcctacagttagcagatatggtatcctctgagcgccacaaactgtacctggtattttctaaggaagagctaaggaagttgctgcagaagctcagagagtcctctctaatgctcctagaccagggacttgacccattagggtatgaaattcagttatagtttaatctttgtaatctcactaattttcatgataaatgaagtttttaataaaatatacttgttattagtaattttttcttttgcattaccatgtaaaatttagacatttgaattttgtacttttcagaatattatcgtgacactttcaacatgtagggatatcagcgtttctctgtgtgcttgttaataaaactatataaaaattaaaattttctgtttttacaaaaaatagacaacaaacaacaaagataacaaaaacaaaaagaattat

SEQ ID NO: 418321 - DNA, 2633 bp, Homo sapiens
gttttagggacagactgcttccgggtcgaagggcttgcttccggagagcgggaaggctaaaacgcggtagctaaactgcagccaactttggttgtgtgtggaaaaggctttagccatggacaggagtggctttggagagatatcatcccctgtaatccgggaggcagaggtgacacggactgcacggaaacagagtgctcagaaaagagttttacttcaggcatctcaagatgaaaattttggtaatactacaccaagaaaccaggttatccctcgaactcctagctcatttcgacagccttttaccccaacaagccgaagcttactaaggcagccagatatttcctgcattcttggaacaggagggaagtcgccccgacttacgcagtcttcagggttctttggaaatctctccatggttactaatctggatgacagtaactgggcagctgcattttcatcacagcgttccgggctgttcacaaacacagagccccacagtataacagaagatgtaactatcagtgctgttatgttacgtgaggatgatcctggagaagctgcatccatgagtatgttttctgatttcctgcagtcttttctgaagcactcttcgagtacagtttttgatcttgtggaagagtatgaaaacatctgtggtagtcaggtgaatatactgagtaaaatagtgagtcgagcaacacctggacttcaaaaattttcaaaaacagccagtatgctctggcttcttcaacaggagatggtcacatggaggctgctggcttctttgtatagagacagaatacagtctgcattagaagaggaaagtgtattcgcagttactgctgttaatgccagtgaaaaaacagttgtggaagcgttatttcagagggattcacttgttcgacaaagtcagctggtggtagattggttagagagtattgccaaagatgaaattggagaattttctgataatattgagttttatgcaaaatcagtatattgggaaaatactctgcataccttaaaacaacggcagctgacttcttacgttggaagtgttcgtccgcttgtcactgaattggaccctgatgctcccataagacagaaaatgccccttgatgatctggatagagaagatgaagttagattactcaaatatctctttactctaatccgtgctggaatgacagaagaggcacaacgactctgtaaacgctgtggtcaagcatggagagctgcaacacttgaaggctggaaactgtaccatgaccctaatgttaatggaggaacagaattagaacctgttgaagggaatccatatagacgcatttggaaaataagttgctggagaatggcagaagatgagctttttaatagatacgagagagcaatttatgcagctttaagtgggaatcttaagcagctgcttcctgtctgtgacacctgggaagacacagtttgggcctacttccgggtgatggtggacagtctggtagaacaggagatccagacatcagtagcaactctggatgaaactgaagaactccctagagaatatctgggagcaaactggacgttagaaaaggtttttgaggaacttcaagctactgacaaaaagagagttctggaagagaatcaagaacattatcatatagttcaaaagtttcttatcctgggagacattgatggtttgatggatgagtttagcaaatggctttccaaaagcagaaacaatctacctggacacctgcttcgctttatgactcaccttattttgtttttccgtactctgggactacagaccaaggaggaagtttctattgaagttttaaagacatacatacagcttttaataagagagaaacatacaaatcttatagcattttatacctgtcatttgcctcaagacctagctgttgcccagtatgcattatttttggaaagtgttacagaatttgaacagcgccaccattgcctggagttggctaaagaagcagatttggatgttgcaacaataacaaaaactgtagttgagaatattcgaaagaaagataatggtgaatttagtcatcatgacctggccccagccctagatactggcactactgaggaggatcgtttaaaaattgatgtaattgactggttggtatttgacccagcgcagagggcagaagcactgaaacaaggcaatgcaattatgagaaaattcttggcatcaaaaaagcacgaagctgcaaaagaagtatttgtgaaaattcctcaggattctatagcagaaatctataatcagtgcgaggaacaaggaatggaaagtccacttcctgctgaagatgataatgctatccgagaacatttgtgcatcagagcttatttggaagcccatgaaacctttaatgagtggtttaagcatatgaattcagttccacaaaaacctgctttgatacctcaaccaacttttactgagaaagtggctcatgaacacaaagaaaagaaatatgaaatggattttggtatttggaaagggcatttggatgccctaactgctgatgtgaaggagaaaatgtataacgtcttgttgtttgttgatggaggtgctacggttcaaggaggtcgcggggtgcgagctcgat

SEQ ID NO: 418322 - DNA, 390 bp, Homo sapiens
gttttagggacagactgcttccgggtcgaagggcttgcttccggagagcgggaaggctaaaacgcggtagctaaactgcagccaactttggttgtgtgtggaaaaggctttagccatggacaggagtggctttggagagatatcatcccctgtaatccgggaggcagaggtgacacggactgcacggaaacagagtgctcagaaaagagttttacttcaggcatctcaagatgaaaattttggtaatactacaccaagaaaccaggttatccctcgaactcctagctcatttcgacagccttgtaagattttttgcttttaaagcatttaataataacggtaattataatagcaactaacatttattgtaacataattagtatagtattt

SEQ ID NO: 418323 - DNA, 346 bp, Homo sapiens
ctggaataaaatttgattttaaatattcaaagcatccactagagttggatctgctttcacctgatatttggcatttaaatgttttactttttcctctagatttcagcatttattatttcatcacactgaagttcttccttgttattaccccactagatctttcactaaagtttaaaaactatcaagtgaataggttcagtctagaagagtttgcaagactccacattatgaggaaaattgacatactaagaaaaacaatatttcaaatttgtttatattcattgtgttttaggagctttttaatagatacgagagagcaatttatgcagctttaagtgggaatctt

SEQ ID NO: 418324 - DNA, 2124 bp, Homo sapiens
gagagcttcatacctggtacgctgctgattggatgaaggacagagggcttccgggagttttcaagccgactgtgtggcagctgagaagagttttgcacgtggatcgccgttcgggtgggcgagatggagacagcccccaagccgggcaaggatgtcccgcccaagaaagacaaacttcagaccaagagaaagaaaccgcggcgatactgggaggaagagaccgttccgaccacagccggagcctctccagggcctcctcgtaacaagaagaatcgggagctccgtcctcagagaccaaaaaatgcttacatcttaaagaagtctcggatctctaagaagcctcaggtcccgaagaaaccccgagaatggaagaacccggagtcccagcgcggcttgtccggggcccaagatccattcccaggccccgcccccgtccctgtggaagtggtccagaagttctgtcgcattgacaaatcccgaaagctaccacattctaaagccaaaactcgaagccgacttgaggtggctgaagctgaggaagaggaaacaagtatcaaagctgctcgttctgagctgctgcttgctgaagaacctgggtttctggaaggggaggatggggaagacacagcaaagatatgccaggctgacattgtggaggctgtggacattgcaagtgcagccaagcactttgacttgaatctgcggcagtttggaccctacagactaaactactctcgaactggaagacacctggcttttggagggcgccgaggtcatgtggctgcccttgattgggtaacaaagaagcttatgtgcgagatcaacgtcatggaggcggtgcgggacatccggtttctccattctgaggcactgcttgctgttgctcagaaccgctggctccacatctatgacaatcagggcattgagctccactgtatccgccgctgtgaccgagtaacacggcttgagttcctgcccttccacttcctcctggctacagcttcagaaacagggtttctaacctacctggatgtgtcagtggggaagattgtggcagctctgaatgctcgagctgggcggctcgatgttatgagtcagaacccttacaatgccgtcatccatctcggacacagcaatggtactgtgtctttatggagtccagctatgaaggagccactggcaaagattctctgtcatcgtggtggggtccgggctgtggcagtagattctacaggcacgtacatggccacctctggcctagaccaccagctgaagatctttgacttgcgagggacgtaccagcctctgagcactcggaccctgccccatggagcagggcacctggccttctcccagaggggactgctggtggcgggaatgggtgacgttgtcaacatctgggcagggcagggcaaggccagcccaccctcccttgaacagccctacctcacccaccggctctcaggccctgtgcatggccttcagttctgcccctttgaagatgtgctgggggtggggcacactgggggcatcaccagcatgctggtccctggggccggtgagcccaacttcgatggcctggagagtaatccatacagaagccggaagcagcgccaggagtgggaggtgaaggccctgctagagaaggtacctgcagagcttatttgtctggacccacgagccctggccgaggtggatgtcatctccctggagcagggaaagaaggagcagatagagaggctgggctatgacccgcaggctaaggctcccttccagccaaagccaaagcagaagggccgcagctccacggcaagcctggtgaagaggaagaggaaggtcatggatgaggaacacagggacaaggtccggcagagccttcagcagcagcatcataaggaggcgaaggccaagcccacgggggcccggccatctgccctggacagatttgtgcgctgagccagactccagggttgcctgggaacagtctctccccaagatcacctgtagggaaatgagtgttccctggaacaaggaggtgggggcagtgtggccccttccccaactgggggtggacagctgtctcctggggtgggttggtattaaagaggaaagcgattttttgga

SEQ ID NO: 418325 - DNA, 2249 bp, Homo sapiens
gagagcttcatacctggtacgctgctgattggatgaaggacagagggcttccgggagttttcaagccgactgtgtggcagctgagaagagttttgcacgtggatcgccgttcgggtgggcgagatggagacagcccccaagccgggcaaggatgtcccgcccaagaaagacaaacttcagaccaagagaaagaaaccgcggcgatactgggaggaagagaccgttccgaccacagccggagcctctccagggcctcctcgtaacaagaagaatcgggagctccgtcctcagagaccaaaaaatgcttacatcttaaagaagtctcggatctctaagaagcctcaggtcccgaagaaaccccgagaatggaagaacccggagtcccagcgcggcttgtccggggcccaagatccattcccaggccccgcccccgtccctgtggaagtggtccagaagttctgtcgcattgacaaatcccgaaagctaccacattctaaagccaaaactcgaagccgacttgaggtggctgaagctgaggaagaggaaacaagtatcaaagctgctcgttctgagctgctgcttgctgaagaacctgggtttctggaaggggaggatggggaagacacagcaaagatatgccaggctgacattgtggaggctgtggacattgcaagtgcagccaagcactttgacttgaatctgcggcagtttggaccctacagactaaactactctcgaactggaagacacctggcttttggagggcgccgaggtcatgtggctgcccttgattgggtaacaaagaagcttatgtgcgagatcaacgtcatggaggcggtgcgggacatccggtttctccattctgaggcactgcttgctgttgctcagaaccgctggctccacatctatgacaatcagggcattgagctccactgtatccgccgctgtgaccgagtaacacggcttgagttcctgcccttccacttcctcctggctacagcttcagaaacagggtttctaacctacctggatgtgtcagtggggaagattgtggcagctctgaatgctcgagctgggcggctcgatgttatgagtcagaacccttacaatgccgtcatccatctcggacacagcaatggtactgtgtctttatggagtccagctatgaaggagccactggcaaagattctctgtcatcgtggtggggtccgggctgtggcagtagattctacaggcacgtacatggccacctctggcctagaccaccagctgaagatctttgacttgcgagggacgtaccagcctctgagcactcggaccctgccccatggagcagggcacctggccttctcccagaggggactgctggtggcgggaatgggtgacgttgtcaacatctgggcagggcagggcaaggccagcccaccctcccttgaacagccctacctcacccaccggctctcaggccctgtgcatggccttcagttctgcccctttgaagatgtgctgggggtggggcacactgggggcatcaccagcatgctggtccctggggccggtgagcccaacttcgatggcctggagagtaatccatacagaagccggaagcagcgccaggagtgggaggtgaaggccctgctagagaaggtacctgcagagcttatttgtctggacccacgagccctggccgaggtggatgtcatctccctggagcagggaaagaaggagcagatagagaggctgggctatgacccgcaggctaaggctcccttccagccaaagccaaagcagaagggccgcagctccacggcaagcctggtgaagaggaagaggaaggtcatggatgaggaacacagggtaaatgagcattggcatgggccgggccttccacaggctgcaccctcctgcttgtgcctctgcccttgtcagcctgccacttctcactctgtgcctgtgtcctccccgtctccggtccccaggacgacaaggtccggcagagccttcagcagcagcatcataaggaggcgaaggccaagcccacgggggcccggccatctgccctggacagatttgtgcgctgagccagactccagggttgcctgggaacagtctctccccaagatcacctgtagggaaatgagtgttccctggaacaaggaggtgggggcagtgtggccccttccccaactgggggtggacagctgtctcctggggtgggttggtattaaagaggaaagcgattttttgga

SEQ ID NO: 418326 - DNA, 1983 bp, Homo sapiens
gagagcttcatacctggtacgctgctgattggatgaaggacagagggcttccgggagttttcaagccgactgtgtggcagctgagaagagttttgcacgtggatcgccgttcgggtgggcgagatggagacagcccccaagccgggcaaggatgtcccgcccaagaaagacaaacttcagaccaagagaaagaaaccgcggcgatactgggaggaagagaccgttccgaccacagccggagcctctccagggcctcctcgtaacaagaagaatcgggagctccgtcctcagagaccaaaaaatgcttacatcttaaagaagtctcggatctctaagaagcctcaggtcccgaagaaaccccgagaatggaagaacccggagtcccagcgcggcttgtccggggcccaagatccattcccaggccccgcccccgtccctgtggaagtggtccagaagttctgtcgcattgacaaatcccgaaagctaccacattctaaagccaaaactcgaagccgacttgaggtggctgaagctgaggaagaggaaacaagtatcaaagctgctcgttctgagctgctgcttgctgaagaacctgggtttctggaaggggaggatggggaagacacagcaaagatatgccaggctgacattgtggaggctgtggacattgcaagtgcagccaagcactttgacttgaatctgcggcagtttggaccctacagactaaactactctcgaactggaagacacctggcttttggagggcgccgaggtcatgtggctgcccttgattgggtaacaaagaagcttatgtgcgagatcaacgtcatggaggcggtgcgggacatccggtttctccattctgaggcactgcttgctgttgctcagaaccgctggctccacatctatgacaatcagggcattgagctccactgtatccgccgctgtgaccgagtaacacggcttgagttcctgcccttccacttcctcctggctacagcttcagaaacagggtttctaacctacctggatgtgtcagtggggaagattgtggcagctctgaatgctcgagctgggcggctcgatgttatgagtcagaacccttacaatgccgtcatccatctcggacacagcaatggtactgtgtctttatggagtccagctatgaaggagccactggcaaagattctctgtcatcgtggtggggtccgggctgtggcagtagattctacaggcacgtacatggccacctctggcctagaccaccagctgaagatctttgacttgcgagggacgtaccagcctctgagcactcggaccctgccccatggagcagggcacctggccttctcccagaggggactgctggtggcgggaatgggtgacgttgtcaacatctgggcagggcagggggccggtgagcccaacttcgatggcctggagagtaatccatacagaagccggaagcagcgccaggagtgggaggtgaaggccctgctagagaaggtacctgcagagcttatttgtctggacccacgagccctggccgaggtggatgtcatctccctggagcagggaaagaaggagcagatagagaggctgggctatgacccgcaggctaaggctcccttccagccaaagccaaagcagaagggccgcagctccacggcaagcctggtgaagaggaagaggaaggtcatggatgaggaacacagggacaaggtccggcagagccttcagcagcagcatcataaggaggcgaaggccaagcccacgggggcccggccatctgccctggacagatttgtgcgctgagccagactccagggttgcctgggaacagtctctccccaagatcacctgtagggaaatgagtgttccctggaacaaggaggtgggggcagtgtggccccttccccaactgggggtggacagctgtctcctggggtgggttggtattaaagaggaaagcgattttttgga

SEQ ID NO: 418327 - DNA, 2010 bp, Homo sapiens
gagagcttcatacctggtacgctgctgattggatgaaggacagagggcttccgggagttttcaagccgactgtgtggcagctgagaagagttttgcacgtggatcgccgttcgggtgggcgagatggagacagcccccaagccgggcaaggatgtcccgcccaagaaagacaaacttcagaccaagagaaagaaaccgcggcgatactgggaggaagagaccgttccgaccacagccggagcctctccagggcctcctcgtaacaagaagaatcgggagctccgtcctcagagaccaaaaaatgcttacatcttaaagaagtctcggatctctaagaagcctcaggtcccgaagaaaccccgagaatggaagaacccggagtcccagcgcggcttgtccggggcccaagatccattcccaggccccgcccccgtccctgtggaagtggtccagaagttctgtcgcattgacaaatcccgaaagctaccacattctaaagccaaaactcgaagccgacttgaggtggctgaagctgaggaagaggaaacaagtatcaaagctgctcgttctgagctgctgcttgctgaagaacctgggtttctggaaggggaggatggggaagacacagcaaagatatgccaggctgacattgtggaggctgtggacattgcaagtgcagccaagcactttgacttgaatctgcggcagtttggaccctacagactaaactactctcgaactggaagacacctggcttttggagggcgccgaggtcatgtggctgcccttgattgggtaacaaagaagcttatgtgcgagatcaacgtcatggaggcggtgcgggacatccggtttctccattctgaggcactgcttgctgttgctcagaaccgctggctccacatctatgacaatcagggcattgagctccactgtatccgccgctgtgaccgagtaacacggcttgagttcctgcccttccacttcctcctggctacagcttcagaaacagggtttctaacctacctggatgtgtcagtggggaagattgtggcagctctgaatgctcgagctgggcggctcgatgttatgagtcagaacccttacaatgccgtcatccatctcggacacagcaatggtactgtgtctttatggagtccagctatgaaggagccactggcaaagattctctgtcatcgtggtggggtccgggctgtggcagtagattctacaggcacgtacatggccacctctggcctagaccaccagctgaagatctttgacttgcgagggacgtaccagcctctgagcactcggaccctgccccatggagcagggcacctggccttctcccagaggggactgctggtggcgggaatgggtgacgttgtcaacatctgggcagggcagggcaaggccagcccaccctcccttgaacagccctacctcacccaccggctctcaggccctgtgcatggccttcagttctgcccctttgaagatgtgctgggggtggggcacactgggggcatcaccagcatgctggtccctggggccggtgagcccaacttcgatggcctggagagtaatccatacagaagccggaagcagcgccaggagtgggaggtgaaggccctgctagagaaggtacctgcagagcttatttgtctggacccacgagccctggccgaggtggatgtcatctccctggagcagggaaagaaggagcagatagagaggctggacaaggtccggcagagccttcagcagcagcatcataaggaggcgaaggccaagcccacgggggcccggccatctgccctggacagatttgtgcgctgagccagactccagggttgcctgggaacagtctctccccaagatcacctgtagggaaatgagtgttccctggaacaaggaggtgggggcagtgtggccccttccccaactgggggtggacagctgtctcctggggtgggttggtattaaagaggaaagcgattttttgga

SEQ ID NO: 418328 - DNA, 2174 bp, Homo sapiens
gagagcttcatacctggtacgctgctgattggatgaaggacagagggcttccgggagttttcaagccgactgtgtggcagctgagaagagttttgcacgtggatcgccgttcgggtgggcgagatggagacagcccccaagccgggcaaggatgtcccgcccaagaaagacaaacttcagaccaagagaaagaaaccgcggcgatactgggaggaagagaccgttccgaccacagccggagcctctccagggcctcctcgtaacaagaagaatcgggagctccgtcctcagagaccaaaaaatgcttacatcttaaagaagtctcggatctctaagaagcctcaggtcccgaagaaaccccgagaatggaagaacccggagtcccagcgcggcttgtccggggcccaagatccattcccaggccccgcccccgtccctgtggaagtggtccagaagttctgtcgcattgacaaatcccgaaaggtgaggtccagccggagagttgggaagtgctggaggcagggagtgtctggctaccacattctaaagccaaaactcgaagccgacttgaggtggctgaagctgaggaagaggaaacaagtatcaaagctgctcgttctgagctgctgcttgctgaagaacctgggtttctggaaggggaggatggggaagacacagcaaagatatgccaggctgacattgtggaggctgtggacattgcaagtgcagccaagcactttgacttgaatctgcggcagtttggaccctacagactaaactactctcgaactggaagacacctggcttttggagggcgccgaggtcatgtggctgcccttgattgggtaacaaagaagcttatgtgcgagatcaacgtcatggaggcggtgcgggacatccggtttctccattctgaggcactgcttgctgttgctcagaaccgctggctccacatctatgacaatcagggcattgagctccactgtatccgccgctgtgaccgagtaacacggcttgagttcctgcccttccacttcctcctggctacagcttcagaaacagggtttctaacctacctggatgtgtcagtggggaagattgtggcagctctgaatgctcgagctgggcggctcgatgttatgagtcagaacccttacaatgccgtcatccatctcggacacagcaatggtactgtgtctttatggagtccagctatgaaggagccactggcaaagattctctgtcatcgtggtggggtccgggctgtggcagtagattctacaggcacgtacatggccacctctggcctagaccaccagctgaagatctttgacttgcgagggacgtaccagcctctgagcactcggaccctgccccatggagcagggcacctggccttctcccagaggggactgctggtggcgggaatgggtgacgttgtcaacatctgggcagggcagggcaaggccagcccaccctcccttgaacagccctacctcacccaccggctctcaggccctgtgcatggccttcagttctgcccctttgaagatgtgctgggggtggggcacactgggggcatcaccagcatgctggtccctggggccggtgagcccaacttcgatggcctggagagtaatccatacagaagccggaagcagcgccaggagtgggaggtgaaggccctgctagagaaggtacctgcagagcttatttgtctggacccacgagccctggccgaggtggatgtcatctccctggagcagggaaagaaggagcagatagagaggctgggctatgacccgcaggctaaggctcccttccagccaaagccaaagcagaagggccgcagctccacggcaagcctggtgaagaggaagaggaaggtcatggatgaggaacacagggacaaggtccggcagagccttcagcagcagcatcataaggaggcgaaggccaagcccacgggggcccggccatctgccctggacagatttgtgcgctgagccagactccagggttgcctgggaacagtctctccccaagatcacctgtagggaaatgagtgttccctggaacaaggaggtgggggcagtgtggccccttccccaactgggggtggacagctgtctcctggggtgggttggtattaaagaggaaagcgattttttgga

SEQ ID NO: 418329 - DNA, 1798 bp, Homo sapiens
gagagcttcatacctggtacgctgctgattggatgaaggacagagggcttccgggagttttcaagccgactgtgtggcagctgagaagagttttgcacgtggatcgccgttcgggtgggcgagatggagacagcccccaagccgggcaaggatgtcccgcccaagaaagacaaacttcagaccaagagaaagaaaccgcggcgatactgggaggaagagaccgttccgaccacagccggagcctctccagggcctcctcgtaacaagaagaatcgggagctccgtcctcagagaccaaaaaatgcttacatcttaaagaagtctcggatctctaagaagcctcaggtcccgaagaaaccccgagaatggaagaacccggagtcccagcgcggcttgtccggggcccaagatccattcccaggccccgcccccgtccctgtggaagtggtccagaagttctgtcgcattgacaaatcccgaaagctaccacattctaaagccaaaactcgaagccgacttgaggtggctgaagctgaggaagaggaaacaagtatcaaagctgctcgttctgagctgctgcttgctgaagaacctgggtttctggaaggggaggatggggaagacacagcaaagatatgccaggctgacattgtggaggctgtggacattgcaagtgcagccaagcactttgacttgaatctgcggcagtttggaccctacagactaaactactctcgaactggaagacacctggcttttggagggcgccgaggtcatgtggctgcccttgattgggtaacaaagaagcttatgtgcgagatcaacgtcatggaggcggtgcgggacatccggtttctccattctgaggcactgcttgctgttgctcagaaccgctggctccacatctatgacaatcagggcattgagctccactgtatccgccgctgtgaccgagtaacacggcttgagttcctgcccttccacttcctcctggctacagcttcagaaacagggtttctaacctacctggatgtgtcagtggggaagattgtggcagctctgaatgctcgagctgggcggctcgatgttatgagtcagaacccttacaatgccgtcatccatctcggacacagcaatggtactgtgtctttatggagtccagctatgaaggagccactggcaaagattctctgtcatcgtggtggggtccgggctgtggcagtagattctacaggcacgtaatgataggtgatatgtgaggtgcttgaaatgctgtgaagcacttacgactgtgtcactgtgacttgtagtgtacaaagcagcagtgcaaatcaggatgctgtagtcgctgtcgtgaccactcggctgtgtgttgtagagcaaaagcagccacagtattaagtaaatagtgtggccccgttccaataaaactttatttgttggatattggaatttgaatttcatacggttttcacagtctcaaaatattcttttgattttttttcaaccacttaaaaatgtaaaaaccattcttggcttgtgggctatacagaactagatgatgggccaggtttggcccatgggcagtagtttaccaagccttggtttaaagccctcatataagctgttgtagacattaagatgagttaaggcatatagtttagcacagcgcttagcaaaatagggagcgctgtgttcatcattgtcattcaagatgatcgttctctccaggtctggctgatgtgaggggtggaggtggtgtctgctttggatttctgctgttcctgagggagtatct

SEQ ID NO: 418330 - DNA, 1584 bp, Homo sapiens
gagagcttcatacctggtacgctgctgattggatgaaggacagagggcttccgggagttttcaagccgactgtgtggcagctgagaagagttttgcacgtggatcgccgttcgggtgggcgagatggagacagcccccaagccgggcaaggatgtcccgcccaagaaagacaaacttcagaccaagagaaagaaaccgcggcgatactgggaggaagagaccgttccgaccacagccggagcctctccagggcctcctcgtaacaagaagaatcgggagctccgtcctcagagaccaaaaaatgcttacatgtttctccattctgaggcactgcttgctgttgctcagaaccgctggctccacatctatgacaatcagggcattgagctccactgtatccgccgctgtgaccgagtaacacggcttgagttcctgcccttccacttcctcctggctacagcttcagaaacagggtttctaacctacctggatgtgtcagtggggaagattgtggcagctctgaatgctcgagctgggcggctcgatgttatgagtcagaacccttacaatgccgtcatccatctcggacacagcaatggtactgtgtctttatggagtccagctatgaaggagccactggcaaagattctctgtcatcgtggtggggtccgggctgtggcagtagattctacaggcacgtacatggccacctctggcctagaccaccagctgaagatctttgacttgcgagggacgtaccagcctctgagcactcggaccctgccccatggagcagggcacctggccttctcccagaggggactgctggtggcgggaatgggtgacgttgtcaacatctgggcagggcagggcaaggccagcccaccctcccttgaacagccctacctcacccaccggctctcaggccctgtgcatggccttcagttctgcccctttgaagatgtgctgggggtggggcacactgggggcatcaccagcatgctggtccctggggccggtgagcccaacttcgatggcctggagagtaatccatacagaagccggaagcagcgccaggagtgggaggtgaaggccctgctagagaaggtacctgcagagcttatttgtctggacccacgagccctggccgaggtggatgtcatctccctggagcagggaaagaaggagcagatagagaggctgggctatgacccgcaggctaaggctcccttccagccaaagccaaagcagaagggccgcagctccacggcaagcctggtgaagaggaagaggaaggtcatggatgaggaacacagggacaaggtccggcagagccttcagcagcagcatcataaggaggcgaaggccaagcccacgggggcccggccatctgccctggacagatttgtgcgctgagccagactccagggttgcctgggaacagtctctccccaagatcacctgtagggaaatgagtgttccctggaacaaggaggtgggggcagtgtggccccttccccaactgggggtggacagctgtctcctggggtgggttggtattaaagaggaaagcgattttttgga

SEQ ID NO: 418331 - DNA, 1098 bp, Homo sapiens
gagagcttcatacctggtacgctgctgattggatgaaggacagagggcttccgggagttttcaagccgactgtgtggcagctgagaagagttttgcacgtggatcgccgttcgggtgggcgagatggagacagcccccaagccgggcaaggatgtcccgcccaagaaagacaaacttcagaccaagagaaagaaaccgcggcgatactgggaggaagagaccgttccgaccacagccggagcctctccagggcctcctcgtaacaagaagaatcgggagctccgtcctcagagaccaaaaaatgcttacatcttaaagaagtctcggatctctaagaagcctcaggtcccgaagaaaccccgagaatggaagaacccggagtcccagcgcggcttgtccggggcccaagatccattcccaggccccgcccccgtccctgtggaagtggtccagaagttctgtcgcattgacaaatcccgaaagctaccacattctaaagccaaaactcgaagccgacttgaggtggctgaagctgaggaagaggaaacaagtatcaaagctgctcgttctgagctgctgcttgctgaagaacctgggtttctggaaggggaggatggggaagacacacctgccacttctcactctgtgcctgtgtcctccccgtctccggtccccaggacgacaaggtccggcagagccttcagcagcagcatcataaggaggcgaaggccaagcccacgggggcccggccatctgccctggacagatttgtgcgctgagccagactccagggttgcctgggaacagtctctccccaagatcacctgtagggaaatgagtgttccctggaacaaggaggtgggggcagtgtggccccttccccaactgggggtggacagctgtctcctggggtgggttggtattaaagaggaaagcgattttttggagataatgtgtctggatcatcttgtggacctgttcccctcccccttgccaagcatgaggccattctaggatcggaggggtcagtgtcctgcctctacccccaccccataccttgtggctgctgtggccttagctttgccttttaggggcctt

SEQ ID NO: 418332 - DNA, 550 bp, Homo sapiens
gagagcttcatacctggtacgctgctgattggatgaaggacagagggcttccgggagttttcaagccgactgtgtggcagctgagaagagttttgcacgtggatcgccgttcgggtgggcgagatggagacagcccccaagccgggcaaggatgtcccgcccaagaaagacaaacttcagaccaagagaaagaaaccgcggcgatactgggaggaagagaccgttccgaccacagccggagcctctccagggcctcctcgtaacaagaagaatcgggagctccgtcctcagagaccaaaaaatgcttacatcttaaagaagtctcggatctctaagaagcctcagggcccggccatctgccctggacagatttgtgcgctgagccagactccagggttgcctgggaacagtctctccccaagatcacctgtagggaaatgagtgttccctggaacaaggaggtgggggcagtgtggccccttccccaactgggggtggacagctgtctcctggggtgggttggtattaaagaggaaagcgattttttgga

SEQ ID NO: 418333 - DNA, 2275 bp, Homo sapiens
gagagcttcatacctggtacgctgctgattggatgaaggacagagggcttccgggagttttcaagccgactgtgtggcagctgagaagagttttgcacgtggatcgccgttcgggtgggcgagatggagacagcccccaagccgggcaaggatgtcccgcccaagaaagacaaacttcagaccaagagaaagaaaccgcggcgatactgggaggaagagaccgttccgaccacagccggagcctctccagggcctcctcgtaacaagaagaatcgggagctccgtcctcagagaccaaaaaatgcttacatcttaaagaagtctcggatctctaagaagcctcaggtcccgaagaaaccccgagaatggaagaacccggagtcccagcgcggcttgtccggggcccaagatccattcccaggccccgcccccgtccctgtggaagtggtccagaagttctgtcgcattgacaaatcccgaaagctaccacattctaaagccaaaactcgaagccgacttgaggtggctgaagctgaggaagaggaaacaagtatcaaagctgctcgttctgagctgctgcttgctgaagaacctgggtttctggaaggggaggatggggaagacacagcaaagatatgccaggctgacattgtggaggctgtggacattgcaagtgcagccaagcactttgacttgaatctgcggcagtttggaccctacagactaaactactctcgaactggaagacacctggcttttggagggcgccgaggtcatgtggctgcccttgattgggtaacaaagaagcttatgtgcgagatcaacgtcatggaggcggtgcgggacatccggtttctccattctgaggcactgcttgctgttgctcagaaccgctggctccacatctatgacaatcagggcattgagctccactgtatccgccgctgtgaccgagtaacacggcttgagttcctgcccttccacttcctcctggctacagcttcagaaacagggtttctaacctacctggatgtgtcagtggggaagattgtggcagctctgaatgctcgagctgggcggctcgatgttatgagtcagaacccttacaatgccgtcatccatctcggacacagcaatggtactgtgtctttatggagtccagctatgaaggagccactggcaaagattctctgtcatcgtggtggggtccgggctgtggcagtagattctacaggcacgtacatggccacctctggcctagaccaccagctgaagatctttgacttgcgagggacgtaccagcctctgagcactcggaccctgccccatggagcagggcacctggccttctcccagaggggactgctggtggcgggaatgggtgacgttgtcaacatctgggcagggcagggcaaggccagcccaccctcccttgaacagccctacctcacccaccggctctcaggccctgtgcatggccttcagttctgcccctttgaagatgtgctgggggtggggcacactgggggcatcaccagcatgctggtccctggggccggtgagcccaacttcgatggcctggagagtaatccatacagaagccggaagcagcgccaggagtgggaggtgaaggccctgctagagaaggtacctgcagagcttatttgtctggacccacgagccctggccgaggtggatgtcatctccctggagcagggaaagaaggagcagatagagaggctgggctatgacccgcaggctaaggctcccttccagccaaagccaaagcagaagggccgcagctccacggcaagcctggtgaagaggaagaggaaggtcatggatgaggaacacagggacaaggtccggcagagccttcagcagcagcatcataaggaggcgaaggccaagcccacgggggcccggccatctgccctggacagatttgtgcgctgagccagactccagggttgcctgggaacagtctctccccaagatcacctgtagggaaatgagtgttccctggaacaaggaggtgggggcagtgtggccccttccccaactgggggtggacagctgtctcctggggtgggttggtattaaagaggaaagcgattttttggagataatgtgtctggatcatcttgtggacctgttcccctcccccttgccaagcatgaggccattctaggatcggaggggtcagtgtcctgcctctacccccaccccataccttgtggctgctgtggccttagctttgccttttaggggcctt

SEQ ID NO: 418334 - DNA, 2275 bp, Homo sapiens
gagagcttcatacctggtacgctgctgattggatgaaggacagagggcttccgggagttttcaagccgactgtgtggcagctgagaagagttttgcacgtggatcgccgttcgggtgggcgagatggagacagcccccaagccgggcaaggatgtcccgcccaagaaagacaaacttcagaccaagagaaagaaaccgcggcgatactgggaggaagagaccgttccgaccacagccggagcctctccagggcctcctcgtaacaagaagaatcgggagctccgtcctcagagaccaaaaaatgcttacatcttaaagaagtctcggatctctaagaagcctcaggtcccgaagaaaccccgagaatggaagaacccggagtcccagcgcggcttgtccggggcccaagatccattcccaggccccgcccccgtccctgtggaagtggtccagaagttctgtcgcattgacaaatcccgaaagctaccacattctaaagccaaaactcgaagccgacttgaggtggctgaagctgaggaagaggaaacaagtatcaaagctgctcgttctgagctgctgcttgctgaagaacctgggtttctggaaggggaggatggggaagacacagcaaagatatgccaggctgacattgtggaggctgtggacattgcaagtgcagccaagcactttgacttgaatctgcggcagtttggaccctacagactaaactactctcgaactggaagacacctggcttttggagggcgccgaggtcatgtggctgcccttgattgggtaacaaagaagcttatgtgcgagatcaacgtcatggaggcggtgcgggacatccggtttctccattctgaggcactgcttgctgttgctcagaaccgctggctccacatctatgacaatcagggcattgagctccactgtatccgccgctgtgaccgagtaacacggcttgagttcctgcccttccacttcctcctggctacagcttcagaaacagggtttctaacctacctggatgtgtcagtggggaagattgtggcagctctgaatgctcgagctgggcggctcgatgttatgagtcagaacccttacaatgccgtcatccatctcggacacagcaatggtactgtgtctttatggagtccagctatgaaggagccactggcaaagattctctgtcatcgtggtggggtccgggctgtggcagtagattctacaggcacgtacatggccacctctggcctagaccaccagctgaagatctttgacttgcgagggacgtaccagcctctgagcactcggaccctgccccatggagcagggcacctggccttctcccagaggggactgctggtggcgggaatgggtgacgttgtcaacatctgggcagggcagggcaaggccagcccaccctcccttgaacagccctacctcacccaccggctctcaggccctgtgcatggccttcagttctgcccctttgaagatgtgctgggggtggggcacactgggggcatcaccagcatgctggtccctggtgagtgggccaggggatggggcttgaagtgaatgaactctgggtggaagtttgggccagagacatccaggaactgggggcttagttgggctggagctgttggactgaggttcttccttatggctccatgcttctccctccctcccttcaggggccggtgagcccaacttcgatggcctggagagtaatccatacagaagccggaagcagcgccaggagtgggaggtgaaggccctgctagagaaggtacctgcagagcttatttgtctggacccacgagccctggccgaggtggatgtcatctccctggagcagggaaagaaggagcagatagagaggctgggctatgacccgcaggctaaggctcccttccagccaaagccaaagcagaagggccgcagctccacggcaagcctggtgaagaggaagaggaaggtcatggatgaggaacacagggacaaggtccggcagagccttcagcagcagcatcataaggaggcgaaggccaagcccacgggggcccggccatctgccctggacagatttgtgcgctgagccagactccagggttgcctgggaacagtctctccccaagatcacctgtagggaaatgagtgttccctggaacaaggaggtgggggcagtgtggccccttccccaactgggggtggacagctgtctcctggggtgggttggtattaaagaggaaagcgattttttgga

SEQ ID NO: 418335 - DNA, 2246 bp, Homo sapiens
gagagcttcatacctggtacgctgctgattggatgaaggacagagggcttccgggagttttcaagccgactgtgtggcagctgagaagagttttgcacgtggatcgccgttcgggtgggcgagatggagacagcccccaagccgggcaaggatgtcccgcccaagaaagacaaacttcagaccaagagaaagaaaccgcggcgatactgggaggaagagaccgttccgaccacagccggagcctctccagggcctcctcgtaacaagaagaatcgggagctccgtcctcagagaccaaaaaatgcttacatcttaaagaagtctcggatctctaagaagcctcaggtcccgaagaaaccccgagaatggaagaacccggagtcccagcgcggcttgtccggggcccaagatccattcccaggccccgcccccgtccctgtggaagtggtccagaagttctgtcgcattgacaaatcccgaaagctaccacattctaaagccaaaactcgaagccgacttgaggtggctgaagctgaggaagaggaaacaagtatcaaagctgctcgttctgagctgctgcttgctgaagaacctgggtgagtgagccctaatctggacccccattccctgccttttgggactgtcttttctcgtttttatgttggtatacttgcttcatattgggaagctttactgccatcctaacccttgctttcaggtttctggaaggggaggatggggaagacacagcaaagatatgccaggctgacattgtggaggctgtggacattgcaagtgcagccaagcactttgacttgaatctgcggcagtttggaccctacagactaaactactctcgaactggaagacacctggcttttggagggcgccgaggtcatgtggctgcccttgattgggtaacaaagaagcttatgtgcgagatcaacgtcatggaggcggtgcgggacatccggtttctccattctgaggcactgcttgctgttgctcagaaccgctggctccacatctatgacaatcagggcattgagctccactgtatccgccgctgtgaccgagtaacacggcttgagttcctgcccttccacttcctcctggctacagcttcagaaacagggtttctaacctacctggatgtgtcagtggggaagattgtggcagctctgaatgctcgagctgggcggctcgatgttatgagtcagaacccttacaatgccgtcatccatctcggacacagcaatggtactgtgtctttatggagtccagctatgaaggagccactggcaaagattctctgtcatcgtggtggggtccgggctgtggcagtagattctacaggcacgtacatggccacctctggcctagaccaccagctgaagatctttgacttgcgagggacgtaccagcctctgagcactcggaccctgccccatggagcagggcacctggccttctcccagaggggactgctggtggcgggaatgggtgacgttgtcaacatctgggcagggcagggcaaggccagcccaccctcccttgaacagccctacctcacccaccggctctcaggccctgtgcatggccttcagttctgcccctttgaagatgtgctgggggtggggcacactgggggcatcaccagcatgctggtccctggggccggtgagcccaacttcgatggcctggagagtaatccatacagaagccggaagcagcgccaggagtgggaggtgaaggccctgctagagaaggtacctgcagagcttatttgtctggacccacgagccctggccgaggtggatgtcatctccctggagcagggaaagaaggagcagatagagaggctgggctatgacccgcaggctaaggctcccttccagccaaagccaaagcagaagggccgcagctccacggcaagcctggtgaagaggaagaggaaggtcatggatgaggaacacagggacaaggtccggcagagccttcagcagcagcatcataaggaggcgaaggccaagcccacgggggcccggccatctgccctggacagatttgtgcgctgagccagactccagggttgcctgggaacagtctctccccaagatcacctgtagggaaatgagtgttccctggaacaaggaggtgggggcagtgtggccccttccccaactgggggtggacagctgtctcctggggtgggttggtattaaagaggaaagcgattttttgga

SEQ ID NO: 418336 - DNA, 1345 bp, Homo sapiens
gagagcttcatacctggtacgctgctgattggatgaaggacagagggcttccgggagttttcaagccgactgtgtggcagctgagaagagttttgcacgtggatcgccgttcgggtgggcgagatggagacagcccccaagccgggcaaggatgtcccgcccaagaaagacaaacttcagaccaagagaaagaaaccgcggcgatactgggaggaagagaccgttccgaccacagccggagcctctccagggcctcctcgtaacaagaagaatcgggagctccgtcctcagagaccaaaaaatgcttacatcttaaagaagtctcggatctctaagaagcctcaggtcccgaagaaaccccgagaatggaagaacccggagtcccagcgcggcttgtccggggcccaagatccattcccaggccccgcccccgtccctgtggaagtggtccagaagttctgtcgcattgacaaatcccgaaagctaccacattctaaagccaaaactcgaagccgacttgaggtggctgaagctgaggaagaggaaacaagtatcaaagctgctcgttctgagctgctgcttgctgaagaacctgggtttctggaaggggaggatggggaagacacagcaaagatatgccaggctgacattgtggaggctgtggacattgcaagtgcagccaagcactttgacttgaatctgcggcagtttggaccctacagactaaactactctcgaactggaagacacctggcttttggagggcgccgaggtcatgtggctgcccttgattgggtaacaaagaagcttatgtgcgagatcaacgtcatggaggcggtgcgggacatccggtttctccattctgaggcactgcttgctgttgctcagaaccgctggctccacatctatgacaatcagggcattgagctccactgtatccgccgctgtgaccgagtaacacggcttgagttcctgcccttccacttcctcctggctacagcttcagaaacagggtttctaacctacctggatgtgtcagtggggaagattgtggcagctctgaatgctcgagctgggcggctcgatgttatgagtcagaacccttacaatgccgtcatccatctcggacacagcaatggtactgtgtctttatggagtccagctatgaaggagccactggcaaagattctctgtcatcgtggtggggtccgggctgtggcagtagattctacaggcacgtacatggccacctctggcctagaccaccagctgaagatctttgacttgcgagggacagctgtctcctggggtgggttggtattaaagaggaaagcgattttttgga

SEQ ID NO: 418337 - DNA, 1333 bp, Homo sapiens
gcctcgtgccgaatcggcacgaggcgagatcaacgtcatggaggcggtgcgggacatccggtttctccattctgaggcactgcttgctgttgctcagaaccgctggctccacatctatgacaatcagggcattgagctccactgtatccgccgctgtgaccgagtaacacggcttgagttcctgcccttccacttcctcctggctacagcttcagaaacagggtttctaacctacctggatgtgtcagtggggaagattgtggcagctctgaatgctcgagctgggcggctcgatgttatgagtcagaacccttacaatgccgtcatccatctcggacacagcaatggtactgtgtctttatggagtccagctatgaaggagccactggcaaagattctctgtcatcgtggtggggtccgggctgtggcagtagattctacaggcacgtacatggccacctctggcctagaccaccagctgaagatctttgacttgcgagggacgtaccagcctctgagcactcggaccctgccccatggagcagggcacctggccttctcccagaggggactgctggtggcgggaatgggtgacgttgtcaacatctgggcagggcagggcaaggccagcccaccctcccttgaacagccctacctcacccaccggctctcaggccctgtgcatggccttcagttctgcccctttgaagatgtgctgggggtggggcacactgggggcatcaccagcatgctggtccctggggccggtgagcccaacttcgatggcctggagagtaatccatacagaagccggaagcagcgccaggagtgggaggtgaaggccctgctagagaaggtacctgcagagcttatttgtctggacccacgagccctggccgaggtggatgtcatctccctggagcagggaaagaaggagcagatagagaggctgggctatgacccgcaggctaaggctcccttccagccaaagccaaagcagaagggccgcagctccacggcaagcctggtgaagaggaagaggaaggtcatggatgaggaacacagggacaaggtccggcagagccttcagcagcagcatcataaggaggcgaaggccaagcccacgggggcccggccatctgccctggacagatttgtgcgctgagccagactccagggttgcctgggaacagtctctccccaagatcacctgtagggaaatgagtgttccctggaacaaggaggtgggggcagtgtggccccttccccaactgggggtggacagctgtctcctggggtgggttggtattaaagaggaaagcgattttttgga

SEQ ID NO: 418338 - DNA, 1259 bp, Homo sapiens
agtgcctcagaatggagaaaccggatgtcccgcaccgcatctatgacaatcagggcattgagctccactgtatccgccgctgtgaccgagtaacacggcttgagttcctgcccttccacttcctcctggctacagcttcagaaacagggtttctaacctacctggatgtgtcagtggggaagattgtggcagctctgaatgctcgagctgggcggctcgatgttatgagtcagaacccttacaatgccgtcatccatctcggacacagcaatggtactgtgtctttatggagtccagctatgaaggagccactggcaaagattctctgtcatcgtggtggggtccgggctgtggcagtagattctacaggcacgtacatggccacctctggcctagaccaccagctgaagatctttgacttgcgagggacgtaccagcctctgagcactcggaccctgccccatggagcagggcacctggccttctcccagaggggactgctggtggcgggaatgggtgacgttgtcaacatctgggcagggcagggcaaggccagcccaccctcccttgaacagccctacctcacccaccggctctcaggccctgtgcatggccttcagttctgcccctttgaagatgtgctgggggtggggcacactgggggcatcaccagcatgctggtccctggggccggtgagcccaacttcgatggcctggagagtaatccatacagaagccggaagcagcgccaggagtgggaggtgaaggccctgctagagaaggtacctgcagagcttatttgtctggacccacgagccctggccgaggtggatgtcatctccctggagcagggaaagaaggagcagatagagaggctgggctatgacccgcaggctaaggctcccttccagccaaagccaaagcagaagggccgcagctccacggcaagcctggtgaagaggaagaggaaggtcatggatgaggaacacagggacaaggtccggcagagccttcagcagcagcatcataaggaggcgaaggccaagcccacgggggcccggccatctgccctggacagatttgtgcgctgagccagactccagggttgcctgggaacagtctctccccaagatcacctgtagggaaatgagtgttccctggaacaaggaggtgggggcagtgtggccccttccccaactgggggtggacagctgtctcctggggtgggttggtattaaagaggaaagcgattttttgga

SEQ ID NO: 418339 - DNA, 647 bp, Homo sapiens
gagagcttcatacctggtacgctgctgattggatgaaggacagagggcttccgggagttttcaagccgactgtgtggcagctgagaagagttttgcacgtggatcgccgttcgggtgggcgagatggagacagcccccaagccgggcaaggatgtcccgcccaagaaagacaaacttcagaccaagagaaagaaaccgcggcgatactgggaggaagagaccgttccgaccacagccggagcctctccagggcctcctcgtaacaagaagaatcgggagctccgtcctcagagaccaaaaaatgcttacatcttaaagaagtctcggatctctaagaagcctcaggtcccgaagaaaccccgagaatggaagaacccggagacaaggtccggcagagccttcagcagcagcatcataaggaggcgaaggccaagcccacgggggcccggccatctgccctggacagatttgtgcgctgagccagactccagggttgcctgggaacagtctctccccaagatcacctgtagggaaatgagtgttccctggaacaaggaggtgggggcagtgtggccccttccccaactgggggtggacagctgtctcctggggtgggttggtattaaagaggaaagcgattttttgga

SEQ ID NO: 418340 - DNA, 5628 bp, Homo sapiens
gttttccaagatggtagccaatgatatagcaaagatgtcaaggaagttaagcttacctactgacctaaagcctgatttagatgtaaaggataactcctttagccgatcacggagttcaagtgtaacaagcattgacaaagaatcccgagaagcgatctccgctcttcatttctgtgaaacgtttactcgaaagacggactcgtccccttccccttgtctatgggttggaacaacgctaggaacagtgcttgtcattgcactgaaccttcccccagggggagagcaaagacttcttcagccagtaattgtgtctccaagtggtactatattgaggttaaaaggtgcaatcttgagaatggcatttctggataccacaggctgcttaataccacctgcgtatgaaccctggagagagcacaatgttcctgaagaaaaagacgaaaaggagaaattgaaaaaacggcggcctgtctcagtatccccctcctcttctcaggaaattagtgaaaaccagtatgcagtgatatgttctgaaaagcaagcaaaagtaatctcactgccaacccagaactgtgcttataagcaaaatattacagagacctcgtttgtgcttcgtggagatattgtagcattgagtaacagtatctgccttgcctgtttctgtgccaatggacatataatgacttttagtttgccaagtttaagacctctgttggatgtgtattacttgccccttaccaatatgcggatagccagaacgttctgctttaccaacaatggacaagcattataccttgtttcacctacagaaatccagagacttacttatagtcaagagacctgtgaaaatcttcaggaaatgttgggtgaactcttcactcctgtagaaacacctgaagcaccaaacaggggattctttaaaggcttatttggaggtggtgcacaatctcttgacagagaagaactatttggagaatcgtcctcaggaaaggcttcaaggagccttgcacagcatattcctggccctggtggcattgaaggcgtaaaaggggcagcatctggagttgttggtgaattagcacgagccaggctggcactagatgaaagagggcagaaacttggcgatctggaagaaagaactgcggccatgttatcaagtgcagagtcattttctaaacatgctcatgagattatgttgaaatacaaagataagaagtggtaccagttctgacaaccagaatccaataagtccaacttcagccagaaggaaaaaagttttccatttttattacattctttaggaaagttaacgttaaagggatgttcgtcactgaatactgttctttcctagcacagtcatgcactgttttacctcagtcatgtggctttaactgaggagtgttcacacgcactcgaaatggagtatatggtgtgtgccagttatgagttgaccatttgggaattaaacaggtcacacgtgacagatgaagaaaccaagggggctgctgaggagacctggtgcagggactaatcctggatcattcctgtattaaactttcatatgccaaaagggtttgtgccgttttatctgccatcagtgtttgacctgtttagggcagaggcaataagtcagaagtcttgaagttgaaatagttatatgtgtgtcattggactggattataaacagctgtcttggactttccctctcttaacactgactggtcatcagtatcattagtgaaaaagaaacaaattgtttgttatcatctctttagacagataagctgaatggtgggctttaaataataaaaacatacacatagttgacttgtgtatgagctactcttggattcttgttattatagacttgtatttagttcatattttgtcaaaagcaaaacaagaagatacatcacttttcattgaaaagaaaagtgtagagcatgactgaattgctcatcattctgggagtttccatgtagtggctatgcagtgtggaaagtgagaaaaacctccattgtggtgaggagaatacttcaatgtcccttgtccttgttctcattaattcagctaaaggtggatttgaccaaaataatgctggttaaatttgtagaaatgttgaaattggctgtgttttaaattttgcttgaatttttataaaatgtttaaccaaatgtacctttgcattctttaattaaaattgcttaaaaaaaaactttcattatttcagtaaaatgctcagctcccttttcaaaatgccctttatttgctaactgttccaatacactcaggtgatgagccaattaaatgttagtgcacatgctatcgcatggaaaattacaagcatctgttgtcaataattatataagagtttagtctgatgacctacaaaatattttgtgtagaaatatactataaatctgtacatatcctttcaaggttttaaaaaaccaaaaagaaaggaaaatatgtacactgtgataactaaattatttctgtattggaatataatacaatttgagaccagcaatggacaatgaatgattgtttcatagaatagcattacgggcaggaaagaaaccacctagtagatctagaagtaagcaatctcagaatacagactaatctgagattattattgattgttgttaaagcaacccagcaaaagcaaaatggaagcattaaaattaatgttaatgaaatttaaatattgtcttctataaaaaattcctttaaatgattttgttttttcattaagagataatcagagcacaaattgatagtaaacaggatggttgtttttctattctatatgatcattaaaggaatatgtaggacatcttaactttttcatacagtctgttatgcatattttcctctacttttcattaataaagcttttatgtttacattttataacatgcactactagatgcaaaagtttacatcaaagtttactttaaatatcatttggtagggactaaatgtgtgtgatagagataattgatcaagccaaaagaaatattttttaaataagcccttttcaaaagtttttgaatttatagaaagcaccaatgaataacatatttctgtttcgttaatgtcagctgcctgaacattcagcagtttataaattgcttaatttgtgttatctattatccagtaaacccatagttccatgatatgtcacaggaattgttaggtcctattttaaaggtacagttttgtgaatgtcatcaataaaatcaacagttatggatttgaagaagttgggaaagcattatgtagattaatatactggttggttccctatctatgtggaaggtcatattagctgcaattatttaatttgctgtgttattttgtgttatataacacaaatatatttgtatattaacttcatttttactgtcatttttcctgttgtatacaaaatgaactaatcttgtaattattttcaaatatagaagtatatacattagatggatttccaagattttgtaagaaaatcttaaatcagtgttttgagttatttaatttttaaattaatctacaaattatgcacaacaaactagagactcagttaggattagaaagcttaaagtatgtttgagtgtaggaaataagcttctcagagttatacttgattctgtctgtagataagagacagtctacagtaataactaacccagggaatttactgtaatttgagaggtaacatctctatttttttctttttaaatacagaaagtaatagtcaccagcaagccacgatttcaggaaaactgactaaaaaaaaaagtcaaaatagaaaatatcagaaaaatgaaagatttttgtgtgccctctccatatcctcattgtttttgttgcatttgtccttgactctaaaatcactgaagtattcatgattagtagtttgtaagtaggaagtggtttttctgtatgtaccatatatccagttcatttcagttttcaaactaaaatccatatgtatttgctgagaaagttatttgaaatcttatattctgacaaattctgtacattacatccatttgaagttttgcatcatcttaacacttttgctttgcatttcaattgtacaaagtgtttccaaaaaaatggttatagattcgactgagctattactaacttctccatttgattttttatggatgtgaaaaatgctgctacttgtctatgttattatgtggtatttgttctcttggattgaaatttatgcccacagatttttcttttcatttgaaaatgaatgtgaagatactgtttacagcttttgttaattgcacttttcatcactctgatcaatttcttgtaaagtgctatgggaattatttttcctgtgaatattaatgattttactactgcctccgaagttttaaaaaaggttctgtagacagaaaacagttgttgcaaccaaaaacaaccaaaaaaagaaaaaaagggaaaactggcttacctttctcagatgaattaaatgattttaataacttcccaattaccagggttataacattgctttcttcagttattaatacagtcaaattaattttaacaatataggcacaattcatttacaaattcagtacagtagtccagggctacatgtaagtggtctctttattttattctttacatcagaaaaatcatgaatgtcagttttgccagtattttacaatgaggcttatcgtttaaaattttatagtgtatgacatgtaaataaaccagtatttattgtaggttgtttgattcaggcatttcaaatggatataggttaatggcaatggaatcctatttatttggtagttggttttgtttgtttttgtttatttacttttgctatttgttttgtattgtctaaactttgcttcaactgaagacagtgtaaggagttgaaaatacaatcaacatagcaatggaaagcaatgcaaagagggtaaatcttgttttaatttttttaactttttttttttgtaaataaatagtactgtgatactttaggtgtgacctctattccacatgatagttagaaccagaaaaacacttttgctttctagttatactattggttcattgtaaatgcattaccaaaagacaatatgaaaaagagcaagattaagtttttctaacattgtccacttcaggggcaagcatgcttggtatagagctctagcttgtgtataccttaaactgtaacttgcaggtgtttttcagttgctgcactttttatttaatcttgctcagtcccagtaactatctcaaaggtaattgctggaatatgcattttgaaatacggtttaaaaaaaaatctgtgtattgtttcatctaaaaagaaaagcactattggaaacactaaaaacgtgttaaactttgtagttattttgcattcctgtactttacaaactgtcatcacagcaaaaagtttaaaattaggtaatgaaatatttttgtaaataaataccgttaagctggtattttaaaaaatgtattataaattaattaatgtttctggaaaatgttcatatatatgtatatgaatgtctctttatgctgaagggctctgattgggcaaaataaaatactctaatctctcctgaaactaaacaa

SEQ ID NO: 418341 - DNA, 4596 bp, Homo sapiens
gttttccaagatggtagccaatgatatagcaaagatgtcaaggaagttaagcttacctactgacctaaagcctgatttagatgtaaaggataactcctttagccgatcacggagttcaagtgtaacaagcattgacaaagaatcccgagaagcgatctccgctcttcatttctgtgaaacgtttactcgaaagacggactcgtccccttccccttgtctatgggttggaacaacgctaggaacagtgcttgtcattgcactgaaccttcccccagggggagagcaaagacttcttcagccagtaattgtgtctccaagtggtactatattgaggttaaaaggtgcaatcttgagaatggcatttctggataccacaggctgcttaataccacctgcgtatgaaccctggagagagcacaatgttcctgaagaaaaagacgaaaaggagaaattgaaaaaacggcggcctgtctcagtatccccctcctcttctcaggaaattagtgaaaaccagtatgcagtgatatgttctgaaaagcaagcaaaagtaatctcactgccaacccagaactgtgcttataagcaaaatattacagagacctcgtttgtgcttcgtggagatattgtagcattgagtaacagtatctgccttgcctgtttctgtgccaatggacatataatgacttttagtttgccaagtttaagacctctgttggatgtgtattacttgccccttaccaatatgcggatagccagaacgttctgctttaccaacaatggacaagcattataccttgtttcacctacagaaatccagagacttacttatagtcaagagacctgtgaaaatcttcaggaaatgttgggtgaactcttcactcctgtagaaacacctgaagcaccaaacaggggattctttaaaggcttatttggaggtggtgcacaatctcttgacagagaagaactatttggagaatcgtcctcaggaaaggcttcaaggagccttgcacagcatattcctggccctggtggcattgaaggcgtaaaaggggcagcatctggagttgttggtgaattagcacgagccaggctggcactagatgaaagagggcagaaacttggcgatctggaagaaagaactgcggccatgttatcaagtgcagagtcattttctaaacatgctcatgagattatgttgaaatacaaagataagaagtggtaccagttctgacaaccagaatccaataagtccaacttcagccagaaggaaaaaagttttccatttttattacattctttaggaaagttaacgttaaagggatgttcgtcactgaatactgttctttcctagcacagtcatgcactgttttacctcagtcatgtggctttaactgaggagtgttcacacgcactcgaaatggagtatatggtgtgtgccagttatgagttgaccatttgggaattaaacaggtcacacgtgacagatgaagaaaccaagggggctgctgaggagacctggtgcagggactaatcctggatcattcctgtattaaactttcatatgccaaaagggtttgtgccgttttatctgccatcagtgtttgacctgtttagggcagaggcaataagtcagaagtcttgaagttgaaatagttatatgtgtgtcattggactggattataaacagctgtcttggactttccctctcttaacactgactggtcatcagtatcattagtgaaaaagaaacaaattgtttgttatcatctctttagacagataagctgaatggtgggctttaaataataaaaacatacacatagttgacttgtgtatgagctactcttggattcttgttattatagacttgtatttagttcatattttgtcaaaagcaaaacaagaagatacatcacttttcattgaaaagaaaagtgtagagcatgactgaattgctcatcattctgggagtttccatgtagtggctatgcagtgtggaaagtgagaaaaacctccattgtggtgaggagaatacttcaatgtcccttgtccttgttctcattaattcagctaaaggtggatttgaccaaaataatgctggttaaatttgtagaaatgttgaaattggctgtgttttaaattttgcttgaatttttataaaatgtttaaccaaatgtacctttgcattctttaattaaaattgcttaaaaaaaaactttcattatttcagtaaaatgctcagctcccttttcaaaatgccctttatttgctaactgttccaatacactcaggtgatgagccaattaaatgttagtgcacatgctatcgcatggaaaattacaagcatctgttgtcaataattatataagagtttagtctgatgacctacaaaatattttgtgtagaaatatactataaatctgtacatatcctttcaaggttttaaaaaaccaaaaagaaaggaaaatatgtacactgtgataactaaattatttctgtattggaatataatacaatttgagaccagcaatggacaatgaatgattgtttcatagaatagcattacgggcaggaaagaaaccacctagtagatctagaagtaagcaatctcagaatacagactaatctgagattattattgattgttgttaaagcaacccagcaaaagcaaaatggaagcattaaaattaatgttaatgaaatttaaatattgtcttctataaaaaattcctttaaatgattttgttttttcattaagagataatcagagcacaaattgatagtaaacaggatggttgtttttctattctatatgatcattaaaggaatatgtaggacatcttaactttttcatacagtctgttatgcatattttcctctacttttcattaataaagcttttatgtttacattttataacatgcactactagatgcaaaagtttacatcaaagtttactttaaatatcatttggtagggactaaatgtgtgtgatagagataattgatcaagccaaaagaaatattttttaaataagcccttttcaaaagtttttgaatttatagaaagcaccaatgaataacatatttctgtttcgttaatgtcagctgcctgaacattcagcagtttataaattgcttaatttgtgttatctattatccagtaaacccatagttccatgatatgtcacaggaattgttaggtcctattttaaaggtacagttttgtgaatgtcatcaataaaatcaacagttatggatttgaagaagttgggaaagcattatgtagattaatatactggttggttccctatctatgtggaaggtcatattagctgcaattatttaatttgctgtgttattttgtgttatataacacaaatatatttgtatattaacttcatttttactgtcatttttcctgttgtatacaaaatgaactaatcttgtaattattttcaaatatagaagtatatacattagatggatttccaagattttgtaagaaaatcttaaatcagtgttttgagttatttaatttttaaattaatctacaaattatgcacaacaaactagagactcagttaggattagaaagcttaaagtatgtttgagtgtaggaaataagcttctcagagttatacttgattctgtctgtagataagagacagtctacagtaataactaacccagggaatttactgtaatttgagaggtaacatctctatttttttctttttaaatacagaaagtaatagtcaccagcaagccacgatttcaggaaaactgactaaaaaaaaaagtcaaaatagaaaatatcagaaaaatgaaagatttttgtgtgccctctccatatcctcattgtttttgttgcatttgtccttgactctaaaatcactgaagtattcatgattagtagtttgtaagtaggaagtggtttttctgtatgtaccatatatccagttcatttcagttttcaaactaaaatccatatgtatttgctgagaaagttatttgaaatcttatattctgacaaattctgtacattacatccatttgaagttttgcatcatcttaacacttttgctttgcatttcaattgtacaaagtgtttccaaaaaaatggttatagattcgactgagctattactaacttctccatttgattttttatggatgtgaaaaatgctgctacttgtctatgttattatgtgtaagtatattacaatttaattaagtacaatagtttaaagaacgaagcaattttttttttttgggcttagaacttcttaattgtaggttcctctgaagcgatttcatgtagatatgtgagtgttttaaacaagtctgaaagtgttacatacttttaggttacaggggtgctggggagacagctgaggaaaggaagaatatgtggaagacaccacggagttcaaagttttaccctgagttctatcttccatgtatgttttgcttaaggcatttctcatgtgacattagaaaagctatatccaaaggtaaattttttgtggcaaagatttattttacactttaacttttgggattttatttgtttcagcaaaataaagagcactga

SEQ ID NO: 418342 - DNA, 2015 bp, Homo sapiens
tttagttttaaaatggaatttttataaatgtactttaattttaaaatggtgaacttgttaagtttaagtcaaagtacttaaaaagtatgtatattatccatacaaaaagttatgttttacgcttataataagaaatactggtatctcatatcgagatacaattaattttaaaaaatcatacatcatttaaaaatcttcacacatgaacaggaaagatatcatttctatgctttaaaaaaccctctattgagcattttcaaatattaattttattttgggggaaaatgcccacaacaataattgcaagatctttctcaatagcttcagtttgctgttggatgcctaccttaactattgttttaaaatatagatatatatatatatatttaaaatagttttccaggtattttcttctaccttttttaaaaataaatttccaaaaatgaaaacagagtttatgtatttttgtcaatgaaggtttttattttgtagtttatagaatttgttccttatcagtttgatacttgatcaacattcttagactttttaatctgtatttactttggggggaaaaaagcactcctatatcttaaatgtccttcttttttcttttcccttttagggtatttgttctcttggattgaaatttatgcccacagatttttcttttcatttgaaaatgaatgtgaagatactgtttacagcttttgttaattgcacttttcatcactctgatcaatttcttgtaaagtgctatgggaattatttttcctgtgaatattaatgattttactactgcctccgaagttttaaaaaaggttctgtagacagaaaacagttgttgcaaccaaaaacaaccaaaaaaagaaaaaaagggaaaactggcttacctttctcagatgaattaaatgattttaataacttcccaattaccagggttataacattgctttcttcagttattaatacagtcaaattaattttaacaatataggcacaattcatttacaaattcagtacagtagtccagggctacatgtaagtggtctctttattttattctttacatcagaaaaatcatgaatgtcagttttgccagtattttacaatgaggcttatcgtttaaaattttatagtgtatgacatgtaaataaaccagtatttattgtaggttgtttgattcaggcatttcaaatggatataggttaatggcaatggaatcctatttatttggtagttggttttgtttgtttttgtttatttacttttgctatttgttttgtattgtctaaactttgcttcaactgaagacagtgtaaggagttgaaaatacaatcaacatagcaatggaaagcaatgcaaagagggtaaatcttgttttaatttttttaactttttttttttgtaaataaatagtactgtgatactttaggtgtgacctctattccacatgatagttagaaccagaaaaacacttttgctttctagttatactattggttcattgtaaatgcattaccaaaagacaatatgaaaaagagcaagattaagtttttctaacattgtccacttcaggggcaagcatgcttggtatagagctctagcttgtgtataccttaaactgtaacttgcaggtgtttttcagttgctgcactttttatttaatcttgctcagtcccagtaactatctcaaaggtaattgctggaatatgcattttgaaatacggtttaaaaaaaaatctgtgtattgtttcatctaaaaagaaaagcactattggaaacactaaaaacgtgttaaactttgtagttattttgcattcctgtactttacaaactgtcatcacagcaaaaagtttaaaattaggtaatgaaatatttttgtaaataaataccgttaagctggtattttaaaaaatgtattataaattaattaatgtttctggaaaatgttcatatatatgtatatgaatgtctctttatgctgaagtgtcaacgtggggatactctagagcgag

SEQ ID NO: 418343 - DNA, 299 bp, Homo sapiens
aagcatatttcactttataattttatttcagttgtattaccactcaatccaaaaattgtattttaatgtagtaggattttatattagtaaaatgttcatgttttgagttactctttgatttatcaaatgtgttcagttggagaatcgtcctcaggaaaggcttcaaggagccttgcacagcatattcctggccctggtggcattgaaggcgtaaaaggggcagcatctggagttgttggtgaattagcacgagccaggctggcactagatgaaagagggcagaaacttggcgatctgga

SEQ ID NO: 418344 - DNA, 5605 bp, Homo sapiens
gttttccaagatggtagccaatgatatagcaaagatgtcaaggaagttaagcttacctactgacctaaagcctgatttagatgtaaaggataactcctttagccgatcacggagttcaagtgtaacaagcattgacaaagaatcccgagaagcgatctccgctcttcatttctgtgaaacgtttactcgaaagacggactcgtccccttccccttgtctatgggttggaacaacgctaggaacagtgcttgtcattgcactgaaccttcccccagggggagagcaaagacttcttcagccagtaattgtgtctccaagtggtactatattgaggttaaaaggtgcaatcttgagaatggcatttctggataccacaggctgcttaataccacctgcgtatgaaccctggagagagcacaatgttcctgaagaaaaagacgaaaaggagaaattgaaaaaacggcggcctgtctcagtatccccctcctcttctcaggaaattagtgaaaaccagtatgcagtgatatgttctgaaaagcaagcaaaagtaatctcactgccaacccagaactgtgcttataagcaaaatattacagagacctcgtttgtgcttcgtggagatattgtagcattgagtaacagtatctgccttgcctgtttctgtgccaatggacatataatgacttttagtttgccaagtttaagacctctgttggatgtgtattacttgccccttaccaatatgcggatagccagaacgttctgctttaccaacaatggacaagcattataccttgtttcacctacagaaatccagagacttacttatagtcaagagacctgtgaaaatcttcaggaaatgttgggtgaactcttcactcctgtagaaacacctgaagcaccaaacaggggattctttaaaggcttatttggaggtggtgcacaatctcttgacagagaagaactatttggagaatcgtcctcaggaaaggcttcaaggagccttgcacagcatattcctggccctggtggcattgaaggcgtaaaaggggcagcatctggagttgttggtgaattagcacgagccaggctggcactagatgaaagagggcagaaacttggcgatctggaagaaagaactgcggccatgttatcaagtgcagagtcattttctaaacatgctcatgagattatgttgaaatacaaagataagaagtggtaccagttctgacaaccagaatccaataagtccaacttcagccagaaggaaaaaagttttccatttttattacattctttaggaaagttaacgttaaagggatgttcgtcactgaatactgttctttcctagcacagtcatgcactgttttacctcagtcatgtggctttaactgaggagtgttcacacgcactcgaaatggagtatatggtgtgtgccagttatgagttgaccatttgggaattaaacaggtcacacgtgacagatgaagaaaccaagggggctgctgaggagacctggtgcagggactaatcctggatcattcctgtattaaactttcatatgccaaaagggtttgtgccgttttatctgccatcagtgtttgacctgtttagggcagaggcaataagtcagaagtcttgaagttgaaatagttatatgtgtgtcattggactggattataaacagctgtcttggactttccctctcttaacactgactggtcatcagtatcattagtgaaaaagaaacaaattgtttgttatcatctctttagacagataagctgaatggtgggctttaaataataaaaacatacacatagttgacttgtgtatgagctactcttggattcttgttattatagacttgtatttagttcatattttgtcaaaagcaaaacaagaagatacatcacttttcattgaaaagaaaagtgtagagcatgactgaattgctcatcattctgggagtttccatgtagtggctatgcagtgtggaaagtgagaaaaacctccattgtggtgaggagaatacttcaatgtcccttgtccttgttctcattaattcagctaaaggtggatttgaccaaaataatgctggttaaatttgtagaaatgttgaaattggctgtgttttaaattttgcttgaatttttataaaatgtttaaccaaatgtacctttgcattctttaattaaaattgcttaaaaaaaaactttcattatttcagtaaaatgctcagctcccttttcaaaatgccctttatttgctaactgttccaatacactcaggtgatgagccaattaaatgttagtgcacatgctatcgcatggaaaattacaagcatctgttgtcaataattatataagagtttagtctgatgacctacaaaatattttgtgtagaaatatactataaatctgtacatatcctttcaaggttttaaaaaaccaaaaagaaaggaaaatatgtacactgtgataactaaattatttctgtattggaatataatacaatttgagaccagcaatggacaatgaatgattgtttcatagaatagcattacgggcaggaaagaaaccacctagtagatctagaagtaagcaatctcagaatacagactaatctgagattattattgattgttgttaaagcaacccagcaaaagcaaaatggaagcattaaaattaatgttaatgaaatttaaatattgtcttctataaaaaattcctttaaatgattttgttttttcattaagagataatcagagcacaaattgatagtaaacaggatggttgtttttctattctatatgatcattaaaggaatatgtaggacatcttaactttttcatacagtctgttatgcatattttcctctacttttcattaataaagcttttatgtttacattttataacatgcactactagatgcaaaagtttacatcaaagtttactttaaatatcatttggtagggactaaatgtgtgtgatagagataattgatcaagccaaaagaaatattttttaaataagcccttttcaaaagtttttgaatttatagaaagcaccaatgaataacatatttctgtttcgttaatgtcagctgcctgaacattcagcagtttataaattgcttaatttgtgttatctattatccagtaaacccatagttccatgatatgtcacaggaattgttaggtcctattttaaaggtacagttttgtgaatgtcatcaataaaatcaacagttatggatttgaagaagttgggaaagcattatgtagattaatatactggttggttccctatctatgtggaaggtcatattagctgcaattatttaatttgctgtgttattttgtgttatataacacaaatatatttgtatattaacttcatttttactgtcatttttcctgttgtatacaaaatgaactaatcttgtaattattttcaaatatagaagtatatacattagatggatttccaagattttgtaagaaaatcttaaatcagtgttttgagttatttaatttttaaattaatctacaaattatgcacaacaaactagagactcagttaggattagaaagcttaaagtatgtttgagtgtaggaaataagcttctcagagttatacttgattctgtctgtagataagagacagtctacagtaataactaacccagggaatttactgtaatttgagaggtaacatctctatttttttctttttaaatacagaaagtaatagtcaccagcaagccacgatttcaggaaaactgactaaaaaaaaaagtcaaaatagaaaatatcagaaaaatgaaagatttttgtgtgccctctccatatcctcattgtttttgttgcatttgtccttgactctaaaatcactgaagtattcatgattagtagtttgtaagtaggaagtggtttttctgtatgtaccatatatccagttcatttcagttttcaaactaaaatccatatgtatttgctgagaaagttatttgaaatcttatattctgacaaattctgtacattacatccatttgaagttttgcatcatcttaacacttttgctttgcatttcaattgtacaaagtgtttccaaaaaaatggttatagattcgactgagctattactaacttctccatttgattttttatggatgtgaaaaatgctgctacttgtctatgttattatgtggtatttgttctcttggattgaaatttatgcccacagatttttcttttcatttgaaaatgaatgtgaagatactgtttacagcttttgttaattgcacttttcatcactctgatcaatttcttgtaaagtgctatgggaattatttttcctgtgaatattaatgattttactactgcctccgaagttttaaaaaaggttctgtagacagaaaacagttgttgcaaccaaaaacaaccaaaaaaagaaaaaaagggaaaactggcttacctttctcagatgaattaaatgattttaataacttcccaattaccagggttataacattgctttcttcagttattaatacagtcaaattaattttaacaatataggcacaattcatttacaaattcagtacagtagtccagggctacatgtaagtggtctctttattttattctttacatcagaaaaatcatgaatgtcagttttgccagtattttacaatgaggcttatcgtttaaaattttatagtgtatgacatgtaaataaaccagtatttattgtaggttgtttgattcaggcatttcaaatggatataggttaatggcaatggaatcctatttatttggtagttggttttgtttgtttttgtttatttacttttgctatttgttttgtattgtctaaactttgcttcaactgaagacagtgtaaggagttgaaaatacaatcaacatagcaatggaaagcaatgcaaagagggtaaatcttgttttaatttttttaactttttttttttgtaaataaatagtactgtgatactttaggtgtgacctctattccacatgatagttagaaccagaaaaacacttttgctttctagttatactattggttcattgtaaatgcattaccaaaagacaatatgaaaaagagcaagattaagtttttctaacattgtccacttcaggggcaagcatgcttggtatagagctctagcttgtgtataccttaaactgtaacttgcaggtgtttttcagttgctgcactttttatttaatcttgctcagtcccagtaactatctcaaaggtaattgctggaatatgcattttgaaatacggtttaaaaaaaaatctgtgtattgtttcatctaaaaagaaaagcactattggaaacactaaaaacgtgttaaactttgtagttattttgcattcctgtactttacaaactgtcatcacagcaaaaagtttaaaattaggtaatgaaatatttttgtaaataaataccgttaagctggtattttaaaaaatgtattataaattaattaatgtttctggaaaatgttcatatatatgtatatgaatgtctctttatgctgaagtgtcaacgtggggatactctagagcgag

SEQ ID NO: 418345 - DNA, 3117 bp, Homo sapiens
tgctgtactgagagagaatgttacataacattgagaactagtacaagtaaatattaaagtgaagtgaccatttcctacacaagctcattcagaggaggatgaagaccattttggaggaagaaaagcacccttattaagaattgcagcaagtaagccaacaaggtcttttcaggatgattttcttatatcaagtggtacatttcattttatttacttcagtttctggtgaatgtgtgactcagttgttgaaggacacctgctttgaaggaggggacattactacggtcttcacaccaagcgccaagtactgccaggtagtctgcacttaccacccaagatgtttactcttcactttcacggcggaatcaccatctgaggatcccacccgatggtttacttgtgtcctgaaagacagtgttacagaaacactgccaagagtgaataggacagcagcgatttctgggtattctttcaagcaatgctcacaccaaataagcgcttgcaacaaagacatttatgtggacctagacatgaagggcataaactataacagctcagttgccaagagtgctcaagaatgccaagaaagatgcacggatgacgtccactgccactttttcacgtacgccacaaggcagtttcccagcctggagcatcgtaacatttgtctactgaagcacacccaaacagggacaccaaccagaataacgaagctcgataaagtggtgtctggattttcactgaaatcctgtgcactttctaatctggcttgtattagggacattttccctaatacggtgtttgcagacagcaacatcgacagtgtcatggctcccgatgcttttgtctgtggccgaatctgcactcatcatcccggttgcttgttttttaccttcttttcccaggaatggcccaaagaatctcaaagaaatctttgtctccttaaaacatctgagagtggattgcccagtacacgcattaaaaagagcaaagctctttctggtttcagtctacaaagctgcaggcacagcatcccagtgttctgccattcttcattttaccatgacactgatttcttgggagaagaactggatattgttgctgcaaaaagtcacgaggcctgccagaaactgtgcaccaatgccgtccgctgccagttttttacctataccccagcccaagcatcctgcaacgaagggaagggcaagtgttacttaaagctttcttcaaacggatctccaactaaaatacttcacgggagaggaggcatctctggatacacattaaggttgtgtaaaatggataatgagtgtaccaccaaaatcaagcccaggatcgttggaggaactgcgtctgttcgtggtgagtggccgtggcaggtgaccctgcacacaacctcacccactcagagacacctgtgtggaggctccatcattggaaaccagtggatattaacagccgctcactgtttctatggggtagagtcacctaagattttgcgtgtctacagtggcattttaaatcaatctgaaataaaagaggacacatctttctttggggttcaagaaataataatccatgatcagtataaaatggcagaaagcgggtatgatattgccttgttgaaactggaaaccacagtgaattacacagattctcaacgacccatatgcctgccttccaaaggagatagaaatgtaatatacactgattgctgggtgactggatgggggtacagaaaactaagagacaaaatacaaaatactctccagaaagccaagatacccttagtgaccaacgaagagtgccagaagagatacagaggacataaaataacccataagatgatctgtgccggctacagggaaggagggaaggacgcttgcaagggagattcgggaggccctctgtcctgcaaacacaatgaggtctggcatctggtaggcatcacgagctggggcgaaggctgtgctcaaagggagcggccaggtgtttacaccaacgtggtcgagtacgtggactggattctggagaaaactcaagcagtgtgaatgggttcccaggggccattggagtccctgaaggacccaggatttgctgggagagggtgttgagttcactgtgccagcatgcttcctccacagtaacacgctgaaggggcttggtgtttgtaagaaaatgctagaagaaaacaaactgtcacaagttgttatgtccaaaactcccgttctatgatcgttgtagtttgtttgagcattcagtctctttgtttttgatcacgcttctatggagtccaagaattaccataaggcaatatttctgaagattactatataggcagatatagcagaaaataaccaagtagtggcagtggggatcaggcagaagaactggtaaaagaagccaccataaatagatttgttcgatgaaagatgaaaactggaagaaaggagaacaaagacagtcttcaccattttgcaggaatctacactctgcctatgtgaacacatttcttttgtaaagaaagaaattgattgcatttaatggcagattttcagaatagtcaggaattcttgtcatttccattttaaaatatatattaaaaaaaatcagttcgagtagacacgagctaagagtgaatgtgaagataacagaatttctgtgtggaagaggattacaagcagcaatttacctggaagtgataccttaggggcaatcttgaagatacactttcctgaaaaatgatttgtgatggattgtatatttatttaaaatatcttgggaggggaggctgatggagatagggagcatgctcaaacctccctaagacaagctgctgctgtgactatgggctcccaaagagctagatcgtatatttatttgacaaaaatcaccatagactgcatccatactacagagaaaaaacaattagggcgcaaatggatagttacagtaaagtcttcagcaagcagctgcctgtattctaagcactgggattttctgtttcgtgcaaatatttatctcattatgttgtgatctagttcaataacctagaatttgaattgtcaccacatagctttcaatctgtgccaacaactatacaattcatcaagtgtg

SEQ ID NO: 418346 - DNA, 2957 bp, Homo sapiens
tgctgtactgagagagaatgttacataacattgagaactagtacaagtaaatattaaagtgaagtgaccatttcctacacaagctcattcagaggaggatgaagaccattttggaggaagaaaagcacccttattaagaattgcagcaagtaagccaacaaggtcttttcaggatgattttcttatatcaagtggtacatttcattttatttacttcagtttctggtgaatgtgtgactcagttgttgaaggacacctgctttgaaggaggggacattactacggtcttcacaccaagcgccaagtactgccaggtagtctgcacttaccacccaagatgtttactcttcactttcacggcggaatcaccatctgaggatcccacccgatggtttacttgtgtcctgaaagacagtgttacagaaacactgccaagagtgaataggacagcagcgatttctgggtattctttcaagcaatgctcacaccaaataagcgtaacatttgtctactgaagcacacccaaacagggacaccaaccagaataacgaagctcgataaagtggtgtctggattttcactgaaatcctgtgcactttctaatctggcttgtattagggacattttccctaatacggtgtttgcagacagcaacatcgacagtgtcatggctcccgatgcttttgtctgtggccgaatctgcactcatcatcccggttgcttgttttttaccttcttttcccaggaatggcccaaagaatctcaaagaaatctttgtctccttaaaacatctgagagtggattgcccagtacacgcattaaaaagagcaaagctctttctggtttcagtctacaaagctgcaggcacagcatcccagtgttctgccattcttcattttaccatgacactgatttcttgggagaagaactggatattgttgctgcaaaaagtcacgaggcctgccagaaactgtgcaccaatgccgtccgctgccagttttttacctataccccagcccaagcatcctgcaacgaagggaagggcaagtgttacttaaagctttcttcaaacggatctccaactaaaatacttcacgggagaggaggcatctctggatacacattaaggttgtgtaaaatggataatgagtgtaccaccaaaatcaagcccaggatcgttggaggaactgcgtctgttcgtggtgagtggccgtggcaggtgaccctgcacacaacctcacccactcagagacacctgtgtggaggctccatcattggaaaccagtggatattaacagccgctcactgtttctatggggtagagtcacctaagattttgcgtgtctacagtggcattttaaatcaatctgaaataaaagaggacacatctttctttggggttcaagaaataataatccatgatcagtataaaatggcagaaagcgggtatgatattgccttgttgaaactggaaaccacagtgaattacacagattctcaacgacccatatgcctgccttccaaaggagatagaaatgtaatatacactgattgctgggtgactggatgggggtacagaaaactaagagacaaaatacaaaatactctccagaaagccaagatacccttagtgaccaacgaagagtgccagaagagatacagaggacataaaataacccataagatgatctgtgccggctacagggaaggagggaaggacgcttgcaagggagattcgggaggccctctgtcctgcaaacacaatgaggtctggcatctggtaggcatcacgagctggggcgaaggctgtgctcaaagggagcggccaggtgtttacaccaacgtggtcgagtacgtggactggattctggagaaaactcaagcagtgtgaatgggttcccaggggccattggagtccctgaaggacccaggatttgctgggagagggtgttgagttcactgtgccagcatgcttcctccacagtaacacgctgaaggggcttggtgtttgtaagaaaatgctagaagaaaacaaactgtcacaagttgttatgtccaaaactcccgttctatgatcgttgtagtttgtttgagcattcagtctctttgtttttgatcacgcttctatggagtccaagaattaccataaggcaatatttctgaagattactatataggcagatatagcagaaaataaccaagtagtggcagtggggatcaggcagaagaactggtaaaagaagccaccataaatagatttgttcgatgaaagatgaaaactggaagaaaggagaacaaagacagtcttcaccattttgcaggaatctacactctgcctatgtgaacacatttcttttgtaaagaaagaaattgattgcatttaatggcagattttcagaatagtcaggaattcttgtcatttccattttaaaatatatattaaaaaaaatcagttcgagtagacacgagctaagagtgaatgtgaagataacagaatttctgtgtggaagaggattacaagcagcaatttacctggaagtgataccttaggggcaatcttgaagatacactttcctgaaaaatgatttgtgatggattgtatatttatttaaaatatcttgggaggggaggctgatggagatagggagcatgctcaaacctccctaagacaagctgctgctgtgactatgggctcccaaagagctagatcgtatatttatttgacaaaaatcaccatagactgcatccatactacagagaaaaaacaattagggcgcaaatggatagttacagtaaagtcttcagcaagcagctgcctgtattctaagcactgggattttctgtttcgtgcaaatatttatctcattatgttgtgatctagttcaataacctagaatttgaattgtcaccacatagctttcaatctgtgccaacaactatacaattcatcaagtgtg

SEQ ID NO: 418347 - DNA, 1312 bp, Homo sapiens
caaaatcagcctgagcaagatgtgctgaagatgggaagcgtctgagttgatctgtgcaccttttcttgtctcccctcgttctagggagattcgggaggccctctgtcctgcaaacacaatgaggtctggcatctggtaggcatcacgagctggggcgaaggctgtgctcaaagggagcggccaggtgtttacaccaacgtggtcgagtacgtggactggattctggagaaaactcaagcagtgtgaatgggttcccaggggccattggagtccctgaaggacccaggatttgctgggagagggtgttgagttcactgtgccagcatgcttcctccacagtaacacgctgaaggggcttggtgtttgtaagaaaatgctagaagaaaacaaactgtcacaagttgttatgtccaaaactcccgttctatgatcgttgtagtttgtttgagcattcagtctctttgtttttgatcacgcttctatggagtccaagaattaccataaggcaatatttctgaagattactatataggcagatatagcagaaaataaccaagtagtggcagtggggatcaggcagaagaactggtaaaagaagccaccataaatagatttgttcgatgaaagatgaaaactggaagaaaggagaacaaagacagtcttcaccattttgcaggaatctacactctgcctatgtgaacacatttcttttgtaaagaaagaaattgattgcatttaatggcagattttcagaatagtcaggaattcttgtcatttccattttaaaatatatattaaaaaaaatcagttcgagtagacacgagctaagagtgaatgtgaagataacagaatttctgtgtggaagaggattacaagcagcaatttacctggaagtgataccttaggggcaatcttgaagatacactttcctgaaaaatgatttgtgatggattgtatatttatttaaaatatcttgggaggggaggctgatggagatagggagcatgctcaaacctccctaagacaagctgctgctgtgactatgggctcccaaagagctagatcgtatatttatttgacaaaaatcaccatagactgcatccatactacagagaaaaaacaattagggcgcaaatggatagttacagtaaagtcttcagcaagcagctgcctgtattctaagcactgggattttctgtttcgtgcaaatatttatctcattatgttgtgatctagttcaataacctagaatttgaattgtcaccacatagctttcaatctgtgccaacaactatacaattcatcaagtgtg

SEQ ID NO: 418348 - DNA, 992 bp, Homo sapiens
tgctgtactgagagagaatgttacataacattgagaactagtacaagtaaatattaaagtgaagtgaccatttcctacacaagctcattcagaggaggatgaagaccattttggaggaagaaaagcacccttattaagaattgcagcaagtaagccaacaaggtcttttcaggatgattttcttatatcaagtggtacatttcattttatttacttcagtttctggtgaatgtgtgactcagttgttgaaggacacctgctttgaaggaggggacattactacggtcttcacaccaagcgccaagtactgccaggtagtctgcacttaccacccaagatgtttactcttcactttcacggcggaatcaccatctgaggatcccacccgatggtttacttgtgtcctgaaagacagtgttacagaaacactgccaagagtgaataggacagcagcgatttctgggtattctttcaagcaatgctcacaccaaataagcgcttgcaacaaagacatttatgtggacctagacatgaagggcataaactataacagctcagttgccaagagtgctcaagaatgccaagaaagatgcacggatgacgtccactgccactttttcacgtacgccacaaggcagtttcccagcctggagcatcggtgagtgagtcccaggacattcgagtggtcgatgaaaaacagaatcgtgatttactaaaaagcttttgccatcaactttatgccagaatttattttgaacccctaaaagacatttctataaaagtactcctagttttcttcatgaaaaatacacttaaagcctaatttggatgcatttcatttatggtaaggagtctatcttttaataacactgtcagaaaaatatatatacttggctaatttcaaaagcgctacacttttaaattggcacttttgaaacagctgcaattggtatgattgtcagtgcccttcccagtctaaaaaatgttacagt

SEQ ID NO: 418349 - DNA, 691 bp, Homo sapiens
ctttttggctttctgtgtgctgacttttaagatccattattttaaaaacataaattcctattcattaatatgtattttttaaaaaaacaggtttacttgtgtcctgaaagacagtgttacagaaacactgccaagagtgaataggacagcagcgatttctgggtattctttcaagcaatgctcacaccaaataagcgcttgcaacaaagacatttatgtggacctagacatgaagggcataaactataacagctcagttgccaagagtgctcaagaatgccaagaaagatgcacggatgacgtccactgccactttttcacgtacgccacaaggcagtttcccagcctggagcatcggtgagtgagtcccaggacattcgagtggtcgatgaaaaacagaatcgtgatttactaaaaagcttttgccatcaactttatgccagaatttattttgaacccctaaaagacatttctataaaagtactcctagttttcttcatgaaaaatacacttaaagcctaatttggatgcatttcatttatggtaaggagtctatcttttaataacactgtcagaaaaatatatatacttggctaatttcaaaagcgctacacttttaaattggcacttttgaaacagctgcaattggtatgattgtcagtgcccttcccagtctaaaaaatgttacagt

SEQ ID NO: 418350 - DNA, 3205 bp, Homo sapiens
tgctgtactgagagagaatgttacataacattgagaactagtacaagtaaatattaaagtgaagtgaccatttcctacacaagctcattcagaggaggatgaagaccattttggaggaagatgattttcttatatcaagtggtacatttcattttatttacttcagtttctggtgaatgtgtgactcagttgttgaaggacacctgctttgaaggaggggacattactacggtcttcacaccaagcgccaagtactgccaggtagtctgcacttaccacccaagatgtttactcttcactttcacggcggaatcaccatctgaggatcccacccgatggtttacttgtgtcctgaaagacagtgttacagaaacactgccaagagtgaataggacagcagcgatttctgggtattctttcaagcaatgctcacaccaaataagcgcttgcaacaaagacatttatgtggacctagacatgaagggcataaactataacagctcagttgccaagagtgctcaagaatgccaagaaagatgcacggatgacgtccactgccactttttcacgtacgccacaaggcagtttcccagcctggagcatcgtaacatttgtctactgaagcacacccaaacagggacaccaaccagaataacgaagctcgataaagtggtgtctggattttcactgaaatcctgtgcactttctaatctggcttgtattagggacattttccctaatacggtgtttgcagacagcaacatcgacagtgtcatggctcccgatgcttttgtctgtggccgaatctgcactcatcatcccggttgcttgttttttaccttcttttcccaggaatggcccaaagaatctcaaagaaatctttgtctccttaaaacatctgagagtggattgcccagtacacgcattaaaaagagcaaagctctttctggtttcagtctacaaagctgcaggcacagcatcccagtgttctgccattcttcattttaccatgacactgatttcttgggagaagaactggatattgttgctgcaaaaagtcacgaggcctgccagaaactgtgcaccaatgccgtccgctgccagttttttacctataccccagcccaagcatcctgcaacgaagggaagtaagccatatgaagggttatgcagacacccttgtcccgtctgcctgtgaggtgcattatgtttataccgttttgtttccaactgcaggggcaagtgttacttaaagctttcttcaaacggatctccaactaaaatacttcacgggagaggaggcatctctggatacacattaaggttgtgtaaaatggataatgagcttagaggcgctccgatgaaaatctctggatggctcaagacttcttaaaaaagtgtaccaccaaaatcaagcccaggatcgttggaggaactgcgtctgttcgtggtgagtggccgtggcaggtgaccctgcacacaacctcacccactcagagacacctgtgtggaggctccatcattggaaaccagtggatattaacagccgctcactgtttctatggggtagagtcacctaagattttgcgtgtctacagtggcattttaaatcaatctgaaataaaagaggacacatctttctttggggttcaagaaataataatccatgatcagtataaaatggcagaaagcgggtatgatattgccttgttgaaactggaaaccacagtgaattacacagattctcaacgacccatatgcctgccttccaaaggagatagaaatgtaatatacactgattgctgggtgactggatgggggtacagaaaactaagagacaaaatacaaaatactctccagaaagccaagatacccttagtgaccaacgaagagtgccagaagagatacagaggacataaaataacccataagatgatctgtgccggctacagggaaggagggaaggacgcttgcaagggagattcgggaggccctctgtcctgcaaacacaatgaggtctggcatctggtaggcatcacgagctggggcgaaggctgtgctcaaagggagcggccaggtgtttacaccaacgtggtcgagtacgtggactggattctggagaaaactcaagcagtgtgaatgggttcccaggggccattggagtccctgaaggacccaggatttgctgggagagggtgttgagttcactgtgccagcatgcttcctccacagtaacacgctgaaggggcttggtgtttgtaagaaaatgctagaagaaaacaaactgtcacaagttgttatgtccaaaactcccgttctatgatcgttgtagtttgtttgagcattcagtctctttgtttttgatcacgcttctatggagtccaagaattaccataaggcaatatttctgaagattactatataggcagatatagcagaaaataaccaagtagtggcagtggggatcaggcagaagaactggtaaaagaagccaccataaatagatttgttcgatgaaagatgaaaactggaagaaaggagaacaaagacagtcttcaccattttgcaggaatctacactctgcctatgtgaacacatttcttttgtaaagaaagaaattgattgcatttaatggcagattttcagaatagtcaggaattcttgtcatttccattttaaaatatatattaaaaaaaatcagttcgagtagacacgagctaagagtgaatgtgaagataacagaatttctgtgtggaagaggattacaagcagcaatttacctggaagtgataccttaggggcaatcttgaagatacactttcctgaaaaatgatttgtgatggattgtatatttatttaaaatatcttgggaggggaggctgatggagatagggagcatgctcaaacctccctaagacaagctgctgctgtgactatgggctcccaaagagctagatcgtatatttatttgacaaaaatcaccatagactgcatccatactacagagaaaaaacaattagggcgcaaatggatagttacagtaaagtcttcagcaagcagctgcctgtattctaagcactgggattttctgtttcgtgcaaatatttatctcattatgttgtgatctagttcaataacctagaatttgaattgtcaccacatagctttcaatctgtgccaacaactatacaattcatcaagtgtg

SEQ ID NO: 418351 - DNA, 690 bp, Homo sapiens
ggttctggagacttagggattggcaaaggttaaggtaaaactttactagtaacaatgagtgtggtaggatggaaataagtgtttagattacacgagacctgtaataacataaaagttacaataaaaatccaaccagcagtgtttccatcccagtggccaatttctgagcatagtcacgagagatgctttgtaggcaaacagaattgttctaagggacaaaatccccaacaggaaagaacacaccacaaacactcctgcttaaattaccatagtaacttaggatggctttactatatattgatttacataaagctgcatgttcttatactgtttattgccaaatgtccaatattacaatacactataaggtgcaactgagatttaatgaataaaatggaagtaacaatcctgcctcgtgatagttttagaagcacaaaaacattctgtgtcagattatctgctataccgagaaggcgaatcaatccttaatttctgagaacttgttttgtagaacataaagacgttatattgcctccaacactggtatcctaactaacagactatgccttcctagagcttagaggcgctccgatgaaaatctctggatggctcaagacttcttaaaaagcaagtcaattacgtcgtatctcatacattctgttttcctcacaataaatttccctaagacaa

SEQ ID NO: 418352 - DNA, 770 bp, Homo sapiens
aggcaaaatcaagttctacatctgtccctgtgtatgtcacttgtttgaatacgaaataaaattaaaaaaataaattcagtgtattgagaaagcaagcaattctctcaaggtatatttctgacatactaagattttaacgactttcacaaatatgctgtactgagagagaatgttacataacattgagaactagtacaagtaaatattaaagtgaagtgaccatttcctacacaagctcattcagaggaggatgaagaccattttggaggaagaaaagcacccttattaagaattgcagcaagtaagccaacaaggtcttttcaggtacagtttcagaacttactatttaacattcctctcaagcaaatacgccttgaaatgctttttttaaatcataggaatttaaaaacactttacaatagagaatgattgatttttaaaatgtgtctgatttagctttgtagagatgttccgctaatatccataactaatctgagaggaaatgtggaacaacagaagagtaacagtgtctactcagtaacaagcgttttacgagttaaaaagacatccaaatgcagtactgaaaaatcagaagtcttgatttgtctcactgatgactccgtttttcctagagcagtctgtttaatgcttactggagataaatagatttataggtgaccaagacaatcgattaatgtatcagccacagacttttttaaatagaaaattttctaagtaggaaatcattcatagctctttgaaagatatag

SEQ ID NO: 418353 - DNA, 2043 bp, Homo sapiens
tcttttgattaaagcccaaattgtcattgggcagaagcaatcatgtgacagccaattcggtccaatttcaaccttgtctccatgaattcaatagtttaatagtagcgcggtccccatacggctgtaatcagtgaattagaaaaaaaacaccctagcagcgatattctatgatagattttttttcctctgcgctcgcctttttcctaggccttgcccccccaaagcccctccaaaagagggaactttttctctgagggggctccaaggagaaggccatgaattacgaatttgagcgagagattggttttatcaatagccagccgtcgctcgctgagtgcctgacatcttttccccctgtcgctgatacatttcaaagttcatcaatcaagacctcgacgctttcacactcgacactgattcctcctccttttgagcagaccattcccagcctgaaccccggcagtcaccctcgccacggcgctggcggccgccccaagccgagccccgcgggcagccgcggcagcccggtgcccgccggcgccctgcagccgcccgagtacccctggatgaaggagaagaaggcggccaagaaaaccgcacttctgccggccgccgccgccgccgccaccgccgcagccaccggccctgcttgcctcagccacaaagaatccctggaaatcgccgatggcagcggcgggggatcgcggcgcctgagaactgcttacaccaacacacagcttctagagctggaaaaagaatttcatttcaacaagtacctttgcagaccccgaagggtggagattgcagcgctgctggatttgactgagagacaagtgaaagtgtggtttcagaaccggaggatgaagcacaagaggcagacccagtgcaaggaaaaccaaaacagcgaagggaaatgtaaaagccttgaggactccgagaaagtagaggaggacgaggaagagaagacgctctttgagcaagcccttagcgtctctggggcccttctggagagggaaggctacacttttcagcaaaatgccctctctcagcagcaggctcccaatggacacaatggcgactcccaaagtttcccagtctcgcctttaaccagcaatgagaaaaatctgaaacattttcagcaccagtcacccactgttcccaactgcttgtcaacaatgggccagaactgtggagctggcctaaacaatgacagtcctgaggcccttgaggtcccctctttgcaggactttagcgttttctccacagattcctgcctgcagctttcagatgcagtttcacccagtttgccaggttccctcgacagtcccgtagatatttcagctgacagcttagacttttttacagacacactcaccacaatcgacttgcagcatctgaattactaaaaacattaaagcaaaacaaagcatcaccaaacaaaaactcctttgaccaggtggttttgccttcttttatttgggagtttattttttattttcttcttgacctaccccttccctcctttaagtgttgaggattttctgtttagtgattccctgacccagtttcaaacagagccatcttttacagattattttggagttttagttgttttaaacctaactcaacaaccctttatgtgattcctgagagcagtatgaggcctgcaagaaagtgatcatataattgtatcttcactttctttttatttttgtattacattgggatgcattgtcatgcatattttttgtagaataaattctcctttgctataagtagcttatttttctccccctcttttttcaaggctcataacgggttctttttcttcttttagtctaacttcgtaaataaaattcgtcacaatttatcctcttttttcaattttaatacatttattaaggcggcatgttcaaagtcttcaatggacagcaacaaaacagaaagccaaaaaatgactagggcttctaataagtgttttttctttcttttttgcttcttcttctcctctttctttttaaaggatttgattttcagtgcaca

SEQ ID NO: 418354 - DNA, 535 bp, Homo sapiens
cccaagccgagccccgcgggcagccgcggcagcccggtgcccgccggcgccctgcagccgcccgagtacccctggatgaaggagaagaaggcggccaagaaaaccgcacttctgccggccgccgccgccgccgccaccgccgcagccaccggccctgcttgcctcagccacaaaggtcagtccaaagacttggccccaggtctctgggaccctcttccttctccgggctgccccgagagtggctgtggggggaggggagagtgggctgggagagaaggaggagagggagagatgcttggttgccttgtccctgcccctgtgggttcaggagtgggtttgatggagaggaaaggggatcctgcgctctacaatgagacatatatatttttaggaagtggggggaaactttcccgaacttgtgtaatgtgggatgatttatttgagttggaactgacctcctcctgtctagttgtcctagagtttggctttttgacagtaatgaagagtgatagatcgctcttgctcagctaagcag

SEQ ID NO: 418355 - DNA, 1434 bp, Homo sapiens
tcttttgattaaagcccaaattgtcattgggcagaagcaatcatgtgacagccaattcggtccaatttcaaccttgtctccatgaattcaatagtttaatagtagcgcggtccccatacggctgtaatcagtgaattagaaaaaaaacaccctagcagcgatattctatgatagattttttttcctctgcgctcgcctttttcctaggccttgcccccccaaagcccctccaaaagagggaactttttctctgagggggctccaaggagaaggccatgaattacgaatttgagcgagagattggttttatcaatagccagccgtcgctcgctgagtgcctgacatcttttccccctgtcgctgatacatttcaaagttcatcaatcaagacctcgacgctttcacactcgacactgattcctcctccttttgagcagaccattcccagcctgaaccccggcagtcaccctcgccacggcgctggcggccgccccaagccgagccccgcgggcagccgcggcagcccggtgcccgccggcgccctgcagccgcccgagtacccctggatgaaggagaagaaggcggccaagaaaaccgcacttctgccggccgccgccgccgccgccaccgccgcagccaccggccctgcttgcctcagccacaaagaatccctggaaatcgccgatggcagcggcgggggatcgcggcgcctgagaactgcttacaccaacacacagcttctagagctggaaaaagaatttcatttcaacaagtacctttgcagaccccgaagggtggagattgcagcgctgctggatttgactgagagacaagtgaaagtgtggtttcagaaccggaggatgaagcacaagaggcagacccagtgcaaggaaaaccaaaacagcgaagggaaatgtaaaagccttgaggactccgagaaagtagaggaggacgaggaagagaagacgctctttgagcaagcccttagcgtctctggggcccttctggagagggaaggctacacttttcagcaaaatgccctctctcagcagcaggctcccaatggacacaatggcgactcccaaagtttcccagtctcgcctttaaccagcaatgagaaaaatctgaaacattttcagcaccagtcacccactgttcccaactgcttgtcaacaatgggccagaactgtggagctggcctaaacaatgacagtcctgaggcccttgaggtcccctctttgcaggactttagcgttttctccacagattcctgcctgcagctttcagatgcagtttcacccagtttgccaggttccctcgacagtcccgtagatatttcagctgacagcttagacttttttacagacacactcaccacaatcgacttgcagcatctgaattactaaaaacattaaagcaaaacaaagcatcacc

SEQ ID NO: 418356 - DNA, 403 bp, Homo sapiens
tttggggctgtatcctgactctccttggaatctgttacagataggctccccactcaccaccaagaaataattagattctgtagacaaaatatatagtaatttctctgtaccagagcagttcttaaatatctgtttgaatgttgtttctggtgggggtttttctctttctgatttgtcattttaaaggtgtagacttagccactgaggaggtggccagccaggaggatatgaggcacccattaggatcacagttgaggctgggcacagtggctcatgcctgtaatcccagcactttgggaggcctagacaggagcatcccttgaaatctggagttcgagaccaacctgggctgcagtgagccaagatcacaccactgcactctagcctgggtgacagagatgct

SEQ ID NO: 418357 - DNA, 413 bp, Homo sapiens
ataggggctagaatttcttcagtaaggtatagtttaggttgcagaattcaatgaatgatgatttattgccatttagcattgggtttaatagatgaaagaaatgcctttattctcacaagagaccgtggctaggctgatcctgccatgaagacaaaaggaaaaatgaaattattaccaagtacttatgctgagcatctttagaaagtaatttgtaatacattttattagttaattgtgaaaattgacttctgacgttacatagtgcgatatagcaagttctaagacaagctgtgagtagacaaaattccccttcctgaatctttccttttctacactttttcctctttttcaggtacccttcacaggtttaacagcctccacccctcgggcaccaagcagtgttatccaggaaa

SEQ ID NO: 418358 - DNA, 441 bp, Homo sapiens
acctctcccgagaccggccaggcccctacagtacaggggctgaagggtgtagcacgagccctaaaagagatgcagctggaggccgccccgcacaaggcgctggggtggaccggggaggcgccttacccagtggaaagactcccggatcaagggagaaagttacgcaggcttccgatcctgatccgccatcagccgccgaacctcttccgccactaccgcctacccccaaagaccggctacacctcccctcccagccgacagtaggccttgcgtcacttccgcccacggggcggtctcttccgcctcctgcctggttcgccgctcccctccgcgacgacacgcccccagcccactccgccgcgggacgcctcatcccgcgggtacccttcacaggtttaacagcctccacccctcgggcaccaagcagtgttatccaggaaa

SEQ ID NO: 418359 - DNA, 754 bp, Homo sapiens
tcaccgttttagtggcatttaaatccccggcgctccgccgtctaggtgacgcgcagtcgcccccccaggcagcctaggcggcggcagctgctgcggcgactgcaaaggccgatttggagtgctggagcgaagaagagcaaaagctgcgttctgcgcgcgcccgactccgctgcccgccccgccaggcctccgggaggtgggggctgggaggcgtcccccgctcccgccccctccccaccgttcaatgaaagatgaactggcgagaggtctgttttgcctgaacccatcaacagctgggagattaatcaaccacactgaaaatgtggagggatttatgggggagggggttgaaatgtgggtgtttgaaacaaaagtgtataaacaaatgaattgttgataacttagttattgacctggagactggtagcttattaaagaaactccgtgttactcattcctggagttgggggtttctgtaggcactttatttctccactttcaagagcttgggcttggcccaaatcttagactgtccaattctgcctctattaccaatttaaatctatggcttgaacctgtgcactgaaaatcaaatcctttaaaaagaaagaggagaagaagaagcaaaaaagaaagaaaaaacacttattagaagccctagtcattttttggctttctgttttgttgctgtccattgaagactttgaacatgccgccttaataaatgtattaaaattgaaaaaagaaaaaaaat

SEQ ID NO: 418360 - DNA, 820 bp, Homo sapiens
tcaccgttttagtggcatttaaatccccggcgctccgccgtctaggtgacgcgcagtcgcccccccaggcagcctaggcggcggcagctgctgcggcgactgcaaaggccgatttggagtgctggagcgaagaagagcaaaagctgcgttctgcgcgcgcccgactccgctgcccgccccgccaggcctccgggaggtgggggctgggaggcgtcccccgctcccgccccctccccaccgttcaatgaaagatgaactggcgagagaaagcgtttgatttatgagcgtaggacgaatcgcatccaggagctgcgcagccctggccgcggccgggacgccctgctccgcgctgagcttggggccagaaaccagccatagtccccacactccgccgccgcagctaagatttagcggaggaaggggcgagggaaggtagggagcaaacctatgaagaaacatcgcgttgtcattggaacttccaagcctttgctgttaagagccaggttcttaaatcaacccgccccacacacatgttgcttacatgctgcgttttctcacggtctgttttgcctgaacccatcaacagctgggagattaatcaaccacactgaaaatgtggagggatttatgggggagggggttgaaatgtgggtgtttgaaacaaaagtgtataaacaaatgaattgttgataacttagttattgacctggagactggtagcttattaaagaaactccgtgttactcaaaaaagatactgatagaccaagaaaaccggcgcctttaattcgggggcaacaaaggggtcttcaagggccttg

SEQ ID NO: 418361 - DNA, 3839 bp, Homo sapiens
atcagtgggccagagctcgccgggtggccgcaagtacgccggcccagcccgcagcgcgcccagccggaaggcggggaatccggctgacaccgcgccccgggttcccaggccacctcctctgttctgaggctgggctgggagaccgtggggctgtgaggagcgcatagaaccgtggtggagggcgaggctgggccaccggttcttcaagctcggaatggagggggaagagcgcagagggctggctgggaggaactcgggtgggcgtgaaggagacgagggcaagaaaagaaacttcccttcttccaggagggtcttcgaaaccctctccccacagcccctctcgtcattagcatggcaatgaggagtttctgtaattcgacttggaggggcggatgagccctggaaactcagagctcgccggaaaaggccgggggcggccgggctcttcttccccaccttccctctctcgtcgctctccgcccctttctctttcccactcagttttgcaccgggagccctccgggatgcggagctactcgaccgccggatttttaggggtaggaggcgggggagagagatgacgctggcggacgtggccagcgcgggggccgggcggtgcgctgcaggccatctgccggcgccctgagacccaggagcctccgcgctcccgcgtgggcctcagagggccggtccacagctccaacatagtagctgaactcccttcgttgcgttcctctttttctggaggggaatgttagaagagagagagagcttccttttataaccttcctcattctgctgcacgtctagagtgggtgtgggggctggcaggtgggaggggcggtggacaaatggctgatggtggacgggacactttaccccaacgacacctcctcccctttccaactggctgtgtagttgcttatgagaaccttcaagtccttccctagagagacacatgcaaatctgagcctcatcccaggccaggggtcctgttcctcatcaccctacttccctgaggctgctgaggtcgttaaattgttgtttactattaggtttcacgtcaaccctgggcttgtagagagaaaaagccaaacggagaccaagaattgatgcagtcttgggtaggagaaatcgagagcttgtccaggaagctttgctgtataaattataagcaatgctgtataaattttactccaaccatgtgtacaatgttggaatcagatgaaatttatagtgaatgaatgtatgtgggtttggggtttccactcctcttcagcctttcctcccgttagaacaaggaaggttttttttttttcaaggaaggtacatttcaaatatgttagtcaccctttcagtcttctgtattctgttctccacgtaccgaagttcccccaaacctgtcctctcaagagaaaaaacccatgctgactctggactccctcagtaacaatgaaacattctccccaaacatttcctttcagaatagtatttgtgactttgatccatcccaagcatggttaagagggagcacgggcaggaaaggcccactttctggggttgggcagccacccctgccccagtttcggctcctgggaatcctccgactggagaaggggaaaggcaaggcagtcctcctggaggcggcttccttgggagcaccagcttccagcggcggggagagaaggagctcctgtgggagagggggcaggatgtgagtaggtcggtgctggctatgcgagcaatcctccctccaagcctgagcaagtcggtacattttcccccgctgcctcattcctgtaccttggttgccctcctcagcctgggtttgcaggaccccctcggctgcagggcgcctgccacaaagccgaccccggcaggagccactctctctgctagttcgctgcctcggccctgctctccctcagcctctcttcttctctcctggcctcttttctggggcatcctgggtggagtgtttttcttgggatcacgagcttgcactcgcacacaggcccgcagacacacaggcccggcggccgcccttctccgcttactgttcccggctccccgcaggccgggtgctcgcagccgggctggctatgcctcgcctggcagcccagagcgccgctccccgggaacagcacacaaaggcagcctcccctggcctctagcccttaggcttctgtagctcagttctttccccacacccctcccccaagaaattctgggggccgttccaccgagtaggagatccttggccctctaggcaagtaggtcagcgccccaagactggagctggtctctttcaacgccttgggagactgggtgaaaggcgagcttggttacgcttaaaatgatcgcctacaagcggttctcttggctcaaaacgcctctttcagggctcttatgctagaaaggaaaggaataaggaggagataaaatgacgccgaggccctgaactgttcatggcatccgcggctcagccaagctgttgttttaaaagagcaataaaaatgaattatgactaaacgccttctaacttaatgctttcggacggggatccccggcaaataacgtaagaggatttttatttgtgcatgtgttcctgcaattgatctctttgatgacattctcattcatagaaagcgtttgatttatgagcgtaggacgaatcgcatccaggagctgcgcagccctggccgcggccgggacgccctgctccgcgctgagcttggggccagaaaccagccatagtccccacactccgccgccgcagctaagatttagcggaggaaggggcgagggaaggtagggagcaaacctatgaagaaacatcgcgttgtcattggaacttccaagcctttgctgttaagagccaggttcttaaatcaacccgccccacacacatgttgcttacatgctgcgttttctcacggtaagtaagtaggcatcagaagagagctcagaaagggaaaaataaacatggggagacctaacaagggaggggggaaaagcaacaacccagtgacacaccctagatcacattttattgatatttcatttaaagtgcttttctctctctctagaacctgcgttaatttataacctagggtgtagaaacacaccattttaaatctcaacttgctaacctgacttcgaagcattaacgatctattattagcaatgtaaacaggtttaagaatgaaatattgatttttctgaccctgaaaaaaaaaaaaaaatccttagagtgactgaaccagaggattggaaagaacattttctagggtgcattttccagatagtaatcactgttttgttttatttttgtttttctctatcttttaggtctgttttgcctgaacccatcaacagctgggagattaatcaaccacactgaaaatgtggagggatttatgggggagggggttgaaatgtgggtgtttgaaacaaaagtgtataaacaaatgaattgttgataacttagttattgacctggagactggtagcttattaaagaaactccgtgttactcattcctggagttgggggtttctgtaggcactttatttctccactttcaagagcttgggcttggcccaaatcttagactgtccaattctgcctctattaccaatttaaatctatggcttgaacctgtgcactgaaaatcaaatcctttaaaaagaaagaggagaagaagaagcaaaaaagaaagaaaaaacacttattagaagccctagtcattttttggctttctgttttgttgctgtccattgaagactttgaacatgccgccttaataaatgtattaaaattgaaaaaagaaaaaaaat

SEQ ID NO: 418362 - DNA, 3426 bp, Homo sapiens
atcagtgggccagagctcgccgggtggccgcaagtacgccggcccagcccgcagcgcgcccagccggaaggcggggaatccggctgacaccgcgccccgggttcccaggccacctcctctgttctgaggctgggctgggagaccgtggggctgtgaggagcgcatagaaccgtggtggagggcgaggctgggccaccggttcttcaagctcggaatggagggggaagagcgcagagggctggctgggaggaactcgggtgggcgtgaaggagacgagggcaagaaaagaaacttcccttcttccaggagggtcttcgaaaccctctccccacagcccctctcgtcattagcatggcaatgaggagtttctgtaattcgacttggaggggcggatgagccctggaaactcagagctcgccggaaaaggccgggggcggccgggctcttcttccccaccttccctctctcgtcgctctccgcccctttctctttcccactcagttttgcaccgggagccctccgggatgcggagctactcgaccgccggatttttaggggtaggaggcgggggagagagatgacgctggcggacgtggccagcgcgggggccgggcggtgcgctgcaggccatctgccggcgccctgagacccaggagcctccgcgctcccgcgtgggcctcagagggccggtccacagctccaacatagtagctgaactcccttcgttgcgttcctctttttctggaggggaatgttagaagagagagagagcttccttttataaccttcctcattctgctgcacgtctagagtgggtgtgggggctggcaggtgggaggggcggtggacaaatggctgatggtggacgggacactttaccccaacgacacctcctcccctttccaactggctgtgtagttgcttatgagaaccttcaagtccttccctagagagacacatgcaaatctgagcctcatcccaggccaggggtcctgttcctcatcaccctacttccctgaggctgctgaggtcgttaaattgttgtttactattaggtttcacgtcaaccctgggcttgtagagagaaaaagccaaacggagaccaagaattgatgcagtcttgggtaggagaaatcgagagcttgtccaggaagctttgctgtataaattataagcaatgctgtataaattttactccaaccatgtgtacaatgttggaatcagatgaaatttatagtgaatgaatgtatgtgggtttggggtttccactcctcttcagcctttcctcccgttagaacaaggaaggttttttttttttcaaggaaggtacatttcaaatatgttagtcaccctttcagtcttctgtattctgttctccacgtaccgaagttcccccaaacctgtcctctcaagagaaaaaacccatgctgactctggactccctcagtaacaatgaaacattctccccaaacatttcctttcagaatagtatttgtgactttgatccatcccaagcatggttaagagggagcacgggcaggaaaggcccactttctggggttgggcagccacccctgccccagtttcggctcctgggaatcctccgactggagaaggggaaaggcaaggcagtcctcctggaggcggcttccttgggagcaccagcttccagcggcggggagagaaggagctcctgtgggagagggggcaggatgtgagtaggtcggtgctggctatgcgagcaatcctccctccaagcctgagcaagtcggtacattttcccccgctgcctcattcctgtaccttggttgccctcctcagcctgggtttgcaggaccccctcggctgcagggcgcctgccacaaagccgaccccggcaggagccactctctctgctagttcgctgcctcggccctgctctccctcagcctctcttcttctctcctggcctcttttctggggcatcctgggtggagtgtttttcttgggatcacgagcttgcactcgcacacaggcccgcagacacacaggcccggcggccgcccttctccgcttactgttcccggctccccgcaggccgggtgctcgcagccgggctggctatgcctcgcctggcagcccagagcgccgctccccgggaacagcacacaaaggcagcctcccctggcctctagcccttaggcttctgtagctcagttctttccccacacccctcccccaagaaattctgggggccgttccaccgagtaggagatccttggccctctaggcaagtaggtcagcgccccaagactggagctggtctctttcaacgccttgggagactgggtgaaaggcgagcttggttacgcttaaaatgatcgcctacaagcggttctcttggctcaaaacgcctctttcagggctcttatgctagaaaggaaaggaataaggaggagataaaatgacgccgaggccctgaactgttcatggcatccgcggctcagccaagctgttgttttaaaagagcaataaaaatgaattatgactaaacgccttctaacttaatgctttcggacggggatccccggcaaataacgtaagaggatttttatttgtgcatgtgttcctgcaattgatctctttgatgacattctcattcatagaaagcgtttgatttatgagcgtaggacgaatcgcatccaggagctgcgcagccctggccgcggccgggacgccctgctccgcgctgagcttggggccagaaaccagccatagtccccacactccgccgccgcagctaagatttagcggaggaaggggcgagggaaggtagggagcaaacctatgaagaaacatcgcgttgtcattggaacttccaagcctttgctgttaagagccaggttcttaaatcaacccgccccacacacatgttgcttacatgctgcgttttctcacggtctgttttgcctgaacccatcaacagctgggagattaatcaaccacactgaaaatgtggagggatttatgggggagggggttgaaatgtgggtgtttgaaacaaaagtgtataaacaaatgaattgttgataacttagttattgacctggagactggtagcttattaaagaaactccgtgttactcattcctggagttgggggtttctgtaggcactttatttctccactttcaagagcttgggcttggcccaaatcttagactgtccaattctgcctctattaccaatttaaatctatggcttgaacctgtgcactgaaaatcaaatcctttaaaaagaaagaggagaagaagaagcaaaaaagaaagaaaaaacacttattagaagccctagtcattttttggctttctgttttgttgctgtccattgaagactttgaacatgccgccttaataaatgtattaaaattgaaaaaagaaaaaaaat

SEQ ID NO: 418363 - DNA, 3158 bp, Homo sapiens
atcagtgggccagagctcgccgggtggccgcaagtacgccggcccagcccgcagcgcgcccagccggaaggcggggaatccggctgacaccgcgccccgggttcccaggccacctcctctgttctgaggctgggctgggagaccgtggggctgtgaggagcgcatagaaccgtggtggagggcgaggctgggccaccggttcttcaagctcggaatggagggggaagagcgcagagggctggctgggaggaactcgggtgggcgtgaaggagacgagggcaagaaaagaaacttcccttcttccaggagggtcttcgaaaccctctccccacagcccctctcgtcattagcatggcaatgaggagtttctgtaattcgacttggaggggcggatgagccctggaaactcagagctcgccggaaaaggccgggggcggccgggctcttcttccccaccttccctctctcgtcgctctccgcccctttctctttcccactcagttttgcaccgggagccctccgggatgcggagctactcgaccgccggatttttaggggtaggaggcgggggagagagatgacgctggcggacgtggccagcgcgggggccgggcggtgcgctgcaggccatctgccggcgccctgagacccaggagcctccgcgctcccgcgtgggcctcagagggccggtccacagctccaacatagtagctgaactcccttcgttgcgttcctctttttctggaggggaatgttagaagagagagagagcttccttttataaccttcctcattctgctgcacgtctagagtgggtgtgggggctggcaggtgggaggggcggtggacaaatggctgatggtggacgggacactttaccccaacgacacctcctcccctttccaactggctgtgtagttgcttatgagaaccttcaagtccttccctagagagacacatgcaaatctgagcctcatcccaggccaggggtcctgttcctcatcaccctacttccctgaggctgctgaggtcgttaaattgttgtttactattaggtttcacgtcaaccctgggcttgtagagagaaaaagccaaacggagaccaagaattgatgcagtcttgggtaggagaaatcgagagcttgtccaggaagctttgctgtataaattataagcaatgctgtataaattttactccaaccatgtgtacaatgttggaatcagatgaaatttatagtgaatgaatgtatgtgggtttggggtttccactcctcttcagcctttcctcccgttagaacaaggaaggttttttttttttcaaggaaggtacatttcaaatatgttagtcaccctttcagtcttctgtattctgttctccacgtaccgaagttcccccaaacctgtcctctcaagagaaaaaacccatgctgactctggactccctcagtaacaatgaaacattctccccaaacatttcctttcagaatagtatttgtgactttgatccatcccaagcatggttaagagggagcacgggcaggaaattctgggggccgttccaccgagtaggagatccttggccctctaggcaagtaggtcagcgccccaagactggagctggtctctttcaacgccttgggagactgggtgaaaggcgagcttggttacgcttaaaatgatcgcctacaagcggttctcttggctcaaaacgcctctttcagggctcttatgctagaaaggaaaggaataaggaggagataaaatgacgccgaggccctgaactgttcatggcatccgcggctcagccaagctgttgttttaaaagagcaataaaaatgaattatgactaaacgccttctaacttaatgctttcggacggggatccccggcaaataacgtaagaggatttttatttgtgcatgtgttcctgcaattgatctctttgatgacattctcattcatagaaagcgtttgatttatgagcgtaggacgaatcgcatccaggagctgcgcagccctggccgcggccgggacgccctgctccgcgctgagcttggggccagaaaccagccatagtccccacactccgccgccgcagctaagatttagcggaggaaggggcgagggaaggtagggagcaaacctatgaagaaacatcgcgttgtcattggaacttccaagcctttgctgttaagagccaggttcttaaatcaacccgccccacacacatgttgcttacatgctgcgttttctcacggtaagtaagtaggcatcagaagagagctcagaaagggaaaaataaacatggggagacctaacaagggaggggggaaaagcaacaacccagtgacacaccctagatcacattttattgatatttcatttaaagtgcttttctctctctctagaacctgcgttaatttataacctagggtgtagaaacacaccattttaaatctcaacttgctaacctgacttcgaagcattaacgatctattattagcaatgtaaacaggtttaagaatgaaatattgatttttctgaccctgaaaaaaaaaaaaaaatccttagagtgactgaaccagaggattggaaagaacattttctagggtgcattttccagatagtaatcactgttttgttttatttttgtttttctctatcttttaggtctgttttgcctgaacccatcaacagctgggagattaatcaaccacactgaaaatgtggagggatttatgggggagggggttgaaatgtgggtgtttgaaacaaaagtgtataaacaaatgaattgttgataacttagttattgacctggagactggtagcttattaaagaaactccgtgttactcattcctggagttgggggtttctgtaggcactttatttctccactttcaagagcttgggcttggcccaaatcttagactgtccaattctgcctctattaccaatttaaatctatggcttgaacctgtgcactgaaaatcaaatcctttaaaaagaaagaggagaagaagaagcaaaaaagaaagaaaaaacacttattagaagccctagtcattttttggctttctgttttgttgctgtccattgaagactttgaacatgccgccttaataaatgtattaaaattgaaaaaagaaaaaaaat

SEQ ID NO: 418364 - DNA, 1436 bp, Homo sapiens
tcaccgttttagtggcatttaaatccccggcgctccgccgtctaggtgacgcgcagtcgcccccccaggcagcctaggcggcggcagctgctgcggcgactgcaaaggccgatttggagtgctggagcgaagaagagcaaaagctgcgttctgcgcgcgcccgactccgctgcccgccccgccaggcctccgggaggtgggggctgggaggcgtcccccgctcccgccccctccccaccgttcaatgaaagatgaactggcgagaggacgaatcgcatccaggagctgcgcagccctggccgcggccgggacgccctgctccgcgctgagcttggggccagaaaccagccatagtccccacactccgccgccgcagctaagatttagcggaggaaggggcgagggaaggtagggagcaaacctatgaagaaacatcgcgttgtcattggaacttccaagcctttgctgttaagagccaggttcttaaatcaacccgccccacacacatgttgcttacatgctgcgttttctcacggtaagtaagtaggcatcagaagagagctcagaaagggaaaaataaacatggggagacctaacaagggaggggggaaaagcaacaacccagtgacacaccctagatcacattttattgatatttcatttaaagtgcttttctctctctctagaacctgcgttaatttataacctagggtgtagaaacacaccattttaaatctcaacttgctaacctgacttcgaagcattaacgatctattattagcaatgtaaacaggtttaagaatgaaatattgatttttctgaccctgaaaaaaaaaaaaaaatccttagagtgactgaaccagaggattggaaagaacattttctagggtgcattttccagatagtaatcactgttttgttttatttttgtttttctctatcttttaggtctgttttgcctgaacccatcaacagctgggagattaatcaaccacactgaaaatgtggagggatttatgggggagggggttgaaatgtgggtgtttgaaacaaaagtgtataaacaaatgaattgttgataacttagttattgacctggagactggtagcttattaaagaaactccgtgttactcattcctggagttgggggtttctgtaggcactttatttctccactttcaagagcttgggcttggcccaaatcttagactgtccaattctgcctctattaccaatttaaatctatggcttgaacctgtgcactgaaaatcaaatcctttaaaaagaaagaggagaagaagaagcaaaaaagaaagaaaaaacacttattagaagccctagtcattttttggctttctgttttgttgctgtccattgaagactttgaacatgccgccttaataaatgtattaaaattgaaaaaagaaaaaaaat

SEQ ID NO: 418365 - DNA, 3785 bp, Homo sapiens
atcagtgggccagagctcgccgggtggccgcaagtacgccggcccagcccgcagcgcgcccagccggaaggcggggaatccggctgacaccgcgccccgggttcccaggccacctcctctgttctgaggctgggctgggagaccgtggggctgtgaggagcgcatagaaccgtggtggagggcgaggctgggccaccggttcttcaagctcggaatggagggggaagagcgcagagggctggctgggaggaactcgggtgggcgtgaaggagacgagggcaagaaaagaaacttcccttcttccaggagggtcttcgaaaccctctccccacagcccctctcgtcattagcatggcaatgaggagtttctgtaattcgacttggaggggcggatgagccctggaaactcagagctcgccggaaaaggccgggggcggccgggctcttcttccccaccttccctctctcgtcgctctccgcccctttctctttcccactcagttttgcaccgggagccctccgggatgcggagctactcgaccgccggatttttaggggtaggaggcgggggagagagatgacgctggcggacgtggccagcgcgggggccgggcggtgcgctgcaggccatctgccggcgccctgagacccaggagcctccgcgctcccgcgtgggcctcagagggccggtccacagctccaacatagtagctgaactcccttcgttgcgttcctctttttctggaggggaatgttagaagagagagagagcttccttttataaccttcctcattctgctgcacgtctagagtgggtgtgggggctggcaggtgggaggggcggtggacaaatggctgatggtggacgggacactttaccccaacgacacctcctcccctttccaactggctgtgtagttgcttatgagaaccttcaagtccttccctagagagacacatgcaaatctgagcctcatcccaggccaggggtcctgttcctcatcaccctacttccctgaggctgctgaggtcgttaaattgttgtttactattaggtttcacgtcaaccctgggcttgtagagagaaaaagccaaacggagaccaagaattgatgcagtcttgggtaggagaaatcgagagcttgtccaggaagctttgctgtataaattataagcaatgctgtataaattttactccaaccatgtgtacaatgttggaatcagatgaaatttatagtgaatgaatgtatgtgggtttggggtttccactcctcttcagcctttcctcccgttagaacaaggaaggttttttttttttcaaggaaggtacatttcaaatatgttagtcaccctttcagtcttctgtattctgttctccacgtaccgaagttcccccaaacctgtcctctcaagagaaaaaacccatgctgactctggactccctcagtaacaatgaaacattctccccaaacatttcctttcagaatagtatttgtgactttgatccatcccaagcatggttaagagggagcacgggcaggaaaggcccactttctggggttgggcagccacccctgccccagtttcggctcctgggaatcctccgactggagaaggggaaaggcaaggcagtcctcctggaggcggcttccttgggagcaccagcttccagcggcggggagagaaggagctcctgtgggagagggggcaggatgtgagtaggtcggtgctggctatgcgagcaatcctccctccaagcctgagcaagtcggtacattttcccccgctgcctcattcctgtaccttggttgccctcctcagcctgggtttgcaggaccccctcggctgcagggcgcctgccacaaagccgaccccggcaggagccactctctctgctagttcgctgcctcggccctgctctccctcagcctctcttcttctctcctggcctcttttctggggcatcctgggtggagtgtttttcttgggatcacgagcttgcactcgcacacaggcccgcagacacacaggcccggcggccgcccttctccgcttactgttcccggctccccgcaggccgggtgctcgcagccgggctggctatgcctcgcctggcagcccagagcgccgctccccgggaacagcacacaaaggcagcctcccctggcctctagcccttaggcttctgtagctcagttctttccccacacccctcccccaagaaattctgggggccgttccaccgagtaggagatccttggccctctaggcaagtaggtcagcgccccaagactggagctggtctctttcaacgccttgggagactgggtgaaaggcgagcttggttacgcttaaaatgatcgcctacaagcggttctcttggctcaaaacgcctctttcagggctcttatgctagaaaggaaaggaataaggaggagataaaatgacgccgaggccctgaactgttcatggcatccgcggctcagccaagctgttgttttaaaagagcaataaaaatgaattatgactaaacgccttctaacttaatgctttcggacggggatccccggcaaataacgtaagaggatttttatttgtgcatgtgttcctgcaattgatctctttgatgacattctcattcatagaaagcgtttgatttatgagcgtaggacgaatcgcatccaggagctgcgcagccctggccgcggccgggacgccctgctccgcgctgagcttggggccagaaaccagccatagtccccacactccgccgccgcagctaagatttagcggaggaaggggcgagggaaggtagggagcaaacctatgaagaaacatcgcgttgtcattggaacttccaagcctttgctgttaagagccaggttcttaaatcaacccgccccacacacatgttgcttacatgctgcgttttctcacggtaagtaagtaggcatcagaagagagctcagaaagggaaaaataaacatggggagacctaacaagggaggggggaaaatgcttttctctctctctagaacctgcgttaatttataacctagggtgtagaaacacaccattttaaatctcaacttgctaacctgacttcgaagcattaacgatctattattagcaatgtaaacaggtttaagaatgaaatattgatttttctgaccctgaaaaaaaaaaaaaaatccttagagtgactgaaccagaggattggaaagaacattttctagggtgcattttccagatagtaatcactgttttgttttatttttgtttttctctatcttttaggtctgttttgcctgaacccatcaacagctgggagattaatcaaccacactgaaaatgtggagggatttatgggggagggggttgaaatgtgggtgtttgaaacaaaagtgtataaacaaatgaattgttgataacttagttattgacctggagactggtagcttattaaagaaactccgtgttactcattcctggagttgggggtttctgtaggcactttatttctccactttcaagagcttgggcttggcccaaatcttagactgtccaattctgcctctattaccaatttaaatctatggcttgaacctgtgcactgaaaatcaaatcctttaaaaagaaagaggagaagaagaagcaaaaaagaaagaaaaaacacttattagaagccctagtcattttttggctttctgttttgttgctgtccattgaagactttgaacatgccgccttaataaatgtattaaaattgaaaaaagaaaaaaaat

SEQ ID NO: 418366 - DNA, 1183 bp, Homo sapiens
ctctttttcttaggttatttccatctcggttattccttgctccagcagaatcctgaaatgtccatgtatctctgagcagctatgaagaagcttcctggaaaacaataagcaaaggaaaacaaatgtgtcccatctcacatggttctaccctactaaagacaggaagatcataaactgacagatactgaaattgtaaagttggaaactacattttgcaaagtcattgaactctgagctcagttgcagtactcgggaagccatgcaggatgaagatggatacatcaccttaaatattaaaactcggaaaccagctctcgtctccgctgtcatgcagcgcaattacctacaagatgagaatgaaaatcgcacaggaactctgcaacaattagcaaagcgcttctgtcaatatgtggtaaaacaatcagaactaaagggcactttcaaaggtcataaatgcagcccctgtgacacaaactggagatattatggagatagctgctatgggttcttcaggcacaacttaacatgggaagagagtaagcagtactgcactgacatgaatgctactctcctgaagattgacaaccggaacattgtggagtacatcaaagccaggactcatttaattcgttgggtcggattatctcgccagaagtcgaatgaggtctggaagtgggaggatggctcggttatctcagaaaatatgtttgagtttttggaagatggaaaaggaaatatgaattgtgcttattttcataatgggaaaatgcaccctaccttctgtgagaacaaacattatttaatgtgtgagaggaaggctggcatgaccaaggtggaccaactaccttaatgcaaagaggtggacaggataacacagataagggctttattgtacaataaaagatatgtatgaatgcatcagtagctgaaaattgcttatttctccctttcttctcactggagttatttttaatattatctttcctatcagaattacctagtcccttctttgaatatacagaagccatcacgtgagtttatcatttgcttcccaattgttctattttcctttaattttctttcttcttgtccttcatttctaattacctgaacatggtatgatttactgcatcttcagatatacacatataacatcaaaatcaggccaatataggttagggct

SEQ ID NO: 418367 - DNA, 1282 bp, Homo sapiens
ctctttttcttaggttatttccatctcggttattccttgctccagcagaatcctgaaatgtccatgtatctctgagcagctatgaagaagcttcctggaaaacaataagcaaaggaaaacaaatgtgtcccatctcacatggttctaccctactaaagacaggaagatcataaactgacagatactgaaattgtaaagttggaaactacattttgcaaagtcattgaactctgagctcagttgcagtactcgggaagccatgcaggatgaagatggatacatcaccttaaatattaaaactcggaaaccagctctcgtctccgttggctctgcatcctcctcctggtggcgtgtgatggctttgattctgctgatcctgtgcgtggggatggttgtcgggctggtggctctggggatttggtctgtcatgcagcgcaattacctacaagatgagaatgaaaatcgcacaggaactctgcaacaattagcaaagcgcttctgtcaatatgtggtaaaacaatcagaactaaagggcactttcaaaggtcataaatgcagcccctgtgacacaaactggagatattatggagatagctgctatgggttcttcaggcacaacttaacatgggaagagagtaagcagtactgcactgacatgaatgctactctcctgaagattgacaaccggaacattgtggagtacatcaaagccaggactcatttaattcgttgggtcggattatctcgccagaagtcgaatgaggtctggaagtgggaggatggctcggttatctcagaaaatatgtttgagtttttggaagatggaaaaggaaatatgaattgtgcttattttcataatgggaaaatgcaccctaccttctgtgagaacaaacattatttaatgtgtgagaggaaggctggcatgaccaaggtggaccaactaccttaatgcaaagaggtggacaggataacacagataagggctttattgtacaataaaagatatgtatgaatgcatcagtagctgaaaattgcttatttctccctttcttctcactggagttatttttaatattatctttcctatcagaattacctagtcccttctttgaatatacagaagccatcacgtgagtttatcatttgcttcccaattgttctattttcctttaattttctttcttcttgtccttcatttctaattacctgaacatggtatgatttactgcatcttcagatatacacatataacatcaaaatcaggccaatataggttagggct

SEQ ID NO: 418368 - DNA, 325 bp, Homo sapiens
cctattttcctcagtctctatttggtgcatcaaactactatacgcagagtctgattactgattgtttgctcagttttcaaaggaatttattctaactttcccttcacaggtttgagtttttggaagatggaaaaggaaatatgaattgtgcttattttcataatgggaaaatgcaccctaccttctgtgagaacaaacattatttaatgtgtgagaggaaggctggcatgaccaaggtggaccaactaccttaatgcaaagaggtggacaggataacacagataagggctttattgtacaataaaagatatgtatgaatgcatca

SEQ ID NO: 418369 - DNA, 5295 bp, Homo sapiens
  misc_feature (1458)..(1458): n is a, c, g, or t
cactgggaggagtgcggaacgcctggtacagataggggtggggatttgggtgacgcatttaaaagacagcgtgagactcgcgccctccggcacggaaaaggccaggcgacaggtgtcgcttgaaaagactgggcttgtccttgctggtgcatgcgtcgtcggcctctgggcagcaggtttacaaaggaggaaaacgacttcttctagatttttttttcagtttcttctataaatcaaaacatctcaaaatggagacctaaaatccttaaagggacttagtctaatctcgggaggtagttttgtgcatgggtaaacaaattaagtattaactggtgttttactatccaaagaatgctaattttataaacatgatcgagttatataaggtataccataatgagtttgattttgaatttgatttgtggaaataaaggaaaagtgattctagctggggcatattgttaaagcatttttttcagagttggccaggcagtctcctactggcacattctcccattatgtagaatagaaatagtacctgtgtttgggaaagattttaaaatgagtgacagttatttggaacaaagagctaataatcaatccactgcaaattaaagaaacatgcagatgaaagttttgacacattaaaatacttctacagtgacaaagaaaaatcaagaacaaagctttttgatatgtgcaacaaatttagaggaagtaaaaagataaatgtgatgattggtcaagaaattatccagttatttacaaggccactgatattttaaacgtccaaaagtttgtttaaatgggctgttaccgctgagaatgatgaggatgagaatgatggttgaaggttacattttaggaaatgaagaaacttagaaaattaatataaagacagtgatgaatacaaagaagatttttataacaatgtgtaaaatttttggccagggaaaggaatattgaagttagatacaattacttacctttgagggaaataattgttggtaatgagatgtgatgtttctcctgccacctggaaacaaagcattgaagtctgcagttgaaaagcccaacgtctgtgagatccaggaaaccatgcttgcaaaccactggtaaaaaaaaaaaaaaaaaaaaaaaaaagccacagtgacttgcttattggtcattgctagtattatcgactcagaacctctttactaatggctagtaaatcataattgagaaattctgaattttgacaaggtctctgctgttgaaatggtaaatttattattttttttgtcatgataaattctggttcaaggtatgctatccatgaaataatttctgaccaaaactaaattgatgcaatttgattatccatcttagcctacagatggcatctggtaacttttgactgttttaaaaataaatccactatcagagtagatttgatgttggcttcagaaacatttngaaaaacaaaagttcaaaaatgttttcaggaggtgataagttgaataactctacaatgttagttctttgagggggacaaaaaatttaaaatctttgaaaggtcttattttacagccatatctaaattatcttaagaaaatttttaacaaagggaatgaaatatatatcatgattctgtttttccaaaagtaacctgaatatagcaatgaagttcagttttgttattggtagtttgggcagagtctctttttgcagcacctgttgtctaccataattacagaggacatttccatgttctagccaagtatactattagaataaaaaaacttaacattgagttgcttcaacagcatgaaactgagtccaaaagaccaaatgaacaaacacattaatctctgattatttattttaaatagaatatttaattgtgtaagatctaatagtatcattatacttaagcaatcatattcctgatgatctatgggaaataactattatttaattaatattgaaaccaggttttaagatgtgttagccagtcctgttactagtaaatctctttatttggagagaaattttagattgttttgttctccttattagaaggattgtagaaagaaaaaaatgactaattggagaaaaattggggatatatcatatttcactgaattcaaaatgtcttcagttgtaaatcttaccattattttacgtacctctaagaaataaaagtgcttctaattaaaatatgatgtcattaattatgaaatacttcttgataacagaagttttaaaatagccatcttagaatcagtgaaatatggtaatgtattattttcctcctttgagttaggtcttgtgcttttttttcctggccactaaatttcacaatttccaaaaagcaaaataaacatattctgaatatttttgctgtgaaacacttgacagcagagctttccaccatgaaaagaagcttcatgagtcacacattacatctttgggttgattgaatgccactgaaacattctagtagcctggagaagttgacctacctgtggagatgcctgccattaaatggcatcctgatggcttaatacacatcactcttctgtgaagggttttaattttcaacacagcttactctgtagcatcatgtttacattgtatgtataaagattatacaaaggtgcaattgtgtatttcttccttaaaatgtatcagtataggatttagaatctccatgttgaaactctaaatgcatagaaataaaaataataaaaaatttttcattttggcttttcagcctagtattaaaactgataaaagcaaagccatgcacaaaactacctccctagagaaaggctagtcccttttcttccccattcatttcattatgaacatagtagaaaacagcatattcttatcaaatttgatgaaaagcgccaacacgtttgaactgaaatacgacttgtcatgtgaactgtaccgaatgtctacgtattccacttttcctgctggggttcctgtctcagaaaggagtcttgctcgtgctggtttctattacactggtgtgaatgacaaggtcaaatgcttctgttgtggcctgatgctggataactggaaaagaggagacagtcctactgaaaagcataaaaagttgtatcctagctgcagattcgttcagagtctaaattccgttaacaacttggaagctacctctcagcctacttttccttcttcagtaacaaattccacacactcattacttccgggtacagaaaacagtggatatttccgtggctcttattcaaactctccatcaaatcctgtaaactccagagcaaatcaagatttttctgccttgatgagaagttcctaccactgtgcaatgaataacgaaaatgccagattacttacttttcagacatggccattgacttttctgtcgccaacagatctggcaaaagcaggcttttactacataggacctggagacagagtggcttgctttgcctgtggtggaaaattgagcaattgggaaccgaaggataatgctatgtcagaacacctgagacattttcccaaatgcccatttatagaaaatcagcttcaagacacttcaagatacacagtttctaatctgagcatgcagacacatgcagcccgctttaaaacattctttaactggccctctagtgttctagttaatcctgagcagcttgcaagtgcgggtttttattatgtgggtaacagtgatgatgtcaaatgcttttgctgtgatggtggactcaggtgttgggaatctggagatgatccatgggttcaacatgccaagtggtttccaaggtgtgagtacttgataagaattaaaggacaggagttcatccgtcaagttcaagccagttaccctcatctacttgaacagctgctatccacatcagacagcccaggagatgaaaatgcagagtcatcaattatccattttgaacctggagaagaccattcagaagatgcaatcatgatgaatactcctgtgattaatgctgccgtggaaatgggctttagtagaagcctggtaaaacagacagttcagagaaaaatcctagcaactggagagaattatagactagtcaatgatcttgtgttagacttactcaatgcagaagatgaaataagggaagaggagagagaaagagcaactgaggaaaaagaatcaaatgatttattattaatccggaagaatagaatggcactttttcaacatttgacttgtgtaattccaatcctggatagtctactaactgccggaattattaatgaacaagaacatgatgttattaaacagaagacacagacgtctttacaagcaagagaactgattgatacgattttagtaaaaggaaatattgcagccactgtattcagaaactctctgcaagaagctgaagctgtgttatatgagcatttatttgtgcaacaggacataaaatatattcccacagaagatgtttcagatctaccagtggaagaacaattgcggagactacaagaagaaagaacatgtaaagtgtgtatggacaaagaagtgtccatagtgtttattccttgtggtcatctagtagtatgcaaagattgtgctccttctttaagaaagtgtcctatttgtaggagtacaatcaagggtacagttcgtacatttctttcatgaagaagaaccaaaacatcgtctaaactttagaattaatttattaaatgtattataactttaacttttatcctaatttggtttccttaaaatttttatttatttacaactcaaaaaacattgttttgtgtaacatatttatatatgtatctaaaccatatgaacatatattttttagaaactaagagaatgataggcttttgttcttatgaacgaaaaagaggtagcactacaaacacaatattcaatcaaaatttcagcattattgaaattgtaagtgaagtaaaacttaagatatttgagttaacctttaagaattttaaatattttggcattgtactaataccgggaacatgaagccaggtgtggtggtatgtgcctgtagtcccaggctgaggcaagagaattacttgagcccaggagtttgaatccatcctgggcagcatactgagaccctgcctttaaaaacaaacagaacaaaaacaaaacaccagggacacatttctctgtcttttttgatcagtgtcctatacatcgaaggtgtgcatatatgttgaatgacattttagggacatggtgtttttataaagaattctgtgagaaaaaatttaataaagcaacaaaaattactctta

SEQ ID NO: 418370 - DNA, 5425 bp, Homo sapiens
  misc_feature (1588)..(1588): n is a, c, g, or t
cactgggaggagtgcggaacgcctggtacagataggggtggggatttgggtgacgcatttaaaagacagcgtgagactcgcgccctccggcacggaaaaggccaggcgacaggtgtcgcttgaaaagactgggcttgtccttgctggtgcatgcgtcgtcggcctctgggcagcagttgttgcctaaatttccacaaatatatgccttgctggagtgcagtggtgtgatcttggcttactgcaaccttcacctcccgggttcaagtgattctcctgcttcagtctcctgagtagctggaaatacaggtttacaaaggaggaaaacgacttcttctagatttttttttcagtttcttctataaatcaaaacatctcaaaatggagacctaaaatccttaaagggacttagtctaatctcgggaggtagttttgtgcatgggtaaacaaattaagtattaactggtgttttactatccaaagaatgctaattttataaacatgatcgagttatataaggtataccataatgagtttgattttgaatttgatttgtggaaataaaggaaaagtgattctagctggggcatattgttaaagcatttttttcagagttggccaggcagtctcctactggcacattctcccattatgtagaatagaaatagtacctgtgtttgggaaagattttaaaatgagtgacagttatttggaacaaagagctaataatcaatccactgcaaattaaagaaacatgcagatgaaagttttgacacattaaaatacttctacagtgacaaagaaaaatcaagaacaaagctttttgatatgtgcaacaaatttagaggaagtaaaaagataaatgtgatgattggtcaagaaattatccagttatttacaaggccactgatattttaaacgtccaaaagtttgtttaaatgggctgttaccgctgagaatgatgaggatgagaatgatggttgaaggttacattttaggaaatgaagaaacttagaaaattaatataaagacagtgatgaatacaaagaagatttttataacaatgtgtaaaatttttggccagggaaaggaatattgaagttagatacaattacttacctttgagggaaataattgttggtaatgagatgtgatgtttctcctgccacctggaaacaaagcattgaagtctgcagttgaaaagcccaacgtctgtgagatccaggaaaccatgcttgcaaaccactggtaaaaaaaaaaaaaaaaaaaaaaaaaagccacagtgacttgcttattggtcattgctagtattatcgactcagaacctctttactaatggctagtaaatcataattgagaaattctgaattttgacaaggtctctgctgttgaaatggtaaatttattattttttttgtcatgataaattctggttcaaggtatgctatccatgaaataatttctgaccaaaactaaattgatgcaatttgattatccatcttagcctacagatggcatctggtaacttttgactgttttaaaaataaatccactatcagagtagatttgatgttggcttcagaaacatttngaaaaacaaaagttcaaaaatgttttcaggaggtgataagttgaataactctacaatgttagttctttgagggggacaaaaaatttaaaatctttgaaaggtcttattttacagccatatctaaattatcttaagaaaatttttaacaaagggaatgaaatatatatcatgattctgtttttccaaaagtaacctgaatatagcaatgaagttcagttttgttattggtagtttgggcagagtctctttttgcagcacctgttgtctaccataattacagaggacatttccatgttctagccaagtatactattagaataaaaaaacttaacattgagttgcttcaacagcatgaaactgagtccaaaagaccaaatgaacaaacacattaatctctgattatttattttaaatagaatatttaattgtgtaagatctaatagtatcattatacttaagcaatcatattcctgatgatctatgggaaataactattatttaattaatattgaaaccaggttttaagatgtgttagccagtcctgttactagtaaatctctttatttggagagaaattttagattgttttgttctccttattagaaggattgtagaaagaaaaaaatgactaattggagaaaaattggggatatatcatatttcactgaattcaaaatgtcttcagttgtaaatcttaccattattttacgtacctctaagaaataaaagtgcttctaattaaaatatgatgtcattaattatgaaatacttcttgataacagaagttttaaaatagccatcttagaatcagtgaaatatggtaatgtattattttcctcctttgagttaggtcttgtgcttttttttcctggccactaaatttcacaatttccaaaaagcaaaataaacatattctgaatatttttgctgtgaaacacttgacagcagagctttccaccatgaaaagaagcttcatgagtcacacattacatctttgggttgattgaatgccactgaaacattctagtagcctggagaagttgacctacctgtggagatgcctgccattaaatggcatcctgatggcttaatacacatcactcttctgtgaagggttttaattttcaacacagcttactctgtagcatcatgtttacattgtatgtataaagattatacaaaggtgcaattgtgtatttcttccttaaaatgtatcagtataggatttagaatctccatgttgaaactctaaatgcatagaaataaaaataataaaaaatttttcattttggcttttcagcctagtattaaaactgataaaagcaaagccatgcacaaaactacctccctagagaaaggctagtcccttttcttccccattcatttcattatgaacatagtagaaaacagcatattcttatcaaatttgatgaaaagcgccaacacgtttgaactgaaatacgacttgtcatgtgaactgtaccgaatgtctacgtattccacttttcctgctggggttcctgtctcagaaaggagtcttgctcgtgctggtttctattacactggtgtgaatgacaaggtcaaatgcttctgttgtggcctgatgctggataactggaaaagaggagacagtcctactgaaaagcataaaaagttgtatcctagctgcagattcgttcagagtctaaattccgttaacaacttggaagctacctctcagcctacttttccttcttcagtaacaaattccacacactcattacttccgggtacagaaaacagtggatatttccgtggctcttattcaaactctccatcaaatcctgtaaactccagagcaaatcaagatttttctgccttgatgagaagttcctaccactgtgcaatgaataacgaaaatgccagattacttacttttcagacatggccattgacttttctgtcgccaacagatctggcaaaagcaggcttttactacataggacctggagacagagtggcttgctttgcctgtggtggaaaattgagcaattgggaaccgaaggataatgctatgtcagaacacctgagacattttcccaaatgcccatttatagaaaatcagcttcaagacacttcaagatacacagtttctaatctgagcatgcagacacatgcagcccgctttaaaacattctttaactggccctctagtgttctagttaatcctgagcagcttgcaagtgcgggtttttattatgtgggtaacagtgatgatgtcaaatgcttttgctgtgatggtggactcaggtgttgggaatctggagatgatccatgggttcaacatgccaagtggtttccaaggtgtgagtacttgataagaattaaaggacaggagttcatccgtcaagttcaagccagttaccctcatctacttgaacagctgctatccacatcagacagcccaggagatgaaaatgcagagtcatcaattatccattttgaacctggagaagaccattcagaagatgcaatcatgatgaatactcctgtgattaatgctgccgtggaaatgggctttagtagaagcctggtaaaacagacagttcagagaaaaatcctagcaactggagagaattatagactagtcaatgatcttgtgttagacttactcaatgcagaagatgaaataagggaagaggagagagaaagagcaactgaggaaaaagaatcaaatgatttattattaatccggaagaatagaatggcactttttcaacatttgacttgtgtaattccaatcctggatagtctactaactgccggaattattaatgaacaagaacatgatgttattaaacagaagacacagacgtctttacaagcaagagaactgattgatacgattttagtaaaaggaaatattgcagccactgtattcagaaactctctgcaagaagctgaagctgtgttatatgagcatttatttgtgcaacaggacataaaatatattcccacagaagatgtttcagatctaccagtggaagaacaattgcggagactacaagaagaaagaacatgtaaagtgtgtatggacaaagaagtgtccatagtgtttattccttgtggtcatctagtagtatgcaaagattgtgctccttctttaagaaagtgtcctatttgtaggagtacaatcaagggtacagttcgtacatttctttcatgaagaagaaccaaaacatcgtctaaactttagaattaatttattaaatgtattataactttaacttttatcctaatttggtttccttaaaatttttatttatttacaactcaaaaaacattgttttgtgtaacatatttatatatgtatctaaaccatatgaacatatattttttagaaactaagagaatgataggcttttgttcttatgaacgaaaaagaggtagcactacaaacacaatattcaatcaaaatttcagcattattgaaattgtaagtgaagtaaaacttaagatatttgagttaacctttaagaattttaaatattttggcattgtactaataccgggaacatgaagccaggtgtggtggtatgtgcctgtagtcccaggctgaggcaagagaattacttgagcccaggagtttgaatccatcctgggcagcatactgagaccctgcctttaaaaacaaacagaacaaaaacaaaacaccagggacacatttctctgtcttttttgatcagtgtcctatacatcgaaggtgtgcatatatgttgaatgacattttagggacatggtgtttttataaagaattctgtgagaaaaaatttaataaagcaacaaaaattactctta

SEQ ID NO: 418371 - DNA, 6033 bp, Homo sapiens
  misc_feature (1458)..(1458): n is a, c, g, or t
cactgggaggagtgcggaacgcctggtacagataggggtggggatttgggtgacgcatttaaaagacagcgtgagactcgcgccctccggcacggaaaaggccaggcgacaggtgtcgcttgaaaagactgggcttgtccttgctggtgcatgcgtcgtcggcctctgggcagcaggtttacaaaggaggaaaacgacttcttctagatttttttttcagtttcttctataaatcaaaacatctcaaaatggagacctaaaatccttaaagggacttagtctaatctcgggaggtagttttgtgcatgggtaaacaaattaagtattaactggtgttttactatccaaagaatgctaattttataaacatgatcgagttatataaggtataccataatgagtttgattttgaatttgatttgtggaaataaaggaaaagtgattctagctggggcatattgttaaagcatttttttcagagttggccaggcagtctcctactggcacattctcccattatgtagaatagaaatagtacctgtgtttgggaaagattttaaaatgagtgacagttatttggaacaaagagctaataatcaatccactgcaaattaaagaaacatgcagatgaaagttttgacacattaaaatacttctacagtgacaaagaaaaatcaagaacaaagctttttgatatgtgcaacaaatttagaggaagtaaaaagataaatgtgatgattggtcaagaaattatccagttatttacaaggccactgatattttaaacgtccaaaagtttgtttaaatgggctgttaccgctgagaatgatgaggatgagaatgatggttgaaggttacattttaggaaatgaagaaacttagaaaattaatataaagacagtgatgaatacaaagaagatttttataacaatgtgtaaaatttttggccagggaaaggaatattgaagttagatacaattacttacctttgagggaaataattgttggtaatgagatgtgatgtttctcctgccacctggaaacaaagcattgaagtctgcagttgaaaagcccaacgtctgtgagatccaggaaaccatgcttgcaaaccactggtaaaaaaaaaaaaaaaaaaaaaaaaaagccacagtgacttgcttattggtcattgctagtattatcgactcagaacctctttactaatggctagtaaatcataattgagaaattctgaattttgacaaggtctctgctgttgaaatggtaaatttattattttttttgtcatgataaattctggttcaaggtatgctatccatgaaataatttctgaccaaaactaaattgatgcaatttgattatccatcttagcctacagatggcatctggtaacttttgactgttttaaaaataaatccactatcagagtagatttgatgttggcttcagaaacatttngaaaaacaaaagttcaaaaatgttttcaggaggtgataagttgaataactctacaatgttagttctttgagggggacaaaaaatttaaaatctttgaaaggtcttattttacagccatatctaaattatcttaagaaaatttttaacaaagggaatgaaatatatatcatgattctgtttttccaaaagtaacctgaatatagcaatgaagttcagttttgttattggtagtttgggcagagtctctttttgcagcacctgttgtctaccataattacagaggacatttccatgttctagccaagtatactattagaataaaaaaacttaacattgagttgcttcaacagcatgaaactgagtccaaaagaccaaatgaacaaacacattaatctctgattatttattttaaatagaatatttaattgtgtaagatctaatagtatcattatacttaagcaatcatattcctgatgatctatgggaaataactattatttaattaatattgaaaccaggttttaagatgtgttagccagtcctgttactagtaaatctctttatttggagagaaattttagattgttttgttctccttattagaaggattgtagaaagaaaaaaatgactaattggagaaaaattggggatatatcatatttcactgaattcaaaatgtcttcagttgtaaatcttaccattattttacgtacctctaagaaataaaagtgcttctaattaaaatatgatgtcattaattatgaaatacttcttgataacagaagttttaaaatagccatcttagaatcagtgaaatatggtaatgtattattttcctcctttgagttaggtcttgtgcttttttttcctggccactaaatttcacaatttccaaaaagcaaaataaacatattctgaatatttttgctgtgaaacacttgacagcagagctttccaccatgaaaagaagcttcatgagtcacacattacatctttgggttgattgaatgccactgaaacattctagtagcctggagaagttgacctacctgtggagatgcctgccattaaatggcatcctgatggcttaatacacatcactcttctgtgaagggttttaattttcaacacagcttactctgtagcatcatgtttacattgtatgtataaagattatacaaaggtgcaattgtgtatttcttccttaaaatgtatcagtataggatttagaatctccatgttgaaactctaaatgcatagaaataaaaataataaaaaatttttcattttggcttttcagcctagtattaaaactgataaaagcaaagccatgcacaaaactacctccctagagaaaggctagtcccttttcttccccattcatttcattatgaacatagtagaaaacagcatattcttatcaaatttgatgaaaagcgccaacacgtttgaactgaaatacgacttgtcatgtgaactgtaccgaatgtctacgtattccacttttcctgctggggttcctgtctcagaaaggagtcttgctcgtgctggtttctattacactggtgtgaatgacaaggtcaaatgcttctgttgtggcctgatgctggataactggaaaagaggagacagtcctactgaaaagcataaaaagttgtatcctagctgcagattcgttcagagtctaaattccgttaacaacttggaagctacctctcagcctacttttccttcttcagtaacaaattccacacactcattacttccgggtacagaaaacagtggatatttccgtggctcttattcaaactctccatcaaatcctgtaaactccagagcaaatcaagatttttctgccttgatgagaagttcctaccactgtgcaatgaataacgaaaatgccagattacttacttttcagacatggccattgacttttctgtcgccaacagatctggcaaaagcaggcttttactacataggacctggagacagagtggcttgctttgcctgtggtggaaaattgagcaattgggaaccgaaggataatgctatgtcagaacacctgagacattttcccaaatgcccatttatagaaaatcagcttcaagacacttcaagatacacagtttctaatctgagcatgcagacacatgcagcccgctttaaaacattctttaactggccctctagtgttctagttaatcctgagcagcttgcaagtgcgggtttttattatgtgggtaacagtgatgatgtcaaatgcttttgctgtgatggtggactcaggtgttgggaatctggagatgatccatgggttcaacatgccaagtggtttccaaggtgtgagtacttgataagaattaaaggacaggagttcatccgtcaagttcaagccagttaccctcatctacttgaacagctgctatccacatcagacagcccaggagatgaaaatgcagagtcatcaattatccattttgaacctggagaagaccattcagaagatgcaatcatgatgaatactcctgtgattaatgctgccgtggaaatgggctttagtagaagcctggtaaaacagacagttcagagaaaaatcctagcaactggagagaattatagactagtcaatgatcttgtgttagacttactcaatgcagaagatgaaataagggaagaggagagagaaagagcaactgaggaaaaagaatcaaatgatttattattaatccggaagaatagaatggcactttttcaacatttgacttgtgtaattccaatcctggatagtctactaactgccggaattattaatgaacaagaacatgatgttattaaacagaagacacagacgtctttacaagcaagagaactgattgatacgattttagtaaaaggaaatattgcagccactgtattcagaaactctctgcaagaagctgaagctgtgttatatgagcatttatttgtgcaacaggacataaaatatattcccacagaagatgtttcagatctaccagtggaagaacaattgcggagactacaagaagaaagaacatgtaaagtgtgtatggacaaagaagtgtccatagtgtttattccttgtggtcatctagtagtatgcaaagattgtgctccttctttaagaaagtgtcctatttgtaggagtacaatcaagggtacagttcgtacatttctttcatgaagaagaaccaaaacatcgtctaaactttagaattaatttattaaatgtattataactttaacttttatcctaatttggtttccttaaaatttttatttatttacaactcaaaaaacattgttttgtgtaacatatttatatatgtatctaaaccatatgaacatatattttttagaaactaagagaatgataggcttttgttcttatgaacgaaaaagaggtagcactacaaacacaatattcaatcaaaatttcagcattattgaaattgtaagtgaagtaaaacttaagatatttgagttaacctttaagaattttaaatattttggcattgtactaatacctggttttttttttgttttgtttttttgtacagacagggcagcatactgagaccctgcctttaaaaacaaacagaacaaaaacaaaacaccagggacacatttctctgtcttttttgatcagtgtcctatacatcgaaggtgtgcatatatgttgaatgacattttagggacatggtgtttttataaagaattctgtgagaaaaaatttaataaagcaacaaaaattactcttattcttcattgctttatttcaatgacattggatagtttagtcactcccagactctttccataccttcttaaagcctctcaaatattgaactacagtttatactccttcccataagatgcttcttcattgacacttgtagaacacggggtcaacacatcataaaatctattatggaatgcctgagacaagaatcaaacagtccctttagtaagtttgtttattcacttctctattgattcattcaagaagtctcatgccagccccacctattggaagaaggtctgagttttattcttatctctttggtattaattctgaaacttagaaagtacactggttagcaatgcttgggaccaacaggttgttctggtaaataaatctgtttcatattgtcagtgcaacaaaatgtccccctctgcattatgttattggtactcaacacgtccgagtcataactctgtcctttgcttcttatagaggtattaggtcttcaagagcagaagtaagactgtaatagggaatactcaggggaaggcaggcaaaggctagtcatctaaaccagttctagatgtctgtataggggcagatggctctgtaagggcagaagggaaagaccccttcataagggtcacagctgacaatcctataacaaaagacaggttaacaagagaaaaacttaacaaatttatttaatcacagatttacatcaccggggagccttcgtaatgaagatccaaaattacaggggaaactgtgcatttttatgcttaggtttgataatgaatggacagccc

SEQ ID NO: 418372 - DNA, 2736 bp, Homo sapiens
cactgggaggagtgcggaacgcctggtacagataggggtggggatttgggtgacgcatttaaaagacagcgtgagactcgcgccctccggcacggaaaaggccaggcgacaggtgtcgcttgaaaagactgggcttgtccttgctggtgcatgcgtcgtcggcctctgggcagcaggtttacaaaggaggaaaacgacttcttctagatttttttttcagtttcttctataaatcaaaactacctccctagagaaaggctagtcccttttcttccccattcatttcattatgaacatagtagaaaacagcatattcttatcaaatttgatgaaaagcgccaacacgtttgaactgaaatacgacttgtcatgtgaactgtaccgaatgtctacgtattccacttttcctgctggggttcctgtctcagaaaggagtcttgctcgtgctggtttctattacactggtgtgaatgacaaggtcaaatgcttctgttgtggcctgatgctggataactggaaaagaggagacagtcctactgaaaagcataaaaagttgtatcctagctgcagattcgttcagagtctaaattccgttaacaacttggaagctacctctcagcctacttttccttcttcagtaacaaattccacacactcattacttccgggtacagaaaacagtggatatttccgtggctcttattcaaactctccatcaaatcctgtaaactccagagcaaatcaagatttttctgccttgatgagaagttcctaccactgtgcaatgaataacgaaaatgccagattacttacttttcagacatggccattgacttttctgtcgccaacagatctggcaaaagcaggcttttactacataggacctggagacagagtggcttgctttgcctgtggtggaaaattgagcaattgggaaccgaaggataatgctatgtcagaacacctgagacattttcccaaatgcccatttatagaaaatcagcttcaagacacttcaagatacacagtttctaatctgagcatgcagacacatgcagcccgctttaaaacattctttaactggccctctagtgttctagttaatcctgagcagcttgcaagtgcgggtttttattatgtgggtaacagtgatgatgtcaaatgcttttgctgtgatggtggactcaggtgttgggaatctggagatgatccatgggttcaacatgccaagtggtttccaaggtgtgagtacttgataagaattaaaggacaggagttcatccgtcaagttcaagccagttaccctcatctacttgaacagctgctatccacatcagacagcccaggagatgaaaatgcagagtcatcaattatccattttgaacctggagaagaccattcagaagatgcaatcatgatgaatactcctgtgattaatgctgccgtggaaatgggctttagtagaagcctggtaaaacagacagttcagagaaaaatcctagcaactggagagaattatagactagtcaatgatcttgtgttagacttactcaatgcagaagatgaaataagggaagaggagagagaaagagcaactgaggaaaaagaatcaaatgatttattattaatccggaagaatagaatggcactttttcaacatttgacttgtgtaattccaatcctggatagtctactaactgccggaattattaatgaacaagaacatgatgttattaaacagaagacacagacgtctttacaagcaagagaactgattgatacgattttagtaaaaggaaatattgcagccactgtattcagaaactctctgcaagaagctgaagctgtgttatatgagcatttatttgtgcaacaggacataaaatatattcccacagaagatgtttcagatctaccagtggaagaacaattgcggagactacaagaagaaagaacatgtaaagtgtgtatggacaaagaagtgtccatagtgtttattccttgtggtcatctagtagtatgcaaagattgtgctccttctttaagaaagtgtcctatttgtaggagtacaatcaagggtacagttcgtacatttctttcatgaagaagaaccaaaacatcgtctaaactttagaattaatttattaaatgtattataactttaacttttatcctaatttggtttccttaaaatttttatttatttacaactcaaaaaacattgttttgtgtaacatatttatatatgtatctaaaccatatgaacatatattttttagaaactaagagaatgataggcttttgttcttatgaacgaaaaagaggtagcactacaaacacaatattcaatcaaaatttcagcattattgaaattgtaagtgaagtaaaacttaagatatttgagttaacctttaagaattttaaatattttggcattgtactaataccgggaacatgaagccaggtgtggtggtatgtgcctgtagtcccaggctgaggcaagagaattacttgagcccaggagtttgaatccatcctgggcagcatactgagaccctgcctttaaaaacaaacagaacaaaaacaaaacaccagggacacatttctctgtcttttttgatcagtgtcctatacatcgaaggtgtgcatatatgttgaatgacattttagggacatggtgtttttataaagaattctgtgagaaaaaatttaataaagcaacaaaaattactctta

SEQ ID NO: 418373 - DNA, 3748 bp, Homo sapiens
  misc_feature (1458)..(1458): n is a, c, g, or t
cactgggaggagtgcggaacgcctggtacagataggggtggggatttgggtgacgcatttaaaagacagcgtgagactcgcgccctccggcacggaaaaggccaggcgacaggtgtcgcttgaaaagactgggcttgtccttgctggtgcatgcgtcgtcggcctctgggcagcaggtttacaaaggaggaaaacgacttcttctagatttttttttcagtttcttctataaatcaaaacatctcaaaatggagacctaaaatccttaaagggacttagtctaatctcgggaggtagttttgtgcatgggtaaacaaattaagtattaactggtgttttactatccaaagaatgctaattttataaacatgatcgagttatataaggtataccataatgagtttgattttgaatttgatttgtggaaataaaggaaaagtgattctagctggggcatattgttaaagcatttttttcagagttggccaggcagtctcctactggcacattctcccattatgtagaatagaaatagtacctgtgtttgggaaagattttaaaatgagtgacagttatttggaacaaagagctaataatcaatccactgcaaattaaagaaacatgcagatgaaagttttgacacattaaaatacttctacagtgacaaagaaaaatcaagaacaaagctttttgatatgtgcaacaaatttagaggaagtaaaaagataaatgtgatgattggtcaagaaattatccagttatttacaaggccactgatattttaaacgtccaaaagtttgtttaaatgggctgttaccgctgagaatgatgaggatgagaatgatggttgaaggttacattttaggaaatgaagaaacttagaaaattaatataaagacagtgatgaatacaaagaagatttttataacaatgtgtaaaatttttggccagggaaaggaatattgaagttagatacaattacttacctttgagggaaataattgttggtaatgagatgtgatgtttctcctgccacctggaaacaaagcattgaagtctgcagttgaaaagcccaacgtctgtgagatccaggaaaccatgcttgcaaaccactggtaaaaaaaaaaaaaaaaaaaaaaaaaagccacagtgacttgcttattggtcattgctagtattatcgactcagaacctctttactaatggctagtaaatcataattgagaaattctgaattttgacaaggtctctgctgttgaaatggtaaatttattattttttttgtcatgataaattctggttcaaggtatgctatccatgaaataatttctgaccaaaactaaattgatgcaatttgattatccatcttagcctacagatggcatctggtaacttttgactgttttaaaaataaatccactatcagagtagatttgatgttggcttcagaaacatttngaaaaacaaaagttcaaaaatgttttcaggaggtgataagttgaataactctacaatgttagttctttgagggggacaaaaaatttaaaatctttgaaaggtcttattttacagccatatctaaattatcttaagaaaatttttaacaaagggaatgaaatatatatcatgattctgtttttccaaaagtaacctgaatatagcaatgaagttcagttttgttattggtagtttgggcagagtctctttttgcagcacctgttgtctaccataattacagaggacatttccatgttctagccaagtatactattagaataaaaaaacttaacattgagttgcttcaacagcatgaaactgagtccaaaagaccaaatgaacaaacacattaatctctgattatttattttaaatagaatatttaattgtgtaagatctaatagtatcattatacttaagcaatcatattcctgatgatctatgggaaataactattatttaattaatattgaaaccaggttttaagatgtgttagccagtcctgttactagtaaatctctttatttggagagaaattttagattgttttgttctccttattagaaggattgtagaaagaaaaaaatgactaattggagaaaaattggggatatatcatatttcactgaattcaaaatgtcttcagttgtaaatcttaccattattttacgtacctctaagaaataaaagtgcttctaattaaaatatgatgtcattaattatgaaatacttcttgataacagaagttttaaaatagccatcttagaatcagtgaaatatggtaatgtattattttcctcctttgagttaggtcttgtgcttttttttcctggccactaaatttcacaatttccaaaaagcaaaataaacatattctgaatatttttgctgtgaaacacttgacagcagagctttccaccatgaaaagaagcttcatgagtcacacattacatctttgggttgattgaatgccactgaaacattctagtagcctggagaagttgacctacctgtggagatgcctgccattaaatggcatcctgatggcttaatacacatcactcttctgtgaagggttttaattttcaacacagcttactctgtagcatcatgtttacattgtatgtataaagattatacaaaggtgcaattgtgtatttcttccttaaaatgtatcagtataggatttagaatctccatgttgaaactctaaatgcatagaaataaaaataataaaaaatttttcattttggcttttcagcctagtattaaaactgataaaagcaaagccatgcacaaaactacctccctagagaaaggctagtcccttttcttccccattcatttcattatgaacatagtagaaaacagcatattcttatcaaatttgatgaaaagcgccaacacgtttgaactgaaatacgacttgtcatgtgaactgtaccgaatgtctacgtattccacttttcctgctggggttcctgtctcagaaaggagtcttgctcgtgctggtttctattacactggtgtgaatgacaaggtcaaatgcttctgttgtggcctgatgctggataactggaaaagaggagacagtcctactgaaaagcataaaaagttgtatcctagctgcagattcgttcagagtctaaattccgttaacaacttggaagctacctctcagcctacttttccttcttcagtaacaaattccacacactcattacttccgggtacagaaaacagtggatatttccgtggctcttattcaaactctccatcaaatcctgtaaactccagagcaaatcaagatttttctgccttgatgagaagttcctaccactgtgcaatgaataacgaaaatgccagattacttacttttcagacatggccattgacttttctgtcgccaacagatctggcaaaagcaggcttttactacataggacctggagacagagtggcttgctttgcctgtggtggaaaattgagcaattgggaaccgaaggataatgctatgtcagaacacctgagacattttcccaaatgcccatttatagaaaatcagcttcaagacacttcaagatacacagtttctaatctgagcatgcagacacatgcagcccgctttaaaacattctttaactggccctctagtgttctagttaatcctgagcagcttgcaagtgcgggtttttattatgtgggtaagaaactgaatctgctaattaaaaaaaatatatttcattttaaa

SEQ ID NO: 418374 - DNA, 1729 bp, Homo sapiens
cagatagaatcgagctggtactttctaatctgagcatgcagacacatgcagcccgctttaaaacattctttaactggccctctagtgttctagttaatcctgagcagcttgcaagtgcgggtttttattatgtgggtaacagtgatgatgtcaaatgcttttgctgtgatggtggactcaggtgttgggaatctggagatgatccatgggttcaacatgccaagtggtttccaaggtgtgagtacttgataagaattaaaggacaggagttcatccgtcaagttcaagccagttaccctcatctacttgaacagctgctatccacatcagacagcccaggagatgaaaatgcagagtcatcaattatccattttgaacctggagaagaccattcagaagatgcaatcatgatgaatactcctgtgattaatgctgccgtggaaatgggctttagtagaagcctggtaaaacagacagttcagagaaaaatcctagcaactggagagaattatagactagtcaatgatcttgtgttagacttactcaatgcagaagatgaaataagggaagaggagagagaaagagcaactgaggaaaaagaatcaaatgatttattattaatccggaagaatagaatggcactttttcaacatttgacttgtgtaattccaatcctggatagtctactaactgccggaattattaatgaacaagaacatgatgttattaaacagaagacacagacgtctttacaagcaagagaactgattgatacgattttagtaaaaggaaatattgcagccactgtattcagaaactctctgcaagaagctgaagctgtgttatatgagcatttatttgtgcaacaggacataaaatatattcccacagaagatgtttcagatctaccagtggaagaacaattgcggagactacaagaagaaagaacatgtaaagtgtgtatggacaaagaagtgtccatagtgtttattccttgtggtcatctagtagtatgcaaagattgtgctccttctttaagaaagtgtcctatttgtaggagtacaatcaagggtacagttcgtacatttctttcatgaagaagaaccaaaacatcgtctaaactttagaattaatttattaaatgtattataactttaacttttatcctaatttggtttccttaaaatttttatttatttacaactcaaaaaacattgttttgtgtaacatatttatatatgtatctaaaccatatgaacatatattttttagaaactaagagaatgataggcttttgttcttatgaacgaaaaagaggtagcactacaaacacaatattcaatcaaaatttcagcattattgaaattgtaagtgaagtaaaacttaagatatttgagttaacctttaagaattttaaatattttggcattgtactaataccgggaacatgaagccaggtgtggtggtatgtgcctgtagtcccaggctgaggcaagagaattacttgagcccaggagtttgaatccatcctgggcagcatactgagaccctgcctttaaaaacaaacagaacaaaaacaaaacaccagggacacatttctctgtcttttttgatcagtgtcctatacatcgaaggtgtgcatatatgttgaatgacattttagggacatggtgtttttataaagaattctgtgagaaaaaatttaataaagcaacaaaaattactctta

SEQ ID NO: 418375 - DNA, 1107 bp, Homo sapiens
gagatagaggctcccatgagctgtgattgtgccactgcactccagcttgggtgacagactctgtctcaaaaaaaaatcaatctaatttatagatattagttacataaaaagattaaagacttctgttgccttgaaatgagtatttggctatagtctaaagtgttcatttttaaaatagattccatagctaaatattaaccttatttgtcatagtaatgctttttctttttctcccttagtgcaacaggacataaaatatattcccacagaagatgtttcagatctaccagtggaagaacaattgcggagactacaagaagaaagaacatgtaaagtgtgtatggacaaagaagtgtccatagtgtttattccttgtggtcatctagtagtatgcaaagattgtgctccttctttaagaaagtgtcctatttgtaggagtacaatcaagggtacagttcgtacatttctttcatgaagaagaaccaaaacatcgtctaaactttagaattaatttattaaatgtattataactttaacttttatcctaatttggtttccttaaaatttttatttatttacaactcaaaaaacattgttttgtgtaacatatttatatatgtatctaaaccatatgaacatatattttttagaaactaagagaatgataggcttttgttcttatgaacgaaaaagaggtagcactacaaacacaatattcaatcaaaatttcagcattattgaaattgtaagtgaagtaaaacttaagatatttgagttaacctttaagaattttaaatattttggcattgtactaataccgggaacatgaagccaggtgtggtggtatgtgcctgtagtcccaggctgaggcaagagaattacttgagcccaggagtttgaatccatcctgggcagcatactgagaccctgcctttaaaaacaaacagaacaaaaacaaaacaccagggacacatttctctgtcttttttgatcagtgtcctatacatcgaaggtgtgcatatatgttgaatgacattttagggacatggtgtttttataaagaattctgtgagaaaaaatttaataaagcaacaaaaattactctta

SEQ ID NO: 418376 - DNA, 5375 bp, Homo sapiens
  misc_feature (1538)..(1538): n is a, c, g, or t
cactgggaggagtgcggaacgcctggtacagataggggtggggatttgggtgacgcatttaaaagacagcgtgagactcgcgccctccggcacggaaaaggccaggcgacaggtgtcgcttgaaaagactgggcttgtccttgctggtgcatgcgtcgtcggcctctgggcagcagttgttgcctaaatttccacaaatatatgccttgctggagtgcagtggtgtgatcttggcttactgcaaccttcacctcccgggttcaagtgattctcctgcttcagtctcctgagtagctggaaatacaggtttacaaaggaggaaaacgacttcttctagatttttttttcagtttcttctataaatcaaaacatctcaaaatggagacctaaaatccttaaagggacttagtctaatctcgggaggtagttttgtgcatgggtaaacaaattaagtattaactggtgttttactatccaaagaatgctaattttataaacatgatcgagttatataaggtataccataatgagtttgattttgaatttgatttgtggaaataaaggaaaagtgattctagctggggcatattgttaaagcatttttttcagagttggccaggcagtctcctactggcacattctcccattatgtagaatagaaatagtacctgtgtttgggaaagattttaaaatgagtgacagttatttggaacaaagagctaataatcaatccactgcaaattaaagaaacatgcagatgaaagttttgacacattaaaatacttctacagtgacaaagaaaaatcaagaacaaagctttttgatatgtgcaacaaatttagaggaagtaaaaatgatattttaaacgtccaaaagtttgtttaaatgggctgttaccgctgagaatgatgaggatgagaatgatggttgaaggttacattttaggaaatgaagaaacttagaaaattaatataaagacagtgatgaatacaaagaagatttttataacaatgtgtaaaatttttggccagggaaaggaatattgaagttagatacaattacttacctttgagggaaataattgttggtaatgagatgtgatgtttctcctgccacctggaaacaaagcattgaagtctgcagttgaaaagcccaacgtctgtgagatccaggaaaccatgcttgcaaaccactggtaaaaaaaaaaaaaaaaaaaaaaaaaagccacagtgacttgcttattggtcattgctagtattatcgactcagaacctctttactaatggctagtaaatcataattgagaaattctgaattttgacaaggtctctgctgttgaaatggtaaatttattattttttttgtcatgataaattctggttcaaggtatgctatccatgaaataatttctgaccaaaactaaattgatgcaatttgattatccatcttagcctacagatggcatctggtaacttttgactgttttaaaaataaatccactatcagagtagatttgatgttggcttcagaaacatttngaaaaacaaaagttcaaaaatgttttcaggaggtgataagttgaataactctacaatgttagttctttgagggggacaaaaaatttaaaatctttgaaaggtcttattttacagccatatctaaattatcttaagaaaatttttaacaaagggaatgaaatatatatcatgattctgtttttccaaaagtaacctgaatatagcaatgaagttcagttttgttattggtagtttgggcagagtctctttttgcagcacctgttgtctaccataattacagaggacatttccatgttctagccaagtatactattagaataaaaaaacttaacattgagttgcttcaacagcatgaaactgagtccaaaagaccaaatgaacaaacacattaatctctgattatttattttaaatagaatatttaattgtgtaagatctaatagtatcattatacttaagcaatcatattcctgatgatctatgggaaataactattatttaattaatattgaaaccaggttttaagatgtgttagccagtcctgttactagtaaatctctttatttggagagaaattttagattgttttgttctccttattagaaggattgtagaaagaaaaaaatgactaattggagaaaaattggggatatatcatatttcactgaattcaaaatgtcttcagttgtaaatcttaccattattttacgtacctctaagaaataaaagtgcttctaattaaaatatgatgtcattaattatgaaatacttcttgataacagaagttttaaaatagccatcttagaatcagtgaaatatggtaatgtattattttcctcctttgagttaggtcttgtgcttttttttcctggccactaaatttcacaatttccaaaaagcaaaataaacatattctgaatatttttgctgtgaaacacttgacagcagagctttccaccatgaaaagaagcttcatgagtcacacattacatctttgggttgattgaatgccactgaaacattctagtagcctggagaagttgacctacctgtggagatgcctgccattaaatggcatcctgatggcttaatacacatcactcttctgtgaagggttttaattttcaacacagcttactctgtagcatcatgtttacattgtatgtataaagattatacaaaggtgcaattgtgtatttcttccttaaaatgtatcagtataggatttagaatctccatgttgaaactctaaatgcatagaaataaaaataataaaaaatttttcattttggcttttcagcctagtattaaaactgataaaagcaaagccatgcacaaaactacctccctagagaaaggctagtcccttttcttccccattcatttcattatgaacatagtagaaaacagcatattcttatcaaatttgatgaaaagcgccaacacgtttgaactgaaatacgacttgtcatgtgaactgtaccgaatgtctacgtattccacttttcctgctggggttcctgtctcagaaaggagtcttgctcgtgctggtttctattacactggtgtgaatgacaaggtcaaatgcttctgttgtggcctgatgctggataactggaaaagaggagacagtcctactgaaaagcataaaaagttgtatcctagctgcagattcgttcagagtctaaattccgttaacaacttggaagctacctctcagcctacttttccttcttcagtaacaaattccacacactcattacttccgggtacagaaaacagtggatatttccgtggctcttattcaaactctccatcaaatcctgtaaactccagagcaaatcaagatttttctgccttgatgagaagttcctaccactgtgcaatgaataacgaaaatgccagattacttacttttcagacatggccattgacttttctgtcgccaacagatctggcaaaagcaggcttttactacataggacctggagacagagtggcttgctttgcctgtggtggaaaattgagcaattgggaaccgaaggataatgctatgtcagaacacctgagacattttcccaaatgcccatttatagaaaatcagcttcaagacacttcaagatacacagtttctaatctgagcatgcagacacatgcagcccgctttaaaacattctttaactggccctctagtgttctagttaatcctgagcagcttgcaagtgcgggtttttattatgtgggtaacagtgatgatgtcaaatgcttttgctgtgatggtggactcaggtgttgggaatctggagatgatccatgggttcaacatgccaagtggtttccaaggtgtgagtacttgataagaattaaaggacaggagttcatccgtcaagttcaagccagttaccctcatctacttgaacagctgctatccacatcagacagcccaggagatgaaaatgcagagtcatcaattatccattttgaacctggagaagaccattcagaagatgcaatcatgatgaatactcctgtgattaatgctgccgtggaaatgggctttagtagaagcctggtaaaacagacagttcagagaaaaatcctagcaactggagagaattatagactagtcaatgatcttgtgttagacttactcaatgcagaagatgaaataagggaagaggagagagaaagagcaactgaggaaaaagaatcaaatgatttattattaatccggaagaatagaatggcactttttcaacatttgacttgtgtaattccaatcctggatagtctactaactgccggaattattaatgaacaagaacatgatgttattaaacagaagacacagacgtctttacaagcaagagaactgattgatacgattttagtaaaaggaaatattgcagccactgtattcagaaactctctgcaagaagctgaagctgtgttatatgagcatttatttgtgcaacaggacataaaatatattcccacagaagatgtttcagatctaccagtggaagaacaattgcggagactacaagaagaaagaacatgtaaagtgtgtatggacaaagaagtgtccatagtgtttattccttgtggtcatctagtagtatgcaaagattgtgctccttctttaagaaagtgtcctatttgtaggagtacaatcaagggtacagttcgtacatttctttcatgaagaagaaccaaaacatcgtctaaactttagaattaatttattaaatgtattataactttaacttttatcctaatttggtttccttaaaatttttatttatttacaactcaaaaaacattgttttgtgtaacatatttatatatgtatctaaaccatatgaacatatattttttagaaactaagagaatgataggcttttgttcttatgaacgaaaaagaggtagcactacaaacacaatattcaatcaaaatttcagcattattgaaattgtaagtgaagtaaaacttaagatatttgagttaacctttaagaattttaaatattttggcattgtactaataccgggaacatgaagccaggtgtggtggtatgtgcctgtagtcccaggctgaggcaagagaattacttgagcccaggagtttgaatccatcctgggcagcatactgagaccctgcctttaaaaacaaacagaacaaaaacaaaacaccagggacacatttctctgtcttttttgatcagtgtcctatacatcgaaggtgtgcatatatgttgaatgacattttagggacatggtgtttttataaagaattctgtgagaaaaaatttaataaagcaacaaaaattactctta

SEQ ID NO: 418377 - DNA, 1961 bp, Homo sapiens
ccggctaggtagcgaggcctgggtggtggattacttacttttcagacatggccattgacttttctgtcgccaacagatctggcaaaagcaggcttttactacataggacctggagacagagtggcttgctttgcctgtggtggaaaattgagcaattgggaaccgaaggataatgctatgtcagaacacctgagacattttcccaaatgcccatttatagaaaatcagcttcaagacacttcaagatacacagtttctaatctgagcatgcagacacatgcagcccgctttaaaacattctttaactggccctctagtgttctagttaatcctgagcagcttgcaagtgcgggtttttattatgtgggtaacagtgatgatgtcaaatgcttttgctgtgatggtggactcaggtgttgggaatctggagatgatccatgggttcaacatgccaagtggtttccaaggtgtgagtacttgataagaattaaaggacaggagttcatccgtcaagttcaagccagttaccctcatctacttgaacagctgctatccacatcagacagcccaggagatgaaaatgcagagtcatcaattatccattttgaacctggagaagaccattcagaagatgcaatcatgatgaatactcctgtgattaatgctgccgtggaaatgggctttagtagaagcctggtaaaacagacagttcagagaaaaatcctagcaactggagagaattatagactagtcaatgatcttgtgttagacttactcaatgcagaagatgaaataagggaagaggagagagaaagagcaactgaggaaaaagaatcaaatgatttattattaatccggaagaatagaatggcactttttcaacatttgacttgtgtaattccaatcctggatagtctactaactgccggaattattaatgaacaagaacatgatgttattaaacagaagacacagacgtctttacaagcaagagaactgattgatacgattttagtaaaaggaaatattgcagccactgtattcagaaactctctgcaagaagctgaagctgtgttatatgagcatttatttgtgcaacaggacataaaatatattcccacagaagatgtttcagatctaccagtggaagaacaattgcggagactacaagaagaaagaacatgtaaagtgtgtatggacaaagaagtgtccatagtgtttattccttgtggtcatctagtagtatgcaaagattgtgctccttctttaagaaagtgtcctatttgtaggagtacaatcaagggtacagttcgtacatttctttcatgaagaagaaccaaaacatcgtctaaactttagaattaatttattaaatgtattataactttaacttttatcctaatttggtttccttaaaatttttatttatttacaactcaaaaaacattgttttgtgtaacatatttatatatgtatctaaaccatatgaacatatattttttagaaactaagagaatgataggcttttgttcttatgaacgaaaaagaggtagcactacaaacacaatattcaatcaaaatttcagcattattgaaattgtaagtgaagtaaaacttaagatatttgagttaacctttaagaattttaaatattttggcattgtactaataccgggaacatgaagccaggtgtggtggtatgtgcctgtagtcccaggctgaggcaagagaattacttgagcccaggagtttgaatccatcctgggcagcatactgagaccctgcctttaaaaacaaacagaacaaaaacaaaacaccagggacacatttctctgtcttttttgatcagtgtcctatacatcgaaggtgtgcatatatgttgaatgacattttagggacatggtgtttttataaagaattctgtgagaaaaaatttaataaagcaacaaaaattactctta

SEQ ID NO: 418378 - DNA, 3901 bp, Homo sapiens
cactgggaggagtgcggaacgcctggtacagataggggtggggatttgggtgacgcatttaaaagacagcgtgagactcgcgccctccggcacggaaaaggccaggcgacaggtgtcgcttgaaaagactgggcttgtccttgctggtgcatgcgtcgtcggcctctgggcagcaggtttacaaaggaggaaaacgacttcttctagatttttttttcagtttcttctataaatcaaaactacctccctagagaaaggctagtcccttttcttccccattcatttcattatgaacatagtagaaaacagcatattcttatcaaatttgatgaaaagcgccaacacgtttgaactgaaatacgacttgtcatgtgaactgtaccgaatgtctacgtattccacttttcctgctggggttcctgtctcagaaaggagtcttgctcgtgctggtttctattacactggtgtgaatgacaaggtcaaatgcttctgttgtggcctgatgctggataactggaaaagaggagacagtcctactgaaaagcataaaaagttgtatcctagctgcagattcgttcagagtctaaattccgttaacaacttggaagctacctctcagcctacttttccttcttcagtaacaaattccacacactcattacttccgggtacagaaaacagtggatatttccgtggctcttattcaaactctccatcaaatcctgtaaactccagagcaaatcaagatttttctgccttgatgagaagttcctaccactgtgcaatgaataacgaaaatgccagattacttacttttcagacatggccattgacttttctgtcgccaacagatctggcaaaagcaggcttttactacataggacctggagacagagtggcttgctttgcctgtggtggaaaattgagcaattgggaaccgaaggataatgctatgtcagaacacctgagacattttcccaaatgcccatttatagaaaatcagcttcaagacacttcaagatacacagtttctaatctgagcatgcagacacatgcagcccgctttaaaacattctttaactggccctctagtgttctagttaatcctgagcagcttgcaagtgcgggtttttattatgtgggtaacagtgatgatgtcaaatgcttttgctgtgatggtggactcaggtgttgggaatctggagatgatccatgggttcaacatgccaagtggtttccaaggtgtgagtacttgataagaattaaaggacaggagttcatccgtcaagttcaagccagttaccctcatctacttgaacagctgctatccacatcagacagcccaggagatgaaaatgcagagtcatcaattatccattttgaacctggagaagaccattcagaagatgcaatcatgatgaatactcctgtgattaatgctgccgtggaaatgggctttagtagaagcctggtaaaacagacagttcagagaaaaatcctagcaactggagagaattatagactagtcaatgatcttgtgttagacttactcaatgcagaagatgaaataagggaagaggagagagaaagagcaactgaggaaaaagaatcaagaataaagattactgtaaacccagagtcaaaggcagtcttggctggacagtttgtgaaactgtgttgccgggcaactggacatccttttgttcaatatcagtggttcaaaatgaataaagagattccaaatggaaatacatcagagcttatttttaatgcagtgcatgtaaaagatgcaggcttttatgtctgtcgagttaataacaatttcacctttgaattcagccagtggtcacagctggatgtttgcgacatcccagagagcttccagagaagtgttgatggcgtctctgaatccaagttgcaaatctgtgttgaaccaacttcccaaaagctgatgccaggcagcacattggttttacagtgtgttgctgttggaagccctattcctcactaccagtggttcaaaaatgaattaccattaacacatgagaccaaaaagctatacatggtgccttatgtggatttggaacaccaaggaacctactggtgtcatgtatataatgatcgagacagtcaagatagcaagaaggtagaaatcatcataggaagaacagatgaggcagtggagtgcactgaagatgaattaaataatcttggtcatcctgataataaagagcaaacaactgaccagcctttggcgaaggacaaggttgcccttttgataggaaatatgaattaccgggagcaccccaagctcaaagctcctttggtggatgtgtacgaattgactaacttactgagacagctggacttcaaagtggtttcactgttggatcttactgaatatgagatgcgtaatgctgtggatgagtttttactccttttagacaagggagtatatgggttattatattatgcaggacatggttatgaaaattttgggaacagcttcatggtccccgttgatgctccaaatccatataggtctgaaaattgtctgtgtgtacaaaatatactgaaattgatgcaagaaaaagaaactggacttaatgtgttcttattggatatgtgtaggaaaagaaatgactacgatgataccattccaatcttggatgcactaaaagtcaccgccaatattgtgtttggatatgccacgtgtcaaggagcagaagcttttgaaatccagcattctggattggcaaatggaatctttatgaaatttttaaaagacagattattagaagataagaaaatcactgtgttactggatgaagttgcagaagatatgggtaagtgtcaccttaccaaaggcaaacaggctctagagattcgaagtagtttatctgagaagagagcacttactgatccaatacagggaacagaatattctgctgaatctcttgtgcggaatctacagtgggccaaggctcatgaacttccagaaagtatgtgtcttaagtttgactgtggtgttcagattcaattaggatttgcagctgagttttccaatgtcatgatcatctatacaagtatagtttacaaaccaccggagataataatgtgtgatgcctacgttactgattttccacttgatctagatattgatccaaaagatgcaaataaaggcacacctgaagaaactggcagctacttggtatcaaaggatcttcccaagcattgcctctataccagactcagttcactgcaaaaattaaaggaacatctagtcttcacagtatgtttatcatatcagtactcaggattggaagatactgtagaggacaagcaggaagtgaatgttgggaaacctctcattgctaaattagacatgcatcgaggtttgggaaggaagacttgctttcaaacttgtcttatgtctaatggtccttaccagagttctgcagccacctcaggaggagcagggcattatcactcattgcaagacccattccatggtgtttaccattcacatcctggtaatccaagtaatgttacaccagcagatagctgtcattgcagccggactccagatgcatttatttcaagtttcgctcaccatgcttcatgtcattttagtagaagtaatgtgccagtagagacaactgatgaaataccatttagtttctctgacaggctcagaatttctgaaaaatgacctccttgtttttgaaagttagcataattttagatgcctgtgaaatagtactgcacttacataaagtgagacattgtgaaaaggcaaatttgtatatgtagagaaagaatagtagtaactgtttcatagcaaacttcaggactttgagatgttgaaattacattatttaattacagacttcctctttct

SEQ ID NO: 418379 - DNA, 612 bp, Homo sapiens
acggagccggcgctggggacggcggcgccgagtctgcgggtcctcccgccagcccggccggaggcagccgaggccgctcgggcggcggcggcggcggcggcgggagccggagcgcatctcgcccaggagccggagcagcggcactgcctgaaccagacagcagccttgggtgcaggcgtggtcatgagggcagatggacactgctgaagacccggcctggctccaccccatcccctctcccactgagtcacaggtttgagattcccagagaggccaaagacagctacaggaagtaccctgggggctcagctgagagagagtcacagaaaggccagagggtctcaggaaggtctggaggtcacagctgggctcacagaagctcttgggccctggcatcctgggtgaccggtgttcttgggtattggggacaggacagagagctcattctataaccacagttgtcttttaaaggccaccctctccagccccttgtcccccctgtgctgtgagcccaagtcccttgtgaccactcagtgtcccgtccccacccctccagccgcagtttttggctacaaactgtcacagtatacattggtaataaaatatttcccc

SEQ ID NO: 418380 - DNA, 4202 bp, Homo sapiens
aggctggtacggcccgggagttatgggcatcccgccagtccctggcctggaggctgtcgaggccgctcgggcggtggctggcggctgtgcggcgtggtagccggagctgctatctcgtcccagtgagcctggagctagcgtgcactgcctgaaccagacagcagccttgggtgcaggcgtggtcatgagggcagatggacactgctgaagacccggcctggctccagctgcttcaaaaggattccagccccccaggaccccgacccacagccttcttctgcccacaggatgggagcctgggggctggcagctcggctatgagggattactgcccctcccagcaaaaggcaagccctgcaccccccaggcacacccctgaccaaagcccaggcatggagtctagacacagaagccccagtggggctggggaaggggcctcctgctctgacggccccagagggagcctggcctgcccctccccaacctgcttctctccccaggagtcaccctccaaggagacattggaggcacatggagcctccatctcagggacaccagaagccaccacgtctgggaagccagagcctgtgtcctccgtgaaaactgagcccaaatcctcagatgacagaaatcccatgttcttagagaagatggatttcaagtcctcaaagcaggccgattccacttccataggaaaggaggatcctgggtcctcacggaaggcagatcccatgtttacaggaaaggcagagcctgaaatcttgggaaagggggatcctgtggctcctggaaggatggatcccatgactgtaagaaaggaagatcttggatccctgggaaaagtagatcctttgtgctccagcaagacgtatacagtgtcaccgaagaaaggtggatcctgtgtcctcagacaaagtggaccctgtattcccaagaaaggaggagcccaggtattcaggaaaagagcatcctgtgtcctcagaaaaggtcgctcctacatctgcagaaaaggtagatcttgtattgtcgggaaagagagatcctgggccctcgggaaaggcagatcccgtgcccttggaaagcatggattctgcgtccacaggaaagacagagccggggctcctgggcaagctgattccaggctcatcaggcaagaatgggcctgtatcctctgggaccggggctcctgggtccttgggaaggctggatcccacatgcttggggatggcagatcccgcatctgtgggaaatgtagaaactgtgcctgccacaaaagaggactcccggttcctgggaaagatggaccctgcctcctcaggagaggggcgtcctgtgtctggccacacggatactacggcttcagcaaagacagatctcacatctttgaaaaatgtggatcccatgtcttcaggcaaggtggatccagtttctctgggaaagatggaccccatgtgctcaggaaagccagagctcttgtctcctggacaggcagagcgtgtgtctgtgggaaaggcaggaactgtatccccaggaaaagaggacccggtgtcctccagaagggaggaccccatatctgctggaagtagaaagacatcatctgaaaaagtgaatcctgagtcttcaggaaagacaaaccctgtgtcttcaggtccaggcgatcccaggtccttggggacagcaggtcccccatctgcagtaaaggctgagccagcgacggggggaaaaggagatcccctgtcctcggagaaggcaggtctggtggcctctggaaaggcggctcccacagcctcagggaaggccgagcccctcgcggtgggcaaggaggaccctgtgagcaagggaaaggcagacgctggcccctctggacaaggggactctgtgtctataggtaaagtggtctcaactccaggaaaaacagtcccggtgccctcggggaaggtggatcccgtgtccctgggaaaagcagaagctatcccagagggaaaagtgggttctctgcctctagagaaggggagtcctgttaccaccacaaaggcggatcccagggcctcggggaaagcacagccgcagtctggtggcaaagcagaaacaaagctccctgggcaagagggcgctgcagcaccaggagaagcaggggctgtgtgtttgaaaaaggagacaccacaggcctcagagaaggtggatcctggatcctgcagaaaagcagagccccttgcctcagggaagggagagcctgtgtccctggggaaagccgactctgcaccttccagaaaaacggagtccccatccttggggaaggtggtccccctgagtctggagaagaccaagccgtcctcctcctccaggcagttagaccgcaaagccctcggctcagcccggtctcccgagggtgccaggggcagtgaaggccgcgtggagccgaaggccgagcccgtgtccagcaccgaggcctccagtctcggccagaaagacctggaagccgctggggccgagagaagcccctgcccagaggccgcagcgcccccgccggggccgcggactcgcgacaacttcaccaaggcgccgtcgtgggaggcgagcgccccgccgccgccgcgcgaggacgcgggcactcaggcgggcgcgcaggcctgcgtctcagtggccgtgagccccatgtctccgcaggacggcgctgggggctcggccttcagcttccaggcggcgccgcgcgcgcccagcccgccctcgcgccgagatgcgggcctgcaggtgtcgctgggcgccgccgagacgcgctccgtggccactgggcccatgacacctcaagccgccgcgccgcccgccttccccgaagtgcgggtgcggcccggctcagcgctggcggccgctgtagcgcccccggagccggctgagcccgtgcgagacgtgagctgggacgagaagggcatgacgtgggaggtatacggcgccgccatggaggtggaggtgctgggcatggccatccagaagcatctggagcgacagatcgaggagcacggccgccaaggggcgcccgcgccgccgcccgccgcccgtgccggccccggccgttcgggctcggtgcgcaccgcgcccccagatggcgccgccaagcgtccgcccggcctgttccgcgcgctgctgcagagtgtgcgccggccgcggtgctgctcgcgggcgggacccacggccgagtgatctgcccccattttgtacgcccgagtttccgaccttctcaggctcccttcttgatcacaggcccctagaaggggtcccctctgcgtgccacaggcctccgaggggttgtgcagcctctagggctgttgcgtccccgtctttccagcccctcccatcacaaatacagaagaaccccttctaccaagctccctcgtggccacgaggccacgaacccggccagccctgacgccccactgtcccctcacagccctcagctctactcccggtcacactgggcgaccacgggggcctgctcagcaccctcacctcccaccccctgagagctggggcaggctcctgagatgtctagactggtgcgttgtggtctccggtggggccagatccccagaacagggagagactgcatacaagtctgagtggcagaagcttcaagtgggtgaggatcggtgtgtgagacccgcgagtgggcacgtctctgaatgtgaggtctcgggcagcacgtgaggtagaacgagtgtgagcgtctccacgcagtggctggccccgtggccggggcgtctcttgcatgctgttggtggtccttccccagttcctatctcccacccgcctggttccagccccatcccctctcccactgagtcacaggtttgagattcccagagaggccaaagacagctacaggaagtaccctgggggctcagctgagagagagtcacagaaaggccagagggtctcaggaaggtctggaggtcacagctgggctcacagaagctcttgggccctggcatcctgggtgaccggtgttcttgggtattggggacaggacagagagctcattctataaccacagttgtcttttaaaggccaccctctccagccccttgtcccccctgtgctgtgagcccaagtcccttgtgaccactcagtgtcccgtccccacccctccagccgcagtttttggctacaaactgtcacagtatacattggtaataaaatatttcccc

SEQ ID NO: 418381 - DNA, 3354 bp, Homo sapiens
acggagccggcgctggggacggcggcgccgagtctgcgggtcctcccgccagcccggccggaggcagccgaggccgctcgggcggcggcggcggcggcggcgggagccggagcgcatctcgcccaggagccggagcagcggcactgcctgaaccagacagcagccttgggtgcaggcgtggtcatgagggcagatggacactgctgaagacccggcctggctccagctgcttcaaaaggattccagccccccaggaccccgacccacagccttcttctgcccacaggatgggagcctgggggctggcagctcggctatgagggattactgcccctcccagcaaaaggcaagccctgcaccccccaggcacacccctgaccaaagcccaggcatggagtctagacacagaagccccagtggggctggggaaggggcctcctgctctgacggccccagagggagcctggcctgcccctccccaacctgcttctctccccaggagtcaccctccaaggagacattggaggcacatggagcctccatctcagggacaccagaagccaccacgtctgggaagccagagcctgtgtcctccgtgaaaactgagcccaaatcctcagatgacagaaatcccatgttcttagagaagatggatttcaagtcctcaaagcaggccgattccacttccataggaaaggaggatcctgggtcctcacggaaggcagatcccatgtttacaggaaaggcagagcctgaaatcttgggaaagggggatcctgtggctcctggaaggatggatcccatgactgtaagaaaggaagatcttggatccctgggaaaagtagatcctttgtgctccagcaagacgtatacagtgtcaccgaagaaaggtggatcctgtgtcctcagacaaagtggaccctgtattcccaagaaaggaggagcccaggtattcaggaaaagagcatcctgtgtcctcagaaaaggtcgctcctacatctgcagaaaaggtagatcttgtattgtcgggaaagagagatcctgggccctcgggaaaggcagatcccgtgcccttggaaagcatggattctgcgtccacaggaaagacagagccggggctcctgggcaagctgattccaggctcatcaggcaagaatgggcctgtatcctctgggaccggggctcctgggtccttgggaaggctggatcccacatgcttggggatggcagatcccgcatctgtgggaaatgtagaaactgtgcctgccacaaaagaggactcccggttcctgggaaagatggaccctgcctcctcaggagaggggcgtcctgtgtctggccacacggatactacggcttcagcaaagacagatctcacatctttgaaaaatgtggatcccatgtcttcaggcaaggtggatccagtttctctgggaaagatggaccccatgtgctcaggaaagccagagctcttgtctcctggacaggcagagcgtgtgtctgtgggaaaggcaggaactgtatccccaggaaaagaggacccggtgtcctccagaagggaggaccccatatctgctggaagtagaaagacatcatctgaaaaagtgaatcctgagtcttcaggaaagacaaaccctgtgtcttcaggtccaggcgatcccaggtccttggggacagcaggtcccccatctgcagtaaaggctgagccagcgacggggggaaaaggagatcccctgtcctcggagaaggcaggtctggtggcctctggaaaggcggctcccacagcctcagggaaggccgagcccctcgcggtgggcaaggaggaccctgtgagcaagggaaaggcagacgctggcccctctggacaaggggactctgtgtctataggtaaagtggtctcaactccaggaaaaacagtcccggtgccctcggggaaggtggatcccgtgtccctgggaaaagcagaagctatcccagagggaaaagtgggttctctgcctctagagaaggggagtcctgttaccaccacaaaggcggatcccagggcctcggggaaagcacagccgcagtctggtggcaaagcagaaacaaagctccctgggcaagagggcgctgcagcaccaggagaagcaggggctgtgtgtttgaaaaaggagacaccacaggcctcagagaaggtggatcctggatcctgcagaaaagcagagccccttgcctcagggaagggagagcctgtgtccctggggaaagccgactctgcaccttccagaaaaacggagtccccatccttggggaaggtggtccccctgagtctggagaagaccaagccgtcctcctcctccaggcagttagaccgcaaagccctcggctcagcccggtctcccgagggtgccaggggcagtgaaggccgcgtggagccgaaggccgagcccgtgtccagcaccgaggcctccagtctcggccagaaagacctggaagccgctggggccgagagaagcccctgcccagaggccgcagcgcccccgccggggccgcggactcgcgacaacttcaccaaggcgccgtcgtgggaggcgagcgccccgccgccgccgcgcgaggacgcgggcactcaggcgggcgcgcaggcctgcgtctcagtggccgtgagccccatgtctccgcaggacggcgctgggggctcggccttcagcttccaggcggcgccgcgcgcgcccagcccgccctcgcgccgagatgcgggcctgcaggtgtcgctgggcgccgccgagacgcgctccgtggccactgggcccatgacacctcaagccgccgcgccgcccgccttccccgaagtgcgcgggtttgcgggcccgggttcaacggcttgggcgggccggttgtaagggcccccgggaagccgggttggaagcccgtgtcgcggaacaagttggaagctggcgacacggagcaggggctatgagttgggggcaccggggcaaataccgggggcgcgccgggccccagctgcagacctgggtggacaacggggcctgcctagggcagcactctgggggccccaattccacgagagagcggcactcttctgtggaacaacgggcggcacccgaagcaattccagagggcagcacacacgacggcggggacacgagagcacacaaagggggggaggtacacccaccagaggaaagactcaaggcgctgcgcccggcggcaccccagccccagatgaggaagccaggagggacccccaaggacagccgagcatcacaggaagacaatagagaagaagcgcggccacggcaggagaggcccccaccacagcaaaagtgacgggcgccgcgggccccaaag

SEQ ID NO: 418382 - DNA, 3526 bp, Homo sapiens
acggagccggcgctggggacggcggcgccgagtctgcgggtcctcccgccagcccggccggaggcagccgaggccgctcgggcggcggcggcggcggcggcgggagccggagcgcatctcgcccaggagccggagcagcggcactgcctgaaccagacagcagccttgggtgcaggcgtggtcatgagggcagatggacactgctgaagacccggcctggctccagctgcttcaaaaggattccagccccccaggaccccgacccacagccttcttctgcccacaggatgggagcctgggggctggcagctcggctatgagggattactgcccctcccagcaaaaggcaagccctgcaccccccaggcacacccctgaccaaagcccaggcatggagtctagacacagaagccccagtggggctggggaaggggcctcctgctctgacggccccagagggagcctggcctgcccctccccaacctgcttctctccccaggagtcaccctccaaggagacattggaggcacatggagcctccatctcagggacaccagaagccaccacgtctgggaagccagagcctgtgtcctccgtgaaaactgagcccaaatcctcagatgacagaaatcccatgttcttagagaagatggatttcaagtcctcaaagcaggccgattccacttccataggaaaggaggatcctgggtcctcacggaaggcagatcccatgtttacaggaaaggcagagcctgaaatcttgggaaagggggatcctgtggctcctggaaggatggatcccatgactgtaagaaaggaagatcttggatccctgggaaaagtagatcctttgtgctccagcaagacgtatacagtgtcaccgaggaaggaggatcctgggtctttgagaaaggtggatcctgtgtcctcagacaaagtggaccctgtattcccaagaaaggaggagcccaggtattcaggaaaagagcatcctgtgtcctcagaaaaggtcgctcctacatctgcagaaaaggtagatcttgtattgtcgggaaagagagatcctgggccctcgggaaaggcagatcccgtgcccttggaaagcatggattctgcgtccacaggaaagacagagccggggctcctgggcaagctgattccaggctcatcaggcaagaatgggcctgtatcctctgggaccggggctcctgggtccttgggaaggctggatcccacatgcttggggatggcagatcccgcatctgtgggaaatgtagaaactgtgcctgccacaaaagaggactcccggttcctgggaaagatggaccctgcctcctcaggagaggggcgtcctgtgtctggccacacggatactacggcttcagcaaagacagatctcacatctttgaaaaatgtggatcccatgtcttcaggcaaggtggatccagtttctctgggaaagatggaccccatgtgctcaggaaagccagagctcttgtctcctggacaggcagagcgtgtgtctgtgggaaaggcaggaactgtatccccaggaaaagaggacccggtgtcctccagaagggaggaccccatatctgctggaagtagaaagacatcatctgaaaaagtgaatcctgagtcttcaggaaagacaaaccctgtgtcttcaggtccaggcgatcccaggtccttggggacagcaggtcccccatctgcagtaaaggctgagccagcgacggggggaaaaggagatcccctgtcctcggagaaggcaggtctggtggcctctggaaaggcggctcccacagcctcagggaaggccgagcccctcgcggtgggcaaggaggaccctgtgagcaagggaaaggcagacgctggcccctctggacaaggggactctgtgtctataggtaaagtggtctcaactccaggaaaaacagtcccggtgccctcggggaaggtggatcccgtgtccctgggaaaagcagaagctatcccagagggaaaagtgggttctctgcctctagagaaggggagtcctgttaccaccacaaaggcggatcccagggcctcggggaaagcacagccgcagtctggtggcaaagcagaaacaaagctccctgggcaagagggcgctgcagcaccaggagaagcaggggctgtgtgtttgaaaaaggagacaccacaggcctcagagaaggtggatcctggatcctgcagaaaagcagagccccttgcctcagggaagggagagcctgtgtccctggggaaagccgactctgcaccttccagaaaaacggagtccccatccttggggaaggtggtccccctgagtctggagaagaccaagccgtcctcctcctccaggcagttagaccgcaaagccctcggctcagcccggtctcccgagggtgccaggggcagtgaaggccgccaagcgtccgcccggcctgttccgcgcgctgctgcagagtgtgcgccggccgcggtgctgctcgcgggcgggacccacggccgagtgatctgcccccattttgtacgcccgagtttccgaccttctcaggctcccttcttgatcacaggcccctagaaggggtcccctctgcgtgccacaggcctccgaggggttgtgcagcctctagggctgttgcgtccccgtctttccagcccctcccatcacaaatacagaagaaccccttctaccaagctccctcgtggccacgaggccacgaacccggccagccctgacgccccactgtcccctcacagccctcagctctactcccggtcacactgggcgaccacgggggcctgctcagcaccctcacctcccaccccctgagagctggggcaggctcctgagatgtctagactggtgcgttgtggtctccggtggggccagatccccagaacagggagagactgcatacaagtctgagtggcagaagcttcaagtgggtgaggatcggtgtgtgagacccgcgagtgggcacgtctctgaatgtgaggtctcgggcagcacgtgaggtagaacgagtgtgagcgtctccacgcagtggctggccccgtggccggggcgtctcttgcatgctgttggtggtccttccccagttcctatctcccacccgcctggttccagccccatcccctctcccactgagtcacaggtttgagattcccagagaggccaaagacagctacaggaagtaccctgggggctcagctgagagagagtcacagaaaggccagagggtctcaggaaggtctggaggtcacagctgggctcacagaagctcttgggccctggcatcctgggtgaccggtgttcttgggtattggggacaggacagagagctcattctataaccacagttgtcttttaaaggccaccctctccagccccttgtcccccctgtgctgtgagcccaagtcccttgtgaccactcagtgtcccgtccccacccctccagccgcagtttttggctacaaactgtcacagtatacattggtaataaaatatttcccc

SEQ ID NO: 418383 - DNA, 4201 bp, Homo sapiens
acggagccggcgctggggacggcggcgccgagtctgcgggtcctcccgccagcccggccggaggcagccgaggccgctcgggcggcggcggcggcggcggcgggagccggagcgcatctcgcccaggagccggagcagcggcactgcctgaaccagacagcagccttgggtgcaggcgtggtcatgagggcagatggacactgctgaagacccggcctggctccagctgcttcaaaaggattccagccccccaggaccccgacccacagccttcttctgcccacaggatgggagcctgggggctggcagctcggctatgagggattactgcccctcccagcaaaaggcaagccctgcaccccccaggcacacccctgaccaaagcccaggcatggagtctagacacagaagccccagtggggctggggaaggggcctcctgctctgacggccccagagggagcctggcctgcccctccccaacctgcttctctccccaggagtcaccctccaaggagacattggaggcacatggagcctccatctcagggacaccagaagccaccacgtctgggaagccagagcctgtgtcctccgtgaaaactgagcccaaatcctcagatgacagaaatcccatgttcttagagaagatggatttcaagtcctcaaagcaggccgattccacttccataggaaaggaggatcctgggtcctcacggaaggcagatcccatgtttacaggaaaggcagagcctgaaatcttgggaaagggggatcctgtggctcctggaaggatggatcccatgactgtaagaaaggaagatcttggatccctgggaaaagtagatcctttgtgctccagcaagacgtatacagtgtcaccgaagaaaggtggatcctgtgtcctcagacaaagtggaccctgtattcccaagaaaggaggagcccaggtattcaggaaaagagcatcctgtgtcctcagaaaaggtcgctcctacatctgcagaaaaggtagatcttgtattgtcgggaaagagagatcctgggccctcgggaaaggcagatcccgtgcccttggaaagcatggattctgcgtccacaggaaagacagagccggggctcctgggcaagctgattccaggctcatcaggcaagaatgggcctgtatcctctgggaccggggctcctgggtccttgggaaggctggatcccacatgcttggggatggcagatcccgcatctgtgggaaatgtagaaactgtgcctgccacaaaagaggactcccggttcctgggaaagatggaccctgcctcctcaggagaggggcgtcctgtgtctggccacacggatactacggcttcagcaaagacagatctcacatctttgaaaaatgtggatcccatgtcttcaggcaaggtggatccagtttctctgggaaagatggaccccatgtgctcaggaaagccagagctcttgtctcctggacaggcagagcgtgtgtctgtgggaaaggcaggaactgtatccccaggaaaagaggacccggtgtcctccagaagggaggaccccatatctgctggaagtagaaagacatcatctgaaaaagtgaatcctgagtcttcaggaaagacaaaccctgtgtcttcaggtccaggcgatcccaggtccttggggacagcaggtcccccatctgcagtaaaggctgagccagcgacggggggaaaaggagatcccctgtcctcggagaaggcaggtctggtggcctctggaaaggcggctcccacagcctcagggaaggccgagcccctcgcggtgggcaaggaggaccctgtgagcaagggaaaggcagacgctggcccctctggacaaggggactctgtgtctataggtaaagtggtctcaactccaggaaaaacagtcccggtgccctcggggaaggtggatcccgtgtccctgggaaaagcagaagctatcccagagggaaaagtgggttctctgcctctagagaaggggagtcctgttaccaccacaaaggcggatcccagggcctcggggaaagcacagccgcagtctggtggcaaagcagaaacaaagctccctgggcaagagggcgctgcagcaccaggagaagcaggggctgtgtgtttgaaaaaggagacaccacaggcctcagagaaggtggatcctggatcctgcagaaaagcagagccccttgcctcagggaagggagagcctgtgtccctggggaaagccgactctgcaccttccagaaaaacggagtccccatccttggggaaggtggtccccctgagtctggagaagaccaagccgtcctcctcctccaggcagttagaccgcaaagccctcggctcagcccggtctcccgagggtgccaggggcagtgaaggccgcgtggagccgaaggccgagcccgtgtccagcaccgaggcctccagtctcggccagaaagacctggaagccgctggggccgagagaagcccctgcccagaggccgcagcgcccccgccggggccgcggactcgcgacaacttcaccaaggcgccgtcgtgggaggcgagcgccccgccgccgccgcgcgaggacgcgggcactcaggcgggcgcgcaggcctgcgtctcagtggccgtgagccccatgtctccgcaggacggcgctgggggctcggccttcagcttccaggcggcgccgcgcgcgcccagcccgccctcgcgccgagatgcgggcctgcaggtgtcgctgggcgccgccgagacgcgctccgtggccactgggcccatgacacctcaagccgccgcgccgcccgccttccccgaagtgcgggtgcggcccggctcagcgctggcggccgctgtagcgcccccggagccggctgagcccgtgcgagacgtgagctgggacgagaagggcatgacgtgggaggtatacggcgccgccatggaggtggaggtgctgggcatggccatccagaagcatctggagcgacagatcgaggagcacggccgccaaggggcgcccgcgccgccgcccgccgcccgtgccggccccggccgttcgggctcggtgcgcaccgcgcccccagatggcgccgccaagcgtccgcccggcctgttccgcgcgctgctgcagagtgtgcgccggccgcggtgctgctcgcgggcgggacccacggccgagtgatctgcccccattttgtacgcccgagtttccgaccttctcaggctcccttcttgatcacaggcccctagaaggggtcccctctgcgtgccacaggcctccgaggggttgtgcagcctctagggctgttgcgtccccgtctttccagcccctcccatcacaaatacagaagaaccccttctaccaagctccctcgtggccacgaggccacgaacccggccagccctgacgccccactgtcccctcacagccctcagctctactcccggtcacactgggcgaccacgggggcctgctcagcaccctcacctcccaccccctgagagctggggcaggctcctgagatgtctagactggtgcgttgtggtctccggtggggccagatccccagaacagggagagactgcatacaagtctgagtggcagaagcttcaagtgggtgaggatcggtgtgtgagacccgcgagtgggcacgtctctgaatgtgaggtctcgggcagcacgtgaggtagaacgagtgtgagcgtctccacgcagtggctggccccgtggccggggcgtctcttgcatgctgttggtggtccttccccagttcctatctcccacccgcctggttccagccccatcccctctcccactgagtcacaggtttgagattcccagagaggccaaagacagctacaggaagtaccctgggggctcagctgagagagagtcacagaaaggccagagggtctcaggaaggtctggaggtcacagctgggctcacagaagctcttgggccctggcatcctgggtgaccggtgttcttgggtattggggacaggacagagagctcattctataaccacagttgtcttttaaaggccaccctctccagccccttgtcccccctgtgctgtgagcccaagtcccttgtgaccactcagtgtcccgtccccacccctccagccgcagtttttggctacaaactgtcacagtatacattggtaataaaatatttcccc

SEQ ID NO: 418384 - DNA, 4373 bp, Homo sapiens
acggagccggcgctggggacggcggcgccgagtctgcgggtcctcccgccagcccggccggaggcagccgaggccgctcgggcggcggcggcggcggcggcgggagccggagcgcatctcgcccaggagccggagcagcggcactgcctgaaccagacagcagccttgggtgcaggcgtggtcatgagggcagatggacactgctgaagacccggcctggctccagctgcttcaaaaggattccagccccccaggaccccgacccacagccttcttctgcccacaggatgggagcctgggggctggcagctcggctatgagggattactgcccctcccagcaaaaggcaagccctgcaccccccaggcacacccctgaccaaagcccaggcatggagtctagacacagaagccccagtggggctggggaaggggcctcctgctctgacggccccagagggagcctggcctgcccctccccaacctgcttctctccccaggagtcaccctccaaggagacattggaggcacatggagcctccatctcagggacaccagaagccaccacgtctgggaagccagagcctgtgtcctccgtgaaaactgagcccaaatcctcagatgacagaaatcccatgttcttagagaagatggatttcaagtcctcaaagcaggccgattccacttccataggaaaggaggatcctgggtcctcacggaaggcagatcccatgtttacaggaaaggcagagcctgaaatcttgggaaagggggatcctgtggctcctggaaggatggatcccatgactgtaagaaaggaagatcttggatccctgggaaaagtagatcctttgtgctccagcaagacgtatacagtgtcaccgaagaaaggtggatcctgtgtcctcagacaaagtggaccctgtattcccaagaaaggaggagcccaggtattcaggaaaagagcatcctgtgtcctcagaaaaggtcgctcctacatctgcagaaaaggtagatcttgtattgtcgggaaagagagatcctgggccctcgggaaaggcagatcccgtgcccttggaaagcatggattctgcgtccacaggaaagacagagccggggctcctgggcaagctgattccaggctcatcaggcaagaatgggcctgtatcctctgggaccggggctcctgggtccttgggaaggctggatcccacatgcttggggatggcagatcccgcatctgtgggaaatgtagaaactgtgcctgccacaaaagaggactcccggttcctgggaaagatggaccctgcctcctcaggagaggggcgtcctgtgtctggccacacggatactacggcttcagcaaagacagatctcacatctttgaaaaatgtggatcccatgtcttcaggcaaggtggatccagtttctctgggaaagatggaccccatgtgctcaggaaagccagagctcttgtctcctggacaggcagagcgtgtgtctgtgggaaaggcaggaactgtatccccaggaaaagaggacccggtgtcctccagaagggaggaccccatatctgctggaagtagaaagacatcatctgaaaaagtgaatcctgagtcttcaggaaagacaaaccctgtgtcttcaggtccaggcgatcccaggtccttggggacagcaggtcccccatctgcagtaaaggctgagccagcgacggggggaaaaggagatcccctgtcctcggagaaggcaggtctggtggcctctggaaaggcggctcccacagcctcagggaaggccgagcccctcgcggtgggcaaggaggaccctgtgagcaagggaaaggcagacgctggcccctctggacaaggggactctgtgtctataggtaaagtggtctcaactccaggaaaaacagtcccggtgccctcggggaaggtggatcccgtgtccctgggaaaagcagaagctatcccagagggaaaagtgggttctctgcctctagagaaggggagtcctgttaccaccacaaaggcggatcccagggcctcggggaaagcacagccgcagtctggtggcaaagcagaaacaaagctccctgggcaagagggcgctgcagcaccaggagaagcaggggctgtgtgtttgaaaaaggagacaccacaggcctcagagaaggtggatcctggatcctgcagaaaagcagagccccttgcctcagggaagggagagcctgtgtccctggggaaagccgactctgcaccttccagaaaaacggagtccccatccttggggaaggtggtccccctgagtctggagaagaccaagccgtcctcctcctccaggcagttagaccgcaaagccctcggctcagcccggtctcccgagggtgccaggggcagtgaaggccgcgtggagccgaaggccgagcccgtgtccagcaccgaggcctccagtctcggccagaaagacctggaagccgctggggccgagagaagcccctgcccagaggccgcagcgcccccgccggggccgcggactcgcgacaacttcaccaaggcgccgtcgtgggaggcgagcgccccgccgccgccgcgcgaggacgcgggcactcaggcgggcgcgcaggcctgcgtctcagtggccgtgagccccatgtctccgcaggacggcgctgggggctcggccttcagcttccaggcggcgccgcgcgcgcccagcccgccctcgcgccgagatgcgggcctgcaggtgtcgctgggcgccgccgagacgcgctccgtggccactgggcccatgacacctcaagccgccgcgccgcccgccttccccgaagtgcgggtgcggcccggctcagcgctggcggccgctgtagcgcccccggagccggctgagcccgtgcgagacgtgagctgggacgagaagggcatgacgtgggaggtatacggcgccgccatggaggtggaggtgctgggcatggccatccagaagcatctggagcgacagatcgaggagcacggccgccaaggggcgcccgcgccgccgcccgccgcccgtgccggccccggccgttcgggctcggtgcgcaccgcgcccccagatggcgccgccaagcgtccgcccggcctgttccgcgcgctgctgcagagtgtgcgccggccgcggtgctgctcgcgggcgggacccacggccgagtgatctgcccccattttgtacgcccgagtttccgaccttctcaggctcccttcttgatcacaggcccctagaaggggtcccctctgcgtgccacaggcctccgaggggttgtgcagcctctagggctgttgcgtccccgtctttccagcccctcccatcacaaatacagaagaaccccttctaccaagctccctcgtggccacgaggccacgaacccggccagccctgacgccccactgtcccctcacagccctcagctctactcccggtcacactgggcgaccacgggggcctgctcagcaccctcacctcccaccccctgagagctggggcaggctcctgagatgtctagactggtgcgttgtggtctccggtggggccagatccccagaacagggagagactgcatacaagtctgagtggcagaagcttcaagtgggtgaggatcggtgtgtgagacccgcgagtgggcacgtctctgaatgtgaggtctcgggcagcacgtgaggtagaacgagtgtgagcgtctccacgcagtggctggccccgtggccggggcgtctcttgcatgctgttggtggtccttccccagttcctatctcccacccgcctggttccagccccatcccctctcccactgagtcacaggtttgagattcccagagaggccaaagacagctacaggaagtaccctgggggctcagctgagagagagtcacagaaaggccagagggtctcaggaaggtctggaggtcacagctgggctcacagaagctcttgggccctggcatcctgggtgaccggtgttcttgggtattggggacaggacagagagctcattctataaccacagttgtcttttaaaggccaccctctccagccccttgtcccccctgtgctgtgagcccaagtcccttgtgaccactcagtgtcccgtccccacccctccagccgcagtttttggctacaaactgtcacagtatacattggtaataaaatatttccccaacccctgtctgccgtgattggccaaaagcaggaggcagggcagcgtcatatattttcatctccagggagacaggtgcagttagggtgtggtagggcctcttcaaggggtccagaagagtggggccccctgtcacaggtccgtggtgtccaggccagcgttggtgtaggatg

SEQ ID NO: 418385 - DNA, 2998 bp, Homo sapiens
  misc_feature (839)..(839): n is a, c, g, or t
  misc_feature (903)..(903): n is a, c, g, or t
  misc_feature (1588)..(1588): n is a, c, g, or t
  misc_feature (1843)..(1843): n is a, c, g, or t
  misc_feature (1936)..(1936): n is a, c, g, or t
  misc_feature (2188)..(2188): n is a, c, g, or t
  misc_feature (2348)..(2348): n is a, c, g, or t
  misc_feature (2719)..(2719): n is a, c, g, or t
  misc_feature (2831)..(2831): n is a, c, g, or t
atcagaaggcctgggcagacttggccagccacctggagcactgtgcccttaaactcagggcattcactggtgacccacactgacactgctttttggaggacaaggcagagttgaccatcccagtcttgcctggaggtcataggaccgttgtcactgcagcctcaggtctgatgcataatcccatgaccctccagatctgagccatgacccactctgggccctgccggcggggaggcggtgggcccatgggggctgcctcactggcctccctcgtcctctattccgggttggggttggctctcagcacactggggaaaagggtggggtcgatgacttgtccctggctccctccccttgccccatgcctgccataaccgcagcttcagagaaaggtgccacactcgcttggctgacaatgtcggggagtcccctgggctccacaccagggcgtgtgcccttggaaaaccacggtgactgaatcatgtccctttcagccaaaactggaagacagcccagctccctgccttcaggtgaccagatctctaagtcacattactggccccagggtcaagtccaggctccccagctggggtacctcccaggctgagtacaggccttgctccctccttcctccctgcacgtgctctgagcctccagcccgacgcctgggatgccggtgccccttgggccccagaccctactactcttgagtgacaggcctcttcctaggggtttctgtgcatccgtcacatcacccacgttagagtcccttcctgtgaggacagaagggccctgaagacagagccggcccctggtgagctctgctttcccgcactganccctcctgggctgcagctccccacctggcagctgccgccccccatggccctggtcgaggtcacntgtcgttcccgtccccaccactcaccaagcgctcccaggttctccgtctggaagaccctctgcagcggggggatgtaaatgaccgccagctgccccaggatggaccccaggacggagtagaggaacatgtggttcctgagaaagccgatctcaaatatcagcttggtctgcagggagaaggtcacacgggggattgtgtgctgtccacaccccaggtacaggcaggggagctctgactgcccacgctgagccagagccgctcaatgctgcgggcagggtcggggcgctgctgtcgagaacacacagcagctctgcagcgaggagggtcagcccgggtctcacctgagagcggcaggtcaaggcgttgaagagatcgaaaaacacaaaacaagtgaacgtcatcgtcgtggtgcggggagtgcttgctctgtcttcaggcatctggaaggtgagcacaaagatgtgagctgtggcaggagggcagggactgcagtccccagcgtctgcaccgcaccagggcttggagaacaggccggggtgaccctcgctcacctccttccagaagataaagagggtcccgctgatgatgatggccgcggacatgaggatcttcaggatgagggctctgctgaggatggtgtcccgcacactccgtggtggctgcctgaaggcgtctttgtcaacnggctctacccccaagctgctccgaacaagacacagacactttgaaatgaaccaggaatgaaataaaggacccttgaaacagctgtgcctgagcctcccaggccaagttggcacagggggcagggccaggcatttgctgaacgcccccaggcatcgcacctgccctcctcggcaccttccagaagccccagagcctgggtccatgggcagctgtgcccctccatctgtcccgcagacagtgaaggaagaccacccngtaaggccaaccacacacagttccatacacccagatgatctccatcaccccgaggggaccccccccaacgttgcgcctggagaaacaggctcnaggctccgccctccgcagagcccctcatcagctgagagagaccagcctccagccaactccacacagcagggttgaggctagacccgcagcaggcggtatggtgggagtggccgggtgaggccctgccgctcagacacagctgaggccagcttcctggtcccacttctgctcccagggagggctggcaggagaggtaaccctcacacttggctttggggacacaaatgaggactctctttcccttggcagctntcactggtgataacagcagcactgagctccagcggaagcactggctctgtgctcatacggttacgcacacgtggccagatgggtcccctgactccaaagcgcattccttcccccacaccacttggccagcttgttgaaggggatattaagtggcggagcnggtggactcctgagcacctactgagtggcaagccctttatctctagacatcagggatgaaacacaaactccgcctccatgaaactgatgttctaaaggggagacagatcacaatcagatccataaggaaaagtgtgtctgtgtgtatcttcctctctagggaaaaatacagcagggtgaggggattgagtgggagtgcaatcagggaagacttcctgaaggcagtgactggtgactggaatgaagcatgagaatgagccatgcaggttgcccagagagagcatccaggcagagggagcagaaagttccatcctcacccagctctgccggcccaggtactttctcctctgccttctactcccagtctcactncagtgcaacacacttcagttttctgggaactcctgatggaaagtggctgtatttgttcatccctatagccttggggcacagccagcagcccctggaggaagccccgcaggtnggtaaagagacacagggctcccagccggccctgcctcacctctgcgccggtggcccatccatgatgatgttgatccataggatctgcatggcgttgagggggctgggcaggttgaacacggtggacagagtgatgagactcagggcggagatgctcctgcggggcac

SEQ ID NO: 418386 - DNA, 2195 bp, Homo sapiens
ggcattctgaagcaagtcttaacagagctaaaaatcacccttacccaattctctgcactgacatatgtacacaaagtaatattttattattctccttcataaatggtttctttaattgaacctttgagccttatactatttttaaatttccctttaaaaattgaattacagccaggcatggtggctcatgcctgtaatcccagaactttgggaggccatggcaggaggattgcttgaacccaggagttgtagaccagcctgggcaagatagcgagatcctgcctctgaaaaaatcataataatactttaatttagaaaataccctgaattagaagtgcttcattcctcatttgtgtacagctgttcctctatatacgaaggggattggtaccagaaccactgcataccaaattccacccatactcaagtctcacagtcttccctgcagaatccaagtatacaaaaagtaggcctatcatttatatgggttttgcatcctgacagtactgtattttcaatcctagtttgtttgggaaaaaaaaattgtttgtatgcctgggtacagtatcatacctgtggtcccagcactttggaaggctgaggcgggaggactgttttgtggccaggagttcaagatcagcctggtcgacgtggtgagaccccatctctacaaaagaaaaattagctgggcatgtggcacctgcctgtggtcccagctactcgggaggctgtgaggcaggagaattgcttgagcctgggaggttgaggctgcagtgagccgcgatcacaccactgcatgccagcctgggcgacagagtgagaccctgtctcagaaaagaaaaaaaaagtaaaaaatggcatgtaagtgacccgcactattcaaatttgtggtgttcaaggttcaactgtaatttcctagcagcatttggtgtgtttgagaatctcttgacactcttcaagtaaatccctaaattacaactttgacatcaaaaaagctagacattcctacatttttgcactacaatacataaaaactcccatgctgatcggttgtgggatcgtgcctgtgaataaccactgcactccagcctgggcaacatagtaagtaagaccttgtctcttaaaaaaaatacattctgaagaaagttctacttatgaatacattttatttataacaaactggtgaaaattttagaccaaaccatgtctttctgggttgtagtgattaaaaaatggttaagagaatgttccctatacaaggcatatgttattaaacatgaaatttaggattagttttctctttgaaaattcttttgatatgctgaggttacagtttggaggttacattagagaaagaatatagggaagatggcagtggtaaaacatttccctgctttacatttttatattggcagtatcttggtttcaacttttctattttcagcaagatatttgcaagtttttactttgaagatgtttggtttatagtagtccatgctatactaatgctgttgctgagataattaagttagatactaatatgaaaaagaatatttgtgtaaaatattttgaagttgtaattagtgtatatacaagttgttaatacttacgaaaaaaggaagcattcccacctgtaataattttgttaacactagactatcagtaaattatcaagaataaaaaccttggtttttctgtaatatttgccactgagcaatttttattaaaaaccaaacagaagtatttacacaagaacaagtgaaattacacaaaatgataatggggagaaatttctcatctggtgataaagggaaaaagataatgtaaaagcagattgctgctatttgcataataagcacttgttgaagaataaatgattaagttcaatatttttgctctattttatacctactcactttggtggaattagttctccatgtaaagtatctttttaatagtaagcaccatttaataatgaaacaactcatatgttttgtaatccttatggagaattacttcatgtgataattatagtctcttcatggaaaacagtaaaaatactcacgtttatgatgatgggcctaggtactaaattcctcattcaatctttttttaccaaatggtacttaataaaatcttttaccttataaaaatctattttcggccaggcgcggtggctcacgcctgtaatccca

SEQ ID NO: 418387 - DNA, 670 bp, Homo sapiens
gtactcgaggttgaagacggcgccgtgggtgcgggtgctgagggtctcactctgttgaccaggatggagtacagtaatacagtcatggctcactgcagcctcaacctcccaagctcaagcagcaggaagatcttttgagggtagaaggccctgaagaggcgtttcaggaggaatgggttttgcttcctggtccagttgtgctcactggcacacttctgcagcacagcagcttctccagcatctgttcctgctttgattggtggccagaaacactcagcagccagcagtgttccttagcaccctattgggcagttttatagcagaggcttccaggagacccctccccatgaatacgtttcctcagcaacgtaaaagtgccagaaaattctagagggtggatttataggaagttccactggaagattcccaatgacttcttgccatttaatgagccatagccacactctcttcaaaagggtctcaatctgccctggctggaggcgagaggctcctctttgggaactctatcacagcattagagtagcagctgttccttatatctgctattgctatactctttaaagctctctagttcttattagccagtgcttcattattctaataccctgttatagctaataattcctcatatattaaactgtctttattc

SEQ ID NO: 418388 - DNA, 457 bp, Homo sapiens
ttgttcttggcagagtccccctagggtcttcctgcagagtcccttgaggtaccagaatgatggctgctcaatttcagtttcagtttcctgtgggatgatcacttgatttcacaatacctgaaccaggacttatgcactgacaaaaagaatcaagggccagacacagtggctcacgcctgtaatctcagtgctttgggaggccaaggtaggaggatctttttttttttttttcagggtctcactctgttgaccaggatggagtacagtaatacagtcatggctcactgcagcctcaacctcccaagctcaagcagcaggaagatcttttgagggtaaggagtttgagaccagcctgggcaacatcatgaaactctgtctctctatgaaaaataacaaaatcattccggtgtggtgatgcatgcttgtagtcctagctgctcggaaggctgagccagga

SEQ ID NO: 418389 - DNA, 804 bp, Homo sapiens
gagctgcaatcagagggtgtctgccatagctgggctcaggcatctgtccttggctttgttgcctggctccagggagattccgggggccctgtgctgtgcctcgagcctgacggacactgggttcaggctggcatcatcagctttgcatcaagctgtgcccaggaggacgctcctgtgctgctgaccaacacagctgctcacagttcctggctgcaggctcgagttcagggggcagctttcctggcccagagcccagagaccccggagatgagtgatgaggacagctgtgtagcctgtggatccttgaggacagcaggtccccaggcaggagcaccctccccatggccctgggaggccaggctgatgcaccagggacagctggcctgtggcggagccctggtgtcagaggaggcggtgctaactgctgcccactgcttcattgggcgccaggccccagaggaatggagcgtagggctggggaccagaccggaggagtggggcctgaagcagctcatcctgcatggagcctacacccaccctgaggggggctacgacatggccctcctgctgctggcccagcctgtgacactgggagccagcctgcggcccctctgcctgccctatcctgaccaccacctgcctgatggggagcgtggctgggttctgggacgggcccgcccaggagcaggcatcagctccctccagacagtgcccgtgaccctcctggggcctagggcctgcagccggctgcatgcagctcctgggggtgatggcagccctattctgccggggatggtgtgtacc

SEQ ID NO: 418390 - DNA, 706 bp, Homo sapiens
gcaccctccccatggccctgggaggccaggctgatgcaccagggacagctggcctgtggcggagccctggtgtcagaggaggcggtgctaactgctgcccactgcttcattgggtgagtcttggatccctctctgctgtgccccctgcccctgccggcagccctgtcacctggtgccgtccacactgcctctgcacaggcgccaggccccagaggaatggagcgtagggctggggaccagaccggaggagtggggcctgaagcagctcatcctgcatggagcctacacccaccctgaggggggctacgacatggccctcctgctgctggcccagcctgtgacactgggagccagcctgcggcccctctgcctgccctatcctgaccaccacctgcctgatggggagcgtggctgggttctgggacgggcccgcccaggagcaggtaggtgggcacagggccagggctgctgtccatccaacctgcaggccggggcagccagctttcccttgctccacaggcatcagctccctccagacagtgcccgtgaccctcctggggcctagggcctgcagccggctgcatgcagctcctgggggtgatggcagccctattctgccggggatggtgtgtaccagtgctgtgggtgagctgcccagctgtgaggtgagccccaggcccccacaccttacctaacaggcccctgg

SEQ ID NO: 418391 - DNA, 1965 bp, Homo sapiens
tttttttttaatgtgagaagcagaatgtgcttctagaaactggttttaaagagatgagctgagaaagaaatgtggaatggagtatatttgaggaggacaaaacataacttcacttttgaacagaaatcactctagcttgccagcatgggatgtaaaccaagagagtagaaatatacccatcttattttaagttgggtttatggcatcgctcatatatgtaaaagcactacaaactctttaaagaaaattgggaaactacagagaagtcaaagaaaaaaaaaagtaacccatatttctattgcccaggtataatccttgttaatattttggtttggtctcctcttttttcccccaatatagttgtaaataaatgatgtctttcagagttgacatttatcctgtagcttgaatggcatgtaaatgccagttgtatattttttcatgaagtgtaggtttggaatacactagagttagctatatgcttgaatgctgatcactggattctgagactgactactgagtctacctttttaatcaagcctaacatgaatgggctccaaaaagtaatgaatgtaattgtactttttgatgtgcctctgcacttggcttggtgagtcatcataaatagctgttaaatatgtgactttacagattttgatatgttcagattgtaaaaaatgaatagtttatttcattaattgatgggcagtcaagaatctccctcccttcagtagggctgacacttaggagttaggtcatggttgtggttacttggcatggctaatcagattttgttctggtcagaatttgcccaagatcaatacccagcagaaactggagttaggctataaaaaaccattcatgtttccgagtgatcatttcagtcagcgattcatgttttacagtgtttagttgttgattattagaaaaagtaatattttcttccctttatgattacatcattataaatcaagtccttccatgaacacatttaaggtgtgtggagatgagatctctgaatccatttggggatgggctgcatttttggggaactctatgcctgtccagtgaagagtgcctaaaacattaattatagatcaaagatgttctgttgagggacaaagcttgatggtcatcaaacacaaggctttgtaaaaatacgaccacctattccacttactggatctgtcaggtgtgtaaaacttctctcgccagttcatcatgcttccatgagccctcaggactgggatttgagccttcctggctctttatcccttggggcagacatggaaccatctctgagggaccaggtggatgctgaagctcacccagtcagggcccctctcctagctccttttacactgaaattaatctgaaagctttcatagccaaggctttgcctaggtgctattattccagctggccaaagagaagtcttgggccagattgggattctcaatggattttatagacataattcccctgcaaacttaaaaaaataaataacccctactttataggactaattgtttgaattgtatctttctctgtatgttaaaccagatttaaaactattttataaccacaatatgtaatcagagcaatatagtgttttcagatatataccttgttttataccttatgtaggtgtcctacataagggtggcatgcccactggctgtggtaaaatttaatcctcattgctttgggagtgacttaaggccttttgaagtggagcttttgcactttatactttttctgtgaactatgataactatatttgatattaaagctgtaagtggcattttcagcaaatgaatatgtacatgtttgtgtctatttccaaaatgatttctgaactatctgcagtgaaaatgtatctgatggattgtagagcaaagcacattgcctaaattcatttgttaatgaattgggtaccattgttattaaaaatgcgtaaagtaa

SEQ ID NO: 418392 - DNA, 2437 bp, Homo sapiens
tttttttttaatgtgagaagcagaatgtgcttctagaaactggttttaaagagatgagctgagaaagaaatgtggaatggagtatatttgaggaggacaaaacataacttcacttttgaacagaaatcactctagcttgccagcatgggatgtaaaccaagagagtagaaatatacccatcttattttaagttgggtttatggcatcgctcatatatgtaaaagcactacaaactctttaaagaaaattgggaaactacagagaagtcaaagaaaaaaaaaagtaacccatatttctattgcccaggtataatccttgttaatattttggtttggtctcctcttttttcccccaatatagttgtaaataaatgatgtctttcagagttgacatttatcctgtagcttgaatggcatgtaaatgccagttgtatattttttcatgaagtgtaggtttggaatacactagagttagctatatgcttgaatgctgatcactggattctgagactgactactgagtctacctttttaatcaagcctaacatgaatgggctccaaaaagtaatgaatgtaattgtactttttgatgtgcctctgcacttggcttggtgagtcatcataaatagctgttaaatatgtgactttacagattttgatatgttcagattgtaaaaaatgaatagtttatttcattaattgatgggcagtcaagaatctccctcccttcagtagggctgacacttaggagttaggtcatggttgtggttacttggcatggctaatcagattttgttctggtcagaatttgcccaagatcaatacccagcagaaactggagttaggctataaaaaaccattcatgtttccgagtgatcatttcagtcagcgattcatgttttacagtgtttagttgttgattattagaaaaagtaatattttcttccctttatgattacatcattataaatcaagtccttccatgaacacatttaaggtgtgtggagatgagatctctgaatccatttggggatgggctgcatttttggggaactctatgcctgtccagtgaagagtgcctaaaacattaattatagatcaaagatgttctgttgagggacaaagcttgatggtcatcaaacacaaggctttgtaaaaatacgaccacctattccacttactggatctgtcaggtgtgtaaaacttctctcgccagttcatcatgcttccatgagccctcaggactgggatttgagccttcctggctctttatcccttggggcagacatggaaccatctctgagggaccaggtggatgctgaagctcacccagtcagggcccctctcctagctccttttacactgaaattaatctgaaagctttcatagccaaggctttgcctaggtgctattattccagctggccaaagagaagtcttgggccagattgggattctcaatggattttatagacataattcccctgcaaacttaaaaaaataaataacccctactttataggactaattgtttgaattgtatctttctctgtatgttaaaccagatttaaaactattttataaccacaatatgtaatcagagcaatatagtgttttcagatatataccttgttttataccttatgtaggtgtcctacataagggtggcatgcccactggctgtggtaaaatttaatcctcattgctttgggagtgacttaaggccttttgaagtggagcttttgcactttatactttttctgtgaactatgataactatatttgatattaaagctgtaagtggcattttcagcaaatgaatatgtacatgtttgtgtctatttccaaaatgatttctgaactatctgcagtgaaaatgtatctgatggattgtagagcaaagcacattgcctaaattcatttgttaatgaattgggtaccattgttattaaaaatgcgtaaagtaaaaaaaaaaaaaaaaaaaaaaaaaaaaaaaaaaaaaacaaaaaacaaaaaaaaaaaaaaaaaaaaaaaaaaaggggggggggggcaaaaatattccccggggggggggcacaatttggcgcccccggttttttgtaagaaaagggggccccccaatagggggggacgcataacacaaacacgagggagcgggtcgcgcgataataaaacgccgacgtggcaagagggggaaaacaaggaccaaggagcaagagacattggagggaagcaggacccacaacacttaagtgaggggggcacaaaatagggagagagaacaccccaccaaaggagatagtacacagcccacgggggacaaataaacaaaacgagacgaaggaatacaattgtaggaatacaacaaccgagaccaatgtctcagggcgagaaagaatagtggaacaagaggaatatagtgagaagagaaattatcgg

SEQ ID NO: 418393 - DNA, 1911 bp, Homo sapiens
tttttttttaatgtgagaagcagaatgtgcttctagaaactggttttaaagagatgagctgagaaagaaatgtggaatggagtatatttgaggaggacaaaacataacttcacttttgaacagaaatcactctagcttgccagcatgggatgtaaaccaagagagtagaaatatacccatcttattttaagttgggtttatggcatcgctcatatatgtaaaagcactacaaactctttaaagaaaattgggaaactacagagaagtcaaagaaaaaaaaaagtaacccatatttctattgcccaggtataatccttgttaatattttggtttggtctcctcttttttcccccaatatagttgtaaataaatgatgtctttcagagttgacatttatcctgtagcttgaatggcatgtaaatgccagttgtatattttttcatgaagtgtaggtttggaatacactagagttagctatatgcttgaatgctgatcactggattctgagactgactactgagtctacctttttaatcaagcctaacatgaatgggctccaaaaagtaatgaatgtaattgtactttttgatgtgcctctgcacttggcttggtgagtcatcataaatagctgttaaatatgtgactttacagattttgatatgttcagattgtaaaaaatgaatagtttatttcattaattgatgggcagtcaagaatctccctcccttcagtagggctgacacttaggagttaggtcatggttgtggttacttggcatggctaatcagattttgttctggtcagaatttgcccaagatcaatacccagcagaaactggagttaggctataaaaaaccattcatgtttccgagtgatcatttcagtcagcgattcatgttttacagtgtttagttgttgattattagaaaaagtaatattttcttccctttatgattacatcattataaatcaagtccttccatgaacacatttaaggtgtgtggagatgagatctctgaatccatttggggatgggctgcatttttggggaactctatgcctgtccagtgaagagtgcctaaaacattaattatagatcaaagatgttctgttgagggacaaagcttgatggtcatcaaacacaaggctttgtaaaaatacgaccacctattccacttactggatctgtcaggtgtgtaaaacttctctcgccagttcatcatgcttccatgagccctcaggactgggatttgagccttcctggctctttatcccttggggcagacatggaaccatctctgagggaccaggtggatgctgaagctcacccagtcagggcccctctcctagctccttttacactgaaattaatctgaaagctttcatagccaaggctttgcctaggtgctattattccagctggccaaagagaagtcttgggccagattgggattctcaatggattttatagacataattcccctgcaaacttaaaaaaataaataacccctactttataggactaattgtttgaattgtatctttctctgtatgttaaaccagattttataccttgttttataccttatgtaggtgtcctacataagggtggcatgcccactggctgtggtaaaatttaatcctcattgctttgggagtgacttaaggccttttgaagtggagcttttgcactttatactttttctgtgaactatgataactatatttgatattaaagctgtaagtggcattttcagcaaatgaatatgtacatgtttgtgtctatttccaaaatgatttctgaactatctgcagtgaaaatgtatctgatggattgtagagcaaagcacattgcctaaattcatttgttaatgaattgggtaccattgttattaaaaatgcgtaaagtaa

SEQ ID NO: 418394 - DNA, 12710 bp, Homo sapiens
cctcccgcctcagttcgcgccgcgcctcggcttggaacgcaggagcgccggctccgggagcccgagcggagccagccgcgcgcacagccagcggccgcgccggcgatgcggggccaccccgcgcccgccccagtcccggccccggcccccgcgggaaggggctgagctgcccgccgccgcccggatggcgagcctcgccgcgctcgccctcagcctgctcctgaggctgcagctgccgccactgcccggcgcccgggctcagagcgccccaggtggctgttcctttgatgagcactacagcaactgtggttatagtgtggctctagggaccaatgggttcacctgggagcagattaacacaacggagaaaccaatgctggaccaggcagtgcccacaggatctttcatgatggtgaacagctctgggagagcctctggccagaaggcccaccttctcctgccaaccctgaaggagaatgacacccactgcatcgacttccattactacttctccagccgtgacaggtccagcccaggggccttgaacgtctacgtgaaggtgaatggtggcccccaagggaaccctgtgtggaatgtgtccggggtcgtcactgagggctgggtgaaggcagagctcgccatcagcactttctggccacatttctatcaggtgatatttgaatccgtctcattgaagggtcatcctggctacatcgccgtggacgaggtccgggtccttgctcatccatgcagaaaagcacctcattttctgcgactccaaaacgtggaggtgaatgtggggcagaatgccacatttcagtgcattgctggtgggaagtggtctcagcatgacaagctttggctccagcaatggaatggcagggacacggccctgatggtcacccgtgtggtcaaccacaggcgcttctcagccacagtcagtgtggcagacactgcccagcggagcgtcagcaagtaccgctgtgtgatccgctctgatggtgggtctggtgtgtccaactacgcggagctgatcgtgaaagagcctcccacgcccattgctcccccagagctgctggctgtgggggccacatacctgtggatcaagccaaatgccaactccatcatcggggatggccccatcatcctgaaggaagtggaatatcgcaccaccacaggcacgtgggcagagacccacatagtcgactctcccaactataagctgtggcatctggaccccgatgttgagtatgagatccgagtgctcctcacacgaccaggtgaggggggtacgggaccgccaggggctcccctcaccaccaggaccaagtgtgcagatccggtacatggcccacagaacgtggaaatcgtagacatcagagcccggcagctgaccctgcagtgggagcccttcggctacgcggtgacccgctgccatagctacaacctcaccgtgcagtaccagtatgtgttcaaccagcagcagtacgaggccgaggaggtcatccagacctcctcccactacaccctgcgaggcctgcgccccttcatgaccatccggctgcgactcttgctgtctaaccccgagggccgaatggagagcgaggagctggtggtgcagactgaggaagacgttccaggagctgttcctctagaatccatccaaggggggccctttgaggagaagatctacatccagtggaaacctcccaatgagaccaatggggtcatcacgctctacgagatcaactacaaggctgtcggctcgctggacccaagtgctgacctctcgagccagagggggaaagtgttcaagctccggaatgaaacccaccacctctttgtgggtctgtacccagggaccacctattccttcaccatcaaggccagcacagcaaagggctttgggccccctgtcaccactcggattgccaccaaaatttcagctccatccatgcctgagtacgacacagacaccccattgaatgagacagacacgaccatcacagtgatgctgaaacccgctcagtcccggggagctcctgtcagtgtttatcagctggttgtcaaggaggagcgacttcagaagtcacggagggcagctgacattattgagtgcttttcggtgcccgtgagctatcggaatgcctccagcctcgattctctacactactttgctgctgagttgaagcctgccaacctgcctgtcacccagccatttacagtgggtgacaataagacatacaatggctactggaaccctcctctctctcccctgaaaagctacagcatctacttccaggcactcagcaaagccaatggagagaccaaaatcaactgtgttcgtctggctacaaaagcaccaatgggcagcgcccaggtgaccccggggactccactctgcctcctcaccacaggtgcctccacccagaattctaacactgtggagccagagaagcaggtggacaacaccgtgaagatggctggcgtgatcgctggcctcctcatgttcatcatcattctcctgggcgtgatgctcaccatcaaaaggagaagaaatgcttattcctactcctattacttgtcccaaaggaagctggccaagaagcagaaggagacccagagtggagcccagagggagatggggcctgtggcctctgccgacaaacccaccaccaagctcagcgccagccgcaatgatgaaggcttctcttctagttctcaggacgtcaacggattcacagatggcagccgcggggagctttcccagcccaccctcacgatccagactcatccctaccgcacctgtgaccctgtggagatgagctacccccgggaccagttccaactcgccatccgggtggctgacttgctgcagcacatcacgcagatgaagagaggccagggctacgggttcaaggaggaatacgaggccttaccagaggggcagacagcttcgtgggacacagccaaggaggatgaaaaccgcaataagaatcgatatgggaacatcatatcctacgaccattcccgggtgaggctgctggtgctggatggagacccgcactctgactacatcaatgccaactacattgacggataccatcgacctcggcactacattgcgactcaaggtccgatgcaggagactgtaaaggacttttggagaatgatctggcaggagaactccgccagcatcgtcatggtcacaaacctggtggaagtgggcagggtgaaatgtgtgcgatactggccagatgacacggaggtctacggagacattaaagtcaccctgattgaaacagagcccctggcagaatacgtcatacgcaccttcacagtccagaagaaaggctaccatgagatccgggagctccgcctcttccacttcaccagctggcctgaccacggcgttccctgctatgccactggccttctgggcttcgtccgccaggtcaagttcctcaaccccccggaagctgggcccatagtggtccactgcagtgctggggctgggcggactggctgcttcattgccattgacaccatgcttgacatggccgagaatgaaggggtggtggacatcttcaactgcgtgcgtgagctccgggcccaaagggtcaacctggtacagacagaggagcaatatgtgtttgtgcacgatgccatcctggaagcgtgcctctgtggcaacactgccatccctgtgtgtgagttccgttctctctactacaatatcagcaggctggacccccagacaaactccagccaaatcaaagatgaatttcagaccctcaacattgtgacaccccgtgtgcggcccgaggactgcagcattgggctcctgccccggaaccatgataagaatcgaagtatggacgtgctgcctctggaccgctgcctgcccttccttatctcagtggacggagaatccagcaattacatcaacgcagcactgatggatagccacaagcagcctgccgccttcgtggtcacccagcaccctctacccaacaccgtggcagacttctggaggctggtgttcgattacaactgctcctctgtggtgatgctgaatgagatggacactgcccagttctgtatgcagtactggcctgagaagacctccgggtgctatgggcccatccaggtggagttcgtctccgcagacatcgacgaggacatcatccacagaatattccgcatctgtaacatggcccggccacaggatggttatcgtatagtccagcacctccagtacattggctggcctgcctaccgggacacgcccccctccaagcgctctctgctcaaagtggtccgacgactggagaagtggcaggagcagtatgacgggagggagggacgtactgtggtccactgcctaaatgggggaggccgtagtggaaccttctgtgccatctgcagtgtgtgtgagatgatccagcagcaaaacatcattgacgtgttccacatcgtgaaaacactgcgtaacaacaaatccaacatggtggagaccctggaacagtataaatttgtatacgaggtggcactggaatatttaagctccttttagctcaatgggatggggaacctgccggagtccagaggctgctgtgaccaagcccccttttgtgtgaatggcagtaactgggctcaggagctctgaggtggcaccctgcctgactccaaggagaagactggtggccctgtgttccacggggggctctgcaccttctgaggggtctcctgttgccgtgggagatgctgctccaaaaggcccaggcttccttttcaacctaaccagccacagccaagggcccaagcagaagtacacccacaagcaaggccttggatttctggctcccagaccacctgcttttgttctgagtttgtggatctcttggcaagccaactgtgcaggtgctggggagtgggaggctcccctgccctccttctccttaggagtggaggagatgtgtgttctgctcctctacgtcatggaaaagattgaggctcttgggggtcactgctctgctgccccctgcaacctccttcaggggcctctggcaccagacatttgcagtctggaccagtgtgaccttacgatgttccctaggccacaagagaggccccccatcctcacacctaacctgcatggggcttcgcccacaaccattctgtaccccttccccagcctgggccttgaccgtccagcattcactggccggccagctgtgtccacagcagtttttgataaaggtgttctttgcttttttgtgtggtcagtgggagggggtggaactgcagggaacttctctgctcctccttgtctttgtaaaaagggaccacctccctggggcagggcttgggctgacctgtaggatgtaacccctgtgtttctttggtggtagctttctttggaagagacaaacaagataagatttgattattttccaaagtgtatgtgaaaagaaactttcttttggagggtgtaaaatcttagtctcttatgtcaaaaagaagggggcgggggagtttgagtatgtacctctaagacaaatctctcgggccttttattttttcctggcaatgtccttaaaagctcccaccctgggacagcatgccactgagcaaggagagatgggtgagcctgaagatggtccctttggtttctggggcaaatagagcaccagctttgtgcataatttggatgtccaaatttgaactccttcctaaagaaacccagcagccaccttgaaaaaggccattgtggagcccattatactttgatttaaaataggccaagagaatcaggcctggagatctagggtcttgtccaaagtgtgagtgagtcaatgagagggaaccaacatttgctaagtctctactgtatgccagggatcatgcttggcactttccataggacatttcacacagtccttagaacccccaggagagagctactgacttgttatcatctccatttgatcatctcctccaatgaggaaacccacgcaccttccttagtaatgaaatcctgggttccaaaggggcaggtaatggcaatgagacttctccgtgctgttttcttcatcttctctaagccaagcaattattttatggagggaaaataaggccagaaacttctgagcagataactccacaaatggaaatttagtactttcttcctgatgccagttcttctgggaagcgcagaatttcagatatattttagtaacacattcccagctccccaggaaagccagtctcatctaatttcttagtcagtaaaaacaattccctgttccttcaggctatgaatggaccagccagggaaactctcgaccttgatctctagccagtgcttaggcccaatatctgacagcctcaggtgggctgggacctaggaagctccatcttgaaggctggtctagccccagacagggcatgaggggcagagaattcaagaaggtacagctttggccctcaagagcccactgtatgctggggaaatggaaccatggtgcagtagtgtggagtggatgagtgttccatgagcctaggagcaagaaagtctcttcggcctcgggcttcctggagaaggggacgtccattcctgctgggtcttaacaagcataaaaaggaaaaaaaggaaactcaggcaaagggatccatatgtgcaatggcaaagaaatgtgaaaaggcattgggagaagcagtctgggggaggccagcccagtgcgggcacagcacaacacggggagcagcaagagatgagccagggtccaggagacagatgcccatcgcgagtacagactttgtcctattggcaacaaggagtccatggagctttagagagatgcactcagcttcgtgttggccaagactccttctgggccaatggggctgcctcttttcctttcatcagacactgtgaaaacattcccttaagcgtgcactttttaatatcacatctatttgtctgtctgctcattgttttgttgctggaactaaatatgcaatggatcatgagactcagattctatgagaaacccagggtctctgctttaccacggagcagggtcaccaacccagatctccaggcccatgaggatggaacatgaaaggagccgacaaaagttgcttccattggcatgggctctggagctgtccagaagtccagggacaccagacttgatcaaggaagggctgtcactttagaggttcaaaaggaagtgcctcaaagcaaaggcaagcaaaggaaccccacgatgaacttgctcttttcctttgatgagcctctccccaggtgtatttcagcagaccccggggacccacccccactgggcctgctggcctccctcggctccagcccaatgccccagctggccttccccagcctgcaaggagcctgtagcatggcaaatctgcctgctgtatgctattttcttagatcttggtacatccagacaggatgagggtggagggagagctatttaacacaaatcctaagatttttttctgctcaggaaggggtgaaatagctggcagatacaaaagacagtggcttttatcattttaaatggtaggaatttaaggtgtgacttcagggagaaacaaacttgcaaaaaaaaaaaatctcaggccatgttggggtaacccagcaagggccagtgatgatttcccccagctcatccccttattttcccacaacccaaccattctctaaagcaggacagtgaataggtcttaggccagtgcacacaggaagaaattgaggcttatggatggggatgacttccctaagatcccatgggacaaggatgtggcaaggcttggatgagatggggcaccagtgcccaggaatttgaacattttcctttacccaggaaatctccggagccaacaccaccacccccagggggtctccccaccccaccccatttacagggtgagctcagcctgtcatgagcagaggaaaatattattaatgctctctgagtctttacaacaggagctcttacctcatagatgtgggctctgtttggggaagatgcaaggaagtaatgagaagcccaggaaatttctccacctgtgtttatggcctaaatagcttcaggatgtatcttagctgcactccaacattgcatcctttctggggtgaagaatctgggccaaccaggggtccttgggcctctagaaggccacagtaggcctctctttgtgggaatggaaggggacagtttgcttttagtgctggccctctctgtgggtgtggcctgcaaaggaaccaacagaccctatgctggggactctaacatgtgagctcattaaattcttccagcattctaaaggagggtttgtgattgtcaccatttactgatgaggaaactaaggctcctaggggagaaatcacttgcccacagttccacagctagtgagtgaatgaaccaggatttaaaccggttttttctcactacagagacaatatttttccaccattgtatctcacatttttcccaggaggttacccataacagaagagactagagtggaacagatacgtcagtggataaagctcaaagcaaacaacagtaagcttaaaattccttcatagtctcatgttttacgttcacaattcatgcaaaatttgcattccactttctgatttagccttgttggttttaatatgactctatgaatatttcaaaaaaaaatgtgctctgttcctcatgttgttctgttctgttcaccccgctatgacggaccctaggtcagctggtcttcagcttgaccctagaattgactctaggagcagtgaccctgctgcctcccagagccagttataggctcaagatcaagaccaactgaccttctcctaggcagctcctttggtgtgtgggtgctctgacctcactgttcatgaggggacctcaactaaggcatcttccagttgggtgctggaaggaacccattaactcacactagaatgatgaggatttgctcatctggcgtggagaaggatgagcccacaaaaccctaaagggaaaagagaagctggacacagctgtactcagcagattcctgaatgctaggctggaaagtggtgcctgttgtccaagtggagtcacatggttgctaatgtgggcaagtctgaggacacacttcatgagcagctggggtctggaaggctcctcactttaccctagccacacataattactgggtgcctacagcacctagcaccttggagggggcactattaggaaatcgagattactatggcacaattaattcctgggtaaggcatggggttgtggtggacagagctcagtctttagtttgaacgaaaacatacatacatgaaaaacatacatgaaaaaaggaccctcatcaacattagaaggggtagatttggagcactttaggcaggaaaacaggaacgcaaggccaggaaactggaacccagtgaatactcagaaccgaggatgcagatgacttatttagcaaaatggtcacttctgtgacatagctggagaaaggatgggtaacagcttgccagagccacttggaacaagggcaaatctcagtgtctggggcaaaagatgatgcatttccctctgacccatcatgtttattcatcctccactccccattgccacactagctcttgctgtaagtcctcaccaggatctacatttcctcgtcgctggtgggaaccccttagagtacatagaggtatcagtccagtaagactgctctacacaacagaagtgaggcccagggagtagcagccaggcccttatcctgttacctctgcaggagtgactgcccaacccagatccagagacattgaaggaaatgataattccttggtacctcactgccttgggacaaaatgaagaaagccacccttccttaggctgcagcttgccactcctgggctgggtaaacaggtcatcagcaccaggctcaaccaggagtaacattctggaagacatgggtgagcccaagaggaagcatgaacaggacgctgttcctaagtcatgtcaacaggttgtgctgggccaggatccccagggaaaaaaatggtcaacccaactggagggtaggttagaagaaaaaaaacataaacgtggatagtcatgtcatctcaaatccctgacttggcttccccattacttgacagtctgagctccttcttagcctgtgaccagcttcaaatcacagccaagtaaaacaaggaaataggaaaagtaaatccaactagaagagacaagctgagattcagatttgtttactcctcccatgcaaagtttccctgttggaggttttccatgtatacatgtctagaagtgatagaatgcaaggccttggctttgtcttgcagggatctgcctttgaggtcatagactgaacagcagggagagaggttagtggtggagtgtggggggagctgttctagctccagtttcttctgacacatttttcaggatcatggatctgatcctccgaagcacagcagagatatctaagccatatttgtgcacatgagcagactcttctagttttttagtaaccagggatgggcttttgcatggcactgactatagagatgtcttgtagagatcaagccagtcttttgcatcccacctgcccacctccagaagagatgggaaaaggtcatcaaagggcattcaccaactgaaatccactcatgaatgttaggtctctaaaaggaggcatcaacactcacaatggtagcctccaaacctagcatcccacctatctaagagctcaggggtggtccactggggcagatacaagggaagtgcaagggctcaggatgaaagaaaatctattgggaagagttttaggggcttgatcattatggggcttccttctatatctgagaactgctctgggtggtgagatgtggactctgatccttaattggaatgttcggagaatgagtgtctggtggccttgaagtgttggacagaaaagtatcagtataaaagcctggagctcagggtaattaatgtagttcatggttccttagtgagcaggactcttggatgtggaggagaaagggtcataggaagtaaaccaccaaaattacaaaattgagtctctgtacaattacttcagtgcctttgggcttatgaatacaaatcagtgggccttctctatgatggtccaacaaactctcagtgtccaccctgtccctgtatctcccatggaagatgaataatgtcaggtgttctttgggtcaaaggccccagggcagtctggaggcttagagggcagagtggtgtcattccatgtaaagttaggcttctgaggggtcaggcagaatatggtgtccatatcttccatagctctgcagattcttggatgaagtcaagcacagtttgctagacccaggtcactcctctgagtataactaggacccatgagtgaaacttaatagctgtaaggaagaacctgctgtctgccagagaggataagctgcccatctcagcagctgtctaaaagaaggcaggtgtctctttaaagggaagagaagcattggtgaaatggatttcaggtcacttccattccagatgggtgagatcttgtggagctgggatcatgtttgaactcattcatacctgtagagcacgaatccaagtagattgtgtttggtctgtacaggctgaagccccctgctctcccacccaagtgcccccactgagcaggccaacatgctgttgtggccacatatactgggctgatccaggctggttatcaccaaacagcaaaccatagggaacagctgctttgccatagacccaatacccatgtagatctctcatgagagcagccataactcagacccactgaccaacagggccatgagtgacagccagaaccagtgaaggtccaagtaggacacagagcagggcttttcttaccatacacattatctccagaggttatttctaccccactccctattcaaggcctgttggagcacactgcaaaagcaaaagcacagtaactcaatttacacatgattataatcatttccagtgcacacatttcatcaccaggtggatcctgagctagcccatgtaaatccgggttaacccatattggtaatcatactcaaaagcacttttcaccctacattctactagccaatcaaagacaaagagttgtggcctctaccattgccttggcttctggacaccctcacaagctatcccaaggttcccgctcaactccagggaggctgacatcttcacatccactgggcatataatattgcatgagaccaaagtctccacactctttgcagcctcctccatgaatcccaatggcctgcacttgtacagtttgggtgtttgatagataaagcacgtatgagaagagaaaacaaaataaatcaactttttaaaaaagccagcactgtgctgtcaatgttttttttttcttttcaattctagctcagaaaagcagaaggtaaataatgtcaggtcaatgaatatcagatatattttttgactgtacattacagtgaagtgtaatctttttacacctgcaagtccatcttatttattcttgtaaatgttccctgacaatgtttgtaatatggctgtgttaaaaaatctatacaataaagctgtgaccctgagattcatgttttcctaagataaaaaaaa

SEQ ID NO: 418395 - DNA, 8838 bp, Homo sapiens
ctggagcctctggcctcagtccaggcctcatcatcatcagaatatcactgatggatgtgtaatttacgaagcctgtgtcattcctttgtcagagccacaagcagcctgccgccttcgtggtcacccagcaccctctacccaacaccgtggcagacttctggaggctggtgttcgattacaactgctcctctgtggtgatgctgaatgagatggacactgcccagttctgtatgcagtactggcctgagaagacctccgggtgctatgggcccatccaggtggagttcgtctccgcagacatcgacgaggacatcatccacagaatattccgcatctgtaacatggcccggccacaggatggttatcgtatagtccagcacctccagtacattggctggcctgcctaccgggacacgcccccctccaagcgctctctgctcaaagtggtccgacgactggagaagtggcaggagcagtatgacgggagggagggacgtactgtggtccactgcctaaatgggggaggccgtagtggaaccttctgtgccatctgcagtgtgtgtgagatgatccagcagcaaaacatcattgacgtgttccacatcgtgaaaacactgcgtaacaacaaatccaacatggtggagaccctggaacagtataaatttgtatacgaggtggcactggaatatttaagctccttttagctcaatgggatggggaacctgccggagtccagaggctgctgtgaccaagcccccttttgtgtgaatggcagtaactgggctcaggagctctgaggtggcaccctgcctgactccaaggagaagactggtggccctgtgttccacggggggctctgcaccttctgaggggtctcctgttgccgtgggagatgctgctccaaaaggcccaggcttccttttcaacctaaccagccacagccaagggcccaagcagaagtacacccacaagcaaggccttggatttctggctcccagaccacctgcttttgttctgagtttgtggatctcttggcaagccaactgtgcaggtgctggggagtgggaggctcccctgccctccttctccttaggagtggaggagatgtgtgttctgctcctctacgtcatggaaaagattgaggctcttgggggtcactgctctgctgccccctgcaacctccttcaggggcctctggcaccagacatttgcagtctggaccagtgtgaccttacgatgttccctaggccacaagagaggccccccatcctcacacctaacctgcatggggcttcgcccacaaccattctgtaccccttccccagcctgggccttgaccgtccagcattcactggccggccagctgtgtccacagcagtttttgataaaggtgttctttgcttttttgtgtggtcagtgggagggggtggaactgcagggaacttctctgctcctccttgtctttgtaaaaagggaccacctccctggggcagggcttgggctgacctgtaggatgtaacccctgtgtttctttggtggtagctttctttggaagagacaaacaagataagatttgattattttccaaagtgtatgtgaaaagaaactttcttttggagggtgtaaaatcttagtctcttatgtcaaaaagaagggggcgggggagtttgagtatgtacctctaagacaaatctctcgggccttttattttttcctggcaatgtccttaaaagctcccaccctgggacagcatgccactgagcaaggagagatgggtgagcctgaagatggtccctttggtttctggggcaaatagagcaccagctttgtgcataatttggatgtccaaatttgaactccttcctaaagaaacccagcagccaccttgaaaaaggccattgtggagcccattatactttgatttaaaataggccaagagaatcaggcctggagatctagggtcttgtccaaagtgtgagtgagtcaatgagagggaaccaacatttgctaagtctctactgtatgccagggatcatgcttggcactttccataggacatttcacacagtccttagaacccccaggagagagctactgacttgttatcatctccatttgatcatctcctccaatgaggaaacccacgcaccttccttagtaatgaaatcctgggttccaaaggggcaggtaatggcaatgagacttctccgtgctgttttcttcatcttctctaagccaagcaattattttatggagggaaaataaggccagaaacttctgagcagataactccacaaatggaaatttagtactttcttcctgatgccagttcttctgggaagcgcagaatttcagatatattttagtaacacattcccagctccccaggaaagccagtctcatctaatttcttagtcagtaaaaacaattccctgttccttcaggctatgaatggaccagccagggaaactctcgaccttgatctctagccagtgcttaggcccaatatctgacagcctcaggtgggctgggacctaggaagctccatcttgaaggctggtctagccccagacagggcatgaggggcagagaattcaagaaggtacagctttggccctcaagagcccactgtatgctggggaaatggaaccatggtgcagtagtgtggagtggatgagtgttccatgagcctaggagcaagaaagtctcttcggcctcgggcttcctggagaaggggacgtccattcctgctgggtcttaacaagcataaaaaggaaaaaaaggaaactcaggcaaagggatccatatgtgcaatggcaaagaaatgtgaaaaggcattgggagaagcagtctgggggaggccagcccagtgcgggcacagcacaacacggggagcagcaagagatgagccagggtccaggagacagatgcccatcgcgagtacagactttgtcctattggcaacaaggagtccatggagctttagagagatgcactcagcttcgtgttggccaagactccttctgggccaatggggctgcctcttttcctttcatcagacactgtgaaaacattcccttaagcgtgcactttttaatatcacatctatttgtctgtctgctcattgttttgttgctggaactaaatatgcaatggatcatgagactcagattctatgagaaacccagggtctctgctttaccacggagcagggtcaccaacccagatctccaggcccatgaggatggaacatgaaaggagccgacaaaagttgcttccattggcatgggctctggagctgtccagaagtccagggacaccagacttgatcaaggaagggctgtcactttagaggttcaaaaggaagtgcctcaaagcaaaggcaagcaaaggaaccccacgatgaacttgctcttttcctttgatgagcctctccccaggtgtatttcagcagaccccggggacccacccccactgggcctgctggcctccctcggctccagcccaatgccccagctggccttccccagcctgcaaggagcctgtagcatggcaaatctgcctgctgtatgctattttcttagatcttggtacatccagacaggatgagggtggagggagagctatttaacacaaatcctaagatttttttctgctcaggaaggggtgaaatagctggcagatacaaaagacagtggcttttatcattttaaatggtaggaatttaaggtgtgacttcagggagaaacaaacttgcaaaaaaaaaaaatctcaggccatgttggggtaacccagcaagggccagtgatgatttcccccagctcatccccttattttcccacaacccaaccattctctaaagcaggacagtgaataggtcttaggccagtgcacacaggaagaaattgaggcttatggatggggatgacttccctaagatcccatgggacaaggatgtggcaaggcttggatgagatggggcaccagtgcccaggaatttgaacattttcctttacccaggaaatctccggagccaacaccaccacccccagggggtctccccaccccaccccatttacagggtgagctcagcctgtcatgagcagaggaaaatattattaatgctctctgagtctttacaacaggagctcttacctcatagatgtgggctctgtttggggaagatgcaaggaagtaatgagaagcccaggaaatttctccacctgtgtttatggcctaaatagcttcaggatgtatcttagctgcactccaacattgcatcctttctggggtgaagaatctgggccaaccaggggtccttgggcctctagaaggccacagtaggcctctctttgtgggaatggaaggggacagtttgcttttagtgctggccctctctgtgggtgtggcctgcaaaggaaccaacagaccctatgctggggactctaacatgtgagctcattaaattcttccagcattctaaaggagggtttgtgattgtcaccatttactgatgaggaaactaaggctcctaggggagaaatcacttgcccacagttccacagctagtgagtgaatgaaccaggatttaaaccggttttttctcactacagagacaatatttttccaccattgtatctcacatttttcccaggaggttacccataacagaagagactagagtggaacagatacgtcagtggataaagctcaaagcaaacaacagtaagcttaaaattccttcatagtctcatgttttacgttcacaattcatgcaaaatttgcattccactttctgatttagccttgttggttttaatatgactctatgaatatttcaaaaaaaaatgtgctctgttcctcatgttgttctgttctgttcaccccgctatgacggaccctaggtcagctggtcttcagcttgaccctagaattgactctaggagcagtgaccctgctgcctcccagagccagttataggctcaagatcaagaccaactgaccttctcctaggcagctcctttggtgtgtgggtgctctgacctcactgttcatgaggggacctcaactaaggcatcttccagttgggtgctggaaggaacccattaactcacactagaatgatgaggatttgctcatctggcgtggagaaggatgagcccacaaaaccctaaagggaaaagagaagctggacacagctgtactcagcagattcctgaatgctaggctggaaagtggtgcctgttgtccaagtggagtcacatggttgctaatgtgggcaagtctgaggacacacttcatgagcagctggggtctggaaggctcctcactttaccctagccacacataattactgggtgcctacagcacctagcaccttggagggggcactattaggaaatcgagattactatggcacaattaattcctgggtaaggcatggggttgtggtggacagagctcagtctttagtttgaacgaaaacatacatacatgaaaaacatacatgaaaaaaggaccctcatcaacattagaaggggtagatttggagcactttaggcaggaaaacaggaacgcaaggccaggaaactggaacccagtgaatactcagaaccgaggatgcagatgacttatttagcaaaatggtcacttctgtgacatagctggagaaaggatgggtaacagcttgccagagccacttggaacaagggcaaatctcagtgtctggggcaaaagatgatgcatttccctctgacccatcatgtttattcatcctccactccccattgccacactagctcttgctgtaagtcctcaccaggatctacatttcctcgtcgctggtgggaaccccttagagtacatagaggtatcagtccagtaagactgctctacacaacagaagtgaggcccagggagtagcagccaggcccttatcctgttacctctgcaggagtgactgcccaacccagatccagagacattgaaggaaatgataattccttggtacctcactgccttgggacaaaatgaagaaagccacccttccttaggctgcagcttgccactcctgggctgggtaaacaggtcatcagcaccaggctcaaccaggagtaacattctggaagacatgggtgagcccaagaggaagcatgaacaggacgctgttcctaagtcatgtcaacaggttgtgctgggccaggatccccagggaaaaaaatggtcaacccaactggagggtaggttagaagaaaaaaaacataaacgtggatagtcatgtcatctcaaatccctgacttggcttccccattacttgacagtctgagctccttcttagcctgtgaccagcttcaaatcacagccaagtaaaacaaggaaataggaaaagtaaatccaactagaagagacaagctgagattcagatttgtttactcctcccatgcaaagtttccctgttggaggttttccatgtatacatgtctagaagtgatagaatgcaaggccttggctttgtcttgcagggatctgcctttgaggtcatagactgaacagcagggagagaggttagtggtggagtgtggggggagctgttctagctccagtttcttctgacacatttttcaggatcatggatctgatcctccgaagcacagcagagatatctaagccatatttgtgcacatgagcagactcttctagttttttagtaaccagggatgggcttttgcatggcactgactatagagatgtcttgtagagatcaagccagtcttttgcatcccacctgcccacctccagaagagatgggaaaaggtcatcaaagggcattcaccaactgaaatccactcatgaatgttaggtctctaaaaggaggcatcaacactcacaatggtagcctccaaacctagcatcccacctatctaagagctcaggggtggtccactggggcagatacaagggaagtgcaagggctcaggatgaaagaaaatctattgggaagagttttaggggcttgatcattatggggcttccttctatatctgagaactgctctgggtggtgagatgtggactctgatccttaattggaatgttcggagaatgagtgtctggtggccttgaagtgttggacagaaaagtatcagtataaaagcctggagctcagggtaattaatgtagttcatggttccttagtgagcaggactcttggatgtggaggagaaagggtcataggaagtaaaccaccaaaattacaaaattgagtctctgtacaattacttcagtgcctttgggcttatgaatacaaatcagtgggccttctctatgatggtccaacaaactctcagtgtccaccctgtccctgtatctcccatggaagatgaataatgtcaggtgttctttgggtcaaaggccccagggcagtctggaggcttagagggcagagtggtgtcattccatgtaaagttaggcttctgaggggtcaggcagaatatggtgtccatatcttccatagctctgcagattcttggatgaagtcaagcacagtttgctagacccaggtcactcctctgagtataactaggacccatgagtgaaacttaatagctgtaaggaagaacctgctgtctgccagagaggataagctgcccatctcagcagctgtctaaaagaaggcaggtgtctctttaaagggaagagaagcattggtgaaatggatttcaggtcacttccattccagatgggtgagatcttgtggagctgggatcatgtttgaactcattcatacctgtagagcacgaatccaagtagattgtgtttggtctgtacaggctgaagccccctgctctcccacccaagtgcccccactgagcaggccaacatgctgttgtggccacatatactgggctgatccaggctggttatcaccaaacagcaaaccatagggaacagctgctttgccatagacccaatacccatgtagatctctcatgagagcagccataactcagacccactgaccaacagggccatgagtgacagccagaaccagtgaaggtccaagtaggacacagagcagggcttttcttaccatacacattatctccagaggttatttctaccccactccctattcaaggcctgttggagcacactgcaaaagcaaaagcacagtaactcaatttacacatgattataatcatttccagtgcacacatttcatcaccaggtggatcctgagctagcccatgtaaatccgggttaacccatattggtaatcatactcaaaagcacttttcaccctacattctactagccaatcaaagacaaagagttgtggcctctaccattgccttggcttctggacaccctcacaagctatcccaaggttcccgctcaactccagggaggctgacatcttcacatccactgggcatataatattgcatgagaccaaagtctccacactctttgcagcctcctccatgaatcccaatggcctgcacttgtacagtttgggtgtttgatagataaagcacgtatgagaagagaaaacaaaataaatcaactttttaaaaaagccagcactgtgctgtcaatgttttttttttcttttcaattctagctcagaaaagcagaaggtaaataatgtcaggtcaatgaatatcagatatattttttgactgtacattacagtgaagtgtaatctttttacacctgcaagtccatcttatttattcttgtaaatgttccctgacaatgtttgtaatatggctgtgttaaaaaatctatacaataaagctgtgaccctgagattcatgttttcctaagataaaaaaaa

SEQ ID NO: 418396 - DNA, 6515 bp, Homo sapiens
cctcccgcctcagttcgcgccgcgcctcggcttggaacgcaggagcgccggctccgggagcccgagcggagccagccgcgcgcacagccagcggccgcgccggcgatgcggggccaccccgcgcccgccccagtcccggccccggcccccgcgggaaggggctgagctgcccgccgccgcccggatggcgagcctcgccgcgctcgccctcagcctgctcctgaggctgcagctgccgccactgcccggcgcccgggctcagagcgccccaggtggctgttcctttgatgagcactacagcaactgtggttatagtgtggctctagggaccaatgggttcacctgggagcagattaacacaacggagaaaccaatgctggaccaggcagtgcccacaggatctttcatgatggtgaacagctctgggagagcctctggccagaaggcccaccttctcctgccaaccctgaaggagaatgacacccactgcatcgacttccattactacttctccagccgtgacaggtccagcccaggggccttgaacgtctacgtgaaggtgaatggtggcccccaagggaaccctgtgtggaatgtgtccggggtcgtcactgagggctgggtgaaggcagagctcgccatcagcactttctggccacatttctatcaggtgatatttgaatccgtctcattgaagggtcatcctggctacatcgccgtggacgaggtccgggtccttgctcatccatgcagaaaagcacctcattttctgcgactccaaaacgtggaggtgaatgtggggcagaatgccacatttcagtgcattgctggtgggaagtggtctcagcatgacaagctttggctccagcaatggaatggcagggacacggccctgatggtcacccgtgtggtcaaccacaggcgcttctcagccacagtcagtgtggcagacactgcccagcggagcgtcagcaagtaccgctgtgtgatccgctctgatggtgggtctggtgtgtccaactacgcggagctgatcgtgaaagagcctcccacgcccattgctcccccagagctgctggctgtgggggccacatacctgtggatcaagccaaatgccaactccatcatcggggatggccccatcatcctgaaggaagtggaatatcgcaccaccacaggcacgtgggcagagacccacatagtcgactctcccaactataagctgtggcatctggaccccgatgttgagtatgagatccgagtgctcctcacacgaccaggtgaggggggtacgggaccgccaggggctcccctcaccaccaggaccaagtgtgcagatccggtacatggcccacagaacgtggaaatcgtagacatcagagcccggcagctgaccctgcagtgggagcccttcggctacgcggtgacccgctgccatagctacaacctcaccgtgcagtaccagtatgtgttcaaccagcagcagtacgaggccgaggaggtcatccagacctcctcccactacaccctgcgaggcctgcgccccttcatgaccatccggctgcgactcttgctgtctaaccccgagggccgaatggagagcgaggagctggtggtgcagactgaggaagacgttccaggagctgttcctctagaatccatccaaggggggccctttgaggagaagatctacatccagtggaaacctcccaatgagaccaatggggtcatcacgctctacgagatcaactacaaggctgtcggctcgctggacccaagtgctgacctctcgagccagagggggaaagtgttcaagctccggaatgaaacccaccacctctttgtgggtctgtacccagggaccacctattccttcaccatcaaggccagcacagcaaagggctttgggccccctgtcaccactcggattgccaccaaaatttcagctccatccatgcctgagtacgacacagacaccccattgaatgagacagacacgaccatcacagtgatgctgaaacccgctcagtcccggggagctcctgtcagtgtttatcagctggttgtcaaggaggagcgacttcagaagtcacggagggcagctgacattattgagtgcttttcggtgcccgtgagctatcggaatgcctccagcctcgattctctacactactttgctgctgagttgaagcctgccaacctgcctgtcacccagccatttacagtgggtgacaataagacatacaatggctactggaaccctcctctctctcccctgaaaagctacagcatctacttccaggcactcagcaaagccaatggagagaccaaaatcaactgtgttcgtctggctacaaaagcaccaatgggcagcgcccaggtgaccccggggactccactctgcctcctcaccacaggtgcctccacccagaattctaacactgtggagccagagaagcaggtggacaacaccgtgaagatggctggcgtgatcgctggcctcctcatgttcatcatcattctcctgggcgtgatgctcaccatcaaaaggagaagaaatgcttattcctactcctattacttgtcccaaaggaagctggccaagaagcagaaggagacccagagtggagcccagagggagatggggcctgtggcctctgccgacaaacccaccaccaagctcagcgccagccgcaatgatgaaggcttctcttctagttctcaggacgtcaacggattcacagatggcagccgcggggagctttcccagcccaccctcacgatccagactcatccctaccgcacctgtgaccctgtggagatgagctacccccgggaccagttccaactcgccatccgggtggctgacttgctgcagcacatcacgcagatgaagagaggccagggctacgggttcaaggaggaatacgaggccttaccagaggggcagacagcttcgtgggacacagccaaggaggatgaaaaccgcaataagaatcgatatgggaacatcatatcctacgaccattcccgggtgaggctgctggtgctggatggagacccgcactctgactacatcaatgccaactacattgacggataccatcgacctcggcactacattgcgactcaaggtccgatgcaggagactgtaaaggacttttggagaatgatctggcaggagaactccgccagcatcgtcatggtcacaaacctggtggaagtgggcagggtgaaatgtgtgcgatactggccagatgacacggaggtctacggagacattaaagtcaccctgattgaaacagagcccctggcagaatacgtcatacgcaccttcacagtccagaagaaaggctaccatgagatccgggagctccgcctcttccacttcaccagctggcctgaccacggcgttccctgctatgccactggccttctgggcttcgtccgccaggtcaagttcctcaaccccccggaagctgggcccatagtggtccactgcagtgctggggctgggcggactggctgcttcattgccattgacaccatgcttgacatggccgagaatgaaggggtggtggacatcttcaactgcgtgcgtgagctccgggcccaaagggtcaacctggtacagacagaggagcaatatgtgtttgtgcacgatgccatcctggaagcgtgcctctgtggcaacactgccatccctgtgtgtgagttccgttctctctactacaatatcagcaggctggacccccagacaaactccagccaaatcaaagatgaatttcagaccctcaacattgtgacaccccgtgtgcggcccgaggactgcagcattgggctcctgccccggaaccatgataagaatcgaagtatggacgtgctgcctctggaccgctgcctgcccttccttatctcagtggacggagaatccagcaattacatcaacgcagcactgatggatagccacaagcagcctgccgccttcgtggtcacccagcaccctctacccaacaccgtggcagacttctggaggctggtgttcgattacaactgctcctctgtggtgatgctgaatgagatggacactgcccagttctgtatgcagtactggcctgagaagacctccgggtgctatgggcccatccaggtggagttcgtctccgcagacatcgacgaggacatcatccacagaatattccgcatctgtaacatggcccggccacaggatggttatcgtatagtccagcacctccagtacattggctggcctgcctaccgggacacgcccccctccaagcgctctctgctcaaagtggtccgacgactggagaagtggcaggagcagtatgacgggagggagggacgtactgtggtccactgcctaaatgggggaggccgtagtggaaccttctgtgccatctgcagtgtgtgtgagatgatccagcagcaaaacatcattgacgtgttccacatcgtgaaaacactgcgtaacaacaaatccaacatggtggagaccctggaacagtataaatttgtatacgaggtggcactggaatatttaagctccttttagctcaatgggatggggaacctgccggagtccagaggctgctgtgaccaagcccccttttgtgtgaatggcagtaactgggctcaggagctctgaggtggcaccctgcctgactccaaggagaagactggtggccctgtgttccacggggggctctgcaccttctgaggggtctcctgttgccgtgggagatgctgctccaaaaggcccaggcttccttttcaacctaaccagccacagccaagggcccaagcagaagtacacccacaagcaaggccttggatttctggctcccagaccacctgcttttgttctgagtttgtggatctcttggcaagccaactgtgcaggtgctggggagtgggaggctcccctgccctccttctccttaggagtggaggagatgtgtgttctgctcctctacgtcatggaaaagattgaggctcttgggggtcactgctctgctgccccctgcaacctccttcaggggcctctggcaccagacatttgcagtctggaccagtgtgaccttacgatgttccctaggccacaagagaggccccccatcctcacacctaacctgcatggggcttcgcccacaaccattctgtaccccttccccagcctgggccttgaccgtccagcattcactggccggccagctgtgtccacagcagtttttgataaaggtgttctttgcttttttgtgtggtcagtgggagggggtggaactgcagggaacttctctgctcctccttgtctttgtaaaaagggaccacctccctggggcagggcttgggctgacctgtaggatgtaacccctgtgtttctttggtggtagctttctttggaagagacaaacaagataagatttgattattttccaaagtgtatgtgaaaagaaactttcttttggagggtgtaaaatcttagtctcttatgtcaaaaagaagggggcgggggagtttgagtatgtacctctaagacaaatctctcgggccttttattttttcctggcaatgtccttaaaagctcccaccctgggacagcatgccactgagcaaggagagatgggtgagcctgaagatggtccctttggtttctggggcaaatagagcaccagctttgtgcataatttggatgtccaaatttgaactccttcctaaagaaacccagcagccaccttgaaaaaggccattgtggagcccattatactttgatttaaaataggccaagagaatcaggcctggagatctagggtcttgtccaaagtgtgagtgagtcaatgagagggaaccaacatttgctaagtctctactgtatgccagggatcatgcttggcactttccataggacatttcacacagtccttagaacccccaggagagagctactgacttgttatcatctccatttgatcatctcctccaatgaggaaacccacgcaccttccttagtaatgaaatcctgggttccaaaggggcaggtaatggcaatgagacttctccgtgctgttttcttcatcttctctaagccaagcaattattttatggagggaaaataaggccagaaacttctgagcagataactccacaaatggaaatttagtactttcttcctgatgccagttcttctgggaagcgcagaatttcagatatattttagtaacacattcccagctccccaggaaagccagtctcatctaatttcttagtcagtaaaaacaattccctgttccttcaggctatgaatggaccagccagggaaactctcgaccttgatctctagccagtgcttaggcccaatatctgaagtgattgttccccgagcggggaaccatcacttttgctaggcacctagccaaagtgaaccaataggattacatgaagtgaaaaagcttatgtacagccaaggaaaccacaccaagtgattgttccccgct

SEQ ID NO: 418397 - DNA, 775 bp, Homo sapiens
aagaattcacagaaagcaagccgcgcacggtggctcacgcctgtcctcccaaagtgctaggattatagccaccgcacctcgtcttgaaatagccttttaaatgttcacctcagcttgcctcacagtggtaaaaataagcatttttttgttttgtaggatcagggagcttccaaggcatttgatacctttttgatgggaagaagggctctgaggagctccaagataccccaacctccaggcccttcattagggggtagttgggtttctgtttggcctttccccctgggccccataggcttaaactacccccacccccacctccgcctcctacctcagctgggagcactgtcttccatggggcttccacttctctcctcaacctggggaagaccacagggcagtgcctgcctcaggacctgccttccccaaaagctggcttcttgctccaaggagagagcattgacccacctgccagagtcttgccttttgcccaaaggagcctggtcttcagggctgcataggatgcaagtgccttctctgcttctcaccgtgggtggcactaatttcctccttaaccagaactttgttccagccactgacccattctaactcttccccctctgactctcctgcgcagggtctgttcctggtttcccagatgcataaaggaagacatatccctcccctgggcagcaaggctacaatgggagggagggagaacatgggagcatgtgaataaaatggcattaaatactgaaccagggagtccagcctc

SEQ ID NO: 418398 - DNA, 979 bp, Homo sapiens
cgcgcgcacacacacaaacacaaacacacaccccaacacacacgccctgtcccctttctccaccctgcaagctagttgcatttagctcacagagcctgggctgcgacttgaaagagtttaggcagcaacagagtgaccctgggggtgctcttgaccgacagccgcacccccggcgtctaggacctccgagcagggatgcatctggaggtctagggaagcacttccaccccctcctctcctcaatcctggcaggatggctactgctgcttcaagacagtgacgtttctctccggtcagctgtcaggagcgctggtgagcttcctactgtgccacaaggtgcgggtgctggagacacagctgagcctggaaatgagagtgggcatcgccgtggtcatcatgactcctctgcggcgtggtcaccatgttggttcactgtgttgggctcttattgacgggtctcctgctaggcctgaccttgggtgccggagccctgctggcttctgagcctatctaccaaccaccttcagcctgggtgccagctggggggctggtggggctggcgctgctgggagccctgctcacacttcggtggccacgtccattcacagttctgggcacaaccctgctgggttctgcagtgcttgtggcctgtgttgactacttcctggaggggctggcactggggagttggctgggccaacgcctgcagacacttccagccttgccttctctctgctgatatagctgggtcttactggggatctggccagccttgggggcccttggagccctggcccagtggaagctcgtgcctgaggaacatggaggccacgctaatgagggtctgttcctggtttcccagatgcataaaggaagacatatccctcccctgggcagcaaggctacaatgggagggagggagaacatgggagcatgtgaataaaatggcattaaatactgaaccagggagtccagcctc

SEQ ID NO: 418399 - DNA, 553 bp, Homo sapiens
cgcttgtccagggtccccagacttccaagcagattgaggagaggagctccgagagtcaaccctccagcctgtaaggaccttgatatccaaaggacagctgaagaaagtaatgtgcctgcatttttgccacttcattcccacagtgcccgaaatgccagctcctccttggtgttctcctttcaggatttgaattcaaatcccattggcagccctgataccgctgggggaagggtgaggctactgctgcttcaagacagtgacgtttctctccggtcagctgtcaggagcgctggtgagcttcctactgtgccacaaggatcagggagcttccaaggcatttgatacctttttgatgggaagaagggctctgaggagctccaagataccccaacctccaggcccttcattaggggagggtctgttcctggtttcccagatgcataaaggaagacatatccctcccctgggcagcaaggctacaatgggagggagggagaacatgggagcatgtgaataaaatggcattaaatactgaaccagggagtccagcctc

SEQ ID NO: 418400 - DNA, 3841 bp, Homo sapiens
cgcttgtccagggtccccagacttccaagcagattgaggagaggagctccgagagtcaaccctccagcctgtaaggaccttgatatccaaaggacagctgaagaaagtaatgtgcctgcatttttgccacttcattcccacagtgcccgaaatgccagctcctccttggtgttctcctttcaggatttgaattcaaatcccattggcagccctgataccgctgggggaagggtgaggtaggaaaagtcccaccaatatcctaaggggaggtgcgagtggctaccaggatgtgagatgtctgtgggcaaagtccctgcttattccatgaggggctgtgggattaggactgtggctggatgcctcttcctccaacaactccatctcaggatgaagctgaggctttaaaaccctgacaaactgtgggtgactgtctctacttaattcctcctcccaaactcttggtgtctggttttttccctctttctgccctgggcctggagcagctgtccagagacccccaccatgactcatactctcctgttctccctccctctcccctctctattaacctcacccttcccaatccagtggggtagtattaagtcccagtcgcagatggggcaataatgtcccagcacccctccctccacacacccagggcttcctgttctttccaccctcaccctgaagagctgcagggtggtggggggaggcaaaggctcattactttataagattttcattactttataagatttcattttacattttacttaagtgtacttgtttcagagagtggtaaagacagatcctgctcctctcaatccaatcctgtagatttcttcagttacctcaacagggtcatactggctcctgaaatgggcaccattatttaaaagaaatagaggtacagagtcctcaagatttatgggcacctgagtttctgccccgtgccccgctgcaggtttcccaatcccctaaagacattcatggatgggtgagaggagctgacacctcccgctctgtgaccactttctctttggccatggaggaagtcttgctgcccctggctgtgacatctgaccccaggccctttaatcaacaactcccagagcctccagacccaagatgtgttttggaaccccaggacaatcctgaactggcacttgccctggtgtgtgccctttgctgctgctttggaatcatctactgctgcttcagtgagggcagggccaaggacctggggggccattgcccaagactgtcatcctcaaggatgatgccagctttcctccttgctcctgggccatctcacctcctctgccaggggttcctacctctagtgtggcccatgttgctctggctgtattcctaggcccatgttgctcttgccagcttcttgtccatcctccatgcccatgccttccagctttcacctctggcatctatcatttgctcttctcttaactcctacctgaaaaccccattcctaaattattcactatatttcagacttcttcactcttctccaaaaacctgaatcagcttgtgctgattttttcctatctgctatccctaaaaggactagaccttctttctatccttactcccctcaatgtatccatcttacctcttgattttccctcccattccctcacagttcctgaaacagtgcccccccccgaccctaagcgacccctttctgcccctggccttgaggtcccttgacgtgctgctcctgtcttctgctcctctagtgagccattcctctcccttggaattcatcagagtcatccctgtagagcccccttcctgcctctcaattcctcctgcctcacttcccaggctactgctgcttcaagacagtgacgtttctctccggtcagctgtcaggagcgctggtgagcttcctactgtgccacaaggtgcgggtgctggagacacagctgagcctggaaatgagagtgggcatcgccgtggtcatcatgactcctctgcggcgtggtcaccatgttggttcactgtgttgggctcttattgacgggtctcctgctaggcctgaccttgggtgccggagccctgctggcttctgagcctatctaccaaccaccttcagcctgggtgccagctggggggctggtggggctggcgctgctgggagccctgctcacacttcggtggccacgtccattcacagttctgggcacaaccctgctgggttctgcagtgcttgtggcctgtgttgactacttcctggaggggctggcactggggagttggctgggccaacgcctgcagacacttccagccttgccttctctctgctgatatagctgggtcttactggggatctggccagccttgggggcccttggagccctggcccagtggaagctcgtgcctgaggaacatggaggccacgctaatgagttacttccagagtcttcaagagtgccaactgggaccaggaccccagaccacagccccccacaccgtcctggacctggattctgactgtggttccactgtacccctcaccttaatctctggttctaaccagacctgagcctagacttccactttttcccttacccctgtgagggcctgggaacactaggtgggcagggtttgagcccacaggacctgcacacaaacttccccacctcttggacttggggacaggatctgtgcctcaacccagaccagctttgtagggatatgttccaagaacagagaagagtcttatggggaagggggaggaagggaagtatgaatatttacctctgaccaataatagaggtgccctggtccccaaagaaattgactcccgaattccctccaagccttacccatatagcttttgtttgtttgtttgttttcagacaaggtcttgttctgtccagtgccgtggcgtgaccacagctcatgacaactttgatttccccggcccaagcgagcctctcattcagcctcctgagtggctgggaccacagacgccacacacagctaatttttatgtattcgtttttatttttttgcagagacagggtctccctatgttgcccaagctggtcttgaactcctgggctcaagtgatcctcctgcttcagcctcccaaagtgctaggattatagccaccgcacctcgtcttgaaatagccttttaaatgttcacctcagcttgcctcacagtggtaaaaataagcatttttttgttttgtaggatcagggagcttccaaggcatttgatacctttttgatgggaagaagggctctgaggagctccaagataccccaacctccaggcccttcattagggggtagttgggtttctgtttggcctttccccctgggccccataggcttaaactacccccacccccacctccgcctcctacctcagctgggagcactgtcttccatggggcttccacttctctcctcaacctggggaagaccacagggcagtgcctgcctcaggacctgccttccccaaaagctggcttcttgctccaaggagagagcattgacccacctgccagagtcttgccttttgcccaaaggagcctggtcttcagggctgcataggatgcaagtgccttctctgcttctcaccgtgggtggcactaatttcctccttaaccagaactttgttccagccactgacccattctaactcttccccctctgactctcctgcgcagggtctgttcctggtttcccagatgcataaaggaagacatatccctcccctgggcagcaaggctacaatgggagggagggagaacatgggagcatgtgaataaaatggcattaaatactgaaccagggagtccagcctc

SEQ ID NO: 418401 - DNA, 3433 bp, Homo sapiens
cgcttgtccagggtccccagacttccaagcagattgaggagaggagctccgagagtcaaccctccagcctgtaaggaccttgatatccaaaggacagctgaagaaagtaatgtgcctgcatttttgccacttcattcccacagtgcccgaaatgccagctcctccttggtgttctcctttcaggatttgaattcaaatcccattggcagccctgataccgctgggggaagggtgaggtaggaaaagtcccaccaatatcctaaggggaggtgcgagtggctaccaggatgtgagatgtctgtgggcaaagtccctgcttattccatgaggggctgtgggattaggactgtggctggatgcctcttcctccaacaactccatctcaggatgaagctgaggctttaaaaccctgacaaactgtgggtgactgtctctacttaattcctcctcccaaactcttggtgtctggttttttccctctttctgccctgggcctggagcagctgtccagagacccccaccatgactcatactctcctgttctccctccctctcccctctctattaacctcacccttcccaatccagtggggtagtattaagtcccagtcgcagatggggcaataatgtcccagcacccctccctccacacacccagggcttcctgttctttccaccctcaccctgaagagctgcagggtggtggggggaggcaaaggctcattactttataagattttcattactttataagatttcattttacattttacttaagtgtacttgtttcagagagtggtaaagacagatcctgctcctctcaatccaatcctgtagatttcttcagttacctcaacagggtcatactggctcctgaaatgggcaccattatttaaaagaaatagaggtacagagtcctcaagatttatgggcacctgagtttctgccccgtgccccgctgcaggtttcccaatcccctaaagacattcatggatgggtgagaggagctgacacctcccgctctgtgaccactttctctttggccatggaggaagtcttgctgcccctggctgtgacatctgaccccaggccctttaatcaacaactcccagagcctccagacccaagatgtgttttggaaccccaggacaatcctgaactggcacttgccctggtgtgtgccctttgctgctgctttggaatcatctactgctgcttcagtgagggcagggccaaggacctggggggccattgcccaagactgtcatcctcaaggatgatgccagctttcctccttgctcctgggccatctcacctcctctgccaggggttcctacctctagtgtggcccatgttgctctggctgtattcctaggcccatgttgctcttgccagcttcttgtccatcctccatgcccatgccttccagctttcacctctggcatctatcatttgctcttctcttaactcctacctgaaaaccccattcctaaattattcactatatttcagacttcttcactcttctccaaaaacctgaatcagcttgtgctgattttttcctatctgctatccctaaaaggactagaccttctttctatccttactcccctcaatgtatccatcttacctcttgattttccctcccattccctcacagttcctgaaacagtgcccccccccgaccctaagcgacccctttctgcccctggccttgaggtcccttgacgtgctgctcctgtcttctgctcctctagtgagccattcctctcccttggaattcatcagagtcatccctgtagagcccccttcctgcctctcaattcctcctgcctcacttcccaggctactgctgcttcaagacagtgacgtttctctccggtcagctgtcaggagcgctggtgagcttcctactgtgccacaagctgggtcttactggggatctggccagccttgggggcccttggagccctggcccagtggaagctcgtgcctgaggaacatggaggccacgctaatgagttacttccagagtcttcaagagtgccaactgggaccaggaccccagaccacagccccccacaccgtcctggacctggattctgactgtggttccactgtacccctcaccttaatctctggttctaaccagacctgagcctagacttccactttttcccttacccctgtgagggcctgggaacactaggtgggcagggtttgagcccacaggacctgcacacaaacttccccacctcttggacttggggacaggatctgtgcctcaacccagaccagctttgtagggatatgttccaagaacagagaagagtcttatggggaagggggaggaagggaagtatgaatatttacctctgaccaataatagaggtgccctggtccccaaagaaattgactcccgaattccctccaagccttacccatatagcttttgtttgtttgtttgttttcagacaaggtcttgttctgtccagtgccgtggcgtgaccacagctcatgacaactttgatttccccggcccaagcgagcctctcattcagcctcctgagtggctgggaccacagacgccacacacagctaatttttatgtattcgtttttatttttttgcagagacagggtctccctatgttgcccaagctggtcttgaactcctgggctcaagtgatcctcctgcttcagcctcccaaagtgctaggattatagccaccgcacctcgtcttgaaatagccttttaaatgttcacctcagcttgcctcacagtggtaaaaataagcatttttttgttttgtaggatcagggagcttccaaggcatttgatacctttttgatgggaagaagggctctgaggagctccaagataccccaacctccaggcccttcattagggggtagttgggtttctgtttggcctttccccctgggccccataggcttaaactacccccacccccacctccgcctcctacctcagctgggagcactgtcttccatggggcttccacttctctcctcaacctggggaagaccacagggcagtgcctgcctcaggacctgccttccccaaaagctggcttcttgctccaaggagagagcattgacccacctgccagagtcttgccttttgcccaaaggagcctggtcttcagggctgcataggatgcaagtgccttctctgcttctcaccgtgggtggcactaatttcctccttaaccagaactttgttccagccactgacccattctaactcttccccctctgactctcctgcgcagggtctgttcctggtttcccagatgcataaaggaagacatatccctcccctgggcagcaaggctacaatgggagggagggagaacatgggagcatgtgaataaaatggcattaaatactgaaccagggagtccagcctc

SEQ ID NO: 418402 - DNA, 2252 bp, Homo sapiens
cgcgcgcacacacacaaacacaaacacacaccccaacacacacgccctgtcccctttctccaccctgcaagctagttgcatttagctcacagagcctgggctgcgacttgaaagagtttaggcagcaacagagtgaccctgggggtgctcttgaccgacagccgcacccccggcgtctaggacctccgagcagggatgcatctggaggtctagggaagcacttccaccccctcctctcctcaatcctggcaggatggctactgctgcttcaagacagtgacgtttctctccggtcagctgtcaggagcgctggtgagcttcctactgtgccacaaggtgcgggtgctggagacacagctgagcctggaaatgagagtgggcatcgccgtggtcatcatgactcctctgcggcgtggtcaccatgttggttcactgtgttgggctcttattgacgggtctcctgctaggcctgaccttgggtgccggagccctgctggcttctgagcctatctaccaaccaccttcagcctgggtgccagctggggggctggtggggctggcgctgctgggagccctgctcacacttcggtggccacgtccattcacagttctgggcacaaccctgctgggttctgcagtgcttgtggcctgtgttgactacttcctggaggggctggcactggggagttggctgggccaacgcctgcagacacttccagccttgccttctctctgctgatatagctgggtcttactggggatctggccagccttgggggcccttggagccctggcccagtggaagctcgtgcctgaggaacatggaggccacgctaatgagttacttccagagtcttcaagagtgccaactgggaccaggaccccagaccacagccccccacaccgtcctggacctggattctgactgtggttccactgtacccctcaccttaatctctggttctaaccagacctgagcctagacttccactttttcccttacccctgtgagggcctgggaacactaggtgggcagggtttgagcccacaggacctgcacacaaacttccccacctcttggacttggggacaggatctgtgcctcaacccagaccagctttgtagggatatgttccaagaacagagaagagtcttatggggaagggggaggaagggaagtatgaatatttacctctgaccaataatagaggtgccctggtccccaaagaaattgactcccgaattccctccaagccttacccatatagcttttgtttgtttgtttgttttcagacaaggtcttgttctgtccagtgccgtggcgtgaccacagctcatgacaactttgatttccccggcccaagcgagcctctcattcagcctcctgagtggctgggaccacagacgccacacacagctaatttttatgtattcgtttttatttttttgcagagacagggtctccctatgttgcccaagctggtcttgaactcctgggctcaagtgatcctcctgcttcagcctcccaaagtgctaggattatagccaccgcacctcgtcttgaaatagccttttaaatgttcacctcagcttgcctcacagtggtaaaaataagcatttttttgttttgtaggatcagggagcttccaaggcatttgatacctttttgatgggaagaagggctctgaggagctccaagataccccaacctccaggcccttcattagggggtagttgggtttctgtttggcctttccccctgggccccataggcttaaactacccccacccccacctccgcctcctacctcagctgggagcactgtcttccatggggcttccacttctctcctcaacctggggaagaccacagggcagtgcctgcctcaggacctgccttccccaaaagctggcttcttgctccaaggagagagcattgacccacctgccagagtcttgccttttgcccaaaggagcctggtcttcagggctgcataggatgcaagtgccttctctgcttctcaccgtgggtggcactaatttcctccttaaccagaactttgttccagccactgacccattctaactcttccccctctgactctcctgcgcagggtctgttcctggtttcccagatgcataaaggaagacatatccctcccctgggcagcaaggctacaatgggagggagggagaacatgggagcatgtgaataaaatggcattaaatactgaaccagggagtccagcctc

SEQ ID NO: 418403 - DNA, 1937 bp, Homo sapiens
cgcgcgcacacacacaaacacaaacacacaccccaacacacacgccctgtcccctttctccaccctgcaagctagttgcatttagctcacagagcctgggctgcgacttgaaagagtttaggcagcaacagagtgaccctgggggtgctcttgaccgacagccgcacccccggcgtctaggacctccgagcagggatgcatctggaggtctagggaagcacttccaccccctcctctcctcaatcctggcaggatgtgcccgaaatgccagctcctccttggtgttctcctttcaggatttgaattcaaatcccattggcagccctgataccgctgggggaagggtgaggctactgctgcttcaagacagtgacgtttctctccggtcagctgtcaggagcgctggtgagcttcctactgtgccacaagctgggtcttactggggatctggccagccttgggggcccttggagccctggcccagtggaagctcgtgcctgaggaacatggaggccacgctaatgagttacttccagagtcttcaagagtgccaactgggaccaggaccccagaccacagccccccacaccgtcctggacctggattctgactgtggttccactgtacccctcaccttaatctctggttctaaccagacctgagcctagacttccactttttcccttacccctgtgagggcctgggaacactaggtgggcagggtttgagcccacaggacctgcacacaaacttccccacctcttggacttggggacaggatctgtgcctcaacccagaccagctttgtagggatatgttccaagaacagagaagagtcttatggggaagggggaggaagggaagtatgaatatttacctctgaccaataatagaggtgccctggtccccaaagaaattgactcccgaattccctccaagccttacccatatagcttttgtttgtttgtttgttttcagacaaggtcttgttctgtccagtgccgtggcgtgaccacagctcatgacaactttgatttccccggcccaagcgagcctctcattcagcctcctgagtggctgggaccacagacgccacacacagctaatttttatgtattcgtttttatttttttgcagagacagggtctccctatgttgcccaagctggtcttgaactcctgggctcaagtgatcctcctgcttcagcctcccaaagtgctaggattatagccaccgcacctcgtcttgaaatagccttttaaatgttcacctcagcttgcctcacagtggtaaaaataagcatttttttgttttgtaggatcagggagcttccaaggcatttgatacctttttgatgggaagaagggctctgaggagctccaagataccccaacctccaggcccttcattagggggtagttgggtttctgtttggcctttccccctgggccccataggcttaaactacccccacccccacctccgcctcctacctcagctgggagcactgtcttccatggggcttccacttctctcctcaacctggggaagaccacagggcagtgcctgcctcaggacctgccttccccaaaagctggcttcttgctccaaggagagagcattgacccacctgccagagtcttgccttttgcccaaaggagcctggtcttcagggctgcataggatgcaagtgccttctctgcttctcaccgtgggtggcactaatttcctccttaaccagaactttgttccagccactgacccattctaactcttccccctctgactctcctgcgcagggtctgttcctggtttcccagatgcataaaggaagacatatccctcccctgggcagcaaggctacaatgggagggagggagaacatgggagcatgtgaataaaatggcattaaatactgaaccagggagtccagcctc

SEQ ID NO: 418404 - DNA, 2345 bp, Homo sapiens
cgcgcgcacacacacaaacacaaacacacaccccaacacacacgccctgtcccctttctccaccctgcaagctagttgcatttagctcacagagcctgggctgcgacttgaaagagtttaggcagcaacagagtgaccctgggggtgctcttgaccgacagccgcacccccggcgtctaggacctccgagcagggatgcatctggaggtctagggaagcacttccaccccctcctctcctcaatcctggcaggatgtgcccgaaatgccagctcctccttggtgttctcctttcaggatttgaattcaaatcccattggcagccctgataccgctgggggaagggtgaggctactgctgcttcaagacagtgacgtttctctccggtcagctgtcaggagcgctggtgagcttcctactgtgccacaaggtgcgggtgctggagacacagctgagcctggaaatgagagtgggcatcgccgtggtcatcatgactcctctgcggcgtggtcaccatgttggttcactgtgttgggctcttattgacgggtctcctgctaggcctgaccttgggtgccggagccctgctggcttctgagcctatctaccaaccaccttcagcctgggtgccagctggggggctggtggggctggcgctgctgggagccctgctcacacttcggtggccacgtccattcacagttctgggcacaaccctgctgggttctgcagtgcttgtggcctgtgttgactacttcctggaggggctggcactggggagttggctgggccaacgcctgcagacacttccagccttgccttctctctgctgatatagctgggtcttactggggatctggccagccttgggggcccttggagccctggcccagtggaagctcgtgcctgaggaacatggaggccacgctaatgagttacttccagagtcttcaagagtgccaactgggaccaggaccccagaccacagccccccacaccgtcctggacctggattctgactgtggttccactgtacccctcaccttaatctctggttctaaccagacctgagcctagacttccactttttcccttacccctgtgagggcctgggaacactaggtgggcagggtttgagcccacaggacctgcacacaaacttccccacctcttggacttggggacaggatctgtgcctcaacccagaccagctttgtagggatatgttccaagaacagagaagagtcttatggggaagggggaggaagggaagtatgaatatttacctctgaccaataatagaggtgccctggtccccaaagaaattgactcccgaattccctccaagccttacccatatagcttttgtttgtttgtttgttttcagacaaggtcttgttctgtccagtgccgtggcgtgaccacagctcatgacaactttgatttccccggcccaagcgagcctctcattcagcctcctgagtggctgggaccacagacgccacacacagctaatttttatgtattcgtttttatttttttgcagagacagggtctccctatgttgcccaagctggtcttgaactcctgggctcaagtgatcctcctgcttcagcctcccaaagtgctaggattatagccaccgcacctcgtcttgaaatagccttttaaatgttcacctcagcttgcctcacagtggtaaaaataagcatttttttgttttgtaggatcagggagcttccaaggcatttgatacctttttgatgggaagaagggctctgaggagctccaagataccccaacctccaggcccttcattagggggtagttgggtttctgtttggcctttccccctgggccccataggcttaaactacccccacccccacctccgcctcctacctcagctgggagcactgtcttccatggggcttccacttctctcctcaacctggggaagaccacagggcagtgcctgcctcaggacctgccttccccaaaagctggcttcttgctccaaggagagagcattgacccacctgccagagtcttgccttttgcccaaaggagcctggtcttcagggctgcataggatgcaagtgccttctctgcttctcaccgtgggtggcactaatttcctccttaaccagaactttgttccagccactgacccattctaactcttccccctctgactctcctgcgcagggtctgttcctggtttcccagatgcataaaggaagacatatccctcccctgggcagcaaggctacaatgggagggagggagaacatgggagcatgtgaataaaatggcattaaatactgaaccagggagtccagcctc

SEQ ID NO: 418405 - DNA, 2030 bp, Homo sapiens
cgcgcgcacacacacaaacacaaacacacaccccaacacacacgccctgtcccctttctccaccctgcaagctagttgcatttagctcacagagcctgggctgcgacttgaaagagtttaggcagcaacagagtgaccctgggggtgctcttgaccgacagccgcacccccggcgtctaggacctccgagcagggatgcatctggaggtctagggaagcacttccaccccctcctctcctcaatcctggcaggatgtgcccgaaatgccagctcctccttggtgttctcctttcaggatttgaattcaaatcccattggcagccctgataccgctgggggaagggtgaggctactgctgcttcaagacagtgacgtttctctccggtcagctgtcaggagcgctgctgggtcttactggggatctggccagccttgggggcccttggagccctggcccagtggaagctcgtgcctgaggaacatggaggccacgctaatgacccttcagcaaaaggccaaatggcactggatcccctctggggtggggctttgtgagggcagctgtcggcatcagctccctgccaatacctgcagccctgctgacagtctcgctccaagttacttccagagtcttcaagagtgccaactgggaccaggaccccagaccacagccccccacaccgtcctggacctggattctgactgtggttccactgtacccctcaccttaatctctggttctaaccagacctgagcctagacttccactttttcccttacccctgtgagggcctgggaacactaggtgggcagggtttgagcccacaggacctgcacacaaacttccccacctcttggacttggggacaggatctgtgcctcaacccagaccagctttgtagggatatgttccaagaacagagaagagtcttatggggaagggggaggaagggaagtatgaatatttacctctgaccaataatagaggtgccctggtccccaaagaaattgactcccgaattccctccaagccttacccatatagcttttgtttgtttgtttgttttcagacaaggtcttgttctgtccagtgccgtggcgtgaccacagctcatgacaactttgatttccccggcccaagcgagcctctcattcagcctcctgagtggctgggaccacagacgccacacacagctaatttttatgtattcgtttttatttttttgcagagacagggtctccctatgttgcccaagctggtcttgaactcctgggctcaagtgatcctcctgcttcagcctcccaaagtgctaggattatagccaccgcacctcgtcttgaaatagccttttaaatgttcacctcagcttgcctcacagtggtaaaaataagcatttttttgttttgtaggatcagggagcttccaaggcatttgatacctttttgatgggaagaagggctctgaggagctccaagataccccaacctccaggcccttcattagggggtagttgggtttctgtttggcctttccccctgggccccataggcttaaactacccccacccccacctccgcctcctacctcagctgggagcactgtcttccatggggcttccacttctctcctcaacctggggaagaccacagggcagtgcctgcctcaggacctgccttccccaaaagctggcttcttgctccaaggagagagcattgacccacctgccagagtcttgccttttgcccaaaggagcctggtcttcagggctgcataggatgcaagtgccttctctgcttctcaccgtgggtggcactaatttcctccttaaccagaactttgttccagccactgacccattctaactcttccccctctgactctcctgcgcagggtctgttcctggtttcccagatgcataaaggaagacatatccctcccctgggcagcaaggctacaatgggagggagggagaacatgggagcatgtgaataaaatggcattaaatactgaaccagggagtccagcctc

SEQ ID NO: 418406 - DNA, 3669 bp, Homo sapiens
cgcttgtccagggtccccagacttccaagcagattgaggagaggagctccgagagtcaaccctccagcctgtaaggaccttgatatccaaaggacagctgaagaaagtaatgtgcctgcatttttgccacttcattcccacagtgcccgaaatgccagctcctccttggtgttctcctttcaggatttgaattcaaatcccattggcagccctgataccgctgggggaagggtgaggtaggaaaagtcccaccaatatcctaaggggaggtgcgagtggctaccaggatgtgagatgtctgtgggcaaagtccctgcttattccatgaggggctgtgggattaggactgtggctggatgcctcttcctccaacaactccatctcaggatgaagctgaggctttaaaaccctgacaaactgtgggtgactgtctctacttaattcctcctcccaaactcttggtgtctggttttttccctctttctgccctgggcctggagcagctgtccagagacccccaccatgactcatactctcctgttctccctccctctcccctctctattaacctcacccttcccaatccagtggggtagtattaagtcccagtcgcagatggggcaataatgtcccagcacccctccctccacacacccagggcttcctgttctttccaccctcaccctgaagagctgcagggtggtggggggaggcaaaggctcattactttataagattttcattactttataagatttcattttacattttacttaagtgtacttgtttcagagagtggtaaagacagatcctgctcctctcaatccaatcctgtagatttcttcagttacctcaacagggtcatactggctcctgaaatgggcaccattatttaaaagaaatagaggtacagagtcctcaagatttatgggcacctgagtttctgccccgtgccccgctgcaggtttcccaatcccctaaagacattcatggatgggtgagaggagctgacacctcccgctctgtgaccactttctctttggccatggaggaagtcttgctgcccctggctgtgacatctgaccccaggccctttaatcaacaactcccagagcctccagacccaagatgtgttttggaaccccaggacaatcctgaactggcacttgccctggtgtgtgccctttgctgctgctttggaatcatctactgctgcttcagtgagggcagggccaaggacctggggggccattgcccaagactgtcatcctcaaggatgatgccagctttcctccttgctcctgggccatctcacctcctctgccaggggttcctacctctagtgtggcccatgttgctctggctgtattcctaggcccatgttgctcttgccagcttcttgtccatcctccatgcccatgccttccagctttcacctctggcatctatcatttgctcttctcttaactcctacctgaaaaccccattcctaaattattcactatatttcagacttcttcactcttctccaaaaacctgaatcagcttgtgctgattttttcctatctgctatccctaaaaggactagaccttctttctatccttactcccctcaatgtatccatcttacctcttgattttccctcccattccctcacagttcctgaaacagtgcccccccccgaccctaagcgacccctttctgcccctggccttgaggtcccttgacgtgctgctcctgtcttctgctcctctagtgagccattcctctcccttggaattcatcagagtcatccctgtagagcccccttcctgcctctcaattcctcctgcctcacttcccaggctactgctgcttcaagacagtgacgtttctctccggtcagctgtcaggagcgctggtgagcttcctactgtgccacaaggtgcgggtgctggagacacagctgagcctggaaatgagagtgggcatcgccgtggtcatcatgactcctctgcggcgtggtcaccatgttggttcactgtgttgggctcttattgacgggtctcctgctaggcctgaccttgggtgccggagccctgctggcttctgagcctatctaccaaccaccttcagcctgggtgccagctggggggctggtggggctggcgctgctgggagccctgctcacacttcggtggccacgtccattcacagttctgggcacaaccctgctgggttctgcagtgcttgtggcctgtgttgactacttcctggaggggctggcactggggagttggctgggccaacgcctgcagacacttccagccttgccttctctctgctgatatagctgggtcttactggggatctggccagccttgggggcccttggagccctggcccagtggaagctcgtgcctgaggaacatggaggccacgctaatgagttacttccagagtcttcaagagtgccaactgggaccaggaccccagaccacagccccccacaccgtcctggacctggattctgactgtggttccactgtacccctcaccttaatctctggttctaaccagacctgagcctagacttccactttttcccttacccctgtgagggcctgggaacactaggtgggcagggtttgagcccacaggacctgcacacaaacttccccacctcttggacttggggacaggatctgtgcctcaacccagaccagctttgtagggatatgttccaagaacagagaagagtcttatggggaagggggaggaagggaagtatgaatatttacctctgaccaataatagaggtgccctggtccccaaagaaattgactcccgaattccctccaagccttacccatatagcttttgtttgtttgtttgttttcagacaaggtcttgttctgtccagtgccgtggcgtgaccacagctcatgacaactttgatttccccggcccaagcgagcctctcattcagcctcctgagtggctgggaccacagacgccacacacagctaatttttatgtattcgtttttatttttttgcagagacagggtctccctatgttgcccaagctggtcttgaactcctgggctcaagtgatcctcctgcttcagcctcccaaagtgctaggattatagccaccgcacctcgtcttgaaatagccttttaaatgttcacctcagcttgcctcacagtggtaaaaataagcatttttttgttttgtaggatcagggagcttccaaggcatttgatacctttttgatgggaagaagggctctgaggagctccaagataccccaacctccgcctcctacctcagctgggagcactgtcttccatggggcttccacttctctcctcaacctggggaagaccacagggcagtgcctgcctcaggacctgccttccccaaaagctggcttcttgctccaaggagagagcattgacccacctgccagagtcttgccttttgcccaaaggagcctggtcttcagggctgcataggatgcaagtgccttctctgcttctcaccagggtctgttcctggtttcccagatgcataaaggaagacatatccctcccctgggcagcaaggctacaatgggagggagggagaacatgggagcatgtgaataaaatggcattaaatactgaaccagggagtccagcctc

SEQ ID NO: 418407 - DNA, 3730 bp, Homo sapiens
cgcttgtccagggtccccagacttccaagcagattgaggagaggagctccgagagtcaaccctccagcctgtaaggaccttgatatccaaaggacagctgaagaaagtaatgtgcctgcatttttgccacttcattcccacagtgcccgaaatgccagctcctccttggtgttctcctttcaggatttgaattcaaatcccattggcagccctgataccgctgggggaagggtgaggtaggaaaagtcccaccaatatcctaaggggaggtgcgagtggctaccaggatgtgagatgtctgtgggcaaagtccctgcttattccatgaggggctgtgggattaggactgtggctggatgcctcttcctccaacaactccatctcaggatgaagctgaggctttaaaaccctgacaaactgtgggtgactgtctctacttaattcctcctcccaaactcttggtgtctggttttttccctctttctgccctgggcctggagcagctgtccagagacccccaccatgactcatactctcctgttctccctccctctcccctctctattaacctcacccttcccaatccagtggggtagtattaagtcccagtcgcagatggggcaataatgtcccagcacccctccctccacacacccagggcttcctgttctttccaccctcaccctgaagagctgcagggtggtggggggaggcaaaggctcattactttataagattttcattactttataagatttcattttacattttacttaagtgtacttgtttcagagagtggtaaagacagatcctgctcctctcaatccaatcctgtagatttcttcagttacctcaacagggtcatactggctcctgaaatgggcaccattatttaaaagaaatagaggtacagagtcctcaagatttatgggcacctgagtttctgccccgtgccccgctgcaggtttcccaatcccctaaagacattcatggatgggtgagaggagctgacacctcccgctctgtgaccactttctctttggccatggaggaagtcttgctgcccctggctgtgacatctgaccccaggccctttaatcaacaactcccagagcctccagacccaagatgtgttttggaaccccaggacaatcctgaactggcacttgccctggtgtgtgccctttgctgctgctttggaatcatctactgctgcttcagtgagggcagggccaaggacctggggggccattgcccaagactgtcatcctcaaggatgatgccagctttcctccttgctcctgggccatctcacctcctctgccaggggttcctacctctagtgtggcccatgttgctctggctgtattcctaggcccatgttgctcttgccagcttcttgtccatcctccatgcccatgccttccagctttcacctctggcatctatcatttgctcttctcttaactcctacctgaaaaccccattcctaaattattcactatatttcagacttcttcactcttctccaaaaacctgaatcagcttgtgctgattttttcctatctgctatccctaaaaggactagaccttctttctatccttactcccctcaatgtatccatcttacctcttgattttccctcccattccctcacagttcctgaaacagtgcccccccccgaccctaagcgacccctttctgcccctggccttgaggtcccttgacgtgctgctcctgtcttctgctcctctagtgagccattcctctcccttggaattcatcagagtcatccctgtagagcccccttcctgcctctcaattcctcctgcctcacttcccaggctactgctgcttcaagacagtgacgtttctctccggtcagctgtcaggagcgctggtgagcttcctactgtgccacaaggtgcgggtgctggagacacagctgagcctggaaatgagagtgggcatcgccgtggtcatcatgactcctctgcggcgtggtcaccatgttggttcactgtgttgggctcttattgacgggtctcctgctaggcctgaccttgggtgccggagccctgctggcttctgagcctatctaccaaccaccttcagcctgggtgccagctggggggctggtggggctggcgctgctgggagccctgctcacacttcggtggccacgtccattcacagttctgggcacaaccctgctgggttctgcagtgcttgtggcctgtgttgactacttcctggaggggctggcactggggagttggctgggccaacgcctgcagacacttccagccttgccttctctctgctgatatagctgggtcttactggggatctggccagccttgggggcccttggagccctggcccagtggaagctcgtgcctgaggaacatggaggccacgctaatgagttacttccagagtcttcaagagtgccaactgggaccaggaccccagaccacagccccccacaccgtcctggacctggattctgactgtggttccactgtacccctcaccttaatctctggttctaaccagacctgagcctagacttccactttttcccttacccctgtgagggcctgggaacactaggtgggcagggtttgagcccacaggacctgcacacaaacttccccacctcttggacttggggacaggatctgtgcctcaacccagaccagctttgtagggatatgttccaagaacagagaagagtcttatggggaagggggaggaagggaagtatgaatatttacctctgaccaataatagaggtgccctggtccccaaagaaattgactcccgaattccctccaagccttacccatatagcttttgtttgtttgtttgttttcagacaaggtcttgttctgtccagtgccgtggcgtgaccacagctcatgacaactttgatttccccggcccaagcgagcctctcattcagcctcctgagtggctgggaccacagacgccacacacagctaatttttatgtattcgtttttatttttttgcagagacagggtctccctatgttgcccaagctggtcttgaactcctgggctcaagtgatcctcctgcttcagcctcccaaagtgctaggattatagccaccgcacctcgtcttgaaatagccttttaaatgttcacctcagcttgcctcacagtggtaaaaataagcatttttttgttttgtaggatcagggagcttccaaggcatttgatacctttttgatgggaagaagggctctgaggagctccaagataccccaacctccaggcccttcattagggggtagttgggtttctgtttggcctttccccctgggccccataggcttaaactacccccacccccacctccgcctcctacctcagctgggagcactgtcttccatggggcttccacttctctcctcaacctggggaagaccacagggcagtgcctgcctcaggacctgccttccccaaaagctggcttcttgctccaaggagagagcattgacccacctgccagagtcttgccttttgcccaaaggagcctggtcttcagggctgcataggatagggtctgttcctggtttcccagatgcataaaggaagacatatccctcccctgggcagcaaggctacaatgggagggagggagaacatgggagcatgtgaataaaatggcattaaatactgaaccagggagtccagcctc

SEQ ID NO: 418408 - DNA, 1388 bp, Homo sapiens
cgcgcgcacacacacaaacacaaacacacaccccaacacacacgccctgtcccctttctccaccctgcaagctagttgcatttagctcacagagcctgggctgcgacttgaaagagtttaggcagcaacagagtgaccctgggggtgctcttgaccgacagccgcacccccggcgtctaggacctccgagcagggatgcatctggaggtctagggaagcacttccaccccctcctctcctcaatcctggcaggatgtgcccgaaatgccagctcctccttggtgttctcctttcaggatttgaattcaaatcccattggcagccctgataccgctgggggaagggtgagtgagccattcctctcccttggaattcatcagagtcatccctgtagagcccccttcctgcctctcaattcctcctgcctcacttcccaggctactgctgcttcaagacagtgacgtttctctccggtcagctgtcaggagcgctgctgggtcttactggggatctggccagccttgggggcccttggagccctggcccagtggaagctcgtgcctgaggaacatggaggccacgctaatgagacagggtctccctatgttgcccaagctggtcttgaactcctgggctcaagtgatcctcctgcttcagcctcccaaagtgctaggattatagccaccgcacctcgtcttgaaatagccttttaaatgttcacctcagcttgcctcacagtggtaaaaataagcatttttttgttttgtaggatcagggagcttccaaggcatttgatacctttttgatgggaagaagggctctgaggagctccaagataccccaacctccaggcccttcattagggggtagttgggtttctgtttggcctttccccctgggccccataggcttaaactacccccacccccacctccgcctcctacctcagctgggagcactgtcttccatggggcttccacttctctcctcaacctggggaagaccacagggcagtgcctgcctcaggacctgccttccccaaaagctggcttcttgctccaaggagagagcattgacccacctgccagagtcttgccttttgcccaaaggagcctggtcttcagggctgcataggatgcaagtgccttctctgcttctcaccgtgggtggcactaatttcctccttaaccagaactttgttccagccactgacccattctaactcttccccctctgactctcctgcgcagggtctgttcctggtttcccagatgcataaaggaagacatatccctcccctgggcagcaaggctacaatgggagggagggagaacatgggagcatgtgaataaaatggcattaaatactgaaccagggagtccagcctc

SEQ ID NO: 418409 - DNA, 3127 bp, Homo sapiens
cgcttgtccagggtccccagacttccaagcagattgaggagaggagctccgagagtcaaccctccagcctgtaaggaccttgatatccaaaggacagctgaagaaagtaatgtgcctgcatttttgccacttcattcccacagtgcccgaaatgccagctcctccttggtgttctcctttcaggatttgaattcaaatcccattggcagccctgataccgctgggggaagggtgaggtaggaaaagtcccaccaatatcctaaggggaggtgcgagtggctaccaggatgtgagatgtctgtgggcaaagtccctgcttattccatgaggggctgtgggattaggactgtggctggatgcctcttcctccaacaactccatctcaggatgaagctgaggctttaaaaccctgacaaactgtgggtgactgtctctacttaattcctcctcccaaactcttggtgtctggttttttccctctttctgccctgggcctggagcagctgtccagagacccccaccatgactcatactctcctgttctccctccctctcccctctctattaacctcacccttcccaatccagtggggtagtattaagtcccagtcgcagatggggcaataatgtcccagcacccctccctccacacacccagggcttcctgttctttccaccctcaccctgaagagctgcagggtggtggggggaggcaaaggctcattactttataagattttcattactttataagatttcattttacattttacttaagtgtacttgtttcagagagtggtaaagacagatcctgctcctctcaatccaatcctgtagatttcttcagttacctcaacagggtcatactggctcctgaaatgggcaccattatttaaaagaaatagaggtacagagtcctcaagatttatgggcacctgagtttctgccccgtgccccgctgcaggtttcccaatcccctaaagacattcatggatgggtgagaggagctgacacctcccgctctgtgaccactttctctttggccatggaggaagtcttgctgcccctggctgtgacatctgaccccaggccctttaatcaacaactcccagagcctccagacccaagatgtgttttggaaccccaggacaatcctgaactggcacttgccctggtgtgtgccctttgctgctgctttggaatcatctactgctgcttcagtgagggcagggccaaggacctggggggccattgcccaagactgtcatcctcaaggatgatgccagctttcctccttgctcctgggccatctcacctcctctgccaggggttcctacctctagtgtggcccatgttgctctggctgtattcctaggcccatgttgctcttgccagcttcttgtccatcctccatgcccatgccttccagctttcacctctggcatctatcatttgctcttctcttaactcctacctgaaaaccccattcctaaattattcactatatttcagacttcttcactcttctccaaaaacctgaatcagcttgtgctgattttttcctatctgctatccctaaaaggactagaccttctttctatccttactcccctcaatgtatccatcttacctcttgattttccctcccattccctcacagttcctgaaacagtgcccccccccgaccctaagcgacccctttctgcccctggccttgaggtcccttgacgtgctgctcctgtcttctgctcctctagtgagccattcctctcccttggaattcatcagagtcatccctgtagagcccccttcctgcctctcaattcctcctgcctcacttcccaggctactgctgcttcaagacagtgacgtttctctccggtcagctgtcaggagcgctggtgagcttcctactgtgccacaaggtgcgggtgctggagacacagctgagcctggaaatgagagtgggcatcgccgtggtcatcatgactcctctgcggcgtggtcaccatgttggttcactgtgttgggctcttattgacgggtctcctgctaggcctgaccttgggtgccggagccctgctggcttctgagcctatctaccaaccaccttcagcctgggtgccagctggggggctggtggggctggcgctgctgggagccctgctcacacttcggtggccacgtccattcacagttctgggcacaaccctgctgggttctgcagtgcttgtggcctgtgttgactacttcctggaggggctggcactggggagttggctgggccaacgcctgcagacacttccagccttgccttctctctgctgatatagctgggtcttactggggatctggccagccttgggggcccttggagccctggcccagtggaagctcgtgcctgaggaacatggaggccacgctaatgagttacttccagagtcttcaagagtgccaactgggaccaggaccccagaccacagccccccacaccgtcctggacctggattctgactgtggttccactgtacccctcaccttaatctctggttctaaccagacctgagcctagacttccactttttcccttacccctgtgagggcctgggaacactaggtgggcagggtttgagcccacaggacctgcacacaaacttccccacctcttggacttggggacaggatctgtgcctcaacccagaccagctttgtagggatatgttccaagaacagagaagagtcttatggggaagggggaggaagggaagtatgaatatttacctccgcctcctacctcagctgggagcactgtcttccatggggcttccacttctctcctcaacctggggaagaccacagggcagtgcctgcctcaggacctgccttccccaaaagctggcttcttgctccaaggagagagcattgacccacctgccagagtcttgccttttgcccaaaggagcctggtcttcagggctgcataggatagggtctgttcctggtttcccagatgcataaaggaagacatatccctcccctgggcagcaaggctacaatgggagggagggagaacatgggagcatgtgaataaaatggcattaaatactgaaccagggagtccagcctc

SEQ ID NO: 418410 - DNA, 2288 bp, Homo sapiens
cgcttgtccagggtccccagacttccaagcagattgaggagaggagctccgagagtcaaccctccagcctgtaaggaccttgatatccaaaggacagctgaagaaagtaatgtgcctgcatttttgccacttcattcccacagtgcccgaaatgccagctcctccttggtgttctcctttcaggatttgaattcaaatcccattggcagccctgataccgctgggggaagggtgaggtaggaaaagtcccaccaatatcctaaggggaggtgcgagtggctaccaggatgtgagatgtctgtgggcaaagtccctgcttattccatgaggggctgtgggattaggactgtggctggatgcctcttcctccaacaactccatctcaggatgaagctgaggctttaaaaccctgacaaactgtgggtgactgtctctacttaattcctcctcccaaactcttggtgtctggttttttccctctttctgccctgggcctggagcagctgtccagagacccccaccatgactcatactctcctgttctccctccctctcccctctctattaacctcacccttcccaatccagtggggtagtattaagtcccagtcgcagatggggcaataatgtcccagcacccctccctccacacacccagggcttcctgttctttccaccctcaccctgaagagctgcagggtggtggggggaggcaaaggctcattactttataagattttcattactttataagatttcattttacattttacttaagtgtacttgtttcagagagtggtaaagacagatcctgctcctctcaatccaatcctgtagatttcttcagttacctcaacagggtcatactggctcctgaaatgggcaccattatttaaaagaaatagaggtacagagtcctcaagatttatgggcacctgagtttctgccccgtgccccgctgcaggtttcccaatcccctaaagacattcatggatgggtgagaggagctgacacctcccgctctgtgaccactttctctttggccatggaggaagtcttgctgcccctggctgtgacatctgaccccaggccctttaatcaacaactcccagagcctccagacccaagatgtgttttggaaccccaggacaatcctgaactggcacttgccctggtgtgtgccctttgctgctgctttggaatcatctactgctgcttcagtgagggcagggccaaggacctggggggccattgcccaagactgtcatcctcaaggatgatgccagctttcctccttgctcctgggccatctcacctcctctgccaggggttcctacctctagtgtggcccatgttgctctggctgtattcctaggcccatgttgctcttgccagcttcttgtccatcctccatgcccatgccttccagctttcacctctggcatctatcatttgctcttctcttaactcctacctgaaaaccccattcctaaattattcactatatttcagacttcttcactcttctccaaaaacctgaatcagcttgtgctgattttttcctatctgctatccctaaaaggactagaccttctttctatccttactcccctcaatgtatccatcttacctcttgattttccctcccattccctcacagttcctgaaacagtgcccccccccgaccctaagcgacccctttctgcccctggccttgaggtcccttgacgtgctgctcctgtcttctgctcctctagtgagccattcctctcccttggaattcatcagagtcatccctgtagagcccccttcctgcctctcaattcctcctgcctcacttcccaggctactgctgcttcaagacagtgacgtttctctccggtcagctgtcaggagcgctgctgggtcttactggggatctggccagccttgggggcccttggagccctggcccagtggaagctcgtgcctgaggaacatggaggccacgctaatgagacagggtctccctatgttgcccaagctggtcttgaactcctgggctcaagtgatcctcctgcttcagcctcccaaagtgctaggattatagccaccgcacctcgtcttgaaatagccttttaaatgttcacctcagcttgcctcacagtgagggtctgttcctggtttcccagatgcataaaggaagacatatccctcccctgggcagcaaggctacaatgggagggagggagaacatgggagcatgtgaataaaatggcattaaatactgaaccagggagtccagcctc

SEQ ID NO: 418411 - DNA, 780 bp, Homo sapiens
cgcgcgcacacacacaaacacaaacacacaccccaacacacacgccctgtcccctttctccaccctgcaagctagttgcatttagctcacagagcctgggctgcgacttgaaagagtttaggcagcaacagagtgaccctgggggtgctcttgaccgacagccgcacccccggcgtctaggacctccgagcagggatgcatctggaggtctagggaagcacttccaccccctcctctcctcaatcctggcaggatgtgcccgaaatgccagctcctccttggtgttctcctttcaggatttgaattcaaatcccattggcagccctgataccgctgggggaagggtgagctgggtcttactggggatctggccagccttgggggcccttggagccctggcccagtggaagctcgtgcctgaggaacatggaggccacgctaatgagttacttccagagtcttcaagagtgccaactgggaccaggaccccagaccacagccccccacaccgtcctggacctggattctgactgtggttccactgatcagggagcttccaaggcatttgatacctttttgatgggaagaagggctctgaggagctccaagataccccaacctccaggcccttcattaggggagggtctgttcctggtttcccagatgcataaaggaagacatatccctcccctgggcagcaaggctacaatgggagggagggagaacatgggagcatgtgaataaaatggcattaaatactgaaccagggagtccagcctc

SEQ ID NO: 418412 - DNA, 3954 bp, Homo sapiens
cgcgcgcacacacacaaacacaaacacacaccccaacacacacgccctgtcccctttctccaccctgcaagctagttgcatttagctcacagagcctgggctgcgacttgaaagagtttaggcagcaacagagtgaccctgggggtgctcttgaccgacagccgcacccccggcgtctaggacctccgagcagggatgcatctggaggtctagggaagcacttccaccccctcctctcctcaatcctggcaggatgtgcccgaaatgccagctcctccttggtgttctcctttcaggatttgaattcaaatcccattggcagccctgataccgctgggggaagggtgaggtaggaaaagtcccaccaatatcctaaggggaggtgcgagtggctaccaggatgtgagatgtctgtgggcaaagtccctgcttattccatgaggggctgtgggattaggactgtggctggatgcctcttcctccaacaactccatctcaggatgaagctgaggctttaaaaccctgacaaactgtgggtgactgtctctacttaattcctcctcccaaactcttggtgtctggttttttccctctttctgccctgggcctggagcagctgtccagagacccccaccatgactcatactctcctgttctccctccctctcccctctctattaacctcacccttcccaatccagtggggtagtattaagtcccagtcgcagatggggcaataatgtcccagcacccctccctccacacacccagggcttcctgttctttccaccctcaccctgaagagctgcagggtggtggggggaggcaaaggctcattactttataagattttcattactttataagatttcattttacattttacttaagtgtacttgtttcagagagtggtaaagacagatcctgctcctctcaatccaatcctgtagatttcttcagttacctcaacagggtcatactggctcctgaaatgggcaccattatttaaaagaaatagaggtacagagtcctcaagatttatgggcacctgagtttctgccccgtgccccgctgcaggtttcccaatcccctaaagacattcatggatgggtgagaggagctgacacctcccgctctgtgaccactttctctttggccatggaggaagtcttgctgcccctggctgtgacatctgaccccaggccctttaatcaacaactcccagagcctccagacccaagatgtgttttggaaccccaggacaatcctgaactggcacttgccctggtgtgtgccctttgctgctgctttggaatcatctactgctgcttcagtgagggcagggccaaggacctggggggccattgcccaagactgtcatcctcaaggatgatgccagctttcctccttgctcctgggccatctcacctcctctgccaggggttcctacctctagtgtggcccatgttgctctggctgtattcctaggcccatgttgctcttgccagcttcttgtccatcctccatgcccatgccttccagctttcacctctggcatctatcatttgctcttctcttaactcctacctgaaaaccccattcctaaattattcactatatttcagacttcttcactcttctccaaaaacctgaatcagcttgtgctgattttttcctatctgctatccctaaaaggactagaccttctttctatccttactcccctcaatgtatccatcttacctcttgattttccctcccattccctcacagttcctgaaacagtgcccccccccgaccctaagcgacccctttctgcccctggccttgaggtcccttgacgtgctgctcctgtcttctgctcctctagtgagccattcctctcccttggaattcatcagagtcatccctgtagagcccccttcctgcctctcaattcctcctgcctcacttcccaggctactgctgcttcaagacagtgacgtttctctccggtcagctgtcaggagcgctggtgagcttcctactgtgccacaaggtgcgggtgctggagacacagctgagcctggaaatgagagtgggcatcgccgtggtcatcatgactcctctgcggcgtggtcaccatgttggttcactgtgttgggctcttattgacgggtctcctgctaggcctgaccttgggtgccggagccctgctggcttctgagcctatctaccaaccaccttcagcctgggtgccagctggggggctggtggggctggcgctgctgggagccctgctcacacttcggtggccacgtccattcacagttctgggcacaaccctgctgggttctgcagtgcttgtggcctgtgttgactacttcctggaggggctggcactggggagttggctgggccaacgcctgcagacacttccagccttgccttctctctgctgatatagctgggtcttactggggatctggccagccttgggggcccttggagccctggcccagtggaagctcgtgcctgaggaacatggaggccacgctaatgagttacttccagagtcttcaagagtgccaactgggaccaggaccccagaccacagccccccacaccgtcctggacctggattctgactgtggttccactgtacccctcaccttaatctctggttctaaccagacctgagcctagacttccactttttcccttacccctgtgagggcctgggaacactaggtgggcagggtttgagcccacaggacctgcacacaaacttccccacctcttggacttggggacaggatctgtgcctcaacccagaccagctttgtagggatatgttccaagaacagagaagagtcttatggggaagggggaggaagggaagtatgaatatttacctctgaccaataatagaggtgccctggtccccaaagaaattgactcccgaattccctccaagccttacccatatagcttttgtttgtttgtttgttttcagacaaggtcttgttctgtccagtgccgtggcgtgaccacagctcatgacaactttgatttccccggcccaagcgagcctctcattcagcctcctgagtggctgggaccacagacgccacacacagctaatttttatgtattcgtttttatttttttgcagagacagggtctccctatgttgcccaagctggtcttgaactcctgggctcaagtgatcctcctgcttcagcctcccaaagtgctaggattatagccaccgcacctcgtcttgaaatagccttttaaatgttcacctcagcttgcctcacagtggtaaaaataagcatttttttgttttgtaggatcagggagcttccaaggcatttgatacctttttgatgggaagaagggctctgaggagctccaagataccccaacctccaggcccttcattagggggtagttgggtttctgtttggcctttccccctgggccccataggcttaaactacccccacccccacctccgcctcctacctcagctgggagcactgtcttccatggggcttccacttctctcctcaacctggggaagaccacagggcagtgcctgcctcaggacctgccttccccaaaagctggcttcttgctccaaggagagagcattgacccacctgccagagtcttgccttttgcccaaaggagcctggtcttcagggctgcataggatgcaagtgccttctctgcttctcaccgtgggtggcactaatttcctccttaaccagaactttgttccagccactgacccattctaactcttccccctctgactctcctgcgcagggtctgttcctggtttcccagatgcataaaggaagacatatccctcccctgggcagcaaggctacaatgggagggagggagaacatgggagcatgtgaataaaatggcattaaatactgaaccagggagtccagcctc

SEQ ID NO: 418413 - DNA, 1820 bp, Homo sapiens
cgcgcgcacacacacaaacacaaacacacaccccaacacacacgccctgtcccctttctccaccctgcaagctagttgcatttagctcacagagcctgggctgcgacttgaaagagtttaggcagcaacagagtgaccctgggggtgctcttgaccgacagccgcacccccggcgtctaggacctccgagcagggatgcatctggaggtctagggaagcacttccaccccctcctctcctcaatcctggcaggatggctactgctgcttcaagacagtgacgtttctctccggtcagctgtcaggagcgctgctgggtcttactggggatctggccagccttgggggcccttggagccctggcccagtggaagctcgtgcctgaggaacatggaggccacgctaatgagttacttccagagtcttcaagagtgccaactgggaccaggaccccagaccacagccccccacaccgtcctggacctggattctgactgtggttccactgtacccctcaccttaatctctggttctaaccagacctgagcctagacttccactttttcccttacccctgtgagggcctgggaacactaggtgggcagggtttgagcccacaggacctgcacacaaacttccccacctcttggacttggggacaggatctgtgcctcaacccagaccagctttgtagggatatgttccaagaacagagaagagtcttatggggaagggggaggaagggaagtatgaatatttacctctgaccaataatagaggtgccctggtccccaaagaaattgactcccgaattccctccaagccttacccatatagcttttgtttgtttgtttgttttcagacaaggtcttgttctgtccagtgccgtggcgtgaccacagctcatgacaactttgatttccccggcccaagcgagcctctcattcagcctcctgagtggctgggaccacagacgccacacacagctaatttttatgtattcgtttttatttttttgcagagacagggtctccctatgttgcccaagctggtcttgaactcctgggctcaagtgatcctcctgcttcagcctcccaaagtgctaggattatagccaccgcacctcgtcttgaaatagccttttaaatgttcacctcagcttgcctcacagtggtaaaaataagcatttttttgttttgtaggatcagggagcttccaaggcatttgatacctttttgatgggaagaagggctctgaggagctccaagataccccaacctccaggcccttcattagggggtagttgggtttctgtttggcctttccccctgggccccataggcttaaactacccccacccccacctccgcctcctacctcagctgggagcactgtcttccatggggcttccacttctctcctcaacctggggaagaccacagggcagtgcctgcctcaggacctgccttccccaaaagctggcttcttgctccaaggagagagcattgacccacctgccagagtcttgccttttgcccaaaggagcctggtcttcagggctgcataggatgcaagtgccttctctgcttctcaccgtgggtggcactaatttcctccttaaccagaactttgttccagccactgacccattctaactcttccccctctgactctcctgcgcagggtctgttcctggtttcccagatgcataaaggaagacatatccctcccctgggcagcaaggctacaatgggagggagggagaacatgggagcatgtgaataaaatggcattaaatactgaaccagggagtccagcctc

SEQ ID NO: 418414 - DNA, 1857 bp, Homo sapiens
cgcgcgcacacacacaaacacaaacacacaccccaacacacacgccctgtcccctttctccaccctgcaagctagttgcatttagctcacagagcctgggctgcgacttgaaagagtttaggcagcaacagagtgaccctgggggtgctcttgaccgacagccgcacccccggcgtctaggacctccgagcagggatgcatctggaggtctagggaagcacttccaccccctcctctcctcaatcctggcaggatgtgcccgaaatgccagctcctccttggtgttctcctttcaggatttgaattcaaatcccattggcagccctgataccgctgggggaagggtgagctgggtcttactggggatctggccagccttgggggcccttggagccctggcccagtggaagctcgtgcctgaggaacatggaggccacgctaatgagttacttccagagtcttcaagagtgccaactgggaccaggaccccagaccacagccccccacaccgtcctggacctggattctgactgtggttccactgtacccctcaccttaatctctggttctaaccagacctgagcctagacttccactttttcccttacccctgtgagggcctgggaacactaggtgggcagggtttgagcccacaggacctgcacacaaacttccccacctcttggacttggggacaggatctgtgcctcaacccagaccagctttgtagggatatgttccaagaacagagaagagtcttatggggaagggggaggaagggaagtatgaatatttacctctgaccaataatagaggtgccctggtccccaaagaaattgactcccgaattccctccaagccttacccatatagcttttgtttgtttgtttgttttcagacaaggtcttgttctgtccagtgccgtggcgtgaccacagctcatgacaactttgatttccccggcccaagcgagcctctcattcagcctcctgagtggctgggaccacagacgccacacacagctaatttttatgtattcgtttttatttttttgcagagacagggtctccctatgttgcccaagctggtcttgaactcctgggctcaagtgatcctcctgcttcagcctcccaaagtgctaggattatagccaccgcacctcgtcttgaaatagccttttaaatgttcacctcagcttgcctcacagtggtaaaaataagcatttttttgttttgtaggatcagggagcttccaaggcatttgatacctttttgatgggaagaagggctctgaggagctccaagataccccaacctccaggcccttcattagggggtagttgggtttctgtttggcctttccccctgggccccataggcttaaactacccccacccccacctccgcctcctacctcagctgggagcactgtcttccatggggcttccacttctctcctcaacctggggaagaccacagggcagtgcctgcctcaggacctgccttccccaaaagctggcttcttgctccaaggagagagcattgacccacctgccagagtcttgccttttgcccaaaggagcctggtcttcagggctgcataggatgcaagtgccttctctgcttctcaccgtgggtggcactaatttcctccttaaccagaactttgttccagccactgacccattctaactcttccccctctgactctcctgcgcagggtctgttcctggtttcccagatgcataaaggaagacatatccctcccctgggcagcaaggctacaatgggagggagggagaacatgggagcatgtgaataaaatggcattaaatactgaaccagggagtccagcctc

SEQ ID NO: 418415 - DNA, 1913 bp, Homo sapiens
cgcgcgcacacacacaaacacaaacacacaccccaacacacacgccctgtcccctttctccaccctgcaagctagttgcatttagctcacagagcctgggctgcgacttgaaagagtttaggcagcaacagagtgaccctgggggtgctcttgaccgacagccgcacccccggcgtctaggacctccgagcagggatgcatctggaggtctagggaagcacttccaccccctcctctcctcaatcctggcaggatgtgcccgaaatgccagctcctccttggtgttctcctttcaggatttgaattcaaatcccattggcagccctgataccgctgggggaagggtgaggctactgctgcttcaagacagtgacgtttctctccggtcagctgtcaggagcgctgctgggtcttactggggatctggccagccttgggggcccttggagccctggcccagtggaagctcgtgcctgaggaacatggaggccacgctaatgagttacttccagagtcttcaagagtgccaactgggaccaggaccccagaccacagccccccacaccgtcctggacctggattctgactgtggttccactgtacccctcaccttaatctctggttctaaccagacctgagcctagacttccactttttcccttacccctgtgagggcctgggaacactaggtgggcagggtttgagcccacaggacctgcacacaaacttccccacctcttggacttggggacaggatctgtgcctcaacccagaccagctttgtagggatatgttccaagaacagagaagagtcttatggggaagggggaggaagggaagtatgaatatttacctctgaccaataatagaggtgccctggtccccaaagaaattgactcccgaattccctccaagccttacccatatagcttttgtttgtttgtttgttttcagacaaggtcttgttctgtccagtgccgtggcgtgaccacagctcatgacaactttgatttccccggcccaagcgagcctctcattcagcctcctgagtggctgggaccacagacgccacacacagctaatttttatgtattcgtttttatttttttgcagagacagggtctccctatgttgcccaagctggtcttgaactcctgggctcaagtgatcctcctgcttcagcctcccaaagtgctaggattatagccaccgcacctcgtcttgaaatagccttttaaatgttcacctcagcttgcctcacagtggtaaaaataagcatttttttgttttgtaggatcagggagcttccaaggcatttgatacctttttgatgggaagaagggctctgaggagctccaagataccccaacctccaggcccttcattagggggtagttgggtttctgtttggcctttccccctgggccccataggcttaaactacccccacccccacctccgcctcctacctcagctgggagcactgtcttccatggggcttccacttctctcctcaacctggggaagaccacagggcagtgcctgcctcaggacctgccttccccaaaagctggcttcttgctccaaggagagagcattgacccacctgccagagtcttgccttttgcccaaaggagcctggtcttcagggctgcataggatgcaagtgccttctctgcttctcaccgtgggtggcactaatttcctccttaaccagaactttgttccagccactgacccattctaactcttccccctctgactctcctgcgcagggtctgttcctggtttcccagatgcataaaggaagacatatccctcccctgggcagcaaggctacaatgggagggagggagaacatgggagcatgtgaataaaatggcattaaatactgaaccagggagtccagcctc

SEQ ID NO: 418416 - DNA, 3755 bp, Homo sapiens
cgcttgtccagggtccccagacttccaagcagattgaggagaggagctccgagagtcaaccctccagcctgtaaggaccttgatatccaaaggacagctgaagaaagtaatgtgcctgcatttttgccacttcattcccacagtgcccgaaatgccagctcctccttggtgttctcctttcaggatttgaattcaaatcccattggcagccctgataccgctgggggaagggtgaggtaggaaaagtcccaccaatatcctaaggggaggtgcgagtggctaccaggatgtgagatgtctgtgggcaaagtccctgcttattccatgaggggctgtgggattaggactgtggctggatgcctcttcctccaacaactccatctcaggatgaagctgaggctttaaaaccctgacaaactgtgggtgactgtctctacttaattcctcctcccaaactcttggtgtctggttttttccctctttctgccctgggcctggagcagctgtccagagacccccaccatgactcatactctcctgttctccctccctctcccctctctattaacctcacccttcccaatccagtggggtagtattaagtcccagtcgcagatggggcaataatgtcccagcacccctccctccacacacccagggcttcctgttctttccaccctcaccctgaagagctgcagggtggtggggggaggcaaaggctcattactttataagattttcattactttataagatttcattttacattttacttaagtgtacttgtttcagagagtggtaaagacagatcctgctcctctcaatccaatcctgtagatttcttcagttacctcaacagggtcatactggctcctgaaatgggcaccattatttaaaagaaatagaggtacagagtcctcaagatttatgggcacctgagtttctgccccgtgccccgctgcaggtttcccaatcccctaaagacattcatggatgggtgagaggagctgacacctcccgctctgtgaccactttctctttggccatggaggaagtcttgctgcccctggctgtgacatctgaccccaggccctttaatcaacaactcccagagcctccagacccaagatgtgttttggaaccccaggacaatcctgaactggcacttgccctggtgtgtgccctttgctgctgctttggaatcatctactgctgcttcagtgagggcagggccaaggacctggggggccattgcccaagactgtcatcctcaaggatgatgccagctttcctccttgctcctgggccatctcacctcctctgccaggggttcctacctctagtgtggcccatgttgctctggctgtattcctaggcccatgttgctcttgccagcttcttgtccatcctccatgcccatgccttccagctttcacctctggcatctatcatttgctcttctcttaactcctacctgaaaaccccattcctaaattattcactatatttcagacttcttcactcttctccaaaaacctgaatcagcttgtgctgattttttcctatctgctatccctaaaaggactagaccttctttctatccttactcccctcaatgtatccatcttacctcttgattttccctcccattccctcacagttcctgaaacagtgcccccccccgaccctaagcgacccctttctgcccctggccttgaggtcccttgacgtgctgctcctgtcttctgctcctctagtgagccattcctctcccttggaattcatcagagtcatccctgtagagcccccttcctgcctctcaattcctcctgcctcacttcccaggctactgctgcttcaagacagtgacgtttctctccggtcagctgtcaggagcgctggtgagcttcctactgtgccacaaggtgcgggtgctggagacacagctgagcctggaaatgagagtgggcatcgccgtggtcatcatgactcctctgcggcgtggtcaccatgttggttcactgtgttgggctcttattgacgggtctcctgctaggcctgaccttgggtgccggagccctgctggcttctgagcctatctaccaaccaccttcagcctgggtgccagctggggggctggtggggctggcgctgctgggagccctgctcacacttcggtggccacgtccattcacagttctgggcacaaccctgctgggttctgcagtgcttgtggcctgtgttgactacttcctggaggggctggcactggggagttggctgggccaacgcctgcagacacttccagccttgccttctctctgctgatatagctgggtcttactggggatctggccagccttgggggcccttggagccctggcccagtggaagctcgtgcctgaggaacatggaggccacgctaatgagttacttccagagtcttcaagagtgccaactgggaccaggaccccagaccacagccccccacaccgtcctggacctggattctgactgtggttccactgtacccctcaccttaatctctggttctaaccagacctgagcctagacttccactttttcccttacccctgtgagggcctgggaacactaggtgggcagggtttgagcccacaggacctgcacacaaacttccccacctcttggacttggggacaggatctgtgcctcaacccagaccagctttgtagggatatgttccaagaacagagaagagtcttatggggaagggggaggaagggaagtatgaatatttacctctgaccaataatagaggtgccctggtccccaaagaaattgactcccgaattccctccaagccttacccatatagcttttgtttgtttgtttgttttcagacaaggtcttgttctgtccagtgccgtggcgtgaccacagctcatgacaactttgatttccccggcccaagcgagcctctcattcagcctcctgagtggctgggaccacagacgccacacacagctaatttttatgtattcgtttttatttttttgcagagacagggtctccctatgttgcccaagctggtcttgaactcctgggctcaagtgatcctcctgcttcagcctcccaaagtgctaggattatagccaccgcacctcgtcttgaaatagccttttaaatgttcacctcagcttgcctcacagtggtaaaaataagcatttttttgttttgtaggatcagggagcttccaaggcatttgatacctttttgatgggaagaagggctctgaggagctccaagataccccaacctccaggcccttcattagggggtagttgggtttctgtttggcctttccccctgggccccataggcttaaactacccccacccccacctccgcctcctacctcagctgggagcactgtcttccatggggcttccacttctctcctcaacctggggaagaccacagggcagtgcctgcctcaggacctgccttccccaaaagctggcttcttgctccaaggagagagcattgacccacctgccagagtcttgccttttgcccaaaggagcctggtcttcagggctgcataggatgcaagtgccttctctgcttctcaccagggtctgttcctggtttcccagatgcataaaggaagacatatccctcccctgggcagcaaggctacaatgggagggagggagaacatgggagcatgtgaataaaatggcattaaatactgaaccagggagtccagcctc

SEQ ID NO: 418417 - DNA, 1215 bp, Homo sapiens
agcgcggtgactctgaggatcccaactcagggcgagcctcttggacttggggacaggatctgtgcctcaacccagaccagctttgtagggatatgttccaagaacagagaagagtcttatggggaagggggaggaagggaagtatgaatatttacctctgaccaataatagaggtgccctggtccccaaagaaattgactcccgaattccctccaagccttacccatatagcttttgtttgtttgtttgttttcagacaaggtcttgttctgtccagtgccgtggcgtgaccacagctcatgacaactttgatttccccggcccaagcgagcctctcattcagcctcctgagtggctgggaccacagacgccacacacagctaatttttatgtattcgtttttatttttttgcagagacagggtctccctatgttgcccaagctggtcttgaactcctgggctcaagtgatcctcctgcttcagcctcccaaagtgctaggattatagccaccgcacctcgtcttgaaatagccttttaaatgttcacctcagcttgcctcacagtggtaaaaataagcatttttttgttttgtaggatcagggagcttccaaggcatttgatacctttttgatgggaagaagggctctgaggagctccaagataccccaacctccaggcccttcattagggggtagttgggtttctgtttggcctttccccctgggccccataggcttaaactacccccacccccacctccgcctcctacctcagctgggagcactgtcttccatggggcttccacttctctcctcaacctggggaagaccacagggcagtgcctgcctcaggacctgccttccccaaaagctggcttcttgctccaaggagagagcattgacccacctgccagagtcttgccttttgcccaaaggagcctggtcttcagggctgcataggatgcaagtgccttctctgcttctcaccgtgggtggcactaatttcctccttaaccagaactttgttccagccactgacccattctaactcttccccctctgactctcctgcgcagggtctgttcctggtttcccagatgcataaaggaagacatatccctcccctgggcagcaaggctacaatgggagggagggagaacatgggagcatgtgaataaaatggcattaaatactgaaccagggagtccagcctc

SEQ ID NO: 418418 - DNA, 3333 bp, Homo sapiens
cgcttgtccagggtccccagacttccaagcagattgaggagaggagctccgagagtcaaccctccagcctgtaaggaccttgatatccaaaggacagctgaagaaagtaatgtgcctgcatttttgccacttcattcccacagtgcccgaaatgccagctcctccttggtgttctcctttcaggatttgaattcaaatcccattggcagccctgataccgctgggggaagggtgaggtaggaaaagtcccaccaatatcctaaggggaggtgcgagtggctaccaggatgtgagatgtctgtgggcaaagtccctgcttattccatgaggggctgtgggattaggactgtggctggatgcctcttcctccaacaactccatctcaggatgaagctgaggctttaaaaccctgacaaactgtgggtgactgtctctacttaattcctcctcccaaactcttggtgtctggttttttccctctttctgccctgggcctggagcagctgtccagagacccccaccatgactcatactctcctgttctccctccctctcccctctctattaacctcacccttcccaatccagtggggtagtattaagtcccagtcgcagatggggcaataatgtcccagcacccctccctccacacacccagggcttcctgttctttccaccctcaccctgaagagctgcagggtggtggggggaggcaaaggctcattactttataagattttcattactttataagatttcattttacattttacttaagtgtacttgtttcagagagtggtaaagacagatcctgctcctctcaatccaatcctgtagatttcttcagttacctcaacagggtcatactggctcctgaaatgggcaccattatttaaaagaaatagaggtacagagtcctcaagatttatgggcacctgagtttctgccccgtgccccgctgcaggtttcccaatcccctaaagacattcatggatgggtgagaggagctgacacctcccgctctgtgaccactttctctttggccatggaggaagtcttgctgcccctggctgtgacatctgaccccaggccctttaatcaacaactcccagagcctccagacccaagatgtgttttggaaccccaggacaatcctgaactggcacttgccctggtgtgtgccctttgctgctgctttggaatcatctactgctgcttcagtgagggcagggccaaggacctggggggccattgcccaagactgtcatcctcaaggatgatgccagctttcctccttgctcctgggccatctcacctcctctgccaggggttcctacctctagtgtggcccatgttgctctggctgtattcctaggcccatgttgctcttgccagcttcttgtccatcctccatgcccatgccttccagctttcacctctggcatctatcatttgctcttctcttaactcctacctgaaaaccccattcctaaattattcactatatttcagacttcttcactcttctccaaaaacctgaatcagcttgtgctgattttttcctatctgctatccctaaaaggactagaccttctttctatccttactcccctcaatgtatccatcttacctcttgattttccctcccattccctcacagttcctgaaacagtgcccccccccgaccctaagcgacccctttctgcccctggccttgaggtcccttgacgtgctgctcctgtcttctgctcctctagtgagccattcctctcccttggaattcatcagagtcatccctgtagagcccccttcctgcctctcaattcctcctgcctcacttcccaggctactgctgcttcaagacagtgacgtttctctccggtcagctgtcaggagcgctggtgagcttcctactgtgccacaaggtgcgggtgctggagacacagctgagcctggaaatgagagtgggcatcgccgtggtcatcatgactcctctgcggcgtggtcaccatgttggttcactgtgttgggctcttattgacgggtctcctgctaggcctgaccttgggtgccggagccctgctggcttctgagcctatctaccaaccaccttcagcctgggtgccagctggggggctggtggggctggcgctgctgggagccctgctcacacttcggtggccacgtccattcacagttctgggcacaaccctgctgggttctgcagtgcttgtggcctgtgttgactacttcctggaggggctggcactggggagttggctgggccaacgcctgcagacacttccagccttgccttctctctgctgatatagctgggtcttactggggatctggccagccttgggggcccttggagccctggcccagtggaagctcgtgcctgaggaacatggaggccacgctaatgagttacttccagagtcttcaagagtgccaactgggaccaggaccccagaccacagccccccacaccgtcctggacctggattctgactgtggttccactgtacccctcaccttaatctctggttctaaccagacctgagcctagacttccactttttcccttacccctgtgagggcctgggaacactaggtgggcagggtttgagcccacaggacctgcacacaaacttccccacctcttggacttggggacaggatctgtgcctcaacccagaccagctttgtagggatatgttccaagaacagagaagagtcttatggggaagggggaggaagggaagtatgaatatttacctctgaccaataatagaggtgccctggtccccaaagaaattgactcccgaattccctccaagccttacccatatagcttttgtttgtttgtttgttttcagacaaggtcttgttctgtccagtgccgtggcgtgaccacagctcatgacaactttgatttccccggcccaagcgagcctctcattcagcctcctgagtggctgggaccacagacgccacacacagctaatttttatgtattcgtttttatttttttgcagagacagggtctccctatgttgcccaagctggtcttgaactcctgggctcaagtgatcctcctgcttcagcctcccaaagtgctaggattatagccaccgcacctcgtcttgaaatagccttttaaatgttcacctcagcttgcctcacagtgagggtctgttcctggtttcccagatgcataaaggaagacatatccctcccctgggcagcaaggctacaatgggagggagggagaacatgggagcatgtgaataaaatggcattaaatactgaaccagggagtccagcctc

SEQ ID NO: 418419 - DNA, 2568 bp, Homo sapiens
cgcttgtccagggtccccagacttccaagcagattgaggagaggagctccgagagtcaaccctccagcctgtaaggaccttgatatccaaaggacagctgaagaaagtaatgtgcctgcatttttgccacttcattcccacagtgcccgaaatgccagctcctccttggtgttctcctttcaggatttgaattcaaatcccattggcagccctgataccgctgggggaagggtgaggtaggaaaagtcccaccaatatcctaaggggaggtgcgagtggctaccaggatgtgagatgtctgtgggcaaagtccctgcttattccatgaggggctgtgggattaggactgtggctggatgcctcttcctccaacaactccatctcaggatgaagctgaggctttaaaaccctgacaaactgtgggtgactgtctctacttaattcctcctcccaaactcttggtgtctggttttttccctctttctgccctgggcctggagcagctgtccagagacccccaccatgactcatactctcctgttctccctccctctcccctctctattaacctcacccttcccaatccagtggggtagtattaagtcccagtcgcagatggggcaataatgtcccagcacccctccctccacacacccagggcttcctgttctttccaccctcaccctgaagagctgcagggtggtggggggaggcaaaggctcattactttataagattttcattactttataagatttcattttacattttacttaagtgtacttgtttcagagagtggtaaagacagatcctgctcctctcaatccaatcctgtagatttcttcagttacctcaacagggtcatactggctcctgaaatgggcaccattatttaaaagaaatagaggtacagagtcctcaagatttatgggcacctgagtttctgccccgtgccccgctgcaggtttcccaatcccctaaagacattcatggatgggtgagaggagctgacacctcccgctctgtgaccactttctctttggccatggaggaagtcttgctgcccctggctgtgacatctgaccccaggccctttaatcaacaactcccagagcctccagacccaagatgtgttttggaaccccaggacaatcctgaactggcacttgccctggtgtgtgccctttgctgctgctttggaatcatctactgctgcttcagtgagggcagggccaaggacctggggggccattgcccaagactgtcatcctcaaggatgatgccagctttcctccttgctcctgggccatctcacctcctctgccaggggttcctacctctagtgtggcccatgttgctctggctgtattcctaggcccatgttgctcttgccagcttcttgtccatcctccatgcccatgccttccagctttcacctctggcatctatcatttgctcttctcttaactcctacctgaaaaccccattcctaaattattcactatatttcagacttcttcactcttctccaaaaacctgaatcagcttgtgctgattttttcctatctgctatccctaaaaggactagaccttctttctatccttactcccctcaatgtatccatcttacctcttgattttccctcccattccctcacagttcctgaaacagtgcccccccccgaccctaagcgacccctttctgcccctggccttgaggtcccttgacgtgctgctcctgtcttctgctcctctagtgagccattcctctcccttggaattcatcagagtcatccctgtagagcccccttcctgcctctcaattcctcctgcctcacttcccaggctactgctgcttcaagacagtgacgtttctctccggtcagctgtcaggagcgctggtgagcttcctactgtgccacaaggtgcgggtgctggagacacagctgagcctggaaatgagagtgggcatcgccgtggtcatcatgactcctctgcggcgtggtcaccatgttggttcactgtgttgggctcttattgacgggtctcctgctaggcctgaccttgggtgccggagccctgctggcttctgagcctatctaccaaccaccttcagcctgggtgccagctggggggctggtggggctggcgctgctgggagccctgctcacacttcggtggccacgtccattcacagttctgggcacaaccctgctgggttctgcagtgcttgtggcctgtgttgactacttcctggaggggctggcactggggagttggctgggccaacgcctgcagacacttccagccttgccttctctctgctgatatagctgggtcttactggggatctggccagccttgggggcccttggagccctggcccagtggaagctcgtgcctgaggaacatggaggccacgctaatgagggtctgttcctggtttcccagatgcataaaggaagacatatccctcccctgggcagcaaggctacaatgggagggagggagaacatgggagcatgtgaataaaatggcattaaatactgaaccagggagtccagcctc

SEQ ID NO: 418420 - DNA, 2553 bp, Homo sapiens
  misc_feature (1921)..(1921): n is a, c, g, or t
cagggagacatacaggatttaagaagcccatcatggagaagaccttcaattacagagataaaaagtttttcttgtgaacaagttacactagatggaagataacagactgaggagtgagctgcttctgactcgattaaaaagggagtgagccataactggcggctgctcttgcgccaatgagcctccccaattcctcctgcctcttagaagacaagatgtgtgagggcaacaagaccactatggccagcccccagctgatgcccctggtggtggtcctgagcactatctgcttggtcacagtagggctcaacctgctggtgctgtatgccgtacggagtgagcggaagctccacactgtggggaacctgtacatcgtcagcctctcggtggcggacttgatcgtgggtgccgtcgtcatgcctatgaacatcctctacctgctcatgtccaagtggtcactgggccgtcctctctgcctcttttggctttccatggactatgtggccagcacagcgtccattttcagtgtcttcatcctgtgcattgatcgctaccgctctgtccagcagcccctcaggtaccttaagtatcgtaccaagacccgagcctcggccaccattctgggggcctggtttctctcttttctgtgggttattcccattctaggctggaatcacttcatgcagcagacctcggtgcgccgagaggacaagtgtgagacagacttctatgatgtcacctggttcaaggtcatgactgccatcatcaacttctacctgcccaccttgctcatgctctggttctatgccaagatctacaaggccgtacgacaacactgccagcaccgggagctcatcaataggtccctcccttccttctcagaaattaagctgaggccagagaaccccaagggggatgccaagaaaccagggaaggagtctccctgggaggttctgaaaaggaagccaaaagatgctggtggtggatctgtcttgaagtcaccatcccaaacccccaaggagatgaaatccccagttgtcttcagccaagaggatgatagagaagtagacaaactctactgctttccacttgatattgtgcacatgcaggctgcggcagaggggagtagcagggactatgtagccgtcaaccggagccatggccagctcaagacagatgagcagggcctgaacacacatggggccagcgagatatcagaggatcagatgttaggtgatagccaatccttctctcgaacggactcagataccaccacagagacagcaccaggcaaaggcaaattgaggagtgggtctaacacaggcctggattacatcaagtttacttggaagaggctccgctcgcattcaagacagtatgtatctgggttgcacatgaaccgcgaaaggaaggccgccaaacagttgggttttatcatggcagccttcatcctctgctggatcccttatttcatcttcttcatggtcattgccttctgcaagaactgttgcaatgaacatttgcacatgttcaccatctggctgggcaacagagcaagactctgtctcaaaaaaaaaaaatacaatattttaacaatgtgccctcttaagtgtgcacagatacacatacacggtattcccaagagtggtggcagctcaaaatgatatgtttgagtagacgaacagctgacatggagttcccgtgcacctacggaaggggacgctttgaaggaaccaagtgcatttttatctgtgagttctgttgtgtttgtcaaaaagtcattgtaatctttcatagccatacctggtaagcaaaaactagtaaagacataggaacatgtagttttacttggtgtttatgttgcaatctggttgtgatttatattttaaagcttggtgctaaaccacaatatgtatagcanatggagtgcctgtacaagctgatgttttgtattttgtgttcctctttgcatgatctgtcaaagtgagatatttttacctgcctaaaatatgatgtttaaaagcatactctatgtgatttatttatttctacctttctgagtctcttggactaagaagatgttttgaaatgtaccatcaaatgttaacagagtttgatatgggctttctctttggtttctcatcacatttgtaaatgtcttttcaaaaggatttactttttgtaaaaagcttcattctcactctgctttgcatcccccaaacttcttgttcaaaacggggggagtttaggagactttaatcccggtttcagaagctgcagctggtctgtttccaggtcagaaaccattgttcagaagacctccctgtgagagagttgctcctcagggtccctcaggaccaaagaacactcgaaaagagcacttcacacagacaagtggctaagtgtccattatttaccttgaacaatcaaggcaactagtggagagaactgattgtgagctctgcctctgggtcagagagacctggatttgagtctgacaagaacaagaaatggtcaataaatataaattaccagcgtctaaggaaaaaaaaa

SEQ ID NO: 418421 - DNA, 3960 bp, Homo sapiens
  misc_feature (3328)..(3328): n is a, c, g, or t
cagggagacatacaggatttaagaagcccatcatggagaagaccttcaattacagagataaaaagtttttcttgtgaacaagttacactagatggaagataacagactgaggagtgagctgcttctgactcgattaaaaagggagtgagccataactggcggctgctcttgcgccaatgagcctccccaattcctcctgcctcttagaagacaagatgtgtgagggcaacaagaccactatggccagcccccagctgatgcccctggtggtggtcctgagcactatctgcttggtcacagtagggctcaacctgctggtgctgtatgccgtacggagtgagcggaagctccacactgtggggaacctgtacatcgtcagcctctcggtggcggacttgatcgtgggtgccgtcgtcatgcctatgaacatcctctacctgctcatgtccaagtggtcactgggccgtcctctctgcctcttttggctttccatggactatgtggccagcacagcgtccattttcagtgtcttcatcctgtgcattgatcgctaccgctctgtccagcagcccctcaggtaccttaagtatcgtaccaagacccgagcctcggccaccattctgggggcctggtttctctcttttctgtgggttattcccattctaggctggaatcacttcatgcagcagacctcggtgcgccgagaggacaagtgtgagacagacttctatgatgtcacctggttcaaggtcatgactgccatcatcaacttctacctgcccaccttgctcatgctctggttctatgccaagatctacaaggccgtacgacaacactgccagcaccgggagctcatcaataggtccctcccttccttctcagaaattaagctgaggccagagaaccccaagggggatgccaagaaaccagggaaggagtctccctgggaggttctgaaaaggaagccaaaagatgctggtggtggatctgtcttgaagtcaccatcccaaacccccaaggagatgaaatccccagttgtcttcagccaagaggatgatagagaagtagacaaactctactgctttccacttgatattgtgcacatgcaggctgcggcagaggggagtagcagggactatgtagccgtcaaccggagccatggccagctcaagacagatgagcagggcctgaacacacatggggccagcgagatatcagaggatcagatgttaggtgatagccaatccttctctcgaacggactcagataccaccacagagacagcaccaggcaaaggcaaattgaggagtgggtctaacacaggcctggattacatcaagtttacttggaagaggctccgctcgcattcaagacagtatgtatctgggttgcacatgaaccgcgaaaggaaggccgccaaacagttgggttttatcatggcagccttcatcctctgctggatcccttatttcatcttcttcatggtcattgccttctgcaagaactgttgcaatgaacatttgcacatgttcaccatctggctgggctacatcaactccacactgaaccccctcatctaccccttgtgcaatgagaacttcaagaagacattcaagagaattctgcatattcgctcctaagggaggctctgaggggatgcaacaaaatgatccttatgatgtccaacaaggaaatagaggacgaaggcctgtgtgttgccaggcaggcacctgggctttctggaatccaaaccacagtcttaggggcttggtagtttggaaagttcttaggcaccatagaagaacagcagatggcggtgatcagcagagagattgaactttgaggaggaagcagaatctttgcaagaaagtcagacctgtttcttgtaactgggttcaaaaagaaaaaaataataaaaataaaagagagagagaatcagacctgggtggaactctcctgctcctcaggaactatgggagcctcagactcattgtaattcaagctttccgagtcaagtgattgacaactgaagagacacgtggctagggttccactggagaattgaaaaggactcttgagccctcctggaatggagctgtataactgtgcagagactttatccatgccaatagttgctgtccccttccaggggtcaccttgagaggcatgacagctgttccacaggggctatcccttctcagaaaacttctcttctgagcctctttaacagctttctccagaaccagtgtctgaaccaccctggaaattctgccttattatttcttactcaaacatgtttagagtggatagaaaattatgcagcttgcacacccatcgtctttaaccccaaatttcctttggctattaaaaaagtggtggcaaaaggcatcctcaaaagaaagagaaatgaaatatttttgaatggttgcacgttaaaaattaaaagaaggaatgggggcagaatgccatatttttgagggctgtactaggtttatctcatttaagccccacaacaccccacaggagggtaattttctaactctagtttgcagaggagcaaattgaggttcagcaaggtgagagaggtacccaaggtcacatagctagttatgtgagaaagttagagtacagatcctctggggtttcagcttattgtagcatattttctccgaaaggcaaaaatgtgcccttttggccgggcatggtagctcaagcctataatcccagcatgttgagaggctgaggtgggcagatcatttgaggccaggagttcaagaccagtctggccaatatggagaaaccttgtctctactaaaaacacaaaaattatctgggcatggtggggcatgcctgtagtcccacttacttgggaggccgaggcacgagaatcgcttgaacccgggaggtggaggttgccgtgagccaagatcacgccactgcactccagcctgggcaacagagcaagactctgtctcaaaaaaaaaaaatacaatattttaacaatgtgccctcttaagtgtgcacagatacacatacacggtattcccaagagtggtggcagctcaaaatgatatgtttgagtagacgaacagctgacatggagttcccgtgcacctacggaaggggacgctttgaaggaaccaagtgcatttttatctgtgagttctgttgtgtttgtcaaaaagtcattgtaatctttcatagccatacctggtaagcaaaaactagtaaagacataggaacatgtagttttacttggtgtttatgttgcaatctggttgtgatttatattttaaagcttggtgctaaaccacaatatgtatagcanatggagtgcctgtacaagctgatgttttgtattttgtgttcctctttgcatgatctgtcaaagtgagatatttttacctgcctaaaatatgatgtttaaaagcatactctatgtgatttatttatttctacctttctgagtctcttggactaagaagatgttttgaaatgtaccatcaaatgttaacagagtttgatatgggctttctctttggtttctcatcacatttgtaaatgtcttttcaaaaggatttactttttgtaaaaagcttcattctcactctgctttgcatcccccaaacttcttgttcaaaacggggggagtttaggagactttaatcccggtttcagaagctgcagctggtctgtttccaggtcagaaaccattgttcagaagacctccctgtgagagagttgctcctcagggtccctcaggaccaaagaacactcgaaaagagcacttcacacagacaagtggctaagtgtccattatttaccttgaacaatcaaggcaactagtggagagaactgattgtgagctctgcctctgggtcagagagacctggatttgagtctgacaagaacaagaaatggtcaataaatataaattaccagcgtctaaggaaaaaaaaa

SEQ ID NO: 418422 - DNA, 1036 bp, Homo sapiens
  misc_feature (581)..(581): n is a, c, g, or t
  misc_feature (745)..(745): n is a, c, g, or t
ctaggaattggcctgaaggcccacagttactcagcaatattagagacagctatgcaaagggagaagccaggcgttttaagattcacgggagacagtttgtaggaaggctgtttgctgaataagacaaagatacagacatgcaaagtaaaggatgtgggcctatagggaaggtcaaagaataaggaaagttcacttgagtgagcagaaatggaagagggatttaagcaaatagatgaacaagaattgtctctcctaaaaaaaaaaaacctacacaattatttgatgatttattatgacttttggggtagagaccacgctagtcacaggatctgcaagccctgccacctggatgatctggctccagctggctcactgcctcttctcaccagtctctggatcatgtgactgtaccggctcctagtctttgcatatgctgcttccttggcttgggatcatcacttctatcagctcttctatcccttctatgcgctcttcgttttaaaaatctcatgtgtccttgtactcttccttcataacgcttattacagttgataattttttagtgcttatttgattaatgncctccagagatcaggaccagtagtgttttgctctctcttgcaatctcagtggttggcagggtgcttggcacatagtaaacactaaataaacatttgttgaatgaatcagtgaactacatgctttggtctttactagttggtctcaaggaccaaaaacctacagnaggaagatgtttgttggactaagagattagcaggaaatatgagagctttgaggaaaaaggaaaagatgaagttttttaaagataggattagaaagttctatgtagtcaggagaaagaaaattattcgtggaataattcaacaaatgcacatgaaatgcctactatgtattgagaattagatactggaaatgtggagtggaaagattctgtcttctgtattaaaggagtgtataattgtagtagtttactgaaatggggacagtccttagtggttgtttggagcaggtgtaa

SEQ ID NO: 418423 - DNA, 1009 bp, Homo sapiens
  misc_feature (581)..(581): n is a, c, g, or t
ctaggaattggcctgaaggcccacagttactcagcaatattagagacagctatgcaaagggagaagccaggcgttttaagattcacgggagacagtttgtaggaaggctgtttgctgaataagacaaagatacagacatgcaaagtaaaggatgtgggcctatagggaaggtcaaagaataaggaaagttcacttgagtgagcagaaatggaagagggatttaagcaaatagatgaacaagaattgtctctcctaaaaaaaaaaaacctacacaattatttgatgatttattatgacttttggggtagagaccacgctagtcacaggatctgcaagccctgccacctggatgatctggctccagctggctcactgcctcttctcaccagtctctggatcatgtgactgtaccggctcctagtctttgcatatgctgcttccttggcttgggatcatcacttctatcagctcttctatcccttctatgcgctcttcgttttaaaaatctcatgtgtccttgtactcttccttcataacgcttattacagttgataattttttagtgcttatttgattaatgncctccagagatcaggaccagtagtgttttgctctctcttgcaatctcagtggttggcagggtgcttggcacatagtaaacactaaataaacatttgttgaatgaatcagtgaactacatgctttggtctttactagttggaagatgtttgttggactaagagattagcaggaaatatgagagctttgaggaaaaaggaaaagatgaagttttttaaagataggattagaaagttctatgtagtcaggagaaagaaaattattcgtggaataattcaacaaatgcacatgaaatgcctactatgtattgagaattagatactggaaatgtggagtggaaagattctgtcttctgtattaaaggagtgtataattgtagtagtttactgaaatggggacagtccttagtggttgtttggagcaggtgtaa

SEQ ID NO: 418424 - DNA, 3195 bp, Homo sapiens
acagcatggagtggggttacctgttggaagtgacctcgctgctggccgccttggcgctgctgcagcgctctagcggcgctgcggccgcctcggccaaggagctggcatgccaagagatcaccgtgccgctgtgtaagggcatcggctacaactacacctacatgcccaatcagttcaaccacgacacgcaagacgaggcgggcctggaggtgcaccagttctggccgctggtggagatccagtgctcgcccgatctcaagttcttcctgtgcagcatgtacacgcccatctgcctagaggactacaagaagccgctgccgccctgccgctcggtgtgcgagcgcgccaaggccggctgcgcgccgctcatgcgccagtacggcttcgcctggcccgaccgcatgcgctgcgaccggctgcccgagcaaggcaaccctgacacgctgtgcatggactacaaccgcaccgacctaaccaccgccgcgcccagcccgccgcgccgcctgccgccgccgccgcccggcgagcagccgccttcgggcagcggccacggccgcccgccgggggccaggcccccgcaccgcggaggcggcaggggcggtggcggcggggacgcggcggcgcccccagctcgcggcggcggcggtggcgggaaggcgcggccccctggcggcggcgcggctccctgcgagcccgggtgccagtgccgcgcgcctatggtgagcgtgtccagcgagcgccacccgctctacaaccgcgtcaagacaggccagatcgctaactgcgcgctgccctgccacaacccctttttcagccaggacgagcgcgccttcaccgtcttctggatcggcctgtggtcggtgctctgcttcgtgtccaccttcgccaccgtctccaccttccttatcgacatggagcgcttcaagtacccggagcggcccattatcttcctctcggcctgctacctcttcgtgtcggtgggctacctagtgcgcctggtggcgggccacgagaaggtggcgtgcagcggtggcgcgccgggcgcggggggcgctgggggcgcgggcggcgcggcggcgggcgcgggcgcggcgggcgcgggcgcgggcggcccgggcgggcgcggcgagtacgaggagctgggcgcggtggagcagcacgtgcgctacgagaccaccggccccgcgctgtgcaccgtggtcttcttgctggtctacttcttcggcatggccagctccatctggtgggtgatcttgtcgctcacatggttcctggcggccggtatgaagtggggcaacgaagccatcgccggctactcgcagtacttccacctggccgcgtggcttgtgcccagcgtcaagtccatcgcggtgctggcgctcagctcggtggacggcgacccggtggcgggcatctgctacgtgggcaaccagagcctggacaacctgcgcggcttcgtgctggcgccgctggtcatctacctcttcatcggcaccatgttcctgctggccggcttcgtgtccctgttccgcatccgctcggtcatcaagcaacaggacggccccaccaagacgcacaagctggagaagctgatgatccgcctgggcctgttcaccgtgctctacaccgtgcccgccgcggtggtggtcgcctgcctcttctacgagcagcacaaccgcccgcgctgggaggccacgcacaactgcccgtgcctgcgggacctgcagcccgaccaggcacgcaggcccgactacgccgtcttcatgctcaagtacttcatgtgcctagtggtgggcatcacctcgggcgtgtgggtctggtccggcaagacgctggagtcctggcgctccctgtgcacccgctgctgctgggccagcaagggcgccgcggtgggcgggggcgcgggcgccacggccgcggggggtggcggcgggccggggggcggcggcggcgggggacccggcggcggcggggggccgggcggcggcgggggctccctctacagcgacgtcagcactggcctgacgtggcggtcgggcacggcgagctccgtgtcttatccaaagcagatgccattgtcccaggtctgagcggaggggagggggcgcccaggaggggtggggaggggggcgaggagacccaagtgcagcgaagggacacttgatgggctgaggttcccaccccttcacagtgttgattgctattagcatgataatgaactcttaatggtatccattagctgggacttaaatgactcacttagaacaaagtacctggcattgaagcctcccagacccagccccttttcctccattgatgtgcggggagctcctcccgccacgcgttaatttctgttggctgaggagggtggactctgcggcgtttccagaacccgagatttggagccctccctggctgcacttggctgggtttgcagtcagatacacagatttcacctgggagaacctctttttctccctcgactcttcctacgtaaactcccacccctgacttaccctggaggaggggtgaccgccacctgatgggattgcacggtttgggtattcttaatgaccaggcaaatgccttaagtaaacaaacaagaaatgtcttaattatacaccccacgtaaatacgggtttcttacattagaggatgtatttatataattatttgttaaattgtaaaaaaaaaaagtgtaaaatatgtatatatccaaagatatagtgtgtacatttttttgtaaaaagtttagaggcttacccctgtaagaacagatataagtattctattttgtcaataaaatgacttttgataaatgatttaaccattgccctctcccccgcctcttctgagctgtcacctttaaagtgcttgctaaggacgcatggggaaaatggacattttctggcttgtcattctgtacactgaccttaggcatggagaaaattacttgttaaactctagttcttaagttgttagccaagtaaatatcattgttgaactgaaatcaaaattgagtttttgcaccttccccaaagacggtgtttttcatgggagctcttttctgatccatggataacaactctcactttagtggatgtaaatggaacttctgcaaggcagtaattccccttaggccttgttatttatcctgcatggtatcactaaaggtttcaaaaccctgaaaaaaaa

SEQ ID NO: 418425 - DNA, 2603 bp, Homo sapiens
cccagctccatctgctggctgatcttctcgctcacattggttcctgccgcccggtatgaagtgggcaaacgaagccatcgccggctactcccagtacttccacctgcccgcttgggcttgttgcccagcctcaaagtccatcgcggttctggcgctcagctcggtggacggcgacccggtggcgggcatctgctacgtgggcaaccagagcccgggtgccagtgccgcgcgcctatggtgagcgtgtccagcgagcgccacccgctctacaaccgcgtcaagacaggccagatcgctaactgcgcgctgccctgccacaacccctttttcagccaggacgagcgcgccttcaccgtcttctggatcggcctgtggtcggtgctctgcttcgtgtccaccttcgccaccgtctccaccttccttatcgacatggagcgcttcaagtacccggagcggcccattatcttcctctcggcctgctacctcttcgtgtcggtgggctacctagtgcgcctggtggcgggccacgagaaggtggcgtgcagcggtggcgcgccgggcgcggggggcgctgggggcgcgggcggcgcggcggcgggcgcgggcgcggcgggcgcgggcgcgggcggcccgggcgggcgcggcgagtacgaggagctgggcgcggtggagcagcacgtgcgctacgagaccaccggccccgcgctgtgcaccgtggtcttcttgctggtctacttcttcggcatggccagctccatctggtgggtgatcttgtcgctcacatggttcctggcggccggtatgaagtggggcaacgaagccatcgccggctactcgcagtacttccacctggccgcgtggcttgtgcccagcgtcaagtccatcgcggtgctggcgctcagctcggtggacggcgacccggtggcgggcatctgctacgtgggcaaccagagcctggacaacctgcgcggcttcgtgctggcgccgctggtcatctacctcttcatcggcaccatgttcctgctggccggcttcgtgtccctgttccgcatccgctcggtcatcaagcaacaggacggccccaccaagacgcacaagctggagaagctgatgatccgcctgggcctgttcaccgtgctctacaccgtgcccgccgcggtggtggtcgcctgcctcttctacgagcagcacaaccgcccgcgctgggaggccacgcacaactgcccgtgcctgcgggacctgcagcccgaccaggcacgcaggcccgactacgccgtcttcatgctcaagtacttcatgtgcctagtggtgggcatcacctcgggcgtgtgggtctggtccggcaagacgctggagtcctggcgctccctgtgcacccgctgctgctgggccagcaagggcgccgcggtgggcgggggcgcgggcgccacggccgcggggggtggcggcgggccggggggcggcggcggcgggggacccggcggcggcggggggccgggcggcggcgggggctccctctacagcgacgtcagcactggcctgacgtggcggtcgggcacggcgagctccgtgtcttatccaaagcagatgccattgtcccaggtctgagcggaggggagggggcgcccaggaggggtggggaggggggcgaggagacccaagtgcagcgaagggacacttgatgggctgaggttcccaccccttcacagtgttgattgctattagcatgataatgaactcttaatggtatccattagctgggacttaaatgactcacttagaacaaagtacctggcattgaagcctcccagacccagccccttttcctcttggctgggtttgcagtcagatacacagatttcacctgggagaacctctttttctccctcgactcttcctacgtaaactcccacccctgacttaccctggaggaggggtgaccgccacctgatgggattgcacggtttgggtattcttaatgaccaggcaaatgccttaagtaaacaaacaagaaatgtcttaattatacaccccacgtaaatacgggtttcttacattagaggatgtatttatataattatttgttaaattgtaaaaaaaaaaagtgtaaaatatgtatatatccaaagatatagtgtgtacatttttttgtaaaaagtttagaggcttacccctgtaagaacagatataagtattctattttgtcaataaaatgacttttgataaatgatttaaccattgccctctcccccgcctcttctgagctgtcacctttaaagtgcttgctaaggacgcatggggaaaatggacattttctggcttgtcattctgtacactgaccttaggcatggagaaaattacttgttaaactctagttcttaagttgttagccaagtaaatatcattgttgaactgaaatcaaaattgagtttttgcaccttccccaaagacggtgtttttcatgggagctcttttctgatccatggataacaactctcactttagtggatgtaaatggaacttctgcaaggcagtaattccccttaggccttgttatttatcctgcatggtatcactaaaggtttcaaaaccctgaaaaaaaa

SEQ ID NO: 418426 - DNA, 2713 bp, Homo sapiens
cccagctccatctgctggctgatcttctcgctcacattggttcctgccgcccggtatgaagtgggcaaacgaagccatcgccggctactcccagtacttccacctgcccgcttgggcttgttgcccagcctcaaagtccatcgcggttctggcgctcagctcggtggacggcgacccggtggcgggcatctgctacgtgggcaaccagagcccgggtgccagtgccgcgcgcctatggtgagcgtgtccagcgagcgccacccgctctacaaccgcgtcaagacaggccagatcgctaactgcgcgctgccctgccacaacccctttttcagccaggacgagcgcgccttcaccgtcttctggatcggcctgtggtcggtgctctgcttcgtgtccaccttcgccaccgtctccaccttccttatcgacatggagcgcttcaagtacccggagcggcccattatcttcctctcggcctgctacctcttcgtgtcggtgggctacctagtgcgcctggtggcgggccacgagaaggtggcgtgcagcggtggcgcgccgggcgcggggggcgctgggggcgcgggcggcgcggcggcgggcgcgggcgcggcgggcgcgggcgcgggcggcccgggcgggcgcggcgagtacgaggagctgggcgcggtggagcagcacgtgcgctacgagaccaccggccccgcgctgtgcaccgtggtcttcttgctggtctacttcttcggcatggccagctccatctggtgggtgatcttgtcgctcacatggttcctggcggccggtatgaagtggggcaacgaagccatcgccggctactcgcagtacttccacctggccgcgtggcttgtgcccagcgtcaagtccatcgcggtgctggcgctcagctcggtggacggcgacccggtggcgggcatctgctacgtgggcaaccagagcctggacaacctgcgcggcttcgtgctggcgccgctggtcatctacctcttcatcggcaccatgttcctgctggccggcttcgtgtccctgttccgcatccgctcggtcatcaagcaacaggacggccccaccaagacgcacaagctggagaagctgatgatccgcctgggcctgttcaccgtgctctacaccgtgcccgccgcggtggtggtcgcctgcctcttctacgagcagcacaaccgcccgcgctgggaggccacgcacaactgcccgtgcctgcgggacctgcagcccgaccaggcacgcaggcccgactacgccgtcttcatgctcaagtacttcatgtgcctagtggtgggcatcacctcgggcgtgtgggtctggtccggcaagacgctggagtcctggcgctccctgtgcacccgctgctgctgggccagcaagggcgccgcggtgggcgggggcgcgggcgccacggccgcggggggtggcggcgggccggggggcggcggcggcgggggacccggcggcggcggggggccgggcggcggcgggggctccctctacagcgacgtcagcactggcctgacgtggcggtcgggcacggcgagctccgtgtcttatccaaagcagatgccattgtcccaggtctgagcggaggggagggggcgcccaggaggggtggggaggggggcgaggagacccaagtgcagcgaagggacacttgatgggctgaggttcccaccccttcacagtgttgattgctattagcatgataatgaactcttaatggtatccattagctgggacttaaatgactcacttagaacaaagtacctggcattgaagcctcccagacccagccccttttcctccattgatgtgcggggagctcctcccgccacgcgttaatttctgttggctgaggagggtggactctgcggcgtttccagaacccgagatttggagccctccctggctgcacttggctgggtttgcagtcagatacacagatttcacctgggagaacctctttttctccctcgactcttcctacgtaaactcccacccctgacttaccctggaggaggggtgaccgccacctgatgggattgcacggtttgggtattcttaatgaccaggcaaatgccttaagtaaacaaacaagaaatgtcttaattatacaccccacgtaaatacgggtttcttacattagaggatgtatttatataattatttgttaaattgtaaaaaaaaaaagtgtaaaatatgtatatatccaaagatatagtgtgtacatttttttgtaaaaagtttagaggcttacccctgtaagaacagatataagtattctattttgtcaataaaatgacttttgataaatgatttaaccattgccctctcccccgcctcttctgagctgtcacctttaaagtgcttgctaaggacgcatggggaaaatggacattttctggcttgtcattctgtacactgaccttaggcatggagaaaattacttgttaaactctagttcttaagttgttagccaagtaaatatcattgttgaactgaaatcaaaattgagtttttgcaccttccccaaagacggtgtttttcatgggagctcttttctgatccatggataacaactctcactttagtggatgtaaatggaacttctgcaaggcagtaattccccttaggccttgttatttatcctgcatggtatcactaaaggtttcaaaaccctgaaaaaaaa

SEQ ID NO: 418427 - DNA, 2757 bp, Homo sapiens
  misc_feature (2040)..(2040): n is a, c, g, or t
  misc_feature (2042)..(2042): n is a, c, g, or t
cccagctccatctgctggctgatcttctcgctcacattggttcctgccgcccggtatgaagtgggcaaacgaagccatcgccggctactcccagtacttccacctgcccgcttgggcttgttgcccagcctcaaagtccatcgcggttctggcgctcagctcggtggacggcgacccggtggcgggcatctgctacgtgggcaaccagagcccgggtgccagtgccgcgcgcctatggtgagcgtgtccagcgagcgccacccgctctacaaccgcgtcaagacaggccagatcgctaactgcgcgctgccctgccacaacccctttttcagccaggacgagcgcgccttcaccgtcttctggatcggcctgtggtcggtgctctgcttcgtgtccaccttcgccaccgtctccaccttccttatcgacatggagcgcttcaagtacccggagcggcccattatcttcctctcggcctgctacctcttcgtgtcggtgggctacctagtgcgcctggtggcgggccacgagaaggtggcgtgcagcggtggcgcgccgggcgcggggggcgctgggggcgcgggcggcgcggcggcgggcgcgggcgcggcgggcgcgggcgcgggcggcccgggcgggcgcggcgagtacgaggagctgggcgcggtggagcagcacgtgcgctacgagaccaccggccccgcgctgtgcaccgtggtcttcttgctggtctacttcttcggcatggccagctccatctggtgggtgatcttgtcgctcacatggttcctggcggccggtatgaagtggggcaacgaagccatcgccggctactcgcagtacttccacctggccgcgtggcttgtgcccagcgtcaagtccatcgcggtgctggcgctcagctcggtggacggcgacccggtggcgggcatctgctacgtgggcaaccagagcctggacaacctgcgcggcttcgtgctggcgccgctggtcatctacctcttcatcggcaccatgttcctgctggccggcttcgtgtccctgttccgcatccgctcggtcatcaagcaacaggacggccccaccaagacgcacaagctggagaagctgatgatccgcctgggcctgttcaccgtgctctacaccgtgcccgccgcggtggtggtcgcctgcctcttctacgagcagcacaaccgcccgcgctgggaggccacgcacaactgcccgtgcctgcgggacctgcagcccgaccaggcacgcaggcccgactacgccgtcttcatgctcaagtacttcatgtgcctagtggtgggcatcacctcgggcgtgtgggtctggtccggcaagacgctggagtcctggcgctccctgtgcacccgctgctgctgggccagcaagggcgccgcggtgggcgggggcgcgggcgccacggccgcggggggtggcggcgggccggggggcggcggcggcgggggacccggcggcggcggggggccgggcggcggcgggggctccctctacagcgacgtcagcactggcctgacgtggcggtcgggcacggcgagctccgtgtcttatccaaagcagatgccattgtcccaggtctgagcggaggggagggggcgcccaggaggggtggggaggggggcgaggagacccaagtgcagcgaagggacacttgatgggctgaggttcccaccccttcacagtgttgattgctattagcatgataatgaactcttaatggtatccattagctgggacttaaatgactcacttagaacaaagtacctggcattgaagcctcccagacccagccccttttcctccattgatgtgcggggagctcctcccgccacgcgttaatttctgttggctgaggagggtggactctgcggcgtttccagaacccgagatttggagccctccctggctgcacttggctgggtttgcagtcagatacacagatttcacctgggagaacctctttttctccctcgactctttttttccttttttcccccctaaaaacgggtatanancatcttcccctacgtaaactcccacccctgacttaccctggaggaggggtgaccgccacctgatgggattgcacggtttgggtattcttaatgaccaggcaaatgccttaagtaaacaaacaagaaatgtcttaattatacaccccacgtaaatacgggtttcttacattagaggatgtatttatataattatttgttaaattgtaaaaaaaaaaagtgtaaaatatgtatatatccaaagatatagtgtgtacatttttttgtaaaaagtttagaggcttacccctgtaagaacagatataagtattctattttgtcaataaaatgacttttgataaatgatttaaccattgccctctcccccgcctcttctgagctgtcacctttaaagtgcttgctaaggacgcatggggaaaatggacattttctggcttgtcattctgtacactgaccttaggcatggagaaaattacttgttaaactctagttcttaagttgttagccaagtaaatatcattgttgaactgaaatcaaaattgagtttttgcaccttccccaaagacggtgtttttcatgggagctcttttctgatccatggataacaactctcactttagtggatgtaaatggaacttctgcaaggcagtaattccccttaggccttgttatttatcctgcatggtatcactaaaggtttcaaaaccctgaaaaaaaa

SEQ ID NO: 418428 - DNA, 2751 bp, Homo sapiens
ggccgggctgtccggcgctttagcttagcaggcgacgttgcgggccctgggcgccaggagagcttcccggagtcgaccttcctgctggctgctctgtgaccgcttcccggctctgccctcttggccgaagtgcccgctgccgggcgcgggcctcagacaatacaatggtgggtgaagagaagatgtctctaagaaaccggctgtcaaagtccagggaaaatcctgaggaagatgaagaccagagaaaccctgcaaaggagtccctagagacacctagtaatggtcgaattgacataaaacagttgatagcaaagaagataaagttgacagcagaggcagaggaattgaagccattttttatgaaggaagttggcagtcactttgatgattttgtgaccaatctcattgaaaagtcagcatcattagataatggtgggtgcgctctcacaaccttttctgttcttgaaggagagaaaaacaaccatagagcgaaggatttgagagcacctccagaacaaggaaagatttttattgcaaggcgctctctcttagatgaactgcttgaagtggaccacatcagaacaatatatcacatgtttattgccctcctcattctctttatcctcagcacacttgtagtagattacattgatgaaggaaggctggtgcttgagttcagcctcctgtcttatgcttttggcaaatttcctaccgttgtttggacctggtggatcatgttcctgtctacattttcagttccctattttctgtttcaacattgggccactggctatagcaagagttctcatccgctgatccgttctctcttccatggctttcttttcatgatcttccagattggagttctaggttttggaccaacatatgttgtgttagcatatacactgccaccagcttcccggttcatcattatattcgagcagattcgttttgtaatgaaggcccactcatttgtcagagagaacgtgcctcgggtactaaattcagctaaggagaaatcaagcactgttccaatacctacagtcaaccagtatttgtacttcttatttgctcctacccttatctaccgtgacagctatcccaggaatcccactgtaagatggggttatgtcgctatgaagtttgcacaggtctttggttgctttttctatgtgtactacatctttgaaaggctttgtgcccccttgtttcggaatatcaaacaggagcccttcagcgctcgtgttctggtcctatgtgtatttaactccatcttgccaggtgtgctgattctcttccttactttttttgcctttttgcactgctggctcaatgcctttgctgagatgttacgctttggtgacaggatgttctataaggattggtggaactccacgtcatactccaactattatagaacctggaatgtggtggtccatgactggctatattactatgcttacaaggactttctctggtttttctccaagagattcaaatctgctgccatgttagctgtctttgctgtatctgctgtagtacacgaatatgccttggctgtttgcttgagctttttctatcccgtgctcttcgtgctcttcatgttctttggaatggctttcaacttcattgtcaatgatagtcggaaaaagccgatttggaatgttctgatgtggacttctcttttcttgggcaatggagtcttactctgcttttattctcaagaatggtatgcacgtcagcactgtcctctgaaaaatcccacatttttggattatgtccggccacgttcctggacttgtcgttacgtgttttagaagcttggactttgtttcctccttgtcactgaagattgggtagctccctgatttggagccagctgtttccagttgttactgaagttatctgtgttatttggaccactccaggctttacagatgactcactccattcctaggtcacttgaagccaaactgttggaagttcactggagtcttgtacacttaagcagagcagaactttttttgtggggctgggtggggggagaagaccgactaacagctgaagtaatgacagattgttgctgggtcatatcagctttatcccttggtaattatatctgttttgtttcttgactctgtccaatcagagaataaacatcatagtttcttggccactgaattagccaaaacacttaggaagaaatcacttaaatacctctggcttagaaattttttcatgcacactgttggaatgtatgctaattgaacatgcaattggggaagaaaaaatgtagaatgatttttgctatttctagtagaaagaaaatgtctgttttccaaagataatgttatacatcctattttgtaatttttttgaaaaaagttcaatgttcagttttccttagtttttaccttgttttctctataggtcatgatttctgtgaagcaaaaagatgccttttaccatgaattcttgagtttacatcaataatattgtatattaaggggatcagaagtaggaaggaaaaaataagagatagcagaggaaaaagaaaaacatttcctcttataacttctgaagtaatttgtaaaaaagatttgtagagtcaatcatgtgtttaaattattttatcacaaacttaacatggaagatattcctttttaactttgtggtaacttctttgaagttatttagaaatatcctttggaacaattattttattgtctaataaatattgacttctcttga

SEQ ID NO: 418429 - DNA, 4725 bp, Homo sapiens
  misc_feature (1)..(2): n is a, c, g, or t
  misc_feature (11)..(11): n is a, c, g, or t
  misc_feature (22)..(22): n is a, c, g, or t
  misc_feature (27)..(27): n is a, c, g, or t
  misc_feature (34)..(34): n is a, c, g, or t
  misc_feature (41)..(41): n is a, c, g, or t
  misc_feature (44)..(44): n is a, c, g, or t
  misc_feature (47)..(47): n is a, c, g, or t
  misc_feature (79)..(79): n is a, c, g, or t
  misc_feature (83)..(83): n is a, c, g, or t
  misc_feature (98)..(100): n is a, c, g, or t
  misc_feature (109)..(109): n is a, c, g, or t
nngtagagacngggtttcaccntgttngccaggntggtctnganctnctgacctcgtgatccacccacctcggcctccnaaantgctgggattacagnnntgagccacngcgcccagccctattcatcccttttcaaaagtcagaccctaggaagctggagggaggtggggcatggttttacagtgaatttctgatttcactcagggtgataaatcagactcttggggaagcgggtggtggctctggacagcagcaggaatggggatccagttagcaacaaatccatggacctatgacaggctgaaagccaccccttctccatctttgggaggttgccaatgtctgatttaacactatccaatgaatgatcattgaaagtaaaaaataactatcaactagcagaaaatataaatggtaagcattagcacatatttcacatgtttatatttggctctcagattgacctataaaacaaagtctgggaaattctatatgatcctgaaaaaatgatacgctggtctggatggtagaataagttggagaaatgtttaagccaaaatgcagtcttaccaatgactttttattttattttattaattttcaggatttttggtatacaggtggtttttggttacatggaaaagttctttactggtgatttctgagattttagttcaccccttatcctgagcagtgtacactgttcccaatatgtagccttttatccctcaccccctctaagttcaagaagactatggtcctgcagaaagctttatatgtaattaacatatctttatctttatctttataggcagtagactcatcttttgaaacagattccattaagagtgaatgtgtaccctccctctagcctttattattactgtttttgctattacatgtgttagtgtatgtgaatttaatgcttaaaaatgtatcccattggctactatggcaaaaggttgactcataagagtttagcacgggttaagatctgaaagttttctcccagcctcttatcactggcgcagacttcacaattcatggaagccaccagtgagatgacattgcctcaggcagttactatttttatattctataactcgaggagctcagggtttcggaaatcattaaactttttttgtccttttaaagttggagacagcaattgtagacagccttccagtgggttatctttttgtgtctccttacctgtggagaagcctattagctgggatatgtagttaaatagctatatttatatatatccagggcaccccgaattcgggagagcttcccggagtcgaccttcctgctggctgctctgtgaccgcttcccggctctgccctcttggccgaagtgcccgctgccgggcgcgggcctcagacaatacaatggtgggtgaagagaagatgtctctaagaaaccggctgtcaaagtccagggaaaatcctgaggaagatgaagaccagagaaaccctgcaaaggagtccctagagacacctagtaatggtcgaattgacataaaacagttgatagcaaagaagataaagttgacagcagaggcagaggaattgaagccattttttatgaaggaagttggcagtcactttgatgattttgtgaccaatctcattgaaaagtcagcatcattagataatggtgggtgcgctctcacaaccttttctgttcttgaaggagagaaaaacaaccatagagcgaaggatttgagagcacctccagaacaaggaaagatttttattgcaaggcgctctctcttagatgaactgcttgaagtggaccacatcagaacaatatatcacatgtttattgccctcctcattctctttatcctcagcacacttgtagtagattacattgatgaaggaaggctggtgcttgagttcagcctcctgtcttatgcttttggcaaatttcctaccgttgtttggacctggtggatcatgttcctgtctacattttcagttccctattttctgtttcaacattgggccactggctatagcaagagttctcatccgctgatccgttctctcttccatggctttcttttcatgatcttccagattggagttctaggttttggaccaacatatgttgtgttagcatatacactgccaccagcttcccggttcatcattatattcgagcagattcgttttgtaatgaaggcccactcatttgtcagagagaacgtgcctcgggtactaaattcagctaaggagaaatcaagcactgttccaatacctacagtcaaccagtatttgtacttcttatttgctcctacccttatctaccgtgacagctatcccaggaatcccactgtaagatggggttatgtcgctatgaagtttgcacaggtctttggttgctttttctatgtgtactacatctttgaaaggctttgtgcccccttgtttcggaatatcaaacaggagcccttcagcgctcgtgttctggtcctatgtgtatttaactccatcttgccaggtgtgctgattctcttccttactttttttgcctttttgcactgctggctcaatgcctttgctgagatgttacgctttggtgacaggatgttctataaggattggtggaactccacgtcatactccaactattatagaacctggaatgtggtggtccatgactggctatattactatgcttacaaggactttctctggtttttctccaagagattcaaatctgctgccatgttagctgtctttgctgtatctgctgtagtacacgaatatgccttggctgtttgcttgagctttttctatcccgtgctcttcgtgctcttcatgttctttggaatggctttcaacttcattgtcaatgatagtcggaaaaagccgatttggaatgttctgatgtggacttctcttttcttgggcaatggagtcttactctgcttttattctcaagaatggtatgcacgtcagcactgtcctctgaaaaatcccacatttttggattatgtccggccacgttcctggacttgtcgttacgtgttttagaagcttggactttgtttcctccttgtcactgaagattgggtagctccctgatttggagccagctgtttccagttgttactgaagttatctgtgttatttggaccactccaggctttacagatgactcactccattcctaggtcacttgaagccaaactgttggaagttcactggagtcttgtacacttaagcagagcagaactttttttgtggggctgggtggggggagaagaccgactaacagctgaagtaatgacagattgttgctgggtcatatcagctttatcccttggtaattatatctgttttgtttcttgactctgtccaatcagagaataaacatcatagtttcttggccactgaattagccaaaacacttaggaagaaatcacttaaatacctctggcttagaaattttttcatgcacactgttggaatgtatgctaattgaacatgcaattggggaagaaaaaatgtagaatgatttttgctatttctagtagaaagaaaatgtctgttttccaaagataatgttatacatcctattttgtaatttttttgaaaaaagttcaatgttcagttttccttagtttttaccttgttttctctataggtcatgatttctgtgaagcaaaaagatgccttttaccatgaattcttgagtttacatcaataatattgtatattaaggggatcagaagtaggaaggaaaaaataagagatagcagaggaaaaagaaaaacatttcctcttataacttctgaagtaatttgtaaaaaagatttgtagagtcaatcatgtgtttaaattattttatcacaaacttaacatggaagatattcctttttaactttgtggtaacttctttgaagttatttagaaatatcctttggaacaattattttattgtctaataaatattgacttctcttgaattattttgcagactagtgagtctgtaacataagtattaatcacctccactcatattaaagtgatcattaagaatccagaagctggcttctgcatttgctcagttatacttttaatggtagtatgtttttaggtggaataaattaatatgtgattggtttcaaggaaatgtactctattatgtaatacttccattttataagatgcccatttctaatacaatgtgtgtaggaattatttgtatgtatgaggtatgattgtaaagattgagcattggaaggggtatcagagaccatgtagttcaactttccactcaaagtaagatttatgaattatttaaatgatagttgttacttggaacagccacttgagaggctctcttggtattgtttggaattgttttaaagtcagtttgagtctcacaagaaggtaagtagagtttcttaatagtcacaacttaatttgaaccacaagtatccagcttaatcacgtatcttactcacgataccactggtccagatgagtttaggtaattttcaaacattaaatccaacttcaacggaaacaaatacactcaagggaagttatttttaaaaaggtactctgcatgttcccgcagtaatgttctgcacaacagtattgtaattgtaatggaatcataacctgctaactagtttgctttaatatggcttgtaattcttgacatttttcttaaaattaaaacgaatttttattttgaattt

SEQ ID NO: 418430 - DNA, 2476 bp, Homo sapiens
ggccgggctgtccggcgctttagcttagcaggcgacgttgcgggccctgggcgccaggagagcttcccggagtcgaccttcctgctggctgctctgtgaccgcttcccggctctgccctcttggccgaagtgcccgctgccgggcgcgggcctcagacaatacaatggtgggtgaagagaagatgtctctaagaaaccggctgtcaaagtccagggaaaatcctgaggaagatgaagaccagagaaaccctgcaaaggagtccctagagacacctagtaatggtcgaattgacataaaacagttgatagcaaagaagataaagttgacagcagaggcagaggaattgaagccattttttatgaaggaagttggcagtcactttgatgattttgtgaccaatctcattgaaaagtcagcatcattagataatggtgggtgcgctctcacaaccttttctgttcttgaaggagagaaaaacaaccatagagcgaaggatttgagagcacctccagaacaaggaaagatttttattgcaaggcgctctctcttagatgaactgcttgaagtggaccacatcagaacaatatatcacatgtttattgccctcctcattctctttatcctcagcacacttgtagtagattacattgatgaaggaaggctggtgcttgagttcagcctcctgtcttatgcttttggcaaatttcctaccgttgtttggacctggtggatcatgttcctgtctacattttcagttccctattttctgtttcaacattgggccactggctatagcaagagttctcatccgctgatccgttctctcttccatggctttcttttcatgatcttccagattggagttctaggttttggaccaacatatgttgtgttagcatatacactgccaccagcttcccggttcatcattatattcgagcagattcgttttgtaatgaaggcccactcatttgtcagagagaacgtgcctcgggtactaaattcagctaaggagaaatcaagcactgttccaatacctacagtcaaccagtatttgtacttcttatttgctcctacccttatctaccgtgacagctatcccaggaatcccactgtaagatggggttatgtcgctatgaagtttgcacaggtctttggttgctttttctatgtgtactacatctttgaaaggctttgtgcccccttgtttcggaatatcaaacaggagcccttcagcgctcgtgttctggtcctatgtgtatttaactccatcttgccaggtgtgctgattctcttccttactttttttgcctttttgcactgctggctcaatgcctttgctgagatgttacgctttggtgacaggatgttctataaggattggtggaactccacgtcatactccaactattatagaacctggaatgtggtggtccatgactggctatattactatgcttacaaggactttctctggtttttctccaagagattcaaatctgctgccatgttagctgtctttgctgtatctgctgtagtacacgaatatgccttggctgtttgcttgagctttttctatcccgtgctcttcgtgctcttcatgttctttggaatggctttcaacttcattgtcaatgatagtcggaaaaagccgatttggaatgttctgatgtggacttctcttttcttgggcaatggagtcttactctgcttttattctcaagaatggtatgcacgtcagcactgtcctctgaaaaatcccacatttttggattatgtccggccacgttcctggacttgtcgttacgtgttttagaagcttggactttgtttcctccttgtcactgaagattgggtagctccctgatttggagccagctgtttccagttgttactgaagttatctgtgttatttggaccactccaggctttacagatgactcactccattcctaggtcacttgaagccaaactgttggaagttcactggagtcttgtacacttaagcagagcagaactttttttgtggggctgggtggggggagaagaccgactaacagctgaagtaatgacagattgttgctgggtcatatcagctttatcccttggtaattatatctgttttgtttcttgactctgtccaatcagagaataaacatcatagtttcttggccactgaattagccaaaaaaaaaaaaaaaaaaaaaaaaaaaaaaaaaaaaaaaaaaaaaaaaaaaaaaaaaaaaaaaaaaaaaaaaaaaaataaaaaaaaataaaaaaaaatataaaaaaaaaataatataaaaaaaaataaaaaaaaaaacttgggggggggccctggacccaatttccccttatggggggcttttataaaataatggggcgatatttaaaaaattttttatggggaaaactcttggttccccacattaatgcccttggaacaaatctcctttctccaattggggtaaaaac

SEQ ID NO: 418431 - DNA, 323 bp, Homo sapiens
aaggagtccctagagacacctagtaatggtgaggcttaattttttttttttaggtgaattagtgaaatagagaacaaatacagtgttatagaataagtattgccatctctttaattctttattgtaaatgggtattgatagagttttatatgtctagtaacaaagcaattagacaataagtcctttctcgttaattaatttggtggacatctattggtatctgctgtgttttagagaccattcattcagtcacgtaacctaccaataattgctgaggtcccccgctggatgctggggctatagcagtgatcagtacggatttg

SEQ ID NO: 418432 - DNA, 592 bp, Homo sapiens
gattacaagcgtgagccactgtgcccggccatgttacgggttttaagcagcaggaaaacaggttccaagagtaagctcttctaaaaatatcatttggtaaagggttaggaaaagtgatggtagaaactaggcttgagtaatctccctgaaggattatagcagtcttctatactagtgttaaatggaatacatatgcgaacattactgtaagggtcacatctgtactttcttttggagagaaaaaaatcgccttccatcttattaagccatcgttattataattctgtctctgttatgttccaggtctttggttgctttttctatgtgtactacatctttgaaaggctttgtgcccccttgtttcggaatatcaaacaggagcccttcagcgctcgtgttctggtcctatgtgtatttaactccatcttgccaggtaacatgggtacttgttaatttggtcatgcataaattcacgaggtaaatagaaagctattgcctatgagcacctttgctttgcctactttttcatctaaacttctatacatctatgcccatcttgacctcttttgcatctactttataaatgaagtat

SEQ ID NO: 418433 - DNA, 5496 bp, Homo sapiens
  misc_feature (1)..(2): n is a, c, g, or t
  misc_feature (11)..(11): n is a, c, g, or t
  misc_feature (22)..(22): n is a, c, g, or t
  misc_feature (27)..(27): n is a, c, g, or t
  misc_feature (34)..(34): n is a, c, g, or t
  misc_feature (41)..(41): n is a, c, g, or t
  misc_feature (44)..(44): n is a, c, g, or t
  misc_feature (47)..(47): n is a, c, g, or t
  misc_feature (79)..(79): n is a, c, g, or t
  misc_feature (83)..(83): n is a, c, g, or t
  misc_feature (98)..(100): n is a, c, g, or t
  misc_feature (109)..(109): n is a, c, g, or t
nngtagagacngggtttcaccntgttngccaggntggtctnganctnctgacctcgtgatccacccacctcggcctccnaaantgctgggattacagnnntgagccacngcgcccagccctattcatcccttttcaaaagtcagaccctaggaagctggagggaggtggggcatggttttacagtgaatttctgatttcactcagggtgataaatcagactcttggggaagcgggtggtggctctggacagcagcaggaatggggatccagttagcaacaaatccatggacctatgacaggctgaaagccaccccttctccatctttgggaggttgccaatgtctgatttaacactatccaatgaatgatcattgaaagtaaaaaataactatcaactagcagaaaatataaatggtaagcattagcacatatttcacatgtttatatttggctctcagattgacctataaaacaaagtctgggaaattctatatgatcctgaaaaaatgatacgctggtctggatggtagaataagttggagaaatgtttaagccaaaatgcagtcttaccaatgactttttattttattttattaattttcaggatttttggtatacaggtggtttttggttacatggaaaagttctttactggtgatttctgagattttagttcaccccttatcctgagcagtgtacactgttcccaatatgtagccttttatccctcaccccctctaagttcaagaagactatggtcctgcagaaagctttatatgtaattaacatatctttatctttatctttataggcagtagactcatcttttgaaacagattccattaagagtgaatgtgtaccctccctctagcctttattattactgtttttgctattacatgtgttagtgtatgtgaatttaatgcttaaaaatgtatcccattggctactatggcaaaaggttgactcataagagtttagcacgggttaagatctgaaagttttctcccagcctcttatcactggcgcagacttcacaattcatggaagccaccagtgagatgacattgcctcaggcagttactatttttatattctataactcgaggagctcagggtttcggaaatcattaaactttttttgtccttttaaagttggagacagcaattgtagacagccttccagtgggttatctttttgtgtctccttacctgtggagaagcctattagctgggatatgtagttaaatagctatatttatatatatccagggcaccccgaattcgggagagcttcccggagtcgaccttcctgctggctgctctgtgaccgcttcccggctctgccctcttggccgaagtgcccgctgccgggcgcgggcctcagacaatacaatggtgggtgaagagaagatgtctctaagaaaccggctgtcaaagtccagggaaaatcctgaggaagatgaagaccagagaaaccctgcaaaggagtccctagagacacctagtaatggtcgaattgacataaaacagttgatagcaaagaagataaagttgacagcagaggcagaggaattgaagccattttttatgaaggaagttggcagtcactttgatgattttgtgaccaatctcattgaaaagtcagcatcattagataatggtgggtgcgctctcacaaccttttctgttcttgaaggagagaaaaacaaccatagagcgaaggatttgagagcacctccagaacaaggaaagatttttattgcaaggcgctctctcttagatgaactgcttgaagtggaccacatcagaacaatatatcacatgtttattgccctcctcattctctttatcctcagcacacttgtagtagattacattgatgaaggaaggctggtgcttgagttcagcctcctgtcttatgcttttggcaaatttcctaccgttgtttggacctggtggatcatgttcctgtctacattttcagttccctattttctgtttcaacattgggccactggctatagcaagagttctcatccgctgatccgttctctcttccatggctttcttttcatgatcttccagattggagttctaggttttggaccaacatatgttgtgttagcatatacactgccaccagcttcccggttcatcattatattcgagcagattcgttttgtaatgaaggcccactcatttgtcagagagaacgtgcctcgggtactaaattcagctaaggagaaatcaagcactgttccaatacctacagtcaaccagtatttgtacttcttatttgctcctacccttatctaccgtgacagctatcccaggaatcccactgtaagatggggttatgtcgctatgaagtttgcacaggtctttggttgctttttctatgtgtactacatctttgaaaggctttgtgcccccttgtttcggaatatcaaacaggagcccttcagcgctcgtgttctggtcctatgtgtatttaactccatcttgccaggtgtgctgattctcttccttactttttttgcctttttgcactgctggctcaatgcctttgctgagatgttacgctttggtgacaggatgttctataaggattggtggaactccacgtcatactccaactattatagaacctggaatgtggtggtccatgactggctatattactatgcttacaaggactttctctggtttttctccaagagattcaaatctgctgccatgttagctgtctttgctgtatctgctgtagtacacgaatatgccttggctgtttgcttgagctttttctatcccgtgctcttcgtgctcttcatgttctttggaatggctttcaacttcattgtcaatgatagtcggaaaaagccgatttggaatgttctgatgtggacttctcttttcttgggcaatggagtcttactctgcttttattctcaagaatggtatgcacgtcagcactgtcctctgaaaaatcccacatttttggattatgtccggccacgttcctggacttgtcgttacgtgttttagaagcttggactttgtttcctccttgtcactgaagattgggtagctccctgatttggagccagctgtttccagttgttactgaagttatctgtgttatttggaccactccaggctttacagatgactcactccattcctaggtcacttgaagccaaactgttggaagttcactggagtcttgtacacttaagcagagcagaactttttttgtggggctgggtggggggagaagaccgactaacagctgaagtaatgacagattgttgctgggtcatatcagctttatcccttggtaattatatctgttttgtttcttgactctgtccaatcagagaataaacatcatagtttcttggccactgaattagccaaaacacttaggaagaaatcacttaaatacctctggcttagaaattttttcatgcacactgttggaatgtatgctaattgaacatgcaattggggaagaaaaaatgtagaatgatttttgctatttctagtagaaagaaaatgtctgttttccaaagataatgttatacatcctattttgtaatttttttgaaaaaagttcaatgttcagttttccttagtttttaccttgttttctctataggtcatgatttctgtgaagcaaaaagatgccttttaccatgaattcttgagtttacatcaataatattgtatattaaggggatcagaagtaggaaggaaaaaataagagatagcagaggaaaaagaaaaacatttcctcttataacttctgaagtaatttgtaaaaaagatttgtagagtcaatcatgtgtttaaattattttatcacaaacttaacatggaagatattcctttttaactttgtggtaacttctttgaagttatttagaaatatcctttggaacaattattttattgtctaataaatattgacttctcttgaattattttgcagactagtgagtctgtaacataagtattaatcacctccactcatattaaagtgatcattaagaatccagaagctggcttctgcatttgctcagttatacttttaatggtagtatgtttttaggtggaataaattaatatgtgattggtttcaaggaaatgtactctattatgtaatacttccattttataagatgcccatttctaatacaatgtgtgtaggaattatttgtatgtatgaggtatgattgtaaagattgagcattggaaggggtatcagagaccatgtagttcaactttccactcaaagtaagatttatgaattatttaaatgatagttgttacttggaacagccacttgagaggctctcttggtattgtttggaattgttttaaagtcagtttgagtctcacaagaaggtaagtagagtttcttaatagtcacaacttaatttgaaccacaagtatccagcttaatcacgtatcttactcacgataccactggtccagatgagtttaggtaattttcaaacattaaatccaacttcaacggaaacaaatacactcaagggaagttatttttaaaaaggtactctgcatgttcccgcagtaatgttctgcacaacagtattgtaattgtaatggaatcataacctgctaactagtttgctttaatatggcttgtaattcttgacatttttcttaaaattaaaacgaatttttattttgaatttataactgcattttaaatatattggggacagattgcgctgagacctggttatgagcaagccaatcttttgaatctagagaatggaattcttaggtttatatttctgttaagaaatactataaatatgactcttatgagaagactttgttgctctgtagtgtttctgaatactgtatttgttggattgatcaaggctatttttcaaaaagctctctgcttcctgtttgtttgtttgtttgtttttgagacagagtcttgctctgtcgccggggctggagtgcaatggcgtgaactcagctcactgcaacctctgcctccctggttcaagctattctcctgcctcagcctcctgagtagctgggattacagggccacgcctggctaatttttgtatttttagtagagatggggtttcaccctgttggtcaggctggtctcaaactcctgaccttgtgatctgcccacctcagcctcccaaagtgctgggaagacaggcgttagccaccgtgcccggcctctgtttcctgttattagtgattttcctgcccaagattgcaacaacaaatatgtagaactacagactgtttagaatgctgagactgttctaagaaactttcaaaaacagtagcacttcaaggaatggtcactttctatgaaagaaactggtttgatagccataatcttattgctagctgcttttagcaaaagtcttttcttgaaaccaccacctatactctttaaacaaataaaaactaaaatctcttgctaatgt

SEQ ID NO: 418434 - DNA, 973 bp, Homo sapiens
ggccgggctgtccggcgctttagcttagcaggcgacgttgcgggccctgggcgccaggagagcttcccggagtcgaccttcctgctggctgctctgtgaccgcttcccggctctgccctcttggccgaagtgcccgctgccgggcgcgggcctcagacaatacaatggtgggtgaagagaagatgtctctaagaaaccggctgtcaaagtccagggaaaatcctgaggaagatgaagaccagagaaaccctgcaaaggagtccctagagacacctagtaatggtcgaattgacataaaacagttgatagcaaagaagataaagttgacagcagaggcagaggaattgaagccattttttatgaaggaagttggcagtcactttgatgattttgtgaccaatctcattgaaaagtcagcatcattagataatggtgggtgcgctctcacaaccttttctgttcttgaaggagagaaaaacaaccatagagcgaaggatttgagagcacctccagaacaaggaaagatttttattgcaaggcgctctctcttagatgaactgcttgaagtggaccacatcagaacaatatatcacatgtttattgccctcctcattctctttatcctcagcacacttgtagtagattacattgatgaaggaaggctggtgcttgagttcagttatctgtgctagtgacaatgaatgtcagaactgccaaaggataccagtgatcatacgatgatttgcatgatcgggtctatttcacccaatagtcacttgtgtgtcccccgaaattgggatgggtgagcacccttgctgtggtgtaaacttcctgttatttaatctcccccacggtttcatttttctcttctgttaatacttagaactttctaagaaactccatgaaatgaggaaatactgtttctaataatatgaggtaagaagtcacatgtcttccaagtggcagctcatgg

SEQ ID NO: 418435 - DNA, 622 bp, Homo sapiens
agcgaggcgttggagagctccgaggccgggcccgatggcgtccctgtctgcagcgccgcgtctgtcgacttgtccacgcccgtgttttcctgccgtaagaggttgcgcctgaacttggctcgggcgttctggaaccagacctgcgggggacgacagggaagggctggtgagcggaaggcaggcagagcattcccccgactgcttcactcagagctctgctgcctctggggacgctgatctgtgttttgccaagaggatccaaaaagtcagagacggggtcttgcaatgttgcccaggctggtctcaaactccaggcttcaagtgatccctcctgcctcagcctcctaaagcgttgggattacagatgtggttccagagctgagctgtactcccgaatatcacagccacgagccacgtatggctgctgagcacttaaaatggcattagcccaaattcaaccagtctgcaggtgaaaacacacaacctatctgaaggctgaatatgaaaaaaaaagcaggtagaatatctcaataatttttatattgattacatgtcgaaatgattaatagtttggctatactgagttaagcaaaatacattattaaaattaattttactttta

SEQ ID NO: 418436 - DNA, 531 bp, Homo sapiens
ctcagcctcctgggtagctggggctatagataggccaccggcccccgcctaaactttttaaagttaatttttttgtaagagacggggtcttgcaatgttgcccaggctggtctcaaactccaggcttcaagtgatccctcctgcctcagcctcctaaagcgttgggattacagatgtgagccactgcaccctggcccaatattttgctcttaataaaataaaacaaaaatttcactctatctaatgggctacggctgggcttctctttctgataggtggttccagagctgagctgtactcccgaatatcacagccacgagccacgtatggctgctgagcacttaaaatggcattagcccaaattcaaccagtctgcaggtgaaaacacacaacctatctgaaggctgaatatgaaaaaaaaagcaggtagaatatctcaataatttttatattgattacatgtcgaaatgattaatagtttggctatactgagttaagcaaaatacattattaaaattaattttactttta

SEQ ID NO: 418437 - DNA, 1366 bp, Homo sapiens
  misc_feature (485)..(485): n is a, c, g, or t
  misc_feature (512)..(512): n is a, c, g, or t
  misc_feature (524)..(524): n is a, c, g, or t
gatagattcacttatgttatgaatctatattgtctgaaacttttttcttaaaaaaatgattttcttaggcttcttcactctctctgactttactagctctagtaattgacgtacttttcataacagttttaagtaatcaaacagttatatcacttcagaagtgaaaaactctttgtcttcaaagacatctctttgataatagacttaccagttgctgatcctgaacaactggctaggcctgttcatttgttttttgtttgtttgtgagatggagttgctcaggttggagagcagtggcacaatctcggctcactgccgcctccatctaccaggttcgggcaattctcatgcctcagcctcccgagtagcagggattgcaggcgcatgcaaccgtgcctgggctaatttttgtatttttagcagagatggggtttcaccgtgttggccaggctggtcttgaactcctgacttcaggtaatccgccngccctcagcctcccaaagtgctgggantcacacctgttncatttgttaaagcaatttgctaaaaactgacgaggtttattccattgctatacagcagtgtttgattcagataaatatccttaatagagtcacatttccttcatgtcatgcctttaaggttgttccccaaatagtcataaagaacagaggatactcaggtatgtaagatcttagagccaagagagagtatggaaatggatgttcagctggtatttactgtcataagtgggattaggaattgtgggtttagggaattaaaaacaaccaacaattctacttggcttttaatctcttcagttatgagtgaagcatatttgcttgtaagggaagagataaggtaaaggaaatgaaataaagaaaaaaaatttggtggttggtatggggaattcaagaaagataaaattttgtagaaataaaaggcttgatgagctggattagaaacccagcacagttggaaaaattgacagttttcaatcaccaggcatatctttaaagtgaataaactgagattcaattaggacagggaaggaagtgaacaggagagataatggtatagcaaaagggagtccaaggagaagaagtctcagtgggagttttggaaaaccaagagaggcagcaagataccggaaagagcgtagacggtacaatgaacggtaagcaaagcataatttcccaaaatagtcttgatcagtatttcctgtaaaatgtttgatttaagcattttgtccatctctactaaaaatacaaaaaattagccggatgtggtggtgtgtgtctgtagtcctagctgctcggagggctgaggcaggagaatcacctgaacccgggaggcagaggttgca

SEQ ID NO: 418438 - DNA, 490 bp, Homo sapiens
gtgggagcgcccgctgattttgtttcttttttattctatcactgtggtaaactgctcctttatttcctgaattgtttttctgatttctttgtattgttttttgaaattctcttgtatctcattgggcttctttagtatcataattttgaattctttttctgggatttcttttttttttttttttttgaaacagagtgagatcctgtctcaaaaaaaaaagaaattaatgaagatattttttattgctattatgataaaatgcctaagatatattaaatgaaacaaaggtagatgcagtgaataatatactactgtttgtgtaaatagaagctatatgtatgtatgcatatatgtatatacttgtgtgtgtgtgtgtgtgtataattgcttttattagattaagtctttataaaaggatgcataagaaaccaaaacattggtgatccttagggagaactaaggtagctggaggaaggagaggggggctttt

SEQ ID NO: 418439 - DNA, 4786 bp, Homo sapiens
caactagaggagctcgccccctgcctgtgacagcttagggtcgcctactttttgtggacacactgccgtccacggagtgcagaggccgcctgcagttttcttgcgtccctgtgagacgcacggtggcgcaattcccgagcgtgccaatcccgggctggctggagggcgggctcttcaaatttgaattgcggaagtgttttgtgtgttagagaacgtcgcggaggaggtaagcgtcgcttggcgcctggccgccgcgggcaggatacaccgtgggcctgaggcgcgagcccggcggcgtgcggccctctctccgcgcggagccgagccggaactgcggcagtctctccctgccaggctcttcatccaaggtttctgtggatcccttctgaagttctatctgaaaattgcgcttaagtgaattttctgttagaagaacttggttgctactttcttgtcaagatgattgcaacacctttgaaacattcaagaatttacttacctccagaggcatcttctcaaaggagaaatctacccatggatgcaatcttttttgacagcattccttcaggcacacttactcctgtaaaagatttggtgaaatatcagaactcctccttaaaattgaatgaccataaaaagaatcagttcctaaaaatgacaacttttaacaataaaaatatatttcaatcaactatgctaacagaggctactacctctaacagttctcttgatatcagtgctataaagcccaacaaggatggattaaaaaataaagcaaactatgaatcaccaggaaaaatatttctaagaatgaaagaaaaagtactgcgtgacaagcaagaacagccatcaagaaacagtagtttgttggaaccacagaaaagtggaaataatgaaaccttcactcctaacagagttgaaaaaaaaaaattgcagcatacctacctatgtgaagaaaaggaaaacaacaaatcattccagtcagatgacagttcactaagagcctcagtccaaggagttcctctagaatcatcaaataatgatattttcctcccggtcaaacaaaagattcagtgccagcaggaaaagaaagcaccactgcacaatttaacttacgaacttccaactctgaaccaagaacaggaaaattttttggctgtagaagcccgaaacaagacattaactagagctcagttggctaaacaaatttttcactcaaaggagagtatagttgcaaccactaaatccaaaaaggacacgtttgttttagaaagcgttgattctgctgatgaacaatttcaaaatactaatgctgagactctcagtactaattgtattcctattaaaaatggcagcctgttaatggtttctgatagtgagaggacaacagaagggacttcgcaacagaaagttaaggaaggaaatggaaaaacagtgcctggagagacaggtcttccaggttccatgaaagatacatgtaaaattgtacttgcaacaccaagacttcatataacaatacctcggaggtcaaaaagaaatatttcaaagctttctcctccaagaatatttcaaactgttacaaatggacttaaaaaaaatcaggtagttcagctacaggaatggatgattaaaagcatcaataataatactgctatatgtgtagaaggaaaattgatagacgtcactaacatatattggcacagtaatgtaattatagagcggattgagcacaacaaacttaggactatatcaggcaacgtttatatattaaaaggcatgatagaccaaatttccatgaaagaagcaggatatccaaattatctcataaggaaatttatgtttggatttccagaaaattggaaagagcacattgataattttctggaacaattaagggctggtgaaaagaacagggaaaagaccaaacaaaaacagaaaactggaagatctgtccgtgacataaggaaatcaatgaaaaatgatgcacgagaaaaccaaacagatactgctcaaagagccaccaccacttacgattttgattgtgataatttggaactgaagagtaataagcacagtgagtcaccaggagctacagaattaaacatgtgccacagtaattgccaaaataaaccaacattaaggttcccagatgaccaagtaaataatactattcaaaatggaggaggagatgacttatctaatcaggaattaattggaaaaaaagaatataaaatgtcttcaaagaaactaaaaattggtgaaagaacaaatgaaaggataataaaaagtcagaagcaagagacaactgaagaattggatgtatccattgatattctaacctcaagggaacagtttttctcagatgaagaaagaaaatacatggccatcaatcagaagaaagcttatattttagtaacaccacttaaatctagaaaagtgatagagcaaagatgcatgaggtataatctgtccgctggcaccatcaaagcagtaacagattttgtaataccagagtgtcaaaaaaaaagtcccatcagcaagtccatggggactttagaaaatacatttgaaggtcataaaagtaaaaacaaggaagattgcgatgaacgtgacttacttactgtcaaccggaaaataaaaatatctaaccttgaaaaggaacaaatgctcacctctgactttaagaaaaataccagactattaccaaaattgaagaaaatagaaaatcaggtagctatgtcattttataagcatcagtcctcaccagatttgtcaagtgaagaaagtgaaacagaaaaggaaattaaaaggaaagctgaagttaagaaaaccaaagcaggaaacaccaaagaagcagtggttcacctgagaaagagcacaagaaacacaagtaatattccagtgattttggaacctgaaactgaagaaagtgaaaatgaattttatatcaaacaaaagaaagctagaccttccgtcaaagaaactcttcagaagtctggtgttaggaaagagtttccaattactgaggcagtaggatctgataagacaaataggcatcccttagaatgcttacctggtttaattcaggataaggaatggaatgagaaggagttacagaaacttcattgtgcttttgcatctcttccaaagcacaaacctggtttctggtcagaggtagctgcggctgtaggttctcgatctcctgaagaatgccagaggaaatacatggaaaatcccagaggaaaaggatcccagaaacatgtcactaagaagaagccagccaattccaaaggccaaaatggcaagagaggtgatgctgatcagaaacaaactattaagataactgccaaagtgggaactcttaaaaggaagcaacagatgagggaatttctggaacagttgccaaaagatgaccatgatgattttttcagtacaacacctttacagcatcaaagaatactgttgccaagtttccaggacagtgaagatgatgatgatattctgccaaatatggacaaaaatccaacaactccatcatcagttatctttccattggtaaaaactcctcaatgtcagcatgtcagtcctggcatgctaggttctataaataggaatgactgtgataaatatgtttttcgtatgcaaaaatatcataaaagtaatggtggtattgtctggggcaacatcaagaaaaaattagttgaaactgatttctcaactccaacaccaagaaggaaaaccccatttaacacagacttaggagaaaactctggtattggaaaacttttcactaatgctgtggaatctttagatgaagaagagaaagattattatttttcgaactctgattctgcatagtaaaatgagaaaatatgattcctgggatttttaccataaagcagacagtgtttgtattttcaactggagtacatgtattttctttgtaaagtagcttcctatgaaaatgtggacttttttgaaggtttcatatgtttgtgttcaaagtaaaatatcctcattgctgcagcttactaaaaatgtaaagaaaattgtttttgctcgtgtagatatctgtaaatttgtttttgcatattaaaatatatatagataattttttaataagcatccaagtctgtttactttaagaaaaccatttcccaaacagattttttttttatttcaagaaaattttgctaccatttaagtaagagaaggtgagaaggatgacagaggttgtattggtagctattgaattcatgaaaacttttaagttagcatttgttagcagttattatccaagccagagtaggatttgttaccagttgttatccaaacctaatgtttaaattacacattgttgaaattaaattacacattgttgacatgcttctctcctgattgtttttattttaaacttgtgataggcatatctatgaaacctttgtaaatttagtttattgctttaccattattttactaggtaaaattagagaacagattttgttctctaatttttaagccttatttacatatgcagaaacagcttaaatattttgactagattagacaaacagttaatagatccaccattaggaatcaatatattatgtcataataaacatcctttttctttcactgaaatttcttttagaaataaacttatttttgcttgttatgttttgaaacttgacataggatattttccctctggctacacattcacctacccttgttctctatttagattattcaaataaagttagtttgcttttatagtaaaaaaatc

SEQ ID NO: 418440 - DNA, 4905 bp, Homo sapiens
caactagaggagctcgccccctgcctgtgacagcttagggtcgcctactttttgtggacacactgccgtccacggagtgcagaggccgcctgcagttttcttgcgtccctgtgagacgcacggtggcgcaattcccgagcgtgccaatcccgggctggctggagggcgggctcttcaaatttgaattgcggaagtgttttgtgtgttagagaacgtcgcggaggaggtaagcgtcgcttggcgcctggccgccgcgggcaggatacaccgtgggcctgaggcgcgagcccggcggcgtgcggccctctctccgcgcggagccgagccggaactgcggcagtctctccctgccaggctcttcatccaaggtttctgtggatcccttctgaagttctatctgaaaattgcgcttaagtgaattttctgttagaagaacttggttgctactttcttgtcaagatgattgcaacacctttgaaacattcaagaatttacttacctccagaggcatcttctcaaaggagaaatctacccatggatgcaatcttttttgacagcattccttcaggcacacttactcctgtaaaagatttggtgaaatatcagaactcctccttaaaattgaatgaccataaaaagaatcagttcctaaaaatgacaacttttaacaataaaaatatatttcaatcaactatgctaacagaggctactacctctaacagttctcttgatatcagtgctataaagcccaacaaggatggattaaaaaataaagcaaactatgaatcaccaggaaaaatatttctaagaatgaaagaaaaagtactgcgtgacaagcaagaacagccatcaagaaacagtagtttgttggaaccacagaaaagtggaaataatgaaaccttcactcctaacagagttgaaaaaaaaaaattgcagcatacctacctatgtgaagaaaaggaaaacaacaaatcattccagtcagatgacagttcactaagagcctcagtccaaggagttcctctagaatcatcaaataatgatattttcctcccggtcaaacaaaagattcagtgccagcaggaaaagaaagcaccactgcacaatttaacttacgaacttccaactctgaaccaagaacaggaaaattttttggctgtagaagcccgaaacaagacattaactagagctcagttggctaaacaaatttttcactcaaaggagagtatagttgcaaccactaaatccaaaaaggacacgtttgttttagaaagcgttgattctgctgatgaacaatttcaaaatactaatgctgagactctcagtactaattgtattcctattaaaaatggcagcctgttaatggtttctgatagtgagaggacaacagaagggacttcgcaacagaaagttaaggaaggaaatggaaaaacagtgcctggagagacaggtcttccaggttccatgaaagatacatgtaaaattgtacttgcaacaccaagacttcatataacaatacctcggaggtcaaaaagaaatatttcaaagctttctcctccaagaatatttcaaactgttacaaatggacttaaaaaaaatcaggtagttcagctacaggaatggatgattaaaagcatcaataataatactgctatatgtgtagaaggaaaattgatagacgtcactaacatatattggcacagtaatgtaattatagagcggattgagcacaacaaacttaggactatatcaggcaacgtttatatattaaaaggcatgatagaccaaatttccatgaaagaagcaggatatccaaattatctcataaggaaatttatgtttggatttccagaaaattggaaagagcacattgataattttctggaacaattaagagatggggtttcgtcatgttggccagactggtctcgaactcctggctacaagtgatccgcctgtctcagcctcccaaagtgttgggattacaggcatgagccactgtgcctggcctgagggctggtgaaaagaacagggaaaagaccaaacaaaaacagaaaactggaagatctgtccgtgacataaggaaatcaatgaaaaatgatgcacgagaaaaccaaacagatactgctcaaagagccaccaccacttacgattttgattgtgataatttggaactgaagagtaataagcacagtgagtcaccaggagctacagaattaaacatgtgccacagtaattgccaaaataaaccaacattaaggttcccagatgaccaagtaaataatactattcaaaatggaggaggagatgacttatctaatcaggaattaattggaaaaaaagaatataaaatgtcttcaaagaaactaaaaattggtgaaagaacaaatgaaaggataataaaaagtcagaagcaagagacaactgaagaattggatgtatccattgatattctaacctcaagggaacagtttttctcagatgaagaaagaaaatacatggccatcaatcagaagaaagcttatattttagtaacaccacttaaatctagaaaagtgatagagcaaagatgcatgaggtataatctgtccgctggcaccatcaaagcagtaacagattttgtaataccagagtgtcaaaaaaaaagtcccatcagcaagtccatggggactttagaaaatacatttgaaggtcataaaagtaaaaacaaggaagattgcgatgaacgtgacttacttactgtcaaccggaaaataaaaatatctaaccttgaaaaggaacaaatgctcacctctgactttaagaaaaataccagactattaccaaaattgaagaaaatagaaaatcaggtagctatgtcattttataagcatcagtcctcaccagatttgtcaagtgaagaaagtgaaacagaaaaggaaattaaaaggaaagctgaagttaagaaaaccaaagcaggaaacaccaaagaagcagtggttcacctgagaaagagcacaagaaacacaagtaatattccagtgattttggaacctgaaactgaagaaagtgaaaatgaattttatatcaaacaaaagaaagctagaccttccgtcaaagaaactcttcagaagtctggtgttaggaaagagtttccaattactgaggcagtaggatctgataagacaaataggcatcccttagaatgcttacctggtttaattcaggataaggaatggaatgagaaggagttacagaaacttcattgtgcttttgcatctcttccaaagcacaaacctggtttctggtcagaggtagctgcggctgtaggttctcgatctcctgaagaatgccagaggaaatacatggaaaatcccagaggaaaaggatcccagaaacatgtcactaagaagaagccagccaattccaaaggccaaaatggcaagagaggtgatgctgatcagaaacaaactattaagataactgccaaagtgggaactcttaaaaggaagcaacagatgagggaatttctggaacagttgccaaaagatgaccatgatgattttttcagtacaacacctttacagcatcaaagaatactgttgccaagtttccaggacagtgaagatgatgatgatattctgccaaatatggacaaaaatccaacaactccatcatcagttatctttccattggtaaaaactcctcaatgtcagcatgtcagtcctggcatgctaggttctataaataggaatgactgtgataaatatgtttttcgtatgcaaaaatatcataaaagtaatggtggtattgtctggggcaacatcaagaaaaaattagttgaaactgatttctcaactccaacaccaagaaggaaaaccccatttaacacagacttaggagaaaactctggtattggaaaacttttcactaatgctgtggaatctttagatgaagaagagaaagattattatttttcgaactctgattctgcatagtaaaatgagaaaatatgattcctgggatttttaccataaagcagacagtgtttgtattttcaactggagtacatgtattttctttgtaaagtagcttcctatgaaaatgtggacttttttgaaggtttcatatgtttgtgttcaaagtaaaatatcctcattgctgcagcttactaaaaatgtaaagaaaattgtttttgctcgtgtagatatctgtaaatttgtttttgcatattaaaatatatatagataattttttaataagcatccaagtctgtttactttaagaaaaccatttcccaaacagattttttttttatttcaagaaaattttgctaccatttaagtaagagaaggtgagaaggatgacagaggttgtattggtagctattgaattcatgaaaacttttaagttagcatttgttagcagttattatccaagccagagtaggatttgttaccagttgttatccaaacctaatgtttaaattacacattgttgaaattaaattacacattgttgacatgcttctctcctgattgtttttattttaaacttgtgataggcatatctatgaaacctttgtaaatttagtttattgctttaccattattttactaggtaaaattagagaacagattttgttctctaatttttaagccttatttacatatgcagaaacagcttaaatattttgactagattagacaaacagttaatagatccaccattaggaatcaatatattatgtcataataaacatcctttttctttcactgaaatttcttttagaaataaacttatttttgcttgttatgttttgaaacttgacataggatattttccctctggctacacattcacctacccttgttctctatttagattattcaaataaagttagtttgcttttatagtaaaaaaatc

SEQ ID NO: 418441 - DNA, 5091 bp, Homo sapiens
caactagaggagctcgccccctgcctgtgacagcttagggtcgcctactttttgtggacacactgccgtccacggagtgcagaggccgcctgcagttttcttgcgtccctgtgagacgcacggtggcgcaattcccgagcgtgccaatcccgggctggctggagggcgggctcttcaaatttgaattgcggaagtgttttgtgtgttagagaacgtcgcggaggaggtaagcgtcgcttggcgcctggccgccgcgggcaggatacaccgtgggcctgaggcgcgagcccggcggcgtgcggccctctctccgcgcggagccgagccggaactgcggcagtctctccctgccaggctcttcatccaaggtttctgtggatcccttctgaagttctatctgaaaattgcgcttaagtgaattttctgttagaagaacttggttgctactttcttgtcaagatgattgcaacacctttgaaacattcaagaatttacttacctccagaggcatcttctcaaaggagaaatctacccatggatgcaatcttttttgacagcattccttcaggcacacttactcctgtaaaagatttggtgaaatatcagaactcctccttaaaattgaatgaccataaaaagaatcagttcctaaaaatgacaacttttaacaataaaaatatatttcaatcaactatgctaacagaggctactacctctaacagttctcttgatatcagtgctataaagcccaacaaggatggattaaaaaataaagcaaactatgaatcaccaggaaaaatatttctaagaatgaaagaaaaagtactgcgtgacaagcaagaacagccatcaagaaacagtagtttgttggaaccacagaaaagtggaaataatgaaaccttcactcctaacagagttgaaaaaaaaaaattgcagcatacctacctatgtgaagaaaaggaaaacaacaaatcattccagtcagatgacagttcactaagagcctcagtccaaggagttcctctagaatcatcaaataatgatattttcctcccggtcaaacaaaagattcagtgccagcaggaaaagaaagcaccactgcacaatttaacttacgaacttccaactctgaaccaagaacaggaaaattttttggctgtagaagcccgaaacaagacattaactagagctcagttggctaaacaaatttttcactcaaaggagagtatagttgcaaccactaaatccaaaaaggacacgtttgttttagaaagcgttgattctgctgatgaacaatttcaaaatactaatgctgagactctcagtactaattgtattcctattaaaaatggcagcctgttaatggtttctgatagtgagaggacaacagaagggacttcgcaacagaaagttaaggaaggaaatggaaaaacagtgcctggagagacaggtcttccaggttccatgaaagatacatgtaaaattgtacttgcaacaccaagacttcatataacaatacctcggaggtcaaaaagaaatatttcaaagctttctcctccaagaatatttcaaactgttacaaatggacttaaaaaaaatcaggtagttcagctacaggaatggatgattaaaagcatcaataataatactgctatatgtgtagaaggaaaattgatagacgtcactaacatatattggcacagtaatgtaattatagagcggattgagcacaacaaacttaggactatatcaggcaacgtttatatattaaaaggcatgatagaccaaatttccatgaaagaagcaggatatccaaattatctcataaggaaatttatgtttggatttccagaaaattggaaagagcacattgataattttctggaacaattaagagatggggtttcgtcatgttggccagactggtctcgaactcctggctacaagtgatccgcctgtctcagcctcccaaagtgttgggattacaggcatgagccactgtgcctggcctgagggctggtgaaaagaacagggaaaagaccaaacaaaaacagaaaactggaagatctgtccgtgacataaggaaatcaatgaaaaatgatgcacgagaaaaccaaacagatactgctcaaagagccaccaccacttacgattttgattgtgataatttggaactgaagagtaataagcacagtgagtcaccaggagctacagaattaaacatgtgccacagtaattgccaaaataaaccaacattaaggttcccagatgaccaagtaaataatactattcaaaatggaggaggagatgacttatctaatcaggaattaattggaaaaaaagaatataaaatgtcttcaaagaaactaaaaattggtgaaagaacaaatgaaaggataataaaaagtcagaagcaagagacaactgaagaattggatgtatccattgatattctaacctcaagggaacagtttttctcagatgaagaaagaaaatacatggccatcaatcagaagaaagcttatattttagtaacaccacttaaatctagaaaagtgatagagcaaagatgcatgaggtataatctgtccgctggcaccatcaaagcagtaacagattttgtaataccagagtgtcaaaaaaaaagtcccatcagcaagtccatggggactttagaaaatacatttgaaggtcataaaagtaaaaacaaggaagattgcgatgaacgtgacttacttactgtcaaccggaaaataaaaatatctaaccttgaaaaggaacaaatgctcacctctgactttaagaaaaataccagactattaccaaaattgaagaaaatagaaaatcaggtagctatgtcattttataagcatcagtcctcaccagatttgtcaagtgaagaaagtgaaacagaaaaggaaattaaaaggaaagctgaagttaagaaaaccaaagcaggaaacaccaaagaagcagtggttcacctgagaaagagcacaagaaacacaagtaatattccagtgattttggaacctgaaactgaagaaagtgaaaatgaattttatatcaaacaaaagaaagctagaccttccgtcaaagaaactcttcagaagtctggtgttaggaaagagtttccaattactgaggcagtaggatctgataagacaaataggcatcccttagaatgcttacctggtttaattcaggataaggaatggaatgagaaggagttacagaaacttcattgtgcttttgcatctcttccaaagcacaaacctggtttctggtcagaggtagctgcggctgtaggttctcgatctcctgaagaatgccagaggaaatacatggaaaatcccagaggaaaaggatcccagaaacatgtcactaagaagaagccagccaattccaaaggccaaaatggcaagagaggtgatgctgatcagaaacaaactattaagataactgccaaagtgggaactcttaaaaggaagcaacagatgagggaatttctggaacagttgccaaaagatgaccatgatgattttttcagtacaacacctttacagcatcaaagaatactgttgccaagtttccaggacagtgaagatgatgatgatattctgccaaatatggacaaaaatccaacaactccatcatcagttatctttccattggtaaaaactcctcaatgtcagcatgtcagtcctggcatgctaggttctataaataggaatgactgtgataaatatgtttttcgtatgcaaaaatatcataaaagtaatggtggtattgtctggggcaacatcaagaaaaaattagttgaaactgatttctcaactccaacaccaagaaggaaaaccccatttaacacaggtaatacacttacagctttcttttgtggctcagttctattataaggtaggttctttatttaaatggtattaaaattaattgctctcaagtggacagacttagcattttattccttatagttgttttcagttttattgaaagtacttttagaaatttattatctttttattaaacttctctttacagacttaggagaaaactctggtattggaaaacttttcactaatgctgtggaatctttagatgaagaagagaaagattattatttttcgaactctgattctgcatagtaaaatgagaaaatatgattcctgggatttttaccataaagcagacagtgtttgtattttcaactggagtacatgtattttctttgtaaagtagcttcctatgaaaatgtggacttttttgaaggtttcatatgtttgtgttcaaagtaaaatatcctcattgctgcagcttactaaaaatgtaaagaaaattgtttttgctcgtgtagatatctgtaaatttgtttttgcatattaaaatatatatagataattttttaataagcatccaagtctgtttactttaagaaaaccatttcccaaacagattttttttttatttcaagaaaattttgctaccatttaagtaagagaaggtgagaaggatgacagaggttgtattggtagctattgaattcatgaaaacttttaagttagcatttgttagcagttattatccaagccagagtaggatttgttaccagttgttatccaaacctaatgtttaaattacacattgttgaaattaaattacacattgttgacatgcttctctcctgattgtttttattttaaacttgtgataggcatatctatgaaacctttgtaaatttagtttattgctttaccattattttactaggtaaaattagagaacagattttgttctctaatttttaagccttatttacatatgcagaaacagcttaaatattttgactagattagacaaacagttaatagatccaccattaggaatcaatatattatgtcataataaacatcctttttctttcactgaaatttcttttagaaataaacttatttttgcttgttatgttttgaaacttgacataggatattttccctctggctacacattcacctacccttgttctctatttagattattcaaataaagttagtttgcttttatagtaaaaaaatc

SEQ ID NO: 418442 - DNA, 5057 bp, Homo sapiens
caactagaggagctcgccccctgcctgtgacagcttagggtcgcctactttttgtggacacactgccgtccacggagtgcagaggccgcctgcagttttcttgcgtccctgtgagacgcacggtggcgcaattcccgagcgtgccaatcccgggctggctggagggcgggctcttcaaatttgaattgcggaagtgttttgtgtgttagagaacgtcgcggaggaggtaagcgtcgcttggcgcctggccgccgcgggcaggatacaccgtgggcctgaggcgcgagcccggcggcgtgcggccctctctccgcgcggagccgagccggaactgcggcagtctctccctgccaggctcttcatccaaggtttctgtggatcccttctgaagttctatctgaaaattgcgcttaagtgaattttctgttagaagaacttggttgctactttcttgtcaagatgattgcaacacctttgaaacattcaagaatttacttacctccagaggcatcttctcaaaggagaaatctacccatggatgcaatcttttttgacagcattccttcaggcacacttactcctgtaaaagatttggtgaaatatcagaactcctccttaaaattgaatgaccataaaaagaatcagttcctaaaaatgacaacttttaacaataaaaatatatttcaatcaactatgctaacagaggctactacctctaacagttctcttgatatcagtgctataaagcccaacaaggatggattaaaaaataaagcaaactatgaatcaccaggaaaaatatttctaagaatgaaagaaaaagtactgcgtgacaagcaagaacagccatcaagaaacagtagtttgttggaaccacagaaaagtggaaataatgaaaccttcactcctaacagagttgaaaaaaaaaaattgcagcatacctacctatgtgaagaaaaggaaaacaacaaatcattccagtcagatgacagttcactaagagcctcagtccaaggagttcctctagaatcatcaaataatgatattttcctcccggtcaaacaaaagattcagtgccagcaggaaaagaaagcaccactgcacaatttaacttacgaacttccaactctgaaccaagaacaggaaaattttttggctgtagaagcccgaaacaagacattaactagagctcagttggctaaacaaatttttcactcaaaggagagtatagttgcaaccactaaatccaaaaaggacacgtttgttttagaaagcgttgattctgctgatgaacaatttcaaaatactaatgctgagactctcagtactaattgtattcctattaaaaatggcagcctgttaatggtttctgatagtgagaggacaacagaagggacttcgcaacagaaagttaaggaaggaaatggaaaaacagtgcctggagagacaggtcttccaggttccatgaaagatacatgtaaaattgtacttgcaacaccaagacttcatataacaatacctcggaggtcaaaaagaaatatttcaaagctttctcctccaagaatatttcaaactgttacaaatggacttaaaaaaaatcaggtagttcagctacaggaatggatgattaaaagcatcaataataatactgctatatgtgtagaaggaaaattgatagacgtcactaacatatattggcacagtaatgtaattatagagcggattgagcacaacaaacttaggactatatcaggcaacgtttatatattaaaaggcatgatagaccaaatttccatgaaagaagcaggatatccaaattatctcataaggaaatttatgtttggatttccagaaaattggaaagagcacattgataattttctggaacaattaagagatggggtttcgtcatgttggccagactggtctcgaactcctggctacaagtgatccgcctgtctcagcctcccaaagtgttgggattacaggcatgagccactgtgcctggcctgagggctggtgaaaagaacagggaaaagaccaaacaaaaacagaaaactggaagatctgtccgtgacataaggaaatcaatgaaaaatgatgcacgagaaaaccaaacagatactgctcaaagagccaccaccacttacgattttgattgtgataatttggaactgaagagtaataagcacagtgagtcaccaggagctacagaattaaacatgtgccacagtaattgccaaaataaaccaacattaaggttcccagatgaccaagtaaataatactattcaaaatggaggaggagatgacttatctaatcaggaattaattggaaaaaaagaatataaaatgtcttcaaagaaactaaaaattggtgaaagaacaaatgaaaggataataaaaagtcagaagcaagagacaactgaagaattggatgtatccattgatattctaacctcaagggaacagtttttctcagatgaagaaagaaaatacatggccatcaatcagaagaaagcttatattttagtaacaccacttaaatctagaaaagtgatagagcaaagatgcatgaggtataatctgtccgctggcaccatcaaagcagtaacagattttgtaataccagagtgtcaaaaaaaaagtcccatcagcaagtccatggggactttagaaaatacatttgaaggtcataaaagtaaaaacaaggaagattgcgatgaacgtgacttacttactgtcaaccggaaaataaaaatatctaaccttgaaaaggaacaaatgctcacctctgactttaagaaaaataccagactattaccaaaattgaagaaaatagaaaatcaggtagctatgtcattttataagcatcagtcctcaccagatttgtcaagtgaagaaagtgaaacagaaaaggaaattaaaaggaaagctgaagttaagaaaaccaaagcaggaaacaccaaagaagcagtggttcacctgagaaagagcacaagaaacacaagtaatattccagtgattttggaacctgaaactgaagaaagtgaaaatgaattttatatcaaacaaaagaaagctagaccttccgtcaaagaaactcttcagaagtctggtgttaggaaagagtttccaattactgaggcagtaggatctgataagacaaataggcatcccttagaatgcttacctggtttaattcaggataaggaatggaatgagaaggagttacagaaacttcattgtgcttttgcatctcttccaaagcacaaacctggtttctggtcagaggtagctgcggctgtaggttctcgatctcctgaagaatgccagaggaaatacatggaaaatcccagaggaaaaggatcccagaaacatgtcactaagaagaagccagccaattccaaaggccaaaatggcaagagaggtgatgctgatcagaaacaaactattaagataactgccaaagtgggaactcttaaaaggaagcaacagatgagggaatttctggaacagttgccaaaagatgaccatgatgattttttcagtacaacacctttacagcatcaaagaatactgttgccaagtttccaggacagtgaagatgatgatgatattctgccaaatatggacaaaaatccaacaactccatcatcagttatctttccattggtaaaaactcctcaatgtcagcatgtcagtcctggcatgctaggttctataaataggtaaatattcatgcatatgatatgttaattctctgcatcagagtagtgaggaacatttaaacatttcatgaggaccatagatgccagtaatgggaagaggcattatttaaaaaatcaagaatgtgtagtttctagaagttaaggatggacaagttcatcaaatcggggtgctattcaataaacagcattgtgatataacccacatttacttctggatcaattcgaaatggatcaaggttttacttgtaaaaaactttaaaaaaaaaaaactaaagaaaccttggagaattattttataataccagattagtgatggtctttctaactatactataaaacctacaagccattaatgaaaagatgaataaagtcaactgtgtaaaaatgtttaacaaattttacctggtaccaaccactacaaacaaaagacaacctgagaaaagaatatatgcaacttgtcacaggcaaaaggctaatttccgtaatatatacagcattcctacaaactaacaaggaatgcattgttaatttttgtgcattgctagtgagaaggtaaagtagtgcgatctttgcagcaacaatttgtaagtatcaaaattataaatgcacatgccctttgacttaggaattttacttatagaattgtgaatgtacagcttattcattgtagcattgtttaaatggcagtacctcaaaaatctatcagtagggactaattaaatgaactctggtccattatatagtcatagaaattaatgaagagccaggcacagtggctgaagcctgtaatcccagcactttgggaggatcacttgagcccaggagttcaagaccagcatgggcaacataggaagaccccatttctacaaaaaaaacccaaaaatgttagcaggatgcagtggggcaagcctgtggccctagctactagggaggctgatgtagaaggattgcttgagtcccagaggtgtaggctgcagtgagctgtgattgcaacaattgcactccatcctgggcaacagagtgagaacagagtgagatcctgtctcaaaaaaaaaagaaattaatgaagatattttttattgctattatgataaaatgcctaagatatattaaatgaaacaaaggtagatgcagtgaataatatactactgtttgtgtaaatagaagctatatgtatgtatgcatatatgtatatacttgtgtgtgtgtgtgtgtgtataattgcttttattagattaagtctttataaaaggatgcataagaaaccaaaacattggtgatccttagggagaactaaggtagctggaggaaggagaggggggctttt

SEQ ID NO: 418443 - DNA, 4851 bp, Homo sapiens
caactagaggagctcgccccctgcctgtgacagcttagggtcgcctactttttgtggacacactgccgtccacggagtgcagaggccgcctgcagttttcttgcgtccctgtgagacgcacggtggcgcaattcccgagcgtgccaatcccgggctggctggagggcgggctcttcaaatttgaattgcggaagtgttttgtgtgttagagaacgtcgcggaggaggtaagcgtcgcttggcgcctggccgccgcgggcaggatacaccgtgggcctgaggcgcgagcccggcggcgtgcggccctctctccgcgcggagccgagccggaactgcggcagtctctccctgccaggctcttcatccaaggtttctgtggatcccttctgaagttctatctgaaaattgcgcttaagtgaattttctgttagaagaacttggttgctactttcttgtcaagatgattgcaacacctttgaaacattcaagaatttacttacctccagaggcatcttctcaaaggagaaatctacccatggatgcaatcttttttgacagcattccttcaggcacacttactcctgtaaaagatttggtgaaatatcagaactcctccttaaaattgaatgaccataaaaagaatcagttcctaaaaatgacaacttttaacaataaaaatatatttcaatcaactatgctaacagaggctactacctctaacagttctcttgatatcagtgctataaagcccaacaaggatggattaaaaaataaagcaaactatgaatcaccaggaaaaatatttctaagaatgaaagaaaaagtactgcgtgacaagcaagaacagccatcaagaaacagtagtttgttggaaccacagaaaagtggaaataatgaaaccttcactcctaacagagttgaaaaaaaaaaattgcagcatacctacctatgtgaagaaaaggaaaacaacaaatcattccagtcagatgacagttcactaagagcctcagtccaaggagttcctctagaatcatcaaataatgatattttcctcccggtcaaacaaaagattcagtgccagcaggaaaagaaagcaccactgcacaatttaacttacgaacttccaactctgaaccaagaacaggaaaattttttggctgtagaagcccgaaacaagacattaactagagctcagttggctaaacaaatttttcactcaaaggagagtatagttgcaaccactaaatccaaaaaggacacgtttgttttagaaagcgttgattctgctgatgaacaatttcaaaatactaatgctgagactctcagtactaattgtattcctattaaaaatggcagcctgttaatggtttctgatagtgagaggacaacagaagggacttcgcaacagaaagttaaggaaggaaatggaaaaacagtgcctggagagacaggtcttccaggttccatgaaagatacatgtaaaattgtacttgcaacaccaagacttcatataacaatacctcggaggtcaaaaagaaatatttcaaagctttctcctccaagaatatttcaaactgttacaaatggacttaaaaaaaatcaggtagttcagctacaggaatggatgattaaaagcatcaataataatactgctatatgtgtagaaggaaaattgatagacgtcactaacatatattggcacagtaatgtaattatagagcggattgagcacaacaaacttaggactatatcaggcaacgtttatatattaaaaggcatgatagaccaaatttccatgaaagaagcaggatatccaaattatctcataaggaaatttatgtttggatttccagaaaattggaaagagcacattgataattttctggaacaattaagagatggggtttcgtcatgttggccagactggtctcgaactcctggctacaagtgatccgcctgtctcagcctcccaaagtgttgggattacaggcatgagccactgtgcctggcctgagggctggtgaaaagaacagggaaaagaccaaacaaaaacagaaaactggaagatctgtccgtgacataaggaaatcaatgaaaaatgatgcacgagaaaaccaaacagatactgctcaaagagccaccaccacttacgattttgattgtgataatttggaactgaagagtaataagcacagtgagtcaccaggagctacagaattaaacatgtgccacagtaattgccaaaataaaccaacattaaggttcccagatgaccaagtaaataatactattcaaaatggaggaggagatgacttatctaatcaggaattaattggaaaaaaagaatataaaatgtcttcaaagaaactaaaaattggtgaaagaacaaatgaaaggataataaaaagtcagaagcaagagacaactgaagaattggatgtatccattgatattctaacctcaagggaacagtttttctcagatgaagaaagaaaatacatggccatcaatcagaagaaagcttatattttagtaacaccacttaaatctagaaaagtgatagagcaaagatgcatgaggtataatctgtccgctggcaccatcaaagcagtaacagattttgtaataccagagtgtcaaaaaaaaagtcccatcagcaagtccatggggactttagaaaatacatttgaaggtcataaaagtaaaaacaaggaagattgcgatgaacgtgacttacttactgtcaaccggaaaataaaaatatctaaccttgaaaaggaacaaatgctcacctctgactttaagaaaaataccagactattaccaaaattgaagaaaatagaaaatcaggtagctatgtcattttataagcatcagtcctcaccagatttgtcaagtgaagaaagtgaaacagaaaaggaaattaaaaggaaagctgaagttaagaaaaccaaagcaggaaacaccaaagaagcagtggttcacctgagaaagagcacaagaaacacaagtaatattccagtgattttggaacctgaaactgaagaaagtgaaaatgaattttatatcaaacaaaagaaagctagaccttccgtcaaagaaactcttcagaagtctggtgttaggaaagagtttccaattactgaggcagtaggatctgataagacaaataggcatcccttagaatgcttacctggtttaattcaggataaggaatggaatgagaaggagttacagaaacttcattgtgcttttgcatctcttccaaagcacaaacctggtttctggtcagaggtagctgcggctgtaggttctcgatctcctgaagaatgccagaggaaatacatggaaaatcccagaggaaaaggatcccagaaacatgtcactaagaagaagccagccaattccaaaggccaaaatggcaagagaggtgatgctgatcagaaacaaactattaagataactgccaaagtgggaactcttaaaaggaagcaacagatgagggaatttctggaacagttgccaaaagatgaccatgatgattttttcagtacaacacctttacagcatcaaagaatactgttgccaagtttccaggacagtgaagatgatgatgatattctgccaaatatggacaaaaatccaacaactccatcatcagttatctttccattggtaaaaactcctcaatgtcagcatgtcagtcctggcatgctaggttctataaataggaatgactgtgataaatatgtttttcgtatgcaaaaatatcataaaagtaatggtggtattgtctggggcaacatcaagaaaaaattagttgaaactgatttctcaactccaacaccaagaaggaaaaccccatttaacacagacttaggagaaaactctggtattggaaaacttttcactaatgctgtggaatctttagatgaagaagagaaagattattatttttcgaactctgattctgcatagtaaaatgagatggagtacatgtattttctttgtaaagtagcttcctatgaaaatgtggacttttttgaaggtttcatatgtttgtgttcaaagtaaaatatcctcattgctgcagcttactaaaaatgtaaagaaaattgtttttgctcgtgtagatatctgtaaatttgtttttgcatattaaaatatatatagataattttttaataagcatccaagtctgtttactttaagaaaaccatttcccaaacagattttttttttatttcaagaaaattttgctaccatttaagtaagagaaggtgagaaggatgacagaggttgtattggtagctattgaattcatgaaaacttttaagttagcatttgttagcagttattatccaagccagagtaggatttgttaccagttgttatccaaacctaatgtttaaattacacattgttgaaattaaattacacattgttgacatgcttctctcctgattgtttttattttaaacttgtgataggcatatctatgaaacctttgtaaatttagtttattgctttaccattattttactaggtaaaattagagaacagattttgttctctaatttttaagccttatttacatatgcagaaacagcttaaatattttgactagattagacaaacagttaatagatccaccattaggaatcaatatattatgtcataataaacatcctttttctttcactgaaatttcttttagaaataaacttatttttgcttgttatgttttgaaacttgacataggatattttccctctggctacacattcacctacccttgttctctatttagattattcaaataaagttagtttgcttttatagtaaaaaaatc

SEQ ID NO: 418444 - DNA, 4894 bp, Homo sapiens
caactagaggagctcgccccctgcctgtgacagcttagggtcgcctactttttgtggacacactgccgtccacggagtgcagaggccgcctgcagttttcttgcgtccctgtgagacgcacggtggcgcaattcccgagcgtgccaatcccgggctggctggagggcgggctcttcaaatttgaattgcggaagtgttttgtgtgttagagaacgtcgcggaggaggtaagcgtcgcttggcgcctggccgccgcgggcaggatacaccgtgggcctgaggcgcgagcccggcggcgtgcggccctctctccgcgcggagccgagccggaactgcggcagtctctccctgccaggctcttcatccaaggggcagggacattaggaaacagaaagctctgttttggttcttggagcctttcaacgtgaccacaattatctgactttaaatgaagacagttctgcatgtccattacaggtttctgtggatcccttctgaagttctatctgaaaattgcgcttaagtgaattttctgttagaagaacttggttgctactttcttgtcaagatgattgcaacacctttgaaacattcaagaatttacttacctccagaggcatcttctcaaaggagaaatctacccatggatgcaatcttttttgacagcattccttcaggcacacttactcctgtaaaagatttggtgaaatatcagaactcctccttaaaattgaatgaccataaaaagaatcagttcctaaaaatgacaacttttaacaataaaaatatatttcaatcaactatgctaacagaggctactacctctaacagttctcttgatatcagtgctataaagcccaacaaggatggattaaaaaataaagcaaactatgaatcaccaggaaaaatatttctaagaatgaaagaaaaagtactgcgtgacaagcaagaacagccatcaagaaacagtagtttgttggaaccacagaaaagtggaaataatgaaaccttcactcctaacagagttgaaaaaaaaaaattgcagcatacctacctatgtgaagaaaaggaaaacaacaaatcattccagtcagatgacagttcactaagagcctcagtccaaggagttcctctagaatcatcaaataatgatattttcctcccggtcaaacaaaagattcagtgccagcaggaaaagaaagcaccactgcacaatttaacttacgaacttccaactctgaaccaagaacaggaaaattttttggctgtagaagcccgaaacaagacattaactagagctcagttggctaaacaaatttttcactcaaaggagagtatagttgcaaccactaaatccaaaaaggacacgtttgttttagaaagcgttgattctgctgatgaacaatttcaaaatactaatgctgagactctcagtactaattgtattcctattaaaaatggcagcctgttaatggtttctgatagtgagaggacaacagaagggacttcgcaacagaaagttaaggaaggaaatggaaaaacagtgcctggagagacaggtcttccaggttccatgaaagatacatgtaaaattgtacttgcaacaccaagacttcatataacaatacctcggaggtcaaaaagaaatatttcaaagctttctcctccaagaatatttcaaactgttacaaatggacttaaaaaaaatcaggtagttcagctacaggaatggatgattaaaagcatcaataataatactgctatatgtgtagaaggaaaattgatagacgtcactaacatatattggcacagtaatgtaattatagagcggattgagcacaacaaacttaggactatatcaggcaacgtttatatattaaaaggcatgatagaccaaatttccatgaaagaagcaggatatccaaattatctcataaggaaatttatgtttggatttccagaaaattggaaagagcacattgataattttctggaacaattaagggctggtgaaaagaacagggaaaagaccaaacaaaaacagaaaactggaagatctgtccgtgacataaggaaatcaatgaaaaatgatgcacgagaaaaccaaacagatactgctcaaagagccaccaccacttacgattttgattgtgataatttggaactgaagagtaataagcacagtgagtcaccaggagctacagaattaaacatgtgccacagtaattgccaaaataaaccaacattaaggttcccagatgaccaagtaaataatactattcaaaatggaggaggagatgacttatctaatcaggaattaattggaaaaaaagaatataaaatgtcttcaaagaaactaaaaattggtgaaagaacaaatgaaaggataataaaaagtcagaagcaagagacaactgaagaattggatgtatccattgatattctaacctcaagggaacagtttttctcagatgaagaaagaaaatacatggccatcaatcagaagaaagcttatattttagtaacaccacttaaatctagaaaagtgatagagcaaagatgcatgaggtataatctgtccgctggcaccatcaaagcagtaacagattttgtaataccagagtgtcaaaaaaaaagtcccatcagcaagtccatggggactttagaaaatacatttgaaggtcataaaagtaaaaacaaggaagattgcgatgaacgtgacttacttactgtcaaccggaaaataaaaatatctaaccttgaaaaggaacaaatgctcacctctgactttaagaaaaataccagactattaccaaaattgaagaaaatagaaaatcaggtagctatgtcattttataagcatcagtcctcaccagatttgtcaagtgaagaaagtgaaacagaaaaggaaattaaaaggaaagctgaagttaagaaaaccaaagcaggaaacaccaaagaagcagtggttcacctgagaaagagcacaagaaacacaagtaatattccagtgattttggaacctgaaactgaagaaagtgaaaatgaattttatatcaaacaaaagaaagctagaccttccgtcaaagaaactcttcagaagtctggtgttaggaaagagtttccaattactgaggcagtaggatctgataagacaaataggcatcccttagaatgcttacctggtttaattcaggataaggaatggaatgagaaggagttacagaaacttcattgtgcttttgcatctcttccaaagcacaaacctggtttctggtcagaggtagctgcggctgtaggttctcgatctcctgaagaatgccagaggaaatacatggaaaatcccagaggaaaaggatcccagaaacatgtcactaagaagaagccagccaattccaaaggccaaaatggcaagagaggtgatgctgatcagaaacaaactattaagataactgccaaagtgggaactcttaaaaggaagcaacagatgagggaatttctggaacagttgccaaaagatgaccatgatgattttttcagtacaacacctttacagcatcaaagaatactgttgccaagtttccaggacagtgaagatgatgatgatattctgccaaatatggacaaaaatccaacaactccatcatcagttatctttccattggtaaaaactcctcaatgtcagcatgtcagtcctggcatgctaggttctataaataggaatgactgtgataaatatgtttttcgtatgcaaaaatatcataaaagtaatggtggtattgtctggggcaacatcaagaaaaaattagttgaaactgatttctcaactccaacaccaagaaggaaaaccccatttaacacagacttaggagaaaactctggtattggaaaacttttcactaatgctgtggaatctttagatgaagaagagaaagattattatttttcgaactctgattctgcatagtaaaatgagaaaatatgattcctgggatttttaccataaagcagacagtgtttgtattttcaactggagtacatgtattttctttgtaaagtagcttcctatgaaaatgtggacttttttgaaggtttcatatgtttgtgttcaaagtaaaatatcctcattgctgcagcttactaaaaatgtaaagaaaattgtttttgctcgtgtagatatctgtaaatttgtttttgcatattaaaatatatatagataattttttaataagcatccaagtctgtttactttaagaaaaccatttcccaaacagattttttttttatttcaagaaaattttgctaccatttaagtaagagaaggtgagaaggatgacagaggttgtattggtagctattgaattcatgaaaacttttaagttagcatttgttagcagttattatccaagccagagtaggatttgttaccagttgttatccaaacctaatgtttaaattacacattgttgaaattaaattacacattgttgacatgcttctctcctgattgtttttattttaaacttgtgataggcatatctatgaaacctttgtaaatttagtttattgctttaccattattttactaggtaaaattagagaacagattttgttctctaatttttaagccttatttacatatgcagaaacagcttaaatattttgactagattagacaaacagttaatagatccaccattaggaatcaatatattatgtcataataaacatcctttttctttcactgaaatttcttttagaaataaacttatttttgcttgttatgttttgaaacttgacataggatattttccctctggctacacattcacctacccttgttctctatttagattattcaaataaagttagtttgcttttatagtaaaaaaatc

SEQ ID NO: 418445 - DNA, 3118 bp, Homo sapiens
attcggcacgaggagttaagaaaaccaaagcaggaaacaccaaagaagcaggtggttcacctgagaaagagcacaagaaacacaagtaatattccagtgattttggaacctgaaactgaagaaagtgaaaatgaattttatatcaaacaaaagaaaatagaaaatcaggtagctatgtcattttataagcatcagtcctcaccagatttgtcaagtgaagaaagtgaggctggtgaaaagaacagggaaaagaccaaacaaaaacagaaaactggaagatctgtccgtgacataaggaaatcaatgaaaaatgatgcacgagaaaaccaaacagatactgctcaaagagccaccaccacttacgattttgattgtgataatttggaactgaagagtaataagcacagtgagtcaccaggagctacagaattaaacatgtgccacagtaattgccaaaataaaccaacattaaggttcccagatgaccaagtaaataatactattcaaaatggaggaggagatgacttatctaatcaggaattaattggaaaaaaagaatataaaatgtcttcaaagaaactaaaaattggtgaaagaacaaatgaaaggataataaaaagtcagaagcaagagacaactgaagaattggatgtatccattgatattctaacctcaagggaacagtttttctcagatgaagaaagaaaatacatggccatcaatcagaagaaagcttatattttagtaacaccacttaaatctagaaaagtgatagagcaaagatgcatgaggtataatctgtccgctggcaccatcaaagcagtaacagattttgtaataccagagtgtcaaaaaaaaagtcccatcagcaagtccatggggactttagaaaatacatttgaaggtcataaaagtaaaaacaaggaagattgcgatgaacgtgacttacttactgtcaaccggaaaataaaaatatctaaccttgaaaaggaacaaatgctcacctctgactttaagaaaaataccagactattaccaaaattgaagaaaatagaaaatcaggtagctatgtcattttataagcatcagtcctcaccagatttgtcaagtgaagaaagtgaaacagaaaaggaaattaaaaggaaagctgaagttaagaaaaccaaagcaggaaacaccaaagaagcagtggttcacctgagaaagagcacaagaaacacaagtaatattccagtgattttggaacctgaaactgaagaaagtgaaaatgaattttatatcaaacaaaagaaagctagaccttccgtcaaagaaactcttcagaagtctggtgttaggaaagagtttccaattactgaggcagtaggatctgataagacaaataggcatcccttagaatgcttacctggtttaattcaggataaggaatggaatgagaaggagttacagaaacttcattgtgcttttgcatctcttccaaagcacaaacctggtttctggtcagaggtagctgcggctgtaggttctcgatctcctgaagaatgccagaggaaatacatggaaaatcccagaggaaaaggatcccagaaacatgtcactaagaagaagccagccaattccaaaggccaaaatggcaagagaggtgatgctgatcagaaacaaactattaagataactgccaaagtgggaactcttaaaaggaagcaacagatgagggaatttctggaacagttgccaaaagatgaccatgatgattttttcagtacaacacctttacagcatcaaagaatactgttgccaagtttccaggacagtgaagatgatgatgatattctgccaaatatggacaaaaatccaacaactccatcatcagttatctttccattggtaaaaactcctcaatgtcagcatgtcagtcctggcatgctaggttctataaataggaatgactgtgataaatatgtttttcgtatgcaaaaatatcataaaagtaatggtggtattgtctggggcaacatcaagaaaaaattagttgaaactgatttctcaactccaacaccaagaaggaaaaccccatttaacacagacttaggagaaaactctggtattggaaaacttttcactaatgctgtggaatctttagatgaagaagagaaagattattatttttcgaactctgattctgcatagtaaaatgagaaaatatgattcctgggatttttaccataaagcagacagtgtttgtattttcaactggagtacatgtattttctttgtaaagtagcttcctatgaaaatgtggacttttttgaaggtttcatatgtttgtgttcaaagtaaaatatcctcattgctgcagcttactaaaaatgtaaagaaaattgtttttgctcgtgtagatatctgtaaatttgtttttgcatattaaaatatatatagataattttttaataagcatccaagtctgtttactttaagaaaaccatttcccaaacagattttttttttatttcaagaaaattttgctaccatttaagtaagagaaggtgagaaggatgacagaggttgtattggtagctattgaattcatgaaaacttttaagttagcatttgttagcagttattatccaagccagagtaggatttgttaccagttgttatccaaacctaatgtttaaattacacattgttgaaattaaattacacattgttgacatgcttctctcctgattgtttttattttaaacttgtgataggcatatctatgaaacctttgtaaatttagtttattgctttaccattattttactaggtaaaattagagaacagattttgttctctaatttttaagccttatttacatatgcagaaacagcttaaatattttgactagattagacaaacagttaatagatccaccattaggaatcaatatattatgtcataataaacatcctttttctttcactgaaatttcttttagaaataaacttatttttgcttgttatgttttgaaacttgacataggatattttccctctggctacacattcacctacccttgttctctatttagattattcaaataaagttagtttgcttttatagtaaaaaaatc

SEQ ID NO: 418446 - DNA, 2937 bp, Homo sapiens
gagaatcagtattaaggaaaaataaaataattgtttttaaagggctggctggtgaaaagaacagggaaaagaccaaacaaaaacagaaaactggaagatctgtccgtgacataaggaaatcaatgaaaaatgatgcacgagaaaaccaaacagatactgctcaaagagccaccaccacttacgattttgattgtgataatttggaactgaagagtaataagcacagtgagtcaccaggagctacagaattaaacatgtgccacagtaattgccaaaataaaccaacattaaggttcccagatgaccaagtaaataatactattcaaaatggaggaggagatgacttatctaatcaggaattaattggaaaaaaagaatataaaatgtcttcaaagaaactaaaaattggtgaaagaacaaatgaaaggataataaaaagtcagaagcaagagacaactgaagaattggatgtatccattgatattctaacctcaagggaacagtttttctcagatgaagaaagaaaatacatggccatcaatcagaagaaagcttatattttagtaacaccacttaaatctagaaaagtgatagagcaaagatgcatgaggtataatctgtccgctggcaccatcaaagcagtaacagattttgtaataccagagtgtcaaaaaaaaagtcccatcagcaagtccatggggactttagaaaatacatttgaaggtcataaaagtaaaaacaaggaagattgcgatgaacgtgacttacttactgtcaaccggaaaataaaaatatctaaccttgaaaaggaacaaatgctcacctctgactttaagaaaaataccagactattaccaaaattgaagaaaatagaaaatcaggtagctatgtcattttataagcatcagtcctcaccagatttgtcaagtgaagaaagtgaaacagaaaaggaaattaaaaggaaagctgaagttaagaaaaccaaagcaggaaacaccaaagaagcagtggttcacctgagaaagagcacaagaaacacaagtaatattccagtgattttggaacctgaaactgaagaaagtgaaaatgaattttatatcaaacaaaagaaagctagaccttccgtcaaagaaactcttcagaagtctggtgttaggaaagagtttccaattactgaggcagtaggatctgataagacaaataggcatcccttagaatgcttacctggtttaattcaggataaggaatggaatgagaaggagttacagaaacttcattgtgcttttgcatctcttccaaagcacaaacctggtttctggtcagaggtagctgcggctgtaggttctcgatctcctgaagaatgccagaggaaatacatggaaaatcccagaggaaaaggatcccagaaacatgtcactaagaagaagccagccaattccaaaggccaaaatggcaagagaggtgatgctgatcagaaacaaactattaagataactgccaaagtgggaactcttaaaaggaagcaacagatgagggaatttctggaacagttgccaaaagatgaccatgatgattttttcagtacaacacctttacagcatcaaagaatactgttgccaagtttccaggacagtgaagatgatgatgatattctgccaaatatggacaaaaatccaacaactccatcatcagttatctttccattggtaaaaactcctcaatgtcagcatgtcagtcctggcatgctaggttctataaataggaatgactgtgataaatatgtttttcgtatgcaaaaatatcataaaagtaatggtggtattgtctggggcaacatcaagaaaaaattagttgaaactgatttctcaactccaacaccaagaaggaaaaccccatttaacacagacttaggagaaaactctggtattggaaaacttttcactaatgctgtggaatctttagatgaagaagagaaagattattatttttcgaactctgattctgcatagtaaaatgagaaaatatgattcctgggatttttaccataaagcagacagtgtttgtattttcaactggagtacatgtattttctttgtaaagtagcttcctatgaaaatgtggacttttttgaaggtttcatatgtttgtgttcaaagtaaaatatcctcattgctgcagcttactaaaaatgtaaagaaaattgtttttgctcgtgtagatatctgtaaatttgtttttgcatattaaaatatatatagataattttttaataagcatccaagtctgtttactttaagaaaaccatttcccaaacagattttttttttatttcaagaaaattttgctaccatttaagtaagagaaggtgagaaggatgacagaggttgtattggtagctattgaattcatgaaaacttttaagttagcatttgttagcagttattatccaagccagagtaggatttgttaccagttgttatccaaacctaatgtttaaattacacattgttgaaattaaattacacattgttgacatgcttctctcctgattgtttttattttaaacttgtgataggcatatctatgaaacctttgtaaatttagtttattgctttaccattattttactaggtaaaattagagaacagattttgttctctaatttttaagccttatttacatatgcagaaacagcttaaatattttgactagattagacaaacagttaatagatccaccattaggaatcaatatattatgtcataataaacatcctttttctttcactgaaatttcttttagaaataaacttatttttgcttgttatgttttgaaacttgacataggatattttccctctggctacacattcacctacccttgttctctatttagattattcaaataaagttagtttgcttttatagtaaaaaaatc

SEQ ID NO: 418447 - DNA, 1648 bp, Homo sapiens
  misc_feature (9)..(9): n is a, c, g, or t
agaggatcnccggaaggcacactgcaacacatcagggtcaaatggttgaacatttgataaagagataaaggataaaggtctcttgaaagcagccaagaaggaagtgactcatgttaaaggatcctcaataagaggaagccagccaattccaaaggccaaaatggcaagagaggtgatgctgatcagaaacaaactattaagataactgccaaagtgggaactcttaaaaggaagcaacagatgagggaatttctggaacagttgccaaaagatgaccatgatgattttttcagtacaacacctttacagcatcaaagaatactgttgccaagtttccaggacagtgaagatgatgatgatattctgccaaatatggacaaaaatccaacaactccatcatcagttatctttccattggtaaaaactcctcaatgtcagcatgtcagtcctggcatgctaggttctataaataggaatgactgtgataaatatgtttttcgtatgcaaaaatatcataaaagtaatggtggtattgtctggggcaacatcaagaaaaaattagttgaaactgatttctcaactccaacaccaagaaggaaaaccccatttaacacagacttaggagaaaactctggtattggaaaacttttcactaatgctgtggaatctttagatgaagaagagaaagattattatttttcgaactctgattctgcatagtaaaatgagaaaatatgattcctgggatttttaccataaagcagacagtgtttgtattttcaactggagtacatgtattttctttgtaaagtagcttcctatgaaaatgtggacttttttgaaggtttcatatgtttgtgttcaaagtaaaatatcctcattgctgcagcttactaaaaatgtaaagaaaattgtttttgctcgtgtagatatctgtaaatttgtttttgcatattaaaatatatatagataattttttaataagcatccaagtctgtttactttaagaaaaccatttcccaaacagattttttttttatttcaagaaaattttgctaccatttaagtaagagaaggtgagaaggatgacagaggttgtattggtagctattgaattcatgaaaacttttaagttagcatttgttagcagttattatccaagccagagtaggatttgttaccagttgttatccaaacctaatgtttaaattacacattgttgaaattaaattacacattgttgacatgcttctctcctgattgtttttattttaaacttgtgataggcatatctatgaaacctttgtaaatttagtttattgctttaccattattttactaggtaaaattagagaacagattttgttctctaatttttaagccttatttacatatgcagaaacagcttaaatattttgactagattagacaaacagttaatagatccaccattaggaatcaatatattatgtcataataaacatcctttttctttcactgaaatttcttttagaaataaacttatttttgcttgttatgttttgaaacttgacataggatattttccctctggctacacattcacctacccttgttctctatttagattattcaaataaagttagtttgcttttatagtaaaaaaatc

SEQ ID NO: 418448 - DNA, 2919 bp, Homo sapiens
  misc_feature (485)..(485): n is a, c, g, or t
  misc_feature (512)..(512): n is a, c, g, or t
  misc_feature (524)..(524): n is a, c, g, or t
gatagattcacttatgttatgaatctatattgtctgaaacttttttcttaaaaaaatgattttcttaggcttcttcactctctctgactttactagctctagtaattgacgtacttttcataacagttttaagtaatcaaacagttatatcacttcagaagtgaaaaactctttgtcttcaaagacatctctttgataatagacttaccagttgctgatcctgaacaactggctaggcctgttcatttgttttttgtttgtttgtgagatggagttgctcaggttggagagcagtggcacaatctcggctcactgccgcctccatctaccaggttcgggcaattctcatgcctcagcctcccgagtagcagggattgcaggcgcatgcaaccgtgcctgggctaatttttgtatttttagcagagatggggtttcaccgtgttggccaggctggtcttgaactcctgacttcaggtaatccgccngccctcagcctcccaaagtgctgggantcacacctgttncatttgttaaagcaatttgctaaaaactgacgaggtttattccattgctatacagcagtgtttgattcagataaatatccttaatagagtcacatttccttcatgtcatgcctttaaggttgttccccaaatagtcataaagaacagaggatactcaggtatgtaagatcttagagccaagagagagtatggaaatggatgttcagctggtatttactgtcataagtgggattaggaattgtgggtttagggaattaaaaacaaccaacaattctacttggcttttaatctcttcagttatgagtgaagcatatttgcttgtaagggaagagataaggtaaaggaaatgaaataaagaaaaaaaatttggtggttggtatggggaattcaagaaagataaaattttgtagaaataaaaggcttgatgagctggattagaaacccagcacagttggaaaaattgacagttttcaatcaccaggcatatctttaaagtgaataaactgagattcaattaggacagggaaggaagtgaacaggagagataatggtatagcaaaagggagtccaaggagaagaagtctcagtgggagttttggaaaaccaagagaggcagcaagataccggaaagagcgtagacggtacaatgaacggtaagcaaagcataatttcccaaaatagtcttgatcagtatttcctgtaaaatgtttgatttaagcattttgtccatctccataggcacattttattgtcctctttaaaatacagaatgtactttttaaagatggaaatacgtttgaggtcaggcgtggtggctcacgactgtcatcccaacactttgggaggcccaggagggcagattgcttgatgagctcagtagtttgaaaccagcctgggcaatgtggtgaaaccctgtctcttaagaaaaatacaaagattagccaggcatgatggcacgtgcctgtagtccaagctacttgggaggctgagttgggaggatcacttgagcccaggaggttgaggctgcagtgagccattatcatgttactgcactccagcctgggcgacagagtgagaccctgtttcaaaaaaagaaatacatttgaaattaatttaggcaattgttgttcaacctgtggttaaaagtatgacagttaacttaaaattattaggttgacttaaaaatattgttgacttaaaattatttcgtattcaaacaggaatgactgtgataaatatgtttttcgtatgcaaaaatatcataaaagtaatggtggtattgtctggggcaacatcaagaaaaaattagttgaaactgatttctcaactccaacaccaagaaggaaaaccccatttaacacagacttaggagaaaactctggtattggaaaacttttcactaatgctgtggaatctttagatgaagaagagaaagattattatttttcgaactctgattctgcatagtaaaatgagaaaatatgattcctgggatttttaccataaagcagacagtgtttgtattttcaactggagtacatgtattttctttgtaaagtagcttcctatgaaaatgtggacttttttgaaggtttcatatgtttgtgttcaaagtaaaatatcctcattgctgcagcttactaaaaatgtaaagaaaattgtttttgctcgtgtagatatctgtaaatttgtttttgcatattaaaatatatatagataattttttaataagcatccaagtctgtttactttaagaaaaccatttcccaaacagattttttttttatttcaagaaaattttgctaccatttaagtaagagaaggtgagaaggatgacagaggttgtattggtagctattgaattcatgaaaacttttaagttagcatttgttagcagttattatccaagccagagtaggatttgttaccagttgttatccaaacctaatgtttaaattacacattgttgaaattaaattacacattgttgacatgcttctctcctgattgtttttattttaaacttgtgataggcatatctatgaaacctttgtaaatttagtttattgctttaccattattttactaggtaaaattagagaacagattttgttctctaatttttaagccttatttacatatgcagaaacagcttaaatattttgactagattagacaaacagttaatagatccaccattaggaatcaatatattatgtcataataaacatcctttttctttcactgaaatttcttttagaaataaacttatttttgcttgttatgttttgaaacttgacataggatattttccctctggctacacattcacctacccttgttctctatttagattattcaaataaagttagtttgcttttatagtaaaaaaatc

SEQ ID NO: 418449 - DNA, 1523 bp, Homo sapiens
aataccttttatggggtgcctgctgataataaatacttgttttctagttgccaagtttccaggacagtgaagatgatgatgatattctgccaaatatggacaaaaatccaacaactccatcatcagttatctttccattggtaaaaactcctcaatgtcagcatgtcagtcctggcatgctaggttctataaataggtaaatattcatgcatatgatatgttaattctctgcatcagagtagtgaggaacatttaaacatttcatgaggaccatagatgccagtaatgggaagaggcattatttaaaaaatcaagaatgtgtagtttctagaagttaaggatggacaagttcatcaaatcggggtgctattcaataaacagcattgtgatataacccacatttacttctggatcaattcgaaatggatcaaggttttacttgtaaaaaactttaaaaaaaaaaaactaaagaaaccttggagaattattttataataccagattagtgatggtctttctaactatactataaaacctacaagccattaatgaaaagatgaataaagtcaactgtgtaaaaatgtttaacaaattttacctggtaccaaccactacaaacaaaagacaacctgagaaaagaatatatgcaacttgtcacaggcaaaaggctaatttccgtaatatatacagcattcctacaaactaacaaggaatgcattgttaatttttgtgcattgctagtgagaaggtaaagtagtgcgatctttgcagcaacaatttgtaagtatcaaaattataaatgcacatgccctttgacttaggaattttacttatagaattgtgaatgtacagcttattcattgtagcattgtttaaatggcagtacctcaaaaatctatcagtagggactaattaaatgaactctggtccattatatagtcatagaaattaatgaagagccaggcacagtggctgaagcctgtaatcccagcactttgggaggatcacttgagcccaggagttcaagaccagcatgggcaacataggaagaccccatttctacaaaaaaaacccaaaaatgttagcaggatgcagtggggcaagcctgtggccctagctactagggaggctgatgtagaaggattgcttgagtcccagaggtgtaggctgcagtgagctgtgattgcaacaattgcactccatcctgggcaacagagtgagaacagagtgagatcctgtctcaaaaaaaaaagaaattaatgaagatattttttattgctattatgataaaatgcctaagatatattaaatgaaacaaaggtagatgcagtgaataatatactactgtttgtgtaaatagaagctatatgtatgtatgcatatatgtatatacttgtgtgtgtgtgtgtgtgtataattgcttttattagattaagtctttataaaaggatgcataagaaaccaaaacattggtgatccttagggagaactaaggtagctggaggaaggagaggggggctttt

SEQ ID NO: 418450 - DNA, 2849 bp, Homo sapiens
  misc_feature (485)..(485): n is a, c, g, or t
  misc_feature (512)..(512): n is a, c, g, or t
  misc_feature (524)..(524): n is a, c, g, or t
gatagattcacttatgttatgaatctatattgtctgaaacttttttcttaaaaaaatgattttcttaggcttcttcactctctctgactttactagctctagtaattgacgtacttttcataacagttttaagtaatcaaacagttatatcacttcagaagtgaaaaactctttgtcttcaaagacatctctttgataatagacttaccagttgctgatcctgaacaactggctaggcctgttcatttgttttttgtttgtttgtgagatggagttgctcaggttggagagcagtggcacaatctcggctcactgccgcctccatctaccaggttcgggcaattctcatgcctcagcctcccgagtagcagggattgcaggcgcatgcaaccgtgcctgggctaatttttgtatttttagcagagatggggtttcaccgtgttggccaggctggtcttgaactcctgacttcaggtaatccgccngccctcagcctcccaaagtgctgggantcacacctgttncatttgttaaagcaatttgctaaaaactgacgaggtttattccattgctatacagcagtgtttgattcagataaatatccttaatagagtcacatttccttcatgtcatgcctttaaggttgttccccaaatagtcataaagaacagaggatactcaggtatgtaagatcttagagccaagagagagtatggaaatggatgttcagctggtatttactgtcataagtgggattaggaattgtgggtttagggaattaaaaacaaccaacaattctacttggcttttaatctcttcagttatgagtgaagcatatttgcttgtaagggaagagataaggtaaaggaaatgaaataaagaaaaaaaatttggtggttggtatggggaattcaagaaagataaaattttgtagaaataaaaggcttgatgagctggattagaaacccagcacagttggaaaaattgacagttttcaatcaccaggcatatctttaaagtgaataaactgagattcaattaggacagggaaggaagtgaacaggagagataatggtatagcaaaagggagtccaaggagaagaagtctcagtgggagttttggaaaaccaagagaggcagcaagataccggaaagagcgtagacggtacaatgaacggtaagcaaagcataatttcccaaaatagtcttgatcagtatttcctgtaaaatgtttgatttaagcattttgtccatctccataggcacattttattgtcctctttaaaatacagaatgtactttttaaagatggaaatacgtttgaggtcaggcgtggtggctcacgactgtcatcccaacactttgggaggcccaggagggcagattgcttgatgagctcagtagtttgaaaccagcctgggcaatgtggtgaaaccctgtctcttaagaaaaatacaaagattagccaggcatgatggcacgtgcctgtagtccaagctacttgggaggctgagttgggaggatcacttgagcccaggaggttgaggctgcagtgagccattatcatgttactgcactccagcctgggcgacagagtgagaccctgtttcaaaaaaagaaatacatttgaaattaatttaggcaattgttgttcaacctgtggttaaaagtatgacagttaacttaaaattattaggttgacttaaaaatattgttgacttaaaattatttcgtattcaaacaggaatgactgtgataaatatgtttttcgtatgcaaaaatatcataaaagtaatggtggtattgtctggggcaacatcaagaaaaaattagttgaaactgatttctcaactccaacaccaagaaggaaaaccccatttaacacagacttaggagaaaactctggtattggaaaacttttcactaatgctgtggaatctttagatgaagaagagaaagattattatttttcgaactctgattctgcatagtaaaatgagaaaatatgattcctgggatttttaccataaagcagacagtgtttgtattttcaactggagtacatgtattttctttgtaaagtagcttcctatgaaaatgtggacttttttgaaggtttcatatgtttgtgttcaaagtaaaatatcctcattgctgcagcttactaaaaatgtaaagaaaattgtttttgctcgtgtagatatctgtaaatttgtttttgcatattaaaatatatatagataatttaaacaaacaacacaccacctctacacacccctatctctttccctctaatccctccacacgggaatccaccacttcctccctatcaccataccacactctcacctgcaaatcttcccttcctaacaatctctactccgtggacctcccctcatattaaccaataaaacattgtgccctcctcgccaaactcttataccgtcgccttttattccgcgccgatatcggcacatttggcatattcccctatgggtgcgttaacaattgcgtcgctttaaaagcgcgctggggctcgggtcccccttatagtgtgggtacctctctgccgtggtgaatacgaagggcccactcggttcttctccaatgggctcctcttcgggacaaggaacgtggcgctaattttcatacacgcgcaatctttacaccgtctttacaacagcgccgcggcgatactctcatatacataacctctcataggtggttttccctctacacgcgtattattatctgccattcagtcgccctctcttgtcggtgcctcctctctcacccatcactttggcggggctctctccgctcccggcgccctctctgcgtctcgcctc

SEQ ID NO: 418451 - DNA, 290 bp, Homo sapiens
ctcctccctcggcctcccagagtgctgggattacaggcgtgagccaccacacctagcgtcaaagttaattcttcatgtagaaaagcagcttctcttttatataaccatttattgaaatctccatctttgtattcatagaactgaagagtaataagcacagtgagtcaccaggagctacagaattaaacatgtgccacagtaattgccaaaataaaccaacattaaggttcccagatgaccaagtaaataatactattcaaaatggaggaggagatgacttatctaatcag

SEQ ID NO: 418452 - DNA, 515 bp, Homo sapiens
ttttttcttttaatgtaagttaattttgtaatgcttgtgctgcaagtaatacaggaaatatgttctttgttttatacttgattaggtagttcagctacaggaatggatgattaaaagcatcaataataatactgctatatgtgtagaaggaaaattgatgtaagtatactatttcattattcttttaataaaactttagttatgtgtaagcacttaagagttaatgcatgagaaatagcatcctccacaaagcaaagacctaacaaggttatgaactgaaggcaaaaaagtaaaattactgtgcaggtcctagccatgttgattgctaccagctttcttgtttttgcatgtttactcaagtttttcttaaaataatgacagttcaaatttgtatagtggtttatttttttctgaggtgctaataagtggactggtattatctgcttaattatatatgatcagttaatatttactacatgcatttcagtccagattctcacatctaaattgggaca

SEQ ID NO: 418453 - DNA, 606 bp, Homo sapiens
aagtaattgatgatacaccattttttccctagatgcatgaagaagcagaggctgtgttggcaacaccaccaaagcaacctatagttgatacatctgctgaatcctgacctcatatttatgatggatatagatacatactatatatattcatatttgtggatttcctaaaagcctcagaaaatacgactgactaggcagcaaagacaggagtatcttctgtacactgttccgcagttactggtacatgaacagttggaactgctgactttcctaaccaaaacaacttccttctctcctttgttgagccttttgaggggttcatgattcattaccacagttttaagagtttcagttaccattgtatgcaagagccaagcactgaatacctacataggttttctattttctttcattttaaaagcgtaatgacagtggaacaataatgggatatgcagaagcacccttcacaagttatttctgaatgatttttagggtaaataatacagatgccttgtttgttaactaacttgtggaaaggaagggaggtcttaaggtgtgttctattacacaatggggggggatcggtgggttatagggccttggcct

SEQ ID NO: 418454 - DNA, 2019 bp, Homo sapiens
tatgcatcattagataaagaagatttattgagtcctattaatcaaaataccctgcaacgatcttcctcagtgcggtccatggtgtccagtgccacatatgggggttcagatgattacattggtcttgctctcccggtggatataaatgatatattccaggtaaaggatattccctattttcagacaaaaaacataccaccacatgatgatcgaggtgcaagagcatttgcccatgatgcaggaggtcttccatctggaactggaggtcttgtaaaaaattcttttcacttgctacgacagcagatgagtcttacggaaataatgaattcaatccattcagatgcctctctgtttttagaaagtacagaagacactggactacaggaacatacagatgataactgcctttattgtgtctgtattgaaattctgggtttccagcccagcaaccaactgagtgcaatatgtagtcattcagactttcaagatattccatattctgattggtgtgagcagactatccataatcctttagaagtggttccctctaagttttcggggatttctggatgcagtgatggggtgtctcaagaaggctcagctagcagcaccaaaagcacagaattgttactaggtgttaaaacaattccagatgatacaccaatgtgccgtatactccttcgcagagaagttctaagattagtcattaacttgagtagttcagtttcaactaaatgccatgagactgggcttttaacaattaaggagaagtatcctcaaacatttgatgacatatgcctttactctgaggtttcccatttgctgtcacactgcacattcagacttccgtgtcggaggttcatacaagaattatttcaagatgtacagtttctacaaatgcatgaagaagcagaggctgtgttggcaacaccaccaaagcaacctatagttgatacatctgctgaatcctgacctcatatttatgatggatatagatacatactatatatattcatatttgtggatttcctaaaagcctcagaaaatacgactgactaggcagcaaagacaggagtatcttctgtacactgttccgcagttactggtacatgaacagttggaactgctgactttcctaaccaaaacaacttccttctctcctttgttgagccttttgaggggttcatgattcattaccacagttttaagagtttcagttaccattgtatgcaagagccaagcactgaatacctacataggttttctattttctttcattttaaaagcgtaatgacagtggaacaataatgggatatgcagaagcacccttcacaagttatttctgaatgatttttagggtaaataatacagatgccttgtttgttaactaacttgtggaaagcaggaatcagtgtctctaaggctgcatcctattaccacaatggggtgtgctataactgctggtattagagagggaactttggccctttcacgtttttcttaatgtttgtaacactacttcagaggtttataacctcaaagcagaagaagagcctcaacaacccgggacttataagttatttttatgttactagacttgcataaagattcttgttttccaactcttcattttgttgcaatgtgttattacaggatatatgaaccaattaaggtttttcactacagttcttgaataaaatttaaaaatcattttttattttaattaaaaatatttcccatttatagaatgcatatatttgcaatggacttccactttcatcaactttccatctcatcgctttaaacaggaacttgaacaagcactgttagtttagacctaaaggataggaaagcattaaataatactttggatctcctgaggaaaagataagtttgcttgcaatttacacattccatggggaaagaagagccatatttccttaaaaaaaacattattaaagcttgttattgagaaaaattgtagtgaaaagccttaagtaccaaattttaaagcagcag

SEQ ID NO: 418455 - DNA, 712 bp, Homo sapiens
tatgcatcattagataaagaagatttattgagtcctattaatcaaaataccctgcaacgatcttcctcagtgcggtccatggtgtccagtgccacatatgggggttcagatgattacattggtcttgctctcccggtggatataaatgatatattccaggtaaaggatattccctattttcagacaaaaaacataccaccacatgatgatcgaggtgcaagagcatttgcccatgatgcaggaggtcttccatctggaactggaggtcttgtaaaaaattcttttcacttgctacgacagcagatgagtcttacggaaataatgaattcaatccattcagatgcctctctgtttttagaaagtacagaagacactggactacaggaacatacagatgataactgcctttattgtgtctgtattgaaattctgggtttccagcccagcaaccaactgagtgcaatatgtagtcattcagactttcaagatattccatattctgattggtgtgagcagactatccataatcctttagaagtggttccctctaagttttcggggatttctggatgcagtgatggggtgtctcaagaaggctcagctagcaggacaaagccagattggtcccaggggttaaacaatccaatggtcaccaggggcgggcttcgcaagaggcttagatagcctactggggcccaggacgggggggggc

SEQ ID NO: 418456 - DNA, 1744 bp, Homo sapiens
tatgcatcattagataaagaagatttattgagtcctattaatcaaaataccctgcaacgatcttcctcagtgcggtccatggtgtccagtgccacatatgggggttcagatgattacattggtcttgctctcccggtggatataaatgatatattccaggtaaaggatattccctattttcagacaaaaaacataccaccacatgatgatcgaggtgcaagagcatttgcccatgatgcaggaggtcttccatctggaactggaggtcttgtaaaaaattcttttcacttgctacgacagcagatgagtcttacggaaataatgaattcaatccattcagatgcctctctgtttttagaaagtacagaagacactggactacaggaacatacagatgataactgcctttattgtgtctgtattgaaattctgggtttccagcccagcaaccaactgagtgcaatatgtagtcattcagactttcaagatattccatattctgattggtgtgagcagactatccataatcctttagaagtggttccctctaagttttcggggatttctggatgcagtgatggggtgtctcaagaaggctcagctagcagcaccaaaagcacagaattgttactaggtgttaaaacaattccagatgatacaccaatgtgccgtatactccttcgcagagaagttctaagattagtcattaacttgagtagttcagtttcaactaaatgccatgagactgggcttttaacaattaaggagaagtatcctcaaacatttgatgacatatgcctttactctgaggtttcccatttgctgtcacactgcacattcagacttccgtgtcggaggttcatacaagaattatttcaagatgtacagtttctacaaatgcatgaagaagcagaggctgtgttggcaacaccaccaaagcaacctatagttgatacatctgctgaatcctgacctcatatttatgatggatatagatacatactatatatattcatatttgtggatttcctaaaagcctcagaaaatacgactgactaggcagcaaagacaggagtatcttctgtacactgttccgcagttactggtacatgaacagttggaactgctgactttcctaaccaaaacaacttccttctctcctttgttgagccttttgaggggttcatgattcattaccacagttttaagagtttcagttaccattgtatgcaagagccaagcactgaatacctacataggttttctattttctttcattttaaaagcgtaatgacagtggaacaataatgggatatgcagaagcacccttcacaagttatttctgaatgatttttagggtaaataatacagatgccttgtttgttaactaacttgtggaaagcaggaatcagtgtctctaaggctgcatcctattaccacaatggggtgtgctataactgctggtattagagagggaactttggccctttcacgtttttcttaatgtttgtaacactacttcagaggtttataacctcaaagcagaagaagagcctcaacaacccgggacttataagttatttttatgttactagacttgcataaagattcttaaaacacaactcctcatcttgtaaaactctactactacacgatataaacacaacttctggactttcaaaacacaacttctgtacaattaaaacacaacttcttaacttcaaaaacacaactccgtcacacg

SEQ ID NO: 418457 - DNA, 2939 bp, Homo sapiens
  misc_feature (115)..(115): n is a, c, g, or t
gactgcagagccggggctgggctaggcgcgcgcttggagagcattgcgcgcggctgggcccgcggccggcggctcctcctcccactctgctcctcctcttttttctcctcctccncctcctcctccgcctcctcctcctcctcttcctcctcctcttcaattctcccggtggctcgactcggctcgcaggcttcggagaaacccctactccagtcgccgactcagcgcccaagagggtcgccttgggctgggggcgcaccccagggaggggaggggtccaggcagctgggccgccgcggacacctagcggcttcagggtgaaccccgaccgcagccgtcgccgcctcgggcagagtttgcgcccttgctttgcgccccgggcgctgaagccgggcgggcgatgcccgcggcgtgaaagcgcccgcggcgggcgccgacctctgtcctagtctcctgctccccccgccccgcttgtcccgtgcccttgtgaccctggctttggcgccgtcgcccaggcgccccgcaatgtagctgcccctgcgcctcggcgggaggcgtcctgccccgcgagcgcccggggcccggagcccggcctgggggctcagccgagctcgggcggggccggggccgcggtggcgatgcaccgggcccgttagcgccaggagcgccaggcagctgaggcggggggcaagccctccctcggaggagccgcgcccccggccccgccggtcccgccgcgatgctgttccacagtctgtcgggccccgaggtgcacggggtcatcgacgagatggaccgcagggccaagagcgaggctcccgccatcagctccgccatcgaccgcggcgacaccgagacgaccatgccgtccatcagcagtgaccgcgccgcgctgtgcgccggctgcgggggcaagatctcggaccgctactacctgctggcggtggacaagcagtggcacatgcgctgcctcaagtgctgcgagtgcaagctcaacctggagtcggagctcacctgtttcagcaaggacggtagcatctactgcaaggaagactactacaggcgcttctctgtgcagcgctgcgcccgctgccacctgggcatctcggcctcggagatggtgatgcgcgctcgggacttggtttatcacctcaactgcttcacgtgcaccacgtgtaacaagatgctgaccacgggcgaccacttcggcatgaaggacagcctggtctactgccgcttgcacttcgaggcgctgctgcagggcgagtaccccgcacacttcaaccatgccgacgtggcagcggcggccgctgcagccgcggcggccaagagcgcggggctgggcgcagcaggggccaaccctctgggtcttccctactacaatggcgtgggcactgtgcagaaggggcggccgaggaaacgtaagagcccgggccccggtgcggatctggcggcctacaacgctgcgctaagctgcaacgaaaacgacgcagagcacctggaccgtgaccagccataccccagcagccagaagaccaagcgcatgcgcacgtccttcaagcaccaccagcttcggaccatgaagtcttactttgccattaaccacaaccccgacgccaaggacttgaagcagctcgcgcaaaagacgggcctcaccaagcgggtcctccaggtctggttccagaacgcccgagccaagttcaggcgcaacctcttacggcaggaaaacacgggcgtggacaagtcgacagacgcggcgctgcagacagggacgccatcgggcccggcctcggagctctccaacgcctcgctcagcccctccagcacgcccaccaccctgacagacttgactagccccaccctgccaactgtgacgtccgtcttaacttctgtgcctggcaacctggagggccatgagcctcacagcccctcacaaacgactcttaccaaccttttctaatgactcgcaacccctcaccccacaatttctttaaaaaagaaattatctttagttgaattccaagtgtattttaaaatagaggctttgagcaactaactaaccacattttaggatctcgcctggaaacagaggtaaaaaaaagaagtgtgcgcccggctaatgcagcggtgtggaccgaggaacaacttggaagatctacctgcaacacaacatttgtgtcactgtacagttttgtggactgagcgaggaaaaacaacaaataatttaagttggctagagcttctgtattttcaaagactgccacgtgccttaggaatactgttttatctccatactttggatgacttgttcatttttctctccctctttttctctgtatatttatgaccagagcaaaaatgtaaaaaacaaaaaaaacaacaaaaaaagtttgttactttgaatagtcctaaaaagaaaaaaagaaaaaaaaaaaaggaaaaatcaaaccccctccaacggtcgctttgttgttttagaattttaaggtggaagtctgttcgaatatcagaatttgtaaaatctaaccagtaataaaaccacttattgaaactaaaaaaaaaaaaaaaaaaaaaaaaaaaaaaaaaaacaaaaaaaaaaaaaaaaacaaaaaaaaaatcatttaaaaaaaaaaaaacaaaaaaaataaaactacgacacaactaaaataaaacaaacatataaacgaacaggaagaaaaaatagaaaagaagagcaaagaacaacaaaaagaagagtataaagagaaacaaaataattgaaacaaaaaagaagagcgagaataaacaacaaggagaaaaaccactgagatgaagaagaagacaacacaatatggagagaagcacacagagagaacaaccataaaaaaacaaaagcgcaaaaataaaatttatgtattgcgacaaacacgaactggggagaaaaaagaaggtgaataagc

SEQ ID NO: 418458 - DNA, 2988 bp, Homo sapiens
  misc_feature (115)..(115): n is a, c, g, or t
gactgcagagccggggctgggctaggcgcgcgcttggagagcattgcgcgcggctgggcccgcggccggcggctcctcctcccactctgctcctcctcttttttctcctcctccncctcctcctccgcctcctcctcctcctcttcctcctcctcttcaattctcccggtggctcgactcggctcgcaggcttcggagaaacccctactccagtcgccgactcagcgcccaagagggtcgccttgggctgggggcgcaccccagggaggggaggggtccaggcagctgggccgccgcggacacctagcggcttcagggtgaaccccgaccgcagccgtcgccgcctcgggcagagtttgcgcccttgctttgcgccccgggcgctgaagccgggcgggcgatgcccgcggcgtgaaagcgcccgcggcgggcgccgacctctgtcctagtctcctgctccccccgccccgcttgtcccgtgcccttgtgaccctggctttggcgccgtcgcccaggcgccccgcaatgtagctgcccctgcgcctcggcgggaggcgtcctgccccgcgagcgcccggggcccggagcccggcctgggggctcagccgagctcgggcggggccggggccgcggtggcgatgcaccgggcccgttagcgccaggagcgccaggcagctgaggcggggggcaagccctccctcggaggagccgcgcccccggccccgccggtcccgccgcgatgctgttccacagtctgtcgggccccgaggtgcacggggtcatcgacgagatggaccgcagggccaagagcgaggctcccgccatcagctccgccatcgaccgcggcgacaccgagacgaccatgccgtccatcagcagtgaccgcgccgcgctgtgcgccggctgcgggggcaagatctcggaccgctactacctgctggcggtggacaagcagtggcacatgcgctgcctcaagtgctgcgagtgcaagctcaacctggagtcggagctcacctgtttcagcaaggacggtagcatctactgcaaggaagactactacaggcgcttctctgtgcagcgctgcgcccgctgccacctgggcatctcggcctcggagatggtgatgcgcgctcgggacttggtttatcacctcaactgcttcacgtgcaccacgtgtaacaagatgctgaccacgggcgaccacttcggcatgaaggacagcctggtctactgccgcttgcacttcgaggcgctgctgcagggcgagtaccccgcacacttcaaccatgccgacgtggcagcggcggccgctgcagccgcggcggccaagagcgcggggctgggcgcagcaggggccaaccctctgggtcttccctactacaatggcgtgggcactgtgcagaaggggcggccgaggaaacgtaagagcccgggccccggtgcggatctggcggcctacaacgctgcgctaagctgcaacgaaaacgacgcagagcacctggaccgtgaccagccataccccagcagccagaagaccaagcgcatgcgcacgtccttcaagcaccaccagcttcggaccatgaagtcttactttgccattaaccacaaccccgacgccaaggacttgaagcagctcgcgcaaaagacgggcctcaccaagcgggtcctccaggcatctctctagatttatcttctgcctcccagactctcctggaagcaaggtctggttccagaacgcccgagccaagttcaggcgcaacctcttacggcaggaaaacacgggcgtggacaagtcgacagacgcggcgctgcagacagggacgccatcgggcccggcctcggagctctccaacgcctcgctcagcccctccagcacgcccaccaccctgacagacttgactagccccaccctgccaactgtgacgtccgtcttaacttctgtgcctggcaacctggagggccatgagcctcacagcccctcacaaacgactcttaccaaccttttctaatgactcgcaacccctcaccccacaatttctttaaaaaagaaattatctttagttgaattccaagtgtattttaaaatagaggctttgagcaactaactaaccacattttaggatctcgcctggaaacagaggtaaaaaaaagaagtgtgcgcccggctaatgcagcggtgtggaccgaggaacaacttggaagatctacctgcaacacaacatttgtgtcactgtacagttttgtggactgagcgaggaaaaacaacaaataatttaagttggctagagcttctgtattttcaaagactgccacgtgccttaggaatactgttttatctccatactttggatgacttgttcatttttctctccctctttttctctgtatatttatgaccagagcaaaaatgtaaaaaacaaaaaaaacaacaaaaaaagtttgttactttgaatagtcctaaaaagaaaaaaagaaaaaaaaaaaaggaaaaatcaaaccccctccaacggtcgctttgttgttttagaattttaaggtggaagtctgttcgaatatcagaatttgtaaaatctaaccagtaataaaaccacttattgaaactaaaaaaaaaaaaaaaaaaaaaaaaaaaaaaaaaaacaaaaaaaaaaaaaaaaacaaaaaaaaaatcatttaaaaaaaaaaaaacaaaaaaaataaaactacgacacaactaaaataaaacaaacatataaacgaacaggaagaaaaaatagaaaagaagagcaaagaacaacaaaaagaagagtataaagagaaacaaaataattgaaacaaaaaagaagagcgagaataaacaacaaggagaaaaaccactgagatgaagaagaagacaacacaatatggagagaagcacacagagagaacaaccataaaaaaacaaaagcgcaaaaataaaatttatgtattgcgacaaacacgaactggggagaaaaaagaaggtgaataagc

SEQ ID NO: 418459 - DNA, 2576 bp, Homo sapiens
ctatttaaaaacccatcaccacaacagacaaaggacatattcatcatacccaaaagtttcctcatgtagcccctccctcccagtcttccttacctctccaccccaccaggcaacccctgatatgctttatgtaactatacattaatttgtatttcctagaattttatataattggaatcacacattgtatattctgttttatctggcttctttcactcagcaaaattattacgagattcactgacgttgtagcatgtatcattagttcattccttttattactgagtagtattcaactgtagggatacaccagtgattttacccattcccttattgatgaacattttggttgtttctagattttggctattgcaaataaagctgctatgaacattcatgtacaaaaaaaaacggggtcatcgacgagatggaccgcagggccaagagcgaggctcccgccatcagctccgccatcgaccgcggcgacaccgagacgaccatgccgtccatcagcagtgaccgcgccgcgctgtgcgccggctgcgggggcaagatctcggaccgctactacctgctggcggtggacaagcagtggcacatgcgctgcctcaagtgctgcgagtgcaagctcaacctggagtcggagctcacctgtttcagcaaggacggtagcatctactgcaaggaagactactacaggcgcttctctgtgcagcgctgcgcccgctgccacctgggcatctcggcctcggagatggtgatgcgcgctcgggacttggtttatcacctcaactgcttcacgtgcaccacgtgtaacaagatgctgaccacgggcgaccacttcggcatgaaggacagcctggtctactgccgcttgcacttcgaggcgctgctgcagggcgagtaccccgcacacttcaaccatgccgacgtggcagcggcggccgctgcagccgcggcggccaagagcgcggggctgggcgcagcaggggccaaccctctgggtcttccctactacaatggcgtgggcactgtgcagaaggggcggccgaggaaacgtaagagcccgggccccggtgcggatctggcggcctacaacgctgcgctaagctgcaacgaaaacgacgcagagcacctggaccgtgaccagccataccccagcagccagaagaccaagcgcatgcgcacgtccttcaagcaccaccagcttcggaccatgaagtcttactttgccattaaccacaaccccgacgccaaggacttgaagcagctcgcgcaaaagacgggcctcaccaagcgggtcctccaggtctggttccagaacgcccgagccaagttcaggcgcaacctcttacggcaggaaaacacgggcgtggacaagtcgacagacgcggcgctgcagacagggacgccatcgggcccggcctcggagctctccaacgcctcgctcagcccctccagcacgcccaccaccctgacagacttgactagccccaccctgccaactgtgacgtccgtcttaacttctgtgcctggcaacctggagggccatgagcctcacagcccctcacaaacgactcttaccaaccttttctaatgactcgcaacccctcaccccacaatttctttaaaaaagaaattatctttagttgaattccaagtgtattttaaaatagaggctttgagcaactaactaaccacattttaggatctcgcctggaaacagaggtaaaaaaaagaagtgtgcgcccggctaatgcagcggtgtggaccgaggaacaacttggaagatctacctgcaacacaacatttgtgtcactgtacagttttgtggactgagcgaggaaaaacaacaaataatttaagttggctagagcttctgtattttcaaagactgccacgtgccttaggaatactgttttatctccatactttggatgacttgttcatttttctctccctctttttctctgtatatttatgaccagagcaaaaatgtaaaaaacaaaaaaaacaacaaaaaaagtttgttactttgaatagtcctaaaaagaaaaaaagaaaaaaaaaaaaggaaaaatcaaaccccctccaacggtcgctttgttgttttagaattttaaggtggaagtctgttcgaatatcagaatttgtaaaatctaaccagtaataaaaccacttattgaaactaaaaaaaaaaaaaaaaaaaaaaaaaaaaaaaaaaacaaaaaaaaaaaaaaaaacaaaaaaaaaatcatttaaaaaaaaaaaaacaaaaaaaataaaactacgacacaactaaaataaaacaaacatataaacgaacaggaagaaaaaatagaaaagaagagcaaagaacaacaaaaagaagagtataaagagaaacaaaataattgaaacaaaaaagaagagcgagaataaacaacaaggagaaaaaccactgagatgaagaagaagacaacacaatatggagagaagcacacagagagaacaaccataaaaaaacaaaagcgcaaaaataaaatttatgtattgcgacaaacacgaactggggagaaaaaagaaggtgaataagc

SEQ ID NO: 418460 - DNA, 537 bp, Homo sapiens
gggctgtctagaggatcaccttcgacggtgttctgcaagtgaaggccccctgaagtggaagacagcattggtactaatggccaactcaaggttagttttttttttttgttcatttacctggtcccttggttttctcttcccaattaacaacaggaccgtagagatgggtccccttgtcctccattgcctttccaaatgcccatttccctttcattgaatattcacatatgcattaggtaaatcattcaattctcccatgtgcttctttttttccaaaggatttttatggtatagaaatacaactcctggaggagaagttaaaacttttgttttagaatgtaatttgttaaggaggagacgagtgattaagtagaatggcacactagatacctttgatcttatttacagacttgatttgcaaacaaagcaagataggagatggtaggtattaatcagtaagtgacaaagttggctttggagacatttaggagtgggaatatgataggagttttatgcagagaggctatgtcaacaagg

SEQ ID NO: 418461 - DNA, 4453 bp, Homo sapiens
gggctgtctagaggatcaccttcgacggtgttctgcaagtgaaggccccctgaagtggaagacagcattggtactaatggccaactcaagtttcattggggatcatgtccatggagctcctcatgctgtcatgccagaagtggaattccctgaccaattctttacagttctaaccatggaccatgaactggtgacactcagggatgtggtcatcaacttctctcaggaggaatgggaatatctggattctgctcagaggaacttgtactgggatgtgatgatggagaactacagcaacttactctcactgggtctacattgagacagatatcggtacaatggtgaccaagaccaatacagaccctgctctcatggaattgacatactagttcttgagatgtataataaacaaatttggagtccaggaatgagactaagcatttatctgtaggaaaagatattattcaaaacactggttctcagtgggaggtaatggaaagtagcaagttatgtggccttgaaggttccattttcagaaatgactggcaaagcaaaagcaagattgacgtacaaggacctgaagtgggatatttcagtcaaatgaaaatcatctctgaaaatgtgcccagttacaaaactcatgaatctcttactttacctcggagaactcatgacagtgagaagccctatgaatacaaggaatatgagaaggtcttcagttgtgacttagagtttgatgaatatcagaaaatacatactggtggaaaaaactatgaatgtaatcaatgttggaaaacctttgggatagataactccagtatgttacaactgaatattcatactggtgtgaaaccttgtaaatatatggaatatgggaatacatgtagtttttataaagactttaatgtataccagaaaattcataatgagaagttctataaatgtaaggaatacagaaggacctttgaaagagttggaaaagttactccacttcaaagagttcatgatggtgagaaacactttgaatgctcattctgtgggaaatcctttagagtgcatgcacaacttactcgacatcagaaaatccatactgatgagaaaacttacaaatgtatggaatgtggcaaggacttcagatttcattcacagcttaccgaacatcagagaattcatactggtgagaaaccctacaaatgtatgcactgtgagaaggtttttagaattagttcacagctcattgaacatcagagaattcacactggtgagaaaccttatgcatgtaaggaatgtgggaaggcttttggagtatgtagagaacttgctcgtcatcagagaattcatactggtaagaaaccctatgaatgcaaagcatgtggaaaggtctttagaaatagttcatccctgactagacatcagaggattcatactggtgaaaaaccctataaatgtaaagaatgtgagaaagcatttggagtaggtagtgaacttactcgacatgaaagaattcacagtggtcaaaaaccttatgaatgtaaggagtgtggaaagttctttagacttacgtcagcccttattcaacatcaaagaattcatagtggtgagaaaccttatgaatgtaaggtatgtgggaaggcctttagacatagttcagcccttacagaacatcagagaattcatactggagaaaaaccctatgaatgcaaggcatgtgggaaggcctttagacatagttcatcctttaccaaacatcagcgcattcatactgatgataaaccctatgaatgtaaggagtgtgggaattcctttagtgttgttgggcatcttacttgccaaccgaaaatttacactggtgagaaatcatttgactgaaataaatgtataaagtggttttttatttctgattttcacaggaaaatactgtggatggatttaataggtaatcaaggcaattcagtatctccctctcttaaagtctgtttttagacttcatggtcattctgtatgtagacgtagaattgcttagtcatagctgatatatacttatagctttgttagatgttgccaaatatttctcctttttatgttaaaaagtttttttcatgagtttctcatcctggcatgttttgtttacaatagcttttgatgtttgtattattgctcttttgactattcagttttttaattgtaatattacttcaatatcttttctgcattgtaattctttgcttgtgatatctatacttacttattttcctccacagagttagcactcctagtcagatacaatgtatttttacagtcttacagctcatcattttgtgtaatgttcttgttttgttttgttttaaatgatagaagtgtgatctcctttccattttcatccaattgttgacttctctttaaatttctactttattttgatacaacatattccccccaaaaaaacacatacataggaactggttatattccaccataacacacacacacacacacacactatatacatatagtgtatatacacatatagtgtatatagtgtatgtgtgatgtatactatacatatcacatatactatatgtgtgtatatagtgtgtgatgtatatgtgtgtgatgtatactatatatgcccacacatgcactacataacacactatatatatatatatatatatacacacacacacacacaatatatgtatatatagtatatacactatatactgggcactatatatatatagtgtgtatgtgtgttatattggaatataaccagttcctttaagcagtctttttacctgcaggctataccaaccaggatccaaatgaagagaactcttttaaatatttgataaaactactcacccagtaagtctcttaaaatttatcattctcttaaagtatcactctaaaatttgtcaaacacctttaaaaggggagaaaaaatgaccactgaacttacattaagagaatttacaactatatattaacatggcttcaattgtttttttaatctattatcattatttttctttttattccctctcagagttgacttactaggtttgggcatttcaacaatcagcagaccttctttggtttaactaatctcatttaactccaaaatcatctctctcttaggactgctgacttggttatgcagtcaatgagatcacgagccactggttattggattttttttctttttttttagacagagttttgctcttgttgcctaggctggagtgcagtggcgcagtcttggctcacctcaacctctgcctcccaggttcaagctattctcctgctcagcctcctgattagctgggattacaggcatgcgccaccatgaccggctaattttatatttttagtagagacgggatatctccgtgttggtcagtctggtctcaaactcccgacctcaggtgatccacccgcctcagcctcccaaagtgctgggattacaggcatgagccaccgcacccagcctggttattggatttatttatttattttgagatagagccttgctctgtcaccaggccggagtgcagtggtgtcatctcagctcactgcaacctccacctcccaggttcaagcgattcccctgcctcagcctgccaagtagctgggattacaggcatgcgccaccatgcccagctaattgtattttagtagatatggagtttcaccacgttggccaagacagtctcgatttcctgaccttgtgatccccctgcctcggcctcccaaagtgctgggattacaggcatgagccaccacgcctgtccggttatttgatttttataagaaaattttactattattttcagataaatttatgtcactgtcattcattacattttaatttttgaaactgatgtctttcccagaatttatgtactctataacggtgtgaatgattaccagtattaagccattttctcatctgatatattgagctatgttttatgtaagtattgcttattcaagtagttttaaaagatatgtaattggttgttgtttcatgtcctacacagtaagaacaagagtatgttaacctttttgtcaggatatttgctatttcatatctttgaaatagagtagtagctctatttctaactaaattctatttatgtaacaacacagctaatttactcttggatctcattctccctttttatcctgagttaccatcagtgctaatgttcctcttttgggtatagttctccaggagaacttgtcctatatttctttgtgtgtgtttttttccttccagcttaaacaaattaaaactaaatatctaaaccttgtatacagacattaaaattagtgagagaaacaaaatatccttgtgtcttggcttttactttttgaagtcattaacaaataataaattaatgaataaaatgtgtccttattatgttttccttgtttgtagttacagcta

SEQ ID NO: 418462 - DNA, 1365 bp, Homo sapiens
gggctgtctagaggatcaccttcgacggtgttctgcaagtgaaggccccctgaagtggaagacagcattggtactaatggccaactcaagtttcattggggatcatgtccatggagctcctcatgctgtcatgccagaagtggaattccctgaccaattctttacagttctaaccatggaccatgaactggtgacactcagggatgtggtcatcaacttctctcaggaggaatgggaatatctggattctgctcagaggaacttgtactgggatgtgatgatggagaactacagcaacttactctcactgggtctacattgagacagatatcggtacaatggtgaccaagaccaatacagaccctgctctcatggaattgacatactagttcttgagatgtataataaacaaatttggagtccaggaatgagactaagcatttatctgtaggaaaagatattattcaaaacactggttctcagtgggaggtaatggaaagtagcaagttatgtggccttgaaggttccattttcagaaatgactggcaaagcaaaagcaagattgacgtacaaggacctgaagtgggatatttcagtcaaatgaaaatcatctctgaaaatgtgcccagttacaaaactcatgaatctcttactttacctcggagaactcatgacagtgagaagccctatgaatacaaggaatatgagaaggtcttcagttgtgacttagagtttgatgaatatcagaaaatacatactggtggaaaaaactatgaatgtaatcaatgttggaaaacctttgggatagataactccagtatgttacaactgaatattcatactggtgtgaaaccttgtaaatatatggaatatgggaatacatgtagtttttataaagactttaatgtataccagaaaattcataatgagaagttctataaatgtaaggaatacagaaggacctttgaaagagttggaaaagttactccacttcaaagagttcatgatggtgagaaacactttgaatgctcattctgtgggaaatcctttagagtgcatgcacaacttactcgacatcagaaaatccatactgatgagaaaacttacaaatgtatggaatgtggcaaggacttcagatttcattcacagcttaccgaacatcagagaattcatactgggaggctgaacaatctactgttggaggaagctgagaagaccatggaagggaaatggaagctgctcacatattccttccctcatgcaggtgtccatctttacctaagattcagttgtaggaagaagtcttaattttaaacagttcagagtactaattattgtaatataccaggtatttcatttagcaaa

SEQ ID NO: 418463 - DNA, 316 bp, Homo sapiens
caccgtgttagccaggatagtctcaatctcctgacctcgtgatctgcccgccttggcctcccaaagtggtgggattacaggtgtaagccactgcacccagcccagactgtgttttgtttgtttgttttaaaaaaagaaacaaaagcctggcacttggaggaaattaagatcttcagtgccaccaactgttttccagttcatcttgtatttagacttatgtatgtatatattgaccaaaaaaaatgctcattcatattctcaatatttattcaggtctacattgagacagatatcggtacaatggtgaccaagacca

SEQ ID NO: 418464 - DNA, 4466 bp, Homo sapiens
  misc_feature (1)..(1): n is a, c, g, or t
nttattgagttaagcctggcgagtcgaggtgacccgggccgggctgcgggaggagctcgcggtgaggtggccccgcgctgccgggcgaggtcggtccacgtggagccgggagcctgaggcctctgtacgcgggagctgcggacgatggtgttctgcaagtgaaggccccctgaagtggaagacagcattggtactaatggccaactcaagtttcattggggatcatgtccatggagctcctcatgctgtcatgccagaagtggaattccctgaccaattctttacagttctaaccatggaccatgaactggtgacactcagggatgtggtcatcaacttctctcaggaggaatgggaatatctggattctgctcagaggaacttgtactgggatgtgatgatggagaactacagcaacttactctcactgggtctacattgagacagatatcggtacaatggtgaccaagaccaatacagaccctgctctcatggaattgacatactagttcttgagatgtataataaacaaatttggagtccaggaatgagactaagcatttatctgtaggaaaagatattattcaaaacactggttctcagtgggaggtaatggaaagtagcaagttatgtggccttgaaggttccattttcagaaatgactggcaaagcaaaagcaagattgacgtacaaggacctgaagtgggatatttcagtcaaatgaaaatcatctctgaaaatgtgcccagttacaaaactcatgaatctcttactttacctcggagaactcatgacagtgagaagccctatgaatacaaggaatatgagaaggtcttcagttgtgacttagagtttgatgaatatcagaaaatacatactggtggaaaaaactatgaatgtaatcaatgttggaaaacctttgggatagataactccagtatgttacaactgaatattcatactggtgtgaaaccttgtaaatatatggaatatgggaatacatgtagtttttataaagactttaatgtataccagaaaattcataatgagaagttctataaatgtaaggaatacagaaggacctttgaaagagttggaaaagttactccacttcaaagagttcatgatggtgagaaacactttgaatgctcattctgtgggaaatcctttagagtgcatgcacaacttactcgacatcagaaaatccatactgatgagaaaacttacaaatgtatggaatgtggcaaggacttcagatttcattcacagcttaccgaacatcagagaattcatactggtgagaaaccctacaaatgtatgcactgtgagaaggtttttagaattagttcacagctcattgaacatcagagaattcacactggtgagaaaccttatgcatgtaaggaatgtgggaaggcttttggagtatgtagagaacttgctcgtcatcagagaattcatactggtaagaaaccctatgaatgcaaagcatgtggaaaggtctttagaaatagttcatccctgactagacatcagaggattcatactggtgaaaaaccctataaatgtaaagaatgtgagaaagcatttggagtaggtagtgaacttactcgacatgaaagaattcacagtggtcaaaaaccttatgaatgtaaggagtgtggaaagttctttagacttacgtcagcccttattcaacatcaaagaattcatagtggtgagaaaccttatgaatgtaaggtatgtgggaaggcctttagacatagttcagcccttacagaacatcagagaattcatactggagaaaaaccctatgaatgcaaggcatgtgggaaggcctttagacatagttcatcctttaccaaacatcagcgcattcatactgatgataaaccctatgaatgtaaggagtgtgggaattcctttagtgttgttgggcatcttacttgccaaccgaaaatttacactggtgagaaatcatttgactgaaataaatgtataaagtggttttttatttctgattttcacaggaaaatactgtggatggatttaataggtaatcaaggcaattcagtatctccctctcttaaagtctgtttttagacttcatggtcattctgtatgtagacgtagaattgcttagtcatagctgatatatacttatagctttgttagatgttgccaaatatttctcctttttatgttaaaaagtttttttcatgagtttctcatcctggcatgttttgtttacaatagcttttgatgtttgtattattgctcttttgactattcagttttttaattgtaatattacttcaatatcttttctgcattgtaattctttgcttgtgatatctatacttacttattttcctccacagagttagcactcctagtcagatacaatgtatttttacagtcttacagctcatcattttgtgtaatgttcttgttttgttttgttttaaatgatagaagtgtgatctcctttccattttcatccaattgttgacttctctttaaatttctactttattttgatacaacatattccccccaaaaaaacacatacataggaactggttatattccaccataacacacacacacacacacacactatatacatatagtgtatatacacatatagtgtatatagtgtatgtgtgatgtatactatacatatcacatatactatatgtgtgtatatagtgtgtgatgtatatgtgtgtgatgtatactatatatgcccacacatgcactacataacacactatatatatatatatatatatacacacacacacacacaatatatgtatatatagtatatacactatatactgggcactatatatatatagtgtgtatgtgtgttatattggaatataaccagttcctttaagcagtctttttacctgcaggctataccaaccaggatccaaatgaagagaactcttttaaatatttgataaaactactcacccagtaagtctcttaaaatttatcattctcttaaagtatcactctaaaatttgtcaaacacctttaaaaggggagaaaaaatgaccactgaacttacattaagagaatttacaactatatattaacatggcttcaattgtttttttaatctattatcattatttttctttttattccctctcagagttgacttactaggtttgggcatttcaacaatcagcagaccttctttggtttaactaatctcatttaactccaaaatcatctctctcttaggactgctgacttggttatgcagtcaatgagatcacgagccactggttattggattttttttctttttttttagacagagttttgctcttgttgcctaggctggagtgcagtggcgcagtcttggctcacctcaacctctgcctcccaggttcaagctattctcctgctcagcctcctgattagctgggattacaggcatgcgccaccatgaccggctaattttatatttttagtagagacgggatatctccgtgttggtcagtctggtctcaaactcccgacctcaggtgatccacccgcctcagcctcccaaagtgctgggattacaggcatgagccaccgcacccagcctggttattggatttatttatttattttgagatagagccttgctctgtcaccaggccggagtgcagtggtgtcatctcagctcactgcaacctccacctcccaggttcaagcgattcccctgcctcagcctgccaagtagctgggattacaggcatgcgccaccatgcccagctaattgtattttagtagatatggagtttcaccacgttggccaagacagtctcgatttcctgaccttgtgatccccctgcctcggcctcccaaagtgctgggattacaggcatgagccaccacgcctgtccggttatttgatttttataagaaaattttactattattttcagataaatttatgtcactgtcattcattacattttaatttttgaaactgatgtctttcccagaatttatgtactctataacggtgtgaatgattaccagtattaagccattttctcatctgatatattgagctatgttttatgtaagtattgcttattcaagtagttttaaaagatatgtaattggttgttgtttcatgtcctacacagtaagaacaagagtatgttaacctttttgtcaggatatttgctatttcatatctttgaaatagagtagtagctctatttctaactaaattctatttatgtaacaacacagctaatttactcttggatctcattctccctttttatcctgagttaccatcagtgctaatgttcctcttttgggtatagttctccaggagaacttgtcctatatttctttgtgtgtgtttttttccttccagcttaaacaaattaaaactaaatatctaaaccttgtatacagacattaaaattagtgagagaaac

SEQ ID NO: 418465 - DNA, 517 bp, Homo sapiens
cttgggaggctgagcccggagaatcgcttgaacctgggaggctgaggttgcagtgagccaaggtcgcgcccttgcactccagcctgggccacgagagcgaaactctgtcttaaaccaaccaaataaaaaataaaaaaataaaaaaaaaataagactttaactgcagttccaaagcttctctaacccaaaaattacagtaccaaatgattgactcaggattgtttttcccatattgatatgctggcaatataggatggtatgtaatggacagaactgatgcagatggttgaatgcgcttgtactatatgctaaaatatggaaaaggaaaaaaaaatctcacaagttcttttggaacttgtttcaagccaaaaactctcaagaaagcaaattgcacctcagctggattgatttccaaatgctagcatgtactgtatgggaggatgatccagatgtttcaaagagaatttctcttagtttagttaggtgtaattcagtagctttaaattctcaggtcaga

SEQ ID NO: 418466 - DNA, 2978 bp, Homo sapiens
ttttaagcccttcttcttttaaagcagagtgttctgaggatgtagagaatttaaatgcccctcctgctgaggctgggtatgatcaaaataaaaccgattttgatgagacttcatcgattaatacggcaatcagtgacgccaccaccggagacgagggaaacactgaaatggaaagcaccacaggaagttccggagatgtgaaaccggctttgtctcccaaagagccaaaaactctggatactctgccaaaacctgcaaccacacctaccacggaggtctgcgatgacaaatttctcttttctctcacaagcccatccatccatttcaatgacaaagatggcgaccacgaccaaagcttttacatcacagatgacccggatgacaacgccgaccgcagcgaaacgtccagcatagcggacccgagctccccaaatccattcggatccagcaatccctttaaatccaaaagtaatgatcggccgggtcacaagcgttttcgaacgcaaatgagcaatcttcaactcaaggttctcaaggcttgctttagtgactaccgaactccaaccatgcaagaatgtgaaatgttagggaatgagattggtctgcccaaacgcgtagtccaggtgtggttccaaaatgcaagggcaaaggaaaagaaatttaaaattaacatagggaagcctttcatgatcaatcaaggcggaacggaaggcaccaaaccagagtgtaccctctgcggggtgaagtactctgcccgcttgtccatcagagatcacattttctccaaacagcacatttcaaaagtgagggagaccgttggcagtcagctcgatcgggagaaagattacttggctccgaccacggttcggcagctgatggcacagcaagaacttgatcgtataaagaaagcttcagacgtgctgggcttgacggtacagcagccaggcatgatggacagcagttctctccacggcatcagcctgccaacagcctaccccggactccccggccttcctccagtccttctccccggaatgaacggtccatcctccttgccgggatttccacaaaattcaaacactttaacacctcccggtgcaggcatgcttgggtttcctacttcagctacttcgtctcctgccctgtctctcagcagtgcccccaccaaacctttgctgcagactccaccacctccaccacctcctcctcctcctcctccttcatcctctctgtcaggacagcagaccgagcaacagaacaaagaatctgagaaaaagcaaactaagccaaacaaggtgaaaaaaaatcaaagaggaggaattagaggccaccaaacccgaaaaacaccccaaaaaagaggaaaaaatctcatctgctctttcagtggtgggcaaagttgtaggtgaaacacatgtcgatcctattcagttgcaggcattacagaatgcaattgctggtgacccagcttcctttataggcggacagttcttgccatactttatccctgggtttgcttcttattttacacctcagctccctggaacagtgcaggggggatacttcccacctgtctgtggcatggagagcctctttccttatggccctacaatgccccagacactggcaggtctgtccccaggtgcactgttgcagcagtaccaacagtatcagcagaacctgcaggagtccctgcaaaagcagcaaaagcaacagcaagaacagcagcagaaaccagttcaggcaaagacatccaaagtagaaagtgaccagccgcaaaactccaacgatgcttcagaaacaaaggaagacaaaagtactgctacagaaagcacaaaagaagaaccccagttagaatccaaaagtgcagacttttcagacacttacgttgttccattcgtcaagtatgagtttatatgcagaaagtgccagatgatgtttactgatgaagacgccgcagtaaatcatcaaaagtccttctgttatttcggtcagcctttgattgacccacaagagacagtgcttcgtgtcccagtcagcaaatatcagtgtcttgcctgtgatgtggctatcagtgggaatgaagcacttagccaacacctccagtcaagcttgcacaaagagaaaacaatcaaacaagcaatgagaaatgccaaagagcatgttagattattacctcactcagtctgctcccctaatcctaacaccacatctacctcgcagtctgcagcttcttctaataacacctatcctcatctttcttgcttctccatgaagtcctggcctaatatccttttccaagcgtctgccaggagagctgcttctcccccttcttctcctccttccctttccttgccttcaacggttacctcaagtttgtgcagcacctcaggggttcaaacctcactacccacagaaagttgttcagatgagtctgacagtgagctgagccagaagctagaagacttagataattctttggaagtgaaggctaagcctgcttctggcctagatggtaatttcaatagcatccgaatggatatgttcagtgtgtaggagtgaagacaggatcccgtgcttaaaaaaataaaaaataaaaaaataaaaaaaaaataagactttaactgcagttccaaagcttctctaacccaaaaattacagtaccaaatgattgactcaggattgtttttcccatattgatatgctggcaatataggatggtatgtaatggacagaactgatgcagatggttgaatgcgcttgtactatatgctaaaatatggaaaaggaaaaaaaaatctcacaagttcttttggaacttgtttcaagccaaaaactctcaagaaagcaaattgcacctcagctggattgatttccaaatgctagcatgtactgtatgggaggatgatccagatgtttcaaagagaatttctcttagtttagttaggtgtaattcagtagctttaaattctcaggtcaga

SEQ ID NO: 418467 - DNA, 1753 bp, Homo sapiens
ctgctctcatcacctatatactcttctctctgcccgtctctgcttccccccccttccccccccccttttctcccggccgacggagctgaaggggcgggggttccttccttggagtgtttctagagctcggaggctgctggtaggggggcaccactttcagataaaaacatagacctgaatggcatcatccagtatccaaggaaaccattgtgtctgtaaccagctaatgagctgcaacagagcctggccttcattttcagcaaattaagttcatccctcataggaattgtggtctggctgtggcaccgctcctaggttctctaaacatgaatatgcctttgggggaagacagaagaacatggaagccatgtgaaaaaaacggatcctaaggtataaacaaagtgcagatgattgtcggccatgctgcagggatttcttgtttgtcttctcagtagtgttagctaattttgtcttccaatccgcaattccttataggacttggacgctttgaacctctcaggacccctcagattctagtacataaactcggagccaaattcacagccagctctccttcaaactgccttatctgtttttgagttaattagaagggccttttaacaactttgcatttgagtcctaagaaaagtctagttcattaggcaataaagccactgtgctggcccctaatcaaggtcagtacatatcattatacgactgatccaaatttgagttggttcagttatttcatttgttcattgtccacaatgttccagtcacagtaccaggtgctcagagtgtggtgttagagacaagattcaaagtaagtaattttagaccaatgtcatatgcgccattatagaagtacggctgaaaatggaatttatataaataagcatgtgagtggttcactaaacagggatgggcaagaaagaccttacagaagagatgaatatcttagcgaataacttagcaggatttcaaagaatggacgagagttttgcaggcagatgagataggaagggtgccagagagaaaggaaagcatgggcaagggctcaggaggtggggaaaaatgtgatatagtttgaggtactggagtatgaagttaacaaggggagaatatttagaaggaaggatggagaagtaggcagagagcagattatcaggttaaaatattagaaattagtattgaagtttactagaagccagcagcacgttcaatgcaagcaggtgccatggtcatattagttttagtttagtaatcagtgtagaaggtggatgagagggggtgagtctggaggcaataagcatagttggtagtagcagtctaggtgtcacctgacaggggcctttactagcccagtggtggacatttttaatgcattagtctttcttctagtctgtgaatttcttataacgagggtgtggtcttcctcacacttgtttcttcacacttgttgcctactatcatacctgacatgcagtaaattaccatagcaagacaaaaaatctcttaaacgtgtactctttattactctgttggaccatgatgagagcaacttattgtatggctatttaaaattatttatgaagataatattttttgtgttggaaatgctacaataatttaattgtgagatttataactaagacttattgttcacatttgttttatgttttcatatatgtgatgaaatagacaatttactctgtaagtcttaaatataaaaatgattcattatttctttctg

SEQ ID NO: 418468 - DNA, 742 bp, Homo sapiens
tgcgtccaggaaggaagtgacagaagacgaatgggaaaaggagaacagctcacagcgtttgaaacatcgcggcaccactttcagataaaaacatagacctgaatggcatcatccagtatccaaggaaaccatgcagttttgaacatctggaggcctgatttattggagattgcaaatgtacagtgtaacatagctgtggagagcgagaagatcaggattgtcaatgctgtcattgcttttactggaatccccagcacgaattgaaggtttgaccagagacaaagaagcaaatgctatcaattaacattcacatgtggtaggaattctactagtgcatgtggagagaaacatggctgctgcatggagtcataaacctcagaggaagctgagaatgagatgaaatgtatatgtaacccttgtgtatggcaagtttggcaagaaagaaaaagcatacttggcagattaagataaggtttctctctgtttactgatatagtctcaggtttgcattgtgtgatgaataataggttgggggaagatatcctttgtttattcattcatttcatcaacaaatatttaatgagtacctactatatgccatgccacaaagagtataaacctagagacagaatgttgagtcacatagacagtgctcctgatacaattatttgaactgagttaacaatacttcaaggttccatgtctaatttactggctaggttctcaacaaaatttctggata

SEQ ID NO: 418469 - DNA, 1230 bp, Homo sapiens
ctgctctcatcacctatatactcttctctctgcccgtctctgcttccccccccttccccccccccttttctcccggccgacggagctgaaggggcgggggttccttccttggagtgtttctagagctcggaggctgctggtagggggaagttgtacccgtcagcacctgctgagggctttgttgtccaaaccctgacaggtaaaaaaattcctgcagaataaagccagaccagctggctttgaagagaaaccccccagtttgggctgcgtttgcctcctctccttttctatgaagaccgaggctttgcccccttgatcgtcaagccgtgagatgcgtgatctctctgcacaagtgtctggcaggccgaggtgcacctgtttctgtcactctggagtaaatttagctgtaaagggcaccactttcagataaaaacatagacctgaatggcatcatccagtatccaaggaaaccattgtgtctgtaaccagctaatgagctgcaacagagcctggccttcattttcagcaaattaagttcatccctcataggaattgtggtctggctgtggcaccgctcctaggttctctaaacatgaatatgcctttgggggaagacagaagaacatggaagccatgtgaaaaaaacggatcctaaggcagttttgaacatctggaggcctgatttattggagattgcaaatgtacagtgtaacatagctgtggagagcgagaagatcaggattgtcaatgctgtcattgcttttactggaatccccagcacgaattgaaggtctcactttgccacctaggctggatgcaatgcaacggtatgttgatcttggttcactgcagcctcaacctcctgagctcatgtgatcctcccacctcagtcccccacgtcgcttggattacaggcctgtgccaccacacctggctaactttttttgtaatttttgtagagacagggtctcactatgtttcccatgctggtctttaatgcctgagctcaagccatccgcctgcctcggcctcccaaattgctgggattacaggcatgagccaccatgcccagcctaattcttctaaatcttatcctagtaattaagccagaatttttctctgccaagaccaatagatggaccaagaagtactcatccttgtaaactttctttggataaattgcttacatataataaattcagagttaagtaataaaaataatgaactact

SEQ ID NO: 418470 - DNA, 961 bp, Homo sapiens
ctcaccagtgcctttctgcttctccaggaagttgtacccgtcagcacctgctgagggctttgttgtccaaaccctgacaggtaaaaaaattcctgcagaataaagccagaccagctggctttgaagagaaaccccccagtttgggctgcgtttgcctcctctccttttctatgaagaccgaggctttgcccccttgatcgtcaagccgtgagatgcgtgatctctctgcacaagtgtctggcaggccgagggcaccactttcagataaaaacatagacctgaatggcatcatccagtatccaaggaaaccatgttctctaaacatgaatatgcctttgggggaagacagaagaacatggaagccatgtgaaaaaaacggatcctaaggcagttttgaacatctggaggcctgatttattggagattgcaaatgtacagtgtaacatagctgtggagagcgagaagatcaggattgtcaatgctgtcattgcttttactggaatccccagcacgaattgaaggtctcactttgccacctaggctggatgcaatgcaacggtatgttgatcttggttcactgcagcctcaacctcctgagctcatgtgatcctcccacctcagtcccccacgtcgcttggattacaggcctgtgccaccacacctggctaactttttttgtaatttttgtagagacagggtctcactatgtttcccatgctggtctttaatgcctgagctcaagccatccgcctgcctcggcctcccaaattgctgggattacaggcatgagccaccatgcccagcctaattcttctaaatcttatcctagtaattaagccagaatttttctctgccaagaccaatagatggaccaagaagtactcatccttgtaaactttctttggataaattgcttacatataataaattcagagttaagtaataaaaataatgaactact

SEQ ID NO: 418471 - DNA, 972 bp, Homo sapiens
ctgctctcatcacctatatactcttctctctgcccgtctctgcttccccccccttccccccccccttttctcccggccgacggagctgaaggggcgggggttccttccttggagtgtttctagagctcggaggctgctggtagggggaagttgtacccgtcagcacctgctgagggctttgttgtccaaaccctgacaggtaaaaaaattcctgcagaataaagccagaccagctggctttgaagagaaaccccccagtttgggctgcgtttgcctcctctccttttctatgaagaccgaggctttgcccccttgatcgtcaagccgtgagatgcgtgatctctctgcacaagtgtctggcaggccgaggtgcacctgtttctgtcactctggagtaaatttagctgtaaagggcaccactttcagataaaaacatagacctgaatggcatcatccagtatccaaggaaaccattgtgtctgtaaccagctaatgagctgcaacagagcctggccttcattttcagcaaattaagttcatccctcataggaattgtggtctggctgtggcaccgctcctagacatgacaaactccaaaaggaaacccaagcagctatttggctcccttaattaatgaagtcgcccagtatggataattcaggttctctaaacatgaatatgcctttgggggaagacagaagaacatggaagccatgtgaaaaaaacggatcctaaggctttttacctgtctgttgaactgagtgaaggacccagaggccctatgatgtggtgtagcttcgagagaaggaagcctagatccctgaatcattgtgcagaacatacttatcctacagccatataggactgttatatgagtaagcgctgaagttatttcttaggttattgaactttccaagcatatctattacattaattagtgttacctcaataaaagcatgtacttcacagaac

SEQ ID NO: 418472 - DNA, 96 bp, Homo sapiens
ctctgcacaagtgtctggcaggccgaggtgcacctgtttctgtcactctggagtaaatttagctgtaaaggtatcactgacaaccagacctttgtc

SEQ ID NO: 418473 - DNA, 1874 bp, Homo sapiens
tagctatcttgatttcactacagctcagtagcagttcagtgctttggctttggagtcacagccaagttcaagtcatggttgtgtgactttggattttattaactatatatttctgttttccatctgctgctaaggtgatgccatctggtataatgagaatgaaatgagatgtttattaaacactgaggatcagtgcctagcatatacaagcacttagtaattatatttttatcattagtctaattctggtctcttgatctttctttagttcctaaagtccttactatggtttctattcatgtggctcttacatgaacaatacatgacacaaatatgatagtgtttgaatgtctgtcatgcacataatagtctgctagaaatttcgaaaatgaataagactggctgggcacggtggctcatgcctgtaatcccagcactgttagaggtcaaggcgggcagatcacctgaggtccggcattcaagaccagcctggccaacatggtgaaaccctgtctctactaaaaatacaaaaaatagtggggcatggtggcgcattcctgtaatctcagctactcgggaggctgagacaggagaatcacttgaacccgggaggcagaggttgcagtgagccgagactgcaccactgcagtccagcctgggcaatagagcgggactcggtctcaaataggatagctgtatgagcaactaatgttacacaggtaatgaagcagagtggactctaagggtctaagatatttacagggtgctagaggaagaagagaatatataggtccaaagacttatttcttagggagttttacatcatctccccacagcagaagccctggttatgtgactatgccagtaattgagtggtttaatctccagtttagggatatgggtattaaccagtccctgttgctacagattgaaagacatattctttaattttgctaacaataaaggtgatgtttgatctcctgagtaacttctccatctcaggagtttccaaattctggaggaaaatacaaggatgttatcctatttttatcattaggaatcagcttccttgctgaaatttagatacaaaagtgacactggtctggcatactctgtttttagtgctggatgattcctaatgatcactactattttgaaaaggcaacagcataagaatttgattaataatgaatggttcaaagaacaaagtctacccagaatttcatcattcgttttggtgtatttcagttatttttatagatatttgtgtattgtttaaagaaattggtattgtactgtctataacaaatttttacacttttacatttgtgaaatctatcatatagaagagagcattcagcatgtacaatttaatgagaaataaagttataaaacagatactcatatacccaatgctcaggttaagaaatgtacattgccaataccttagtaagctcctatgtatcctttcctggtcagtttcctgaatcaccccaagagagagaaccaatattctgcttgtaatgcaaataatcttttctttgtatttttaccaattaagtatactggttgtcacactttttaaaacataatttctaaaccatcataaaatgatacttttgtaaatacaaaatcatgtacttgaatgcattggcactgtcagtttactatcagcatttctaaatgtttatgcatgtttgctcactttatgtgcttatctctccatcagccaatgacagttgatcaatatgggatcaatatgggaccacacttcgagtagtactgatgtctacattccttaaaaatagtctaaacaggtagaagtaaacattaataaaatttaataaagtattaaattctatttaataaataga

SEQ ID NO: 418474 - DNA, 1936 bp, Homo sapiens
tagctatcttgatttcactacagctcagtagcagttcagtgctttggctttggagtcacagccaagttcaagtcatggttgtgtgactttggattttattaactatatatttctgttttccatctgctgctaaggtgatgccatctggtataatgagaatgaaatgagatgtttattaaacactgaggatcagtgcctagcatatacaagcacttagtaattatatttttatcattagtctaattctggtctcttgatctttctttagttcctaaagtccttactatggtttctattcatgtggctcttacatgaacaatacatgacacaaatatgatagtgtttgaatgtctgtcatgcacataatagtctgctagaaatttcgaaaatgaataagactggctgggcacggtggctcatgcctgtaatcccagcactgttagaggtcaaggcgggcagatcacctgaggtccggcattcaagaccagcctggccaacatggtgaaaccctgtctctactaaaaatacaaaaaatagtggggcatggtggcgcattcctgtaatctcagctactcgggaggctgagacaggagaatcacttgaacccgggaggcagaggttgcagtgagccgagactgcaccactgcagtccagcctgggcaatagagcgggactcggtctcaaaaaaaaaaaaaaatgaataagacagtagtctcacctccaggaacataacctagatggtgtagataggatagctgtatgagcaactaatgttacacaggtaatgaagcagagtggactctaagggtctaagatatttacagggtgctagaggaagaagagaatatataggtccaaagacttatttcttagggagttttacatcatctccccacagcagaagccctggttatgtgactatgccagtaattgagtggtttaatctccagtttagggatatgggtattaaccagtccctgttgctacagattgaaagacatattctttaattttgctaacaataaaggtgatgtttgatctcctgagtaacttctccatctcaggagtttccaaattctggaggaaaatacaaggatgttatcctatttttatcattaggaatcagcttccttgctgaaatttagatacaaaagtgacactggtctggcatactctgtttttagtgctggatgattcctaatgatcactactattttgaaaaggcaacagcataagaatttgattaataatgaatggttcaaagaacaaagtctacccagaatttcatcattcgttttggtgtatttcagttatttttatagatatttgtgtattgtttaaagaaattggtattgtactgtctataacaaatttttacacttttacatttgtgaaatctatcatatagaagagagcattcagcatgtacaatttaatgagaaataaagttataaaacagatactcatatacccaatgctcaggttaagaaatgtacattgccaataccttagtaagctcctatgtatcctttcctggtcagtttcctgaatcaccccaagagagagaaccaatattctgcttgtaatgcaaataatcttttctttgtatttttaccaattaagtatactggttgtcacactttttaaaacataatttctaaaccatcataaaatgatacttttgtaaatacaaaatcatgtacttgaatgcattggcactgtcagtttactatcagcatttctaaatgtttatgcatgtttgctcactttatgtgcttatctctccatcagccaatgacagttgatcaatatgggatcaatatgggaccacacttcgagtagtactgatgtctacattccttaaaaatagtctaaacaggtagaagtaaacattaataaaatttaataaagtattaaattctatttaataaataga

SEQ ID NO: 418475 - DNA, 474 bp, Homo sapiens
gagccgaagtgacccggagtcgaagaaagaacaggaatattcttcaggtttccttcaaacaactgcggatgagttttgcttttactatgcaagaaaagatggtgggttgtgctttccagattttccaagaaaacaagtcagaggaccagcatctaactacttggaccagatggaagaatatgacaaagtggaagagatcagcagcacaaacacaactgcttctgtattcaggaggttgtgagtgggctgcggcagcccgttggtgccctgcatagtggggatggctcgcaacgtctcttcattctggaaaaagaaggttatgtgaagatacttacccctgaaggagaaattttcaaggagccttacttggacattcacaaacttgttcaaagtggaataaaggaccttctcatccttttcatcatcaagaaaatcacgtggctgtcactatagacaacaaacaactaccaataa

SEQ ID NO: 418476 - DNA, 341 bp, Homo sapiens
cggcacgaggtgttggagggggacttctgcagaactgcaaaatgtgagccagcatgtcgtcatggaggtgtctgtgttagaccgaacaagtgcctctgtaaaaaaggatatcttggtcctcaatgtgaacaagtggacagaaacatccgcagagtgaccagggcagacatcacctagatgaaacacctttaccctgtcctgtaaaacactaaagttacatttttcaccaacttaattggaaagaaggggagtgagaaagcaaacagtctttaatgtgctgtggatctaatctagcaaggtatccttgtgccaacatgtaatcattaacgacgaaaaaaaaa

SEQ ID NO: 418477 - DNA, 874 bp, Homo sapiens
caactgatgtagatgcctccagggtaaagcaaaggtttacatattacacaagcaatttaactgttttctaaacatattgccaagacagtgggagttggcagcccacactgtgttttaggttttggagacttggattagaagtgactgttgattatgaacctttttatttgtcttctatgaactacaagcaacctagtaacccgggaaagaattcttcacagcacttaaacttgtcctcctagcggcccaagattacatacacaaatcacttgacaaaagtggtgtaagactcttgtacatagataaccacacaagacaattgtcttgttctaacccttaaagagttccacaaagtgaaatgttttataatccttttttgtgcagtaggcaaggaagaaaagaaaggaggttgggcaaagattatccaaaagaaagaaagagactcttttggggttccagttgaaacacaataaagaacataattaactttacaattctttgtgtttttcatttgactgcagggaggagatgaaagaggactgctaagcctcgcattccatcccaattacaagaaaaatggaaagttgtatgtgtcctataccaccaaccaagaacggtgggctatcgggcctcatgaccacattcttagggttgtggaatacacagtatccaggtatcactaaaaggcatcgaagcatagaaatttctcatcttattttctcatcatcttttcataagtttttttatttagaagttgcaaataagtaaccataaggtggcaataattaaatcattacctccatcttgctgaaaactccatatgtgtctttaagagaaatggagaacaacaatggttttgacatttttcctcaat

SEQ ID NO: 418478 - DNA, 640 bp, Homo sapiens
agcagggaggccgccggggcccgggggacgcgctcgcgcgggggccgccccctccccttccctccaccctgggcgggggcgcgcgagaagcggtgacgtcaaggggcgcgctgtggcagcacctccccgcgcgctagttaaaaagaagaagaaaagagggaacgaaacatgagaggctgtgtgagaagctgcagccgccggcagaggagacctcagcatcatctagagcccagcgctggccctgcctccgcctgccccgccgccgccgtcgccgtttctgttcctgctactgtcccacctaaacaactcccgttacacggacaagtgaacatctgtggctgtcctctccttttcttcctcctcttccaactccttctcctcctcccacttcccagccgcagcagaaagcccccaacccaactgacactggcacaactgcaaacggtgtcatccgcacaactttatctcgctcctcgggctcccctaaggcattggacccatcgccgcgtcagtatagataggtcagtatagataagtagtatagataggtcagtatagataagtcggtatagataggtagtatagatagcgtcagtatagataagtagtatagatagcgtcagtatagataggtcagtat

SEQ ID NO: 418479 - DNA, 3723 bp, Homo sapiens
agcagggaggccgccggggcccgggggacgcgctcgcgcgggggccgccccctccccttccctccaccctgggcgggggcgcgcgagaagcggtgacgtcaaggggcgcgctgtggcagcacctccccgcgcgctagttaaaaagaagaagaaaagagggaacgaaacatgagaggctgtgtgagaagctgcagccgccggcagaggagacctcagcatcatctagagcccagcgctggccctgcctccgcctgccccgccgccgccgtcgccgtttctgttcctgctactgtcccacctaaacaactcccgttacacggacaagtgaacatctgtggctgtcctctccttttcttcctcctcttccaactccttctcctcctcccacttcccagccgcagcagaaagcccccaacccaactgacactggcacaactgcaaacggtgtcatccgcacaactttatctcgctcctcgggctcccctaaggcattggacccatcgccgcgtcttttattttttgcaaagttgcatcgctgtacatatttttgtccccgccacctccctctgtctctggagtgccctacagccccgcaaactcctcctggagctgcgccctagtgcccctgctgggcagtggcgttcccccccatcctcccgcgcccagcccctgctgctctgggcagacgatgctgaagatgctctcctttaagctgctgctgctggccgtggctctgggcttctttgaaggagatgctaagtttggggaaagaaacgaagggagcggagcaaggaggagaaggtgcctgaatgggaaccccccgaagcgcctgaaaaggagagacaggaggatgatgtcccagctggagctgctgagtgggggagagatgctgtgcggtggcttctaccctcggctgtcctgctgcctgcggagtgacagcccggggctagggcgcctggagaataagatattttctgttaccaacaacacagaatgtgggaagttactggaggaaatcaaatgtgcactttgctctccacattctcaaagcctgttccactcacctgagagagaagtcttggaaagagacctagtacttcctctgctctgcaaagactattgcaaagaattcttttacacttgccgaggccatattccaggtttccttcaaacaactgcggatgagttttgcttttactatgcaagaaaagatggtgggttgtgctttccagattttccaagaaaacaagtcagaggaccagcatctaactacttggaccagatggaagaatatgacaaagtggaagagatcagcagcacaaacacaactgcttctgtattcaggaggttgtgagtgggctgcggcagcccgttggtgccctgcatagtggggatggctcgcaacgtctcttcattctggaaaaagaaggttatgtgaagatacttacccctgaaggagaaattttcaaggagccttacttggacattcacaaacttgttcaaagtggaataaagggaggagatgaaagaggactgctaagcctcgcattccatcccaattacaagaaaaatggaaagttgtatgtgtcctataccaccaaccaagaacggtgggctatcgggcctcatgaccacattcttagggttgtggaatacacagtatccagaaaaaatccacaccaagttgatttgagaacagccagagtctttcttgaagttgcagaactccacagaaagcatctgggaggacaactgctctttggccctgacggctttttgtacatcattcttggtgatgggatgattacactggatgatatggaagaaatggatgggttaagtgatttcacaggctcagtgctacggctggatgtggacacagacatgtgcaacgtgccttattccataccaaggagcaacccacacttcaacagcaccaaccagccccccgaagtgtttgctcatgggctccacgatccaggcagatgtgctgtggatagacatcccactgatataaacatcaatttaacgatactgtgttcagactccaatggaaaaaacagatcatcagccagaattctacagataataaaggggaaagattatgaaagtgagccatcacttttagaattcaagccattcagtaatggtcctttggttggtggatttgtataccggggctgccagtcagaaagattgtatggaagctacgtgtttggagatcgtaatgggaatttcctaactctccagcaaagtcctgtgacaaagcagtggcaagaaaaaccactctgtctcggcactagtgggtcctgtagaggctacttttccggtcacatcttgggatttggagaagatgaactaggtgaagtttacattttatcaagcagtaaaagtatgacccagactcacaatggaaaactctacaaaattgtagatcccaaaagacctttaatgcctgaggaatgcagagccacggtacaacctgcacagacactgacttcagagtgctccaggctctgtcgaaacggctactgcacccccacgggaaagtgctgctgcagtccaggctgggagggggacttctgcagaactgcaaaatgtgagccagcatgtcgtcatggaggtgtctgtgttagaccgaacaagtgcctctgtaaaaaaggatatcttggtcctcaatgtgaacaagtggacagaaacatccgcagagtgaccagggcaggtattcttgatcagatcattgacatgacatcttacttgctggatctaacaagttacattgtatagtttctgggactgtttgaatattctattccaatgggcatttattttttatcctgtcattaaaaaaaaaagactgttatcctgctacacactcctgtgatttcattctcttttattaatttaaaaataatttccagaaatgtgcagatcctctgtgtgtatgtcagcatgtttgttcacatatgcacatacacatactcataacccctatatgcgttgttgcataacagatgattttttaaaatatatacttccttatgcaaagtaatttacacagaaattccattgtaaattgataatggattttttatgttactagaagagattatttgacttcccaggaattttctgtctgtaatcactaaagtcaactttaatagagttttgaaacagtactgtgcaatccgatggatctaattaaaaaaaaggcaatatttttatattaaagtactatactaggagagaatgtttcagaactccctgatgaatttctaagtgagcaacttgatataaaattgtaatcttcatttttgtcagtgtatccagttacagaatgctacacacttacctttttattggctgagaaatctggttatttcatcttaatctcaagattgttttcaagtgttttataattaaatcataatagcatattttaaaatcaatcttcctaaaaggtctgcttttattgtatattttatttaacaataggcactgggtttgtgttacatatttatatattttattttatttttataatatagacatcacctagatgaaacacctttaccctgtcctgtaaaacactaaagttacatttttcaccaacttaattggaaagaaggggagtgagaaagcaaacagtctttaatgtgctgtggatctaatctagcaaggtatccttgtgccaacatgtaatcattaacgacgaaaaaaaaa

SEQ ID NO: 418480 - DNA, 2870 bp, Homo sapiens
agcagggaggccgccggggcccgggggacgcgctcgcgcgggggccgccccctccccttccctccaccctgggcgggggcgcgcgagaagcggtgacgtcaaggggcgcgctgtggcagcacctccccgcgcgctagttaaaaagaagaagaaaagagggaacgaaacatgagaggctgtgtgagaagctgcagccgccggcagaggagacctcagcatcatctagagcccagcgctggccctgcctccgcctgccccgccgccgccgtcgccgtttctgttcctgctactgtcccacctaaacaactcccgttacacggacaagtgaacatctgtggctgtcctctccttttcttcctcctcttccaactccttctcctcctcccacttcccagccgcagcagaaagcccccaacccaactgacactggcacaactgcaaacggtgtcatccgcacaactttatctcgctcctcgggctcccctaaggcattggacccatcgccgcgtcttttattttttgcaaagttgcatcgctgtacatatttttgtccccgccacctccctctgtctctggagtgccctacagccccgcaaactcctcctggagctgcgccctagtgcccctgctgggcagtggcgttcccccccatcctcccgcgcccagcccctgctgctctgggcagacgatgctgaagatgctctcctttaagctgctgctgctggccgtggctctgggcttctttgaaggagatgctaagtttggggaaagaaacgaagggagcggagcaaggaggagaaggtgcctgaatgggaaccccccgaagcgcctgaaaaggagagacaggaggatgatgtcccagctggagctgctgagtgggggagagatgctgtgcggtggcttctaccctcggctgtcctgctgcctgcggagtgacagcccggggctagggcgcctggagaataagatattttctgttaccaacaacacagaatgtgggaagttactggaggaaatcaaatgtgcactttgctctccacattctcaaagcctgttccactcacctgagagagaagtcttggaaagagacctagtacttcctctgctctgcaaagactattgcaaagaattcttttacacttgccgaggccatattccaggtttccttcaaacaactgcggatgagttttgcttttactatgcaagaaaagatggtgggttgtgctttccagattttccaagaaaacaagtcagaggaccagcatctaactacttggaccagatggaagaatatgacaaagtggaagagatcagcagcacaaacacaactgcttctgtattcaggaggttgtgagtgggctgcggcagcccgttggtgccctgcatagtggggatggctcgcaacgtctcttcattctggaaaaagaaggttatgtgaagatacttacccctgaaggagaaattttcaaggagccttacttggacattcacaaacttgttcaaagtggaataaagggaggagatgaaagaggactgctaagcctcgcattccatcccaattacaagaaaaatggaaagttgtatgtgtcctataccaccaaccaagaacggtgggctatcgggcctcatgaccacattcttagggttgtggaatacacagtatccagaaaaaatccacaccaagttgatttgagaacagccagagtctttcttgaagttgcagaactccacagaaagcatctgggaggacaactgctctttggccctgacggctttttgtacatcattcttggtgatgggatgattacactggatgatatggaagaaatggatgggttaagtgatttcacaggctcagtgctacggctggatgtggacacagacatgtgcaacgtgccttattccataccaaggagcaacccacacttcaacagcaccaaccagccccccgaagtgtttgctcatgggctccacgatccaggcagatgtgctgtggatagacatcccactgatataaacatcaatttaacgatactgtgttcagactccaatggaaaaaacagatcatcagccagaattctacagataataaaggggaaagattatgaaagtgagccatcacttttagaattcaagccattcagtaatggtcctttggttggtggatttgtataccggggctgccagtcagaaagattgtatggaagctacgtgtttggagatcgtaatgggaatttcctaactctccagcaaagtcctgtgacaaagcagtggcaagaaaaaccactctgtctcggcactagtgggtcctgtagaggctacttttccggtcacatcttgggatttggagaagatgaactaggtgaagtttacattttatcaagcagtaaaagtatgacccagactcacaatggaaaactctacaaaattgtagatcccaaaagacctttaatgcctgaggaatgcagagccacggtacaacctgcacagacactgacttcagagtgctccaggctctgtcgaaacggctactgcacccccacgggaaagtgctgctgcagtccaggctgggagggggacttctgcagaactgcaaaatgtgagccagcatgtcgtcatggaggtgtctgtgttagaccgaacaagtgcctctgtaaaaaaggatatcttggtcctcaatgtgaacaagtggacagaaacatccgcagagtgaccagggcaggtattcttgatcagatcattgacatgacatcttacttgctggatctaacaagttacattgtatagtttctgggactgtttgaatattctattccaatgggcatttattttttatcctgtcattaaaaaaaaaagactgttatcctgct

SEQ ID NO: 418481 - DNA, 2897 bp, Homo sapiens
agcagggaggccgccggggcccgggggacgcgctcgcgcgggggccgccccctccccttccctccaccctgggcgggggcgcgcgagaagcggtgacgtcaaggggcgcgctgtggcagcacctccccgcgcgctagttaaaaagaagaagaaaagagggaacgaaacatgagaggctgtgtgagaagctgcagccgccggcagaggagacctcagcatcatctagagcccagcgctggccctgcctccgcctgccccgccgccgccgtcgccgtttctgttcctgctactgtcccacctaaacaactcccgttacacggacaagtgaacatctgtggctgtcctctccttttcttcctcctcttccaactccttctcctcctcccacttcccagccgcagcagaaagcccccaacccaactgacactggcacaactgcaaacggtgtcatccgcacaactttatctcgctcctcgggctcccctaaggcattggacccatcgccgcgtcttttattttttgcaaagttgcatcgctgtacatatttttgtccccgccacctccctctgtctctggagtgccctacagccccgcaaactcctcctggagctgcgccctagtgcccctgctgggcagtggcgttcccccccatcctcccgcgcccagcccctgctgctctgggcagacgatgctgaagatgctctcctttaagctgctgctgctggccgtggctctgggcttctttgaaggagatgctaagtttggggaaagaaacgaagggagcggagcaaggaggagaaggtgcctgaatgggaaccccccgaagcgcctgaaaaggagagacaggaggatgatgtcccagctggagctgctgagtgggggagagatgctgtgcggtggcttctaccctcggctgtcctgctgcctgcggagtgacagcccggggctagggcgcctggagaataagatattttctgttaccaacaacacagaatgtgggaagttactggaggaaatcaaatgtgcactttgctctccacattctcaaagcctgttccactcacctgagagagaagtcttggaaagagacctagtacttcctctgctctgcaaagactattgcaaagaattcttttacacttgccgaggccatattccaggtttccttcaaacaactgcggatgagttttgcttttactatgcaagaaaagatggtgggttgtgctttccagattttccaagaaaacaagtcagaggaccagcatctaactacttggaccagatggaagaatatgacaaagtggaagagatcagcagcacaaacacaactgcttctgtattcaggaggttgtgagtgggctgcggcagcccgttggtgccctgcatagtggggatggctcgcaacgtctcttcattctggaaaaagaaggttatgtgaagatacttacccctgaaggagaaattttcaaggagccttacttggacattcacaaacttgttcaaagtggaataaagggaggagatgaaagaggactgctaagcctcgcattccatcccaattacaagaaaaatggaaagttgtatgtgtcctataccaccaaccaagaacggtgggctatcgggcctcatgaccacattcttagggttgtggaatacacagtatccagaaaaaatccacaccaagttgatttgagaacagccagagtctttcttgaagttgcagaactccacagaaagcatctgggaggacaactgctctttggccctgacggctttttgtacatcattcttggtgatgggatgattacactggatgatatggaagaaatggatgggttaagtgatttcacaggctcagtgctacggctggatgtggacacagacatgtgcaacgtgccttattccataccaaggagcaacccacacttcaacagcaccaaccagccccccgaagtgtttgctcatgggctccacgatccaggcagatgtgctgtggatagacatcccactgatataaacatcaatttaacgatactgtgttcagactccaatggaaaaaacagatcatcagccagaattctacagataataaaggggaaagattatgaaagtgagccatcacttttagaattcaagccattcagtaatggtcctttggttggtggatttgtataccggggctgccagtcagaaagattgtatggaagctacgtgtttggagatcgtaatgggaatttcctaactctccagcaaagtcctgtgacaaagcagtggcaagaaaaaccactctgtctcggcactagtgggtcctgtagaggctacttttccggtcacatcttgggatttggagaagatgaactaggtgaagtttacattttatcaagcagtaaaagtatgacccagactcacaatggaaaactctacaaaattgtagatcccaaaagacctttaatgcctgaggaatgcagagccacggtacaacctgcacagacactgacttcagagtgctccaggctctgtcgaaacggctactgcacccccacgggaaagtgctgctgcagtccaggctgggagggggacttctgcagaactgcaaaatgtgagccagcatgtcgtcatggaggtgtctgtgttagaccgaacaagtgcctctgtaaaaaaggatatcttggtcctcaatgtgaacaagtggacagaaacatccgcagagtgaccagggcagacatcacctagatgaaacacctttaccctgtcctgtaaaacactaaagttacatttttcaccaacttaattggaaagaaggggagtgagaaagcaaacagtctttaatgtgctgtggatctaatctagcaaggtatccttgtgccaacatgtaatcattaacgacgaaaaaaaaa

SEQ ID NO: 418482 - DNA, 2215 bp, Homo sapiens
agcagggaggccgccggggcccgggggacgcgctcgcgcgggggccgccccctccccttccctccaccctgggcgggggcgcgcgagaagcggtgacgtcaaggggcgcgctgtggcagcacctccccgcgcgctagttaaaaagaagaagaaaagagggaacgaaacatgagaggctgtgtgagaagctgcagccgccggcagaggagacctcagcatcatctagagcccagcgctggccctgcctccgcctgccccgccgccgccgtcgccgtttctgttcctgctactgtcccacctaaacaactcccgttacacggacaagtgaacatctgtggctgtcctctccttttcttcctcctcttccaactccttctcctcctcccacttcccagccgcagcagaaagcccccaacccaactgacactggcacaactgcaaacggtgtcatccgcacaactttatctcgctcctcgggctcccctaaggcattggacccatcgccgcgtcttttattttttgcaaagttgcatcgctgtacatatttttgtccccgccacctccctctgtctctggagtgccctacagccccgcaaactcctcctggagctgcgccctagtgcccctgctgggcagtggcgttcccccccatcctcccgcgcccagcccctgctgctctgggcagacgatgctgaagatgctctcctttaagctgctgctgctggccgtggctctgggcttctttgaaggagatgctaagtttggggaaagaaacgaagggagcggagcaaggaggagaaggtgcctgaatgggaaccccccgaagcgcctgaaaaggagagacaggaggatgatgtcccagctggagctgctgagtgggggagagatgctgtgcggtggcttctaccctcggctgtcctgctgcctgcggagtgacagcccggggctagggcgcctggagaataagatattttctgttaccaacaacacagaatgtgggaagttactggaggaaatcaaatgtgcactttgctctccacattctcaaagcctgttccactcacctgagagagaagtcttggaaagagacctagtacttcctctgctctgcaaagactattgcaaagaattcttttacacttgccgaggccatattccaggtttccttcaaacaactgcggatgagttttgcttttactatgcaagaaaagatggtgggttgtgctttccagattttccaagaaaacaagtcagaggaccagcatctaactacttggaccagatggaagaatatgacaaagtggaagagatcagcagcacaaacacaactgcttctgtattcaggaggttgtgagtgggctgcggcagcccgttggtgccctgcatagtggggatggctcgcaacgtctcttcattctggaaaaagaaggttatgtgaagatacttacccctgaaggagaaattttcaaggagccttacttggacattcacaaacttgttcaaagtggaataaagggaggagatgaaagaggactgctaagcctcgcattccatcccaattacaagaaaaatggaaagttgtatgtgtcctataccaccaaccaagaacggtgggctatcgggcctcatgaccacattcttagggttgtggaatacacagtatccagaaaaaatccacaccaagttgatttgagaacagccagagtctttcttgaagttgcagaactccacagaaagcatctgggaggacaactgctctttggccctgacggctttttgtacatcattcttggtgatgggatgattacactggatgatatggaagaaatggatgggttaaggtaaaaggctgatcacagatgggttcctctcaaggttaaaatagtttaagtgccagaagaaaaggtgggcaccagcgaattaagaaccatctttgaatggtcaccttggttaaatacttaacttttgtcatcagtgtctgcatttatgaaatgaagaggaattcactaatatgctacgtgatcttttgtttgtcatgaaaagagttactgttgtgtagttctctgttccagggctgcctctgctccacaaagcactgagaagcagtggccctgtacaaccatactgcctctcaacactgtgtaataggctaacaccgcccagcgaaccttcctgggagatatagaatacataggtttaggctgacaaaaattaa

SEQ ID NO: 418483 - DNA, 1868 bp, Homo sapiens
agcagggaggccgccggggcccgggggacgcgctcgcgcgggggccgccccctccccttccctccaccctgggcgggggcgcgcgagaagcggtgacgtcaaggggcgcgctgtggcagcacctccccgcgcgctagttaaaaagaagaagaaaagagggaacgaaacatgagaggctgtgtgagaagctgcagccgccggcagaggagacctcagcatcatctagagcccagcgctggccctgcctccgcctgccccgccgccgccgtcgccgtttctgttcctgctactgtcccacctaaacaactcccgttacacggacaagtgaacatctgtggctgtcctctccttttcttcctcctcttccaactccttctcctcctcccacttcccagccgcagcagaaagcccccaacccaactgacactggcacaactgcaaacggtgtcatccgcacaactttatctcgctcctcgggctcccctaaggcattggacccatcgccgcgtcttttattttttgcaaagttgcatcgctgtacatatttttgtccccgccacctccctctgtctctggagtgccctacagccccgcaaactcctcctggagctgcgccctagtgcccctgctgggcagtggcgttcccccccatcctcccgcgcccagcccctgctgctctgggcagacgatgctgaagatgctctcctttaagctgctgctgctggccgtggctctgggcttctttgaaggagatgctaagtttggggaaagaaacgaagggagcggagcaaggaggagaaggtgcctgaatgggaaccccccgaagcgcctgaaaaggagagacaggaggatgatgtcccagctggagctgctgagtgggggagagatgctgtgcggtggcttctaccctcggctgtcctgctgcctgcggagtgacagcccggggctagggcgcctggagaataagatattttctgttaccaacaacacagaatgtgggaagttactggaggaaatcaaatgtgcactttgctctccacattctcaaagcctgttccactcacctgagagagaagtcttggaaagagacctagtacttcctctgctctgcaaagactattgcaaagaattcttttacacttgccgaggccatattccaggtttccttcaaacaactgcggatgagttttgcttttactatgcaagaaaagatggtgggttgtgctttccagattttccaagaaaacaagtcagaggaccagcatctaactacttggaccagatggaagaatatgacaaagtggaagagatcagcagcacaaacacaactgcttctgtattcaggaggttgtgagtgggctgcggcagcccgttggtgccctgcatagtggggatggctcgcaacgtctcttcattctggaaaaagaaggttatgtgaagatacttacccctgaaggagaaattttcaaggagccttacttggacattcacaaacttgttcaaagtggaataaagggaggagatgaaagaggactgctaagcctcgcattccatcccaattacaagaaaaatggaaagttgtatgtgtcctataccaccaaccaagaacggtgggctatcgggcctcatgaccacattcttagggttgtggaatacacagtatccaggtatcactaaaaggcatcgaagcatagaaatttctcatcttattttctcatcatcttttcataagtttttttatttagaagttgcaaataagtaaccataaggtggcaataattaaatcattacctccatcttgctgaaaactccatatgtgtctttaagagaaatggagaacaacaatggttttgacatttttcctcaat

SEQ ID NO: 418484 - DNA, 1544 bp, Homo sapiens
agcagggaggccgccggggcccgggggacgcgctcgcgcgggggccgccccctccccttccctccaccctgggcgggggcgcgcgagaagcggtgacgtcaaggggcgcgctgtggcagcacctccccgcgcgctagttaaaaagaagaagaaaagagggaacgaaacatgagaggctgtgtgagaagctgcagccgccggcagaggagacctcagcatcatctagagcccagcgctggccctgcctccgcctgccccgccgccgccgtcgccgtttctgttcctgctactgtcccacctaaacaactcccgttacacggacaagtgaacatctgtggctgtcctctccttttcttcctcctcttccaactccttctcctcctcccacttcccagccgcagcagaaagcccccaacccaactgacactggcacaactgcaaacggtgtcatccgcacaactttatctcgctcctcgggctcccctaaggcattggacccatcgccgcgtcttttattttttgcaaagttgcatcgctgtacatatttttgtccccgccacctccctctgtctctggagtgccctacagccccgcaaactcctcctggagctgcgccctagtgcccctgctgggcagtggcgttcccccccatcctcccgcgcccagcccctgctgctctgggcagacgatgctgaagatgctctcctttaagctgctgctgctggccgtggctctgggcttctttgaaggagatgctaagtttggggaaagaaacgaagggagcggagcaaggaggagaaggtgcctgaatgggaaccccccgaagcgcctgaaaaggagagacaggaggatgatgtcccagctggagctgctgagtgggggagagatgctgtgcggtggcttctaccctcggctgtcctgctgcctgcggagtgacagcccggggctagggcgcctggagaataagatattttctgttaccaacaacacagaatgtgggaagttactggaggaaatcaaatgtgcactttgctctccacattctcaaagcctgttccactcacctgagagagaagtcttggaaagagacctagtacttcctctgctctgcaaagactattgcaaagaattcttttacacttgccgaggccatattccaggtttccttcaaacaactgcggatgagttttgcttttactatgcaagaaaagatggtgggttgtgctttccagattttccaagaaaacaagtcagaggaccagcatctaactacttggaccagatggaagaatatgacaaagtggaagagatcagcagcacaaacacaactgcttctgtattcaggaggttgtgagtgggctgcggcagcccgttggtgccctgcatagtggggatggctcgcaacgtctcttcattctggaaaaagaaggttatgtgaagatacttacccctgaaggagaaattttcaaggagccttacttggacattcacaaacttgttcaaagtggaataaaggttggctttttaaattttaaaaaaaaaag

SEQ ID NO: 418485 - DNA, 1188 bp, Homo sapiens
agcagggaggccgccggggcccgggggacgcgctcgcgcgggggccgccccctccccttccctccaccctgggcgggggcgcgcgagaagcggtgacgtcaaggggcgcgctgtggcagcacctccccgcgcgctagttaaaaagaagaagaaaagagggaacgaaacatgagaggctgtgtgagaagctgcagccgccggcagaggagacctcagcatcatctagagcccagcgctggccctgcctccgcctgccccgccgccgccgtcgccgtttctgttcctgctactgtcccacctaaacaactcccgttacacggacaagtgaacatctgtggctgtcctctccttttcttcctcctcttccaactccttctcctcctcccacttcccagccgcagcagaaagcccccaacccaactgacactggcacaactgcaaacggtgtcatccgcacaactttatctcgctcctcgggctcccctaaggcattggacccatcgccgcgtcttttattttttgcaaagttgcatcgctgtacatatttttgtccccgccacctccctctgtctctggatgacagcccggggctagggcgcctggagaataagatattttctgttaccaacaacacagaatgtgggaagttactggaggaaatcaaatgtgcactttgctctccacattctcaaagcctgttccactcacctgagagagaagtcttggaaagagacctagtacttcctctgctctgcaaagactattgcaaagaattcttttacacttgccgaggccatattccaggtttccttcaaacaactgcggatgagttttgcttttactatgcaagaaaagatggtgggttgtgctttccagattttccaagaaaacaagtcagaggaccagcatctaactacttggaccagatggaagaatatgacaaagtggaagagatcagcagcacaaacacaactgcttctgtattcaggaggttgtgagtgggctgcggcagcccgttggtgccctgcatagtggggatggctcgcaacgtctcttcattctggaaaaagaaggttatgtgaagatacttacccctgaaggagaaattttcaaggagccttacttggacattcacaaacttgttcaaagtggaataaaggttggctttttaaattttaaaaaaaaaag

SEQ ID NO: 418486 - DNA, 1587 bp, Homo sapiens
agcagggaggccgccggggcccgggggacgcgctcgcgcgggggccgccccctccccttccctccaccctgggcgggggcgcgcgagaagcggtgacgtcaaggggcgcgctgtggcagcacctccccgcgcgctagttaaaaagaagaagaaaagagggaacgaaacatgagaggctgtgtgagaagctgcagccgccggcagaggagacctcagcatcatctagagcccagcgctggccctgcctccgcctgccccgccgccgccgtcgccgtttctgttcctgctactgtcccacctaaacaactcccgttacacggacaagtgaacatctgtggctgtcctctccttttcttcctcctcttccaactccttctcctcctcccacttcccagccgcagcagaaagcccccaacccaactgacactggcacaactgcaaacggtgtcatccgcacaactttatctcgctcctcgggctcccctaaggcattggacccatcgccgcgtcttttattttttgcaaagttgcatcgctgtacatatttttgtccccgccacctccctctgtctctggagtgccctacagccccgcaaactcctcctggagctgcgccctagtgcccctgctgggcagtggcgttcccccccatcctcccgcgcccagcccctgctgctctgggcagacgatgctgaagatgctctcctttaagctgctgctgctggccgtggctctgggcttctttgaaggagatgctaagtttggggaaagaaacgaagggagcggagcaaggaggagaaggtgcctgaatgggaaccccccgaagcgcctgaaaaggagagacaggaggatgatgtcccagctggagctgctgagtgggggagagatgctgtgcggtggcttctaccctcggctgtcctgctgcctgcggagtgacagcccggggctagggcgcctggagaataagatattttctgttaccaacaacacagaatgtgggaagttactggaggaaatcaaatgtgcactttgctctccacattctcaaagcctgttccactcacctgagagagaagtcttggaaagagacctagtacttcctctgctctgcaaagactattgcaaagaattcttttacacttgccgaggccatattccaggtttccttcaaacaactgcggatgagttttgcttttactatgcaagaaaagatggtgggttgtgctttccagattttccaagaaaacaagtcagaggaccagcatctaactacttggaccagatggaagaatatgacaaagtggaagagatcagcagcacaaacacaactgcttctgtattcaggaggttgtgagtgggctgcggcagcccgttggtgccctgcatagtggggatggctcgcaacgtctcttcattctggaaaaagaaggttatgtgaagatacttacccctgaaggagaaattttcaaggagccttacttggacattcacaaacttgttcaaagtggaataaaggaccttctcatccttttcatcatcaagaaaatcacgtggctgtcactatagacaacaaacaactaccaataa

SEQ ID NO: 418487 - DNA, 430 bp, Homo sapiens
cgggtttctcaccaccatgtatttatcaagacagagacagtactaggtttccttcaaacaactgcggatgagttttgcttttactatgcaagaaaagatggtgggttgtgctttccagattttccaagaaaacaagtcagaggaccagcatctaactacttggaccagatggaagaatatgacaaagtggaagagatcagcagcacaaacacaactgcttctgtattcaggaggttgtgagtgggctgcggcagcccgttggtgccctgcatagtggggatggctcgcaacgtctcttcattctggaaaaagaaggttatgtgaagatacttacccctgaaggagaaattttcaaggagccttacttggacattcacaaacttgttcaaagtggaataaaggttggctttttaaattttaaaaaaaaaag

SEQ ID NO: 418488 - DNA, 431 bp, Homo sapiens
tagtgatctaaatgtttttattgccacttgaaaaaaagaggattctggtttccttcaaacaactgcggatgagttttgcttttactatgcaagaaaagatggtgggttgtgctttccagattttccaagaaaacaagtcagaggaccagcatctaactacttggaccagatggaagaatatgacaaagtggaagagatcagcagcacaaacacaactgcttctgtattcaggaggttgtgagtgggctgcggcagcccgttggtgccctgcatagtggggatggctcgcaacgtctcttcattctggaaaaagaaggttatgtgaagatacttacccctgaaggagaaattttcaaggagccttacttggacattcacaaacttgttcaaagtggaataaaggttggctttttaaattttaaaaaaaaaag

SEQ ID NO: 418489 - DNA, 428 bp, Homo sapiens
cttatatttttaattctcacccccttgaaaagagaagaatttcagtttccttcaaacaactgcggatgagttttgcttttactatgcaagaaaagatggtgggttgtgctttccagattttccaagaaaacaagtcagaggaccagcatctaactacttggaccagatggaagaatatgacaaagtggaagagatcagcagcacaaacacaactgcttctgtattcaggaggttgtgagtgggctgcggcagcccgttggtgccctgcatagtggggatggctcgcaacgtctcttcattctggaaaaagaaggttatgtgaagatacttacccctgaaggagaaattttcaaggagccttacttggacattcacaaacttgttcaaagtggaataaaggttggctttttaaattttaaaaaaaaaag

SEQ ID NO: 418490 - DNA, 430 bp, Homo sapiens
cccgccccagacactaaccccaaacgaaaacccgcggaaagctcgggtttccttcaaacaactgcggatgagttttgcttttactatgcaagaaaagatggtgggttgtgctttccagattttccaagaaaacaagtcagaggaccagcatctaactacttggaccagatggaagaatatgacaaagtggaagagatcagcagcacaaacacaactgcttctgtattcaggaggttgtgagtgggctgcggcagcccgttggtgccctgcatagtggggatggctcgcaacgtctcttcattctggaaaaagaaggttatgtgaagatacttacccctgaaggagaaattttcaaggagccttacttggacattcacaaacttgttcaaagtggaataaaggttggctttttaaattttaaaaaaaaaag

SEQ ID NO: 418491 - DNA, 2373 bp, Homo sapiens
ggatgagtcaacttaggtagagtcaggtggagaggagtgttccaggcagaggttagtgagtttgagaccactgtgctgggagcaagggggtggtatctggtaaggctggtaggggatgagcctctttccgggactatcttggacctggggagtgtagggctcctttgccttgcattgagaagtagtagttgcaaaactggaggttatcttcgtacgtgttgaggtggtgtctgccatcccctttgcaccattccagagccagatgaagtcagagctggcagcggtggcctcggagtttgggcgactgacacggtttctggctgaagagcaggcagggctggaacggcgtctcagagagatgcatgaagcccagctggggcgtgcgggagccgcggctagtcgccttgcagaacaggccgcccagctcagccgcctgctggcagaggcccaggagcggagccagcaggggggtctccggctgctccaggtgagcaatgtcccctccctgttcccccagcattctgtgttggctgtcaggcagtgcttaccaaacgcctgtccagagctgcctcttttctccctgggaggaacccacagtgattgaacctgaagaccaaaaacatgttttaaagctggaaacagagttaatgtcgaatgtggtatgtgtggcgattatacccagtgaaaagcatgaagattcggttgtaggagaggtttaaatgacagttgaggaaagtctttttgacagtgacatcctgaaaaaggtgagcaagtcgtattgtggaaatgacagtatccctgggctcacagcaggatgaggcgagttaggtatggcgaggcatggggtggttgaaatggatgtgtgttcattgagggccgtgagggtgctgcttctcccttcctgctcaggttcagtctctgactggagatcggggaacgctgtccctgtgcagctgacactctctttatctctttctccctctccctctttttgtttctcttattcccaggacatcaaggagactttcaataggtgtgttcccagtctttgcccatcgtgaggaaaatgagccggatgttctgtcaggctgcgagagtggacctgacgctggaccctgacacggctcacccggccctgatgctgtcccctgaccgccggggggtccgcctggcagagcggcggcaggaggttgctgaccatcccaagcgcttctcggccgactgctgcgtactgggggcccagggcttccgctccggccggcactactgggaggtagaggtgggcgggcggcggggctgggcggtgggtgctgcccgtgaatcaacccatcataaggaaaaggtgggccctgggggttcctccgtgggcagcggggatgccagctcctcgcgccatcaccatcgccgccgccggctccacctgccccagcagcccctgctccagcgggaagtgtggtgcgtgggcaccaacggcaaacgctatcaggcccagagctccacagaacagacgctgctgagccccagtgagaaaccaaggcgctttggtgtgtacctggactatgaagctgggcgcctgggcttctacaacgcagagactctagcccacgtgcacaccttctcggctgccttcctgggcgagcgtgtctttcctttcttccgggtgctctccaagggcacccgcatcaagctctgcccttgattatcctgccacccgcaggggcccctctgtcagcacttggggggtgggtggtggagggtggcccgtaagtttgagggctcaaaggctcttcccactgcttgttactgtgttgcttcccactcccccttgaccccaggcccctgcttctccctctaggagcctaaagaaccctcctggcctccagctcagccttctctcacctactatgtctgtccaacagaccggccagaatttagcttcacttgagagagatctggaatggtcgccatgattgaaaccacgcaccattacatcatcattacattaattacatcaacataaattatttcttcccccttcccttttccagcactcaaccaaggagcaaagctcatcccaccccacacccctcccaggtctgctcactgccaggctcctctcccctttgttcagtggagctggcttttctcccagcccctttccatgcctttcactccatttggcaagctctgagggggagcctggggacgggtttgggtccccaggaggagagccttgggtataatctatttttctaggagcctcttgccttgtcacttgcagctttcgccctctgctttgatggctgaggtgaactcatgttctttgggaaaagggaaggcgtgctgtggaaataaaatgtttatttgcttctc

SEQ ID NO: 418492 - DNA, 1323 bp, Homo sapiens
  misc_feature (70)..(70): n is a, c, g, or t
  misc_feature (455)..(455): n is a, c, g, or t
atcggctgtggggagtaccggctgcagtcggctgtgccgggagggtaggatggcgtctggccgatgcggngatagcaccgaaagcagacggccgccaggcgctccccctaccccccgaagtttctccccagcggcgggggatgggggtaggcggttcctctgttctttctgcgttccccgcggcctcttaccacagagacgcgggcctccaccgtcctagccctcccgccctgttctctagtgcggactagagcgtctcctcgccatttcctgtcgccctggggccccgcggggaaaaagggggagtagcaggacagcggagggaagtcgcgagcttaggtggtgtgtagacgccggaagtgttgggaaggaggccggaagctaggggcggggccaggaagtgaggaggggcgggggtttatgaggagtccaagggagcattggggcagacttgnactcagagccacctgagggacttggcggtggcgcccagcactgtcccctcccctcgtagagacacggttgtcgtttgggagtagggaacactgtgttggggtgggttgtcggcaggacatctctctggctgctcttggggcgaggtgtggaggggcagggctgggggtggagccgggtcgccagggcgtcggtagggaagacccccgcccctcgcccccccaccgaacctctacactggctggctggacactaagatggctgccgttgccatgacacccaagtctgctcactgccaggctcctctcccctttgttcagtggagctggcttttctcccagcccctttccatgcctttcactccatttggcaagctctgagggggagcctggggacgggtttgggtccccaggaggagagccttgggtataatctatttttctaggagcctcttgccttgtcacttgcagctttcgccctctgctttgatggctgaggtgaactcatgttctttgggaaaagggaaggcgtgctgtggaaataaaatgtttatttgcttctcaaacaaagaaaaacaaaaaacaaacaaaacacacccaaccggaacccaaacaacaacaaacaacaaccctacaacacacaaccaaagacgcgggagatggcgctggctacaactcttgccccatccgaggccacagcagcacaacccgcacccacgcgtctagagttccgacagaccggactgggccactagccgggtggccgccgccaccccccgcgccgcgccagcgctaagcaacatgccaacacacgccagagacaaacacccagcgcgcccgcccctcgcagagccccaccaccccgagagca

SEQ ID NO: 418493 - DNA, 3635 bp, Homo sapiens
  misc_feature (70)..(70): n is a, c, g, or t
  misc_feature (455)..(455): n is a, c, g, or t
atcggctgtggggagtaccggctgcagtcggctgtgccgggagggtaggatggcgtctggccgatgcggngatagcaccgaaagcagacggccgccaggcgctccccctaccccccgaagtttctccccagcggcgggggatgggggtaggcggttcctctgttctttctgcgttccccgcggcctcttaccacagagacgcgggcctccaccgtcctagccctcccgccctgttctctagtgcggactagagcgtctcctcgccatttcctgtcgccctggggccccgcggggaaaaagggggagtagcaggacagcggagggaagtcgcgagcttaggtggtgtgtagacgccggaagtgttgggaaggaggccggaagctaggggcggggccaggaagtgaggaggggcgggggtttatgaggagtccaagggagcattggggcagacttgnactcagagccacctgagggacttggcggtggcgcccagcactgtcccctcccctcgtagagacacggttgtcgtttgggagtagggaacactgtgttggggtgggttgtcggcaggacatctctctggctgctcttggggcgaggtgtggaggggcagggctgggggtggagccgggtcgccagggcgtcggtagggaagacccccgcccctcgcccccccaccgaacctctacactggctggctggacactaagatggctgccgttgccatgacacccaaccctgtgcagacccttcaggaggaggcggtgtgcgccatctgcctcgattacttcacggaccccgtgtccatcggctgcgggcacaacttctgccgagtttgtgtaacccagttgtggggtggggaggatgaggaggacagagatgagttagatcgggaggaggaggaggaggacggagaggaggaggaagtggaggctgtgggggctggcgcggggtgggacacccccatgcgggatgaagactacgagggtgacatggaggaggaggtcgaggaggaagaagagggtgtgttctggaccagtggcatgagcaggtccagctgggacaacatggactatgtgtgggaggaggaggacgaggaggaagacctggactactacttgggggacatggaggaggaggacctgaggggggaggatgaggaggacgaggaggaagtgctggaggaggttgaggaagaggatctagaccccgtcaccccactgcccccgcctccagcccctcggaggtgcttcacatgccctcagtgccgaaagagctttcctcggcggagcttccgccccaacctgcagctggccaatatggtccaggtgattcggcagatgcacccaacccctggtcgagggagccgcgtgaccgatcagggcatctgtcccaaacaccaagaagccctgaagctcttctgcgaggtagacgaagaggccatctgtgtggtgtgccgagaatccaggagccacaaacagcacagcgtggtgccattggaggaggtggtgcaggagtacaaggccaaactgcaggggcacgtggaaccactgaggaagcacctggaggcagtgcagaagatgaaagccaaggaggagaggcgagtgacagaactgaagagccagatgaagtcagagctggcagcggtggcctcggagtttgggcgactgacacggtttctggctgaagagcaggcagggctggaacggcgtctcagagagatgcatgaagcccagctggggcgtgcgggagccgcggctagtcgccttgcagaacaggccgcccagctcagccgcctgctggcagaggcccaggagcggagccagcaggggggtctccggctgctccaggacatcaaggagactttcaataggtgtgaagaggtacagctgcagcccccagaggtctggtcccctgacccgtgccaaccccatagccatgacttcctgacagatgccatcgtgaggaaaatgagccggatgttctgtcaggctgcgagagtggacctgacgctggaccctgacacggctcacccggccctgatgctgtcccctgaccgccggggggtccgcctggcagagcggcggcaggaggttgctgaccatcccaagcgcttctcggccgactgctgcgtactgggggcccagggcttccgctccggccggcactactgggaggtagaggtgggcgggcggcggggctgggcggtgggtgctgcccgtgaatcaacccatcataaggaaaaggtgggccctgggggttcctccgtgggcagcggggatgccagctcctcgcgccatcaccatcgccgccgccggctccacctgccccagcagcccctgctccagcgggaagtgtggtgcgtgggcaccaacggcaaacgctatcaggcccagagctccacagaacagacgctgctgagccccagtgagaaaccaaggcgctttggtgtgtacctggactatgaagctgggcgcctgggcttctacaacgcagagactctagcccacgtgcacaccttctcggctgccttcctgggcgagcgtgtctttcctttcttccgggtgctctccaagggcacccgcatcaagctctgcccttgattatcctgccacccgcaggggcccctctgtcagcacttggggggtgggtggtggagggtggcccgtaagtttgagggctcaaaggctcttcccactgcttgttactgtgttgcttcccactcccccttgaccccaggcccctgcttctccctctaggagcctaaagaaccctcctggcctccagctcagccttctctcacctactatgtctgtccaacaggtctgcatgggtccctgataatgagaacagctgcctggtcttctctcccagtctgcctagcccagccctgggactggaatttgagtaggggatgaggggaaattgtaatttcattccttaacttccttttccccacccctgctcttcaacctctttatcagttctgaggctggagggtttgggcaaggcaacatccccattccaattccattttctgatgcagattttagctgagggatttggaagccatttggggaggcaggctgggccaaagggtagagctgggtaataaatgtctattctcctggggaggagggattctaaactttccttccgtcctcaatttctacctccatagaccggccagaatttagcttcacttgagagagatctggaatggtcgccatgattgaaaccacgcaccattacatcatcattacattaattacatcaacataaattatttcttcccccttcccttttccagcactcaaccaaggagcaaagctcatcccaccccacacccctcccaggtctgctcactgccaggctcctctcccctttgttcagtggagctggcttttctcccagcccctttccatgcctttcactccatttggcaagctctgagggggagcctggggacgggtttgggtccccaggaggagagccttgggtataatctatttttctaggagcctcttgccttgtcacttgcagctttcgccctctgctttgatggctgaggtgaactcatgttctttgggaaaagggaaggcgtgctgtggaaataaaatgtttatttgcttctc

SEQ ID NO: 418494 - DNA, 1812 bp, Homo sapiens
ccctctgggaatatcgtggtcccaccccctgcccggtccccttcctccaggtgtgaagaggtacagctgcagcccccagaggtctggtcccctgacccgtgccaaccccatagccatgacttcctgacagatgccatcgtgaggaaaatgagccggatgttctgtcaggctgcgagagtggacctgacgctggaccctgacacggctcacccggccctgatgctgtcccctgaccgccggggggtccgcctggcagagcggcggcaggaggttgctgaccatcccaagcgcttctcggccgactgctgcgtactgggggcccagggcttccgctccggccggcactactgggaggtagaggtgggcgggcggcggggctgggcggtgggtgctgcccgtgaatcaacccatcataaggaaaaggtgggccctgggggttcctccgtgggcagcggggatgccagctcctcgcgccatcaccatcgccgccgccggctccacctgccccagcagcccctgctccagcgggaagtgtggtgcgtgggcaccaacggcaaacgctatcaggcccagagctccacagaacagacgctgctgagccccagtgagaaaccaaggcgctttggtgtgtacctggactatgaagctgggcgcctgggcttctacaacgcagagactctagcccacgtgcacaccttctcggctgccttcctgggcgagcgtgtctttcctttcttccgggtgctctccaagggcacccgcatcaagctctgcccttgattatcctgccacccgcaggggcccctctgtcagcacttggggggtgggtggtggagggtggcccgtaagtttgagggctcaaaggctcttcccactgcttgttactgtgttgcttcccactcccccttgaccccaggcccctgcttctccctctaggagcctaaagaaccctcctggcctccagctcagccttctctcacctactatgtctgtccaacaggtctgcatgggtccctgataatgagaacagctgcctggtcttctctcccagtctgcctagcccagccctgggactggaatttgagtaggggatgaggggaaattgtaatttcattccttaacttccttttccccacccctgctcttcaacctctttatcagttctgaggctggagggtttgggcaaggcaacatccccattccaattccattttctgatgcagattttagctgagggatttggaagccatttggggaggcaggctgggccaaagggtagagctgggtaataaatgtctattctcctggggaggagggattctaaactttccttccgtcctcaatttctacctccatagaccggccagaatttagcttcacttgagagagatctggaatggtcgccatgattgaaaccacgcaccattacatcatcattacattaattacatcaacataaattatttcttcccccttcccttttccagcactcaaccaaggagcaaagctcatcccaccccacacccctcccaggtctgctcactgccaggctcctctcccctttgttcagtggagctggcttttctcccagcccctttccatgcctttcactccatttggcaagctctgagggggagcctggggacgggtttgggtccccaggaggagagccttgggtataatctatttttctaggagcctcttgccttgtcacttgcagctttcgccctctgctttgatggctgaggtgaactcatgttctttgggaaaagggaaggcgtgctgtggaaataaaatgtttatttgcttctc

SEQ ID NO: 418495 - DNA, 2661 bp, Homo sapiens
  misc_feature (70)..(70): n is a, c, g, or t
  misc_feature (455)..(455): n is a, c, g, or t
atcggctgtggggagtaccggctgcagtcggctgtgccgggagggtaggatggcgtctggccgatgcggngatagcaccgaaagcagacggccgccaggcgctccccctaccccccgaagtttctccccagcggcgggggatgggggtaggcggttcctctgttctttctgcgttccccgcggcctcttaccacagagacgcgggcctccaccgtcctagccctcccgccctgttctctagtgcggactagagcgtctcctcgccatttcctgtcgccctggggccccgcggggaaaaagggggagtagcaggacagcggagggaagtcgcgagcttaggtggtgtgtagacgccggaagtgttgggaaggaggccggaagctaggggcggggccaggaagtgaggaggggcgggggtttatgaggagtccaagggagcattggggcagacttgnactcagagccacctgagggacttggcggtggcgcccagcactgtcccctcccctcgtagagacacggttgtcgtttgggagtagggaacactgtgttggggtgggttgtcggcaggacatctctctggctgctcttggggcgaggtgtggaggggcagggctgggggtggagccgggtcgccagggcgtcggtagggaagacccccgcccctcgcccccccaccgaacctctacactggctggctggacactaagatggctgccgttgccatgacacccaaccctgtgcagacccttcaggaggaggcggtgtgcgccatctgcctcgattacttcacggaccccgtgtccatcggctgcgggcacaacttctgccgagtttgtgtaacccagttgtggggtggggaggatgaggaggacagagatgagttagatcgggaggaggaggaggaggacggagaggaggaggaagtggaggctgtgggggctggcgcggggtgggacacccccatgcgggatgaagactacgagggtgacatggaggaggaggtcgaggaggaagaagagggtgtgttctggaccagtggcatgagcaggtccagctgggacaacatggactatgtgtgggaggaggaggacgaggaggaagacctggactactacttgggggacatggaggaggaggacctgaggggggaggatgaggaggacgaggaggaagtgctggaggaggttgaggaagaggatctagaccccgtcaccccactgcccccgcctccagcccctcggaggtgcttcacatgccctcagtgccgaaagagctttcctcggcggagcttccgccccaacctgcagctggccaatatggtccaggtgattcggcagatgcacccaacccctggtcgagggagccgcgtgaccgatcagggcatctgtcccaaacaccaagaagccctgaagctcttctgcgaggtagacgaagaggccatctgtgtggtgtgccgagaatccaggagccacaaacagcacagcgtggtgccattggaggaggtggtgcaggagtacaaggccaaactgcaggggcacgtggaaccactgaggaagcacctggaggcagtgcagaagatgaaagccaaggaggagaggcgagtgacagaactgaagagccagatgaagtcagagctggcagcggtggcctcggagtttgggcgactgacacggtttctggctgaagagcaggcagggctggaacggcgtctcagagagatgcatgaagcccagctggggcgtgcgggagccgcggctagtcgccttgcagaacaggccgcccagctcagccgcctgctggcagaggcccaggagcggagccagcaggggggtctccggctgctccaggtgtgaagaggtacagctgcagcccccagaggtctggtcccctgacccgtgccaaccccatagccatgacttcctgacagatgccatcgtgaggaaaatgagccggatgttctgtcaggctgcgagagtggacctgacgctggaccctgacacggctcacccggccctgatgctgtcccctgaccgccggggggtccgcctggcagagcggcggcaggaggttgctgaccatcccaagcgcttctcggccgactgctgcgtactgggggcccagggcttccgctccggccggcactactgggagaccctcctggcctccagctcagccttctctcacctactatgtctgtccaacagaccggccagaatttagcttcacttgagagagatctggaatggtcgccatgattgaaaccacgcaccattacatcatcattacattaattacatcaacataaattatttcttcccccttcccttttccagcactcaaccaaggagcaaagctcatcccaccccacacccctcccaggtctgctcactgccaggctcctctcccctttgttcagtggagctggcttttctcccagcccctttccatgcctttcactccatttggcaagctctgagggggagcctggggacgggtttgggtccccaggaggagagccttgggtataatctatttttctaggagcctcttgccttgtcacttgcagctttcgccctctgctttgatggctgaggtgaactcatgttctttgggaaaagggaaggcgtgctgtggaaataaaatgtttatttgcttctc

SEQ ID NO: 418496 - DNA, 3531 bp, Homo sapiens
  misc_feature (70)..(70): n is a, c, g, or t
  misc_feature (455)..(455): n is a, c, g, or t
atcggctgtggggagtaccggctgcagtcggctgtgccgggagggtaggatggcgtctggccgatgcggngatagcaccgaaagcagacggccgccaggcgctccccctaccccccgaagtttctccccagcggcgggggatgggggtaggcggttcctctgttctttctgcgttccccgcggcctcttaccacagagacgcgggcctccaccgtcctagccctcccgccctgttctctagtgcggactagagcgtctcctcgccatttcctgtcgccctggggccccgcggggaaaaagggggagtagcaggacagcggagggaagtcgcgagcttaggtggtgtgtagacgccggaagtgttgggaaggaggccggaagctaggggcggggccaggaagtgaggaggggcgggggtttatgaggagtccaagggagcattggggcagacttgnactcagagccacctgagggacttggcggtggcgcccagcactgtcccctcccctcgtagagacacggttgtcgtttgggagtagggaacactgtgttggggtgggttgtcggcaggacatctctctggctgctcttggggcgaggtgtggaggggcagggctgggggtggagccgggtcgccagggcgtcggtagggaagacccccgcccctcgcccccccaccgaacctctacactggctggctggacactaagatggctgccgttgccatgacacccaaccctgtgcagacccttcaggaggaggcggtgtgcgccatctgcctcgattacttcacggaccccgtgtccatcggctgcgggcacaacttctgccgagtttgtgtaacccagttgtggggtggggaggatgaggaggacagagatgagttagatcgggaggaggaggaggaggacggagaggaggaggaagtggaggctgtgggggctggcgcggggtgggacacccccatgcgggatgaagactacgagggtgacatggaggaggaggtcgaggaggaagaagagggtgtgttctggaccagtggcatgagcaggtccagctgggacaacatggactatgtgtgggaggaggaggacgaggaggaagacctggactactacttgggggacatggaggaggaggacctgaggggggaggatgaggaggacgaggaggaagtgctggaggaggttgaggaagaggatctagaccccgtcaccccactgcccccgcctccagcccctcggaggtgcttcacatgccctcagtgccgaaagagctttcctcggcggagcttccgccccaacctgcagctggccaatatggtccaggtgattcggcagatgcacccaacccctggtcgagggagccgcgtgaccgatcagggcatctgtcccaaacaccaagaagccctgaagctcttctgcgaggtagacgaagaggccatctgtgtggtgtgccgagaatccaggagccacaaacagcacagcgtggtgccattggaggaggtggtgcaggagtacaaggccaaactgcaggggcacgtggaaccactgaggaagcacctggaggcagtgcagaagatgaaagccaaggaggagaggcgagtgacagaactgaagagccagatgaagtcagagctggcagcggtggcctcggagtttgggcgactgacacggtttctggctgaagagcaggcagggctggaacggcgtctcagagagatgcatgaagcccagctggggcgtgcgggagccgcggctagtcgccttgcagaacaggccgcccagctcagccgcctgctggcagaggcccaggagcggagccagcaggggggtctccggctgctccaggacatcaaggagactttcaataggtgtgaagaggtacagctgcagcccccagaggtctggtcccctgacccgtgccaaccccatagccatgacttcctgacagatgccatcgtgaggaaaatgagccggatgttctgtcaggctgcgagagtggacctgacgctggaccctgacacggctcacccggccctgatgctgtcccctgaccgccggggggtccgcctggcagagcggcggcaggaggttgctgaccatcccaagcgcttctcggccgactgctgcgtactgggggcccagggcttccgctccggccggcactactgggaggtagaggtgggcgggcggcggggctgggcggtgggtgctgcccgtgaatcaacccatcataaggaaaaggtgggccctgggggttcctccgtgggcagcggggatgccagctcctcgcgccatcaccatcgccgccgccggctccacctgccccagcagcccctgctccagcgggaagtgtggtgcgtgggcaccaacggcaaacgctatcaggcccagagctccacagaacagacgctgctgagccccagtgagaaaccaaggcgctttggtgtgtacctggactatgaagctgggcgcctgggcttctacaacgcagagactctagcccacgtgcacaccttctcggctgccttcctgggcgagcgtgtctttcctttcttccgggtgctctccaagggcacccgcatcaagctctgcccttgattatcctgccacccgcaggggcccctctgtcagcacttggggggtgggtggtggagggtggcccgtaagtttgagggctcaaaggctcttcccactgcttgttactgtgttgcttcccactcccccttgaccccaggcccctgcttctccctctaggagcctaaagaaccctcctggcctccagctcagccttctctcacctactatgtctgtccaacaggtctgcatgggtccctgataatgagaacagctgcctggtcttctctcccagtctgcctagcccagccctgggactggaatttgagtaggggatgaggggaaattgtaatttcattccttaacttccttttccccacccctgctcttcaacctctttatcagttctgaggctggagggtttgggcaaggcaacatccccattccaattccattttctgatgcagattttagctgagggatttggaagccatttggggaggcaggctgggccaaagggtagagctgggtaataaatgtctattctcctggggaggagggattctaaactttccttccgtcctcaatttctacctccatagaccggccagaatttagcttcacttgagagagatctggaatggtcgccatgattgaaaccacgcaccattacatcatcattacattaattacatcaacataaattatttcttcccccttcttttcagccctttcatggctttacatcaattggaagctctgagggagctgggacggttggtcccagaggagagctgggtatactatttcagggccctgctgtcttgggttgcccgcttgaggaggacacgtttggagaggagggcgggacaggttgtcacacaaacaaagaaggggcccaaataaagtggggccaaataccagcgtgttaaagggaaagagtcacagcaac

SEQ ID NO: 418497 - DNA, 2074 bp, Homo sapiens
  misc_feature (70)..(70): n is a, c, g, or t
  misc_feature (455)..(455): n is a, c, g, or t
atcggctgtggggagtaccggctgcagtcggctgtgccgggagggtaggatggcgtctggccgatgcggngatagcaccgaaagcagacggccgccaggcgctccccctaccccccgaagtttctccccagcggcgggggatgggggtaggcggttcctctgttctttctgcgttccccgcggcctcttaccacagagacgcgggcctccaccgtcctagccctcccgccctgttctctagtgcggactagagcgtctcctcgccatttcctgtcgccctggggccccgcggggaaaaagggggagtagcaggacagcggagggaagtcgcgagcttaggtggtgtgtagacgccggaagtgttgggaaggaggccggaagctaggggcggggccaggaagtgaggaggggcgggggtttatgaggagtccaagggagcattggggcagacttgnactcagagccacctgagggacttggcggtggcgcccagcactgtcccctcccctcgtagagacacggttgtcgtttgggagtagggaacactgtgttggggtgggttgtcggcaggacatctctctggctgctcttggggcgaggtgtggaggggcagggctgggggtggagccgggtcgccagggcgtcggtagggaagacccccgcccctcgcccccccaccgaacctctacactggctggctggacactaagatggctgccgttgccatgacacccaaccctgtgcagacccttcaggaggaggcggtgtgcgccatctgcctcgattacttcacggaccccgtgtccatcggctgcgggcacaacttctgccgagtttgtgtaacccagttgtggggtggggaggatgaggaggacagagatgagttagatcgggaggaggaggaggaggacggagaggaggaggaagtggaggctgtgggggctggcgcggggtgggacacccccatgcgggatgaagactacgagggtgacatggaggaggaggtcgaggaggaagaagagggtgtgttctggaccagtggcatgagcaggtccagctgggacaacatggactatgtgtgggaggaggaggacgaggaggaagacctggactactacttgggggacatggaggaggaggacctgaggggggaggatgaggaggacgaggaggaagtgctggaggaggttgaggaagaggatctagaccccgtcaccccactgcccccgcctccagcccctcggaggtgcttcacatgccctcagtgccgaaagagctttcctcggcggagcttccgccccaacctgcagctggccaatatggtccaggtgattcggcagatgcacccaacccctggtcgagggagccgcgtgaccgatcagggcatctgtcccaaacaccaagaagccctgaagctcttctgcgaggtagacgaagaggccatctgtgtggtgtgccgagaatccaggagccacaaacagcacagcgtggtgccattggaggaggtggtgcaggagtacaaggccaaactgcaggggcacgtggaaccactgaggaagcacctggaggcagtgcagaagatgaaagccaaggaggagaggcgagtgacagaactgaagagccagatgaagtcagagctggcagcggtggcctcggagtttgggcgactgacacggtttctggctgaagagcaggcagggctggaacggcgtctcagagagatgcatgaagcccagctggggcgtgcgggagccgcggctagtcgccttgcagaacaggccgcccagctcagccgcctgctggcagaggcccaggagcggagccagcaggggggtctccggctgctccaggacatcaaggagactttcaataggtgtgaagaggtacagctgcagcccccagaggtctggtcccctgacccgtgccaaccccatagccatgacttcctgacagatgccatcgtgaggaaaatgagccggatgttctgtcaggctgcgagagtggctgaggtgaactcatgttctttgggaaaagggaaggcgtgctgtggaaataaaatgtttatttgcttctc

SEQ ID NO: 418498 - DNA, 2684 bp, Homo sapiens
  misc_feature (70)..(70): n is a, c, g, or t
  misc_feature (455)..(455): n is a, c, g, or t
atcggctgtggggagtaccggctgcagtcggctgtgccgggagggtaggatggcgtctggccgatgcggngatagcaccgaaagcagacggccgccaggcgctccccctaccccccgaagtttctccccagcggcgggggatgggggtaggcggttcctctgttctttctgcgttccccgcggcctcttaccacagagacgcgggcctccaccgtcctagccctcccgccctgttctctagtgcggactagagcgtctcctcgccatttcctgtcgccctggggccccgcggggaaaaagggggagtagcaggacagcggagggaagtcgcgagcttaggtggtgtgtagacgccggaagtgttgggaaggaggccggaagctaggggcggggccaggaagtgaggaggggcgggggtttatgaggagtccaagggagcattggggcagacttgnactcagagccacctgagggacttggcggtggcgcccagcactgtcccctcccctcgtagagacacggttgtcgtttgggagtagggaacactgtgttggggtgggttgtcggcaggacatctctctggctgctcttggggcgaggtgtggaggggcagggctgggggtggagccgggtcgccagggcgtcggtagggaagacccccgcccctcgcccccccaccgaacctctacactggctggctggacactaagatggctgccgttgccatgacacccaaccctgtgcagacccttcaggaggaggcggtgtgcgccatctgcctcgattacttcacggaccccgtgtccatcggctgcgggcacaacttctgccgagtttgtgtaacccagttgtggggtggggaggatgaggaggacagagatgagttagatcgggaggaggaggaggaggacggagaggaggaggaagtggaggctgtgggggctggcgcggggtgggacacccccatgcgggatgaagactacgagggtgacatggaggaggaggtcgaggaggaagaagagggtgtgttctggaccagtggcatgagcaggtccagctgggacaacatggactatgtgtgggaggaggaggacgaggaggaagacctggactactacttgggggacatggaggaggaggacctgaggggggaggatgaggaggacgaggaggaagtgctggaggaggttgaggaagaggatctagaccccgtcaccccactgcccccgcctccagcccctcggaggtgcttcacatgccctcagtgccgaaagagctttcctcggcggagcttccgccccaacctgcagctggccaatatggtccaggtgattcggcagatgcacccaacccctggtcgagggagccgcgtgaccgatcagggcatctgtcccaaacaccaagaagccctgaagctcttctgcgaggtagacgaagaggccatctgtgtggtgtgccgagaatccaggagccacaaacagcacagcgtggtgccattggaggaggtggtgcaggagtacaaggccaaactgcaggggcacgtggaaccactgaggaagcacctggaggcagtgcagaagatgaaagccaaggaggagaggcgagtgacagaactgaagagccagatgaagtcagagctggcagcggtggcctcggagtttgggcgactgacacggtttctggctgaagagcaggcagggctggaacggcgtctcagagagatgcatgaagcccagctggggcgtgcgggagccgcggctagtcgccttgcagaacaggccgcccagctcagccgcctgctggcagaggcccaggagcggagccagcaggggggtctccggctgctccaggacatcaaggagactttcaataggtgtgaagaggtacagctgcagcccccagaggtctggtcccctgacccgtgccaaccccatagccatgacttcctgacagatgccatcgtgaggaaaatgagccggatgttctgtcaggctgcgagagtggacctgacgctggaccctgacacggctcacccggccctgatgctgtcccctgaccgccggggggtccgcctggcagagcggcggcaggaggttgctgaccatcccaagcgcttctcggccgactgctgcgtactgggggcccagggcttccgctccggccggcactactgggagaccctcctggcctccagctcagccttctctcacctactatgtctgtccaacagaccggccagaatttagcttcacttgagagagatctggaatggtcgccatgattgaaaccacgcaccattacatcatcattacattaattacatcaacataaattatttcttcccccttcccttttccagcactcaaccaaggagcaaagctcatcccaccccacacccctcccaggtctgctcactgccaggctcctctcccctttgttcagtggagctggcttttctcccagcccctttccatgcctttcactccatttggcaagctctgagggggagcctggggacgggtttgggtccccaggaggagagccttgggtataatctatttttctaggagcctcttgccttgtcacttgcagctttcgccctctgctttgatggctgaggtgaactcatgttctttgggaaaagggaaggcgtgctgtggaaataaaatgtttatttgcttctc

SEQ ID NO: 418499 - DNA, 3421 bp, Homo sapiens
  misc_feature (70)..(70): n is a, c, g, or t
  misc_feature (455)..(455): n is a, c, g, or t
atcggctgtggggagtaccggctgcagtcggctgtgccgggagggtaggatggcgtctggccgatgcggngatagcaccgaaagcagacggccgccaggcgctccccctaccccccgaagtttctccccagcggcgggggatgggggtaggcggttcctctgttctttctgcgttccccgcggcctcttaccacagagacgcgggcctccaccgtcctagccctcccgccctgttctctagtgcggactagagcgtctcctcgccatttcctgtcgccctggggccccgcggggaaaaagggggagtagcaggacagcggagggaagtcgcgagcttaggtggtgtgtagacgccggaagtgttgggaaggaggccggaagctaggggcggggccaggaagtgaggaggggcgggggtttatgaggagtccaagggagcattggggcagacttgnactcagagccacctgagggacttggcggtggcgcccagcactgtcccctcccctcgtagagacacggttgtcgtttgggagtagggaacactgtgttggggtgggttgtcggcaggacatctctctggctgctcttggggcgaggtgtggaggggcagggctgggggtggagccgggtcgccagggcgtcggtagggaagacccccgcccctcgcccccccaccgaacctctacactggctggctggacactaagatggctgccgttgccatgacacccaaccctgtgcagacccttcaggaggaggcggtgtgcgccatctgcctcgattacttcacggaccccgtgtccatcggctgcgggcacaacttctgccgagtttgtgtaacccagttgtggggtggggaggatgaggaggacagagatgagttagatcgggaggaggaggaggaggacggagaggaggaggaagtggaggctgtgggggctggcgcggggtgggacacccccatgcgggatgaagactacgagggtgacatggaggaggaggtcgaggaggaagaagagggtgtgttctggaccagtggcatgagcaggtccagctgggacaacatggactatgtgtgggaggaggaggacgaggaggaagacctggactactacttgggggacatggaggaggaggacctgaggggggaggatgaggaggacgaggaggaagtgctggaggaggttgaggaagaggatctagaccccgtcaccccactgcccccgcctccagcccctcggaggtgcttcacatgccctcagtgccgaaagagctttcctcggcggagcttccgccccaacctgcagctggccaatatggtccaggtgattcggcagatgcacccaacccctggtcgagggagccgcgtgaccgatcagggcatctgtcccaaacaccaagaagccctgaagctcttctgcgaggtagacgaagaggccatctgtgtggtgtgccgagaatccaggagccacaaacagcacagcgtggtgccattggaggaggtggtgcaggagtacaaggccaaactgcaggggcacgtggaaccactgaggaagcacctggaggcagtgcagaagatgaaagccaaggaggagaggcgagtgacagaactgaagagccagatgaagtcagagctggcagcggtggcctcggagtttgggcgactgacacggtttctggctgaagagcaggcagggctggaacggcgtctcagagagatgcatgaagcccagctggggcgtgcgggagccgcggctagtcgccttgcagaacaggccgcccagctcagccgcctgctggcagaggcccaggagcggagccagcaggggggtctccggctgctccaggacatcaaggagactttcaataggtgtgaagaggtacagctgcagcccccagaggtctggtcccctgacccgtgccaaccccatagccatgacttcctgacagatgccatcgtgaggaaaatgagccggatgttctgtcaggctgcgagagtggacctgacgctggaccctgacacggctcacccggccctgatgctgtcccctgaccgccggggggtccgcctggcagagcggcggcaggaggttgctgaccatcccaagcgcttctcggccgactgctgcgtactgggggcccagggcttccgctccggccggcactactgggaggtagaggtgggcgggcggcggggctgggcggtgggtgctgcccgtgaatcaacccatcataaggaaaaggtgggccctgggggttcctccgtgggcagcggggatgccagctcctcgcgccatcaccatcgccgccgccggctccacctgccccagcagcccctgctccagcgggaagtgtggtgcgtgggcaccaacggcaaacgctatcaggcccagagctccacagaacagacgctgctgagccccagtgagaaaccaaggcgctttggtgtgtacctggactatgaagctgggcgcctgggcttctacaacgcagagactctagcccacgtgcacaccttctcggctgccttcctgggcgagcgtgtctttcctttcttccgggtgctctccaagggcacccgcatcaagctctgcccttgattatcctgccacccgcaggggcccctctgtcagcacttggggggtgggtggtggagggtggcccgtaagtttgagggctcaaaggctcttcccactgcttgttactgtgttgcttcccactcccccttgaccccaggcccctgcttctccctctaggagcctaaagaaccctcctggcctccagctcagccttctctcacctactatgtctgtccaacaggtctgcatgggtccctgataatgagaacagctgcctggtcttctctcccagtctgcctagcccagccctgggactggaatttgagtaggggatgaggggaaattgtaatttcattccttccgtcctcaatttctacctccatagaccggccagaatttagcttcacttgagagagatctggaatggtcgccatgattgaaaccacgcaccattacatcatcattacattaattacatcaacataaattatttcttcccccttcccttttccagcactcaaccaaggagcaaagctcatcccaccccacacccctcccaggtctgctcactgccaggctcctctcccctttgttcagtggagctggcttttctcccagcccctttccatgcctttcactccatttggcaagctctgagggggagcctggggacgggtttgggtccccaggaggagagccttgggtataatctatttttctaggagcctcttgccttgtcacttgcagctttcgccctctgctttgatggctgaggtgaactcatgttctttgggaaaagggaaggcgtgctgtggaaataaaatgtttatttgcttctc

SEQ ID NO: 418500 - DNA, 2715 bp, Homo sapiens
  misc_feature (70)..(70): n is a, c, g, or t
  misc_feature (455)..(455): n is a, c, g, or t
atcggctgtggggagtaccggctgcagtcggctgtgccgggagggtaggatggcgtctggccgatgcggngatagcaccgaaagcagacggccgccaggcgctccccctaccccccgaagtttctccccagcggcgggggatgggggtaggcggttcctctgttctttctgcgttccccgcggcctcttaccacagagacgcgggcctccaccgtcctagccctcccgccctgttctctagtgcggactagagcgtctcctcgccatttcctgtcgccctggggccccgcggggaaaaagggggagtagcaggacagcggagggaagtcgcgagcttaggtggtgtgtagacgccggaagtgttgggaaggaggccggaagctaggggcggggccaggaagtgaggaggggcgggggtttatgaggagtccaagggagcattggggcagacttgnactcagagccacctgagggacttggcggtggcgcccagcactgtcccctcccctcgtagagacacggttgtcgtttgggagtagggaacactgtgttggggtgggttgtcggcaggacatctctctggctgctcttggggcgaggtgtggaggggcagggctgggggtggagccgggtcgccagggcgtcggtagggaagacccccgcccctcgcccccccaccgaacctctacactggctggctggacactaagatggctgccgttgccatgacacccaaccctgtgcagacccttcaggaggaggcggtgtgcgccatctgcctcgattacttcacggaccccgtgtccatcggctgcgggcacaacttctgccgagtttgtgtaacccagttgtggggtggggaggatgaggaggacagagatgagttagatcgggaggaggaggaggaggacggagaggaggaggaagtggaggctgtgggggctggcgcggggtgggacacccccatgcgggatgaagactacgagggtgacatggaggaggaggtcgaggaggaagaagagggtgtgttctggaccagtggcatgagcaggtccagctgggacaacatggactatgtgtgggaggaggaggacgaggaggaagacctggactactacttgggggacatggaggaggaggacctgaggggggaggatgaggaggacgaggaggaagtgctggaggaggttgaggaagaggatctagaccccgtcaccccactgcccccgcctccagcccctcggaggtgcttcacatgccctcagtgccgaaagagctttcctcggcggagcttccgccccaacctgcagctggccaatatggtccaggtgattcggcagatgcacccaacccctggtcgagggagccgcgtgaccgatcagggcatctgtcccaaacaccaagaagccctgaagctcttctgcgaggtagacgaagaggccatctgtgtggtgtgccgagaatccaggagccacaaacagcacagcgtggtgccattggaggaggtggtgcaggagtacaaggccaaactgcaggggcacgtggaaccactgaggaagcacctggaggcagtgcagaagatgaaagccaaggaggagaggcgagtgacagaactgaagagccagatgaagtcagagctggcagcggtggcctcggagtttgggcgactgacacggtttctggctgaagagcaggcagggctggaacggcgtctcagagagatgcatgaagcccagctggggcgtgcgggagccgcggctagtcgccttgcagaacaggccgcccagctcagccgcctgctggcagaggcccaggagcggagccagcaggggggtctccggctgctccaggacatcaaggagactttcaataggtgtgaagaggtacagctgcagcccccagaggtctggtcccctgacccgtgccaaccccatagccatgacttcctgacagatgccatcgtgaggaaaatgagccggatgttctgtcaggctgcgagagtggacctgacgctggaccctgacacggctcacccggccctgatgctgtcccctgaccgccggggggtccgcctggcagagcggcggcaggaggttgctgaccatcccaagcgcttctcggccgactgctgcgtactgggggcccagggcttccgctccggccggcactactgggaggtctgcatgggtccctgataatgagaacagctgcctggtcttctctcccagtctgcctagcccagccctgggactggaatttgaaccggccagaatttagcttcacttgagagagatctggaatggtcgccatgattgaaaccacgcaccattacatcatcattacattaattacatcaacataaattatttcttcccccttcccttttccagcactcaaccaaggagcaaagctcatcccaccccacacccctcccaggtctgctcactgccaggctcctctcccctttgttcagtggagctggcttttctcccagcccctttccatgcctttcactccatttggcaagctctgagggggagcctggggacgggtttgggtccccaggaggagagccttgggtataatctatttttctaggagcctcttgccttgtcacttgcagctttcgccctctgctttgatggctgaggtgaactcatgttctttgggaaaagggaaggcgtgctgtggaaataaaatgtttatttgcttctc

SEQ ID NO: 418501 - DNA, 404 bp, Homo sapiens
aaacacctctgtttaatcctgaagttgcaaaataccttaaggtccctcaagacccattgaaattttataagaagatttacttttgccacagttgccagctttatttgccttctacagaattttctgtatcatccacctcacgccgcatataccggtgtcgtaactgcattaaccttcagaatgaggctcaaaaacgagaatcatttttgaagtacaaatgtttacttcaacagctctactatacagaagctgattatgaagatgattctaaaattgctttcttgatgcagctacaagacattcagtacctgacagagaacatctgggcgtcccagtcagtcctcagtgcttgcgacaatctcagtgatctggtcatggtcagatggaataaatccctggagtgg

SEQ ID NO: 418502 - DNA, 925 bp, Homo sapiens
ggatttcgggatggaaagggggagaggctgcccttctaggaaccccccagtacaagcctcctttcccagattggtgtaactaggcccagatatggacgaagagcaggctcggggtccgctagaaatgaggagcacccaggagcagcttatgtgctggcagggggcttctaagctggttaacactgtgtgagggctccccggacctgcccgtcagcttctctccgaccctgctgtcactctcactcgtcaggacgggagtcacccagctgaaggccggcagcttcctgagaattccgtctctgcacctgctcctcttcacctccaactccttctccgtgattgaggacgatgcatttgcgggcctgtcccacctgcagtacctcttcatcgaggacaatgagattggctccatctctaagaatgccctcagaggacttcgctcgcttacacacctaagcctggccaataaccatctggagaccctccccagattcctgttccgaggcctggacacccttactcacgtggacctccgcgggaacccgttccagtgtgactgccgcgtcctctggctcctgcagtggatgcccaccgtgaatgccagcgtggggaccggcgcctgtgcgggccccgcctccctgagccacatgcagctccaccacctcgaccccaagactttcaagtgcagagccatagagctgtcctggttccagacggtgggggagtcggcactgagcgtagagcccttctcctaccaaggggagcctcacattgtgctggcacagcccttcgccggccgctgcctgattctctcctgggactacagcctgcagcgcttccggcccgaggaagagctgcccgcgggctccgtggtgtcctgcaagccactggtgctgggccccagcctcttcgtgctggctgcccg

SEQ ID NO: 418503 - DNA, 1455 bp, Homo sapiens
gccgggtgtccagcgaacccctttcccaaaccttcggggagaagggaggtgggaggaggcaaagaaactacaggcaggagctgcaaggggggtggggggggcaggagacaagaaatcaagacaccaggcagcaggacacacacacactcacatacactcacacacatagagaccaacagatagacagctacctaaagcctgaaagactgacagcaacacagaaaaaaagaaacaggcagaaagagagacaaagacagaaatagaaacagactaacacacagagtcaaaaatacagagacagaaagacagggagaaagagaaacagaaaattagacaccaaagacatacgaacagggaggaaggccgactgaaagaaagacggagaagaggagagagaagccagggccgagcgtgccagcaggcggatggagggcggcctggtggaggaggagacgtagtggcctgggctgagctgggtgggccgggagaacgcgggtgcctcagagtgggggtgggaggcatgggaggggcaggcattctgctgctgctgctggctggggcgggggtggtggtggcctggagacccccaaagggaaagtgtcccctgcgctgctcctgctctaaagacagcgccctgtgtgagggctccccggacctgcccgtcagcttctctccgaccctgctgtcactctcactcgtcaggacgggagtcacccagctgaaggccggcagcttcctgagaattccgtctctgcacctgctcctcttcacctccaactccttctccgtgattgaggacgatgcatttgcgggcctgtcccacctgcagtacctcttcatcgaggacaatgagattggctccatctctaagaatgccctcagaggacttcgctcgcttacacacctaagcctggccaataaccatctggagaccctccccagattcctgttccgaggcctggacacccttactcacgtggacctccgcgggaacccgttccagtgtgactgccgcgtcctctggctcctgcagtggatgcccaccgtgaatgccagcgtggggaccggcgcctgtgcgggccccgcctccctgagccacatgcagctccaccacctcgaccccaagactttcaagtgcagagccataggtggggggctttcccgatggggtgggaggcgggagatctgggggaaaggctgccagggccaagaggctcgtctcactccctgccctgccatttcccggagtgggaagaccctgagcaagcagcactgccttcctgagccccagttttctcatctgtaaagtgggggtaataaacagtgatataggagtgccatgggaattcaatgatacatcttcacgtgttcggcatttggcgccgggcctgggacaggaggtccttataaacgttcacccttgttaacataaaagcaaccaatttaaaaattctt

SEQ ID NO: 418504 - DNA, 1377 bp, Homo sapiens
gccgggtgtccagcgaacccctttcccaaaccttcggggagaagggaggtgggaggaggcaaagaaactacaggcaggagctgcaaggggggtggggggggcaggagacaagaaatcaagacaccaggcagcaggacacacacacactcacatacactcacacacatagagaccaacagatagacagctacctaaagcctgaaagactgacagcaacacagaaaaaaagaaacaggcagaaagagagacaaagacagaaatagaaacagactaacacacagagtcaaaaatacagagacagaaagacagggagaaagagaaacagaaaattagacaccaaagacatacgaacagggaggaaggccgactgaaagaaagacggagaagaggagagagaagccagggccgagcgtgccagcaggcggatggagggcggcctggtggaggaggagacgtagtggcctgggctgagctgggtgggccgggagaacgcgggtgcctcagagtgggggtgggaggcatgggaggggcaggcattctgctgctgctgctggctggggcgggggtggtggtggcctggagacccccaaagggaaagtgtcccctgcgctgctcctgctctaaagacagcgccctgtgtgagggctccccggacctgcccgtcagcttctctccgaccctgctgtcactctcactcgtcaggacgggagtcacccagctgaaggccggcagcttcctgagaattccgtctctgcacctgctcctcttcacctccaactccttctccgtgattgaggacgatgcatttgcgggcctgtcccacctgcagtacctcttcatcgaggacaatgagattggctccatctctaagaatgccctcagaggacttcgctcgcttacacacctaagcctggccaataaccatctggagaccctccccagattcctgttccgaggcctggacacccttactcacgtggacctccgcgggaacccgttccagtgtgactgccgcgtcctctggctcctgcagtggatgcccaccgtgaatgccagcgtggggaccggcgcctgtgcgggccccgcctccctgagccacatgcagctccaccacctcgaccccaagactttcaagtgcagagccatagagctgtcctggttccagacggtgggggagtcggcactgagcgtagagcccttctcctaccaaggggagcctcacattgtgctggcacagcccttcgccggccgctgcctgattctctcctgggactacagcctgcagcgcttccggcccgaggaagagctgcccgcgggctccgtggtgtcctgcaagccactggtgctgggccccagcctcttcgtgctggctgcccg

SEQ ID NO: 418505 - DNA, 907 bp, Homo sapiens
ggatgcccaggatgaagaggatcccggcgatgacgaggcctccgatctgcagggactggtagtctgtgagcagcagagcagggaagctgtgtgagggctccccggacctgcccgtcagcttctctccgaccctgctgtcactctcactcgtcaggacgggagtcacccagctgaaggccggcagcttcctgagaattccgtctctgcacctgctcctcttcacctccaactccttctccgtgattgaggacgatgcatttgcgggcctgtcccacctgcagtacctcttcatcgaggacaatgagattggctccatctctaagaatgccctcagaggacttcgctcgcttacacacctaagcctggccaataaccatctggagaccctccccagattcctgttccgaggcctggacacccttactcacgtggacctccgcgggaacccgttccagtgtgactgccgcgtcctctggctcctgcagtggatgcccaccgtgaatgccagcgtggggaccggcgcctgtgcgggccccgcctccctgagccacatgcagctccaccacctcgaccccaagactttcaagtgcagagccataggtggggggctttcccgatggggtgggaggcgggagatctgggggaaaggctgccagggccaagaggctcgtctcactccctgccctgccatttcccggagtgggaagaccctgagcaagcagcactgccttcctgagccccagttttctcatctgtaaagtgggggtaataaacagtgatataggagtgccatgggaattcaatgatacatcttcacgtgttcggcatttggcgccgggcctgggacaggaggtccttataaacgttcacccttgttaacataaaagcaaccaatttaaaaattctt

SEQ ID NO: 418506 - DNA, 675 bp, Homo sapiens
acagaagtcagagacaagaaacgtttcaaatgaccaggaaacaactctgaattacttcatcgaggacaatgagattggctccatctctaagaatgccctcagaggacttcgctcgcttacacacctaagcctggccaataaccatctggagaccctccccagattcctgttccgaggcctggacacccttactcacgtggacctccgcgggaacccgttccagtgtgactgccgcgtcctctggctcctgcagtggatgcccaccgtgaatgccagcgtggggaccggcgcctgtgcgggccccgcctccctgagccacatgcagctccaccacctcgaccccaagactttcaagtgcagagccataggtggggggctttcccgatggggtgggaggcgggagatctgggggaaaggctgccagggccaagaggctcgtctcactccctgccctgccatttcccggagtgggaagaccctgagcaagcagcactgccttcctgagccccagttttctcatctgtaaagtgggggtaataaacagtgatataggagtgccatgggaattcaatgatacatcttcacgtgttcggcatttggcgccgggcctgggacaggaggtccttataaacgttcacccttgttaacataaaagcaaccaatttaaaaattctt

SEQ ID NO: 418507 - DNA, 3522 bp, Homo sapiens
cgcccgggcaggtcagcctgtctcaaggcacgccagtctcagctccgaccttgcagcggcgcagcgcgggtgggaggcggggaggagcagcgggaagagcggagcgaggaccgcggtccggcgcagtcttcaatgagcagcgcggaaactgcaccccagacccgagcctgctgcgcgccccctcccagagctcacctggtgccaggtaacaggcctggcctcgccctgtggatgatgatggccttgcccccgtgagctacaacctggccttcagcacccgcccacctccaaccagcaggatgcggctgtggaaggcggtggtggtgactttggccttcatgagtgtggacatctgcgtgaccacggccatctatgtcttcagccacctggaccgcagcctcctggaggacatccgccacttcaacatctttgactcggtgctggatctctgggcagcctgcctgtaccgcagctgcctgctgctgggagccaccattggtgtggccaagaacagtgcgctggggccccggcggctgcgggcctcgtggctggtcatcaccctcgtgtgcctcttcgtgggcatctatgccatggtgaagctgctgctcttctcagaggtgcgcaggcccatccgggacccctggttttgggccctgttcgtgtggacgtacatttcactcggcgcatccttcctgctctggtggctgctgtccaccgtgcggccaggcacccaggccctggagccaggggcggccaccgaggctgagggcttccctgggagcggccggccaccgcccgagcaggcgtctggggccacgctgcagaagctgctctcctacaccaagcccgacgtggccttcctcgtggccgcctccttcttcctcatcgtggcagctctgggagagaccttcctgccctactacacgggccgcgccattgatggcatcgtcatccagaaaagcatggatcagttcagcacggctgtcgtcatcgtgtgcctgctggccattggcagctcatttgccgcaggtattcggggcggcatttttaccctcatatttgccagactgaacattcgccttcgaaactgtctcttccgctcactggtgtcccaggagacaagcttctttgatgagaaccgcacaggggacctcatctcccgcctgacctcggacaccaccatggtcagcgacctggtctcccagaacatcaatgtcttcctgcggaacacagtcaaggtcacgggcgtggtggtcttcatgttcagcctctcatggcagctctccttggtcaccttcatgggcttccccatcatcatgatggtgtccaacatctacggcaagtactacaagaggctctccaaagaggtccagaatgccctggccagagcgagcaacacggcggaggagaccatcagtgccatgaagactgtccggagcttcgccaatgaggaggaggaggcagaggtgtacctgcggaagctgcagcaggtgtacaagctgaacaggaaggaggcagctgcctacatgtactacgtctggggcagcgggctcacactgctggtggtccaggtcagcatcctctactacgggggccaccttgtcatctcaggccagatgaccagcggcaacctcatcgccttcatcatctacgagtttgtcctgggagattgtatggagtccgtgggctccgtctacagtggcctgatgcagggagtgggggctgctgagaaggtgttcgagttcatcgaccggcagccgaccatggtgcacgatggcagcttggcccccgaccacctggagggccgggtggactttgagaatgtgaccttcacctaccgcactcggccccacacccaggtcctgcagaatgtctccttcagcctgtcccccggcaaggtgacggccctggtggggccctcgggcagtgggaagagctcctgtgtcaacatcctggagaacttctaccccctggaggggggccgggtgctgctggacggcaagcccatcagcgcctacgaccacaagtacttgcaccgtgtgatctccctggtgagccaggagcccgtgctgttcgcccgctccatcacggataacatctcctacggcctgcccactgtgcctttcgagatggtggtggaggccgcacagaaggccaatgcccacggcttcatcatggaactccaggacggctacagcacagagacaggggagaagggcgcccagctgtcaggtggccagaagcagcgggtggccatggcccgggctctggtgcggaaccccccagtcctcatcctggatgaagccaccagcgctttggatgccgagagcgagtatctgatccagcaggccatccatggcaacctgcagaagcacacggtactcatcatcgcgcaccggctgagcaccgtggagcacgcgcacctcattgtggtgctggacaagggccgcgtagtgcagcagggcacccaccagcagctgctggcccagggcggcctctacgccaagctggtgcagcggcagatgctggggcttcagcccgccgcagacttcacagctggccacaacgagcctgtagccaacggcagtcacaaggcctgatggggggcccctgcttctcccggtggggcagaggacccggtgcctgcctggcagatgtgcccacggaggcccccagctgccctccgagcccaggcctgcagcactgaaagacgacctgccatgtcccatggatcaccgcttcctgcatcttgcccctggtccctgccccattcccagggcactccttacccctgctgccctgagccaacgccttcacggacctccctagcctcctaagcaaaggtagagctgcctttttaaacctaggtcttaccagggtttttactgtttggtttgaggcaccccagtcaactcctagatttcaaaaacctttttctaattgggagtaatggcgggcactttcaccaagatgttctagaaacttctgagccaggagtgaatggcccttccttagtagcctgggggatgtccagagactaggcctctcccctttacccctccagagaaggggcttccctgtcccggagggagacacggggaacgggattttccgtctctccctcttgccagctctgtgagtctggccagggcgggtagggagcgtggagggcatctgtctgccatcgcccgctgccaatctaagccagtctcactgtgaaccacacgaaacctcaactgggggagtgaggggctggccaggtctggaggggcctcaggggtgcccccagcccggcacccagcgctttcgcccctcgtccacccacccctggctggcagcctccctccccacacccgcccctgtgctctgctgtctggaggccacgtggatgttcatgagatgcattctcttctgtctttggtggatgggatggtggcaaagcccaggatctggctttgccagaggttgcaacatgttgagagaacccggtcaataaagtgtactacctcttacccctaaact

SEQ ID NO: 418508 - DNA, 3393 bp, Homo sapiens
cgcccgggcaggtcagcctgtctcaaggcacgccagtctcagctccgaccttgcagcggcgcagcgcgggtgggaggcggggaggagcagcgggaagagcggagcgaggaccgcggtccggcgcagtcttcaatgagcagcgcggaaactgcaccccagacccgagcctgctgcgcgccccctcccagagctcacctggtgccaggtaacaggcctggcctcgccctgtggatgatgatggccttgcccccgtgagctacaacctggccttcagcacccgcccacctccaaccagcaggatgcggctgtggaaggcggtggtggtgactttggccttcatgagtgtggacatctgcgtgaccacggccatctatgtcttcagccacctggaccgcagcctcctggaggacatccgccacttcaacatctttgactcggtgctggatctctgggcagcctgcctgtaccgcagctgcctgctgctgggagccaccattggtgtggccaagaacagtgcgctggggccccggcggctgcgggcctcgtggctggtcatcaccctcgtgtgcctcttcgtgggcatctatgccatggtgaagctgctgctcttctcagaggtgcgcaggcccatccgggacccctggttttgggccctgttcgtgtggacgtacatttcactcggcgcatccttcctgctctggtggctgctgtccaccgtgcggccaggcacccaggccctggagccaggggcggccaccgaggctgagggcttccctgggagcggccggccaccgcccgagcaggcgtctggggccacgctgcagaagctgctctcctacaccaagcccgacgtggccttcctcgtggccgcctccttcttcctcatcgtggcagctctgggagagaccttcctgccctactacacgggccgcgccattgatggcatcgtcatccagaaaagcatggatcagttcagcacggctgtcgtcatcgtgtgcctgctggccattggcagctcatttgccgcaggtattcggggcggcatttttaccctcatatttgccagactgaacattcgccttcgaaactgtctcttccgctcactggtgtcccaggagacaagcttctttgatgagaaccgcacaggggacctcatctcccgcctgacctcggacaccaccatggtcagcgacctggtctcccagaacatcaatgtcttcctgcggaacacagtcaaggtcacgggcgtggtggtcttcatgttcagcctctcatggcagctctccttggtcaccttcatgggcttccccatcatcatgatggtgtccaacatctacggcaagtactacaagaggctctccaaagaggtccagaatgccctggccagagcgagcaacacggcggaggagaccatcagtgccatgaagactgtccggagcttcgccaatgaggaggaggaggcagaggtgtacctgcggaagctgcagcaggtgtacaagctgaacaggaaggaggcagctgcctacatgtactacgtctggggcagcgggtccgtgggctccgtctacagtggcctgatgcagggagtgggggctgctgagaaggtgttcgagttcatcgaccggcagccgaccatggtgcacgatggcagcttggcccccgaccacctggagggccgggtggactttgagaatgtgaccttcacctaccgcactcggccccacacccaggtcctgcagaatgtctccttcagcctgtcccccggcaaggtgacggccctggtggggccctcgggcagtgggaagagctcctgtgtcaacatcctggagaacttctaccccctggaggggggccgggtgctgctggacggcaagcccatcagcgcctacgaccacaagtacttgcaccgtgtgatctccctggtgagccaggagcccgtgctgttcgcccgctccatcacggataacatctcctacggcctgcccactgtgcctttcgagatggtggtggaggccgcacagaaggccaatgcccacggcttcatcatggaactccaggacggctacagcacagagacaggggagaagggcgcccagctgtcaggtggccagaagcagcgggtggccatggcccgggctctggtgcggaaccccccagtcctcatcctggatgaagccaccagcgctttggatgccgagagcgagtatctgatccagcaggccatccatggcaacctgcagaagcacacggtactcatcatcgcgcaccggctgagcaccgtggagcacgcgcacctcattgtggtgctggacaagggccgcgtagtgcagcagggcacccaccagcagctgctggcccagggcggcctctacgccaagctggtgcagcggcagatgctggggcttcagcccgccgcagacttcacagctggccacaacgagcctgtagccaacggcagtcacaaggcctgatggggggcccctgcttctcccggtggggcagaggacccggtgcctgcctggcagatgtgcccacggaggcccccagctgccctccgagcccaggcctgcagcactgaaagacgacctgccatgtcccatggatcaccgcttcctgcatcttgcccctggtccctgccccattcccagggcactccttacccctgctgccctgagccaacgccttcacggacctccctagcctcctaagcaaaggtagagctgcctttttaaacctaggtcttaccagggtttttactgtttggtttgaggcaccccagtcaactcctagatttcaaaaacctttttctaattgggagtaatggcgggcactttcaccaagatgttctagaaacttctgagccaggagtgaatggcccttccttagtagcctgggggatgtccagagactaggcctctcccctttacccctccagagaaggggcttccctgtcccggagggagacacggggaacgggattttccgtctctccctcttgccagctctgtgagtctggccagggcgggtagggagcgtggagggcatctgtctgccatcgcccgctgccaatctaagccagtctcactgtgaaccacacgaaacctcaactgggggagtgaggggctggccaggtctggaggggcctcaggggtgcccccagcccggcacccagcgctttcgcccctcgtccacccacccctggctggcagcctccctccccacacccgcccctgtgctctgctgtctggaggccacgtggatgttcatgagatgcattctcttctgtctttggtggatgggatggtggcaaagcccaggatctggctttgccagaggttgcaacatgttgagagaacccggtcaataaagtgtactacctcttacccctaaact

SEQ ID NO: 418509 - DNA, 3000 bp, Homo sapiens
  misc_feature (2902)..(2902): n is a, c, g, or t
cgcccgggcaggtcagcctgtctcaaggcacgccagtctcagctccgaccttgcagcggcgcagcgcgggtgggaggcggggaggagcagcgggaagagcggagcgaggaccgcggtccggcgcagtcttcaatgagcagcgcggaaactgcaccccagacccgagcctgctgcgcgccccctcccagagctcacctggtgccaggtaacaggcctggcctcgccctgtggatgatgatggccttgcccccgtgagctacaacctggccttcagcacccgcccacctccaaccagcaggatgcggctgtggaaggcggtggtggtgactttggccttcatgagtgtggacatctgcgtgaccacggccatctatgtcttcagccacctggaccgcagcctcctggaggacatccgccacttcaacatctttgactcggtgctggatctctgggcagcctgcctgtaccgcagctgcctgctgctgggagccaccattggtgtggccaagaacagtgcgctggggccccggcggctgcgggcctcgtggctggtcatcaccctcgtgtgcctcttcgtgggcatctatgccatggtgaagctgctgctcttctcagaggtgcgcaggcccatccgggacccctggttttgggccctgttcgtgtggacgtacatttcactcggcgcatccttcctgctctggtggctgctgtccaccgtgcggccaggcacccaggccctggagccaggggcggccaccgaggctgagggcttccctgggagcggccggccaccgcccgagcaggcgtctggggccacgctgcagaagctgctctcctacaccaagcccgacgtggccttcctcgtggccgcctccttcttcctcatcgtggcagctctgggagagaccttcctgccctactacacgggccgcgccattgatggcatcgtcatccagaaaagcatggatcagttcagcacggctgtcgtcatcgtgtgcctgctggccattggcagctcatttgccgcaggtattcggggcggcatttttaccctcatatttgccagactgaacattcgccttcgaaactgtctcttccgctcactggtgtcccaggagacaagcttctttgatgagaaccgcacaggggacctcatctcccgcctgacctcggacaccaccatggtcagcgacctggtctcccagaacatcaatgtcttcctgcggaacacagtcaaggtcacgggcgtggtggtcttcatgttcagcctctcatggcagctctccttggtcaccttcatgggcttccccatcatcatgatggtgtccaacatctacggcaagtactacaagaggctctccaaagaggtccagaatgccctggccagagcgagcaacacggcggaggagaccatcagtgccatgaagactgtccggagcttcgccaatgaggaggaggaggcagaggtgtacctgcggaagctgcagcaggtgtacaagctgaacaggaaggaggcagctgcctacatgtactacgtctggggcagcgggctcacactgctggtggtccaggtcagcatcctctactacgggggccaccttgtcatctcaggccagatgaccagcggcaacctcatcgccttcatcatctacgagtttgtcctgggagattgtatggagaatgtctccttcagcctgtcccccggcaaggtgacggccctggtggggccctcgggcagtgggaagagctcctgtgtcaacatcctggagaacttctaccccctggaggggggccgggtgctgctggacggcaagcccatcagcgcctacgaccacaagtacttgcaccgtgtgatctccctggtgagccaggagcccgtgctgttcgcccgctccatcacggataacatctcctacggcctgcccactgtgcctttcgagatggtggtggaggccgcacagaaggccaatgcccacggcttcatcatggaactccaggacggctacagcacagagacaggggagaagggcgcccagctgtcaggtggccagaagcagcgggtggccatggcccgggctctggtgcggaaccccccagtcctcatcctggatgaagccaccagcgctttggatgccgagagcgagtatctggtgagtcacagggtggtgggcaatgcgggggcaggagcggctccaggtggccagagcccccatcgcccagcagatggatgctgagaagagacgggccccaggagctctcccagactatcagcctcctgggctggtgaattcctggtgttgagagtggggagccaggagccactctggacccagcctccaggctccaggcagagctgtatggtgtggggcaagagaaggcatcagaatggggagacctgggtcatgagtggtggcttacacctgtaatcccagcactttgggaggccgaagcaggtggatcacctgaggtcaggagttgcagaccagcctggccaacatggtgaaaccccatctctactagaaatacaaaaactagccaggtgtggtagcacatgcctataatcccagctacttgggaggctgaggcaggagaattgcttgaacctgggaagtggaggttgcagtcagccgagattgtgccactgcactccagcctgggcgacagagccagactccatctggctcaaacaaacagacaaaacaaaacaaaataaaataggcccagtatgatggctcatgcctataatcccagcactttgggaggccaaggcaggtggatcacttgaggtccggagttcgagacaagcctggtcaatacagtgaaaccctgtctctactaaaaatacaaaaattagctgggcatggtggtgcatgcctgtaaccccagctactcgggaggctgnggcaggagactcacttgaacccgggagatggaggttgcagtgagctgagattgtgccactgcactctagcctgggcgacagagtgagactccatctac

SEQ ID NO: 418510 - DNA, 398 bp, Homo sapiens
cgcccgggcaggtcagcctgtctcaaggcacgccagtctcagctccgaccttgcagcggcgcagcgcgggtgggaggcggggaggagcagcgggaagagcggagcgaggaccgcggtccggcgcagtcttcaatgagcagcgcggaaactgcaccccagacccgagcctgctgcgcgccccctcccagagctcacctggtgccaggtaacaggcctggcctcgccctgtggatgatgatggccttgcccccgtgagccacgtggatgttcatgagatgcattctcttctgtctttggtggatgggatggtggcaaagcccaggatctggctttgccagaggttgcaacatgttgagagaacccggtcaataaagtgtactacctcttacccctaaact

SEQ ID NO: 418511 - DNA, 3485 bp, Homo sapiens
ggaaacggtctgcggagaaagatgctcctgggccgggttgggaccggcggcctcctcgttccgcctcccagttttcccactacgaggcagggactaatggctccactttacagacagctgaactgggtcgtgccttcacaggacggggagaggaagggactcggagccccaaggcctttgacttaaacgccgacccaccccccgccgtctgcccggagctcgtggagaaccagccgagctgaggacagtttaaagagctcggaggtccgactagttcccgctggtgcttcaatcatccagccctgtacgtttcagtttggatttagcatctaccccgggtccctgcctggcgcttccggtccctccgccacagtctgttggattacctcagattgccccagcctggcctcgccctgtggatgatgatggccttgcccccgtgagctacaacctggccttcagcacccgcccacctccaaccagcaggatgcggctgtggaaggcggtggtggtgactttggccttcatgagtgtggacatctgcgtgaccacggccatctatgtcttcagccacctggaccgcagcctcctggaggacatccgccacttcaacatctttgactcggtgctggatctctgggcagcctgcctgtaccgcagctgcctgctgctgggagccaccattggtgtggccaagaacagtgcgctggggccccggcggctgcgggcctcgtggctggtcatcaccctcgtgtgcctcttcgtgggcatctatgccatggtgaagctgctgctcttctcagaggtgcgcaggcccatccgggacccctggttttgggccctgttcgtgtggacgtacatttcactcggcgcatccttcctgctctggtggctgctgtccaccgtgcggccaggcacccaggccctggagccaggggcggccaccgaggctgagggcttccctgggagcggccggccaccgcccgagcaggcgtctggggccacgctgcagaagctgctctcctacaccaagcccgacgtggccttcctcgtggccgcctccttcttcctcatcgtggcagctctgggagagaccttcctgccctactacacgggccgcgccattgatggcatcgtcatccagaaaagcatggatcagttcagcacggctgtcgtcatcgtgtgcctgctggccattggcagctcatttgccgcaggtattcggggcggcatttttaccctcatatttgccagactgaacattcgccttcgaaactgtctcttccgctcactggtgtcccaggagacaagcttctttgatgagaaccgcacaggggacctcatctcccgcctgacctcggacaccaccatggtcagcgacctggtctcccagaacatcaatgtcttcctgcggaacacagtcaaggtcacgggcgtggtggtcttcatgttcagcctctcatggcagctctccttggtcaccttcatgggcttccccatcatcatgatggtgtccaacatctacggcaagtactacaagaggctctccaaagaggtccagaatgccctggccagagcgagcaacacggcggaggagaccatcagtgccatgaagactgtccggagcttcgccaatgaggaggaggaggcagaggtgtacctgcggaagctgcagcaggtgtacaagctgaacaggaaggaggcagctgcctacatgtactacgtctggggcagcgggctcacactgctggtggtccaggtcagcatcctctactacgggggccaccttgtcatctcaggccagatgaccagcggcaacctcatcgccttcatcatctacgagtttgtcctgggagattgtatggagtccgtgggctccgtctacagtggcctgatgcagggagtgggggctgctgagaaggtgttcgagttcatcgaccggcagccgaccatggtgcacgatggcagcttggcccccgaccacctggagggccgggtggactttgagaatgtgaccttcacctaccgcactcggccccacacccaggtcctgcagaatgtctccttcagcctgtcccccggcaaggtgacggccctggtggggccctcgggcagtgggaagagctcctgtgtcaacatcctggagaacttctaccccctggaggggggccgggtgctgctggacggcaagcccatcagcgcctacgaccacaagtacttgcaccgtgtgatctccctggtgagccaggagcccgtgctgttcgcccgctccatcacggataacatctcctacggcctgcccactgtgcctttcgagatggtggtggaggccgcacagaaggccaatgcccacggcttcatcatggaactccaggacggctacagcacagagacaggggagaagggcgcccagctgtcaggtggccagaagcagcgggtggccatggcccgggctctggtgcggaaccccccagtcctcatcctggatgaagccaccagcgctttggatgccgagagcgagtatctgatccagcaggccatccatggcaacctgcagaagcacacggtactcatcatcgcgcaccggctgagcaccgtggagcacgcgcacctcattgtggtgctggacaagggccgcgtagtgcagcagggcacccaccagcagctgctggcccagggcggcctctacgccaagctggtgcagcggcagatgctggggcttcagcccgccgcagacttcacagctggccacaacgagcctgtagccaacggcagtcacaaggcctgatggggggcccctgcttctcccggtggggcagaggacccggtgcctgcctggcagatgtgcccacggaggcccccagctgccctccgagcccaggcctgcagcactgaaagacgacctgccatgtcccatggatcaccgcttcctgcatcttgcccctggtccctgccccattcccagggcactccttacccctcctgggggatgtccagagactaggcctctcccctttacccctccagagaaggggcttccctgtcccggagggagacacggggaacgggattttccgtctctccctcttgccagctctgtgagtctggccagggcgggtagggagcgtggagggcatctgtctgccatcgcccgctgccaatctaagccagtctcactgtgaaccacacgaaacctcaactgggggagtgaggggctggccaggtctggaggggcctcaggggtgcccccagcccggcacccagcgctttcgcccctcgtccacccacccctggctggcagcctccctccccacacccgcccctgtgctctgctgtctggaggccacgtggatgttcatgagatgcattctcttctgtctttggtggatgggatggtggcaaagcccaggatctggctttgccagaggttgcaacatgttgagagaacccggtcaataaagtgtactacctcttacccctaaact

SEQ ID NO: 418512 - DNA, 3245 bp, Homo sapiens
ggaaacggtctgcggagaaagatgctcctgggccgggttgggaccggcggcctcctcgttccgcctcccagttttcccactacgaggcagggactaatggctccactttacagacagctgaactgggtcgtgccttcacaggacggggagaggaagggactcggagccccaaggcctttgacttaaacgccgacccaccccccgccgtctgcccggagctcgtggagaaccagccgagctgaggacagtttaaagagctcggaggtccgactagttcccgctggtgcttcaatcatccagccctgtacgtttcagtttggatttagcatctaccccgggtccctgcctggcgcttccggtccctccgccacagtctgttggattacctcagattgccccagcctggcctcgccctgtggatgatgatggccttgcccccgtgagctacaacctggccttcagcacccgcccacctccaaccagcaggatgcggctgtggaaggcggtggtggtgactttggccttcatgagtgtggacatctgcgtgaccacggccatctatgtcttcagccacctggaccgcagcctcctggaggacatccgccacttcaacatctttgactcggtgctggatctctgggcagcctgcctgtaccgcagctgcctgctgctgggagccaccattggtgtggccaagaacagtgcgctggggccccggcggctgcgggcctcgtggctggtcatcaccctcgtgtgcctcttcgtgggcatctatgccatggtgaagctgctgctcttctcagaggtgcgcaggcccatccgggacccctggttttgggccctgttcgtgtggacgtacatttcactcggcgcatccttcctgctctggtggctgctgtccaccgtgcggccaggcacccaggccctggagccaggggcggccaccgaggctgagggcttccctgggagcggccggccaccgcccgagcaggcgtctggggccacgctgcagaagctgctctcctacaccaagcccgacgtggccttcctcgtggccgcctccttcttcctcatcgtggcagctctgggagagaccttcctgccctactacacgggccgcgccattgatggcatcgtcatccagaaaagcatggatcagttcagcacggctgtcgtcatcgtgtgcctgctggccattggcagactgaacattcgccttcgaaactgtctcttccgctcactggtgtcccaggagacaagcttctttgatgagaaccgcacaggggacctcatctcccgcctgacctcggacaccaccatggtcagcgacctggtctcccagaacatcaatgtcttcctgcggaacacagtcaaggtcacgggcgtggtggtcttcatgttcagcctctcatggcagctctccttggtcaccttcatgggcttccccatcatcatgatggtgtccaacatctacggcaagtactacaagaggctctccaaagaggtccagaatgccctggccagagcgagcaacacggcggaggagaccatcagtgccatgaagactgtccggagcttcgccaatgaggaggaggaggcagaggtgtacctgcggaagctgcagcaggtgtacaagctgaacaggaaggaggcagctgcctacatgtactacgtctggggcagcgggctcacactgctggtggtccaggtcagcatcctctactacgggggccaccttgtcatctcaggccagatgaccagcggcaacctcatcgccttcatcatctacgagtttgtcctgggagattgtatggagaatgtctccttcagcctgtcccccggcaaggtgacggccctggtggggccctcgggcagtgggaagagctcctgtgtcaacatcctggagaacttctaccccctggaggggggccgggtgctgctggacggcaagcccatcagcgcctacgaccacaagtacttgcaccgtgtgatctccctggtgagccaggagcccgtgctgttcgcccgctccatcacggataacatctcctacggcctgcccactgtgcctttcgagatggtggtggaggccgcacagaaggccaatgcccacggcttcatcatggaactccaggacggctacagcacagagacaggggagaagggcgcccagctgtcaggtggccagaagcagcgggtggccatggcccgggctctggtgcggaaccccccagtcctcatcctggatgaagccaccagcgctttggatgccgagagcgagtatctgatccagcaggccatccatggcaacctgcagaagcacacggtactcatcatcgcgcaccggctgagcaccgtggagcacgcgcacctcattgtggtgctggacaagggccgcgtagtgcagcagggcacccaccagcagctgctggcccagggcggcctctacgccaagctggtgcagcggcagatgctggggcttcagcccgccgcagacttcacagctggccacaacgagcctgtagccaacggcagtcacaaggcctgatggggggcccctgcttctcccggtggggcagaggacccggtgcctgcctggcagatgtgcccacggaggcccccagctgccctccgagcccaggcctgcagcactgaaagacgacctgccatgtcccatggatcaccgcttcctgcatcttgcccctggtccctgccccattcccagggcactccttacccctcctgggggatgtccagagactaggcctctcccctttacccctccagagaaggggcttccctgtcccggagggagacacggggaacgggattttccgtctctccctcttgccagctctgtgagtctggccagggcgggtagggagcgtggagggcatctgtctgccatcgcccgctgccaatctaagccagtctcactgtgaaccacacgaaacctcaactgggggagtgaggggctggccaggtctggaggggcctcaggggtgcccccagcccggcacccagcgctttcgcccctcgtccacccacccctggctggcagcctccctccccacacccgcccctgtgctctgctgtctggaggccacgtggatgttcatgagatgcattctcttctgtctttggtggatgggatggtggcaaagcccaggatctggctttgccagaggttgcaacatgttgagagaacccggtcaataaagtgtactacctcttacccctaaact

SEQ ID NO: 418513 - DNA, 3059 bp, Homo sapiens
  misc_feature (2961)..(2961): n is a, c, g, or t
ggaaacggtctgcggagaaagatgctcctgggccgggttgggaccggcggcctcctcgttccgcctcccagttttcccactacgaggcagggactaatggctccactttacagacagctgaactgggtcgtgccttcacaggacggggagaggaagggactcggagccccaaggcctttgacttaaacgccgacccaccccccgccgtctgcccggagctcgtggagaaccagccgagctgaggacagtttaaagagctcggaggtccgactagttcccgctggtgcttcaatcatccagccctgtacgtttcagtttggatttagcatctaccccgggtccctgcctggcgcttccggtccctccgccacagtctgttggattacctcagattgccccagcctggcctcgccctgtggatgatgatggccttgcccccgtgagctacaacctggccttcagcacccgcccacctccaaccagcaggatgcggctgtggaaggcggtggtggtgactttggccttcatgagtgtggacatctgcgtgaccacggccatctatgtcttcagccacctggaccgcagcctcctggaggacatccgccacttcaacatctttgactcggtgctggatctctgggcagcctgcctgtaccgcagctgcctgctgctgggagccaccattggtgtggccaagaacagtgcgctggggccccggcggctgcgggcctcgtggctggtcatcaccctcgtgtgcctcttcgtgggcatctatgccatggtgaagctgctgctcttctcagaggtgcgcaggcccatccgggacccctggttttgggccctgttcgtgtggacgtacatttcactcggcgcatccttcctgctctggtggctgctgtccaccgtgcggccaggcacccaggccctggagccaggggcggccaccgaggctgagggcttccctgggagcggccggccaccgcccgagcaggcgtctggggccacgctgcagaagctgctctcctacaccaagcccgacgtggccttcctcgtggccgcctccttcttcctcatcgtggcagctctgggagagaccttcctgccctactacacgggccgcgccattgatggcatcgtcatccagaaaagcatggatcagttcagcacggctgtcgtcatcgtgtgcctgctggccattggcagctcatttgccgcaggtattcggggcggcatttttaccctcatatttgccagactgaacattcgccttcgaaactgtctcttccgctcactggtgtcccaggagacaagcttctttgatgagaaccgcacaggggacctcatctcccgcctgacctcggacaccaccatggtcagcgacctggtctcccagaacatcaatgtcttcctgcggaacacagtcaaggtcacgggcgtggtggtcttcatgttcagcctctcatggcagctctccttggtcaccttcatgggcttccccatcatcatgatggtgtccaacatctacggcaagtactacaagaggctctccaaagaggtccagaatgccctggccagagcgagcaacacggcggaggagaccatcagtgccatgaagactgtccggagcttcgccaatgaggaggaggaggcagaggtgtacctgcggaagctgcagcaggtgtacaagctgaacaggaaggaggcagctgcctacatgtactacgtctggggcagcgggaatgtctccttcagcctgtcccccggcaaggtgacggccctggtggggccctcgggcagtgggaagagctcctgtgtcaacatcctggagaacttctaccccctggaggggggccgggtgctgctggacggcaagcccatcagcgcctacgaccacaagtacttgcaccgtgtgatctccctggtgagccaggagcccgtgctgttcgcccgctccatcacggataacatctcctacggcctgcccactgtgcctttcgagatggtggtggaggccgcacagaaggccaatgcccacggcttcatcatggaactccaggacggctacagcacagagacaggggagaagggcgcccagctgtcaggtggccagaagcagcgggtggccatggcccgggctctggtgcggaaccccccagtcctcatcctggatgaagccaccagcgctttggatgccgagagcgagtatctggtgagtcacagggtggtgggcaatgcgggggcaggagcggctccaggtggccagagcccccatcgcccagcagatggatgctgagaagagacgggccccaggagctctcccagactatcagcctcctgggctggtgaattcctggtgttgagagtggggagccaggagccactctggacccagcctccaggctccaggcagagctgtatggtgtggggcaagagaaggcatcagaatggggagacctgggtcatgagtggtggcttacacctgtaatcccagcactttgggaggccgaagcaggtggatcacctgaggtcaggagttgcagaccagcctggccaacatggtgaaaccccatctctactagaaatacaaaaactagccaggtgtggtagcacatgcctataatcccagctacttgggaggctgaggcaggagaattgcttgaacctgggaagtggaggttgcagtcagccgagattgtgccactgcactccagcctgggcgacagagccagactccatctggctcaaacaaacagacaaaacaaaacaaaataaaataggcccagtatgatggctcatgcctataatcccagcactttgggaggccaaggcaggtggatcacttgaggtccggagttcgagacaagcctggtcaatacagtgaaaccctgtctctactaaaaatacaaaaattagctgggcatggtggtgcatgcctgtaaccccagctactcgggaggctgnggcaggagactcacttgaacccgggagatggaggttgcagtgagctgagattgtgccactgcactctagcctgggcgacagagtgagactccatctac

SEQ ID NO: 418514 - DNA, 1713 bp, Homo sapiens
gacaagccttggaagacacccctgccaacggccggcatttcagtttgtggctgggtctgccctcacctccccctgcagcctgggatgggtcaggaatggggatggtgggggatctaaggtcccctcgacccacatcccctctccctctgccccagctcacactgctggtggtccaggtcagcatcctctactacgggggccaccttgtcatctcaggccagatgaccagcggcaacctcatcgccttcatcatctacgagtttgtcctgggagattgtatggagaatgtctccttcagcctgtcccccggcaaggtgacggccctggtggggccctcgggcagtgggaagagctcctgtgtcaacatcctggagaacttctaccccctggaggggggccgggtgctgctggacggcaagcccatcagcgcctacgaccacaagtacttgcaccgtgtgatctccctggtgagccaggagcccgtgctgttcgcccgctccatcacggataacatctcctacggcctgcccactgtgcctttcgagatggtggtggaggccgcacagaaggccaatgcccacggcttcatcatggaactccaggacggctacagcacagagacaggggagaagggcgcccagctgtcaggtggccagaagcagcgggtggccatggcccgggctctggtgcggaaccccccagtcctcatcctggatgaagccaccagcgctttggatgccgagagcgagtatctgatccagcaggccatccatggcaacctgcagaagcacacggtactcatcatcgcgcaccggctgagcaccgtggagcacgcgcacctcattgtggtgctggacaagggccgcgtagtgcagcagggcacccaccagcagctgctggcccagggcggcctctacgccaagctggtgcagcggcagatgctggggcttcagcccgccgcagacttcacagctggccacaacgagcctgtagccaacggcagtcacaaggcctgatggggggcccctgcttctcccggtggggcagaggacccggtgcctgcctggcagatgtgcccacggaggcccccagctgccctccgagcccaggcctgcagcactgaaagacgacctgccatgtcccatggatcaccgcttcctgcatcttgcccctggtccctgccccattcccagggcactccttacccctcctgggggatgtccagagactaggcctctcccctttacccctccagagaaggggcttccctgtcccggagggagacacggggaacgggattttccgtctctccctcttgccagctctgtgagtctggccagggcgggtagggagcgtggagggcatctgtctgccatcgcccgctgccaatctaagccagtctcactgtgaaccacacgaaacctcaactgggggagtgaggggctggccaggtctggaggggcctcaggggtgcccccagcccggcacccagcgctttcgcccctcgtccacccacccctggctggcagcctccctccccacacccgcccctgtgctctgctgtctggaggccacgtggatgttcatgagatgcattctcttctgtctttggtggatgggatggtggcaaagcccaggatctggctttgccagaggttgcaacatgttgagagaacccggtcaataaagtgtactacctcttacccctaaact

SEQ ID NO: 418515 - DNA, 1562 bp, Homo sapiens
ggaaacggtctgcggagaaagatgctcctgggccgggttgggaccggcggcctcctcgttccgcctcccagttttcccactacgaggcagggactaatggctccactttacagacagctgaactgggtcgtgccttcacaggacggggagaggaagggactcggagccccaaggcctttgacttaaacgccgacccaccccccgccgtctgcccggagctcgtggagaaccagccgagctgaggacagtttaaagagctcggaggtccgactagttcccgctggtgcttcaatcatccagccctgtacgtttcagtttggatttagcatctaccccgggtccctgcctggcgcttccggtccctccgccacagtctgttggattacctcagattgccccagcctggcctcgccctgtggatgatgatggccttgcccccgtgagctacaacctggccttcagcacccgcccacctccaaccagcaggatgcggctgtggaaggcggtggtggtgactttggccttcatgagtgtggacatctgcgtgaccacggccatctatgtcttcagccacctggaccgcagcctcctggaggacatccgccacttcaacatctttgactcggtgctggatctctgggcagcctgcctgtaccgcagctgcctgctgctgggagccaccattggtgtggccaagaacagtgcgctggggccccggcggctgcgggcctcgtggctggtcatcaccctcgtgtgcctcttcgtgggcatctatgccatggtgaagctgctgctcttctcagaggtgcgcaggcccatccgggacccctggttttgggccctgttcgtgtggacgtacatttcactcggcgcatccttcctgctctggtggctgctgtccaccgtgcggccaggcacccaggccctggagccaggggcggccaccgaggctgagggcttccctgggagcggccggccaccgcccgagcaggcgtctggggccacgctgcagaagctgctctcctacaccaagcccgacgtggccttcctcgtggccgcctccttcttcctcatcgtggcagctctgggtaagtaaggacctcggggacatgtggccaccagaacatcaaattaggtggatatgactgccttagattttaaaagattttacttacgtggttcagacatcaaattgatatgaaaaggaaaagaggccaggcatagtggctcatatctataatcccagcactttgggaggctgaggtaggaagatcacttgagcccaggagttgaaaaccagcctgggcaacatagcgagaacccatttctattttatttatttatttatttattgtatttatttattttttcgaaacataaattgcttgaacctgggaggcagaggttgcagtgagccaagctcacacaactgcactccagcctgagtgacaaagtgagactccatctcaaaaaacataaataataaaatagtaaaataaaaatgttaactgacagagacagagcctagagaggtgacaatgcaataacaatgccagaatgtt

SEQ ID NO: 418516 - DNA, 3671 bp, Homo sapiens
  misc_feature (198)..(198): n is a, c, g, or t
  misc_feature (914)..(914): n is a, c, g, or t
  misc_feature (1328)..(1328): n is a, c, g, or t
  misc_feature (1541)..(1541): n is a, c, g, or t
aacgcacccgttttccagaacaccgctttctccaccagcatcaacgagaccctgcccgtgggcagtgtggtgttctccgtgctggccgtggataaagacatggggtctgcaggcatggtcgtgtactccatagagaaggtcatccctagcactggggacagcgagcatctcttccggatcctggccaatggctccatngtcctcaatggcagcctcagctacaacaacaagagcgctttctaccagctggagctgaaggcctgtgacttgggcggcatgtaccacaacaccttcaccatccagtgctccctgcctgtcttcctgtccatctccgtggtggaccagcctgaccttgacccccagtttgtcagggagttttactcggcctctgtggctgaggatgcagccaagggaacctcggtgctgacggtggaggctgtggatggcgacaaaggcatcaatgaccctgtgatctacagcatctcctactccacgcggcccggctggtttgacatcggggcagatggggtgatcagggtcaacggctccctggaccgtgagcagctgctggaggcggatgaggaggtgcagctgcaggtcacggccaccgagacacacctcaacatctacgggcaggaggccaaggtgagcatctgggtgacagtgagagtgatggacgtcaatgaccacaaacctgagttttacaactgcagcctcccagcctgcaccttcacccccgaagaggcccaagtgaacttcactggctacgtggacgagcatgcctccccccgcatccccatcgatgacctcaccatggtggtctacgacccggacaagggcagcaatggcaccttcctgttgtcgctggggggccccgatgcagaagccttcagcgtctccccggagcgggcagngggctcagcctccgttcaggtgctggtgagagtatccgcgctggtggacacgagaggcagacggcgatggcggtgcaggttgtggccacagactccgtcagccagaacttctccgtcgccatggtgaccatccaccttagagacattaatgaccacaggcccacgtttccccagagcttgtacgtcctcacggtgccagagcacagcgccaccggctctgtggtcaccgacagcatccacgccacggacccagacacgggcgcgtggggccaaattacctacagcctgctcccaggaaatggggcagacctcttccaagtggatcccgtctcagggacggtgacggtgaggaacggtgagctgctggaccgggagagccaggccgtgtactacctgacgctgcaggccacaganggcgggaacctgtcctcctccaccacactgcagatccacctgctggacatcaacgacaatgcacccgtggttagcggctcctacaacatcttcgtccaggaggaggagggcaatgtctccgtgaccatccaggcccacgacaatgatgagccgggcaccaacaacagccgtctgctcttcaacctgctgcctggcccctacagccacaacttntccttggaccctgacacagggctcctcagaaacctggggcccctggacagagaggccatcgaccccgccctggagggccgcattgtgctgacagtgcttgtgtctgactgcggcgagcctgtcctcggcaccaaagtcaatgtcaccatcactgtggaggacatcaatgataacctgcccatcttcaatcagtccagctacaactttacggtgaaggaggaggatccaggagtgctagtgggcgtggtgaaggcctgggacgcggaccagacggaagccaacaaccgcatcagcttcagcctgtcggggagtggtgccaactacttcatgatccgaggcttggtgctgggggctgggtgggctgagggctacctccggctgcccccggacgtgagcctggattacgagacacagcccgtcttcaacttgacagtgagtgctgagaacccagacccccaggggggtgagaccatagtagacgtctgcgtgaatgtgaaagacgtgaacgacaatccccccaccctggatgtagcctcactccggggcatccgtgtggctgagaatggctcacagcacggccaggtggctgtggtggttgcctcggatgtggacaccagtgcccagctggagatacagcttgtgaacattctctgcaccaaggccggggtcgatgtgggcagcctatgctggggctggttctcagtggcggccaacggctctgtgtacatcaaccagagcaaagccatcgactacgaggcctgtgacctggtcacgctggttgtgcgggcctgtgacctagccacggaccccggcttccaggcctacagcaacaatggaagcctcctcattaccattgaggacgtgaatgacaatgcaccctattttctgcctgagaataagacttttgtgatcatccctgaactcgtgctgcccaaccgggaggtggcttctgtccgggccagagacgatgattcagggaacaatggcgtcatcctgttctccatcctccgagtagacttcatctctaaggacggggccaccatccctttccagggtgtcttctcgatcttcacctcctccgaggccgacgtgttcgctgggagcattcagccggtgaccagcctcgactccactctccaaggcacctaccaagtgacagtccaggccagggacagaccttccttgggtcctttcctggaagccaccaccaccctgaatctcttcaccgtggaccagagttaccgctcgcggctgcagttctccacaccgaaggaggaggtgggcgccaacagacaggcgattaatgcggctcttacccaggcaaccaggactacagtatacattgtggacattcaggacatagattctgcagctcgggcccgacctcactcctacctcgatgcctactttgtcttccccaatgggtcagccctgacccttgatgagctgagtgtgatgatccggaatgatcaggactcgctgacgcagctgctgcagctggggctggtggtgctgggctcccaggagagccaggagtcagacctgtcgaaacagctcatcagtgtcatcataggattgggagtggctttgctgctggtccttgtgatcatgaccatggccttcgtgtgtgtgcggaagagctacaaccggaagcttcaagctatgaaggctgccaaggaggccaggaagacagcagcaggggtgatgccctcagcccctgccatcccagggactaacatgtacaacactgagcgagccaaccccatgctgaacctccccaacaaagacctgggcttggagtacctctctccctccaatgacctggactctgtcagcgtcaactccctggacgacaactctgtggatgtggacaagaacagtcaggaaatcaaggagcacaggccaccacacacaccaccagagccagatccagagcccctgagcgtggtcctgttaggacggcaggcaggcgcaagtggacagctggaggggccatcctacaccaacgctggcctggacaccacggacctgtgacaggggcccccactcttctggaccccttgaagaggccctaccacaccctaactgcacctgtctccctggagatgaaaatatatgacgctgccctgc

SEQ ID NO: 418517 - DNA, 1421 bp, Homo sapiens
gtggctgtaataggggtctcttttggtagagaggttgagggcaggtttagggggatgagccctgagctgggctcgtgaccagccttggtccaggtgggcagtgtcccgaccccgctgaccccgttcccgttcacacctgcagtgatcatccctgaactcgtgctgcccaaccgggaggtggcttctgtccgggccagagacgatgattcagggaacaatggcgtcatcctgttctccatcctccgagtagacttcatctctaaggacggggccaccatccctttccagggtgtcttctcgatcttcacctcctccgaggccgacgtgttcgctgggagcattcagccggtgaccagcctcgactccactctccaaggcacctaccaagtgacagtccaggccagggacagaccttccttgggtcctttcctggaagccaccaccaccctgaatctcttcaccgtggaccagagttaccgctcgcggctgcagttctccacaccgaaggaggaggtgggcgccaacagacaggcgattaatgcggctcttacccaggcaaccaggactacagtatacattgtggacattcaggacatagattctgcagctcgggcccgacctcactcctacctcgatgcctactttgtcttccccaatgggtcagccctgacccttgatgagctgagtgtgatgatccggaatgatcaggactcgctgacgcagctgctgcagctggggctggtggtgctgggctcccaggagagccaggagtcagacctgtcgaaacagctcatcagtgtcatcataggattgggagtggctttgctgctggtccttgtgatcatgaccatggccttcgtgtgtgtgcggaagagctacaaccggaagcttcaagctatgaaggctgccaaggaggccaggaagacagcagcaggggtgatgccctcagcccctgccatcccagggactaacatgtacaacactgagcgagccaaccccatgctgaacctccccaacaaagacctgggcttggagtacctctctccctccaatgacctggactctgtcagcgtcaactccctggacgacaactctgtggatgtggacaagaacagtcaggaaatcaaggagcacaggccaccacacacaccaccagagccagatccagagcccctgagcgtggtcctgttaggacggcaggcaggcgcaagtggacagctggaggggccatcctacaccaacgctggcctggacaccacggacctgtgacaggggcccccactcttctggaccccttgaagaggccctaccacaccctaactgcacctgtctccctggagatgaaaatatatgacgctgccctgcctcctgcttttggccaatcacggcagacaggggttggggaaatattttattaccaa

SEQ ID NO: 418518 - DNA, 1392 bp, Homo sapiens
gtggctgtaataggggtctcttttggtagagaggttgagggcaggtttagggggatgagccctgagctgggctcgtgaccagccttggtccaggtgggcagtgtcccgaccccgctgaccccgttcccgttcacacctgcagtgatcatccctgaactcgtgctgcccaaccgggaggtggcttctgtccgggccagagacgatgattcagggaacaatggcgtcatcctgttctccatcctccgagtagacttcatctctaaggacggggccaccatccctttccagggtgtcttctcgatcttcacctcctccgaggccgacgtgttcgctgggagcattcagccggtgaccagcctcgactccactctccaaggcacctaccaagtgacagtccaggccagggacagaccttccttgggtcctttcctggaagccaccaccaccctgaatctcttcaccgtggaccagagttaccgctcgcggctgcagttctccacaccgaaggaggagggctcttacccaggcaaccaggactacagtatacattgtggacattcaggacatagattctgcagctcgggcccgacctcactcctacctcgatgcctactttgtcttccccaatgggtcagccctgacccttgatgagctgagtgtgatgatccggaatgatcaggactcgctgacgcagctgctgcagctggggctggtggtgctgggctcccaggagagccaggagtcagacctgtcgaaacagctcatcagtgtcatcataggattgggagtggctttgctgctggtccttgtgatcatgaccatggccttcgtgtgtgtgcggaagagctacaaccggaagcttcaagctatgaaggctgccaaggaggccaggaagacagcagcaggggtgatgccctcagcccctgccatcccagggactaacatgtacaacactgagcgagccaaccccatgctgaacctccccaacaaagacctgggcttggagtacctctctccctccaatgacctggactctgtcagcgtcaactccctggacgacaactctgtggatgtggacaagaacagtcaggaaatcaaggagcacaggccaccacacacaccaccagagccagatccagagcccctgagcgtggtcctgttaggacggcaggcaggcgcaagtggacagctggaggggccatcctacaccaacgctggcctggacaccacggacctgtgacaggggcccccactcttctggaccccttgaagaggccctaccacaccctaactgcacctgtctccctggagatgaaaatatatgacgctgccctgcctcctgcttttggccaatcacggcagacaggggttggggaaatattttattaccaa

SEQ ID NO: 418519 - DNA, 1155 bp, Homo sapiens
gtggctgtaataggggtctcttttggtagagaggttgagggcaggtttagggggatgagccctgagctgggctcgtgaccagccttggtccaggtgggcagtgtcccgaccccgctgaccccgttcccgttcacacctgcagtgatcatccctgaactcgtgctgcccaaccgggaggtggcttctgtccgggccagagacgatgattcagggaacaatggcgtcatcctgttctccatcctccgagtagacttcatctctaaggacggggccaccatccctttccagggtgtcttctcgatcttcacctcctccgaggccgacgtgttcgctgggagcattcagccggtgaccagcctcgactccactctccaaggcacctaccaagtgacagtccaggccagggacagaccttccttgggtcctttcctggaagccaccaccaccctgaatctcttcaccgtggaccagagttaccgctcgcggctgcagttctccacaccgaaggaggaggtgggcgccaacagacaggcgattaatgcggctcttacccaggcaaccaggactacagtatacattgtggacattcaggacatagattctgcagctcgggcccgacctcactcctacctcgatgcctactttgtcttccccaatgggtcagccctgacccttgatgagctgagtgtgatgatccggaatgatcaggactcgctgacgcagctgctgcagctggggctggtggtgctgggctcccaggagagccaggagtcagacctgtcgaaacagctcatcagtgtcatcataggattgggagtggctttgctgctggtccttgtgatcatgaccatggccttcgtgtgtgtgcggaagagctacaaccggaagcttcaagctatgaaggctgccaaggaggccaggaagacagcagcaggggtgatgccctcagcccctgccatcccagggactaacatgtacaacactgagcgagccaaccccatgctgaacctccccaacaaagacctgggcttggagtacctctctccctccaatgacctggactctgtcagggtaaattccctggcgaaaactttgggatgtggccaagaacgcccgggaataagggggccaggccccccccccacccccagggcc

SEQ ID NO: 418520 - DNA, 1419 bp, Homo sapiens
gtggctgtaataggggtctcttttggtagagaggttgagggcaggtttagggggatgagccctgagctgggctcgtgaccagccttggtccaggtgggcagtgtcccgaccccgctgaccccgttcccgttcacacctgcagtgatcatccctgaactcgtgctgcccaaccgggaggtggcttctgtccgggccagagacgatgattcagggaacaatggcgtcatcctgttctccatcctccgagtagacttcatctctaaggacggggccaccatccctttccagggtgtcttctcgatcttcacctcctccgaggccgacgtgttcgctgggagcattcagccggtgaccagcctcgactccactctccaaggcacctaccaagtgacagtccaggccagggacagaccttccttgggtcctttcctggaagccaccaccaccctgaatctcttcaccgtggaccagagttaccgctcgcggctgcagttctccacaccgaaggaggagggctcttacccaggcaaccaggactacagtatacattgtggacattcaggacatagattctgcagctcgggcccgacctcactcctacctcgatgcctactttgtcttccccaatgggtcagccctgacccttgatgagctgagtgtgatgatccggaatgatcaggactcgctgacgcagctgctgcagctggggctggtggtgctgggctcccaggagagccaggagtcagacctgtcgaaacagctcatcagtgtcatcataggattgggagtggctttgctgctggtccttgtgatcatgaccatggccttcgtgtgtgtgcggaagagctacaaccggaagcttcaagctatgaaggctgccaaggaggccaggaagacagcagcaggggtgatgccctcagcccctgccatcccagggactaacatgtacaacactgagcgagccaaccccatgctgaacctccccaacaaagacctgggcttggagtacctctctccctccaatgacctggactctgtcaggtgagcagtgcccctcacagccaggctaggtggtggtggtggtacaggtagtgacggtgatggtggtgatggtgttggtggtgatgatggtgatgacaatggtgatggtgtggtcatggtagtagtggtagttatggtggtggtggtgatggtagtgaggtgatggtgatggtagcaatggtgacagtggtgatgatgacaacaatgatggtggtgatgatggtgttggtgttgaggtgatggtgatggttgtgatggtgatggtggtgatgatggtgttggtgttgaggtgatggtgatggttgtgatggtgatggtggtgatgatggtgttggtgttgaggtgatggtgatggttgtgatggtgatggtggtgatg

SEQ ID NO: 418521 - DNA, 362 bp, Homo sapiens
cctgtactttcacctgcacgacgttcttgcatgtccccagaagcccatacccagccaagggcagagggaagccttggaacaaggctgccgtgtacagttgtgaaggctgtgtgttgcacaagggcactctgcttgctaagctattcacccagccccagaggaagggatttccttttgtaattttcacagagatgctacctactcagccaacagagctgtccagaggaggtgccctttctcactcatacaattcttaatcccactggcacagcgctggccacaggcccaggctaagaccccaggcctctgtgacatctgccttctttgcagggctcttacccaggcaaccaggactacagtat

SEQ ID NO: 418522 - DNA, 191 bp, Homo sapiens
gtcaggagtccttctgagctctgccccttgtccacaggagtgctagtgggcgtggtgaaggcctgggacgcggaccagacggaagccaacaaccgcatcagcttcagcctgtcggggagtggtgccaactacttcatgatccgaggcttggtgctgggggctgggtgggctgagggctacctccggctgcc

SEQ ID NO: 418523 - DNA, 365 bp, Homo sapiens
gaaaccatttgcttattcggggcagcgtggggatggcggatagagacggtgagggccagcctcccaggccacccttgcctctgatccctgctggggtggagggatgcctggcctggctgggcccccagatattgtccactcttgctcccagaggccagagacgatgattcagggaacaatggcgtcatcctgttctccatcctccgagtagacttcatctctaaggacggggccaccatccctttccagggtgtcttctcgatcttcacctcctccgaggccgacgtgttcgctgggagcattcagtaactgcgggcggccccgggagggaggttgcggggaggggcccgataggagctttcagg

SEQ ID NO: 418524 - DNA, 705 bp, Homo sapiens
agacaaaacccctcagacaccgagttgtagaaggaagggctttattcagctgggagcatccgcagactcacgtctccaaaaaccaagctctccgagtgagcaattcctgtccctcttaagggcttacaactctaagggggtccgcgtgagagggtcttgatggattgaggaagcagagggtacgtgactgggggctgcatgcacaggtaattagatcagaacaaaacaggacagggattttcacagtgcttttctatacaatgtctgtaatctatagataacataaccgagtaggtcaggggtcgatctttaactaccaggcccagggtgtggcgcggggctgtctgcctgtggatttcatttctgccttttagattttacttcttctttctttggaggcagaaattgggcataagacaatatgaggggaggtctccctttgagctatctgtgtctgtgtctttgtgtgtccgtgtgtgtgtgcccgggtgtggtgtgtgtgtgtgtctgcgcgcatgcacccgtgtgtatccgtgtgtgtgtcagggtgggtttgctcgtggtagtggtggggtgtgtctgggtgtccgtcagcccctctttcccgggatgaggctgccggggctctagtgccagggcggggcaaagcagagccttcttgcccctttggccatggcgggtcctcctcagaaaaagcgacgatgg

SEQ ID NO: 418525 - DNA, 3013 bp, Homo sapiens
agacaaaacccctcagacaccgagttgtagaaggaagggctttattcagctgggagcatccgcagactcacgtctccaaaaaccaagctctccgagtgagcaattcctgtccctcttaagggcttacaactctaagggggtccgcgtgagagggtcttgatggattgaggaagcagagggtacgtgactgggggctgcatgcacagacaacgagagcgaaaccacagagaaaagaaacatcccgtgcatcacggcctgatgatggattcctgtttcctgcaaaatggggagtctccaatatagcctgtttgaaaactggaaaggagagcaccgacacgatgctggtcttccacgcattcctggaagtttctggggccccacagagctcgcgaaacagtcaacatggtcacgctttcggggggcagaaacttgagcaacaggcacctttacagagggcaaagaaacgtggaatccagaatcacgcttcagttggcctgagtgtgactcctgtgtggatgggactatccgcctcgagctctgttgcagggctcaacgtggggatatgtcatctgtgaaccatgtggatgaaaaacagacaactacctgggtctcggctcattgctctctggggaattcgctcattccttcggaaacggaattggtctgaattgctccgggacgaagtaacccaggctggtgatccagagggccgctgagcgccccgccggccaacggggctgtgggcccagcactcagcctgtactgggcacccaacattttcccggagttctgggtcctgttggttctggaggcataagaccgtttttgtctctgccttccgttctctgcttcttgctccttttgtcccttggtccatccttccatctgttcttccctccctcccctggctttttcctccctttctccctccctccctctttctctcccttccggggtccctccttccacccatccttgcctagctccatccttccatctcactctgtctccgttcctgtcctcatctctgcctgccttccctcttgcctggaaagggcagcaccctggtttgcgcgaggtctggggtctttatttagttgcaaggcgctctatggtgctggcgaggaggctggcgggacacgggttggcaactgatggtgagcgaagaggcggaggagtcgagccgcagaaaggagaactggcctggcttctgccccggcccagtgtttcgcggactgaggtctccgccaacccgattgaagaacgcagggggaaaagggatgagagctccgcctgggctagttagaaaactaggctgctgcctggaaacccgcgcatgcgcagtagacagcctacctccctgtacctggaccagccctgggatccccgggatgctcaggaatgctttcttgtcattgttgacagccctcctctgtgtggagtctctcgctggacctggaactcagggatcctaggcaggtcagctggaagggaagacacgcctctccacaccaagcctgaggttcaccgcgaaagagaggccgccaccctgccccaaacccgccccaacctgctcctccagcagagccctgtgttcttcctggctgaggagtggttccagcaaagcgggctcttccacgtccttcagctcccccagtggcgccggatctaggaaaggttgtgccttttgctgaaactctggggttgacaggagctcatctaacaggctggaggtgagtgcagaggagagccccggctcctggagcggttgggaggtgcccggttggctggcatctgtgcttgacgcggaggcctccggggtcacgagctccggaggtgaaggtgccccgtcttcgggttcccatgccgccctggcgacctgcggctccagccccaccacggactccggtgggacgtgggtggcgcaagcacacctttcccctgtgactcagcttgaggggccccaaggtgtcccactgagcacgcgcccagcaggccatcgcgctgcgggttctggtcttcctgtcatttgttggggttcggaggccaccagggagtctgaggatgggagagccccagtttcggaggggccagggcagtgaacacaaagccccgcatgcccgggcaggttgggagagtccttctgcctgcgcagcctggctgggctggagcagggggatggcccttgctgcctggctcacgaaagccccctgtgggagagccccaggagcgcagggcatgtggggtgcaggaagcgcctttccccacgccccggtgtaggtgaactcgatagaggagggaggagggtgacacccaccaggggtgctaattagtaaccacagtggcctcaaagaactcaaatgaaaggaagacttgcaagtctctcactttaagtccagagctagaaatgattaagcttagtgaagatgcagaattttcatagctagagagaagtcaacgcttggcttcaaaacttcaaaggatgggctgactctctttgaggagcactgcagctggtgactttaagttacagccagtgctcattgaccactctgaaaatctcagggcccttaagaattatgcaaaatctattctttctgtgctctagaaatggaacatcactgtctgggtgacagcacatctgttaatagcatggtttactgaatattttaatcccactattgagaactgctcagaaaaaaaaaaaaccgattcttttaaaaagattgttggttggccaggcatagtggctcatacttgtaatccctgcactttgggaggccgaggatcacctgaggtcaggagttcaagaccagcctggccaaaatgatgaaaccccatctctaataaaaatacaaaaaaattagccaggcatggtggtagtacctgtaatttcagctactcgggaggctgaggcagaagaatggcttgaaccctggaggcagaggttgcagtgagccgagaccgcaccactgtactgcagcctgggcaacaagagcgaaactacgtcaaa

SEQ ID NO: 418526 - DNA, 2497 bp, Homo sapiens
  misc_feature (34)..(34): n is a, c, g, or t
  misc_feature (117)..(117): n is a, c, g, or t
  misc_feature (139)..(139): n is a, c, g, or t
  misc_feature (155)..(155): n is a, c, g, or t
  misc_feature (172)..(172): n is a, c, g, or t
  misc_feature (187)..(187): n is a, c, g, or t
gcggctccggggtgcctgatcccagcctcgcgcncccgggttggtggtgacgcctggaatcaggcaggcgtagctggactgggctcttgggccagccaggcgccactgccattgtcnacggccataccacctggaaaangagagagacccaagcngcggcccgtgggcacgntcagcgccactgctnctgccacagtgaggggcgcactctacaactttcagggcccacagcaccaagaggacagggaggagccaacaaaggaatgacgctacgaaaagcacccccaaagcaaccaacaaatccaagtaaaaacacgtctcagggctccgttggttttcccgcgtgggcggccctgcccccatgttccagcccagcccaggcaccctccaccctaccctggccaaaggggcccctgtctaccagatagagcctccctctccaaggctctgttgctctccctctctagctccctcaccctttccctttctctacttccctctccaccttgctctctctctctctctctcaatctccccagttcctctctgtctctctctccatcgctgtttctctccttccgtttctatttctcatccctctgtcccttgctctccttcaagttgtctgtgtctttgtgtgtctgtgtgtgtgcttgtgttcccgcgcgtgcgcccgtgtgtgtctgtgtgtttgggagtgggtttgctagtgattgtggtggggtgtgtctggatgtccatcagtacctttgtcccaggatcaggctgccaactctattgccaacgcctgggtgtcacagttgccgtgatagtctcacacacgcagttgtgttcatctcgttcgttttcacgtagacaacgagagcgaaaccacagagaaaagaaacatcccgtgcatcacggcctgatgatggattcctgtttcctgcaaaatggggagtctccaatatagcctgtttgaaaactggaaaggagagcaccgacacgatgctggtcttccacgcattcctggaagtttctggggccccacagagctcgcgaaacagtcaacatggtcacgctttcggggggcagaaacttgagcaacaggcacctttacagagggcaaagaaacgtggaatccagaatcacgcttcagttggcctgagtgtgactcctgtgtggatgggactatccgcctcgagctctgttgcagggctcaacgtggggatatgtcatctgtgaaccatgtggatgaaaaacagacaactacctgggtctcggctcattgctctctggggaattcgctcattccttcggaaacggaattggtctgaattgctccgggacgaagtaacccaggctggtgatccagagggccgctgagcgccccgccggccaacggggctgtgggcccagcactcagcctgtactgggcacccaacattttcccggagttctgggtcctgttggttctggaggcataagaccgtttttgtctctgccttccgttctctgcttcttgctccttttgtcccttggtccatccttccatctgttcttccctccctcccctggctttttcctccctttctccctccctccctctttctctcccttccggggtccctccttccacccatccttgcctagctccatccttccatctcactctgtctccgttcctgtcctcatctctgcctgccttccctcttgcctggaaagggcagcaccctggtttgcgcgaggtctggggtctttatttagttgcaaggcgctctatggtgctggcgaggaggctggcgggacacgggttggcaactgatggtgagcgaagaggcggaggagtcgagccgcagaaaggagaactggcctggcttctgccccggcccagtgtttcgcggactgaggtctccgccaacccgattgaagaacgcagggggaaaagggatgagagctccgcctgggctagttagaaaactaggctgctgcctggaaacccgcgcatgcgcagtagacagcctacctccctgtacctggaccagccctgggatccccgggatgctcaggaatgctttcttgtcattgttgacagccctcctctgtgtggagtctctcgctggacctggaactcagggatcctaggcaggtcagctggaagggaagacacgcctctccacaccaagcctgaggttcaccgcgaaagagaggccgccaccctgccccaaacccgccccaacctgctcctccagcagagccctgtgttcttcctggctgaggagtggttccagcaaagcgggctcttccacgtccttcagctcccccagtggcgccggatctaggaaaggttgtgccttttgctgaaactctggggttgacaggagctcatctaacaggctggagctactcgggaggctgaggcagaagaatggcttgaaccctggaggcagaggttgcagtgagccgagaccgcaccactgtactgcagcctgggcaacaagagcgaaactacgtcaaa

SEQ ID NO: 418527 - DNA, 3662 bp, Homo sapiens
  misc_feature (34)..(34): n is a, c, g, or t
  misc_feature (117)..(117): n is a, c, g, or t
  misc_feature (139)..(139): n is a, c, g, or t
  misc_feature (155)..(155): n is a, c, g, or t
  misc_feature (172)..(172): n is a, c, g, or t
  misc_feature (187)..(187): n is a, c, g, or t
gcggctccggggtgcctgatcccagcctcgcgcncccgggttggtggtgacgcctggaatcaggcaggcgtagctggactgggctcttgggccagccaggcgccactgccattgtcnacggccataccacctggaaaangagagagacccaagcngcggcccgtgggcacgntcagcgccactgctnctgccacagtgaggggcgcactctacaactttcagggcccacagcaccaagaggacagggaggagccaacaaaggaatgacgctacgaaaagcacccccaaagcaaccaacaaatccaagtaaaaacacgtctcagggctccgttggttttcccgcgtgggcggccctgcccccatgttccagcccagcccaggcaccctccaccctaccctggccaaaggggcccctgtctaccagatagagcctccctctccaaggctctgttgctctccctctctagctccctcaccctttccctttctctacttccctctccaccttgctctctctctctctctctcaatctccccagttcctctctgtctctctctccatcgctgtttctctccttccgtttctatttctcatccctctgtcccttgctctccttcaagttgtctgtgtctttgtgtgtctgtgtgtgtgcttgtgttcccgcgcgtgcgcccgtgtgtgtctgtgtgtttgggagtgggtttgctagtgattgtggtggggtgtgtctggatgtccatcagtacctttgtcccaggatcaggctgccaactctattgccaacgcctgggtgtcacagttgccgtgatagtctcacacacgcagttgtgttcatctcgttcgttttcacgtagacaacgagagcgaaaccacagagaaaagaaacatcccgtgcatcacggcctgatgatggattcctgtttcctgcaaaatggggagtctccaatatagcctgtttgaaaactggaaaggagagcaccgacacgatgctggtcttccacgcattcctggaagtttctggggccccacagagctcgcgaaacagtcaacatggtcacgctttcggggggcagaaacttgagcaacaggcacctttacagagggcaaagaaacgtggaatccagaatcacgcttcagttggcctgagtgtgactcctgtgtggatgggactatccgcctcgagctctgttgcagggctcaacgtggggatatgtcatctgtgaaccatgtggatgaaaaacagacaactacctgggtctcggctcattgctctctggggaattcgctcattccttcggaaacggaattggtctgaattgctccgggacgaagtaacccaggctggtgatccagagggccgctgagcgccccgccggccaacggggctgtgggcccagcactcagcctgtactgggcacccaacattttcccggagttctgggtcctgttggttctggaggcataagaccgtttttgtctctgccttccgttctctgcttcttgctccttttgtcccttggtccatccttccatctgttcttccctccctcccctggctttttcctccctttctccctccctccctctttctctcccttccggggtccctccttccacccatccttgcctagctccatccttccatctcactctgtctccgttcctgtcctcatctctgcctgccttccctcttgcctggaaagggcagcaccctggtttgcgcgaggtctggggtctttatttagttgcaaggcgctctatggtgctggcgaggaggctggcgggacacgggttggcaactgatggtgagcgaagaggcggaggagtcgagccgcagaaaggagaactggcctggcttctgccccggcccagtgtttcgcggactgaggtctccgccaacccgattgaagaacgcagggggaaaagggatgagagctccgcctgggctagttagaaaactaggctgctgcctggaaacccgcgcatgcgcagtagacagcctacctccctgtacctggaccagccctgggatccccgggatgctcaggaatgctttcttgtcattgttgacagccctcctctgtgtggagtctctcgctggacctggaactcagggatcctaggcaggtcagctggaagggaagacacgcctctccacaccaagcctgaggttcaccgcgaaagagaggccgccaccctgccccaaacccgccccaacctgctcctccagcagagccctgtgttcttcctggctgaggagtggttccagcaaagcgggctcttccacgtccttcagctcccccagtggcgccggatctaggaaaggttgtgccttttgctgaaactctggggttgacaggagctcatctaacaggctggaggtgagtgcagaggagagccccggctcctggagcggttgggaggtgcccggttggctggcatctgtgcttgacgcggaggcctccggggtcacgagctccggaggtgaaggtgccccgtcttcgggttcccatgccgccctggcgacctgcggctccagccccaccacggactccggtgggacgtgggtggcgcaagcacacctttcccctgtgactcagcttgaggggccccaaggtgtcccactgagcacgcgcccagcaggccatcgcgctgcgggttctggtcttcctgtcatttgttggggttcggaggccaccagggagtctgaggatgggagagccccagtttcggaggggccagggcagtgaacacaaagccccgcatgcccgggcaggttgggagagtccttctgcctgcgcagcctggctgggctggagcagggggatggcccttgctgcctggctcacgaaagccccctgtgggagagccccaggagcgcagggcatgtggggtgcaggaagcgcctttccccacgccccggtgtaggtgaactcgatagaggagggaggagggtgacacccaccaggggtgctaattagtaaccacagtggcctcaaagaactcaaatgaaaggaagacttgcaagtctctcactttaagtccagagctagaaatgattaagcttagtgaagatgcagaattttcatagctagagagaagtcaacgcttggcttcaaaacttcaaaggatgggctgactctctttgaggagcactgcagctggtgactttaagttacagccagtgctcattgaccactctgaaaatctcagggcccttaagaattatgcaaaatctattctttctgtgctctagaaatggaacatcactgtctgggtgacagcacatctgttaatagcatggtttactgaatattttaatcccactattgagaactgctcagaaaaaaaaaaaaccgattcttttaaaaagattgttggttggccaggcatagtggctcatacttgtaatccctgcactttgggaggccgaggatcacctgaggtcaggagttcaagaccagcctggccaaaatgatgaaaccccatctctaataaaaatacaaaaaaattagccaggcatggtggtagtacctgtaatttcagctactcgggaggctgaggcagaagaatggcttgaaccctggaggcagaggttgcagtgagccgagaccgcaccactgtactgcagcctgggcaacaagagcgaaactacgtcaaa

SEQ ID NO: 418528 - DNA, 2733 bp, Homo sapiens
  misc_feature (34)..(34): n is a, c, g, or t
  misc_feature (117)..(117): n is a, c, g, or t
  misc_feature (139)..(139): n is a, c, g, or t
  misc_feature (155)..(155): n is a, c, g, or t
  misc_feature (172)..(172): n is a, c, g, or t
  misc_feature (187)..(187): n is a, c, g, or t
gcggctccggggtgcctgatcccagcctcgcgcncccgggttggtggtgacgcctggaatcaggcaggcgtagctggactgggctcttgggccagccaggcgccactgccattgtcnacggccataccacctggaaaangagagagacccaagcngcggcccgtgggcacgntcagcgccactgctnctgccacagtgaggggcgcactctacaactttcagggcccacagcaccaagaggacagggaggagccaacaaaggaatgacgctacgaaaagcacccccaaagcaaccaacaaatccaagtaaaaacacgtctcagggctccgttggttttcccgcgtgggcggccctgcccccatgttccagcccagcccaggcaccctccaccctaccctggccaaaggggcccctgtctaccagatagagcctccctctccaaggctctgttgctctccctctctagctccctcaccctttccctttctctacttccctctccaccttgctctctctctctctctctcaatctccccagttcctctctgtctctctctccatcgctgtttctctccttccgtttctatttctcatccctctgtcccttgctctccttcaagttgtctgtgtctttgtgtgtctgtgtgtgtgcttgtgttcccgcgcgtgcgcccgtgtgtgtctgtgtgtttgggagtgggtttgctagtgattgtggtggggtgtgtctggatgtccatcagtacctttgtcccaggatcaggctgccaactctattgccaacgcctgggtgtcacagttgccgtgatagtctcacacacgcagttgtgttcatctcgttcgttttcacgtagacaacgagagcgaaaccacagagaaaagaaacatcccgtgcatcacggcctgatgatggattcctgtttcctgcaaaatggggagtctccaatatagcctgtttgaaaactggaaaggagagcaccgacacgatgctggtcttccacgcattcctggaagtttctggggccccacagagctcgcgaaacagtcaacatggtcacgctttcggggggcagaaacttgagcaacaggcacctttacagagggcaaagaaacgtggaatccagaatcacgcttcagttggcctgagtgtgactcctgtgtggatgggactatccgcctcgagctctgttgcagggctcaacgtggggatatgtcatctgtgaaccatgtggatgaaaaacagacaactacctgggtctcggctcattgctctctggggaattcgctcattccttcggaaacggaattggtctgaattgctccgggacgaagtaacccaggctggtgatccagagggccgctgagcgccccgccggccaacggggctgtgggcccagcactcagcctgtactgggcacccaacattttcccggagttctgggtcctgttggttctggaggcataagaccgtttttgtctctgccttccgttctctgcttcttgctccttttgtcccttggtccatccttccatctgttcttccctccctcccctggctttttcctccctttctccctccctccctctttctctcccttccggggtccctccttccacccatccttgcctagctccatccttccatctcactctgtctccgttcctgtcctcatctctgcctgccttccctcttgcctggaaagggcagcaccctggtttgcgcgaggtctggggtctttatttagttgcaaggcgctctatggtgctggcgaggaggctggcgggacacgggttggcaactgatggtgagcgaagaggcggaggagtcgagccgcagaaaggagaactggcctggcttctgccccggcccagtgtttcgcggactgaggtctccgccaacccgattgaagaacgcagggggaaaagggatgagagctccgcctgggctagttagaaaactaggctgctgcctggaaacccgcgcatgcgcagtagacagcctacctccctgtacctggaccagccctgggatccccgggatgctcaggaatgctttcttgtcattgttgacagccctcctctgtgtggagtctctcgctggacctggaactcagggatcctaggcaggtcagctggaagggaagacacgcctctccacaccaagcctgaggttcaccgcgaaagagaggccgccaccctgccccaaacccgccccaacctgctcctccagcagagccctgtgttcttcctggctgaggagtggttccagcaaagcgggctcttccacgtccttcagctcccccagtggcgccggatctaggaaaggttgtgccttttgctgaaactctggggttgacaggagctcatctaacaggctggaggcccataggtggaagggacttgccttgtctcggatgagactttggactttggactgtggacttttgagttaacactgaaatgaattaatgctgaaatgaattgagactttgggagacggttgagaagccatgactcattttaaacatgtgagacatgcctttcaccttctgccatgattgtgaggcctctccagccatgtggaactgtgaacacaacagtgttcatcccctcaggaggacacagctttgaggtaccatcttggaagcagagaacaggccctcactagaaacaaaacttcctggcacgttgaatttggacttcatagcctctaaaactgtgctgggaagaca

SEQ ID NO: 418529 - DNA, 446 bp, Homo sapiens
gcctgggccattccaggtttccctgtcaccaggacctgtaaacctggcctgcccatggggacgccagctggggatacccgtttctctagcttggagccaccaagatagaggacaaacacttctgtgattcagtccccagactgtctctgacttaatcccttgggttcaagccctatgtgggagagcaagggcacacactgcctaatccgtggtgtcccccccaggacaatggcgtctcttggccacatcttggttttctgtgtgggtctcctcaccatggccaaggcagaaagtccaaaggaacacgacccgttcacttacgactaccagtccctgcagatcggaggcctcgtcatcgccgggatcctcttcatcctgggcatcctcatcgtgctgagtgagtgcccctagctcccgccctctaccccgcctctccctggccccac

SEQ ID NO: 418530 - DNA, 602 bp, Homo sapiens
ctgggccagggggtccaaagtgctcagcccccggggcacagcaggacgtttgggggccttctttcagcaggggacagcccgattggggacaatggcgtctcttggccacatcttggttttctgtgtgggtctcctcaccatggccaaggcagaaagtccaaaggaacacgacccgttcacttacgactaccagtccctgcagatcggaggcctcgtcatcgccgggatcctcttcatcctgggcatcctcatcgtgctgagcagaagatgccggtgcaagttcaaccagcagcagaggactggggaacccgatgaagaggagggaactttccgcagctccatccgccgtctgtccacccgcaggcggtagaaacacctggagcgatggaatccggccaggactcccctggcacctgacatctcccacgctccacctgcgcgcccaccgccccctccgccgccccttccccagccctgcccccgcagactccccctgccgccaagacttccaataaaacgtgcgttcctctcgacaaaacgaagggaataccagcacaaggacataacaaatagaaaaaagaaaatatacaccaagaatcaac

SEQ ID NO: 418531 - DNA, 739 bp, Homo sapiens
gcctgggccattccaggtttccctgtcaccaggacctgtaaacctggcctgcccatggggacgccagctggggatacccgtttctctagcttggagccaccaagatagaggacaaacacttctgtgattcagtccccagactgtctctgacttaatcccttgggttcaagccctatgtgggagagcaagggcacacactgcctaatccgtggtgtcccccccaggacaatggcgtctcttggccacatcttggttttctgtgtgggtctcctcaccatggccaaggcagaaagtccaaaggaacacgacccgttcacttacgactaccagtccctgcagatcggaggcctcgtcatcgccgggatcctcttcatcctgggcatcctcatcgtgctgagcagaagatgccggtgcaagttcaaccagcagcagaggactggggaacccgatgaagaggagggaactttccgcagctccatccgccgtctgtccacccgcaggcggtagaaacacctggagcgatggaatccggccaggactcccctggcacctgacatctcccacgctccacctgcgcgcccaccgccccctccgccgccccttccccagccctgcccccgcagactccccctgccgccaagacttccaataaaacgtgcgttcctctcgacaaaacgaagggaataccagcacaaggacataacaaatagaaaaaagaaaatatacaccaagaatcaac

SEQ ID NO: 418532 - DNA, 1459 bp, Homo sapiens
gatgaaatagtagtaatgtttatactcactcagccttcacagccaccctgtgagatgggcagtactgctatccctgctttacagatggggaaactgaggcacagggaagttatgtgattagtttcctggctctagtcagctctaaacctaacccctaggctgtaccacctcatcgcctggggacgagactcatcctgtgattgaggaatgcatgcagcctctcttgacactgacgcccacgcccagaagcctcgttggaggataagggggcttaacagcttggaggtcatgcagatctgggttccaggcccagtcctgtgtggcctcagttttcccatctgtcaaacggggacaatcgtggcacccgcttcccagttgtggagaggactcaggtgatggaggcaactcatccttttggggttcagcacaaggtgggcatcccacagtggtcggcaagcttgggggtgggctccggatccagctcctagaggagcagaccccagcagcttgtggtttgagccatgcccgtcagctctcagtttccttcactgactattgggtatgataaacagggtccctgacatccgattgtgaaagatgtcacccagaggcgggcagaggggctgtcttttccttttctcgttgctgcccagggaggagacggggtggcctttcccacaggggcagcctgtggcgatgtggcagctgggcctcaccccggcaggcttgtgcgtgaccccctgagtgggggaaggcaggctgttgcatggtggcctgagcgagcagaattcctccagggacaatggcgtctcttggccacatcttggttttctgtgtgggtctcctcaccatggccaaggcagaaagtccaaaggaacacgacccgttcacttacgactaccagtccctgcagatcggaggcctcgtcatcgccgggatcctcttcatcctgggcatcctcatcgtgctgagcagaagatgccggtgcaagttcaaccagcagcagaggactggggaacccgatgaagaggagggaactttccgcagctccatccgccgtctgtccacccgcaggcggtagaaacacctggagcgatggaatccggccaggtgctgcagctctgacacggcggtgggagggaaggagggaggaaggaaaggcgggagagggagggggccaagtgccagagttgaagggcggcgaggggtggtggctggacgtcccccctcgcctctcacccttttcaccctcacaggactcccctggcacctgacatctcccacgctccacctgcgcgcccaccgccccctccgccgccccttccccagccctgcccccgcagactccccctgccgccaagacttccaataaaacgtgcgttcctctcgacaaaacgaagggaataccagcacaaggacataacaaatagaaaaaagaaaatatacaccaagaatcaac

SEQ ID NO: 418533 - DNA, 701 bp, Homo sapiens
tgcctgcgtctgtctcagcatctcgtggcccatcctctgcttcttcccgtcttctctcccccctgtcctcctcctccctgtcccctccctccctttcctatacacccctttcctctccctggtaccccactttcctcctcccatatctgctcccccttaattatcttacttccccccttctgcctgctggtcctttctccctgttccctccttcccaatttacccctctcctattctccctcctgtcttccctgccctcaccttccctgctctgctgctcacagactaccagtccctgcagatcggaggcctcgtcatcgccgggatcctcttcatcctgggcatcctcatcgtgctgagcagaagatgccggtgcaagttcaaccagcagcagaggactggggaacccgatgaagaggagggaactttccgcagctccatccgccgtctgtccacccgcaggcggtagaaacacctggagcgatggaatccggccaggactcccctggcacctgacatctcccacgctccacctgcgcgcccaccgccccctccgccgccccttccccagccctgcccccgcagactccccctgccgccaagacttccaataaaacgtgcgttcctctcgacaaaacgaagggaataccagcacaaggacataacaaatagaaaaaagaaaatatacaccaagaatcaac

SEQ ID NO: 418534 - DNA, 364 bp, Homo sapiens
tcctacctctccacgcccacaggcagaagatgccggtgcaagttcaaccagcagcagaggactggggaacccgatgaagaggagggaactttccgcagctccatccgccgtctgtccacccgcaggcggtagaaacacctggagcgatggaatccggccaggactcccctggcacctgacatctcccacgctccacctgcgcgcccaccgccccctccgccgccccttccccagccctgcccccgcagactccccctgccgccaagacttccaataaaacgtgcgttcctctcgacaaaacgaagggaataccagcacaaggacataacaaatagaaaaaagaaaatatacaccaagaatcaac

SEQ ID NO: 418535 - DNA, 756 bp, Homo sapiens
ctcgatgctggggaacccaggacatgctgaacccacagccccatctgccacagagggaacctcacgatacaaatacaaagttaccctcgatgttggggaacccaggacatgctgatctcacaggatggcgactgcatggcgcagccgcgtggaaggaggcagaagaaggagaagtgcgcctgggtgcgcacccaggcgcacttctgggggccttctttcagcaggggacagcccgattggggacaatggcgtctcttggccacatcttggttttctgtgtgggtctcctcaccatggccaaggcagaaagtccaaaggaacacgacccgttcacttacgactaccagtccctgcagatcggaggcctcgtcatcgccgggatcctcttcatcctgggcatcctcatcgtgctgagcagaagatgccggtgcaagttcaaccagcagcagaggactggggaacccgatgaagaggagggaactttccgcagctccatccgccgtctgtccacccgcaggcggtagaaacacctggagcgatggaatccggccaggactcccctggcacctgacatctcccacgctccacctgcgcgcccaccgccccctccgccgccccttccccagccctgcccccgcagactccccctgccgccaagacttccaataaaacgtgcgttcctctcgacaaaacgaagggaataccagcacaaggacataacaaatagaaaaaagaaaatatacaccaagaatcaac

SEQ ID NO: 418536 - DNA, 630 bp, Homo sapiens
tgtgtagggctggttgcgtcactgcgtgggggcaccggaggcccagaggaggagtattggatgcctgacggtgtttacaccccacgtcctgctccaaccagcagtttggggagaggacaatggcgtctcttggccacatcttggttttctgtgtgggtctcctcaccatggccaaggcagaaagtccaaaggaacacgacccgttcacttacgactaccagtccctgcagatcggaggcctcgtcatcgccgggatcctcttcatcctgggcatcctcatcgtgctgagcagaagatgccggtgcaagttcaaccagcagcagaggactggggaacccgatgaagaggagggaactttccgcagctccatccgccgtctgtccacccgcaggcggtagaaacacctggagcgatggaatccggccaggactcccctggcacctgacatctcccacgctccacctgcgcgcccaccgccccctccgccgccccttccccagccctgcccccgcagactccccctgccgccaagacttccaataaaacgtgcgttcctctcgacaaaacgaagggaataccagcacaaggacataacaaatagaaaaaagaaaatatacaccaagaatcaac

SEQ ID NO: 418537 - DNA, 1087 bp, Homo sapiens
gatgaaatagtagtaatgtttatactcactcagccttcacagccaccctgtgagatgggcagtactgctatccctgctttacagatggggaaactgaggcacagggaagttatgtgattagtttcctggctctagtcagctctaaacctaacccctaggctgtaccacctcatcgcctggggacgagactcatcctgtgattgaggaatgcatgcagcctctcttgacactgacgcccacgcccagaagcctcgttggaggataagggggcttaacagcttggaggtcatgcagatctgggttccaggcccagtcctgtgtggcctcagttttcccatctgtcaaacggggacaatcgtggcacccgcttcccagttgtggagaggactcaggtgatggaggcaactcatccttttggggttcagcacaaggtgggcatcccacagtggtcggcaagcttgggggtgggctccggatccagctcctgacatccgattgtgaaagatgtcacccagaggcgggcagaggggctgtcttttccttttctcgttgctgcccagggaggagacggggtggcctttcccacaggggcagcctgtggcgatgtggcagctgggcctcaccccggcaggcttgtgcgtgacccccttccctgctctgctgctcacagactaccagtccctgcagatcggaggcctcgtcatcgccgggatcctcttcatcctgggcatcctcatcgtgctgagcagaagatgccggtgcaagttcaaccagcagcagaggactggggaacccgatgaagaggagggaactttccgcagctccatccgccgtctgtccacccgcaggcggtagaaacacctggagcgatggaatccggccaggactcccctggcacctgacatctcccacgctccacctgcgcgcccaccgccccctccgccgccccttccccagccctgcccccgcagactccccctgccgccaagacttccaataaaacgtgcgttcctctcgacaaaacgaagggaataccagcacaaggacataacaaatagaaaaaagaaaatatacaccaagaatcaac

SEQ ID NO: 418538 - DNA, 1313 bp, Homo sapiens
gatgaaatagtagtaatgtttatactcactcagccttcacagccaccctgtgagatgggcagtactgctatccctgctttacagatggggaaactgaggcacagggaagttatgtgattagtttcctggctctagtcagctctaaacctaacccctaggctgtaccacctcatcgcctggggacgagactcatcctgtgattgaggaatgcatgcagcctctcttgacactgacgcccacgcccagaagcctcgttggaggataagggggcttaacagcttggaggtcatgcagatctgggttccaggcccagtcctgtgtggcctcagttttcccatctgtcaaacggggacaatcgtggcacccgcttcccagttgtggagaggactcaggtgatggaggcaactcatccttttggggttcagcacaaggtgggcatcccacagtggtcggcaagcttgggggtgggctccggatccagctcctagaggagcagaccccagcagcttgtggtttgagccatgcccgtcagctctcagtttccttcactgactattgggtatgataaacagggtccctgacatccgattgtgaaagatgtcacccagaggcgggcagaggggctgtcttttccttttctcgttgctgcccagggaggagacggggtggcctttcccacaggggcagcctgtggcgatgtggcagctgggcctcaccccggcaggcttgtgcgtgaccccctgagtgggggaaggcaggctgttgcatggtggcctgagcgagcagaattcctccagggacaatggcgtctcttggccacatcttggttttctgtgtgggtctcctcaccatggccaaggcagaaagtccaaaggaacacgacccgttcacttacgactaccagtccctgcagatcggaggcctcgtcatcgccgggatcctcttcatcctgggcatcctcatcgtgctgagcagaagatgccggtgcaagttcaaccagcagcagaggactggggaacccgatgaagaggagggaactttccgcagctccatccgccgtctgtccacccgcaggcggtagaaacacctggagcgatggaatccggccaggactcccctggcacctgacatctcccacgctccacctgcgcgcccaccgccccctccgccgccccttccccagccctgcccccgcagactccccctgccgccaagacttccaataaaacgtgcgttcctctcgacaaaacgaagggaataccagcacaaggacataacaaatagaaaaaagaaaatatacaccaagaatcaac

SEQ ID NO: 418539 - DNA, 803 bp, Homo sapiens
acttccctcaacccttcccacaaactgggaggaaaactgagacctcctggtcacccgccgccgggccttttagaaactcccacaagctctgccttccctccctggtcctcttcagaccccctcttagttcttcgcggctaacggctcgcgctcggggcagggtgtggagctggaacagagggctggcaaggcgcgcatgcgcaccgagggtggagccgctgagcacagaaccggaaacttagagacaaagttcggagccccgcccccgccgcgcgccgctgagttgtctggccccgccgacccacggcccacgacccaccgacccacgaatcggcccggccgtcgcgtgcaccatgtctggctcctccagcgtcgccgctatgaagaaagtggttcaacagctccggctggaggccggactcaaccgcgtaaaagtttcccaggcagctgcagacttgaaacagttctgtctgcagaatgctcaacatgaccctctgctgactggagtatcttcaagtacaaatcccttcagaccccagaaagtctgttcctttttgtagtaaaatgaatctttcaaaggtttcccaaaccactccttatgatccagtgaatattcaagagagctacatttgaagcctgtacaaaagcttatccctgtaacacatgtgccataatatacaaacttctactttcgtcagtccttaacatctacctctctgaattttcatgaatttctatttcacaagggtaattgttttatatacactggcagcagcatacaataaaacttagtatgaaacttt

SEQ ID NO: 418540 - DNA, 937 bp, Homo sapiens
acttccctcaacccttcccacaaactgggaggaaaactgagacctcctggtcacccgccgccgggccttttagaaactcccacaagctctgccttccctccctggtcctcttcagaccccctcttagttcttcgcggctaacggtaagctctctccttacctctccctaatccgcccctctggagaggaaaagaaaacttaacagtcgggtcgcgctagcctccagcagccgccgcgcccaccgactgctccgccccttctcctccccctcctccaggctcgcgctcggggcagggtgtggagctggaacagagggctggcaaggcgcgcatgcgcaccgagggtggagccgctgagcacagaaccggaaacttagagacaaagttcggagccccgcccccgccgcgcgccgctgagttgtctggccccgccgacccacggcccacgacccaccgacccacgaatcggcccggccgtcgcgtgcaccatgtctggctcctccagcgtcgccgctatgaagaaagtggttcaacagctccggctggaggccggactcaaccgcgtaaaagtttcccaggcagctgcagacttgaaacagttctgtctgcagaatgctcaacatgaccctctgctgactggagtatcttcaagtacaaatcccttcagaccccagaaagtctgttcctttttgtagtaaaatgaatctttcaaaggtttcccaaaccactccttatgatccagtgaatattcaagagagctacatttgaagcctgtacaaaagcttatccctgtaacacatgtgccataatatacaaacttctactttcgtcagtccttaacatctacctctctgaattttcatgaatttctatttcacaagggtaattgttttatatacactggcagcagcatacaataaaacttagtatgaaacttt

SEQ ID NO: 418541 - DNA, 557 bp, Homo sapiens
ttattcattttactacagagcaccttgtctgtcattttctctgaactgttagctccataacaacagggctctggctgttcttatgtattcttagtgcctgtaagtatatgcggcacatagtggtgcttgaaaattgtgaaagcgagttacattggaccccacctacactttaaacagaaaattaacaggtttcccaggcagctgcagacttgaaacagttctgtctgcagaatgctcaacatgaccctctgctgactggagtatcttcaagtacaaatcccttcagaccccagaaagtctgttcctttttgtagtaaaatgaatctttcaaaggtttcccaaaccactccttatgatccagtgaatattcaagagagctacatttgaagcctgtacaaaagcttatccctgtaacacatgtgccataatatacaaacttctactttcgtcagtccttaacatctacctctctgaattttcatgaatttctatttcacaagggtaattgttttatatacactggcagcagcatacaataaaacttagtatgaaacttt

SEQ ID NO: 418542 - DNA, 433 bp, Homo sapiens
ggacgcgtgggtccggacgcgtgggcaacagctccggctggaggccggactcaaccgcgtaaaagtttcccaggcagctgcagacttgaaacagttctgtctgcagaatgctcaacatgaccctctgctgactggagtatcttcaagtacaaatcccttcagaccccagaaagtctgttcctttttgtagtaaaatgaatctttcaaaggtttcccaaaccactccttatgatccagtgaatattcaagagagctacatttgaagcctgtacaaaagcttatccctgtaacacatgtgccataatatacaaacttctactttcgtcagtccttaacatctacctctctgaattttcatgaatttctatttcacaagggtaattgttttatatacactggcagcagcatacaataaaacttagtatgaaacttt

SEQ ID NO: 418543 - DNA, 408 bp, Homo sapiens
  misc_feature (1)..(1): n is a, c, g, or t
  misc_feature (14)..(14): n is a, c, g, or t
ncctatggggactngactctcttccttaacgccgcacaggtttcccaggcagctgcagacttgaaacagttctgtctgcagaatgctcaacatgaccctctgctgactggagtatcttcaagtacaaatcccttcagaccccagaaagtctgttcctttttgtagtaaaatgaatctttcaaaggtttcccaaaccactccttatgatccagtgaatattcaagagagctacatttgaagcctgtacaaaagcttatccctgtaacacatgtgccataatatacaaacttctactttcgtcagtccttaacatctacctctctgaattttcatgaatttctatttcacaagggtaattgttttatatacactggcagcagcatacaataaaacttagtatgaaacttt

SEQ ID NO: 418544 - DNA, 1220 bp, Homo sapiens
acttccctcaacccttcccacaaactgggaggaaaactgagacctcctggtcacccgccgccgggccttttagaaactcccacaagctctgccttccctccctggtcctcttcagaccccctcttagttcttcgcggctaacggctcgcgctcggggcagggtgtggagctggaacagagggctggcaaggcgcgcatgcgcaccgagggtggagccgctgagcacagaaccggaaacttagagacaaagttcggagccccgcccccgccgcgcgccgctgagttgtctggccccgccgacccacggcccacgacccaccgacccacgaatcggcccggccgtcgcgtgcaccatgtctggctcctccagcgtcgccgctatgaagaaagtggttcaacagctccggctggaggccggactcaaccgcgtaaaagtttcccaggcagctgcagacttgaaacagttctgtctgcagaatgctcaacatgaccctctgctgactggagtatcttcaagtacaaatcccttcagaccccagaaagtctgttcctttttgtagtaaaatgaatctttcaaaggtttcccaaaccactccttatgatccagtgaatattcaagagagctacatttgaagcctgtacaaaagcttatccctgtaacacatgtgccataatatacaaacttctactttcgtcagtccttaacatctacctctctgaattttcatgaatttctatttcacaagggtaattgttttatatacactggcagcagcatacaataaaacttagtatgaaactttaaaaaaaaaaaaaaaaaaaaaaaaaaaaaaaaaagcgggggcttagggggggggggggaaaaaggggttgaaagggggggggactaggtgtttcgtgggaccccattttttgggtaccgaggggcgaaatcgggcgaccgccagaagggggccataaacggtggggagagggcagtggacgtctaggtgccgcccaacaacggaggcgaagagaagcagcaagcgcggggaccataccaggtctcaccagactgtccgaacaccagcagacggatagcgctacacacaagaaacatagagaacggacgaatgctacgaaggacagaaacgagacgacgggggaaagcacgagagaagaaggcagagcaaggtgacgaggcacagacgaggaaggagcgaggcaaagcaacgaagtat

SEQ ID NO: 418545 - DNA, 1282 bp, Homo sapiens
acttccctcaacccttcccacaaactgggaggaaaactgagacctcctggtcacccgccgccgggccttttagaaactcccacaagctctgccttccctccctggtcctcttcagaccccctcttagttcttcgcggctaacggctcgcgctcggggcagggtgtggagctggaacagagggctggcaaggcgcgcatgcgcaccgagggtggagccgctgagcacagaaccggaaacttagagacaaagttcggagccccgcccccgccgcgcgccgctgagttgtctggccccgccgacccacggcccacgacccaccgacccacgaatcggcccggccgtcgcgtgcaccatgtctggctcctccagcgtcgccgctatgaagaaagtggttcaacagctccggctggaggccggactcaaccgcgtaaaagtttcccaggcagctgcagacttgaaacagttctgtctgcagaatgctcaacatgaccctctgctgactggagtatcttcaagtacaaatcccttcagaccccagaaagtctgttcctttttgtagtaaaatgaatctttcaaaggtttcccaaaccactccttatgatccagtgaatattcaagagagctacatttgaagcctgtacaaaagcttatccctgtaacacatgtgccataatatacaaacttctactttcgtcagtccttaacatctacctctctgaattttcatgaatttctatttcacaagggtaattgttttatatacactggcagcagcatacaataaaacttagtatgaaactttattttgcattattattggtattaaatacatggtatattaatctgttctgaacacctgaaggggttaagtttgtacagttttttccacctactcttctcacatgactttatgccatacatctggcaagactgctagggaattaaaggtaaactgtgaacctttattcttttaaggtcaggaggaggctgttaagttctacgggtttccatccatgagttacttatagggttaactttgtttcagtgcctgaatggagtactacagcaccatgtaatgaggtaaaaaagagctccccacaacgtgggcacaaaaaaccaaaaacctcaaaatcaggaagcaaagattagcttcagtaatttgcaactttgctttaaaccctggtagatcattttgctttaaattttttacccttctgaaggcttaagagaatgttaaaacatccagaaacctggcctccatttaagctattaaaactgtgc

SEQ ID NO: 418546 - DNA, 881 bp, Homo sapiens
acttccctcaacccttcccacaaactgggaggaaaactgagacctcctggtcacccgccgccgggccttttagaaactcccacaagctctgccttccctccctggtcctcttcagaccccctcttagttcttcgcggctaacggctcgcgctcggggcagggtgtggagctggaacagagggctggcaaggcgcgcatgcgcaccgagggtggagccgctgagcacagaaccggaaacttagagacaaagttcggagccccgcccccgccgcgcgccgctgagttgtctggccccgccgacccacggcccacgacccaccgacccacgaatcggcccggccgtcgcgtgcaccatgtctggctcctccagcgtcgccgctatgaagaaagtggttcaacagctccggctggaggccggactcaaccgcgtaaaagtttcccaggcagctgcagacttgaaacagttctgtctgcagaatgctcaacatgaccctctgctgactggagtatcttcaagtacaaatcccttcagaccccagaaagtctgttcctttttgtagtaaaatgaatctttcaaaggtttcccaaaccactccttatgatccagtgaatattcaagagagctacatttgaagcctgtacaaaagcttatccctgtaacacatgtgccataatatacaaacttctactttcgtcagtccttaacatctacctctctgaattttcatgaatttctatttcacaagggtaattgttttatatacactggcagcagcatacaataaaacttagtatgaaactttaaagaaaaaacaaaaagagaagccctctttagcaagccaggaattcaaaagaaaaaaaatggcctcgttgtgcctaaa

SEQ ID NO: 418547 - DNA, 527 bp, Homo sapiens
  misc_feature (8)..(8): n is a, c, g, or t
ggctgacntagcgtttacccccgtccgatggcccacgacccaccgacccacgaatcggcccggccgtcgcgtgcaccatgtctggctcctccagcgtcgccgctatgaagaaagtggttcaacagctccggctggaggccggactcaaccgcgtaaaagtttcccaggcagctgcagacttgaaacagttctgtctgcagaatgctcaacatgaccctctgctgactggagtatcttcaagtacaaatcccttcagaccccagaaagtctgttcctttttgtagtaaaatgaatctttcaaaggtttcccaaaccactccttatgatccagtgaatattcaagagagctacatttgaagcctgtacaaaagcttatccctgtaacacatgtgccataatatacaaacttctactttcgtcagtccttaacatctacctctctgaattttcatgaatttctatttcacaagggtaattgttttatatacactggcagcagcatacaataaaacttagtatgaaacttt

SEQ ID NO: 418548 - DNA, 957 bp, Homo sapiens
acttccctcaacccttcccacaaactgggaggaaaactgagacctcctggtcacccgccgccgggccttttagaaactcccacaagctctgccttccctccctggtcctcttcagaccccctcttagttcttcgcggctaacggtaagctctctccttacctctccctaatccgcccctctggagaggaaaagaaaacttaacagtcgggtcgcgctagcctccagcagccgccgcgcccaccgactgctccgccccttctcctccccctcctccaggctcgcgctcggggcagggtgtggagctggaacagagggctggcaaggcgcgcatgcgcaccgagggtggagccgctgagcacagaaccggaaacttagagacaaagttcggagccccgcccccgccgcgcgccgctgagttgtctggccccgccgacccacggcccacgacccaccgacccacgaatcggcccggccgtcgcgtgcaccatgtctggctcctccagcgtcgccgctatgaagaaagtggttcaacagctccggctggaggccggactcaaccgcgtaaaagtttcccaggcagctgcagacttgaaacagttctgtctgcagaatgctcaacatgaccctctgctgactggagtatcttcaagtacaaatcccttcagaccccagaaagtctgttcctttttgtagtaaaatgaatctttcaaaggtttcccaaaccactccttatgatccagtgaatattcaagagagctacatttgaagcctgtacaaaagcttatccctgtaacacatgtgccataatatacaaacttctactttcgtcagtccttaacatctacctctctgaattttcatgaatttctatttcacaagggtaattgttttatatacactggcagcagcatacaataaaacttagtatgaaactttaacaaaagaaaaaaagaagc

SEQ ID NO: 418549 - DNA, 646 bp, Homo sapiens
ttcaagcttctaacgatgtacggggacatgtgccataatatacaaacttctactttcgtcagtccttaacatctacctctctgaattttcatgaatttctatttcacaagggtaattgttttatatacactggcagcagcatacaataaaacttagtatgaaactttattttgcattattattggtattaaatacatggtatattaatctgttctgaacacctgaaggggttaagtttgtacagttttttccacctactcttctcacatgactttatgccatacatctggcaagactgctagggaattaaaggtaaactgtgaacctttattcttttaaggtcaggaggaggctgttaagttctacgggtttccatccatgagttacttatagggttaactttgtttcagtgcctgaatggagtactacagcaccatgtaatgaggtaaaaaagagctccccacaacgtgggcacaaaaaaccaaaaacctcaaaatcaggaagcaaagattagcttcagtaatttgcaactttgctttaaaccctggtagatcattttgctttaaattttttacccttctgaaggcttaagagaatgttaaaacatccagaaacctggcctccatttaagctattaaaactgtgc

SEQ ID NO: 418550 - DNA, 792 bp, Homo sapiens
acttccctcaacccttcccacaaactgggaggaaaactgagacctcctggtcacccgccgccgggccttttagaaactcccacaagctctgccttccctccctggtcctcttcagaccccctcttagttcttcgcggctaacggtaagctctctccttacctctccctaatccgcccctctggagaggaaaagaaaacttaacagtcgggtcgcgctagcctccagcagccgccgcgcccaccgactgctccgccccttctcctccccctcctccaggctcgcgctcggggcagggtgtggagctggaacagagggctggcaaggcgcgcatgcgcaccgagggtggagccgctgagcacagaaccggaaacttagagacaaagttcggagccccgcccccgccgcgcgccgctgagttgtctggccccgccgacccacggcccacgacccaccgacccacgaatcggcccggccgtcgcgtgcaccatgtctggctcctccagcgtcgccgctatgaagaaagtggttcaacagctccggctggaggccggactcaaccgcgtaaaagtttcccaaaccactccttatgatccagtgaatattcaagagagctacatttgaagcctgtacaaaagcttatccctgtaacacatgtgccataatatacaaacttctactttcgtcagtccttaacatctacctctctgaattttcatgaatttctatttcacaagggtaattgttttatatacactggcagcagcatacaataaaacttagtatgaaacttt

SEQ ID NO: 418551 - DNA, 333 bp, Homo sapiens
ggttgtgaaaattaagggaaagattttactgttactggaccataggcatttcccatcctgcttcttttaagttattcatgaaaaaaattaaaaactatgttctttgatactttaccctaactcacctttttttttttttccccatcttaggtttcccaaaccactccttatgatccagtgaatattcaagagagctacatttgaagcctgtacaaaagcttatccctgtaacacatgtgccataatatacaaacttctactttcgtcagtccttaacatctacctctctgaattttcatgaatttctatttcacaagggtaattgttttatat

SEQ ID NO: 418552 - DNA, 570 bp, Homo sapiens
tggctggtacggccggagtgtagggatcgcccccgccgcgcgccgctgagttgtctggccccgccgacccacggcccacgacccaccgacccacgaatcggcccggccgtcgcgtgcaccatgtctggctcctccagcgtcgccgctatgaagaaagtggttcaacagctccggctggaggccggactcaaccgcgtaaaagtttcccaggcagctgcagacttgaaacagttctgtctgcagaatgctcaacatgaccctctgctgactggagtatcttcaagtacaaatcccttcagaccccagaaagtctgttcctttttgtagtaaaatgaatctttcaaaggtttcccaaaccactccttatgatccagtgaatattcaagagagctacatttgaagcctgtacaaaagcttatccctgtaacacatgtgccataatatacaaacttctactttcgtcagtccttaacatctacctctctgaattttcatgaatttctatttcacaagggtaattgttttatatacactggcagcagcatacaataaaacttagtatgaaacttt

SEQ ID NO: 418553 - DNA, 1016 bp, Homo sapiens
acttccctcaacccttcccacaaactgggaggaaaactgagacctcctggtcacccgccgccgggccttttagaaactcccacaagctctgccttccctccctggtcctcttcagaccccctcttagttcttcgcggctaacggtaagctctctccttacctctccctaatccgcccctctggagaggaaaagaaaacttaacagtcgggtcgcgctagcctccagcagccgccgcgcccaccgactgctccgccccttctcctccccctcctccaggctcgcgctcggggcagggtgtggagctggaacagagggctggcaaggcgcgcatgcgcaccgagggtggagccgctgagcacagaaccggaaacttagagacaaagttcggagccccgcccccgccgcgcgccgctgagttgtctggccccgccgacccacggcccacgacccaccgacccacgaatcggcccggccgtcgcgtgcaccatgtctggctcctccagcgtcgccgctatgaagaaagtggttcaacagctccggcaattttggggggattgtccgaagaacgatgcatcactgtggacttgggcaggggggccccctggggggaaaactttcaaaacccccggggccggggttacaaacagtttcccaggcagctgcagacttgaaacagttctgtctgcagaatgctcaacatgaccctctgctgactggagtatcttcaagtacaaatcccttcagaccccagaaagtctgttcctttttgtagtaaaatgaatctttcaaaggtttcccaaaccactccttatgatccagtgaatattcaagagagctacatttgaagcctgtacaaaagcttatccctgtaacacatgtgccataatatacaaacttctactttcgtcagtccttaacatctacctctctgaattttcatgaatttctatttcacaagggtaattgttttatatacactggcagcagcatacaataaaacttagtatgaaacttt

SEQ ID NO: 418554 - DNA, 1058 bp, Homo sapiens
tcaccttgctttaacaagttcaatcgctttccacgctacctacagaggggtccatacggcgttgttctggattcccgtcgtaacttaaagggaaactttcacaatgtccggagcccttgatgtcctgcaaatgaaggaggaggatgtccttaagttccttgcagcaggaacccacttaggtggcaccaatcttgacttccagatggaacagtacatctataaaaggaaaagtgatggcatctatatcataaatctcaagaggacctgggagaagcttctgctggcagctcgtgcaattgttgccattgaaaaccctgctgatgtcagtgttatatcctccaggaatactggccagagggctgtgctgaagtttgctgctgccactggagccactccaattgctggccgcttcactcctggaaccttcactaaccagatccaggcagccttccgggagccacggcttcttgtggttactgaccccagggctgaccaccagcctctcacggaggcatcttatgttaacctacctaccattgcgctgtgtaacacagattctcctctgcgctatgtggacattgccatcccatgcaacaacaagggagctcactcagtgggtttgatgtggtggatgctggctcgggaagttctgcgcatgcgtggcaccatttcccgtgaacacccatgggaggtcatgcctgatctgtacttctacagagatcctgaagagattgaaaaagaagagcaggctgctgctgagaaggcagtgacccaaggaggaatttcagggtgaatggactgctcccgctcctgagttcactgctactcagcctgaggttgcagactggtctgaaggtgtacaggtgccctctgtgcctattcagcaattccctactgaagactggagcgctcagcctgccacggaagactggtctgcagctcccactgctcaggccactgaatgggtaggagcaaccactgactggtcttaagctgttcttgcataggctcttaagcaatatggaaaaatggtggatggaaaataaacatcagtttct

SEQ ID NO: 418555 - DNA, 327 bp, Homo sapiens
tcttgataatttcagttggttaaattacaatagtttgctatttcctccctcacattttatgttctacagtatctagctgcttgggttttcctgtataccatggggcttctgtcatctgggctttactcagtggcatattccctctgcctaaaactctcctcccctctccaccttagaagtagcttttcctagaacggttttcccagggtttcacctaaggtgatagtacaatctacagggacctgcacatgaagacctttgcatacatgccaggaagttggactttatctttggaaaaagggagcctttgaaggttttaaagtaaaa

SEQ ID NO: 418556 - DNA, 2286 bp, Homo sapiens
  misc_feature (2226)..(2226): n is a, c, g, or t
agcgggggtacgcgggcacgcgggactcccagctgtcaatcaggcgcgggctgagctctacgaggcggagcggcggcggtggcgacggcgatgggaccccagcgagagatctgcagctaggctggctgcacttgctccacgggtcaggggatcggagggggattgaagaatgcgccattaaaaggaaagatcaaggagtaaaccagaagaagaagaaaaagaggacttcaaagctgggaaggatgagttcttgcagcaacgtctgtgggtccaggcaggcacaggctgcagctgagggtggttaccagcgctatggagtccggtcctacctgcaccagttttatgaggactgtacagcctcaatttgggagtatgaggatgatttccagatccaaagatcacctaacaggtggagctcagtattctggaaggttggactcatctcaggtacagtttttgtgatcctcggattgactgttctggcagtgggctttcttgtgccccccaaaatcgaagcatttggcgaagccgattttgtggtggtcgacacacatgctgtccagtttaacagtgctctggacatgtacaagctggcaggagctgttctcttctgcattggaggcacgtccatggcagggtgcctgctgatgtcggtgttgtaaagagctactccaaagaagaaaaattcctccagcagaagtttaaagaacgaatcgcagacatcaaagcccacacccagccggttacaaaagctccagggccaggggaaacaaagattccagtcactttgtccagggttcaaaatgtccagcctctactggcaacctgaaacctttcccaccccagttcttcttgtctgatttatgcccgtggttaaaaagagcaggccagttttcgagataaagaagatttggcgttgactgccctagggctgtgttcagctgtgggcaatataatgggtggactcacacttgctcagttcaggcagctctgctggagggcggtgccatgcctaagcctgtgcacatgcatccagctgcttaagatgggtgcttccttgtacccggccaccagaaaacccctggaactcctctttcatagatcgtgactttgtgttattttccgtgttgtttgaaagtgccgaacagtttagaccagctcaccaatggctaatgtggtccattttattttctaatattggtttatctaatgttttctgcgtggtgctgtcttccattcctgtctcactatgtgtaagattttgtcatatgtgttcatagaaacatggaattctctgattttgagccgaacatgagtttttagactgtatcttgacatgaggttcctgacattggatacaaagttatcagcattcacaaatctttttgttttctccattttttttcctttgagatgaagtgctgttcttttgcctaggttggagtacagcggtgaaatcatagcgcactgcagccttgaactcctgggctcaagcgatcctcccacctcagcctcccaagtagctgggactacaggcacctgccaccacccccagttaatattttttttaattttttttagaggcaggatcttgctgtccaattttttttaaaaagctaaaattgccaactttagaatcttgaccaaaaaaaattaattttaggagcatctatttatgcagtgttcaaaagtactgaattagaaaccaggaagttttagttccttctactacctgtgtgatcttggggaaattatttaacctctcagtcctaattttccccttctgtataatgggagttctggatcacaatatgtctgggctctcattacccaaacatctgagattccatttttgccatgtgtcatcgagtcgctccccaacagatgtttgtgatgtttttgtggctgtcaccatggtgggattctttcagaatgagactcctggaaattcactgagtcagcagccttcacaccatctacccttaaatatccaaccccagcaatttatacaacgctgtcatatttttaaaaaaacaaaagtaagccatcctcaaataaggaaccccttggtagatattaaccttaaaaagggttttcattctcaaacaagatgctttgttctccaacaagatgttcatctcatcacttgcacttttgttttaatgtatggattcagattagactgagaaaaatggatggtattttcttaaaattgtgccaccttanagcccccccccttttttttttcttccttcactggataaataaaatatgtgaacaagtgga

SEQ ID NO: 418557 - DNA, 989 bp, Homo sapiens
tgctgggattacaggcgtgagccactgcgccccgccaagagagaggggtctttaaaagtaccttttctgtaatgaaaagagcattgttcaactaggcatacattactcagtctggttcttacctttcatatgtcttttgatcctgtggccaaagcctgtggcattaatccatgtggatgttgtcattccagctgggaaggatgagttcttgcagcaacgtctgtgggtccaggcaggcacaggctgcagctgagggtggttaccagcgctatggagtccggtcctacctgcaccagttttatgaggactgtacagcctcaatttgggagtatgaggatgatttccagatccaaagatcacctaacaggtggagctcagtattctggaagcaggaactgggttttcacacatcctcccacagccaagagtggaatcggaagttacagcacaaaaactgtcctcgctgctgtttcgggagtttgtcaccacctggagaggcccttctctgtcgccattgggattggccttaccaccctaaggccccaggttgctctgctgagcctggaggaggacccttccaaagcattccaactcttctgtgtggccctaaacgaggctgctttgcttcctcagaactttaaacaacctctgcattgcaattttttgactctttccatttgggagtcctctttctgttagacctgggaccaattcgactttgaactgtgtccagagataatttttatgatactgtatggaattgctccctcaatttttatcctttccagtactcagcatggtaccaagactaagctgatgagtcccaactgctctcctcacctcccatatgctactcatgagactccttcgtacctatcatcccacgctctccctcccatgttttaacatgtctggaattccccaatgggtgcatctctcagagattctcattaaagactggcattaacagccccttcagaagccttgaa

SEQ ID NO: 418558 - DNA, 626 bp, Homo sapiens
agcgggggtacgcgggcacgcgggactcccagctgtcaatcaggcgcgggctgagctctacgaggcggagcggcggcggtggcgacggcgatgggaccccagcgagagatctgcagctaggctggctgcacttgctccacgggtcaggggatcggagggggattgaagaatgcgccattaaaaggaaagatcaaggagtaaaccagaagaagaagaaaaagaggacttcaaaggtgcctggcacgtagtgctttaaaaacactgaaggaaggggaggatgaaaaatggaggactactcaggccttcatccacaccaacccacgtagaactctgcaggaagtttcaaagtactggagattaaagtggtcaacagtacagaaaatgtccctgcccacatgtagcttacactctatcatgtatatggtctatcagaccataagtaaataaaccacacatagaatatcagatagtaacaagtgctaggaagagaaacaaacctagacaaggggatagaaagtaatggaacgctgatatttagatatattgattatagaaagcctctcagaagaatttgatagggagtggcagcataatttttttccctcctcatgtctctgggttatgat

SEQ ID NO: 418559 - DNA, 1959 bp, Homo sapiens
  misc_feature (1899)..(1899): n is a, c, g, or t
agcgggggtacgcgggcacgcgggactcccagctgtcaatcaggcgcgggctgagctctacgaggcggagcggcggcggtggcgacggcgatgggaccccagcgagagatctgcagctaggctggctgcacttgctccacgggtcaggggatcggagggggattgaagaatgcgccattaaaaggaaagatcaaggagtaaaccagaagaagaagaaaaagaggacttcaaagctgggaaggatgagttcttgcagcaacgtctgtgggtccaggcaggcacaggctgcagctgagggtggttaccagcgctatggagtccggtcctacctgcaccagttttatgaggactgtacagcctcaatttgggagtatgaggatgatttccagatccaaagatcacctaacaggtggagctcagtattctggaaggttggactcatctcaggtacagtttttgtgatcctcggattgactgttctggcagtgggctttcttgtgccccccaaaatcgaagcatttggcgaagccgattttgtggtggtcgacacacatgctgtccagtttaacagtgctctggacatgtacaagctggcaggagctgttctcttctgcattggaggcacgtccatggcagggtgcctgctgatgtcggtgttgtaaagagctactccaaagaagaaaaattcctccagcagaagtttaaagaacgaatcgcagacatcaaagcccacacccagccggttacaaaagccctggaactcctctttcatagatcgtgactttgtgttattttccgtgttgtttgaaagtgccgaacagtttagaccagctcaccaatggctaatgtggtccattttattttctaatattggtttatctaatgttttctgcgtggtgctgtcttccattcctgtctcactatgtgtaagattttgtcatatgtgttcatagaaacatggaattctctgattttgagccgaacatgagtttttagactgtatcttgacatgaggttcctgacattggatacaaagttatcagcattcacaaatctttttgttttctccattttttttcctttgagatgaagtgctgttcttttgcctaggttggagtacagcggtgaaatcatagcgcactgcagccttgaactcctgggctcaagcgatcctcccacctcagcctcccaagtagctgggactacaggcacctgccaccacccccagttaatattttttttaattttttttagaggcaggatcttgctgtccaattttttttaaaaagctaaaattgccaactttagaatcttgaccaaaaaaaattaattttaggagcatctatttatgcagtgttcaaaagtactgaattagaaaccaggaagttttagttccttctactacctgtgtgatcttggggaaattatttaacctctcagtcctaattttccccttctgtataatgggagttctggatcacaatatgtctgggctctcattacccaaacatctgagattccatttttgccatgtgtcatcgagtcgctccccaacagatgtttgtgatgtttttgtggctgtcaccatggtgggattctttcagaatgagactcctggaaattcactgagtcagcagccttcacaccatctacccttaaatatccaaccccagcaatttatacaacgctgtcatatttttaaaaaaacaaaagtaagccatcctcaaataaggaaccccttggtagatattaaccttaaaaagggttttcattctcaaacaagatgctttgttctccaacaagatgttcatctcatcacttgcacttttgttttaatgtatggattcagattagactgagaaaaatggatggtattttcttaaaattgtgccaccttanagcccccccccttttttttttcttccttcactggataaataaaatatgtgaacaagtgga

SEQ ID NO: 418560 - DNA, 2244 bp, Homo sapiens
  misc_feature (2184)..(2184): n is a, c, g, or t
tgctgggattacaggcgtgagccactgcgccccgccaagagagaggggtctttaaaagtaccttttctgtaatgaaaagagcattgttcaactaggcatacattactcagtctggttcttacctttcatatgtcttttgatcctgtggccaaagcctgtggcattaatccatgtggatgttgtcattccagctgggaaggatgagttcttgcagcaacgtctgtgggtccaggcaggcacaggctgcagctgagggtggttaccagcgctatggagtccggtcctacctgcaccagttttatgaggactgtacagcctcaatttgggagtatgaggatgatttccagatccaaagatcacctaacaggtggagctcagtattctggaaggttggactcatctcaggtacagtttttgtgatcctcggattgactgttctggcagtgggctttcttgtgccccccaaaatcgaagcatttggcgaagccgattttgtggtggtcgacacacatgctgtccagtttaacagtgctctggacatgtacaagctggcaggagctgttctcttctgcattggaggcacgtccatggcagggtgcctgctgatgtcggtgttgtaaagagctactccaaagaagaaaaattcctccagcagaagtttaaagaacgaatcgcagacatcaaagcccacacccagccggttacaaaagctccagggccaggggaaacaaagattccagtcactttgtccagggttcaaaatgtccagcctctactggcaacctgaaacctttcccaccccagttcttcttgtctgatttatgcccgtggttaaaaagagcaggccagttttcgagataaagaagatttggcgttgactgccctagggctgtgttcagctgtgggcaatataatgggtggactcacacttgctcagttcaggcagctctgctggagggcggtgccatgcctaagcctgtgcacatgcatccagctgcttaagatgggtgcttccttgtacccggccaccagaaaacccctggaactcctctttcatagatcgtgactttgtgttattttccgtgttgtttgaaagtgccgaacagtttagaccagctcaccaatggctaatgtggtccattttattttctaatattggtttatctaatgttttctgcgtggtgctgtcttccattcctgtctcactatgtgtaagattttgtcatatgtgttcatagaaacatggaattctctgattttgagccgaacatgagtttttagactgtatcttgacatgaggttcctgacattggatacaaagttatcagcattcacaaatctttttgttttctccattttttttcctttgagatgaagtgctgttcttttgcctaggttggagtacagcggtgaaatcatagcgcactgcagccttgaactcctgggctcaagcgatcctcccacctcagcctcccaagtagctgggactacaggcacctgccaccacccccagttaatattttttttaattttttttagaggcaggatcttgctgtccaattttttttaaaaagctaaaattgccaactttagaatcttgaccaaaaaaaattaattttaggagcatctatttatgcagtgttcaaaagtactgaattagaaaccaggaagttttagttccttctactacctgtgtgatcttggggaaattatttaacctctcagtcctaattttccccttctgtataatgggagttctggatcacaatatgtctgggctctcattacccaaacatctgagattccatttttgccatgtgtcatcgagtcgctccccaacagatgtttgtgatgtttttgtggctgtcaccatggtgggattctttcagaatgagactcctggaaattcactgagtcagcagccttcacaccatctacccttaaatatccaaccccagcaatttatacaacgctgtcatatttttaaaaaaacaaaagtaagccatcctcaaataaggaaccccttggtagatattaaccttaaaaagggttttcattctcaaacaagatgctttgttctccaacaagatgttcatctcatcacttgcacttttgttttaatgtatggattcagattagactgagaaaaatggatggtattttcttaaaattgtgccaccttanagcccccccccttttttttttcttccttcactggataaataaaatatgtgaacaagtgga

SEQ ID NO: 418561 - DNA, 1141 bp, Homo sapiens
agcgggggtacgcgggcacgcgggactcccagctgtcaatcaggcgcgggctgagctctacgaggcggagcggcggcggtggcgacggcgatgggaccccagcgagagatctgcagctaggctggctgcacttgctccacgggtcaggggatcggagggggattgaagaatgcgccattaaaaggaaagatcaaggagtaaaccagaagaagaagaaaaagaggacttcaaagctgggaaggatgagttcttgcagcaacgtctgtgggtccaggcaggcacaggctgcagctgagggtggttaccagcgctatggagtccggtcctacctgcaccagttttatgaggactgtacagcctcaatttgggagtatgaggatgatttccagatccaaagatcacctaacaggtggagctcagtattctggaagcacagcatctaattcacaggagaagctcaatgaatgtttgctgaattgaggtgtttgagttgaagaaactgcaataattgttcttagtaaacagacctccttgtgacctgcaccaattcatatgatactgggatcaaaagcttcaacgaatatggtggctgatttagactcacctgcctcgggtgacattcaaaaggctgctgatgtgtcacggtgaggctgcgccaggctggcaccagagcctgcttcttccttcccatggagtggagctggctgaagaggttgggcaatccgggtccaaggagctgagtctctgccgtgtattgactgtcttgtttcctgcttgacttccttgtttcctgtccccacctgcctcaccctaactcttcattcaagttgcaaatgtatattctcctctgaggaggcttgcttttgaggaagacagtagaaattccccaaattcccttttcagacccatcctgcaaaatatgcctaccctagagtgtaataatccgcacttttatttttgcttactctttctagtattttctggttaaattagaagcagtagaacatagtggctaataacatgagctgagaaagggtgaatctagacttttcaatttactagttgtgtaactttaaaccaattatttactccatgccttacacacttcatcaataaaatggaagtaatggtgtcttcctca

SEQ ID NO: 418562 - DNA, 1214 bp, Homo sapiens
agcgggggtacgcgggcacgcgggactcccagctgtcaatcaggcgcgggctgagctctacgaggcggagcggcggcggtggcgacggcgatgggaccccagcgagagatctgcagctaggctggctgcacttgctccacgggtcaggggatcggagggggattgaagaatgcgccattaaaaggaaagatcaaggagtaaaccagaagaagaagaaaaagaggacttcaaagcactggccctgtggaaaagtggctataatgggaacctcagtctcattatctcagaatcattttatgggagagaaaagcagcatgaaaaattgaatgatatttcaaagaaaataaatagaacagggcctgtgcctggcctcacaactgactcacacatagtgtcacaggaaaacactcatatttgttgcctctcttctctcaaggagaccttgaagacaaagaatataatgtctgtaatgttcttagagtttcatgaggcataaagatttatttctgcttcaaggctatgaacatttataaaggaaaataaaaagtaactgcatatattacacagaaatttaaatttccaacacattgatactacagtctattggcacacatagtgatatcacaatagcacattcatgagcttgtttccctaatacaggaattattcaaggaattctcagcatttgtactccctttacctcttgatgatgcccattttgttatgtttattgcttcatgagtgtgtctccttgtaacccaagagtccattgagggcagacctggctccactcatcttcacaactattatttatctcacaggtgcctggcacgtagtgctttaaaaacactgaaggaaggggaggatgaaaaatggaggactactcaggccttcatccacaccaacccacgtagaactctgcaggaagtttcaaagtactggagattaaagtggtcaacagtacagaaaatgtccctgcccacatgtagcttacactctatcatgtatatggtctatcagaccataagtaaataaaccacacatagaatatcagatagtaacaagtgctaggaagagaaacaaacctagacaaggggatagaaagtaatggaacgctgatatttagatatattgattatagaaagcctctcagaagaatttgatagggagtggcagcataatttttttccctcctcatgtctctgggttatgat

SEQ ID NO: 418563 - DNA, 2220 bp, Homo sapiens
  misc_feature (21)..(21): n is a, c, g, or t
ccacgctggtacggccgcgtnttatatgtgacaggcgtcggaaaagggaggcagaggaggcggaggcagaggcagaggcagagcccggtgccgagaccaagcgacagaccggcggggctgggcctcgcaaagccggctcggcgagctctcccgacacccgagccggggaggaaaagcagcgactcctcgctcgcatccccgggagccgcactccagactggcccggtagtcaggggctcaggagcagatcccgaggcaggctttgctcagcctccgacgagggctggccctttggaaggcgccttcaacagccggaccagacaggccaccatgaccgagaattccacgtccgcccctgcggccaagcccaagcgggccaaggcctccaagaagtccacagaccaccccaagtattcagacatgatcgtggctgccatccaggccgagaagaaccgcgctggctcctcgcgccagtccattcagaagtatatcaagagccactacaaggtgggtgagaacgctgactcgcagatcaagttgtccatcaagcgcctggtcaccaccggtgtcctcaagcagaccaaaggggtgggggcctcggggtccttccggctagccaagagcgacgaacccaagaagtcagtggccttcaagaagaccaagaaggaaatcaagaaggtagccacgccaaagaaggcatccaagcccaagaaggctgcctccaaagccccaaccaagaaacccaaagccaccccggtcaagaaggccaagaagaagctggctgccacgcccaagaaagccaaaaaacccaagactgtcaaagccaagccggtcaaggcatccaagcccaaaaaggccaaaccagtgaaacccaaagcaaagtccagtgccaagagggccggcaagaagaagtgacaatgaagtcttttcttgcggacactccctcctgtctcctattttctgtaaataattttctccttttttctctcttgatgctcaccaccaccttttgcccccttctgttctgactttataagagacaggatttggattcttcagaaattacagaataattcatttttccttaaccagttgtgcaaggacagcaacaaccaatctaatgatgagaatgtacttatattttgttttgctattaacctacttacggggttagggatttgcggggggggcttgtgtgttttgttggcttgtttgccatgaaggtagatgtgggtggggagaagacacaaggcagtttgttctggctagatgagagggaacccaggaattgtgaggttagcaggaatatctttagggtgagtgagttttccttgagttgggcacccgttgtgagagtttcagaacctttggccagcaggagagaggtggtagggagcagccagccggcaaaggaaggaggtggaaaaaaaccgccaccgggctgacttccacctcccagtggtgagcagtgggggcccaaacccagtttccttctcatttttgttagtttgccctttcggcctccctattttcttagggaaggggagtggggtccaagtgacagctggatgggagaagccatagtttctcccagtcagctaggatgtagccattgggggatctttgtggcttcagcaaattctcttgttaaaccggagtgaaaacttcaggggaagggtggggagtcagccaagtgcctcagtgtgccctgttgaaacttaggtttttccacgcaatcgatggattgtgtcctaggaagacttttcttttcctctggatttttgttcctcctgtacaagaggtgtctttgcttggtttggtggggctgcggccacttaaaacctcccgatctctttttgagtcctttattataagtagttgtagctgcgggagggggagggggagtgggcgggcagtggatagtaagacttactgcagtcgatttgggatttgctaagtagttttacagagctagatctgtgtgcatgtgtgtgtttgtgtatatatacatatctagggctagtacttagtttcacacccgggagctgggagaaaaaacctgtacagttgtctttctcttatttttaataaaatagaaaaaatcgcgcacttgcgcgtcccccccccacccccttttttaaacaagtgttacttgtgccgggaaaattttgctgtctttgtaattttaaaactttaaaataaattggaaaagggagaaac

SEQ ID NO: 418564 - DNA, 2398 bp, Homo sapiens
  misc_feature (21)..(21): n is a, c, g, or t
ccacgctggtacggccgcgtnttatatgtgacaggcgtcggaaaagggaggcagaggaggcggaggcagaggcagaggcagagcccggtgccgagaccaagcgacagaccggcggggctgggcctcgcaaagccggctcggcgagctctcccgacacccgagccggggaggaaaagcagcgactcctcgctcgcatccccgggagccgcactccagactggcccggtagtcaggggctcaggagcagatcccgaggcaggctttgctcagcctccgacgagggctggccctttggaaggcgccttcaacagccggaccagacaggccaccatgaccgagaattccacgtccgcccctgcggccaagcccaagcgggccaaggcctccaagaagtccacagaccaccccaagtattcagacatgatcgtggctgccatccaggccgagaagaaccgcgctggctcctcgcgccagtccattcagaagtatatcaagagccactacaaggtgggtgagaacgctgactcgcagatcaagttgtccatcaagcgcctggtcaccaccggtgtcctcaagcagaccaaaggggtgggggcctcggggtccttccggctagccaagagcgacgaacccaagaagtcagtggccttcaagaagaccaagaaggaaatcaagaaggtagccacgccaaagaaggcatccaagcccaagaaggctgcctccaaagccccaaccaagaaacccaaagccaccccggtcaagaaggccaagaagaagctggctgccacgcccaagaaagccaaaaaacccaagactgtcaaagccaagccggtcaaggcatccaagcccaaaaaggccaaaccagtgaaacccaaagcaaagtccagtgccaagagggccggcaagaagaagtgacaatgaagtcttttcttgcggacactccctcctgtctcctattttctgtaaataattttctccttttttctctcttgatgctcaccaccaccttttgcccccttctgttctgactttataagagacaggatttggattcttcagaaattacagaataattcatttttccttaaccagttgtgcaaggacagcaacaaccaatctaatgatgagaatgtacttatattttgttttgctattaacctacttacggggttagggatttgcggggggggcttgtgtgttttgttggcttgtttgccatgaaggtagatgtgggtggggagaagacacaaggcagtttgttctggctagatgagagggaacccaggaattgtgaggttagcaggaatatctttagggtgagtgagttttccttgagttgggcacccgttgtgagagtttcagaacctttggccagcaggagagaggtggtagggagcagccagccggcaaaggaaggaggtggaaaaaaaccgccaccgggctgacttccacctcccagtggtgagcagtgggggcccaaacccagtttccttctcatttttgttagtttgccctttcggcctccctattttcttagggaaggggagtggggtccaagtgacagctggatgggagaagccatagtttctcccagtcagctaggatgtagccattgggggatctttgtggcttcagcaaattctcttgttaaaccggagtgaaaacttcaggggaagggtggggagtcagccaagtgcctcagtgtgccctgttgaaacttaggtttttccacgcaatcgatggattgtgtcctaggaagacttttcttttcctctggatttttgttcctcctgtacaagaggtgtctttgcttggtttggtggggctgcggccacttaaaacctcccgatctctttttgagtcctttattataagtagttgtagctgcgggagggggagggggagtgggcgggcagtggatagtaagacttactgcagtcgatttgggatttgctaagtagttttacagagctagatctgtgtgcatgtgtgtgtttgtgtatatatacatatctagggctagtacttagtttcacacccgggagctgggagaaaaaacctgtacagttgtctttctcttatttttaataaaatagaaaaaatcgcgcacttgcgcgtcccccccccacctccagataaagcttcagttatatctcaaaaaaaaaaaaaaaaaaaaaaaaaaaaaaaaaaaaaaaaaacaaaaaaaaaaaaaaaaaaaaaaaaaaaaaaaaaaaaaaaaaaacacccaaaacaaaacaacacaacacaaacccaccaaacacccaacacaacacaaacccccaaccaccccccaaaaacaaacacaactcaaaaaccccaaccatctcccaacctttctcttctaaccccttttattatattatctaaactcctttca

SEQ ID NO: 418565 - DNA, 2122 bp, Homo sapiens
  misc_feature (21)..(21): n is a, c, g, or t
ccacgctggtacggccgcgtnttatatgtgacaggcgtcggaaaagggaggcagaggaggcggaggcagaggcagaggcagagcccggtgccgagaccaagcgacagaccggcggggctgggcctcgcaaagccggctcggcgagctctcccgacacccgagccggggaggaaaagcagcgactcctcgctcgcatccccgggagccgcactccagactggcccggtagtcaggggctcaggagcagatcccgaggcaggctttgctcagcctccgacgagggctggccctttggaaggcgccttcaacagccggaccagacaggccaccatgaccgagaattccacgtccgcccctgcggccaagcccaagcgggccaaggcctccaagaagtccacagaccaccccaagtattcagacatgatcgtggctgccatccaggccgagaagaaccgcgctggctcctcgcgccagtccattcagaagtatatcaagagccactacaaggtgggtgagaacgctgactcgcagatcaagttgtccatcaagcgcctggtcaccaccggtgtcctcaagcagaccaaaggggtgggggcctcggggtccttccggctagccaagagcgacgaacccaagaagtcagtggccttcaagaagaccaagaaggaaatcaagaaggtagccacgccaaagaaggcatccaagcccaagaaggctgcctccaaagccccaaccaagaaacccaaagccaccccggtcaagaaggccaagaagaagctggctgccacgcccaagaaagccaaaaaacccaagactgtcaaagccaagccggtcaaggcatccaagcccaaaaaggccaaaccagtgaaacccaaagcaaagtccagtgccaagagggccggcaagaagaagtgacaatgaagtcttttcttgcggacactccctcctgtctcctattttctgtaaataattttctccttttttctctcttgatgctcaccaccaccttttgcccccttctgttctgactttataagagacaggatttggattcttcagaaattacagaataattcatttttccttaaccagttgtgcaaggacagcaacaaccaatctaatgatgagaatgtacttatattttgttttgctattaacctacttacggggttagggatttgcggggggggcttgtgtgttttgttggcttgtttgccatgaaggtagatgtgggtggggagaagacacaaggcagtttgttctggctagatgagagggaacccaggaattgtgaggttagcaggaatatctttagggtgagtgagttttccttgagttgggcacccgttgtgagagtttcagaacctttggccagcaggagagaggtggtagggagcagccagccggcaaaggaaggaggtggaaaaaaaccgccaccgggctgacttccacctcccagtggtgagcagtgggggcccaaacccagtttccttctcatttttgttagtttgccctttcggcctccctattttcttagggaaggggagtggggtccaagtgacagctggatgggagaagccatagtttctcccagtcagctaggatgtagccattgggggatctttgtggcttcagcaaattctcttgttaaaccggagtgaaaacttcaggggaagggtggggagtcagccaagtgcctcagtgtgccctgttgaaacttaggtttttccacgcaatcgatggattgtgtcctaggaagacttttcttttcctctggatttttgttcctcctgtacaagaggtgtctttgcttggtttggtggggctgcggccacttaaaacctcccgatctctttttgagtcctttattataagtagttgtagctgcgggagggggagggggagtgggcgggcagtggatagtaagacttactgcagtcgatttgggatttgctaagtagttttacagagctagatctgtgtgcatgtgtgtgtttgtgtatatatacatatctagggctagtacttagtttcacacccgggagctgggagaaaaaacctgtacatgcaagggtaatgcaagcccggtacatgcaagacatgcaagcccggtacatgcaag

SEQ ID NO: 418566 - DNA, 2166 bp, Homo sapiens
  misc_feature (21)..(21): n is a, c, g, or t
ccacgctggtacggccgcgtnttatatgtgacaggcgtcggaaaagggaggcagaggaggcggaggcagaggcagaggcagagcccggtgccgagaccaagcgacagaccggcggggctgggcctcgcaaagccggctcggcgagctctcccgacacccgagccggggaggaaaagcagcgactcctcgctcgcatccccgggagccgcactccagactggcccggtagtcaggggctcaggagcagatcccgaggcaggctttgctcagcctccgacgagggctggccctttggaaggcgccttcaacagccggaccagacaggccaccatgaccgagaattccacgtccgcccctgcggccaagcccaagcgggccaaggcctccaagaagtccacagaccaccccaagtattcagacatgatcgtggctgccatccaggccgagaagaaccgcgctggctcctcgcgccagtccattcagaagtatatcaagagccactacaaggtgggtgagaacgctgactcgcagatcaagttgtccatcaagcgcctggtcaccaccggtgtcctcaagcagaccaaaggggtgggggcctcggggtccttccggctagccaagagcgacgaacccaagaagtcagtggccttcaagaagaccaagaaggaaatcaagaaggtagccacgccaaagaaggcatccaagcccaagaaggctgcctccaaagccccaaccaagaaacccaaagccaccccggtcaagaaggccaagaagaagctggctgccacgcccaagaaagccaaaaaacccaagactgtcaaagccaagccggtcaaggcatccaagcccaaaaaggccaaaccagtgaaacccaaagcaaagtccagtgccaagagggccggcaagaagaagtgacaatgaagtcttttcttgcggacactccctcctgtctcctattttctgtaaataattttctccttttttctctcttgatgctcaccaccaccttttgcccccttctgttctgactttataagagacaggatttggattcttcagaaattacagaataattcatttttccttaaccagttgtgcaaggacagcaacaaccaatctaatgatgagaatgtacttatattttgttttgctattaacctacttacggggttagggatttgcggggggggcttgtgtgttttgttggcttgtttgccatgaaggtagatgtgggtggggagaagacacaaggcagtttgttctggctagatgagagggaacccaggaattgtgaggttagcaggaatatctttagggtgagtgagttttccttgagttgggcacccgttgtgagagtttcagaacctttggccagcaggagagaggtggtagggagcagccagccggcaaaggaaggaggtggaaaaaccagtttccttctcatttttgttagtttgccctttcggcctccctattttcttagggaaggggagtggggtccaagtgacagctggatgggagaagccatagtttctcccagtcagctaggatgtagccattgggggatctttgtggcttcagcaaattctcttgttaaaccggagtgaaaacttcaggggaagggtggggagtcagccaagtgcctcagtgtgccctgttgaaacttaggtttttccacgcaatcgatggattgtgtcctaggaagacttttcttttcctctggatttttgttcctcctgtacaagaggtgtctttgcttggtttggtggggctgcggccacttaaaacctcccgatctctttttgagtcctttattataagtagttgtagctgcgggagggggagggggagtgggcgggcagtggatagtaagacttactgcagtcgatttgggatttgctaagtagttttacagagctagatctgtgtgcatgtgtgtgtttgtgtatatatacatatctagggctagtacttagtttcacacccgggagctgggagaaaaaacctgtacagttgtctttctcttatttttaataaaatagaaaaaatcgcgcacttgcgcgtcccccccccacccccttttttaaacaagtgttacttgtgccgggaaaattttgctgtctttgtaattttaaaactttaaaataaattggaaaagggagaaac

SEQ ID NO: 418567 - DNA, 2286 bp, Homo sapiens
aggtcggatttgctcggcggaagaaacacagatggcggcggcgcagcgccattccgggccgggagcaggcagccagcagccctgtcctcaccgcggtccgcccgccgccgctaaatacccggatgcgccgcccaagcgccagacgcggagctgggaaaagggaggcagaggaggcggaggcggaggcagaggcagaggcagagcccggtgccgagaccaagcgacagaccggcggggctgggcctcgcaaagccggctcggcgagctctcccgacacccgagccggggagggtagtcaggggctcaggagcagatcccgaggcaggctttgctcagcctccgacgagggctggccctttggaaggcgccttcaacagccggaccagacaggccaccatgaccgagaattccacgtccgcccctgcggccaagcccaagcgggccaaggcctccaagaagtccacagaccaccccaagtattcagacatgatcgtggctgccatccaggccgagaagaaccgcgctggctcctcgcgccagtccattcagaagtatatcaagagccactacaaggtgggtgagaacgctgactcgcagatcaagttgtccatcaagcgcctggtcaccaccggtgtcctcaagcagaccaaaggggtgggggcctcggggtccttccggctagccaagagcgacgaacccaagaagtcagtggccttcaagaagaccaagaaggaaatcaagaaggtagccacgccaaagaaggcatccaagcccaagaaggctgcctccaaagccccaaccaagaaacccaaagccaccccggtcaagaaggccaagaagaagctggctgccacgcccaagaaagccaaaaaacccaagactgtcaaagccaagccggtcaaggcatccaagcccaaaaaggccaaaccagtgaaacccaaagcaaagtccagtgccaagagggccggcaagaagaagtgacaatgaagtcttttcttgcggacactccctcctgtctcctattttctgtaaataattttctccttttttctctcttgatgctcaccaccaccttttgcccccttctgttctgactttataagagacaggatttggattcttcagaaattacagaataattcatttttccttaaccagttgtgcaaggacagcaacaaccaatctaatgatgagaatgtacttatattttgttttgctattaacctacttacggggttagggatttgcggggggggcttgtgtgttttgttggcttgtttgccatgaaggtagatgtgggtggggagaagacacaaggcagtttgttctggctagatgagagggaacccaggaattgtgaggttagcaggaatatctttagggtgagtgagttttccttgagttgggcacccgttgtgagagtttcagaacctttggccagcaggagagaggtggtagggagcagccagccggcaaaggaaggaggtggaaaaaaaccgccaccgggctgacttccacctcccagtggtgagcagtgggggcccaaacccagtttccttctcatttttgttagtttgccctttcggcctccctattttcttagggaaggggagtggggtccaagtgacagctggatgggagaagccatagtttctcccagtcagctaggatgtagccattgggggatctttgtggcttcagcaaattctcttgttaaaccggagtgaaaacttcaggggaagggtggggagtcagccaagtgcctcagtgtgccctgttgaaacttaggtttttccacgcaatcgatggattgtgtcctaggaagacttttcttttcctctggatttttgttcctcctgtacaagaggtgtctttgcttggtttggtggggctgcggccacttaaaacctcccgatctctttttgagtcctttattataagtagttgtagctgcgggagggggagggggagtgggcgggcagtggatagtaagacttactgcagtcgatttgggatttgctaagtagttttacagagctagatctgtgtgcatgtgtgtgtttgtgtatatatacatatctagggctagtacttagtttcacacccgggagctgggagaaaaaacctgtacagttgtctttctcttatttttaataaaatagaaaaaatcgcgcacttgcgcgtcccccccccacccccttttttaaacaagtgttacttgtgccgggaaaattttgctgtctttgtaattttaaaactttaaaataaattggaaaagggagaaac

SEQ ID NO: 418568 - DNA, 1965 bp, Homo sapiens
cgagctcggtaccccctggctgctcaggctggccctttggaaggcgccttcaacagccggaccagacaggccaccatgaccgagaattccacgtccgcccctgcggccaagcccaagcgggccaaggcctccaagaagtccacagaccaccccaagtattcagacatgatcgtggctgccatccaggccgagaagaaccgcgctggctcctcgcgccagtccattcagaagtatatcaagagccactacaaggtgggtgagaacgctgactcgcagatcaagttgtccatcaagcgcctggtcaccaccggtgtcctcaagcagaccaaaggggtgggggcctcggggtccttccggctagccaagagcgacgaacccaagaagtcagtggccttcaagaagaccaagaaggaaatcaagaaggtagccacgccaaagaaggcatccaagcccaagaaggctgcctccaaagccccaaccaagaaacccaaagccaccccggtcaagaaggccaagaagaagctggctgccacgcccaagaaagccaaaaaacccaagactgtcaaagccaagccggtcaaggcatccaagcccaaaaaggccaaaccagtgaaacccaaagcaaagtccagtgccaagagggccggcaagaagaagtgacaatgaagtcttttcttgcggacactccctcctgtctcctattttctgtaaataattttctccttttttctctcttgatgctcaccaccaccttttgcccccttctgttctgactttataagagacaggatttggattcttcagaaattacagaataattcatttttccttaaccagttgtgcaaggacagcaacaaccaatctaatgatgagaatgtacttatattttgttttgctattaacctacttacggggttagggatttgcggggggggcttgtgtgttttgttggcttgtttgccatgaaggtagatgtgggtggggagaagacacaaggcagtttgttctggctagatgagagggaacccaggaattgtgaggttagcaggaatatctttagggtgagtgagttttccttgagttgggcacccgttgtgagagtttcagaacctttggccagcaggagagaggtggtagggagcagccagccggcaaaggaaggaggtggaaaaaaaccgccaccgggctgacttccacctcccagtggtgagcagtgggggcccaaacccagtttccttctcatttttgttagtttgccctttcggcctccctattttcttagggaaggggagtggggtccaagtgacagctggatgggagaagccatagtttctcccagtcagctaggatgtagccattgggggatctttgtggcttcagcaaattctcttgttaaaccggagtgaaaacttcaggggaagggtggggagtcagccaagtgcctcagtgtgccctgttgaaacttaggtttttccacgcaatcgatggattgtgtcctaggaagacttttcttttcctctggatttttgttcctcctgtacaagaggtgtctttgcttggtttggtggggctgcggccacttaaaacctcccgatctctttttgagtcctttattataagtagttgtagctgcgggagggggagggggagtgggcgggcagtggatagtaagacttactgcagtcgatttgggatttgctaagtagttttacagagctagatctgtgtgcatgtgtgtgtttgtgtatatatacatatctagggctagtacttagtttcacacccgggagctgggagaaaaaacctgtacagttgtctttctcttatttttaataaaatagaaaaaatcgcgcacttgcgcgtcccccccccacccccttttttaaacaagtgttacttgtgccgggaaaattttgctgtctttgtaattttaaaactttaaaataaattggaaaagggagaaac

SEQ ID NO: 418569 - DNA, 1264 bp, Homo sapiens
  misc_feature (21)..(21): n is a, c, g, or t
ccacgctggtacggccgcgtnttatatgtgacaggcgtcggaaaagggaggcagaggaggcggaggcagaggcagaggcagagcccggtgccgagaccaagcgacagaccggcggggctgggcctcgcaaagccggctcggcgagctctcccgacacccgagccggggaggaaaagcagcgactcctcgctcgcatccccgggagccgcactccagactggcccggtagtcaggggctcaggagcagatcccgaggcaggctttgctcagcctccgacgagggctggccctttggaaggcgccttcaacagccggaccagacaggccaccatgaccgagaattccacgtccgcccctgcggccaagcccaagcgggccaaggcctccaagaagtccacagaccaccccaagtattcagacatgatcgtggctgccatccaggccgagaagaaccgcgctggctcctcgcgccagtccattcagaagtatatcaagagccactacaaggtgggtgagaacgctgactcgcagatcaagttgtccatcaagcgcctggtcaccaccggtgtcctcaagcagaccaaaggggtgggggcctcggggtccttccggctagccaagagcgacgaacccaagaagtcagtggccttcaagaagaccaagaaggaaatcaagaaggtagccacgccaaagaaggcatccaagcccaagaaggctgcctccaaagccccaaccaagaaacccaaagccaccccggtcaagaaggccaagaagaagctggctgccacgcccaagaaagccaaaaaacccaagactgtcaaagccaagccggtcaaggcatccaagcccaaaaaggccaaaccagtgaaacccaaagcaaagtccagtgccaagagggccggcaagaagaagtgacaatgaagtcttttcttgcggacactccctcctgtctcctattttctgtaaataattttctccttttttctctcttgatgctcaccaccaccttttgcccccttctgttctgactttataagagacaggatttggattcactccctcctgtctcctattttctgtaaataattttctccttttttctctcttgatgctcaccaccaccttttgcccccttctgttctgactttataagagacaggatttggattcactccctcctgtctcctattttctgtaaataattttctccttttttctctcttgatgctcaccaccaccttttgcccccttctgtcgtcttctc

SEQ ID NO: 418570 - DNA, 1106 bp, Homo sapiens
  misc_feature (21)..(21): n is a, c, g, or t
ccacgctggtacggccgcgtnttatatgtgacaggcgtcggaaaagggaggcagaggaggcggaggcagaggcagaggcagagcccggtgccgagaccaagcgacagaccggcggggctgggcctcgcaaagccggctcggcgagctctcccgacacccgagccggggaggaaaagcagcgactcctcgctcgcatccccgggagccgcactccagactggcccggtagtcaggggctcaggagcagatcccgaggcaggctttgctcagcctccgacgagggctggccctttggaaggcgccttcaacagccggaccagacaggccaccatgaccgagaattccacgtccgcccctgcggccaagcccaagcgggccaaggcctccaagaagtccacagaccaccccaagtattcagacatgatcgtggctgccatccaggccgagaagaaccgcgctggctcctcgcgccagtccattcagaagtatatcaagagccactacaaggtgggtgagaacgctgactcgcagatcaagttgtccatcaagcgcctggtcaccaccggtgtcctcaagcagaccaaaggggtgggggcctcggggtccttccggctagccaagagcgacgaacccaagaagtcagtggccttcaagaagaccaagaaggaaatcaagaaggtagccacgccaaagaaggcatccaagcccaagaaggctgcctccaaagccccaaccaagaaacccaaagccaccccggtcaagaaggccaagaagaagctggctgccacgcccaagaaagccaaaaaacccaagactgtcaaagccaagccggtcaaggcatccaagcccaaaaaggccaaaccagtgaaacccaaagcaaagtccagtgccaagagggccggcaagaagaagtgacaatgaagtcttttcttgcggacactccctcctgtctcctattttctgtaaataattttctccttttttctctcttgatgctcaccaccaccttttgcccccttcctccttagagtgggaaagaaaaaagggctcaagtagccaaaggagctgagcagcagctctggggtctgggagttgtggcctcaact

SEQ ID NO: 418571 - DNA, 2644 bp, Homo sapiens
  misc_feature (21)..(21): n is a, c, g, or t
  misc_feature (2644)..(2644): n is a, c, g, or t
ccacgctggtacggccgcgtnttatatgtgacaggcgtcggaaaagggaggcagaggaggcggaggcagaggcagaggcagagcccggtgccgagaccaagcgacagaccggcggggctgggcctcgcaaagccggctcggcgagctctcccgacacccgagccggggaggaaaagcagcgactcctcgctcgcatccccgggagccgcactccagactggcccggtagtcaggggctcaggagcagatcccgaggcaggctttgctcagcctccgacgagggctggccctttggaaggcgccttcaacagccggaccagacaggccaccatgaccgagaattccacgtccgcccctgcggccaagcccaagcgggccaaggcctccaagaagtccacagaccaccccaagtattcagacatgatcgtggctgccatccaggccgagaagaaccgcgctggctcctcgcgccagtccattcagaagtatatcaagagccactacaaggtgggtgagaacgctgactcgcagatcaagttgtccatcaagcgcctggtcaccaccggtgtcctcaagcagaccaaaggggtgggggcctcggggtccttccggctagccaagagcgacgaacccaagaagtcagtggccttcaagaagaccaagaaggaaatcaagaaggtagccacgccaaagaaggcatccaagcccaagaaggctgcctccaaagccccaaccaagaaacccaaagccaccccggtcaagaaggccaagaagaagctggctgccacgcccaagaaagccaaaaaacccaagactgtcaaagccaagccggtcaaggcatccaagcccaaaaaggccaaaccagtgaaacccaaagcaaagtccagtgccaagagggccggcaagaagaagtgacaatgaagtcttttcttgcggacactccctcctgtctcctattttctgtaaataattttctccttttttctctcttgatgctcaccaccaccttttgcccccttctgttctgactttataagagacaggatttggattcttcagaaattacagaataattcatttttccttaaccagttgtgcaaggacagcaacaaccaatctaatgatgagaatgtacttatattttgttttgctattaacctacttacggggttagggatttgcggggggggcttgtgtgttttgttggcttgtttgccatgaaggtagatgtgggtggggagaagacacaaggcagtttgttctggctagatgagagggaacccaggaattgtgaggttagcaggaatatctttagggtgagtgagttttccttgagttgggcacccgttgtgagagtttcagaacctttggccagcaggagagaggtggtagggagcagccagccggcaaaggaaggaggtggaaaaaaaccgccaccgggctgacttccacctcccagtggtgagcagtgggggcccaaacccagtttccttctcatttttgttagtttgccctttcggcctccctattttcttagggaaggggagtggggtccaagtgacagctggatgggagaagccatagtttctcccagtcagctaggatgtagccattgggggatctttgtggcttcagcaaattctcttgttaaaccggagtgaaaacttcaggggaagggtggggagtcagccaagtgcctcagtgtgccctgttgaaacttaggtttttccacgcaatcgatggattgtgtcctaggaagacttttcttttcctctggatttttgttcctcctgtacaagaggtgtctttgcttggtttggtggggctgcggccacttaaaacctcccgatctctttttgagtcctttattataagtagttgtagctgcgggagggggagggggagtgggcgggcagtggatagtaagacttactgcagtcgatttgggatttgctaagtagttttacagagctagatctgtgtgcatgtgtgtgtttgtgtatatatacatatctagggctagtacttagtttcacacccgggagctgggagaaaaaacctgtacagttgtctttctcttatttttaataaaatagaaaaaatcgcgcacttgcgcgtcccccccccacccccttttttaaacaagtgttacttgtgccgggaaaattttgctgtctttgtaattttaaaactttaaaataaattggaaaagggagaaacaaaaaaaaaaaaaaaaaaaaaaaaacaaaaaaaaaaaaaaaaaaaaaaaaagggggggggggggcgcaaaaaaatttatccccggggggggcgcccatttaggggcgacaccgagcagttttttgtgtaaaagaagggggccccactaagagagaggagcgacgtaaaaaaagagagagagagagagggagacgcggcgccggttataaaacaacgggtgcgtgggagggggaaaacagcggccgacgggggacaacttggggggaagggacccccacacgcggggcgggggggcgaacctgtggcgaccacatcacccacgagtatttgagcgcccagggggaacaaaacaactgggggggttatggggtaaaccaacgcaatagctctgcggagaattgggtcacggactgattggatattn

SEQ ID NO: 418572 - DNA, 2340 bp, Homo sapiens
aggtcggatttgctcggcggaagaaacacagatggcggcggcgcagcgccattccgggccgggagcaggcagccagcagccctgtcctcaccgcggtccgcccgccgccgctaaatacccggatgcgccgcccaagcgccagacgcggagctgggaaaagggaggcagaggaggcggaggcggaggcagaggcagaggcagagcccggtgccgagaccaagcgacagaccggcggggctgggcctcgcaaagccggctcggcgagctctcccgacacccgagccggggaggaaaagcagcgactcctcgctcgcatccccgggagccgcactccagactggcccggtagtcaggggctcaggagcagatcccgaggcaggctttgctcagcctccgacgagggctggccctttggaaggcgccttcaacagccggaccagacaggccaccatgaccgagaattccacgtccgcccctgcggccaagcccaagcgggccaaggcctccaagaagtccacagaccaccccaagtattcagacatgatcgtggctgccatccaggccgagaagaaccgcgctggctcctcgcgccagtccattcagaagtatatcaagagccactacaaggtgggtgagaacgctgactcgcagatcaagttgtccatcaagcgcctggtcaccaccggtgtcctcaagcagaccaaaggggtgggggcctcggggtccttccggctagccaagagcgacgaacccaagaagtcagtggccttcaagaagaccaagaaggaaatcaagaaggtagccacgccaaagaaggcatccaagcccaagaaggctgcctccaaagccccaaccaagaaacccaaagccaccccggtcaagaaggccaagaagaagctggctgccacgcccaagaaagccaaaaaacccaagactgtcaaagccaagccggtcaaggcatccaagcccaaaaaggccaaaccagtgaaacccaaagcaaagtccagtgccaagagggccggcaagaagaagtgacaatgaagtcttttcttgcggacactccctcctgtctcctattttctgtaaataattttctccttttttctctcttgatgctcaccaccaccttttgcccccttctgttctgactttataagagacaggatttggattcttcagaaattacagaataattcatttttccttaaccagttgtgcaaggacagcaacaaccaatctaatgatgagaatgtacttatattttgttttgctattaacctacttacggggttagggatttgcggggggggcttgtgtgttttgttggcttgtttgccatgaaggtagatgtgggtggggagaagacacaaggcagtttgttctggctagatgagagggaacccaggaattgtgaggttagcaggaatatctttagggtgagtgagttttccttgagttgggcacccgttgtgagagtttcagaacctttggccagcaggagagaggtggtagggagcagccagccggcaaaggaaggaggtggaaaaaaaccgccaccgggctgacttccacctcccagtggtgagcagtgggggcccaaacccagtttccttctcatttttgttagtttgccctttcggcctccctattttcttagggaaggggagtggggtccaagtgacagctggatgggagaagccatagtttctcccagtcagctaggatgtagccattgggggatctttgtggcttcagcaaattctcttgttaaaccggagtgaaaacttcaggggaagggtggggagtcagccaagtgcctcagtgtgccctgttgaaacttaggtttttccacgcaatcgatggattgtgtcctaggaagacttttcttttcctctggatttttgttcctcctgtacaagaggtgtctttgcttggtttggtggggctgcggccacttaaaacctcccgatctctttttgagtcctttattataagtagttgtagctgcgggagggggagggggagtgggcgggcagtggatagtaagacttactgcagtcgatttgggatttgctaagtagttttacagagctagatctgtgtgcatgtgtgtgtttgtgtatatatacatatctagggctagtacttagtttcacacccgggagctgggagaaaaaacctgtacagttgtctttctcttatttttaataaaatagaaaaaatcgcgcacttgcgcgtcccccccccacccccttttttaaacaagtgttacttgtgccgggaaaattttgctgtctttgtaattttaaaactttaaaataaattggaaaagggagaaac

SEQ ID NO: 418573 - DNA, 1953 bp, Homo sapiens
  misc_feature (21)..(21): n is a, c, g, or t
ccacgctggtacggccgcgtnttatatgtgacaggcgtcggaaaagggaggcagaggaggcggaggcagaggcagaggcagagcccggtgccgagaccaagcgacagaccggcggggctgggcctcgcaaagccggctcggcgagctctcccgacacccgagccggggaggaaaagcagcgactcctcgctcgcatccccgggagccgcactccagactggcccggtagtcaggggctcaggagcagatcccgaggcaggctttgctcagcctccgacgagggctggccctttggaaggcgccttcaacagccggaccagacaggccaccatgaccgagaattccacgtccgcccctgcggccaagcccaagcgggccaaggcctccaagaagtccacagaccaccccaagtattcagacatgatcgtggctgccatccaggccgagaagaaccgcgctggctcctcgcgccagtccattcagaagtatatcaagagccactacaaggtgggtgagaacgctgactcgcagatcaagttgtccatcaagcgcctggtcaccaccggtgtcctcaagcagaccaaaggggtgggggcctcggggtccttccggctagccaagagcgacgaacccaagaagtcagtggccttcaagaagaccaagaaggaaatcaagaaggtagccacgccaaagaaggcatccaagcccaagaaggctgcctccaaagccccaaccaagaaacccaaagccaccccggtcaagaaggccaagaagaagctggctgccacgcccaagaaagccaaaaaacccaagactgtcaaagccaagccggtcaaggcatccaagcccaaaaaggccaaaccagtgaaacccaaagcaaagtccagtgccaagagggccggcaagaagaagtgacaatgaagtcttttcttgcggacactccctcctgtctcctattttctgtaaataattttctccttttttctctcttgatgctcaccaccaccttttgcccccttctgttctgactttataagagacaggatttggattcttcagaaattacagaataattcatttttccttaaccagttgtgcaaggacagcaacaaccaatctaatgatgagaatgtacttatattttgttttgctattaacctacttacggggttagggatttgcggggggggcttgtgtgttttgttggcttgtttgccatgaaggtagatgtgggtggggagaagacacaaggcagtttgttctggctagatgagagggaacccaggaattgtgaggttagcaggaatatctttagggtgagtgagttttccttgagttgggcacccgttgtgagagtttcagaacctttggccagcaggagagaggtggtagggagcagccagccggcaaaggaaggaggtggaaaaaaaccgccaccgggctgacttccacctcccagtggtgagcagtgggggcccaaacccagtttccttctcatttttgttagtttgccctttcggcctccctattttcttagggaaggggagtggggtccaagtgacagctggatgggagaagccatagtttctcccagtcagctaggatgtagccattgggggatctttgtggcttcagcaaattctcttgttaaaccggagtgaaaacttcaggggaagggtggggagtcagccaagtgcctcagtgtgccctgttgaaacttaggtttttccacgcaatcgatggattgtgtcctaggaagacttttcttttcctctggatttttgttcctcctgtacaagaggtgtctttgcttggtttggtggggctgcggccacttaaaacctcccgatctctttttgagtccccttttttaaacaagtgttacttgtgccgggaaaattttgctgtctttgtaattttaaaactttaaaataaattggaaaagggagaaac

SEQ ID NO: 418574 - DNA, 1899 bp, Homo sapiens
  misc_feature (21)..(21): n is a, c, g, or t
ccacgctggtacggccgcgtnttatatgtgacaggcgtcggaaaagggaggcagaggaggcggaggcagaggcagaggcagagcccggtgccgagaccaagcgacagaccggcggggctgggcctcgcaaagccggctcggcgagctctcccgacacccgagccggggaggaaaagcagcgactcctcgctcgcatccccgggagccgcactccagactggcccggtagtcaggggctcaggagcagatcccgaggcaggctttgctcagcctccgacgagggctggccctttggaaggcgccttcaacagccggaccagacaggccaccatgaccgagaattccacgtccgcccctgcggccaagcccaagcgggccaaggcctccaagaagtccacagaccaccccaagtattcagacatgatcgtggctgccatccaggccgagaagaaccgcgctggctcctcgcgccagtccattcagaagtatatcaagagccactacaaggtgggtgagaacgctgactcgcagatcaagttgtccatcaagcgcctggtcaccaccggtgtcctcaagcagaccaaaggggtgggggcctcggggtccttccggctagccaagagcgacgaacccaagaagtcagtggccttcaagaagaccaagaaggaaatcaagaaggtagccacgccaaagaaggcatccaagcccaagaaggctgcctccaaagccccaaccaagaaacccaaagccaccccggtcaagaaggccaagaagaagctggctgccacgcccaagaaagccaaaaaacccaagactgtcaaagccaagccggtcaaggcatccaagcccaaaaaggccaaaccagtgaaacccaaagcaaagtccagtgccaagagggccggcaagaagaagtgacaatgaagtcttttcttgcggacactccctcctgtctcctattttctgtaaataattttctccttttttctctcttgatgctcaccaccaccttttgcccccttctgttctgactttataagagacaggatttggattcttcagaaattacagaataattcatttttccttaaccagttgtgcaaggacagcaacaaccaatctaatgatgagaatgtacttatattttgttttgctattaacctacttacggggttagggatttgcggggggggcttgtgtgttttgttggcttgtttgccatgaaggtagatgtgggtggggagaagacacaaggcagtttgttctggctagatgagagggaacccaggaattgtgaggttagcaggaatatctttagggtgagtgagttttccttgagttgggcacccgttgtgagagtttcagaacctttggccagcaggagagaggtggtagggagcagccagccggcaaaggaaggaggtggaaaaaccagtttccttctcatttttgttagtttgccctttcggcctccctattttcttagggaaggggagtggggtccaagtgacagctggatgggagaagccatagtttctcccagtcagctaggatgtagccattgggggatctttgtggcttcagcaaattctcttgttaaaccggagtgaaaacttcaggggaagggtggggagtcagccaagtgcctcagtgtgccctgttgaaacttaggtttttccacgcaatcgatggattgtgtcctaggaagacttttcttttcctctggatttttgttcctcctgtacaagaggtgtctttgcttggtttggtggggctgcggccacttaaaacctcccgatctctttttgagtccccttttttaaacaagtgttacttgtgccgggaaaattttgctgtctttgtaattttaaaactttaaaataaattggaaaagggagaaac

SEQ ID NO: 418575 - DNA, 2166 bp, Homo sapiens
  misc_feature (21)..(21): n is a, c, g, or t
ccacgctggtacggccgcgtnttatatgtgacaggcgtcggaaaagggaggcagaggaggcggaggcagaggcagaggcagagcccggtgccgagaccaagcgacagaccggcggggctgggcctcgcaaagccggctcggcgagctctcccgacacccgagccggggaggaaaagcagcgactcctcgctcgcatccccgggagccgcactccagactggcccggtagtcaggggctcaggagcagatcccgaggcaggctttgctcagcctccgacgagggctggccctttggaaggcgccttcaacagccggaccagacaggccaccatgaccgagaattccacgtccgcccctgcggccaagcccaagcgggccaaggcctccaagaagtccacagaccaccccaagtattcagacatgatcgtggctgccatccaggccgagaagaaccgcgctggctcctcgcgccagtccattcagaagtatatcaagagccactacaaggtgggtgagaacgctgactcgcagatcaagttgtccatcaagcgcctggtcaccaccggtgtcctcaagcagaccaaaggggtgggggcctcggggtccttccggctagccaagagcgacgaacccaagaagtcagtggccttcaagaagaccaagaaggaaatcaagaaggtagccacgccaaagaaggcatccaagcccaagaaggctgcctccaaagccccaaccaagaaacccaaagccaccccggtcaagaaggccaagaagaagctggctgccacgcccaagaaagccaaaaaacccaagactgtcaaagccaagccggtcaaggcatccaagcccaaaaagaagtgacaatgaagtcttttcttgcggacactccctcctgtctcctattttctgtaaataattttctccttttttctctcttgatgctcaccaccaccttttgcccccttctgttctgactttataagagacaggatttggattcttcagaaattacagaataattcatttttccttaaccagttgtgcaaggacagcaacaaccaatctaatgatgagaatgtacttatattttgttttgctattaacctacttacggggttagggatttgcggggggggcttgtgtgttttgttggcttgtttgccatgaaggtagatgtgggtggggagaagacacaaggcagtttgttctggctagatgagagggaacccaggaattgtgaggttagcaggaatatctttagggtgagtgagttttccttgagttgggcacccgttgtgagagtttcagaacctttggccagcaggagagaggtggtagggagcagccagccggcaaaggaaggaggtggaaaaaaaccgccaccgggctgacttccacctcccagtggtgagcagtgggggcccaaacccagtttccttctcatttttgttagtttgccctttcggcctccctattttcttagggaaggggagtggggtccaagtgacagctggatgggagaagccatagtttctcccagtcagctaggatgtagccattgggggatctttgtggcttcagcaaattctcttgttaaaccggagtgaaaacttcaggggaagggtggggagtcagccaagtgcctcagtgtgccctgttgaaacttaggtttttccacgcaatcgatggattgtgtcctaggaagacttttcttttcctctggatttttgttcctcctgtacaagaggtgtctttgcttggtttggtggggctgcggccacttaaaacctcccgatctctttttgagtcctttattataagtagttgtagctgcgggagggggagggggagtgggcgggcagtggatagtaagacttactgcagtcgatttgggatttgctaagtagttttacagagctagatctgtgtgcatgtgtgtgtttgtgtatatatacatatctagggctagtacttagtttcacacccgggagctgggagaaaaaacctgtacagttgtctttctcttatttttaataaaatagaaaaaatcgcgcacttgcgcgtcccccccccacccccttttttaaacaagtgttacttgtgccgggaaaattttgctgtctttgtaattttaaaactttaaaataaattggaaaagggagaaac

SEQ ID NO: 418576 - DNA, 842 bp, Homo sapiens
  misc_feature (21)..(21): n is a, c, g, or t
ccacgctggtacggccgcgtnttatatgtgacaggcgtcggaaaagggaggcagaggaggcggaggcagaggcagaggcagagcccggtgccgagaccaagcgacagaccggcggggctgggcctcgcaaagccggctcggcgagctctcccgacacccgagccggggaggaaaagcagcgactcctcgctcgcatccccgggagccgcactccagactggcccggtagtcaggggctcaggagcagatcccgaggcaggctttgctcagcctccgacgagggctggccctttggaaggcgccttcaacagccggaccagacaggccaccatgaccgagaattccacgtccgcccctgcggccaagcccaagcgggccaaggcctccaagaagtccacagaccaccccaagtattcagacatgatcgtggctgccatccaggccgagaagaaccgcgctggctcctcgcgccagtccattcagaagtatatcaagagccactacaaggtgggtgagaacgctgactcgcagatcaagttgtccatcaagcgcctggtcaccaccggtgtcctcaagcagaccaaaggggtgggggcctcggggtccttccggctagccaagagcgacgaacccaagaagtcagtggccttcaagaagaccaagaaggaaatcaagaaggtagccacgccaaagaaggcatccaagcccaagaaggctgcctccaaagccccaaccaagaaacccaaagccaccccttttttaaacaagtgttacttgtgccgggaaaattttgctgtctttgtaattttaaaactttaaaataaattggaaaagggagaaac

SEQ ID NO: 418577 - DNA, 1592 bp, Homo sapiens
gcaccttgtgctatattagtacttctcagacaggaagaattttctttgctggtgtagctcgtccggttaccttcaggaagattggataaccaagaaatgactaatcaagagtctgccgtacatgtgaaaatgatgccagaattccagaaaagttcagttcgaatcaagaaccctacaagagtagaagaaattatctgtggtcttatcaaaggaggagctgccaaacttcagataataacggactttgatatgacactcagtagattttcatataaagggaaaagatgcccaacatgtcataatatcattgacaactgtaagctggttacagatgaatgtagaaaaaagttattgcaactaaaggaaaaatactacgctattgaagttgatcctgttcttactgtagaagagaagtacccttatatggtggaatggtatactaaatcacatggtttgcttgttcagcaagctttaccaaaagctaaacttaaagaaattgtggcagaatctgacgttatgctcaaagaaggatatgagaatttctttgataagctccaacaacatagcatccccgtgttcatattttcggctggaatcggcgatgtactagaggaagttattcgtcaagctggtgtttatcatcccaatgtcaaagttgtgtccaattttatggattttgatgaaactggggtgctcaaaggatttaaaggagaactaattcatgtatttaacaaacatgatggtgccttgaggaatacagaatatttcaatcaactaaaagacaatagtaacataattcttctgggagactcccaaggagacttaagaatggcagatggagtggccaatgttgagcacattctgaaaattggatatctaaatgatagagtggatgagcttttagaaaagtacatggactcttatgatattgttttagtacaagatgaatcattagaagtagccaactctattttacagaagattctataaacaagcattctccaagaagacctctctcctgtgggtgcaattgaactgttcatccgttcatcttgctgagagacttatttataatatatccttactctcgaagtgttccctttgtataactgaagtattttcagatatggtgaatgcattgactggaagctccttttctccacctctctcaacacactcctcaccgtatcttttaacccatttaaaaaaaaaaatcttaaagccaaaattagaaaaataactccctacttttccaaagtgaattttgtagtttaatgttatcatgcagcttttgaggagtcttttacactgggaaagtttgtagaaattttaaaataagttttatgaaatggtgaaataatatgcatgattttaagtattgccatttttgtaatttgggttattatgctgatggtatcaccatctcttgaaattgtgttaggtttggttattttgtctggggaaaaaatatttactggaaaagactagcagttagtgttggaaaaacctggtggtgtttacaatgttgctaatcattacaaaacattctatattgaagcactgataataaatatgaaatgcaaaaccttttt

SEQ ID NO: 418578 - DNA, 930 bp, Homo sapiens
gcaccttgtgctatattagtacttctcagacaggaagaattttctttgctggtgtagctcgtccggttaccttcaggaagattggataaccaagaaatgactaatcaagagtctgccgtacatgtgaaaatgatgccagaattccagaaaagttcagttcgaatcaagaaccctacaagagtagaagaaattatctgtggtcttatcaaaggaggagctgccaaacttcagataataacggactttgatatgacactcagtagattttcatataaagggaaaagatgcccaacatgtcataatatcattgacaactgtaagctggttacagatgaatgtagaaaaaagttattgcaactaaaggaaaaatactacgctattgaagttgatcctgttcttactgtagaagagaagtacccttatatggtggaatggtatactaaatcacatggtttgcttgttcagcaagctttaccaaaagctaaacttaaagaaattgtggcagaatctgacgttatgctcaaagaaggatatgagaatttctttgataagctccaacaacatagcatccccgtgttcatattttcggctggaatcggcgatgtactagaggaagttattcgtcaagctggtgtttatcatcccaatgtcaaagttgtgtccaattttatggattttgatgaaactgtaagaatatcaaatcgttcttcataattttaaaatctgaaaatattttaatcatgtaaatttatttattgttacttaatatatatcctatatccagaaattaggccaagccgataggcccactgtgggactccatccttctcagtgttaatatatccatattttaaaaacaatgtgcccttcttaaactttcattccccaagctatagactaataataaaagtagtaaaacttcttcttttt

SEQ ID NO: 418579 - DNA, 621 bp, Homo sapiens
gcaccttgtgctatattagtacttctcagacaggaagaattttctttgctggtgtagctcgtccggttaccttcaggaagattggataaccaagaaatgactaatcaagagtctgccgtacatgtgaaaatgatgccagaattccagaaaagttcagttcgaatcaagaaccctacaagagtagaagaaattatctgtggtcttatcaaaggaggagctgccaaacttcagataataacggactttgatatgacactcagtagattttcatataaagggaaaagatgcccaacatgtcatagtaagtgtgatatttgtaaacaaattcacaaaagcatgtcatcattattttaagatcctctttatattacctgtgagataactgggtttttaaaattcttcttggacattgacagtgaggagacctgctttttcttattatatttttgaggttttttttcccatattatataaatggttattttcatgtatggttttggtagcaaagggaatcagagactcctgaaatatttcttgccaaatatggtctattcattattcaagaaatatttaaataggttgtaaactttgggttaacctgaagaaacaccatttatcaaa

SEQ ID NO: 418580 - DNA, 475 bp, Homo sapiens
tatattaggcagtaggaggattaaaaaaaaataataaaacaacactgcagttacaactgatggcttattttttacctgtattgcaaacaaacagattaataaattatgcaagttagagcattgaataacaaaatgagctctaattatctaatctctctaacagtttaggaatccttttgttttgtttatttaaggtgaagtccagtaggaataaattaaaagtcctgcatttaagtctcaaattaaaaacaagaatttttttttaagtatatgaacaaaacgtggcttaatgtgtaaagaaaaggtatgaggatttaaactgagtctgaactcagagccagcaggtgatatggttacccaaaaatcgacctttggttgcattaatcaaaatgcagtgttccaggcagatcacactgaaagcactgtgtcggattctggaagaatgctgttaagagaaaccatgacaatagtgacc

SEQ ID NO: 418581 - DNA, 1103 bp, Homo sapiens
ctttaataaccagtttgttatctccatcttacagaagaaggatatgagaatttctttgataagctccaacaacatagcatccccgtgttcatattttcggctggaatcggcgatgtactagaggaagttattcgtcaagctggtgtttatcatcccaatgtcaaagttgtgtccaattttatggattttgatgaaactggggtgctcaaaggatttaaaggagaactaattcatgtatttaacaaacatgatggtgccttgaggaatacagaatatttcaatcaactaaaagacaatagtaacataattcttctgggagactcccaaggagacttaagaatggcagatggagtggccaatgttgagcacattctgaaaattggatatctaaatgatagagtggatgagcttttagaaaagtacatggactcttatgatattgttttagtacaagatgaatcattagaagtagccaactctattttacagaagattctataaacaagcattctccaagaagacctctctcctgtgggtgcaattgaactgttcatccgttcatcttgctgagagacttatttataatatatccttactctcgaagtgttccctttgtataactgaagtattttcagatatggtgaatgcattgactggaagctccttttctccacctctctcaacacactcctcaccgtatcttttaacccatttaaaaaaaaaaatcttaaagccaaaattagaaaaataactccctacttttccaaagtgaattttgtagtttaatgttatcatgcagcttttgaggagtcttttacactgggaaagtttgtagaaattttaaaataagttttatgaaatggtgaaataatatgcatgattttaagtattgccatttttgtaatttgggttattatgctgatggtatcaccatctcttgaaattgtgttaggtttggttattttgtctggggaaaaaatatttactggaaaagactagcagttagtgttggaaaaacctggtggtgtttacaatgttgctaatcattacaaaacattctatattgaagcactgataataaatatgaaatgcaaaaccttttt

SEQ ID NO: 418582 - DNA, 1502 bp, Homo sapiens
tatattaggcagtaggaggattaaaaaaaaataataaaacaacactgcagttacaactgatggcttattttttacctgtattgcaaacaaacagattaataaattatgcaagttagagcattgaataacaaaatgagctctaattatctaatctctctaacagtttaggaatccttttgttttgtttatttaaggtgaagtccagtaggaataaattaaaagtcctgcatttaagtctcaaattaaaaacaagaatttttttttaagtatatgaacaaaacgtggcttaatgtgtaaagaaaaggtatgaggatttaaactgagtctgaactcagagccagcaggtgatatggttacccaaaaatcgacctttggttgcattaatcaaaatgcagtgttccaggcagatcacactgaaagcactgtgtcggattagaaggatatgagaatttctttgataagctccaacaacatagcatccccgtgttcatattttcggctggaatcggcgatgtactagaggaagttattcgtcaagctggtgtttatcatcccaatgtcaaagttgtgtccaattttatggattttgatgaaactggggtgctcaaaggatttaaaggagaactaattcatgtatttaacaaacatgatggtgccttgaggaatacagaatatttcaatcaactaaaagacaatagtaacataattcttctgggagactcccaaggagacttaagaatggcagatggagtggccaatgttgagcacattctgaaaattggatatctaaatgatagagtggatgagcttttagaaaagtacatggactcttatgatattgttttagtacaagatgaatcattagaagtagccaactctattttacagaagattctataaacaagcattctccaagaagacctctctcctgtgggtgcaattgaactgttcatccgttcatcttgctgagagacttatttataatatatccttactctcgaagtgttccctttgtataactgaagtattttcagatatggtgaatgcattgactggaagctccttttctccacctctctcaacacactcctcaccgtatcttttaacccatttaaaaaaaaaaatcttaaagccaaaattagaaaaataactccctacttttccaaagtgaattttgtagtttaatgttatcatgcagcttttgaggagtcttttacactgggaaagtttgtagaaattttaaaataagttttatgaaatggtgaaataatatgcatgattttaagtattgccatttttgtaatttgggttattatgctgatggtatcaccatctcttgaaattgtgttaggtttggttattttgtctggggaaaaaatatttactggaaaagactagcagttagtgttggaaaaacctggtggtgtttacaatgttgctaatcattacaaaacattctatattgaagcactgataataaatatgaaatgcaaaaccttttt

SEQ ID NO: 418583 - DNA, 961 bp, Homo sapiens
aaaatccaacaaatagaatttttaaagcctgttcaaaagatttatatttttcatagggggtgctcaaaggatttaaaggagaactaattcatgtatttaacaaacatgatggtgccttgaggaatacagaatatttcaatcaactaaaagacaatagtaacataattcttctgggagactcccaaggagacttaagaatggcagatggagtggccaatgttgagcacattctgaaaattggatatctaaatgatagagtggatgagcttttagaaaagtacatggactcttatgatattgttttagtacaagatgaatcattagaagtagccaactctattttacagaagattctataaacaagcattctccaagaagacctctctcctgtgggtgcaattgaactgttcatccgttcatcttgctgagagacttatttataatatatccttactctcgaagtgttccctttgtataactgaagtattttcagatatggtgaatgcattgactggaagctccttttctccacctctctcaacacactcctcaccgtatcttttaacccatttaaaaaaaaaaatcttaaagccaaaattagaaaaataactccctacttttccaaagtgaattttgtagtttaatgttatcatgcagcttttgaggagtcttttacactgggaaagtttgtagaaattttaaaataagttttatgaaatggtgaaataatatgcatgattttaagtattgccatttttgtaatttgggttattatgctgatggtatcaccatctcttgaaattgtgttaggtttggttattttgtctggggaaaaaatatttactggaaaagactagcagttagtgttggaaaaacctggtggtgtttacaatgttgctaatcattacaaaacattctatattgaagcactgataataaatatgaaatgcaaaaccttttt

SEQ ID NO: 418584 - DNA, 1692 bp, Homo sapiens
tccgtgatgctctgggatcccgcgcttccgagactcgcagtctacgcgagctgcctgtttttttcctgcttggacgcgcatgagggccccgtccatggaccgcgcggccgtggcgagggtgggcgcggtagcgagcgccagcgtgtgcgccctggtggcgggggtggtgctggctcagtacatattcaccttgaagaggaagacggggcggaagaccaagatcatcgagatgatgccagaattccagaaaagttcagttcgaatcaagaaccctacaagagtagaagaaattatctgtggtcttatcaaaggaggagctgccaaacttcagataataacggactttgatatgacactcagtagattttcatataaagggaaaagatgcccaacatgtcataatatcattgacaactgtaagctggttacagatgaatgtagaaaaaagttattgcaactaaaggaaaaatactacgctattgaagttgatcctgttcttactgtagaagagaagtacccttatatggtggaatggtatactaaatcacatggtttgcttgttcagcaagctttaccaaaagctaaacttaaagaaattgtggcagaatctgacgttatgctcaaagaaggatatgagaatttctttgataagctccaacaacatagcatccccgtgttcatattttcggctggaatcggcgatgtactagaggaagttattcgtcaagctggtgtttatcatcccaatgtcaaagttgtgtccaattttatggattttgatgaaactggggtgctcaaaggatttaaaggagaactaattcatgtatttaacaaacatgatggtgccttgaggaatacagaatatttcaatcaactaaaagacaatagtaacataattcttctgggagactcccaaggagacttaagaatggcagatggagtggccaatgttgagcacattctgaaaattggatatctaaatgatagagtggatgagcttttagaaaagtacatggactcttatgatattgttttagtacaagatgaatcattagaagtagccaactctattttacagaagattctataaacaagcattctccaagaagacctctctcctgtgggtgcaattgaactgttcatccgttcatcttgctgagagacttatttataatatatccttactctcgaagtgttccctttgtataactgaagtattttcagatatggtgaatgcattgactggaagctccttttctccacctctctcaacacactcctcaccgtatcttttaacccatttaaaaaaaaaaatcttaaagccaaaattagaaaaataactccctacttttccaaagtgaattttgtagtttaatgttatcatgcagcttttgaggagtcttttacactgggaaagtttgtagaaattttaaaataagttttatgaaatggtgaaataatatgcatgattttaagtattgccatttttgtaatttgggttattatgctgatggtatcaccatctcttgaaattgtgttaggtttggttattttgtctggggaaaaaatatttactggaaaagactagcagttagtgttggaaaaacctggtggtgtttacaatgttgctaatcattacaaaacattctatattgaagcactgataataaatatgaaatgcaaaaccttttt

SEQ ID NO: 418585 - DNA, 1747 bp, Homo sapiens
tccgtgatgctctgggatcccgcgcttccgagactcgcagtctacgcgagctgcctgtttttttcctgcttggacgcgcatgagggccccgtccatggaccgcgcggccgtggcgagggtgggcgcggtagcgagcgccagcgtgtgcgccctggtggcgggggtggtgctggctcagtacatattcaccttgaagaggaagacggggcggaagaccaagatcatcgagatgaagattggataaccaagaaatgactaatcaagagtctgccgtacatgtgaaaatgatgccagaattccagaaaagttcagttcgaatcaagaaccctacaagagtagaagaaattatctgtggtcttatcaaaggaggagctgccaaacttcagataataacggactttgatatgacactcagtagattttcatataaagggaaaagatgcccaacatgtcataatatcattgacaactgtaagctggttacagatgaatgtagaaaaaagttattgcaactaaaggaaaaatactacgctattgaagttgatcctgttcttactgtagaagagaagtacccttatatggtggaatggtatactaaatcacatggtttgcttgttcagcaagctttaccaaaagctaaacttaaagaaattgtggcagaatctgacgttatgctcaaagaaggatatgagaatttctttgataagctccaacaacatagcatccccgtgttcatattttcggctggaatcggcgatgtactagaggaagttattcgtcaagctggtgtttatcatcccaatgtcaaagttgtgtccaattttatggattttgatgaaactggggtgctcaaaggatttaaaggagaactaattcatgtatttaacaaacatgatggtgccttgaggaatacagaatatttcaatcaactaaaagacaatagtaacataattcttctgggagactcccaaggagacttaagaatggcagatggagtggccaatgttgagcacattctgaaaattggatatctaaatgatagagtggatgagcttttagaaaagtacatggactcttatgatattgttttagtacaagatgaatcattagaagtagccaactctattttacagaagattctataaacaagcattctccaagaagacctctctcctgtgggtgcaattgaactgttcatccgttcatcttgctgagagacttatttataatatatccttactctcgaagtgttccctttgtataactgaagtattttcagatatggtgaatgcattgactggaagctccttttctccacctctctcaacacactcctcaccgtatcttttaacccatttaaaaaaaaaaatcttaaagccaaaattagaaaaataactccctacttttccaaagtgaattttgtagtttaatgttatcatgcagcttttgaggagtcttttacactgggaaagtttgtagaaattttaaaataagttttatgaaatggtgaaataatatgcatgattttaagtattgccatttttgtaatttgggttattatgctgatggtatcaccatctcttgaaattgtgttaggtttggttattttgtctggggaaaaaatatttactggaaaagactagcagttagtgttggaaaaacctggtggtgtttacaatgttgctaatcattacaaaacattctatattgaagcactgataataaatatgaaatgcaaaaccttttt

SEQ ID NO: 418586 - DNA, 948 bp, Homo sapiens
tccgtgatgctctgggatcccgcgcttccgagactcgcagtctacgcgagctgcctgtttttttcctgcttggacgcgcatgagggccccgtccatggaccgcgcggccgtggcgagggtgggcgcggtagcgagcgccagcgtgtgcgccctggtggcgggggtggtgctggctcagtacatattcaccttgaagaggaagacggggcggaagaccaagatcatcgagatgaagattggataaccaagaaatgactaatcaagagtctgccgtacatgtgaaaatgatgccagaattccagaaaagttcagttcgaatcaagaaccctacaagagtagaagaaattatctgtggtcttatcaaaggaggagctgccaaacttcagataataacggactttgatatgacactcagtagattttcatataaagggaaaagatgcccaacatgtcataatatcattgacaactgtaagctggttacagatgaatgtagaaaaaaggtaaacactaacaacaatctatagtcactcaaagacttcattaccctttttgcctgagaatttcttcaggtgcattcacagaagtaagaatggatgtaaagtgcttacagccatacctggcacatagtaagcactcagtaaatagtaggtttgctgtatgaattacacattcaaaacatattttaaagataaaaattcacagtaacttgacaacaaaacttatatttaaaactcttaaatgattaccaaagtattctggtgttgtaacgttaactggagatttaaaacaaaagtacttcagttttctataggttttgctcctttaagttgatgaggaagttgcttcagtacttcgcttgagtatgtatgtgtctgtgtatatcttaacaaaatgcaatttgaaatgtgaatcaaatttaatacctttatatgaaaactaaagtgt

SEQ ID NO: 418587 - DNA, 1577 bp, Homo sapiens
ctagatccggggaagggttttgcagaagtacccagaactgtgtccaaggtttcctcagatttgggctgttccgcagcggcaggtcccgggaaccaaggcaacagacatcttcctaggctcgcgagagcgcccccttgtcccacggctgctggggccccccagtagccatggctccggtgtccggctcacgcagcccggatagggaggcctcgggctcggggggaagacgtcgcagttcgtcgaagagtccgaagcccagcaaatctgcccgctccccgcggggccgccgctctcgctcgcactcttgctctcggtccggggaccggaatggactcacccatcagctgggtggcctcagccaaggctcccgaaaccagtcctaccgctcacgctcgcggtcgcgttctagagagcggccctctgcgccccggggcatccccttcgcttctgcctcctcgtcagtctattacggcagctactcgcgcccctacgggagcgacaagccttggcctagcctcctcgacaaggagagggaggagagcctgcggcagaagagattaagtgagagagagagaattggagaattgggagctcctgaagtatggggactttctccaaagaatcctgaaccagattctgatgaacatacaccagtggaggatgaagagccaaagaaaagcactacttcagcttctacttcagaagaagaaaaaaagaagaagtctagccgttcaaaagaaaggtccaagaaaaggagaaagaaaaaatcatcgaaaagaaaacataagaagtattctgaagatagcgacagtgactctgattctgaaacagactccagtgatgaagataacaaaaggagagcaaagaaagccaagaaaaaggaaaagaagaagaaacacagatcgaagaaatataagaaaaagaggtctaagaagagcagaaaagagtccagtgattcaagctctaaagaatcccaagaagagtttctggaaaatccctggaaggatcgaacaaaggctgaagaaccatcagatttaattggcccagaggctccaaaaacacttacctctcaagatgataaacctttgaactatggccatgctctgttacctggtgaaggtgcagctatggctgaatatgtaaaagctggaaaacgtatcccacgaagaggtgaaattggcttgacaagtgaagaaattgcatcatttgaatgctcaggttatgtaatgagtggtagcaggcatcgccgaatggaggctgtgcgactgcgaaaagagaaccagatctacagtgctgatgagaagagagcccttgcatcctttaaccaagaagagagacgaaagagagagaacaagattctggccagttttcgagaaatggtttacagaaagaccaaagggaaggatgacaaataaagattttctgattgtccagaagacatttttaacaacaaaaaagaaagtctgggttccacacatacatagaaaaagattattatgttctgagaaagctttacagtgctactgtgccttctatttaattctttcagtccttcaataaaaagctgcttattgata

SEQ ID NO: 418588 - DNA, 667 bp, Homo sapiens
gccgggcgcggtggcgggcgcctgtagtcccagctatcaggaggctgagatgggggaattgcttgagccagggaggtggaagttgcagtgagccgagatcgtgccactgcattccaacctaggcaacagagcaagactccatctcaaaacaaaacaaaaaaaaaggacgtgtcaggcagctaaaatattaataaatgatcttttggaaatttaacccatttcaatttttgtcagctgttaaatagaccactctgggtaagaaaggattaatgatgatgtactatgaaaataattactgagaaattaagccaaaaataaaattctctccaggcatcgccgaatggaggctgtgcgactgcgaaaagagaaccagatctacagtgctgatgagaagagagcccttgcatcctttaaccaagaagagagacgaaagagagagaacaagattctggccagttttcgagaaatggtttacagaaagaccaaagggaaggatgacaaataaagattttctgattgtccagaagacatttttaacaacaaaaaagaaagtctgggttccacacatacatagaaaaagattattatgttctgagaaagctttacagtgctactgtgccttctatttaattctttcagtccttcaataaaaagctgcttattgata

SEQ ID NO: 418589 - DNA, 1792 bp, Homo sapiens
ctagatccggggaagggttttgcagaagtacccagaactgtgtccaaggtttcctcagatttgggctgttccgcagcggcaggtcccgggaaccaaggcaacagacatcttcctaggctcgcgagagcgcccccttgtcccacggctgctggggccccccagtagccatggctccggtgtccggctcacgcagcccggatagggaggcctcgggctcggggggaagacgtcgcagttcgtcgaagagtccgaagcccagcaaatctgcccgctccccgcggggccgccgctctcgctcgcactcttgctctcggtccggggaccggaatggactcacccatcagctgggtggcctcagccaaggctcccgaaaccagtcctaccgctcacgctcgcggtcgcgttctagagagcggccctctgcgccccggggcatccccttcgcttctgcctcctcgtcagtctattacggcagctactcgcgcccctacgggagcgacaagccttggcctagcctcctcgacaaggagagggaggagagcctgcggcagaagagattaagtgagagagagagaattggagaattgggagctcctgaagtatggggactttctccaaagaatcctgaaccagattctgatgaacatacaccagtggaggatgaagagccaaagaaaagcactacttcagcttctacttcagaagaagaaaaaaagaagaagtctagccgttcaaaagaaaggtccaagaaaaggagaaagaaaaaatcatcgaaaagaaaacataagaagtattctgaagatagcgacagtgactctgattctgaaacagactccagtgatgaagataacaaaaggagagcaaagaaagccaagaaaaaggaaaagaagaagaaacacagatcgaagaaatataagaaaaagaggtctaagaagagcagaaaagagtccagtgattcaagctctaaagaatcccaagaagagtttctggaaaatccctggaaggatcgaacaaaggctgaagaaccatcagatttaattggcccagaggctccaaaaacacttacctctcaagatgataaacctttgaactatggccatgctctgttacctggtgaaggtgcagctatggctgaatatgtaaaagctggaaaacgtatcccacgaagaggtgaaattggcttgacaagtgaagaaattgcatcatttgaatgctcaggttatgtaatgagtggtagcaggcatcgccgaatggaggctgtgcgactgcgaaaagagaaccagatctacagtgctgatgagaagagagcccttgcatcctttaaccaagaagagagacgaaagagagagaacaagattctggccagttttcgagaaatggtttacagaaagaccaaagggaaggatgacaaataaagattttctgattgtccagaagacatttttaacaacaaaaaagaaagtctgggttccacacatacatagaaaaagattattatgttctgagaaagctttacagtgctactgtgccttctatttaattctttcagtccttcaataaaaagctgcttattgatataactttagcaagttctttgggttattttggattgaccatagtaactttctggtttaaaaatccaaattatgggctgggcacggttgctcacgcctgtaatctcagcctcctgaaatgctgggattacaggtgtgagcaaccgtgcctggccgtttttgttaaggttatttgatctgcattattattacatgcctatgataaatttaaattacct

SEQ ID NO: 418590 - DNA, 1181 bp, Homo sapiens
ggattacaggggtgaaacactacacccagcctcctttagtgataatttttatagcaaaagatgatttggttaaataagttagaatactttttaaaaaaattcttaagaggcagtgtctcgctctgttgcccagactggagtgcagtgggctaatcatagctcattgcagcctcgaactcctgggctcaagtgatcctcccgcctcagcctcctgaatagcttagactacagatgtgtgccatcacacccagctacttttttttttttttaatagagacggggtcttgctctgtttcccaggttcagttagaagcagatttttttaagtaaaattatcttgtaagtttgaataagctgggaattcagatcattttattgtcacctttctttgccttgaaaaattaagatgtatagtcaccagttcaaaatttaaaaagaaaagaaaaattaagatgccctctaacataggaagattaagtgaatttgtatcaaattaaaatccctataggaagaaatataagaaaaagaggtctaagaagagcagaaaagagtccagtgattcaagctctaaagaatcccaagaagagtttctggaaaatccctggaaggatcgaacaaaggctgaagaaccatcagatttaattggcccagaggctccaaaaacacttacctctcaagatgataaacctttgaactatggccatgctctgttacctggtgaaggtgcagctatggctgaatatgtaaaagctggaaaacgtatcccacgaagaggtgaaattggcttgacaagtgaagaaattgcatcatttgaatgctcaggttatgtaatgagtggtagcaggcatcgccgaatggaggctgtgcgactgcgaaaagagaaccagatctacagtgctgatgagaagagagcccttgcatcctttaaccaagaagagagacgaaagagagagaacaagattctggccagttttcgagaaatggtttacagaaagaccaaagggaaggatgacaaataaagattttctgattgtccagaagacatttttaacaacaaaaaagaaagtctgggttccacacatacatagaaaaagattattatgttctgagaaagctttacagtgctactgtgccttctatttaattctttcagtccttcaataaaaagctgcttattgata

SEQ ID NO: 418591 - DNA, 443 bp, Homo sapiens
ttctgccttaggatctccaatgcttgcttttaatggttcttggacaatcgatgctgttactgaaaaatttggagttcatatctttacactccatggtccatatctcatcactttcctaattcttataaccattttatttaaattcagttctgatgaacatacaccagtggaggatgaagagccaaagaaaagcactacttcagcttctacttcagaaggtattttaaaaaaaagggtatttttaaaatacaagctattttattgagagatttaaaaaaatcagtttgtaaatagttgaacattagactttgcttttactcaaattgcccatcgtctgtttcttttgatgttcagaaatagttttttagaatataatttttttatttgtactttcttagaagaaaaaaagaagaagtctagccgttcaaaagaaaggtccaaga

SEQ ID NO: 418592 - DNA, 1521 bp, Homo sapiens
ctagatccggggaagggttttgcagaagtacccagaactgtgtccaaggtttcctcagatttgggctgttccgcagcggcaggtcccgggaaccaaggcaacagacatcttcctaggctcgcgagagcgcccccttgtcccacggctgctggggccccccagtagccatggctccggtgtccggctcacgcagcccggatagggaggcctcgggctcggggggaagacgtcgcagttcgtcgaagagtccgaagcccagcaaatctgcccgctccccgcggggccgccgctctcgctcgcactcttgctctcggtccggggaccggaatggactcacccatcagctgggtggcctcagccaaggctcccgaaaccagtcctaccgctcacgctcgcggtcgcgttctagagagcggccctctgcgccccggggcatccccttcgcttctgcctcctcgtcagtctattacggcagctactcgcgcccctacgggagcgacaagccttggcctagcctcctcgacaaggagagggaggagagcctgcggcagaagagattaagtgagagagagagaattggagaattgggagctcctgaagtatggggactttctccaaagaatcctgaaccagattctgatgaacatacaccagtggaggatgaagagccaaagaaaagcactacttcagcttctacttcagaagaaaaaatcatcgaaaagaaaacataagaagtattctgaagatagcgacagtgactctgattctgaaacagactccagtgatgaagataacaaaaggagagcaaagaaagccaagaaaaaggaaaagaagaagaaacacagatcgaagaaatataagaaaaagaggtctaagaagagcagaaaagagtccagtgattcaagctctaaagaatcccaagaagagtttctggaaaatccctggaaggatcgaacaaaggctgaagaaccatcagatttaattggcccagaggctccaaaaacacttacctctcaagatgataaacctttgaactatggccatgctctgttacctggtgaaggtgcagctatggctgaatatgtaaaagctggaaaacgtatcccacgaagaggtgaaattggcttgacaagtgaagaaattgcatcatttgaatgctcaggttatgtaatgagtggtagcaggcatcgccgaatggaggctgtgcgactgcgaaaagagaaccagatctacagtgctgatgagaagagagcccttgcatcctttaaccaagaagagagacgaaagagagagaacaagattctggccagttttcgagaaatggtttacagaaagaccaaagggaaggatgacaaataaagattttctgattgtccagaagacatttttaacaacaaaaaagaaagtctgggttccacacatacatagaaaaagattattatgttctgagaaagctttacagtgctactgtgccttctatttaattctttcagtccttcaataaaaagctgcttattgata

SEQ ID NO: 418593 - DNA, 3280 bp, Homo sapiens
acaatccagtgtcaagaaagaagtcaacttttcttcccctatttccctgcatttctcctctgtgctcactgccacacgcagctcaacctgagctacacagccagatgcgagatgcttctctgctgatctgagtctgcctgcagcatggaccttggtcttccctgaagcatctccagggctggagggacgactgccatgcaccgagggctcatccatccgcagagcagggcagtgggaggagacgctatgacccccatcgtcacagtcctgatctgtctcaggctgagtctgggcccccggacccacgtgcaggcagggaccctccccaagcccacactctgggctgagccaggctctgtgatcacccaggggagtcccgtgaccctctggtgtcaggggatcctggagacccaggagtaccgtctgtatagagaaaagaaaacagcaccctggattacacggatcccacaggagattgtgaagaagggccagttccccatcccatccatcacctgggaacacacagggcggtatcgctgtttctacggtagccacactgcaggctggtcagagcccagtgaccccctggagctggtggtgacaggagcctacatcaaacccaccctctcagctctacccagccctgtggtgacctcaggagggaacgtgaccctccattgtgtctcacaggtggcatttggcagcttcattctgtgtaaggaaggagaagatgaacacccacaatgcctgaactcacagccccgtacccatgggtggtcccgggccatcttctctgtgggccccgtgagcccgagtcgcaggtggtcgtacaggtgctatgcttatgactcgaactctccccatgtgtggtctctacccagtgatctcctggagctcctggtcctaggtgtttctaagaagccatcactctcagtgcagccaggtcctatagtggcccctggggagagcctgaccctccagtgtgtttctgatgtcagctacgacagatttgttctgtataaggagggagaacgtgacttcctccagctccctggcccacagccccaggctgggctctcccaggccaacttcaccctgggccctgtgagccgctcctacgggggccagtacagatgctccggtgcatacaacctctcctccgagtggtcggcccccagcgaccccctggacatcctgatcgcaggacagttccgtggcagacccttcatctcggtgcatccgggccccacggtggcctcaggagagaacgtgaccctgctgtgtcagtcatgggggccgttccacactttccttctgaccaaggcgggagcagctgatgcccccctccgtctcagatcaatacacgaatatcctaagtaccaggctgaattccctatgagtcctgtgacctcagcccactcggggacctacaggtgctacggctcactcagctccaacccctacctgctgtctcaccccagtgactccctggagctcatggtctcaggagcagctgagaccctcagcccaccacaaaacaagtccgattccaaggctggagcagctaacaccctcagcccatcacaaaacaagactgcctcacacccccaggattacacagtggagaatctcatccgcatgggcatagctggcttggtcctggtggtcctcgggattctgctatttgaggctcagcacagccagagaagcctctgagatgcagccgggaggtgaacagcagagagaagaatgtacccttcagagtggtggagccttgggaacagatctgatgatgccaggaggttccgggagacaatttagggctgatgctatctggactgtctgccaatcatttttagagggaggaatcagtgttggattgcagagacattttctggagtgatccatgaaggaccattaacatgtgatacctttcctctctattaatgttgacttcccttggttggatcctcttctttccccacccccagacagacatgaggctacatcccacatggcagcgttgggtccacacctctgcacatctgtgtgctctggtccatggtgtgtaacacagtcttctttattactcattgccatactccctggtgtgctttactgagcctccatctcttcaattcagagttccaaacgtgcttcagtaactaaatcaatgggagagtatcggatttcaaccaggaaaagataaatccaccctgatgccctgacaccctctctgaaccctacgagcccttccctccttctcacatgctacctgtgcagcttctccttagatcattgtgtaaccatcactgccatcctgttccacacatggtcatcaccctacacccattcagcagccactccccattccctcttccctccagcacctgctaaccacaaatgtgctttctgtctctacggatttgcctattctgtctgaaaacatttcaatctcctttgacctgtgagctcctcacttcgagacttcctgcctttccaggcagaaccaaagtacaccacgtcaaaagcaatgataggcatttgcagtgtgttggtgatccacgaaaggaaaatcacggaagcaggatagaaatccagctgcagacaagacctcaggtcgatgaatcttgacaagcagttgagctgtttttttctactcacctaggacagtcaggcagaagtatgcaaaatgactggggctgattcttttctgaattgtcgcaaacagcaagaggacttgagtcctagcattaaagagttcaacatgtctaggtccaagaccactgttgtgtttgaaggatgtaaaaccctgctgcataggatggaatatttggagggaggatcctgaaaaacatgagggatcaaatagtcctcaactttctaggacaaagggagcagctatttgccatctaccctccagaataaagaaatcttatcattcaccatctaccctctagaataaagaaatcttatcattcgccatctaccctgtagaataaagaaatcttatcattcaccgtctaccctctagagtaaacaaatcttatcattcaccatctaccctctagaataaagaaatcttatcattcgccatctaccctctagaataaagaaatcttatcattcaccgtctaccctctagagtaaacaaatcttatcattcgccatctaccctctagaatagagaaatcttatcattcatcatctaccctccagaataaagaaatgttatcatttgccatctaccctctagaataaagaaatcttattaaggaca

SEQ ID NO: 418594 - DNA, 688 bp, Homo sapiens
  misc_feature (665)..(666): n is a, c, g, or t
  misc_feature (669)..(672): n is a, c, g, or t
  misc_feature (674)..(674): n is a, c, g, or t
  misc_feature (676)..(676): n is a, c, g, or t
  misc_feature (679)..(679): n is a, c, g, or t
  misc_feature (681)..(681): n is a, c, g, or t
  misc_feature (683)..(684): n is a, c, g, or t
  misc_feature (686)..(687): n is a, c, g, or t
agcagaaccaggctgagcttggtgctctgatctcagatgcagtgggggatggcctgccccctccttggtcagaaggaaagtgtggaactgcccccgtgactgacacagcagggtcacgttctttcctggggctactgtggggaccggctgcaccgagagagagcaccaagctcagcagaaccaggctgaattccgcatgggtcctgtgacctcagcccacgtggggacctacagatgctacagctcactcagctccaacccctacctgctgtctctccccagtgaccccctggagctcgtggtctcagcatccctaggccaacacccccaggattacacagtggagaatctcatccgcatgggtgtggctggcttggtcctggtggtcctcgggattctgctatttgaggctcagcacagccagagaagcctacaagatgcagccgggaggtgaacagcagagaggacaatgcatacttcagcgtggtggagcctcagggacagatctgatgatcccaggaggctctggaggacaatctaggacctacattatctggactgtatgctggtcatttctagagacagcaatcaatatttgagtgtaaggaaactgtctggggtgattcctagaagatcattaaactgtggtacatttttttgtctannaannnngncntcncntnncnng

SEQ ID NO: 418595 - DNA, 2332 bp, Homo sapiens
  misc_feature (2309)..(2310): n is a, c, g, or t
  misc_feature (2313)..(2316): n is a, c, g, or t
  misc_feature (2318)..(2318): n is a, c, g, or t
  misc_feature (2320)..(2320): n is a, c, g, or t
  misc_feature (2323)..(2323): n is a, c, g, or t
  misc_feature (2325)..(2325): n is a, c, g, or t
  misc_feature (2327)..(2328): n is a, c, g, or t
  misc_feature (2330)..(2331): n is a, c, g, or t
acggtttggtaggaaggaaacacacactctcaagacagaacaaatatgttttattatagttaatccctgcatttccccttttgagacagggtctcactctgtcactgaggctggaatgctaaggggtgatcatagctccctgcagcctccgcctcccaggccgaagtattcctcccacctcagcctcctgagtagctgggactagagatgtgagctgccatgcctggctaattttttgctttttttatacagacaaggtcttgctatgtggcccagggtaatctgaagctcctggcctctagccttcacccacctcagcctcctgaagtgctgggattccaggcatgagccaccatggtagaccctgcattactcctctgtgctcactgccacacgcagctcaacctgagctacacagccaggtgtcaggtgcgtctctgctgatctgagtctaactgcagcatggacctgggttttccctgaagcatctccagggctggagggacgaccgccatgccctaaaggtatgacagccaggctcctgagagggcagttgcacttcctgtgtggttgcacataacaaaaccccatgacaagaaggatccagcctccgagtgtccacaccctgtgcgtctctctgtcctgccagcactgagggctcatccatccgcagagcagggcagtgggaggagacgccatgacccccatcctcacggtcctgatctgtctcgggctgagtctgggccccaggacccacgtgcaggcagggcacctccccaagcccaccctctgggctgagccaggctctgtgatcatccagggaagtcctgtgaccctcaggtgtcaggggagccttcaggctgaggagtaccatctatatagggaaaacaaatcagcatcctgggttagacggatacaagagcctgggaagaatggccagttccccatcccatccatcacctgggaacacgcagggcggtatcactgtcagtactacagccacaatcactcatcagagtacagtgaccccctggagctggtggtgacaggagcctacagcaaacccaccctctcagctctgcccagccctgtggtgaccttaggagggaacgtgaccctccagtgtgtctcacaggtggcatttgacggcttcattctgtgtaaggaaggagaagatgaacacccacaacgcctgaactcccattcccatgcccgtgggtggtcctgggccatcttctccgtgggccccgtgagcccgagtcgcaggtggtcgtacaggtgctatgcttatgactcgaactctccctatgtgtggtctctacccagtgatctcctggagctcctggtcccaggtgtttctaagaagccatcactctcagtgcagccaggtcctatggtggcccctggggagagcctgaccctccagtgtgtctctgatgtcggctacgacagatttgttctgtataaggagggagaacgtgacttcctccagcgccctggttggcagccccaggctgggctctcccaggccaacttcaccctgggccctgtgagcccctcccacgggggccagtacagatgctacagtgcacacaacctctcctccgagtggtcggcccccagtgaccccctggacatcctgatcacaggacagttctatgacagaccctctctctcggtgcagccggtccccacagtagccccaggaaagaacgtgaccctgctgtgtcagtcacgggggcagttccacactttccttctgaccaaggagggggcaggccatcccccactgcatctgagatcagagcaccaagctcagcagaaccaggctgaattccgcatgggtcctgtgacctcagcccacgtggggacctacagatgctacagctcactcagctccaacccctacctgctgtctctccccagtgaccccctggagctcgtggtctcagcatccctaggccaacacccccaggattacacagtggagaatctcatccgcatgggtgtggctggcttggtcctggtggtcctcgggattctgctatttgaggctcagcacagccagagaagcctacaagatgcagccgggaggtgaacagcagagaggacaatgcatacttcagcgtggtggagcctcagggacagatctgatgatcccaggaggctctggaggacaatctaggacctacattatctggactgtatgctggtcatttctagagacagcaatcaatatttgagtgtaaggaaactgtctggggtgattcctagaagatcattaaactgtggtacatttttttgtctannaannnngncntcncntnncnng

SEQ ID NO: 418596 - DNA, 2163 bp, Homo sapiens
  misc_feature (2140)..(2141): n is a, c, g, or t
  misc_feature (2144)..(2147): n is a, c, g, or t
  misc_feature (2149)..(2149): n is a, c, g, or t
  misc_feature (2151)..(2151): n is a, c, g, or t
  misc_feature (2154)..(2154): n is a, c, g, or t
  misc_feature (2156)..(2156): n is a, c, g, or t
  misc_feature (2158)..(2159): n is a, c, g, or t
  misc_feature (2161)..(2162): n is a, c, g, or t
acggtttggtaggaaggaaacacacactctcaagacagaacaaatatgttttattatagttaatccctgcatttccccttttgagacagggtctcactctgtcactgaggctggaatgctaaggggtgatcatagctccctgcagcctccgcctcccaggccgaagtattcctcccacctcagcctcctgagtagctgggactagagatgtgagctgccatgcctggctaattttttgctttttttatacagacaaggtcttgctatgtggcccagggtaatctgaagctcctggcctctagccttcacccacctcagcctcctgaagtgctgggattccaggcatgagccaccatggtagaccctgcattactcctctgtgctcactgccacacgcagctcaacctgagctacacagccaggtgtcaggtgcgtctctgctgatctgagtctaactgcagcatggacctgggttttccctgaagcatctccagggctggagggacgaccgccatgcactgagggctcatccatccgcagagcagggcagtgggaggagacgccatgacccccatcctcacggtcctgatctgtctcgggcacctccccaagcccaccctctgggctgagccaggctctgtgatcatccagggaagtcctgtgaccctcaggtgtcaggggagccttcaggctgaggagtaccatctatatagggaaaacaaatcagcatcctgggttagacggatacaagagcctgggaagaatggccagttccccatcccatccatcacctgggaacacgcagggcggtatcactgtcagtactacagccacaatcactcatcagagtacagtgaccccctggagctggtggtgacaggagcctacagcaaacccaccctctcagctctgcccagccctgtggtgaccttaggagggaacgtgaccctccagtgtgtctcacaggtggcatttgacggcttcattctgtgtaaggaaggagaagatgaacacccacaacgcctgaactcccattcccatgcccgtgggtggtcctgggccatcttctccgtgggccccgtgagcccgagtcgcaggtggtcgtacaggtgctatgcttatgactcgaactctccctatgtgtggtctctacccagtgatctcctggagctcctggtcccaggtgtttctaagaagccatcactctcagtgcagccaggtcctatggtggcccctggggagagcctgaccctccagtgtgtctctgatgtcggctacgacagatttgttctgtataaggagggagaacgtgacttcctccagcgccctggttggcagccccaggctgggctctcccaggccaacttcaccctgggccctgtgagcccctcccacgggggccagtacagatgctacagtgcacacaacctctcctccgagtggtcggcccccagtgaccccctggacatcctgatcacaggacagttctatgacagaccctctctctcggtgcagccggtccccacagtagccccaggaaagaacgtgaccctgctgtgtcagtcacgggggcagttccacactttccttctgaccaaggagggggcaggccatcccccactgcatctgagatcagagcaccaagctcagcagaaccaggctgaattccgcatgggtcctgtgacctcagcccacgtggggacctacagatgctacagctcactcagctccaacccctacctgctgtctctccccagtgaccccctggagctcgtggtctcagcatccctaggccaacacccccaggattacacagtggagaatctcatccgcatgggtgtggctggcttggtcctggtggtcctcgggattctgctatttgaggctcagcacagccagagaagcctacaagatgcagccgggaggtgaacagcagagaggacaatgcatacttcagcgtggtggagcctcagggacagatctgatgatcccaggaggctctggaggacaatctaggacctacattatctggactgtatgctggtcatttctagagacagcaatcaatatttgagtgtaaggaaactgtctggggtgattcctagaagatcattaaactgtggtacatttttttgtctannaannnngncntcncntnncnng

SEQ ID NO: 418597 - DNA, 3198 bp, Homo sapiens
acaatccagtgtcaagaaagaagtcaacttttcttcccctatttccctgcatttctcctctgtgctcactgccacacgcagctcaacctgagctacacagccagatgcgagatgcttctctgctgatctgagtctgcctgcagcatggaccttggtcttccctgaagcatctccagggctggagggacgactgccatgggctgagtctgggcccccggacccacgtgcaggcagggaccctccccaagcccacactctgggctgagccaggctctgtgatcacccaggggagtcccgtgaccctctggtgtcaggggatcctggagacccaggagtaccgtctgtatagagaaaagaaaacagcaccctggattacacggatcccacaggagattgtgaagaagggccagttccccatcccatccatcacctgggaacacacagggcggtatcgctgtttctacggtagccacactgcaggctggtcagagcccagtgaccccctggagctggtggtgacaggagcctacatcaaacccaccctctcagctctacccagccctgtggtgacctcaggagggaacgtgaccctccattgtgtctcacaggtggcatttggcagcttcattctgtgtaaggaaggagaagatgaacacccacaatgcctgaactcacagccccgtacccatgggtggtcccgggccatcttctctgtgggccccgtgagcccgagtcgcaggtggtcgtacaggtgctatgcttatgactcgaactctccccatgtgtggtctctacccagtgatctcctggagctcctggtcctaggtgtttctaagaagccatcactctcagtgcagccaggtcctatagtggcccctggggagagcctgaccctccagtgtgtttctgatgtcagctacgacagatttgttctgtataaggagggagaacgtgacttcctccagctccctggcccacagccccaggctgggctctcccaggccaacttcaccctgggccctgtgagccgctcctacgggggccagtacagatgctccggtgcatacaacctctcctccgagtggtcggcccccagcgaccccctggacatcctgatcgcaggacagttccgtggcagacccttcatctcggtgcatccgggccccacggtggcctcaggagagaacgtgaccctgctgtgtcagtcatgggggccgttccacactttccttctgaccaaggcgggagcagctgatgcccccctccgtctcagatcaatacacgaatatcctaagtaccaggctgaattccctatgagtcctgtgacctcagcccactcggggacctacaggtgctacggctcactcagctccaacccctacctgctgtctcaccccagtgactccctggagctcatggtctcaggagcagctgagaccctcagcccaccacaaaacaagtccgattccaaggctggagcagctaacaccctcagcccatcacaaaacaagactgcctcacacccccaggattacacagtggagaatctcatccgcatgggcatagctggcttggtcctggtggtcctcgggattctgctatttgaggctcagcacagccagagaagcctctgagatgcagccgggaggtgaacagcagagagaagaatgtacccttcagagtggtggagccttgggaacagatctgatgatgccaggaggttccgggagacaatttagggctgatgctatctggactgtctgccaatcatttttagagggaggaatcagtgttggattgcagagacattttctggagtgatccatgaaggaccattaacatgtgatacctttcctctctattaatgttgacttcccttggttggatcctcttctttccccacccccagacagacatgaggctacatcccacatggcagcgttgggtccacacctctgcacatctgtgtgctctggtccatggtgtgtaacacagtcttctttattactcattgccatactccctggtgtgctttactgagcctccatctcttcaattcagagttccaaacgtgcttcagtaactaaatcaatgggagagtatcggatttcaaccaggaaaagataaatccaccctgatgccctgacaccctctctgaaccctacgagcccttccctccttctcacatgctacctgtgcagcttctccttagatcattgtgtaaccatcactgccatcctgttccacacatggtcatcaccctacacccattcagcagccactccccattccctcttccctccagcacctgctaaccacaaatgtgctttctgtctctacggatttgcctattctgtctgaaaacatttcaatctcctttgacctgtgagctcctcacttcgagacttcctgcctttccaggcagaaccaaagtacaccacgtcaaaagcaatgataggcatttgcagtgtgttggtgatccacgaaaggaaaatcacggaagcaggatagaaatccagctgcagacaagacctcaggtcgatgaatcttgacaagcagttgagctgtttttttctactcacctaggacagtcaggcagaagtatgcaaaatgactggggctgattcttttctgaattgtcgcaaacagcaagaggacttgagtcctagcattaaagagttcaacatgtctaggtccaagaccactgttgtgtttgaaggatgtaaaaccctgctgcataggatggaatatttggagggaggatcctgaaaaacatgagggatcaaatagtcctcaactttctaggacaaagggagcagctatttgccatctaccctccagaataaagaaatcttatcattcaccatctaccctctagaataaagaaatcttatcattcgccatctaccctgtagaataaagaaatcttatcattcaccgtctaccctctagagtaaacaaatcttatcattcaccatctaccctctagaataaagaaatcttatcattcgccatctaccctctagaataaagaaatcttatcattcaccgtctaccctctagagtaaacaaatcttatcattcgccatctaccctctagaatagagaaatcttatcattcatcatctaccctccagaataaagaaatgttatcatttgccatctaccctctagaataaagaaatcttattaaggaca

SEQ ID NO: 418598 - DNA, 2910 bp, Homo sapiens
acggtttggtaggaaggaaacacacactctcaagacagaacaaatatgttttattatagttaatccctgcatttccccttttgagacagggtctcactctgtcactgaggctggaatgctaaggggtgatcatagctccctgcagcctccgcctcccaggccgaagtattcctcccacctcagcctcctgagtagctgggactagagatgtgagctgccatgcctggctaattttttgctttttttatacagacaaggtcttgctatgtggcccagggtaatctgaagctcctggcctctagccttcacccacctcagcctcctgaagtgctgggattccaggcatgagccaccatggtagaccctgcattactcctctgtgctcactgccacacgcagctcaacctgagctacacagccaggtgtcaggtgcgtctctgctgatctgagtctaactgcagcatggacctgggttttccctgaagcatctccagggctggagggacgaccgccatgggctgagtctgggccccaggacccacgtgcaggcagggcacctccccaagcccaccctctgggctgagccaggctctgtgatcatccagggaagtcctgtgaccctcaggtgtcaggggagccttcaggctgaggagtaccatctatatagggaaaacaaatcagcatcctgggttagacggatacaagagcctgggaagaatggccagttccccatcccatccatcacctgggaacacgcagggcggtatcactgtcagtactacagccacaatcactcatcagagtacagtgaccccctggagctggtggtgacaggagcctacagcaaacccaccctctcagctctgcccagccctgtggtgaccttaggagggaacgtgaccctccagtgtgtctcacaggtggcatttgacggcttcattctgtgtaaggaaggagaagatgaacacccacaacgcctgaactcccattcccatgcccgtgggtggtcctgggccatcttctccgtgggccccgtgagcccgagtcgcaggtggtcgtacaggtgctatgcttatgactcgaactctccctatgtgtggtctctacccagtgatctcctggagctcctggtcccaggagcagctgagaccctcagcccaccacaaaacaagtccgattccaaggctggagcagctaacaccctcagcccatcacaaaacaagactgcctcacacccccaggattacacagtggagaatctcatccgcatgggcatagctggcttggtcctggtggtcctcgggattctgctatttgaggctcagcacagccagagaagcctctgagatgcagccgggaggtgaacagcagagagaagaatgtacccttcagagtggtggagccttgggaacagatctgatgatgccaggaggttccgggagacaatttagggctgatgctatctggactgtctgccaatcatttttagagggaggaatcagtgttggattgcagagacattttctggagtgatccatgaaggaccattaacatgtgatacctttcctctctattaatgttgacttcccttggttggatcctcttctttccccacccccagacagacatgaggctacatcccacatggcagcgttgggtccacacctctgcacatctgtgtgctctggtccatggtgtgtaacacagtcttctttattactcattgccatactccctggtgtgctttactgagcctccatctcttcaattcagagttccaaacgtgcttcagtaactaaatcaatgggagagtatcggatttcaaccaggaaaagataaatccaccctgatgccctgacaccctctctgaaccctacgagcccttccctccttctcacatgctacctgtgcagcttctccttagatcattgtgtaaccatcactgccatcctgttccacacatggtcatcaccctacacccattcagcagccactccccattccctcttccctccagcacctgctaaccacaaatgtgctttctgtctctacggatttgcctattctgtctgaaaacatttcaatctcctttgacctgtgagctcctcacttcgagacttcctgcctttccaggcagaaccaaagtacaccacgtcaaaagcaatgataggcatttgcagtgtgttggtgatccacgaaaggaaaatcacggaagcaggatagaaatccagctgcagacaagacctcaggtcgatgaatcttgacaagcagttgagctgtttttttctactcacctaggacagtcaggcagaagtatgcaaaatgactggggctgattcttttctgaattgtcgcaaacagcaagaggacttgagtcctagcattaaagagttcaacatgtctaggtccaagaccactgttgtgtttgaaggatgtaaaaccctgctgcataggatggaatatttggagggaggatcctgaaaaacatgagggatcaaatagtcctcaactttctaggacaaagggagcagctatttgccatctaccctccagaataaagaaatcttatcattcaccatctaccctctagaataaagaaatcttatcattcgccatctaccctgtagaataaagaaatcttatcattcaccgtctaccctctagagtaaacaaatcttatcattcaccatctaccctctagaataaagaaatcttatcattcgccatctaccctctagaataaagaaatcttatcattcaccgtctaccctctagagtaaacaaatcttatcattcgccatctaccctctagaatagagaaatcttatcattcatcatctaccctccagaataaagaaatgttatcatttgccatctaccctctagaataaagaaatcttattaaggaca

SEQ ID NO: 418599 - DNA, 2992 bp, Homo sapiens
acggtttggtaggaaggaaacacacactctcaagacagaacaaatatgttttattatagttaatccctgcatttccccttttgagacagggtctcactctgtcactgaggctggaatgctaaggggtgatcatagctccctgcagcctccgcctcccaggccgaagtattcctcccacctcagcctcctgagtagctgggactagagatgtgagctgccatgcctggctaattttttgctttttttatacagacaaggtcttgctatgtggcccagggtaatctgaagctcctggcctctagccttcacccacctcagcctcctgaagtgctgggattccaggcatgagccaccatggtagaccctgcattactcctctgtgctcactgccacacgcagctcaacctgagctacacagccaggtgtcaggtgcgtctctgctgatctgagtctaactgcagcatggacctgggttttccctgaagcatctccagggctggagggacgaccgccatgcactgagggctcatccatccgcagagcagggcagtgggaggagacgccatgacccccatcctcacggtcctgatctgtctcgggctgagtctgggccccaggacccacgtgcaggcagggcacctccccaagcccaccctctgggctgagccaggctctgtgatcatccagggaagtcctgtgaccctcaggtgtcaggggagccttcaggctgaggagtaccatctatatagggaaaacaaatcagcatcctgggttagacggatacaagagcctgggaagaatggccagttccccatcccatccatcacctgggaacacgcagggcggtatcactgtcagtactacagccacaatcactcatcagagtacagtgaccccctggagctggtggtgacaggagcctacagcaaacccaccctctcagctctgcccagccctgtggtgaccttaggagggaacgtgaccctccagtgtgtctcacaggtggcatttgacggcttcattctgtgtaaggaaggagaagatgaacacccacaacgcctgaactcccattcccatgcccgtgggtggtcctgggccatcttctccgtgggccccgtgagcccgagtcgcaggtggtcgtacaggtgctatgcttatgactcgaactctccctatgtgtggtctctacccagtgatctcctggagctcctggtcccaggagcagctgagaccctcagcccaccacaaaacaagtccgattccaaggctggagcagctaacaccctcagcccatcacaaaacaagactgcctcacacccccaggattacacagtggagaatctcatccgcatgggcatagctggcttggtcctggtggtcctcgggattctgctatttgaggctcagcacagccagagaagcctctgagatgcagccgggaggtgaacagcagagagaagaatgtacccttcagagtggtggagccttgggaacagatctgatgatgccaggaggttccgggagacaatttagggctgatgctatctggactgtctgccaatcatttttagagggaggaatcagtgttggattgcagagacattttctggagtgatccatgaaggaccattaacatgtgatacctttcctctctattaatgttgacttcccttggttggatcctcttctttccccacccccagacagacatgaggctacatcccacatggcagcgttgggtccacacctctgcacatctgtgtgctctggtccatggtgtgtaacacagtcttctttattactcattgccatactccctggtgtgctttactgagcctccatctcttcaattcagagttccaaacgtgcttcagtaactaaatcaatgggagagtatcggatttcaaccaggaaaagataaatccaccctgatgccctgacaccctctctgaaccctacgagcccttccctccttctcacatgctacctgtgcagcttctccttagatcattgtgtaaccatcactgccatcctgttccacacatggtcatcaccctacacccattcagcagccactccccattccctcttccctccagcacctgctaaccacaaatgtgctttctgtctctacggatttgcctattctgtctgaaaacatttcaatctcctttgacctgtgagctcctcacttcgagacttcctgcctttccaggcagaaccaaagtacaccacgtcaaaagcaatgataggcatttgcagtgtgttggtgatccacgaaaggaaaatcacggaagcaggatagaaatccagctgcagacaagacctcaggtcgatgaatcttgacaagcagttgagctgtttttttctactcacctaggacagtcaggcagaagtatgcaaaatgactggggctgattcttttctgaattgtcgcaaacagcaagaggacttgagtcctagcattaaagagttcaacatgtctaggtccaagaccactgttgtgtttgaaggatgtaaaaccctgctgcataggatggaatatttggagggaggatcctgaaaaacatgagggatcaaatagtcctcaactttctaggacaaagggagcagctatttgccatctaccctccagaataaagaaatcttatcattcaccatctaccctctagaataaagaaatcttatcattcgccatctaccctgtagaataaagaaatcttatcattcaccgtctaccctctagagtaaacaaatcttatcattcaccatctaccctctagaataaagaaatcttatcattcgccatctaccctctagaataaagaaatcttatcattcaccgtctaccctctagagtaaacaaatcttatcattcgccatctaccctctagaatagagaaatcttatcattcatcatctaccctccagaataaagaaatgttatcatttgccatctaccctctagaataaagaaatcttattaaggaca

SEQ ID NO: 418600 - DNA, 2383 bp, Homo sapiens
  misc_feature (2360)..(2361): n is a, c, g, or t
  misc_feature (2364)..(2367): n is a, c, g, or t
  misc_feature (2369)..(2369): n is a, c, g, or t
  misc_feature (2371)..(2371): n is a, c, g, or t
  misc_feature (2374)..(2374): n is a, c, g, or t
  misc_feature (2376)..(2376): n is a, c, g, or t
  misc_feature (2378)..(2379): n is a, c, g, or t
  misc_feature (2381)..(2382): n is a, c, g, or t
acggtttggtaggaaggaaacacacactctcaagacagaacaaatatgttttattatagttaatccctgcatttccccttttgagacagggtctcactctgtcactgaggctggaatgctaaggggtgatcatagctccctgcagcctccgcctcccaggccgaagtattcctcccacctcagcctcctgagtagctgggactagagatgtgagctgccatgcctggctaattttttgctttttttatacagacaaggtcttgctatgtggcccagggtaatctgaagctcctggcctctagccttcacccacctcagcctcctgaagtgctgggattccaggcatgagccaccatggtagaccctgcattactcctctgtgctcactgccacacgcagctcaacctgagctacacagccaggtgtcaggtgcgtctctgctgatctgagtctaactgcagcatggacctgggttttccctgaagcatctccagggctggagggacgaccgccatgccctaaaggtatgacagccaggctcctgagagggcagttgcacttcctgtgtggttgcacataacaaaaccccatgacaagaaggatccagcctccgagtgtccacaccctgtgcgtctctctgtcctgccagcactgagggctcatccatccgcagagcagggcagtgggaggagacgccatgacccccatcctcacggtcctgatctgtctcgggctgagtctgggccccaggacccacgtgcaggcagggcacctccccaagcccaccctctgggctgagccaggctctgtgatcatccagggaagtcctgtgaccctcaggtgtcaggggagccttcaggctgaggagtaccatctatatagggaaaacaaatcagcatcctgggttagacggatacaagagcctgggaagaatggccagttccccatcccatccatcacctgggaacacgcagggcggtatcactgtcagtactacagccacaatcactcatcagagtacagtgaccccctggagctggtggtgacaggagcctacagcaaacccaccctctcagctctgcccagccctgtggtgaccttaggagggaacgtgaccctccagtgtgtctcacaggtggcatttgacggcttcattctgtgtaaggaaggagaagatgaacacccacaacgcctgaactcccattcccatgcccgtgggtggtcctgggccatcttctccgtgggccccgtgagcccgagtcgcaggtggtcgtacaggtgctatgcttatgactcgaactctccctatgtgtggtctctacccagtgatctcctggagctcctggtcccaggtgtttctaagaagccatcactctcagtgcagccaggtcctatggtggcccctggggagagcctgaccctccagtgtgtctctgatgtcggctacgacagatttgttctgtataaggagggagaacgtgacttcctccagcgccctggttggcagccccaggctgggctctcccaggccaacttcaccctgggccctgtgagcccctcccacgggggccagtacagatgctacagtgcacacaacctctcctccgagtggtcggcccccagtgaccccctggacatcctgatcacaggacagttctatgacagaccctctctctcggtgcagccggtccccacagtagccccaggaaagaacgtgaccctgctgtgtcagtcacgggggcagttccacactttccttctgaccaaggagggggcaggccatcccccactgcatctgagatcagagcaccaagctcagcagaaccaggctgaattccgcatgggtcctgtgacctcagcccacgtggggacctacagatgctacagctcactcagctccaacccctacctgctgtctctccccagtgaccccctggagctcgtggtctcagaagcagctgagaccctcagcccatcacaaaacaagacagactccacgactacatccctaggccaacacccccaggattacacagtggagaatctcatccgcatgggtgtggctggcttggtcctggtggtcctcgggattctgctatttgaggctcagcacagccagagaagcctacaagatgcagccgggaggtgaacagcagagaggacaatgcatacttcagcgtggtggagcctcagggacagatctgatgatcccaggaggctctggaggacaatctaggacctacattatctggactgtatgctggtcatttctagagacagcaatcaatatttgagtgtaaggaaactgtctggggtgattcctagaagatcattaaactgtggtacatttttttgtctannaannnngncntcncntnncnng

SEQ ID NO: 418601 - DNA, 1544 bp, Homo sapiens
  misc_feature (1521)..(1522): n is a, c, g, or t
  misc_feature (1525)..(1528): n is a, c, g, or t
  misc_feature (1530)..(1530): n is a, c, g, or t
  misc_feature (1532)..(1532): n is a, c, g, or t
  misc_feature (1535)..(1535): n is a, c, g, or t
  misc_feature (1537)..(1537): n is a, c, g, or t
  misc_feature (1539)..(1540): n is a, c, g, or t
  misc_feature (1542)..(1543): n is a, c, g, or t
acggtttggtaggaaggaaacacacactctcaagacagaacaaatatgttttattatagttaatccctgcatttccccttttgagacagggtctcactctgtcactgaggctggaatgctaaggggtgatcatagctccctgcagcctccgcctcccaggccgaagtattcctcccacctcagcctcctgagtagctgggactagagatgtgagctgccatgcctggctaattttttgctttttttatacagacaaggtcttgctatgtggcccagggtaatctgaagctcctggcctctagccttcacccacctcagcctcctgaagtgctgggattccaggcatgagccaccatggtagaccctgcattactcctctgtgctcactgccacacgcagctcaacctgagctacacagccaggtgtcaggtgcgtctctgctgatctgagtctaactgcagcatggacctgggttttccctgaagcatctccagggctggagggacgaccgccatgccctaaaggtatgacagccaggctcctgagagggcagttgcacttcctgtgtggttgcacataacaaaaccccatgacaagaaggatccagcctccgagtgtccacaccctgtgcgtctctctgtcctgccagcactgagggctcatccatccgcagagcagggcagtgggaggagacgccatgacccccatcctcacggtcctgatctgtctcgggctgagtctgggccccaggacccacgtgcaggcagggcacctccccaagcccaccctctgggctgagccaggctctgtgatcatccagggaagtcctgtgaccctcaggtgtcaggggagccttcaggctgaggagtaccatctatatagggaaaacaaatcagcatcctgggttagacggatacaagagcctgggaagaatggccagttccccatcccatccatcacctgggaacacgcagggcggtatcactgtcagtactacagccacaatcactcatcagaagcaccaagctcagcagaaccaggctgaattccgcatgggtcctgtgacctcagcccacgtggggacctacagatgctacagctcactcagctccaacccctacctgctgtctctccccagtgaccccctggagctcgtggtctcagcatccctaggccaacacccccaggattacacagtggagaatctcatccgcatgggtgtggctggcttggtcctggtggtcctcgggattctgctatttgaggctcagcacagccagagaagcctacaagatgcagccgggaggtgaacagcagagaggacaatgcatacttcagcgtggtggagcctcagggacagatctgatgatcccaggaggctctggaggacaatctaggacctacattatctggactgtatgctggtcatttctagagacagcaatcaatatttgagtgtaaggaaactgtctggggtgattcctagaagatcattaaactgtggtacatttttttgtctannaannnngncntcncntnncnng

SEQ ID NO: 418602 - DNA, 3442 bp, Homo sapiens
acaatccagtgtcaagaaagaagtcaacttttcttcccctatttccctgcatttctcctctgtgctcactgccacacgcagctcaacctgagctacacagccagatgcgagatgcttctctgctgatctgagtctgcctgcagcatggaccttggtcttccctgaagcatctccagggctggagggacgactgccatgcaccgagggctcatccatccgcagagcagggcagtgggaggagacgctatgacccccatcgtcacagtcctgatctgtctcagtgagatttgaagagggaggggagcttctaacctaggagggacctcaccccacagccgacctctagtccctaaggagaccccaggggctcacaaagatcccagggaggggaggacctgcccaggcttcaggggcaaattcctcacagggaactctcttccagggctgagtctgggcccccggacccacgtgcaggcagggaccctccccaagcccacactctgggctgagccaggctctgtgatcacccaggggagtcccgtgaccctctggtgtcaggggatcctggagacccaggagtaccgtctgtatagagaaaagaaaacagcaccctggattacacggatcccacaggagattgtgaagaagggccagttccccatcccatccatcacctgggaacacacagggcggtatcgctgtttctacggtagccacactgcaggctggtcagagcccagtgaccccctggagctggtggtgacaggagcctacatcaaacccaccctctcagctctacccagccctgtggtgacctcaggagggaacgtgaccctccattgtgtctcacaggtggcatttggcagcttcattctgtgtaaggaaggagaagatgaacacccacaatgcctgaactcacagccccgtacccatgggtggtcccgggccatcttctctgtgggccccgtgagcccgagtcgcaggtggtcgtacaggtgctatgcttatgactcgaactctccccatgtgtggtctctacccagtgatctcctggagctcctggtcctaggtgtttctaagaagccatcactctcagtgcagccaggtcctatagtggcccctggggagagcctgaccctccagtgtgtttctgatgtcagctacgacagatttgttctgtataaggagggagaacgtgacttcctccagctccctggcccacagccccaggctgggctctcccaggccaacttcaccctgggccctgtgagccgctcctacgggggccagtacagatgctccggtgcatacaacctctcctccgagtggtcggcccccagcgaccccctggacatcctgatcgcaggacagttccgtggcagacccttcatctcggtgcatccgggccccacggtggcctcaggagagaacgtgaccctgctgtgtcagtcatgggggccgttccacactttccttctgaccaaggcgggagcagctgatgcccccctccgtctcagatcaatacacgaatatcctaagtaccaggctgaattccctatgagtcctgtgacctcagcccactcggggacctacaggtgctacggctcactcagctccaacccctacctgctgtctcaccccagtgactccctggagctcatggtctcaggagcagctgagaccctcagcccaccacaaaacaagtccgattccaaggctggagcagctaacaccctcagcccatcacaaaacaagactgcctcacacccccaggattacacagtggagaatctcatccgcatgggcatagctggcttggtcctggtggtcctcgggattctgctatttgaggctcagcacagccagagaagcctctgagatgcagccgggaggtgaacagcagagagaagaatgtacccttcagagtggtggagccttgggaacagatctgatgatgccaggaggttccgggagacaatttagggctgatgctatctggactgtctgccaatcatttttagagggaggaatcagtgttggattgcagagacattttctggagtgatccatgaaggaccattaacatgtgatacctttcctctctattaatgttgacttcccttggttggatcctcttctttccccacccccagacagacatgaggctacatcccacatggcagcgttgggtccacacctctgcacatctgtgtgctctggtccatggtgtgtaacacagtcttctttattactcattgccatactccctggtgtgctttactgagcctccatctcttcaattcagagttccaaacgtgcttcagtaactaaatcaatgggagagtatcggatttcaaccaggaaaagataaatccaccctgatgccctgacaccctctctgaaccctacgagcccttccctccttctcacatgctacctgtgcagcttctccttagatcattgtgtaaccatcactgccatcctgttccacacatggtcatcaccctacacccattcagcagccactccccattccctcttccctccagcacctgctaaccacaaatgtgctttctgtctctacggatttgcctattctgtctgaaaacatttcaatctcctttgacctgtgagctcctcacttcgagacttcctgcctttccaggcagaaccaaagtacaccacgtcaaaagcaatgataggcatttgcagtgtgttggtgatccacgaaaggaaaatcacggaagcaggatagaaatccagctgcagacaagacctcaggtcgatgaatcttgacaagcagttgagctgtttttttctactcacctaggacagtcaggcagaagtatgcaaaatgactggggctgattcttttctgaattgtcgcaaacagcaagaggacttgagtcctagcattaaagagttcaacatgtctaggtccaagaccactgttgtgtttgaaggatgtaaaaccctgctgcataggatggaatatttggagggaggatcctgaaaaacatgagggatcaaatagtcctcaactttctaggacaaagggagcagctatttgccatctaccctccagaataaagaaatcttatcattcaccatctaccctctagaataaagaaatcttatcattcgccatctaccctgtagaataaagaaatcttatcattcaccgtctaccctctagagtaaacaaatcttatcattcaccatctaccctctagaataaagaaatcttatcattcgccatctaccctctagaataaagaaatcttatcattcaccgtctaccctctagagtaaacaaatcttatcattcgccatctaccctctagaatagagaaatcttatcattcatcatctaccctccagaataaagaaatgttatcatttgccatctaccctctagaataaagaaatcttattaaggaca

SEQ ID NO: 418603 - DNA, 3678 bp, Homo sapiens
tgcgcgagagcgcgccctccgcagacaggttgagcgagcgggagaggcccggggcacgtgcagaaaggagccccgcgagtggcgcgccggggatgtgagtgccccttgccctctactgaatccagccccctccccgcccaccgcctccgcctttgcatagatacagtcatctggccagcccccgcccctcctcccggcgtcagcccgccagaggccgcgcggggcccgggcttcggccgatcagcccgggaggccccgccgcgcccccttggcccgcgcgcccgtggtcacagtggaagaggcgcccgcgctgcgctgcccggaggagccgtcgcgcgcccgcttcctgttcggctggttcctgccagctcgaggacaaaacacgcgtgcgcgcggcgggcgagcgcgctcgccgcctcagtcgccagcgccgggcgcagtccgcctttttccggagcagactggccgcggtgctagtcggtagcagcggccgccgcagcggctccgcactggcgaaccgagggcagaaaaaggcggggttgacggctttttggtaggagtgggctggaccggacgccagagacaaaggctcccaaggcaagagggactgtggccctgcgtcggctctgctcggaactgctgaccccaggaatttacgccccttcgtttttctcttctgattcttctcttctcccaagcccgcgtcccctcacgcgtggcctctctccttgccgggagggccgcgatggaggtcccgcccaggctttcccatgtgccgccgccattgttcccctccgctcccgctactttagcctcccgcagcctctcccattggcggccgcggccgccgcggcagctagccccgctcctcccttcgctcgctcccagctccgcccggcagggggcgcgccgggcccagcgccacgtcaccgcccagcagccctcccgattggcgggcggggcggctataaagggagggcgcaggcggcgcccggatctcttccgccgccattttaaatccagctccatacaacgctccgccgccgctgctgccgcgacccggactgcgcgccagcacccccctgccgacagctccgtcactatggaggatatgaacgagtacagcaatatagaggaattcgcagagggatccaagatcaacgcgagcaagaatcagcaggatgacggtaaaatgtttattggaggcttgagctgggatacaagcaaaaaagatctgacagagtacttgtctcgatttggggaagttgtagactgcacaattaaaacagatccagtcactgggagatcaagaggatttggatttgtgcttttcaaagatgctgctagtgttgataaggttttggaactgaaagaacacaaactggatggcaaattgatagatcccaaaagggccaaagctttaaaagggaaagaacctcccaaaaaggtttttgtgggtggattgagcccggatacttctgaagaacaaattaaagaatattttggagcctttggagagattgaaaatattgaacttcccatggatacaaaaacaaatgaaagaagaggattttgttttatcacatatactgatgaagagccagtaaaaaaattgttagaaagcagataccatcaaattggttctgggaagtgtgaaatcaaagttgcacaacccaaagaggtatataggcagcaacagcaacaacaaaaaggtggaagaggtgctgcagctggtggacgaggtggtacgaggggtcgtggccgaggtcagggccaaaactggaaccaaggatttaataactattatgatcaaggatatggaaattacaatagtgcctatggtggtgatcaaaactatagtggctatggcggatatgattatactgggtataactatgggaactatggatatggacagggatatgcagactacagtggccaacagagcacttatggcaaggcatctcgagggggtggcaatcaccaaaacaattaccagccatactaaaggagaacattggagaaaacagcgggaacttcattgcaggccgtgtgtcaccctgaccacgtctatctctgggggtcgcacgttgcgggcagagcgcaaggcatacaccagaaaacgctgtcctgtggaggagatgttaaagtaacccatcttgcaggacgacattgaagattggtcttctgttgatctaagatgattattttgtaaaagactttctagtgtacaagacaccattgtgtccaactgtatatagctgccaattagttttctttgtttttactttgtcctttgctatctgtgttatgactcaatgtggatttgtttatacacattttatttgtatcatttcatgttaaacctcaaataaatgcttccttatgtgattgcttttctgcgtcaggtactacatagctctgtaaaaaatgtaatttaaaataagcaataattaaggcacagttgattttgtagagtattggtccatacagagaaactgtggtcctttataaatagccagccagcgtcaccctcttctccaatttgtaggtgtattttatgctcttaaggcttcatcttctccctgtaactgagatttctaccacacctttgaacaatgttctttcccttctggttatctgaagactgtcctgaaaggaagacataagtgttgtgattagtagaagctttgtaatcataacacaatgagtaattcttgataaaagttcagatacaaaaggagcactgtaaaactggtaggagctatggtttaagagcattggaagtagttacaactcaaggattttggtagaaaggtatgagtttggtcgaaaaattaaaatagtggcaaaataagatttagttgtgttttctcagagccgccacaagattgaacaaaatgttttctgtttgggcatcctgaggaagttgtattagctgttaatgctctgtgagtttagaaaaagtcttgatagtaaatctagtttttgacacagtgcatgaactaagtagttaaatatttacatattcagaaaggaatagtggaaaaggtatcttggttatgacaaagtcattacaaatgtgactaagtcattacaaatgtgactgagtcattacagtggaccctctgggtgcattgaaaagaatccgttttatatccaggtttcagaggacctggaataataaaaagctttggattttgcattcagtgtagttggattttgggaccttggcctcagtgttatttactgggattggcatacgtgttcacaggcagagtagttgatctcacacaacgggtgatctcacaaaactggtaagtttcttatgctcatgagccctccctttttttttttaatttggtgcctgcaactttcttaacaatgattctacttcctgggctatcacattataatgctcttggcctcttttttgctgctgttttgctattcttaaacttaggccaagtaccaatgttggctgttagaagggattctgttcattcaacatgcaactttagggaatggaagtaagttcatttttaagttgtgttgtcagtaggtgcggtgtctagggtagtgaatcctgtaagttcaaatttatgattaggtgacgagttgacattgagattgtccttttccctgatcaaaaaatgaataaagcctttttaaacaaaa

SEQ ID NO: 418604 - DNA, 3573 bp, Homo sapiens
tgcgcgagagcgcgccctccgcagacaggttgagcgagcgggagaggcccggggcacgtgcagaaaggagccccgcgagtggcgcgccggggatgtgagtgccccttgccctctactgaatccagccccctccccgcccaccgcctccgcctttgcatagatacagtcatctggccagcccccgcccctcctcccggcgtcagcccgccagaggccgcgcggggcccgggcttcggccgatcagcccgggaggccccgccgcgcccccttggcccgcgcgcccgtggtcacagtggaagaggcgcccgcgctgcgctgcccggaggagccgtcgcgcgcccgcttcctgttcggctggttcctgccagctcgaggacaaaacacgcgtgcgcgcggcgggcgagcgcgctcgccgcctcagtcgccagcgccgggcgcagtccgcctttttccggagcagactggccgcggtgctagtcggtagcagcggccgccgcagcggctccgcactggcgaaccgagggcagaaaaaggcggggttgacggctttttggtaggagtgggctggaccggacgccagagacaaaggctcccaaggcaagagggactgtggccctgcgtcggctctgctcggaactgctgaccccaggaatttacgccccttcgtttttctcttctgattcttctcttctcccaagcccgcgtcccctcacgcgtggcctctctccttgccgggagggccgcgatggaggtcccgcccaggctttcccatgtgccgccgccattgttcccctccgctcccgctactttagcctcccgcagcctctcccattggcggccgcggccgccgcggcagctagccccgctcctcccttcgctcgctcccagctccgcccggcagggggcgcgccgggcccagcgccacgtcaccgcccagcagccctcccgattggcgggcggggcggctataaagggagggcgcaggcggcgcccggatctcttccgccgccattttaaatccagctccatacaacgctccgccgccgctgctgccgcgacccggactgcgcgccagcacccccctgccgacagctccgtcactatggaggatatgaacgagtacagcaatatagaggaattcgcagagggatccaagatcaacgcgagcaagaatcagcaggatgacggtaaaatgtttattggaggcttgagctgggatacaagcaaaaaagatctgacagagtacttgtctcgatttggggaagttgtagactgcacaattaaaacagatccagtcactgggagatcaagaggatttggatttgtgcttttcaaagatgctgctagtgttgataaggttttggaactgaaagaacacaaactggatggcaaattgatagatcccaaaagggccaaagctttaaaagggaaagaacctcccaaaaaggtttttgtgggtggattgagcccggatacttctgaagaacaaattaaagaatattttggagcctttggagagattgaaaatattgaacttcccatggatacaaaaacaaatgaaagaagaggattttgttttatcacatatactgatgaagagccagtaaaaaaattgttagaaagcagataccatcaaattggttctgggaagtgtgaaatcaaagttgcacaacccaaagaggtatataggcagcaacagcaacaacaaaaaggtggaagaggtgctgcagctggtggacgaggtggtacgaggggtcgtggccgaggtcagggccaaaactggaaccaaggatttaataactattatgatcaaggatatggaaattacaatagtgcctatggtggtgatcaaaactatagtggctatggcggatatgattatactgggtataactatgggaactatggatatggacagggatatgcagactacagtggccaacagagcacttatggcaaggcatctcgagggggtggcaatcaccaaaacaattaccagccatactaaaggagaacattggagaaaacaggaggagatgttaaagtaacccatcttgcaggacgacattgaagattggtcttctgttgatctaagatgattattttgtaaaagactttctagtgtacaagacaccattgtgtccaactgtatatagctgccaattagttttctttgtttttactttgtcctttgctatctgtgttatgactcaatgtggatttgtttatacacattttatttgtatcatttcatgttaaacctcaaataaatgcttccttatgtgattgcttttctgcgtcaggtactacatagctctgtaaaaaatgtaatttaaaataagcaataattaaggcacagttgattttgtagagtattggtccatacagagaaactgtggtcctttataaatagccagccagcgtcaccctcttctccaatttgtaggtgtattttatgctcttaaggcttcatcttctccctgtaactgagatttctaccacacctttgaacaatgttctttcccttctggttatctgaagactgtcctgaaaggaagacataagtgttgtgattagtagaagctttgtaatcataacacaatgagtaattcttgataaaagttcagatacaaaaggagcactgtaaaactggtaggagctatggtttaagagcattggaagtagttacaactcaaggattttggtagaaaggtatgagtttggtcgaaaaattaaaatagtggcaaaataagatttagttgtgttttctcagagccgccacaagattgaacaaaatgttttctgtttgggcatcctgaggaagttgtattagctgttaatgctctgtgagtttagaaaaagtcttgatagtaaatctagtttttgacacagtgcatgaactaagtagttaaatatttacatattcagaaaggaatagtggaaaaggtatcttggttatgacaaagtcattacaaatgtgactaagtcattacaaatgtgactgagtcattacagtggaccctctgggtgcattgaaaagaatccgttttatatccaggtttcagaggacctggaataataaaaagctttggattttgcattcagtgtagttggattttgggaccttggcctcagtgttatttactgggattggcatacgtgttcacaggcagagtagttgatctcacacaacgggtgatctcacaaaactggtaagtttcttatgctcatgagccctccctttttttttttaatttggtgcctgcaactttcttaacaatgattctacttcctgggctatcacattataatgctcttggcctcttttttgctgctgttttgctattcttaaacttaggccaagtaccaatgttggctgttagaagggattctgttcattcaacatgcaactttagggaatggaagtaagttcatttttaagttgtgttgtcagtaggtgcggtgtctagggtagtgaatcctgtaagttcaaatttatgattaggtgacgagttgacattgagattgtccttttccctgatcaaaaaatgaataaagcctttttaaacaaaa

SEQ ID NO: 418605 - DNA, 2287 bp, Homo sapiens
tgcgcgagagcgcgccctccgcagacaggttgagcgagcgggagaggcccggggcacgtgcagaaaggagccccgcgagtggcgcgccggggatgtgagtgccccttgccctctactgaatccagccccctccccgcccaccgcctccgcctttgcatagatacagtcatctggccagcccccgcccctcctcccggcgtcagcccgccagaggccgcgcggggcccgggcttcggccgatcagcccgggaggccccgccgcgcccccttggcccgcgcgcccgtggtcacagtggaagaggcgcccgcgctgcgctgcccggaggagccgtcgcgcgcccgcttcctgttcggctggttcctgccagctcgaggacaaaacacgcgtgcgcgcggcgggcgagcgcgctcgccgcctcagtcgccagcgccgggcgcagtccgcctttttccggagcagactggccgcggtgctagtcggtagcagcggccgccgcagcggctccgcactggcgaaccgagggcagaaaaaggcggggttgacggctttttggtaggagtgggctggaccggacgccagagacaaaggctcccaaggcaagagggactgtggccctgcgtcggctctgctcggaactgctgaccccaggaatttacgccccttcgtttttctcttctgattcttctcttctcccaagcccgcgtcccctcacgcgtggcctctctccttgccgggagggccgcgatggaggtcccgcccaggctttcccatgtgccgccgccattgttcccctccgctcccgctactttagcctcccgcagcctctcccattggcggccgcggccgccgcggcagctagccccgctcctcccttcgctcgctcccagctccgcccggcagggggcgcgccgggcccagcgccacgtcaccgcccagcagccctcccgattggcgggcggggcggctataaagggagggcgcaggcggcgcccggatctcttccgccgccattttaaatccagctccatacaacgctccgccgccgctgctgccgcgacccggactgcgcgccagcacccccctgccgacagctccgtcactatggaggatatgaacgagtacagcaatatagaggaattcgcagagggatccaagatcaacgcgagcaagaatcagcaggatgacggtaaaatgtttattggaggcttgagctgggatacaagcaaaaaagatctgacagagtacttgtctcgatttggggaagttgtagactgcacaattaaaacagatccagtcactgggagatcaagaggatttggatttgtgcttttcaaagatgctgctagtgttgataaggttttggaactgaaagaacacaaactggatggcaaattgatagatcccaaaagggccaaagctttaaaagggaaagaacctcccaaaaaggtttttgtgggtggattgagcccggatacttctgaagaacaaattaaagaatattttggagcctttggagagattgaaaatattgaacttcccatggatacaaaaacaaatgaaagaagaggattttgttttatcacatatactgatgaagagccagtaaaaaaattgttagaaagcagataccatcaaattggttctgggaagtgtgaaatcaaagttgcacaacccaaagaggtatataggcagcaacagcaacaacaaaaaggtggaagaggtgctgcagctggtggacgaggtggtacgaggggtcgtggccgaggtcagggccaaaactggaaccaaggatttaataactattatgatcaaggatatggaaattacaatagtgcctatggtggtgatcaaaactatagtggctatggcggatatgattatactgggtataactatgggaactatggatatggacagggatatgcagactacagtggccaacagagcacttatggcaaggcatctcgagggggtggcaatcaccaaaacaattaccagccatactaaaggagaacattggagaaaacaggaggagatgttaaagtaacccatcttgcaggacgacattgaagattggtcttctgttgatctaagatgattattttgtaaaagactttctagtgtacaagacaccattgtgtccaactgtatatagctgccaattagttttctttgtttttactttgtcctttgctatctgtgttatgactcaatgtggatttgtttatacacattttatttgtatcatttcatgttaaacctcaaataaatgcttccttatgtgat

SEQ ID NO: 418606 - DNA, 581 bp, Homo sapiens
  misc_feature (32)..(32): n is a, c, g, or t
gtgtgctgatgtgatctagaggatcccgggtnatcgatgccacttggagcttggagagattgaaaatattgaacttcccatggatacaaaaacaaatgaaagaagaggattttgttttatcacatatactgatgaagagccagtaaaaaaattgttagaaagcagataccatcaaattggttctgggaagtgtgaaatcaaagttgcacaacccaaagaggtatataggcagcaacagcaacaacaaaaaggtggaagaggtgctgcagctggtggacgaggtggtacgaggggtcgtggccgagcagggccaaaactgcaaatagaggctggatcctactcaccccccatcaccctgcattttacacattgaagtaaaatgttatttttactgtcgttatttttattactttctctccaggtgttctagctgagcgtttaagagcatggactctggaaccagactttgaatccttgctctgccactgcagctgtgtgaccttgagcaagctatctaaatattctgtgcctttgctttgtcatctgtacaatggagatgatgatggtatcaccttcatggg

SEQ ID NO: 418607 - DNA, 301 bp, Homo sapiens
gggcaatgttctcctttagtatggctggtaattggagaaaacaggaggagatgttaaagtaacccatcttgcaggacgacattgaagattggtcttctgttgatctaagatgattattttgtaaaagactttctagtgtacaagacaccattgtgtccaactgtatatagctgccaattagttttctttgtttttactttgtcctttgctatctgtgttatgactcaatgtggatttgtttatacacattttatttgtatcatttcatgttaaacctcaaataaatgcttccttatgtgat

SEQ ID NO: 418608 - DNA, 3855 bp, Homo sapiens
ggccgggtgttaatcggccgaggtacaacgctccgccgccgctgctgccgcgacccggactgcgcgccagcacccccctgccgacagctccgtcactatggaggatatgaacgagtacagcaatatagaggaattcgcagagggatccaagatcaacgcgagcaagaatcagcaggatgacggtaaaatgtttattggaggcttgagctgggatacaagcaaaaaagatctgacagagtacttgtctcgatttggggaagttgtagactgcacaattaaaacagatccagtcactgggagatcaagaggatttggatttgtgcttttcaaagatgctgctagtgttgataaggttttggaactgaaagaacacaaactggatggcaaattgatagatcccaaaagggccaaagctttaaaagggaaagaacctcccaaaaaggtttttgtgggtggattgagcccggatacttctgaagaacaaattaaagaatattttggagcctttggagagattgaaaatattgaacttcccatggatacaaaaacaaatgaaagaagaggattttgttttatcacatatactgatgaagagccagtaaaaaaattgttagaaagcagataccatcaaattggttctgggaagtgtgaaatcaaagttgcacaacccaaagaggtatataggcagcaacagcaacaacaaaaaggtggaagaggtgctgcagctggtggacgaggtggtacgaggggtcgtggccgaggtcagggccaaaactggaaccaaggatttaataactattatgatcaaggatatggaaattacaatagtgcctatggtggtgatcaaaactatagtggctatggcggatatgattatactgggtataactatgggaactatggatatggacagggatatgcagactacagtggccaacagagcacttatggcaaggcatctcgagggggtggcaatcaccaaaacaattaccagccatactaaaggagaacattggagaaaacaggtgtgtataagagtacaggaaaacagtagaaatgtctaatttaatttaaagatcaatagacaaatgaaacgtaaaaacaaaatactatgtagcctgtttttactaaattgttgattttttaattgctttatgagcctgttttgcctaaagtgtctatagatctttaactttaaagtcttatctcactttctttagtattgcagaaaaacttaagagtttttctgtttgcttttgtgtaccaggtggtctagaggaataattaaacattttagaactattaacaggtaaagtactgaaatgggtacaacttaaggaaaacaagaatgttgtcttctaactctgacattataccttgtttgtacccgccagcgggaacttcattgcaggccgtgtgtcaccctgaccacgtctatctctgggggtcgcacgttgcgggcagagcgcaaggcatacaccagaaaacgctgtcctgtggtatggtctcttccaacttcatgtaccagcgtaaagattaaagtggaaaacttcagactttggcttcatttttaatctttttggagattaagtgtctaaacttaacttaaatggttttttacaggagttaaagtacataaatgcctttttacagcttaatcattttggtcttctgtttagtgttgtatttcaattgtggagcctcattttaagtgttcattcttttaagatttaatgcttgctttttctttttatagctaatagtgaaatctacaaaccaaaacaagaacttttaaatctgggatataaattaaagatcatatgcacagatcaatttatgttcttgtaataaacttattagaaattggtgtttgtgatagcattttacttgggttactagagatgcttctagtagaccttaatctagcatagttgaacctctgaatatgggaaggttgtattcccagattctttcctgaatagatttgaatttaatgtcatttgggaactccagggtgagtttattgactacccaaactgtattttaccaataaatatgcatatgatctttaattattgaagaaaataaagtgaggacttaaaacaattcatgaaagtggacctttaaaagcttgtcagagttgcacaaatctaactggtattttgtttttgtttttaggaggagatgttaaagtaacccatcttgcaggacgacattgaagattggtcttctgttgatctaagatgattattttgtaaaagactttctagtgtacaagacaccattgtgtccaactgtatatagctgccaattagttttctttgtttttactttgtcctttgctatctgtgttatgactcaatgtggatttgtttatacacattttatttgtatcatttcatgttaaacctcaaataaatgcttccttatgtgattgcttttctgcgtcaggtactacatagctctgtaaaaaatgtaatttaaaataagcaataattaaggcacagttgattttgtagagtattggtccatacagagaaactgtggtcctttataaatagccagccagcgtcaccctcttctccaatttgtaggtgtattttatgctcttaaggcttcatcttctccctgtaactgagatttctaccacacctttgaacaatgttctttcccttctggttatctgaagactgtcctgaaaggaagacataagtgttgtgattagtagaagctttctagtagaccatatttcttctggattgtaataaaattgttagtagctccttttactttgttcctgtctctggaaagccatttttgaattgctgattactttggctttaatcagtggtcacctagaaaaagctttgtaatcataacacaatgagtaattcttgataaaagttcagatacaaaaggagcactgtaaaactggtaggagctatggtttaagagcattggaagtagttacaactcaaggattttggtagaaaggtatgagtttggtcgaaaaattaaaatagtggcaaaataagatttagttgtgttttctcagagccgccacaagattgaacaaaatgttttctgtttgggcatcctgaggaagttgtattagctgttaatgctctgtgagtttagaaaaagtcttgatagtaaatctagtttttgacacagtgcatgaactaagtagttaaatatttacatattcagaaaggaatagtggaaaaggtatcttggttatgacaaagtcattacaaatgtgactaagtcattacaaatgtgactgagtcattacagtggaccctctgggtgcattgaaaagaatccgttttatatccaggtttcagaggacctggaataataaaaagctttggattttgcattcagtgtagttggattttgggaccttggcctcagtgttatttactgggattggcatacgtgttcacaggcagagtagttgatctcacacaacgggtgatctcacaaaactggtaagtttcttatgctcatgagccctccctttttttttttaatttggtgcctgcaactttcttaacaatgattctacttcctgggctatcacattataatgctcttggcctcttttttgctgctgttttgctattcttaaacttaggccaagtaccaatgttggctgttagaagggattctgttcattcaacatgcaactttagggaatggaagtaagttcatttttaagttgtgttgtcagtaggtgcggtgtctagggtagtgaatcctgtaagttcaaatttatgattaggtgacgagttgacattgagattgtccttttccctgatcaaaaaatgaataaagcctttttaaacaaaa

SEQ ID NO: 418609 - DNA, 2435 bp, Homo sapiens
ggccgggtgttaatcggccgaggtacaacgctccgccgccgctgctgccgcgacccggactgcgcgccagcacccccctgccgacagctccgtcactatggaggatatgaacgagtacagcaatatagaggaattcgcagagggatccaagatcaacgcgagcaagaatcagcaggatgacggtaaaatgtttattggaggcttgagctgggatacaagcaaaaaagatctgacagagtacttgtctcgatttggggaagttgtagactgcacaattaaaacagatccagtcactgggagatcaagaggatttggatttgtgcttttcaaagatgctgctagtgttgataaggttttggaactgaaagaacacaaactggatggcaaattgatagatcccaaaagggccaaagctttaaaagggaaagaacctcccaaaaaggtttttgtgggtggattgagcccggatacttctgaagaacaaattaaagaatattttggagcctttggagagattgaaaatattgaacttcccatggatacaaaaacaaatgaaagaagaggattttgttttatcacatatactgatgaagagccagtaaaaaaattgttagaaagcagataccatcaaattggttctgggaagtgtgaaatcaaagttgcacaacccaaagaggtatataggcagcaacagcaacaacaaaaaggtggaagaggtgctgcagctggtggacgaggtggtacgaggggtcgtggccgaggtcagggccaaaactggaaccaaggatttaataactattatgatcaaggatatggaaattacaatagtgcctatggtggtgatcaaaactatagtggctatggcggatatgattatactgggtataactatgggaactatggatatggacagggatatgcagactacagtggccaacagagcacttatggcaaggcatctcgagggggtggcaatcaccaaaacaattaccagccatactaaaggagaacattggagaaaacaggtgtgtataagagtacaggaaaacagtagaaatgtctaatttaatttaaagatcaatagacaaatgaaacgtaaaaacaaaatactatgtagcctgtttttactaaattgttgattttttaattgctttatgagcctgttttgcctaaagtgtctatagatctttaactttaaagtcttatctcactttctttagtattgcagaaaaacttaagagtttttctgtttgcttttgtgtaccaggtggtctagaggaataattaaacattttagaactattaacaggtaaagtactgaaatgggtacaacttaaggaaaacaagaatgttgtcttctaactctgacattataccttgtttgtacccgccagcgggaacttcattgcaggccgtgtgtcaccctgaccacgtctatctctgggggtcgcacgttgcgggcagagcgcaaggcatacaccagaaaacgctgtcctgtggtatggtctcttccaacttcatgtaccagcgtaaagattaaagtggaaaacttcagactttggcttcatttttaatctttttggagattaagtgtctaaacttaacttaaatggttttttacaggagttaaagtacataaatgcctttttacagcttaatcattttggtcttctgtttagtgttgtatttcaattgtggagcctcattttaagtgttcattcttttaagatttaatgcttgctttttctttttatagctaatagtgaaatctacaaaccaaaacaagaacttttaaatctgggatataaattaaagatcatatgcacagatcaatttatgttcttgtaataaacttattagaaattggtgtttgtgatagcattttacttgggttactagagatgcttctagtagaccttaatctagcatagttgaacctctgaatatgggaaggttgtattcccagattctttcctgaatagatttgaatttaatgtcatttgggaactccagggtgagtttattgactacccaaactgtattttaccaataaatatgcatatgatctttaattattgaagaaaataaagtgaggacttaaaacaattcatgaaagtggacctttaaaagcttgtcagagttgcacaaatctaactggtattttgtttttgtttttaggaggagatgttaaagtaacccatcttgcaggacgacattgaagattggtcttctgttgatctaagatgattattttgtaaaagactttctagtgtacaagacaccattgtgtccaactgtatatagctgccaattagttttctttgtttttactttgtcctttgctatctgtgttatgactcaatgtggatttgtttatacacattttatttgtatcatttcatgttaaacctcaaataaatgcttccttatgtgat

SEQ ID NO: 418610 - DNA, 3835 bp, Homo sapiens
ggccgggtgttaatcggccgaggtacaacgctccgccgccgctgctgccgcgacccggactgcgcgccagcacccccctgccgacagctccgtcactatggaggatatgaacgagtacagcaatatagaggaattcgcagagggatccaagatcaacgcgagcaagaatcagcaggatgacggtaaaatgtttattggaggcttgagctgggatacaagcaaaaaagatctgacagagtacttgtctcgatttggggaagttgtagactgcacaattaaaacagatccagtcactgggagatcaagaggatttggatttgtgcttttcaaagatgctgctagtgttgataaggttttggaactgaaagaacacaaactggatggcaaattgatagatcccaaaagggccaaagctttaaaagggaaagaacctcccaaaaaggtttttgtgggtggattgagcccggatacttctgaagaacaaattaaagaatattttggagcctttggagagattgaaaatattgaacttcccatggatacaaaaacaaatgaaagaagaggattttgttttatcacatatactgatgaagagccagtaaaaaaattgttagaaagcagataccatcaaattggttctgggaagtgtgaaatcaaagttgcacaacccaaagaggtatataggcagcaacagcaacaacaaaaaggtggaagaggtgctgcagctggtggacgaggtggtacgaggggtcgtggccgaggtcagggccaaaactggaaccaaggatttaataactattatgatcaaggatatggaaattacaatagtgcctatggtggtgatcaaaactatagtggctatggcggatatgattatactgggtataactatgggaactatggatatggacagggatatgcagactacagtggccaacagagcacttatggcaaggcatctcgagggggtggcaatcaccaaaacaattaccagccatactaaaggagaacattggagaaaacaggtgtgtataagagtacaggaaaacagtagaaatgtctaatttaatttaaagatcaatagacaaatgaaacgtaaaaacaaaatactatgtagcctgtttttactaaattgttgattttttaattgctttatgagcctgttttgcctaaagtgtctatagatctttaactttaaagtcttatctcactttctttagtattgcagaaaaacttaagagtttttctgtttgcttttgtgtaccaggtggtctagaggaataattaaacattttagaactattaacaggtaaagtactgaaatgggtacaacttaaggaaaacaagaatgttgtcttctaactctgacattataccttgtttgtacccgccagcgggaacttcattgcaggccgtgtgtcaccctgaccacgtctatctctgggggtcgcacgttgcgggcagagcgcaaggcatacaccagaaaacgctgtcctgtggtatggtctcttccaacttcatgtaccagcgtaaagattaaagtggaaaacttcagactttggcttcatttttaatctttttggagattaagtgtctaaacttaacttaaatggttttttacaggagttaaagtacataaatgcctttttacagcttaatcattttggtcttctgtttagtgttgtatttcaattgtggagcctcattttaagtgttcattcttttaagatttaatgcttgctttttctttttatagctaatagtgaaatctacaaaccaaaacaagaacttttaaatctgggatataaattaaagatcatatgcacagatcaatttatgttcttgtaataaacttattagaaattggtgtttgtgatagcattttacttgggttactagagatgcttctagtagaccttaatctagcatagttgaacctctgaatatgggaaggttgtattcccagattctttcctgaatagatttgaatttaatgtcatttgggaactccagggtgagtttattgactacccaaactgtattttaccaataaatatgcatatgatctttaattattgaagaaaataaagtgaggacttaaaacaattcatgaaagtggacctttaaaagcttgtcagagttgcacaaatctaactggtattttgtttttgtttttaggaggagatgttaaagtaacccatcttgcaggacgacattgaagattggtcttctgttgatctaagatgattattttgtaaaagactttctagtgtacaagacaccattgtgtccaactgtatatagctgccaattagttttctttgtttttactttgtcctttgctatctgtgttatgactcaatgtggatttgtttatacacattttatttgtatcatttcatgttaaacctcaaataaatgcttccttatgtgattgcttttctgcgtcaggtactacatagctctgtaaaaaatgtaatttaaaataagcaataattaaggcacagttgattttgtagagtattggtccatacagagaaactgtggtcctttataaatagccagccagcgtcaccctcttctccaatttgtaggtgtattttatgctcttaaggcttcatcttctccctgtaactgagatttctaccacacctttgaacaatgttctttcccttctggttatctgaagactgtcctgaaaggaagacataagtgttgtgattagtagaagctttctagtagaccatatttcttctggattgtaataaaattgttagtagctccttttactttgttcctgtctctggaaagccatttttgaattgctgattactttggctttaatcagtggtcacctagaaaaagctttgtaatcataacacaatgagtaattcttgataaaagttcagatacaaaaggagcactgtaaaactggtaggagctatggtttaagagcattggaagtagttacaactcaaggattttggtagaaaggtatgagtttggtcgaaaaattaaaatagtggcaaaataagatttagttgtgttttctcagagccgccacaagattgaacaaaatgttttctgtttgggcatcctgaggaagttgtattagctgttaatgctctgtgagtttagaaaaagtcttgatagtaaatctagtttttgacacagtgcatgaactaagtagttaaatatttacatattcagaaaggaatagtggaaaaggtatcttggttatgactaagtcattacaaatgtgactgagtcattacagtggaccctctgggtgcattgaaaagaatccgttttatatccaggtttcagaggacctggaataataaaaagctttggattttgcattcagtgtagttggattttgggaccttggcctcagtgttatttactgggattggcatacgtgttcacaggcagagtagttgatctcacacaacgggtgatctcacaaaactggtaagtttcttatgctcatgagccctccctttttttttttaatttggtgcctgcaactttcttaacaatgattctacttcctgggctatcacattataatgctcttggcctcttttttgctgctgttttgctattcttaaacttaggccaagtaccaatgttggctgttagaagggattctgttcattcaacatgcaactttagggaatggaagtaagttcatttttaagttgtgttgtcagtaggtgcggtgtctagggtagtgaatcctgtaagttcaaatttatgattaggtgacgagttgacattgagattgtccttttccctgatcaaaaaatgaataaagcctttttaaacaaaa

SEQ ID NO: 418611 - DNA, 3801 bp, Homo sapiens
ggccgggtgttaatcggccgaggtacaacgctccgccgccgctgctgccgcgacccggactgcgcgccagcacccccctgccgacagctccgtcactatggaggatatgaacgagtacagcaatatagaggaattcgcagagggatccaagatcaacgcgagcaagaatcagcaggatgacggtaaaatgtttattggaggcttgagctgggatacaagcaaaaaagatctgacagagtacttgtctcgatttggggaagttgtagactgcacaattaaaacagatccagtcactgggagatcaagaggatttggatttgtgcttttcaaagatgctgctagtgttgataaggttttggaactgaaagaacacaaactggatggcaaattgatagatcccaaaagggccaaagctttaaaagggaaagaacctcccaaaaaggtttttgtgggtggattgagcccggatacttctgaagaacaaattaaagaatattttggagcctttggagagattgaaaatattgaacttcccatggatacaaaaacaaatgaaagaagaggattttgttttatcacatatactgatgaagagccagtaaaaaaattgttagaaagcagataccatcaaattggttctgggaagtgtgaaatcaaagttgcacaacccaaagaggtatataggcagcaacagcaacaacaaaaaggtggaagaggtgctgcagctggtggacgaggtggtacgaggggtcgtggccgaggtcagggccaaaactggaaccaaggatttaataactattatgatcaaggatatggaaattacaatagtgcctatggtggtgatcaaaactatagtggctatggcggatatgattatactgggtataactatgggaactatggatatggacagggatatgcagactacagtggccaacagagcacttatggcaaggcatctcgagggggtggcaatcaccaaaacaattaccagccatactaaaggagaacattggagaaaacaggtgtgtataagagtacaggaaaacagtagaaatgtctaatttaatttaaagatcaatagacaaatgaaacgtattatgagcctgttttgcctaaagtgtctatagatctttaactttaaagtcttatctcactttctttagtattgcagaaaaacttaagagtttttctgtttgcttttgtgtaccaggtggtctagaggaataattaaacattttagaactattaacaggtaaagtactgaaatgggtacaacttaaggaaaacaagaatgttgtcttctaactctgacattataccttgtttgtacccgccagcgggaacttcattgcaggccgtgtgtcaccctgaccacgtctatctctgggggtcgcacgttgcgggcagagcgcaaggcatacaccagaaaacgctgtcctgtggtatggtctcttccaacttcatgtaccagcgtaaagattaaagtggaaaacttcagactttggcttcatttttaatctttttggagattaagtgtctaaacttaacttaaatggttttttacaggagttaaagtacataaatgcctttttacagcttaatcattttggtcttctgtttagtgttgtatttcaattgtggagcctcattttaagtgttcattcttttaagatttaatgcttgctttttctttttatagctaatagtgaaatctacaaaccaaaacaagaacttttaaatctgggatataaattaaagatcatatgcacagatcaatttatgttcttgtaataaacttattagaaattggtgtttgtgatagcattttacttgggttactagagatgcttctagtagaccttaatctagcatagttgaacctctgaatatgggaaggttgtattcccagattctttcctgaatagatttgaatttaatgtcatttgggaactccagggtgagtttattgactacccaaactgtattttaccaataaatatgcatatgatctttaattattgaagaaaataaagtgaggacttaaaacaattcatgaaagtggacctttaaaagcttgtcagagttgcacaaatctaactggtattttgtttttgtttttaggaggagatgttaaagtaacccatcttgcaggacgacattgaagattggtcttctgttgatctaagatgattattttgtaaaagactttctagtgtacaagacaccattgtgtccaactgtatatagctgccaattagttttctttgtttttactttgtcctttgctatctgtgttatgactcaatgtggatttgtttatacacattttatttgtatcatttcatgttaaacctcaaataaatgcttccttatgtgattgcttttctgcgtcaggtactacatagctctgtaaaaaatgtaatttaaaataagcaataattaaggcacagttgattttgtagagtattggtccatacagagaaactgtggtcctttataaatagccagccagcgtcaccctcttctccaatttgtaggtgtattttatgctcttaaggcttcatcttctccctgtaactgagatttctaccacacctttgaacaatgttctttcccttctggttatctgaagactgtcctgaaaggaagacataagtgttgtgattagtagaagctttctagtagaccatatttcttctggattgtaataaaattgttagtagctccttttactttgttcctgtctctggaaagccatttttgaattgctgattactttggctttaatcagtggtcacctagaaaaagctttgtaatcataacacaatgagtaattcttgataaaagttcagatacaaaaggagcactgtaaaactggtaggagctatggtttaagagcattggaagtagttacaactcaaggattttggtagaaaggtatgagtttggtcgaaaaattaaaatagtggcaaaataagatttagttgtgttttctcagagccgccacaagattgaacaaaatgttttctgtttgggcatcctgaggaagttgtattagctgttaatgctctgtgagtttagaaaaagtcttgatagtaaatctagtttttgacacagtgcatgaactaagtagttaaatatttacatattcagaaaggaatagtggaaaaggtatcttggttatgacaaagtcattacaaatgtgactaagtcattacaaatgtgactgagtcattacagtggaccctctgggtgcattgaaaagaatccgttttatatccaggtttcagaggacctggaataataaaaagctttggattttgcattcagtgtagttggattttgggaccttggcctcagtgttatttactgggattggcatacgtgttcacaggcagagtagttgatctcacacaacgggtgatctcacaaaactggtaagtttcttatgctcatgagccctccctttttttttttaatttggtgcctgcaactttcttaacaatgattctacttcctgggctatcacattataatgctcttggcctcttttttgctgctgttttgctattcttaaacttaggccaagtaccaatgttggctgttagaagggattctgttcattcaacatgcaactttagggaatggaagtaagttcatttttaagttgtgttgtcagtaggtgcggtgtctagggtagtgaatcctgtaagttcaaatttatgattaggtgacgagttgacattgagattgtccttttccctgatcaaaaaatgaataaagcctttttaaacaaaa

SEQ ID NO: 418612 - DNA, 3799 bp, Homo sapiens
ggccgggtgttaatcggccgaggtacaacgctccgccgccgctgctgccgcgacccggactgcgcgccagcacccccctgccgacagctccgtcactatggaggatatgaacgagtacagcaatatagaggaattcgcagagggatccaagatcaacgcgagcaagaatcagcaggatgacggtaaaatgtttattggaggcttgagctgggatacaagcaaaaaagatctgacagagtacttgtctcgatttggggaagttgtagactgcacaattaaaacagatccagtcactgggagatcaagaggatttggatttgtgcttttcaaagatgctgctagtgttgataaggttttggaactgaaagaacacaaactggatggcaaattgatagatcccaaaagggccaaagctttaaaagggaaagaacctcccaaaaaggtttttgtgggtggattgagcccggatacttctgaagaacaaattaaagaatattttggagcctttggagagattgaaaatattgaacttcccatggatacaaaaacaaatgaaagaagaggattttgttttatcacatatactgatgaagagccagtaaaaaaattgttagaaagcagataccatcaaattggttctgggaagtgtgaaatcaaagttgcacaacccaaagaggtatataggcagcaacagcaacaacaaaaaggtggaagaggtgctgcagctggtggacgaggtggtacgaggggtcgtggccgaggtcagggccaaaactggaaccaaggatttaataactattatgatcaaggatatggaaattacaatagtgcctatggtggtgatcaaaactatagtggctatggcggatatgattatactgggtataactatgggaactatggatatggacagggatatgcagactacagtggccaacagagcacttatggcaaggcatctcgagggggtggcaatcaccaaaacaattaccagccatactaaaggagaacattggagaaaacaggtgtgtataagagtacaggaaaacagtagaaatgtctaatttaatttaaagatcaatagacaaatgaaacgtaaaaacaaaatactatgtagcctgtttttactaaattgttgattttttaattgctttatgagcctgttttgcctaaagtgtctatagatctttaactttaaagtcttatctcactttctttagtattgcagaaaaacttaagagtttttctgtttgcttttgtgtaccaggtggtctagaggaataattaaacattttagaactattaacaggtaaagtactgaaatgggtacaacttaaggaaaacaagaatgttgtcttctaactctgacattataccttgtttgtacccgccagcgggaacttcattgcaggccgtgtgtcaccctgaccacgtctatctctgggggtcgcacgttgcgggcagagcgcaaggcatacaccagaaaacgctgtcctgtggtatggtctcttccaacttcatgtaccagcgtaaagattaaagtggaaaacttcagactttggcttcatttttaatctttttggagattaagtgtctaaacttaacttaaatggttttttacaggagttaaagtacataaatgcctttttacagcttaatcattttggtcttctgtttagtgttgtatttcaattgtggagcctcattttaagtgttcattcttttaagatttaatgcttgctttttctttttatagctaatagtgaaatctacaaaccaaaacaagaacttttaaatctgggatataaattaaagatcatatgcacagatcaatttatgttcttgtaataaacttattagaaattggtgtttgtgatagcattttacttgggttactagagatgcttctagtagaccttaatctagcatagttgaacctctgaatatgggaaggttgtattcccagattctttcctgaatagatttgaatttaatgtcatttgggaactccagggtgagtttattgactacccaaactgtattttaccaataaatatgcatatgatctttaattattgaagaaaataaagtgaggacttaaaacaattcatgaaagtggacctttaaaagcttgtcagagttgcacaaatctaactggtattttgtttttgtttttaggaggagatgttaaagtaacccatcttgcaggacgacattgaagattggtcttctgttgatctaagatgattattttgtaaaagactttctagtgtacaagacaccattgtgtccaactgtatatagctgccaattagttttctttgtttttactttgtcctttgctatctgtgttatgactcaatgtggatttgtttatacacattttatttgtatcatttcatgttaaacctcaaataaatgcttccttatgtgattgcttttctgcgtcaggtactacatagctctgtaaaaaatgtaatttaaaataagcaataattaaggcacagttgattttgtagagtattggtccatacagagaaactgtggtcctttataaatagccagccagcgtcaccctcttctccaatttgtaggtgtattttatgctcttaaggcttcatcttctccctgtaactgagatttctaccacacctttgaacaatgttctttcccttctggttatctgaagactgtcctgaaaggaagacataagtgttgtgattagtagaagctttctagtagaccatatttcttctggattgtaataaaattgttagtagctccttttactttgttcctgtctctggaaagccatttttgaattgctgattactttggctttaatcagtggtcacctagaaaaagctttgtaatcataacacaatgagtaattcttgataaaagttcagatacaaaaggagcactgtaaaactggtaggagctatggtttaagagcattggaagtagttacaactcaaggattttggtagaaaggtatgagtttggtcgaaaaattaaaatagtggcaaaataagatttagttgtgttttctcagagccgccacaagattgaacaaaatgttttctgtttgggcatcctgaggaagttgtattagctgttaatgctctgtgagtttagaaaaagtcttgatagtaaatctagtttttgacacagtgcatgaactaagtagttaaatatttacatattcagaaaggaatagtggaaaaggtatcttggttatgacaaagtcattacaaatgtgactaagtcattacaaatgtgactgagtcattacagtggaccctctgggtgctttggattttgcattcagtgtagttggattttgggaccttggcctcagtgttatttactgggattggcatacgtgttcacaggcagagtagttgatctcacacaacgggtgatctcacaaaactggtaagtttcttatgctcatgagccctccctttttttttttaatttggtgcctgcaactttcttaacaatgattctacttcctgggctatcacattataatgctcttggcctcttttttgctgctgttttgctattcttaaacttaggccaagtaccaatgttggctgttagaagggattctgttcattcaacatgcaactttagggaatggaagtaagttcatttttaagttgtgttgtcagtaggtgcggtgtctagggtagtgaatcctgtaagttcaaatttatgattaggtgacgagttgacattgagattgtccttttccctgatcaaaaaatgaataaagcctttttaaacaaaa

SEQ ID NO: 418613 - DNA, 4188 bp, Homo sapiens
ggccgggtgttaatcggccgaggtacaacgctccgccgccgctgctgccgcgacccggactgcgcgccagcacccccctgccgacagctccgtcactatggaggatatgaacgagtacagcaatatagaggaattcgcagagggatccaagatcaacgcgagcaagaatcagcaggatgacggtaaaatgtttattggaggcttgagctgggatacaagcaaaaaagatctgacagagtacttgtctcgatttggggaagttgtagactgcacaattaaaacagatccagtcactgggagatcaagaggatttggatttgtgcttttcaaagatgctgctagtgttgataaggttttggaactgaaagaacacaaactggatggcaaattgatagatcccaaaagggccaaagctttaaaagggaaagaacctcccaaaaaggtttttgtgggtggattgagcccggatacttctgaagaacaaattaaagaatattttggagcctttggagagattgaaaatattgaacttcccatggatacaaaaacaaatgaaagaagaggattttgttttatcacatatactgatgaagagccagtaaaaaaattgttagaaagcagataccatcaaattggttctgggaagtgtgaaatcaaagttgcacaacccaaagaggtatataggcagcaacagcaacaacaaaaaggtggaagaggtgctgcagctggtggacgaggtggtacgaggggtcgtggccgaggtcagggccaaaactggaaccaaggatttaataactattatgatcaaggatatggaaattacaatagtgcctatggtggtgatcaaaactatagtggctatggcggatatgattatactgggtataactatgggaactatggatatggacagggatatgcagactacagtggtaagaatatttaacttaattttataaagcagtggtattaaaattcattgttaacatacaatcctgttctgaaattgtgtgtatgggctttccattaaagtgttcggagttaagtgtttgaggcatgttacaatcataggatgattatactaacatagactggtggttataaatgaactaggatgtatgatttatgagtagcatctaatgggtgctaaaatatcttaatactttttatttagcatgcaaagatttgtagatttaatagtttgtgtttgtaaagaaagttttgtagaaaactatcttaatgagaattctgtgttttcaaaataggccaacagagcacttatggcaaggcatctcgagggggtggcaatcaccaaaacaattaccagccatactaaaggagaacattggagaaaacaggtgtgtataagagtacaggaaaacagtagaaatgtctaatttaatttaaagatcaatagacaaatgaaacgtaaaaacaaaatactatgtagcctgtttttactaaattgttgattttttaattgctttatgagcctgttttgcctaaagtgtctatagatctttaactttaaagtcttatctcactttctttagtattgcagaaaaacttaagagtttttctgtttgcttttgtgtaccaggtggtctagaggaataattaaacattttagaactattaacaggtaaagtactgaaatgggtacaacttaaggaaaacaagaatgttgtcttctaactctgacattataccttgtttgtacccgccagcgggaacttcattgcaggccgtgtgtcaccctgaccacgtctatctctgggggtcgcacgttgcgggcagagcgcaaggcatacaccagaaaacgctgtcctgtggtatggtctcttccaacttcatgtaccagcgtaaagattaaagtggaaaacttcagactttggcttcatttttaatctttttggagattaagtgtctaaacttaacttaaatggttttttacaggagttaaagtacataaatgcctttttacagcttaatcattttggtcttctgtttagtgttgtatttcaattgtggagcctcattttaagtgttcattcttttaagatttaatgcttgctttttctttttatagctaatagtgaaatctacaaaccaaaacaagaacttttaaatctgggatataaattaaagatcatatgcacagatcaatttatgttcttgtaataaacttattagaaattggtgtttgtgatagcattttacttgggttactagagatgcttctagtagaccttaatctagcatagttgaacctctgaatatgggaaggttgtattcccagattctttcctgaatagatttgaatttaatgtcatttgggaactccagggtgagtttattgactacccaaactgtattttaccaataaatatgcatatgatctttaattattgaagaaaataaagtgaggacttaaaacaattcatgaaagtggacctttaaaagcttgtcagagttgcacaaatctaactggtattttgtttttgtttttaggaggagatgttaaagtaacccatcttgcaggacgacattgaagattggtcttctgttgatctaagatgattattttgtaaaagactttctagtgtacaagacaccattgtgtccaactgtatatagctgccaattagttttctttgtttttactttgtcctttgctatctgtgttatgactcaatgtggatttgtttatacacattttatttgtatcatttcatgttaaacctcaaataaatgcttccttatgtgattgcttttctgcgtcaggtactacatagctctgtaaaaaatgtaatttaaaataagcaataattaaggcacagttgattttgtagagtattggtccatacagagaaactgtggtcctttataaatagccagccagcgtcaccctcttctccaatttgtaggtgtattttatgctcttaaggcttcatcttctccctgtaactgagatttctaccacacctttgaacaatgttctttcccttctggttatctgaagactgtcctgaaaggaagacataagtgttgtgattagtagaagctttctagtagaccatatttcttctggattgtaataaaattgttagtagctccttttactttgttcctgtctctggaaagccatttttgaattgctgattactttggctttaatcagtggtcacctagaaaaagctttgtaatcataacacaatgagtaattcttgataaaagttcagatacaaaaggagcactgtaaaactggtaggagctatggtttaagagcattggaagtagttacaactcaaggattttggtagaaaggtatgagtttggtcgaaaaattaaaatagtggcaaaataagatttagttgtgttttctcagagccgccacaagattgaacaaaatgttttctgtttgggcatcctgaggaagttgtattagctgttaatgctctgtgagtttagaaaaagtcttgatagtaaatctagtttttgacacagtgcatgaactaagtagttaaatatttacatattcagaaaggaatagtggaaaaggtatcttggttatgacaaagtcattacaaatgtgactaagtcattacaaatgtgactgagtcattacagtggaccctctgggtgcattgaaaagaatccgttttatatccaggtttcagaggacctggaataataaaaagctttggattttgcattcagtgtagttggattttgggaccttggcctcagtgttatttactgggattggcatacgtgttcacaggcagagtagttgatctcacacaacgggtgatctcacaaaactggtaagtttcttatgctcatgagccctccctttttttttttaatttggtgcctgcaactttcttaacaatgattctacttcctgggctatcacattataatgctcttggcctcttttttgctgctgttttgctattcttaaacttaggccaagtaccaatgttggctgttagaagggattctgttcattcaacatgcaactttagggaatggaagtaagttcatttttaagttgtgttgtcagtaggtgcggtgtctagggtagtgaatcctgtaagttcaaatttatgattaggtgacgagttgacattgagattgtccttttccctgatcaaaaaatgaataaagcctttttaaacaaaa

SEQ ID NO: 418614 - DNA, 4616 bp, Homo sapiens
ggccgggtgttaatcggccgaggtacaacgctccgccgccgctgctgccgcgacccggactgcgcgccagcacccccctgccgacagctccgtcactatggaggatatgaacgagtacagcaatatagaggaattcgcagagggatccaagatcaacgcgagcaagaatcagcaggatgacggtaaaatgtttattggaggcttgagctgggatacaagcaaaaaagatctgacagagtacttgtctcgatttggggaagttgtagactgcacaattaaaacagatccagtcactgggagatcaagaggatttggatttgtgcttttcaaagatgctgctagtgttgataaggttttggaactgaaagaacacaaactggatggcaaattgatagatcccaaaagggccaaagctttaaaagggaaagaacctcccaaaaaggtttttgtgggtggattgagcccggatacttctgaagaacaaattaaagaatattttggagcctttggagagattgaaaatattgaacttcccatggatacaaaaacaaatgaaagaagaggattttgttttatcacatatactgatgaagagccagtaaaaaaattgttagaaagcagataccatcaaattggttctgggaagtgtgaaatcaaagttgcacaacccaaagaggtatataggcagcaacagcaacaacaaaaaggtggaagaggtgctgcagctggtggacgaggtggtacgaggggtcgtggccgaggtcagggccaaaactggaaccaaggatttaataactattatgatcaaggatatggaaattacaatagtgcctatggtggtgatcaaaactatagtggctatggcggatatgattatactgggtataactatgggaactatggatatggacagggatatgcagactacagtggccaacagagcacttatggcaaggcatctcgagggggtggcaatcaccaaaacaattaccagccatactaaaggagaacattggagaaaacaggtgtgtataagagtacaggaaaacagtagaaatgtctaatttaatttaaagatcaatagacaaatgaaacgtaaaaacaaaatactatgtagcctgtttttactaaattgttgattttttaattgctttatgagcctgttttgcctaaagtgtctatagatctttaactttaaagtcttatctcactttctttagtattgcagaaaaacttaagagtttttctgtttgcttttgtgtaccaggtggtctagaggaataattaaacattttagaactattaacaggtaaagtactgaaatgggtacaacttaaggaaaacaagaatgttgtcttctaactctgacattataccttgtttgtacccgccagcgggaacttcattgcaggccgtgtgtcaccctgaccacgtctatctctgggggtcgcacgttgcgggcagagcgcaaggcatacaccagaaaacgctgtcctgtggtatggtctcttccaacttcatgtaccagcgtaaagattaaagtggaaaacttcagactttggcttcatttttaatctttttggagattaagtgtctaaacttaacttaaatggttttttacaggagttaaagtacataaatgcctttttacagcttaatcattttggtcttctgtttagtgttgtatttcaattgtggagcctcattttaagtgttcattcttttaagatttaatgcttgctttttctttttatagctaatagtgaaatctacaaaccaaaacaagaacttttaaatctgggatataaattaaagatcatatgcacagatcaatttatgttcttgtaataaacttattagaaattggtgtttgtgatagcattttacttgggttactagagatgcttctagtagaccttaatctagcatagttgaacctctgaatatgggaaggttgtattcccagattctttcctgaatagatttgaatttaatgtcatttgggaactccagggtgagtttattgactacccaaactgtattttaccaataaatatgcatatgatctttaattattgaagaaaataaagtgaggacttaaaacaattcatgaaagtggacctttaaaagcttgtcagagttgcacaaatctaactggtattttgtttttgtttttaggaggagatgttaaagtaacccatcttgcaggacgacattgaagattggtcttctgttgatctaagatgattattttgtaaaagactttctagtgtacaagacaccattgtgtccaactgtatatagctgccaattagttttctttgtttttactttgtcctttgctatctgtgttatgactcaatgtggatttgtttatacacattttatttgtatcatttcatgttaaacctcaaataaatgcttccttatgtgattgcttttctgcgtcaggtactacatagctctgtaaaaaatgtaatttaaaataagcaataattaaggcacagttgattttgtagagtattggtccatacagagaaactgtggtcctttataaatagccagccagcgtcaccctcttctccaatttgtaggtgtattttatgctcttaaggcttcatcttctccctgtaactgagatttctaccacacctttgaacaatgttctttcccttctggttatctgaagactgtcctgaaaggaagacataagtgttgtgattagtagaagctttctagtagaccatatttcttctggattgtaataaaattgttagtagctccttttactttgttcctgtctctggaaagccatttttgaattgctgattactttggctttaatcagtggtcacctagaaaaagctttgtaatcataacacaatgagtaattcttgataaaagttcagatacaaaaggagcactgtaaaactggtaggagctatggtttaagagcattggaagtagttacaactcaaggattttggtagaaaggtatgagtttggtcgaaaaattaaaatagtggcaaaataagatttagttgtgttttctcagagccgccacaagattgaacaaaatgttttctgtttgggcatcctgaggaagttgtattagctgttaatgctctgtgagtttagaaaaagtcttgatagtaaatctagtttttgacacagtgcatgaactaagtagttaaatatttacatattcagaaaggaatagtggaaaaggtatcttggttatgacaaagtcattacaaatgtgactaagtcattacaaatgtgactgagtcattacagtggaccctctgggtgcattgaaaagaatccgttttatatccaggtttcagaggacctggaataataaaaagctttggattttgcattcagtgtagttggattttgggaccttggcctcagtgttatttactgggattggcatacgtgttcacaggcagagtagttgatctcacacaacgggtgatctcacaaaactggtaagtttcttatgctcatgagccctccctttttttttttaatttggtgcctgcaactttcttaacaatgattctacttcctgggctatcacattataatgctcttggcctcttttttgctgctgttttgctattcttaaacttaggccaagtaccaatgttggctgttagaagggattctgttcattcaacatgcaactttagggaatggaagtaagttcatttttaagttgtgttgtcagtaggtgcggtgtctagggtagtgaatcctgtaagttcaaatttatgattaggtgacgagttgacattgagattgtccttttccctgatcaaaaaatgaataaagcctttttaaacaaaaaaaaaaaaaaaacaaaaaaaaaaaaaacattggggggggccggagaatgaggtggaacgcgtggcacgagaagcagagcaaaccgaccaggacagaaggtacaaagaggggagccggcggagcgcgcgaatggagcaagacaaacacacgaccagaccggacaaagaaacagacaacaagcgaggagaaagaaaggaggcaccagagcgacaccacgaggaagagaagaaacaaaaacaaagagcggagaaaggagcagaagtaaaaaccaaaacacgacggcaacgaaccaacagtaggagaggagggaagcagacaagacaaacgacaagaaaaaacgaacaagacacaaagacacagacaaaagcaagacaaccaagcggaaaggagaagacgagaagagacaaagaagccaaagaaaaaccaatcatcacgaataaggggaacaacgaaggacagaaagagaacaggggggaaggacacgagagcggagcagagcaggtaaaagtgagtgagcaacagaggcaacgcacagcagaggagaacagaagagagagtgaggaagaaggggcgagaagagcgagaaacggaggtgaaggaggcagcacagggcgcgacgcggaacagaggagaaaaggagcggcaccgagcagaggagagggaggaagagagaggcgaggagggacaggagagagagcacgagaggcaagagggcgacagaggagcgaagaggacgaaagaaggagcagagagtagactcg

SEQ ID NO: 418615 - DNA, 1282 bp, Homo sapiens
ggccgggtgttaatcggccgaggtacaacgctccgccgccgctgctgccgcgacccggactgcgcgccagcacccccctgccgacagctccgtcactatggaggatatgaacgagtacagcaatatagaggaattcgcagagggatccaagatcaacgcgagcaagaatcagcaggatgacggtaaaatgtttattggaggcttgagctgggatacaagcaaaaaagatctgacagagtacttgtctcgatttggggaagttgtagactgcacaattaaaacagatccagtcactgggagatcaagaggatttggatttgtgcttttcaaagatgctgctagtgttgataaggttttggaactgaaagaacacaaactggatggcaaattgatagatcccaaaagggccaaagctttaaaagggaaagaacctcccaaaaaggtttttgtgggtggattgagcccggatacttctgaagaacaaattaaagaatattttggagcctttggagagattgaaaatattgaacttcccatggatacaaaaacaaatgaaagaagaggattttgttttatcacatatactgatgaagagccagtaaaaaaattgttagaaagcagataccatcaaattggttctgggaagtgtgaaatcaaagttgcacaacccaaagaggtatataggcagcaacagcaacaacaaaaaggtggaagaggtgctgcagctggtggacgaggtggtacgaggggtcgtggccgaggtcagggccaaaactggaaccaaggatttaataactattatgatcaaggatatggaaattacaatagtgcctatggtggtgatcaaaactatagtggctatggcggatatgattatactgggtataactatgggaactatggatatggacagggatatgcagactacagtggccaacagagcacttatggcaaggcatctcgagggggtggcaatcaccaaaacaattaccagccatactaaaggagaacattggagaaaacaggaggagatgttaaagtaacccatcttgcaggacgacattgaagattggtcttctgttgatctaagatgattattttgtaaaagactttctagtgtacaagacaccattgtgtccaactgtatatagctgccaattagttttctttgtttttactttgtcctttgctatctgtgttatgactcaatgtggatttgtttatacacattttatttgtatcatttcatgttaaacctcaaataaatgcttccttatgtgat

SEQ ID NO: 418616 - DNA, 3196 bp, Homo sapiens
ggccgggtgttaatcggccgaggtacaacgctccgccgccgctgctgccgcgacccggactgcgcgccagcacccccctgccgacagctccgtcactatggaggatatgaacgagtacagcaatatagaggaattcgcagagggatccaagatcaacgcgagcaagaatcagcaggatgacggtaaaatgtttattggaggcttgagctgggatacaagcaaaaaagatctgacagagtacttgtctcgatttggggaagttgtagactgcacaattaaaacagatccagtcactgggagatcaagaggatttggatttgtgcttttcaaagatgctgctagtgttgataaggttttggaactgaaagaacacaaactggatggcaaattgatagatcccaaaagggccaaagctttaaaagggaaagaacctcccaaaaaggtttttgtgggtggattgagcccggatacttctgaagaacaaattaaagaatattttggagcctttggagagattgaaaatattgaacttcccatggatacaaaaacaaatgaaagaagaggattttgttttatcacatatactgatgaagagccagtaaaaaaattgttagaaagcagataccatcaaattggttctgggaagtgtgaaatcaaagttgcacaacccaaagaggtatataggcagcaacagcaacaacaaaaaggtggaagaggtgctgcagctggtggacgaggtggtacgaggggtcgtggccgaggtcagggccaaaactggaaccaaggatttaataactattatgatcaaggatatggaaattacaatagtgcctatggtggtgatcaaaactatagtggctatggcggatatgattatactgggtataactatgggaactatggatatggacagggatatgcagactacagtggccaacagagcacttatggcaaggcatctcgagggggtggcaatcaccaaaacaattaccagccatactaaaggagaacattggagaaaacaggtgtgtataagagtacaggaaaacagtagaaatgtctaatttaatttaaagatcaatagacaaatgaaacgtaaaaacaaaatactatgtagcctgtttttactaaattgttgattttttaattgctttatgagcctgttttgcctaaagtgtctatagatctttaactttaaagtcttatctcactttctttagtattgcagaaaaacttaagagtttttctgtttgcttttgtgtaccaggtggtctagaggaataattaaacattttagaactattaacaggtaaagtactgaaatgggtacaacttaaggaaaacaagaatgttgtcttctaactctgacattataccttgtttgtacccgccagcgggaacttcattgcaggccgtgtgtcaccctgaccacgtctatctctgggggtcgcacgttgcgggcagagcgcaaggcatacaccagaaaacgctgtcctgtggtatggtctcttccaacttcatgtaccagcgtaaagattaaagtggaaaacttcagactttggcttcatttttaatctttttggagattaagtgtctaaacttaacttaaatggttttttacaggagttaaagtacataaatgcctttttacagcttaatcattttggtcttctgtttagtgttgtatttcaattgtggagcctcattttaagtgttcattcttttaagatttaatgcttgctttttctttttatagctaatagtgaaatctacaaaccaaaacaagaacttttaaatctgggatataaattaaagatcatatgcacagatcaatttatgttcttgtaataaacttattagaaattggtgtttgtgatagcattttacttgggttactagagatgcttctagtagaccttaatctagcatagttgaacctctgaatatgggaaggttgtattcccagattctttcctgaatagatttgaatttaatgtcatttgggaactccagggtgagtttattgactacccaaactgtattttaccaataaatatgcatatgatctttaattattgaagaaaataaagtgaggacttaaaacaattcatgaaagtggacctttaaaagcttgtcagagttgcacaaatctaactggtattttgtttttgtttttaggaggagatgttaaagtaacccatcttgcaggacgacattgaagattggtcttctgttgatctaagatgattattttgtaaaagactttctagtgtacaagacaccattgtgtccaactgtatatagctgccaattagttttctttgtttttactttgtcctttgctatctgtgttatgactcaatgtggatttgtttatacacattttatttgtatcatttcatgttaaacctcaaataaatgcttccttatgtgataaaaaaaaaaaacaaaaaaaaaaaaaacattggggggggccggagaatgaggtggaacgcgtggcacgagaagcagagcaaaccgaccaggacagaaggtacaaagaggggagccggcggagcgcgcgaatggagcaagacaaacacacgaccagaccggacaaagaaacagacaacaagcgaggagaaagaaaggaggcaccagagcgacaccacgaggaagagaagaaacaaaaacaaagagcggagaaaggagcagaagtaaaaaccaaaacacgacggcaacgaaccaacagtaggagaggagggaagcagacaagacaaacgacaagaaaaaacgaacaagacacaaagacacagacaaaagcaagacaaccaagcggaaaggagaagacgagaagagacaaagaagccaaagaaaaaccaatcatcacgaataaggggaacaacgaaggacagaaagagaacaggggggaaggacacgagagcggagcagagcaggtaaaagtgagtgagcaacagaggcaacgcacagcagaggagaacagaagagagagtgaggaagaaggggcgagaagagcgagaaacggaggtgaaggaggcagcacagggcgcgacgcggaacagaggagaaaaggagcggcaccgagcagaggagagggaggaagagagaggcgaggagggacaggagagagagcacgagaggcaagagggcgacagaggagcgaagaggacgaaagaaggagcagagagtagactcg

SEQ ID NO: 418617 - DNA, 4744 bp, Homo sapiens
ggccgggtgttaatcggccgaggtacaacgctccgccgccgctgctgccgcgacccggactgcgcgccagcacccccctgccgacagctccgtcactatggaggatatgaacgagtacagcaatatagaggaattcgcagagggatccaagatcaacgcgagcaagaatcagcaggatgacggtaaaatgtttattggaggcttgagctgggatacaagcaaaaaagatctgacagagtacttgtctcgatttggggaagttgtagactgcacaattaaaacagatccagtcactgggagatcaagaggatttggatttgtgcttttcaaagatgctgctagtgttgataaggttttggaactgaaagaacacaaactggatggcaaattgatagatcccaaaagggccaaagctttaaaagggaaagaacctcccaaaaaggtttttgtgggtggattgagcccggatacttctgaagaacaaattaaagaatattttggagcctttggagagattgaaaatattgaacttcccatggatacaaaaacaaatgaaagaagaggattttgttttatcacatatactgatgaagagccagtaaaaaaattgttagaaagcagataccatcaaattggttctgggaagtgtgaaatcaaagttgcacaacccaaagaggtatataggcagcaacagcaacaacaaaaaggtggaagaggtgctgcagctggtggacgaggtggtacgaggggtcgtggccgagaggtgagacttaattcttgaaatatgactccgtggtttatttaagctgtatactgctgaatatgagtagtcctgtaccaaagcaaaactttaaacttaaaaccattccagcggaggggggactgttcagcttagtggaggttgtgtgtggtggttttttgttgtgagctcactggtttcaaaaaactgttaaaagtgtggccactttgacaattagtgtcatcactgataggaaaagtgtaccattacatgatacaccgtggtgtgataggttttcttgggcaggagtccttgttttaaacagaacagtgtacctgtcttcggctttaatggaaaattgaatgattttccattaagtttaggaagtttgatactggcacaattggactttctgcctccttttttataacagctggaaaaatagtttttcaagcagatagcaatatatatgtccattctgccctttaagatttgcagagtgagagacaagaacgcatcattttatgttagaattgggggtcagaagttgtttcctaacaatcattgtgcattgtttcgtcagggccaaaactggaaccaaggatttaataactattatgatcaaggatatggaaattacaatagtgcctatggtggtgatcaaaactatagtggctatggcggatatgattatactgggtataactatgggaactatggatatggacagggatatgcagactacagtggtaagaatatttaacttaattttataaagcagtggtattaaaattcattgttaacatacaatcctgttctgaaattgtgtgtatgggctttccattaaagtgttcggagttaagtgtttgaggcatgttacaatcataggatgattatactaacatagactggtggttataaatgaactaggatgtatgatttatgagtagcatctaatgggtgctaaaatatcttaatactttttatttagcatgcaaagatttgtagatttaatagtttgtgtttgtaaagaaagttttgtagaaaactatcttaatgagaattctgtgttttcaaaataggccaacagagcacttatggcaaggcatctcgagggggtggcaatcaccaaaacaattaccagccatactaaaggagaacattggagaaaacaggtgtgtataagagtacaggaaaacagtagaaatgtctaatttaatttaaagatcaatagacaaatgaaacgtaaaaacaaaatactatgtagcctgtttttactaaattgttgattttttaattgctttatgagcctgttttgcctaaagtgtctatagatctttaactttaaagtcttatctcactttctttagtattgcagaaaaacttaagagtttttctgtttgcttttgtgtaccaggtggtctagaggaataattaaacattttagaactattaacaggtaaagtactgaaatgggtacaacttaaggaaaacaagaatgttgtcttctaactctgacattataccttgtttgtacccgccagcgggaacttcattgcaggccgtgtgtcaccctgaccacgtctatctctgggggtcgcacgttgcgggcagagcgcaaggcatacaccagaaaacgctgtcctgtggtatggtctcttccaacttcatgtaccagcgtaaagattaaagtggaaaacttcagactttggcttcatttttaatctttttggagattaagtgtctaaacttaacttaaatggttttttacaggagttaaagtacataaatgcctttttacagcttaatcattttggtcttctgtttagtgttgtatttcaattgtggagcctcattttaagtgttcattcttttaagatttaatgcttgctttttctttttatagctaatagtgaaatctacaaaccaaaacaagaacttttaaatctgggatataaattaaagatcatatgcacagatcaatttatgttcttgtaataaacttattagaaattggtgtttgtgatagcattttacttgggttactagagatgcttctagtagaccttaatctagcatagttgaacctctgaatatgggaaggttgtattcccagattctttcctgaatagatttgaatttaatgtcatttgggaactccagggtgagtttattgactacccaaactgtattttaccaataaatatgcatatgatctttaattattgaagaaaataaagtgaggacttaaaacaattcatgaaagtggacctttaaaagcttgtcagagttgcacaaatctaactggtattttgtttttgtttttaggaggagatgttaaagtaacccatcttgcaggacgacattgaagattggtcttctgttgatctaagatgattattttgtaaaagactttctagtgtacaagacaccattgtgtccaactgtatatagctgccaattagttttctttgtttttactttgtcctttgctatctgtgttatgactcaatgtggatttgtttatacacattttatttgtatcatttcatgttaaacctcaaataaatgcttccttatgtgattgcttttctgcgtcaggtactacatagctctgtaaaaaatgtaatttaaaataagcaataattaaggcacagttgattttgtagagtattggtccatacagagaaactgtggtcctttataaatagccagccagcgtcaccctcttctccaatttgtaggtgtattttatgctcttaaggcttcatcttctccctgtaactgagatttctaccacacctttgaacaatgttctttcccttctggttatctgaagactgtcctgaaaggaagacataagtgttgtgattagtagaagctttctagtagaccatatttcttctggattgtaataaaattgttagtagctccttttactttgttcctgtctctggaaagccatttttgaattgctgattactttggctttaatcagtggtcacctagaaaaagctttgtaatcataacacaatgagtaattcttgataaaagttcagatacaaaaggagcactgtaaaactggtaggagctatggtttaagagcattggaagtagttacaactcaaggattttggtagaaaggtatgagtttggtcgaaaaattaaaatagtggcaaaataagatttagttgtgttttctcagagccgccacaagattgaacaaaatgttttctgtttgggcatcctgaggaagttgtattagctgttaatgctctgtgagtttagaaaaagtcttgatagtaaatctagtttttgacacagtgcatgaactaagtagttaaatatttacatattcagaaaggaatagtggaaaaggtatcttggttatgacaaagtcattacaaatgtgactaagtcattacaaatgtgactgagtcattacagtggaccctctgggtgcattgaaaagaatccgttttatatccaggtttcagaggacctggaataataaaaagctttggattttgcattcagtgtagttggattttgggaccttggcctcagtgttatttactgggattggcatacgtgttcacaggcagagtagttgatctcacacaacgggtgatctcacaaaactggtaagtttcttatgctcatgagccctccctttttttttttaatttggtgcctgcaactttcttaacaatgattctacttcctgggctatcacattataatgctcttggcctcttttttgctgctgttttgctattcttaaacttaggccaagtaccaatgttggctgttagaagggattctgttcattcaacatgcaactttagggaatggaagtaagttcatttttaagttgtgttgtcagtaggtgcggtgtctagggtagtgaatcctgtaagttcaaatttatgattaggtgacgagttgacattgagattgtccttttccctgatcaaaaaatgaataaagcctttttaaacaaaa

SEQ ID NO: 418618 - DNA, 2807 bp, Homo sapiens
ggccgggtgttaatcggccgaggtacaacgctccgccgccgctgctgccgcgacccggactgcgcgccagcacccccctgccgacagctccgtcactatggaggatatgaacgagtacagcaatatagaggaattcgcagagggatccaagatcaacgcgagcaagaatcagcaggatgacggtaaaatgtttattggaggcttgagctgggatacaagcaaaaaagatctgacagagtacttgtctcgatttggggaagttgtagactgcacaattaaaacagatccagtcactgggagatcaagaggatttggatttgtgcttttcaaagatgctgctagtgttgataaggttttggaactgaaagaacacaaactggatggcaaattgatagatcccaaaagggccaaagctttaaaagggaaagaacctcccaaaaaggtttttgtgggtggattgagcccggatacttctgaagaacaaattaaagaatattttggagcctttggagagattgaaaatattgaacttcccatggatacaaaaacaaatgaaagaagaggattttgttttatcacatatactgatgaagagccagtaaaaaaattgttagaaagcagataccatcaaattggttctgggaagtgtgaaatcaaagttgcacaacccaaagaggtatataggcagcaacagcaacaacaaaaaggtggaagaggtgctgcagctggtggacgaggtggtacgaggggtcgtggccgaggtcagggccaaaactggaaccaaggatttaataactattatgatcaaggatatggaaattacaatagtgcctatggtggtgatcaaaactatagtggctatggcggatatgattatactgggtataactatgggaactatggatatggacagggatatgcagactacagtggccaacagagcacttatggcaaggcatctcgagggggtggcaatcaccaaaacaattaccagccatactaaaggagaacattggagaaaacagcgggaacttcattgcaggccgtgtgtcaccctgaccacgtctatctctgggggtcgcacgttgcgggcagagcgcaaggcatacaccagaaaacgctgtcctgtggaggagatgttaaagtaacccatcttgcaggacgacattgaagattggtcttctgttgatctaagatgattattttgtaaaagactttctagtgtacaagacaccattgtgtccaactgtatatagctgccaattagttttctttgtttttactttgtcctttgctatctgtgttatgactcaatgtggatttgtttatacacattttatttgtatcatttcatgttaaacctcaaataaatgcttccttatgtgattgcttttctgcgtcaggtactacatagctctgtaaaaaatgtaatttaaaataagcaataattaaggcacagttgattttgtagagtattggtccatacagagaaactgtggtcctttataaatagccagccagcgtcaccctcttctccaatttgtaggtgtattttatgctcttaaggcttcatcttctccctgtaactgagatttctaccacacctttgaacaatgttctttcccttctggttatctgaagactgtcctgaaaggaagacataagtgttgtgattagtagaagctttctagtagaccatatttcttctggattgtaataaaattgttagtagctccttttactttgttcctgtctctggaaagccatttttgaattgctgattactttggctttaatcagtggtcacctagaaaaagctttgtaatcataacacaatgagtaattcttgataaaagttcagatacaaaaggagcactgtaaaactggtaggagctatggtttaagagcattggaagtagttacaactcaaggattttggtagaaaggtatgagtttggtcgaaaaattaaaatagtggcaaaataagatttagttgtgttttctcagagccgccacaagattgaacaaaatgttttctgtttgggcatcctgaggaagttgtattagctgttaatgctctgtgagtttagaaaaagtcttgatagtaaatctagtttttgacacagtgcatgaactaagtagttaaatatttacatattcagaaaggaatagtggaaaaggtatcttggttatgacaaagtcattacaaatgtgactaagtcattacaaatgtgactgagtcattacagtggaccctctgggtgcattgaaaagaatccgttttatatccaggtttcagaggacctggaataataaaaagctttggattttgcattcagtgtagttggattttgggaccttggcctcagtgttatttactgggattggcatacgtgttcacaggcagagtagttgatctcacacaacgggtgatctcacaaaactggtaagtttcttatgctcatgagccctccctttttttttttaatttggtgcctgcaactttcttaacaatgattctacttcctgggctatcacattataatgctcttggcctcttttttgctgctgttttgctattcttaaacttaggccaagtaccaatgttggctgttagaagggattctgttcattcaacatgcaactttagggaatggaagtaagttcatttttaagttgtgttgtcagtaggtgcggtgtctagggtagtgaatcctgtaagttcaaatttatgattaggtgacgagttgacattgagattgtccttttccctgatcaaaaaatgaataaagcctttttaaacaaaa

SEQ ID NO: 418619 - DNA, 3794 bp, Homo sapiens
tggagctcaaggatccttaattaaattaatcccccccctacaacgctccgccgccgctgctgccgcgacccggactgcgcgccagcacccccctgccgacagctccgtcactatggaggatatgaacgagtacagcaatatagaggaattcgcagagggatccaagatcaacgcgagcaagaatcagcaggatgacggtaaaatgtttattggaggcttgagctgggatacaagcaaaaaagatctgacagagtacttgtctcgatttggggaagttgtagactgcacaattaaaacagatccagtcactgggagatcaagaggatttggatttgtgcttttcaaagatgctgctagtgttgataagaacctcccaaaaaggtttttgtgggtggattgagcccggatacttctgaagaacaaattaaagaatattttggagcctttggagagattgaaaatattgaacttcccatggatacaaaaacaaatgaaagaagaggattttgttttatcacatatactgatgaagagccagtaaaaaaattgttagaaagcagataccatcaaattggttctgggaagtgtgaaatcaaagttgcacaacccaaagaggtatataggcagcaacagcaacaacaaaaaggtggaagaggtgctgcagctggtggacgaggtggtacgaggggtcgtggccgaggtcagggccaaaactggaaccaaggatttaataactattatgatcaaggatatggaaattacaatagtgcctatggtggtgatcaaaactatagtggctatggcggatatgattatactgggtataactatgggaactatggatatggacagggatatgcagactacagtggccaacagagcacttatggcaaggcatctcgagggggtggcaatcaccaaaacaattaccagccatactaaaggagaacattggagaaaacaggtgtgtataagagtacaggaaaacagtagaaatgtctaatttaatttaaagatcaatagacaaatgaaacgtaaaaacaaaatactatgtagcctgtttttactaaattgttgattttttaattgctttatgagcctgttttgcctaaagtgtctatagatctttaactttaaagtcttatctcactttctttagtattgcagaaaaacttaagagtttttctgtttgcttttgtgtaccaggtggtctagaggaataattaaacattttagaactattaacaggtaaagtactgaaatgggtacaacttaaggaaaacaagaatgttgtcttctaactctgacattataccttgtttgtacccgccagcgggaacttcattgcaggccgtgtgtcaccctgaccacgtctatctctgggggtcgcacgttgcgggcagagcgcaaggcatacaccagaaaacgctgtcctgtggtatggtctcttccaacttcatgtaccagcgtaaagattaaagtggaaaacttcagactttggcttcatttttaatctttttggagattaagtgtctaaacttaacttaaatggttttttacaggagttaaagtacataaatgcctttttacagcttaatcattttggtcttctgtttagtgttgtatttcaattgtggagcctcattttaagtgttcattcttttaagatttaatgcttgctttttctttttatagctaatagtgaaatctacaaaccaaaacaagaacttttaaatctgggatataaattaaagatcatatgcacagatcaatttatgttcttgtaataaacttattagaaattggtgtttgtgatagcattttacttgggttactagagatgcttctagtagaccttaatctagcatagttgaacctctgaatatgggaaggttgtattcccagattctttcctgaatagatttgaatttaatgtcatttgggaactccagggtgagtttattgactacccaaactgtattttaccaataaatatgcatatgatctttaattattgaagaaaataaagtgaggacttaaaacaattcatgaaagtggacctttaaaagcttgtcagagttgcacaaatctaactggtattttgtttttgtttttaggaggagatgttaaagtaacccatcttgcaggacgacattgaagattggtcttctgttgatctaagatgattattttgtaaaagactttctagtgtacaagacaccattgtgtccaactgtatatagctgccaattagttttctttgtttttactttgtcctttgctatctgtgttatgactcaatgtggatttgtttatacacattttatttgtatcatttcatgttaaacctcaaataaatgcttccttatgtgattgcttttctgcgtcaggtactacatagctctgtaaaaaatgtaatttaaaataagcaataattaaggcacagttgattttgtagagtattggtccatacagagaaactgtggtcctttataaatagccagccagcgtcaccctcttctccaatttgtaggtgtattttatgctcttaaggcttcatcttctccctgtaactgagatttctaccacacctttgaacaatgttctttcccttctggttatctgaagactgtcctgaaaggaagacataagtgttgtgattagtagaagctttctagtagaccatatttcttctggattgtaataaaattgttagtagctccttttactttgttcctgtctctggaaagccatttttgaattgctgattactttggctttaatcagtggtcacctagaaaaagctttgtaatcataacacaatgagtaattcttgataaaagttcagatacaaaaggagcactgtaaaactggtaggagctatggtttaagagcattggaagtagttacaactcaaggattttggtagaaaggtatgagtttggtcgaaaaattaaaatagtggcaaaataagatttagttgtgttttctcagagccgccacaagattgaacaaaatgttttctgtttgggcatcctgaggaagttgtattagctgttaatgctctgtgagtttagaaaaagtcttgatagtaaatctagtttttgacacagtgcatgaactaagtagttaaatatttacatattcagaaaggaatagtggaaaaggtatcttggttatgacaaagtcattacaaatgtgactaagtcattacaaatgtgactgagtcattacagtggaccctctgggtgcattgaaaagaatccgttttatatccaggtttcagaggacctggaataataaaaagctttggattttgcattcagtgtagttggattttgggaccttggcctcagtgttatttactgggattggcatacgtgttcacaggcagagtagttgatctcacacaacgggtgatctcacaaaactggtaagtttcttatgctcatgagccctccctttttttttttaatttggtgcctgcaactttcttaacaatgattctacttcctgggctatcacattataatgctcttggcctcttttttgctgctgttttgctattcttaaacttaggccaagtaccaatgttggctgttagaagggattctgttcattcaacatgcaactttagggaatggaagtaagttcatttttaagttgtgttgtcagtaggtgcggtgtctagggtagtgaatcctgtaagttcaaatttatgattaggtgacgagttgacattgagattgtccttttccctgatcaaaaaatgaataaagcctttttaaacaaaa

SEQ ID NO: 418620 - DNA, 3235 bp, Homo sapiens
ggccgggtgttaatcggccgaggtacaacgctccgccgccgctgctgccgcgacccggactgcgcgccagcacccccctgccgacagctccgtcactatggaggatatgaacgagtacagcaatatagaggaattcgcagagggatccaagatcaacgcgagcaagaatcagcaggatgacggtaaaatgtttattggaggcttgagctgggatacaagcaaaaaagatctgacagagtacttgtctcgatttggggaagttgtagactgcacaattaaaacagatccagtcactgggagatcaagaggatttggatttgtgcttttcaaagatgctgctagtgttgataaggttttggaactgaaagaacacaaactggatggcaaattgatagatcccaaaagggccaaagctttaaaagggaaagaacctcccaaaaaggtttttgtgggtggattgagcccggatacttctgaagaacaaattaaagaatattttggagcctttggagagattgaaaatattgaacttcccatggatacaaaaacaaatgaaagaagaggattttgttttatcacatatactgatgaagagccagtaaaaaaattgttagaaagcagataccatcaaattggttctgggaagtgtgaaatcaaagttgcacaacccaaagaggtatataggcagcaacagcaacaacaaaaaggtggaagaggtgctgcagctggtggacgaggtggtacgaggggtcgtggccgaggtcagggccaaaactggaaccaaggatttaataactattatgatcaaggatatggaaattacaatagtgcctatggtggtgatcaaaactatagtggctatggcggatatgattatactgggtataactatgggaactatggatatggacagggatatgcagactacagtggccaacagagcacttatggcaaggcatctcgagggggtggcaatcaccaaaacaattaccagccatactaaaggagaacattggagaaaacaggtgtgtataagagtacaggaaaacagtagaaatgtctaatttaatttaaagatcaatagacaaatgaaacgtaaaaacaaaatactatgtagcctgtttttactaaattgttgattttttaattgctttatgagcctgttttgcctaaagtgtctatagatctttaactttaaagtcttatctcactttctttagtattgcagaaaaacttaagagtttttctgtttgcttttgtgtaccaggtggtctagaggaataattaaacattttagaactattaacaggtaaagtactgaaatgggtacaacttaaggaaaacaagaatgttgtcttctaactctgacattataccttgtttgtacccgccagcgggaacttcattgcaggccgtgtgtcaccctgaccacgtctatctctgggggtcgcacgttgcgggcagagcgcaaggcatacaccagaaaacgctgtcctgtggtatggtctcttccaacttcatgtaccagcgtaaagattaaagtggaaaacttcagactttggcttcatttttaatctttttggagattaagtgtctaaacttaacttaaatggttttttacaggagttaaagtacataaatgcctttttacagcttaatcattttggtcttctgtttagtgttgtatttcaattgtggagcctcattttaagtgttcattcttttaagatttaatgcttgctttttctttttatagctaatagtgaaatctacaaaccaaaacaagaacttttaaatctgggatataaattaaagatcatatgcacagatcaatttatgttcttgtaataaacttattagaaattggtgtttgtgatagcattttacttgggttactagagatgcttctagtagaccttaatctagcatagttgaacctctgaatatgggaaggttgtattcccagattctttcctgaatagatttgaatttaatgtcatttgggaactccagggtgagtttattgactacccaaactgtattttaccaataaatatgcatatgatctttaattattgaagaaaataaagtgaggacttaaaacaattcatgaaagtggacctttaaaagcttgtcagagttgcacaaatctaactggtattttgtttttgtttttaggaggagatgttaaagtaacccatcttgcaggacgacattgaagattggtcttctgttgatctaagatgattattttgtaaaagactttctagtgtacaagacaccattgtgtccaactgtatatagctgccaattagttttctttgtttttactttgtcctttgctatctgtgttatgactcaatgtggatttgtttatacacattttatttgtatcatttcatgttaaacctcaaataaatgcttccttatgtgataaaaaaaaaaaaaaaaaaaaacaacaaaacaaaaaaaaaaaaaaaaaaaaacaaaaaaaaaaaaaacattggggggggccggagaatgaggtggaacgcgtggcacgagaagcagagcaaaccgaccaggacagaaggtacaaagaggggagccggcggagcgcgcgaatggagcaagacaaacacacgaccagaccggacaaagaaacagacaacaagcgaggagaaagaaaggaggcaccagagcgacaccacgaggaagagaagaaacaaaaacaaagagcggagaaaggagcagaagtaaaaaccaaaacacgacggcaacgaaccaacagtaggagaggagggaagcagacaagacaaacgacaagaaaaaacgaacaagacacaaagacacagacaaaagcaagacaaccaagcggaaaggagaagacgagaagagacaaagaagccaaagaaaaaccaatcatcacgaataaggggaacaacgaaggacagaaagagaacaggggggaaggacacgagagcggagcagagcaggtaaaagtgagtgagcaacagaggcaacgcacagcagaggagaacagaagagagagtgaggaagaaggggcgagaagagcgagaaacggaggtgaaggaggcagcacagggcgcgacgcggaacagaggagaaaaggagcggcaccgagcagaggagagggaggaagagagaggcgaggagggacaggagagagagcacgagaggcaagagggcgacagaggagcgaagaggacgaaagaaggagcagagagtagactcg

SEQ ID NO: 418621 - DNA, 2531 bp, Homo sapiens
ggccgggtgttaatcggccgaggtacaacgctccgccgccgctgctgccgcgacccggactgcgcgccagcacccccctgccgacagctccgtcactatggaggatatgaacgagtacagcaatatagaggaattcgcagagggatccaagatcaacgcgagcaagaatcagcaggatgacggtaaaatgtttattggaggcttgagctgggatacaagcaaaaaagatctgacagagtacttgtctcgatttggggaagttgtagactgcacaattaaaacagatccagtcactgggagatcaagaggatttggatttgtgcttttcaaagatgctgctagtgttgataaggttttggaactgaaagaacacaaactggatggcaaattgatagatcccaaaagggccaaagctttaaaagggaaagaacctcccaaaaaggtttttgtgggtggattgagcccggatacttctgaagaacaaattaaagaatattttggagcctttggagagattgaaaatattgaacttcccatggatacaaaaacaaatgaaagaagaggattttgttttatcacatatactgatgaagagccagtaaaaaaattgttagaaagcagataccatcaaattggttctgggaagtgtgaaatcaaagttgcacaacccaaagaggtatataggcagcaacagcaacaacaaaaaggtggaagaggtgctgcagctggtggacgaggtggtacgaggggtcgtggccgaggccaacagagcacttatggcaaggcatctcgagggggtggcaatcaccaaaacaattaccagccatactaaaggagaacattggagaaaacaggaggagatgttaaagtaacccatcttgcaggacgacattgaagattggtcttctgttgatctaagatgattattttgtaaaagactttctagtgtacaagacaccattgtgtccaactgtatatagctgccaattagttttctttgtttttactttgtcctttgctatctgtgttatgactcaatgtggatttgtttatacacattttatttgtatcatttcatgttaaacctcaaataaatgcttccttatgtgattgcttttctgcgtcaggtactacatagctctgtaaaaaatgtaatttaaaataagcaataattaaggcacagttgattttgtagagtattggtccatacagagaaactgtggtcctttataaatagccagccagcgtcaccctcttctccaatttgtaggtgtattttatgctcttaaggcttcatcttctccctgtaactgagatttctaccacacctttgaacaatgttctttcccttctggttatctgaagactgtcctgaaaggaagacataagtgttgtgattagtagaagctttctagtagaccatatttcttctggattgtaataaaattgttagtagctccttttactttgttcctgtctctggaaagccatttttgaattgctgattactttggctttaatcagtggtcacctagaaaaagctttgtaatcataacacaatgagtaattcttgataaaagttcagatacaaaaggagcactgtaaaactggtaggagctatggtttaagagcattggaagtagttacaactcaaggattttggtagaaaggtatgagtttggtcgaaaaattaaaatagtggcaaaataagatttagttgtgttttctcagagccgccacaagattgaacaaaatgttttctgtttgggcatcctgaggaagttgtattagctgttaatgctctgtgagtttagaaaaagtcttgatagtaaatctagtttttgacacagtgcatgaactaagtagttaaatatttacatattcagaaaggaatagtggaaaaggtatcttggttatgacaaagtcattacaaatgtgactaagtcattacaaatgtgactgagtcattacagtggaccctctgggtgcattgaaaagaatccgttttatatccaggtttcagaggacctggaataataaaaagctttggattttgcattcagtgtagttggattttgggaccttggcctcagtgttatttactgggattggcatacgtgttcacaggcagagtagttgatctcacacaacgggtgatctcacaaaactggtaagtttcttatgctcatgagccctccctttttttttttaatttggtgcctgcaactttcttaacaatgattctacttcctgggctatcacattataatgctcttggcctcttttttgctgctgttttgctattcttaaacttaggccaagtaccaatgttggctgttagaagggattctgttcattcaacatgcaactttagggaatggaagtaagttcatttttaagttgtgttgtcagtaggtgcggtgtctagggtagtgaatcctgtaagttcaaatttatgattaggtgacgagttgacattgagattgtccttttccctgatcaaaaaatgaataaagcctttttaaacaaaa

SEQ ID NO: 418622 - DNA, 1756 bp, Homo sapiens
ggccgggtgttaatcggccgaggtacaacgctccgccgccgctgctgccgcgacccggactgcgcgccagcacccccctgccgacagctccgtcactatggaggatatgaacgagtacagcaatatagaggaattcgcagagggatccaagatcaacgcgagcaagaatcagcaggatgacggtaaaatgtttattggaggcttgagctgggatacaagcaaaaaagatctgacagagtacttgtctcgatttggggaagttgtagactgcacaattaaaacagatccagtcactgggagatcaagaggatttggatttgtgcttttcaaagatgctgctagtgttgataaggttttggaactgaaagaacacaaactggatggcaaattgatagatcccaaaagggccaaagctttaaaagggaaagaacctcccaaaaaggtttttgtgggtggattgagcccggatacttctgaagaacaaattaaagaatattttggagcctttggagagattgaaaatattgaacttcccatggatacaaaaacaaatgaaagaagaggattttgttttatcacatatactgatgaagagccagtaaaaaaattgttagaaagcagataccatcaaattggttctgggaagtgtgaaatcaaagttgcacaacccaaagaggtatataggcagcaacagcaacaacaaaaaggtggaagaggtgctgcagctggtggacgaggtggtacgaggggtcgtggccgaggtcagggccaaaactggaaccaaggatttaataactattatgatcaaggatatggaaattacaatagtgcctatggtggtgatcaaaactatagtggctatggcggatatgattatactgggtataactatgggaactatggatatggacagggatatgcagactacagtggccaacagagcacttatggcaaggcatctcgagggggtggcaatcaccaaaacaattaccagccatactaaaggagaacattggagaaaacaggtgtgtataagagtacaggaaaacagtagaaatgtctaatttaatttaaagatcaatagacaaatgaaacgtaaaaacaaaatactatgtagcctgtttttactaaattgttgattttttaattgctttatgagcctgttttgcctaaagtgtctatagatctttaactttaaagtcttatctcactttctttagtattgcagaaaaacttaagagtttttctgtttgcttttgtgtaccaggtggtctagaggaataattaaacattttagaactattaacaggtaaagtactgaaatgggtacaacttaaggaaaacaagaatgttgtcttctaactctgacattataccttgtttgtacccgccagcgggaacttcattgcaggccgtgtgtcaccctgaccacgtctatctctgggggtcgcacgttgcgggcagagcgcaaggcatacaccagaaaacgctgtcctgtggaggagatgttaaagtaacccatcttgcaggacgacattgaagattggtcttctgttgatctaagatgattattttgtaaaagactttctagtgtacaagacaccattgtgtccaactgtatatagctgccaattagttttctttgtttttactttgtcctttgctatctgtgttatgactcaatgtggatttgtttatacacattttatttgtatcatttcatgttaaacctcaaataaatgcttccttatgtgat

SEQ ID NO: 418623 - DNA, 1387 bp, Homo sapiens
ggccgggtgttaatcggccgaggtacaacgctccgccgccgctgctgccgcgacccggactgcgcgccagcacccccctgccgacagctccgtcactatggaggatatgaacgagtacagcaatatagaggaattcgcagagggatccaagatcaacgcgagcaagaatcagcaggatgacggtaaaatgtttattggaggcttgagctgggatacaagcaaaaaagatctgacagagtacttgtctcgatttggggaagttgtagactgcacaattaaaacagatccagtcactgggagatcaagaggatttggatttgtgcttttcaaagatgctgctagtgttgataaggttttggaactgaaagaacacaaactggatggcaaattgatagatcccaaaagggccaaagctttaaaagggaaagaacctcccaaaaaggtttttgtgggtggattgagcccggatacttctgaagaacaaattaaagaatattttggagcctttggagagattgaaaatattgaacttcccatggatacaaaaacaaatgaaagaagaggattttgttttatcacatatactgatgaagagccagtaaaaaaattgttagaaagcagataccatcaaattggttctgggaagtgtgaaatcaaagttgcacaacccaaagaggtatataggcagcaacagcaacaacaaaaaggtggaagaggtgctgcagctggtggacgaggtggtacgaggggtcgtggccgaggtcagggccaaaactggaaccaaggatttaataactattatgatcaaggatatggaaattacaatagtgcctatggtggtgatcaaaactatagtggctatggcggatatgattatactgggtataactatgggaactatggatatggacagggatatgcagactacagtggccaacagagcacttatggcaaggcatctcgagggggtggcaatcaccaaaacaattaccagccatactaaaggagaacattggagaaaacagcgggaacttcattgcaggccgtgtgtcaccctgaccacgtctatctctgggggtcgcacgttgcgggcagagcgcaaggcatacaccagaaaacgctgtcctgtggaggagatgttaaagtaacccatcttgcaggacgacattgaagattggtcttctgttgatctaagatgattattttgtaaaagactttctagtgtacaagacaccattgtgtccaactgtatatagctgccaattagttttctttgtttttactttgtcctttgctatctgtgttatgactcaatgtggatttgtttatacacattttatttgtatcatttcatgttaaacctcaaataaatgcttccttatgtgat

SEQ ID NO: 418624 - DNA, 1487 bp, Homo sapiens
  misc_feature (1352)..(1353): n is a, c, g, or t
  misc_feature (1398)..(1398): n is a, c, g, or t
  misc_feature (1471)..(1471): n is a, c, g, or t
  misc_feature (1487)..(1487): n is a, c, g, or t
ggccgggtgttaatcggccgaggtacaacgctccgccgccgctgctgccgcgacccggactgcgcgccagcacccccctgccgacagctccgtcactatggaggatatgaacgagtacagcaatatagaggaattcgcagagggatccaagatcaacgcgagcaagaatcagcaggatgacggtaaaatgtttattggaggcttgagctgggatacaagcaaaaaagatctgacagagtacttgtctcgatttggggaagttgtagactgcacaattaaaacagatccagtcactgggagatcaagaggatttggatttgtgcttttcaaagatgctgctagtgttgataaggttttggaactgaaagaacacaaactggatggcaaattgatagatcccaaaagggccaaagctttaaaagggaaagaacctcccaaaaaggtttttgtgggtggattgagcccggatacttctgaagaacaaattaaagaatattttggagcctttggagagattgaaaatattgaacttcccatggatacaaaaacaaatgaaagaagaggattttgttttatcacatatactgatgaagagccagtaaaaaaattgttagaaagcagataccatcaaattggttctgggaagtgtgaaatcaaagttgcacaacccaaagaggtatataggcagcaacagcaacaacaaaaaggtggaagaggtgctgcagctggtggacgaggtggtacgaggggtcgtggccgaggtcagggccaaaactggaaccaaggatttaataactattatgatcaaggatatggaaattacaatagtgcctatggtggtgatcaaaactatagtggctatggcggatatgattatactgggtataactatgggaactatggatatggacagggatatgcagactacagtggccaacagagcacttatggcaaggcatctcgagggggtggcaatcaccaaaacaattaccagccatactaaaggagaacattggagaaaacaggtgtgtataagagtacaggaaaacagtagaaatgtctaatttaatttaaagatcaatagacaaatgaaacgtaaaaacaaaatactatgtagcctgtttttactaaattgttgattttttaattgctttatgagcctgttttgcctaaagtgtctatagatctttaactttaaagtcttatctcactttctttagtattgcagaaaaacttaagagtttttctgtttgcttttgtgtaccaggtggtctagaggaataattaaacattttagaactattaacaggtaaagtactgaaatgggtacaacttaaggaagactcattganngcggtgtacctgacacgttattctggggtcgacgtgcggcagacncagggatcacagaaacgctgctggggatgctttcaactatgacagcgaagataagtgaaactaactggctatntatcttggaatagtgn

SEQ ID NO: 418625 - DNA, 2657 bp, Homo sapiens
  misc_feature (610)..(610): n is a, c, g, or t
  misc_feature (645)..(645): n is a, c, g, or t
  misc_feature (649)..(649): n is a, c, g, or t
  misc_feature (651)..(651): n is a, c, g, or t
  misc_feature (679)..(679): n is a, c, g, or t
  misc_feature (700)..(700): n is a, c, g, or t
  misc_feature (714)..(714): n is a, c, g, or t
  misc_feature (720)..(720): n is a, c, g, or t
  misc_feature (722)..(723): n is a, c, g, or t
  misc_feature (732)..(732): n is a, c, g, or t
  misc_feature (734)..(734): n is a, c, g, or t
  misc_feature (739)..(739): n is a, c, g, or t
  misc_feature (750)..(750): n is a, c, g, or t
tggagctcaaggatccttaattaaattaatcccccccctacaacgctccgccgccgctgctgccgcgacccggactgcgcgccagcacccccctgccgacagctccgtcactatggaggatatgaacgagtacagcaatatagaggaattcgcagagggatccaagatcaacgcgagcaagaatcagcaggatgacggtaaaatgtttattggaggcttgagctgggatacaagcaaaaaagatctgacagagtacttgtctcgatttggggaagttgtagactgcacaattaaagttttggaactgaaagaacacaaactggatggcaaattgatagatcccaaaagggccaaagctttaaaagggaaagaacctcccaaaaaggtttttgtgggtggattgagcccggatacttctgaagaacaaattaaagaatattttggagcctttggagagattgaaaatattgaacttcccatggatacaaaaacaaatgaaagaagaggattttgttttatcacatatactgatgaagagccagtaaaaaaattgttagaaagcagataccatcaaattggttctgggaagaccgccccgggaaacggaaancaaagcgcacaacccaaaaaaccaaaaaaccaacnacancnacaacaaaaaagccgaacaccccccccncccggcgcaccaaccggcacnaggggccccgcccnacgccncnnccaagaccngngccanggaaggaaggnccaagaggaacaaggatatggaaattacaatagtgcctatggtggtgatcaaaactatagtggctatggcggatatgattatactgggtataactatgggaactatggatatggacagggatatgcagactacagtggccaacagagcacttatggcaaggcatctcgagggggtggcaatcaccaaaacaattaccagccatactaaaggagaacattggagaaaacaggaggagatgttaaagtaacccatcttgcaggacgacattgaagattggtcttctgttgatctaagatgattattttgtaaaagactttctagtgtacaagacaccattgtgtccaactgtatatagctgccaattagttttctttgtttttactttgtcctttgctatctgtgttatgactcaatgtggatttgtttatacacattttatttgtatcatttcatgttaaacctcaaataaatgcttccttatgtgattgcttttctgcgtcaggtactacatagctctgtaaaaaatgtaatttaaaataagcaataattaaggcacagttgattttgtagagtattggtccatacagagaaactgtggtcctttataaatagccagccagcgtcaccctcttctccaatttgtaggtgtattttatgctcttaaggcttcatcttctccctgtaactgagatttctaccacacctttgaacaatgttctttcccttctggttatctgaagactgtcctgaaaggaagacataagtgttgtgattagtagaagctttctagtagaccatatttcttctggattgtaataaaattgttagtagctccttttactttgttcctgtctctggaaagccatttttgaattgctgattactttggctttaatcagtggtcacctagaaaaagctttgtaatcataacacaatgagtaattcttgataaaagttcagatacaaaaggagcactgtaaaactggtaggagctatggtttaagagcattggaagtagttacaactcaaggattttggtagaaaggtatgagtttggtcgaaaaattaaaatagtggcaaaataagatttagttgtgttttctcagagccgccacaagattgaacaaaatgttttctgtttgggcatcctgaggaagttgtattagctgttaatgctctgtgagtttagaaaaagtcttgatagtaaatctagtttttgacacagtgcatgaactaagtagttaaatatttacatattcagaaaggaatagtggaaaaggtatcttggttatgacaaagtcattacaaatgtgactaagtcattacaaatgtgactgagtcattacagtggaccctctgggtgcattgaaaagaatccgttttatatccaggtttcagaggacctggaataataaaaagctttggattttgcattcagtgtagttggattttgggaccttggcctcagtgttatttactgggattggcatacgtgttcacaggcagagtagttgatctcacacaacgggtgatctcacaaaactggtaagtttcttatgctcatgagccctccctttttttttttaatttggtgcctgcaactttcttaacaatgattctacttcctgggctatcacattataatgctcttggcctcttttttgctgctgttttgctattcttaaacttaggccaagtaccaatgttggctgttagaagggattctgttcattcaacatgcaactttagggaatggaagtaagttcatttttaagttgtgttgtcagtaggtgcggtgtctagggtagtgaatcctgtaagttcaaatttatgattaggtgacgagttgacattgagattgtccttttccctgatcaaaaaatgaataaagcctttttaaacaaaa

SEQ ID NO: 418626 - DNA, 960 bp, Homo sapiens
ggccgggtgttaatcggccgaggtacaacgctccgccgccgctgctgccgcgacccggactgcgcgccagcacccccctgccgacagctccgtcactatggaggatatgaacgagtacagcaatatagaggaattcgcagagggatccaagatcaacgcgagcaagaatcagcaggatgacggtaaaatgtttattggaggcttgagctgggatacaagcaaaaaagatctgacagagtacttgtctcgatttggggaagttgtagactgcacaattaaaacagatccagtcactgggagatcaagaggatttggatttgtgcttttcaaagatgctgctagtgttgataaggttttggaactgaaagaacacaaactggatggcaaattgatagatcccaaaagggccaaagctttaaaagggaaagaacctcccaaaaaggtttttgtgggtggattgagcccggatacttctgaagaacaaattaaagaatattttggagcctttggagagattgaaaatattgaacttcccatggatacaaaaacaaatgaaagaagaggattttgttttatcacatatactgatgaagagccagtaaaaaaattgttagaaagcagataccatcaaattggttctgggaagtgtgaaatcaaagttgcacaacccaaagaggtatataggcagcaacagcaacaacaaaaaggtggaagaggtgctgcagctggtggacgaggtggtacgaggggtcgtggccgaggtcagggccaaaactggaaccaaggatttaataactattatgatcaaggatatggaaattacaatagtgcctatggtggtgatcaaaactatagtggctatggcggatatgattatactgggtataactatgggaactatggatatggacagggatatgcagactacagtgcgctcgtaggaggggatcctctaaatca

SEQ ID NO: 418627 - DNA, 1189 bp, Homo sapiens
ggccgggtgttaatcggccgaggtacaacgctccgccgccgctgctgccgcgacccggactgcgcgccagcacccccctgccgacagctccgtcactatggaggatatgaacgagtacagcaatatagaggaattcgcagagggatccaagatcaacgcgagcaagaatcagcaggatgacggtaaaatgtttattggaggcttgagctgggatacaagcaaaaaagatctgacagagtacttgtctcgatttggggaagttgtagactgcacaattaaaacagatccagtcactgggagatcaagaggatttggatttgtgcttttcaaagatgctgctagtgttgataaggttttggaactgaaagaacacaaactggatggcaaattgatagatcccaaaagggccaaagctttaaaagggaaagaacctcccaaaaaggtttttgtgggtggattgagcccggatacttctgaagaacaaattaaagaatattttggagcctttggagagattgaaaatattgaacttcccatggatacaaaaacaaatgaaagaagaggattttgttttatcacatatactgatgaagagccagtaaaaaaattgttagaaagcagataccatcaaattggttctgggaagtgtgaaatcaaagttgcacaacccaaagaggtatataggcagcaacagcaacaacaaaaaggtggaagaggtgctgcagctggtggacgaggtggtacgaggggtcgtggccgaggtcagggccaaaactggaaccaaggatttaataactattatgatcaaggatatggaaattacaatagtgcctatggtggccaacagagcacttatggcaaggcatctcgagggggtggcaatcaccaaaacaattaccagccatactaaaggagaacattggagaaaacaggaggagatgttaaagtaacccatcttgcaggacgacattgaagattggtcttctgttgatctaagatgattattttgtaaaagactttctagtgtacaagacaccattgtgtccaactgtatatagctgccaattagttttctttgtttttactttgtcctttgctatctgtgttatgactcaatgtggatttgtttatacacattttatttgtatcatttcatgttaaacctcaaataaatgcttccttatgtgat

SEQ ID NO: 418628 - DNA, 1111 bp, Homo sapiens
ggccgggtgttaatcggccgaggtacaacgctccgccgccgctgctgccgcgacccggactgcgcgccagcacccccctgccgacagctccgtcactatggaggatatgaacgagtacagcaatatagaggaattcgcagagggatccaagatcaacgcgagcaagaatcagcaggatgacggtaaaatgtttattggaggcttgagctgggatacaagcaaaaaagatctgacagagtacttgtctcgatttggggaagttgtagactgcacaattaaaacagatccagtcactgggagatcaagaggatttggatttgtgcttttcaaagatgctgctagtgttgataaggttttggaactgaaagaacacaaactggatggcaaattgatagatcccaaaagggccaaagctttaaaagggaaagaacctcccaaaaaggtttttgtgggtggattgagcccggatacttctgaagaacaaattaaagaatattttggagcctttggagagattgaaaatattgaacttcccatggatacaaaaacaaatgaaagaagaggattttgttttatcacatatactgatgaagagccagtaaaaaaattgttagaaagcagataccatcaaattggttctgggaagtgtgaaatcaaagttgcacaacccaaagaggtatataggcagcaacagcaacaacaaaaaggtggaagaggtgctgcagctggtggacgaggtggtacgaggggtcgtggccgaggccaacagagcacttatggcaaggcatctcgagggggtggcaatcaccaaaacaattaccagccatactaaaggagaacattggagaaaacaggaggagatgttaaagtaacccatcttgcaggacgacattgaagattggtcttctgttgatctaagatgattattttgtaaaagactttctagtgtacaagacaccattgtgtccaactgtatatagctgccaattagttttctttgtttttactttgtcctttgctatctgtgttatgactcaatgtggatttgtttatacacattttatttgtatcatttcatgttaaacctcaaataaatgcttccttatgtgat

SEQ ID NO: 418629 - DNA, 741 bp, Homo sapiens
ggccgggtgttaatcggccgaggtacaacgctccgccgccgctgctgccgcgacccggactgcgcgccagcacccccctgccgacagctccgtcactatggaggatatgaacgagtacagcaatatagaggaattcgcagagggatccaagatcaacgcgagcaagaatcagcaggatgacggtaaaatgtttattggaggcttgagctgggatacaagcaaaaaagatctgacagagtacttgtctcgatttggggaagttgtagactgcacaattaaaacagatccagtcactgggagatcaagaggatttggatttgtgcttttcaaagatgctgctagtgttgataaggttttggaactgaaagaacacaaactggatggcaaattgatagatcccaaaagggccaaagctttaaaagggaaagaacctcccaaaaaggtttttgtgggtggattgagcccggatacttctgaagaacaaattaaagaatattttggagcctttggagagattgaaaatattgaacttcccatggatacaaaaacaaatgaaagaagaggattttgttttatcacatatactgatgaagagccagtaaaaaaattgttagaaagcagataccatcaaattggttctgggaagtgtgaaatcaaagttgcacaacccaaagaggtatataggcagcaacagcaacaacaaaaaggtggaagagagaacccaccaacaatcacatcatg

SEQ ID NO: 418630 - DNA, 681 bp, Homo sapiens
ggccgggtgttaatcggccgaggtacaacgctccgccgccgctgctgccgcgacccggactgcgcgccagcacccccctgccgacagctccgtcactatggaggatatgaacgagtacagcaatatagaggaattcgcagagggatccaagatcaacgcgagcaagaatcagcaggatgacggtaaaatgtttattggaggcttgagctgggatacaagcaaaaaagatctgacagagtacttgtctcgatttggggaagttgtagactgcacaattaaaacagatccagtcactgggagatcaagaggatttggatttgtgcttttcaaagatgctgctagtgttgataaggttttggaactgaaagaacacaaactggatggcaaattgatagatcccaaaagggccaaagctttaaaagggaaagaacctcccaaaaaggtttttgtgggtggattgagcccggatacttctgaagaacaaattaaagaatattttggagcctttggagagattgaaaatattgaacttcccatggatacaaaaacaaatgaaagaagaggattttgttttatcacatatactgatgaagagccagtaaaaaaattgttagaaagcagataccatcaaattggttctgggaaggcagcacacgattcgccgaggtcctctagtcagct

SEQ ID NO: 418631 - DNA, 2392 bp, Homo sapiens
tgcgcgagagcgcgccctccgcagacaggttgagcgagcgggagaggcccggggcacgtgcagaaaggagccccgcgagtggcgcgccggggatgtgagtgccccttgccctctactgaatccagccccctccccgcccaccgcctccgcctttgcatagatacagtcatctggccagcccccgcccctcctcccggcgtcagcccgccagaggccgcgcggggcccgggcttcggccgatcagcccgggaggccccgccgcgcccccttggcccgcgcgcccgtggtcacagtggaagaggcgcccgcgctgcgctgcccggaggagccgtcgcgcgcccgcttcctgttcggctggttcctgccagctcgaggacaaaacacgcgtgcgcgcggcgggcgagcgcgctcgccgcctcagtcgccagcgccgggcgcagtccgcctttttccggagcagactggccgcggtgctagtcggtagcagcggccgccgcagcggctccgcactggcgaaccgagggcagaaaaaggcggggttgacggctttttggtaggagtgggctggaccggacgccagagacaaaggctcccaaggcaagagggactgtggccctgcgtcggctctgctcggaactgctgaccccaggaatttacgccccttcgtttttctcttctgattcttctcttctcccaagcccgcgtcccctcacgcgtggcctctctccttgccgggagggccgcgatggaggtcccgcccaggctttcccatgtgccgccgccattgttcccctccgctcccgctactttagcctcccgcagcctctcccattggcggccgcggccgccgcggcagctagccccgctcctcccttcgctcgctcccagctccgcccggcagggggcgcgccgggcccagcgccacgtcaccgcccagcagccctcccgattggcgggcggggcggctataaagggagggcgcaggcggcgcccggatctcttccgccgccattttaaatccagctccatacaacgctccgccgccgctgctgccgcgacccggactgcgcgccagcacccccctgccgacagctccgtcactatggaggatatgaacgagtacagcaatatagaggaattcgcagagggatccaagatcaacgcgagcaagaatcagcaggatgacggtaaaatgtttattggaggcttgagctgggatacaagcaaaaaagatctgacagagtacttgtctcgatttggggaagttgtagactgcacaattaaaacagatccagtcactgggagatcaagaggatttggatttgtgcttttcaaagatgctgctagtgttgataaggttttggaactgaaagaacacaaactggatggcaaattgatagatcccaaaagggccaaagctttaaaagggaaagaacctcccaaaaaggtttttgtgggtggattgagcccggatacttctgaagaacaaattaaagaatattttggagcctttggagagattgaaaatattgaacttcccatggatacaaaaacaaatgaaagaagaggattttgttttatcacatatactgatgaagagccagtaaaaaaattgttagaaagcagataccatcaaattggttctgggaagtgtgaaatcaaagttgcacaacccaaagaggtatataggcagcaacagcaacaacaaaaaggtggaagaggtgctgcagctggtggacgaggtggtacgaggggtcgtggccgaggtcagggccaaaactggaaccaaggatttaataactattatgatcaaggatatggaaattacaatagtgcctatggtggtgatcaaaactatagtggctatggcggatatgattatactgggtataactatgggaactatggatatggacagggatatgcagactacagtggccaacagagcacttatggcaaggcatctcgagggggtggcaatcaccaaaacaattaccagccatactaaaggagaacattggagaaaacagcgggaacttcattgcaggccgtgtgtcaccctgaccacgtctatctctgggggtcgcacgttgcgggcagagcgcaaggcatacaccagaaaacgctgtcctgtggaggagatgttaaagtaacccatcttgcaggacgacattgaagattggtcttctgttgatctaagatgattattttgtaaaagactttctagtgtacaagacaccattgtgtccaactgtatatagctgccaattagttttctttgtttttactttgtcctttgctatctgtgttatgactcaatgtggatttgtttatacacattttatttgtatcatttcatgttaaacctcaaataaatgcttccttatgtgat

SEQ ID NO: 418632 - DNA, 733 bp, Homo sapiens
tctatattgctgtactcgttcatatcctgcatagtgacggagctgtcggcaggggggtgctggcgcgcagtccgggtcgaggcagcagcggcggcggagcgttgtatggagtaaaatgtttattggaggcttgagctgggatacaagcaaaaaagatctgacagagtacttgtctcgatttggggaagttgtagactgcacaattaaaacagatccagtcactgggagatcaagaggatttggatttgtgcttttcaaagatgctgctagtgttgataaggttttggaactgaaagaacacaaactggatggcaaattgatagatcccaaaagggccaaagctttaaaagggaaagaacctcccaaaaaggtttttgtgggtggattgagcccggatacttctgaagaacaaattaaagaatattttggagcctttggagagattgaaaatattgaacttcccatggatacaaaaacaaatgaaagaagaggattttgttttatcacatatactgatgaagagccagtaaaaaaattgttagaaagcagataccatcaaattggttctgggaagtgtgaaatcaaagttgcacaacccaaagaggtatataggcagcaacagcaacaacaaaaaggtggaagaggtgctgcagctggtggacgaggtggtacgaggggtcgtggccgagcagggccaaaactggacgcgaattcgcgcttattttaatatctc

SEQ ID NO: 418633 - DNA, 3870 bp, Homo sapiens
tggagctcaaggatccttaattaaattaatcccccccctacaacgctccgccgccgctgctgccgcgacccggactgcgcgccagcacccccctgccgacagctccgtcactatggaggatatgaacgagtacagcaatatagaggaattcgcagagggatccaagatcaacgcgagcaagaatcagcaggatgacggtaaaatgtttattggaggcttgagctgggatacaagcaaaaaagatctgacagagtacttgtctcgatttggggaagttgtagactgcacaattaaaacagatccagtcactgggagatcaagaggatttggatttgtgcttttcaaagatgctgctagtgttgataaggttttggaactgaaagaacacaaactggatggcaaattgatagatcccaaaagggccaaagctttaaaagggaaagaacctcccaaaaaggtttttgtgggtggattgagcccggatacttctgaagaacaaattaaagaatattttggagcctttggagagattgaaaatattgaacttcccatggatacaaaaacaaatgaaagaagaggattttgttttatcacatatactgatgaagagccagtaaaaaaattgttagaaagcagataccatcaaattggttctgggaagtgtgaaatcaaagttgcacaacccaaagaggtatataggcagcaacagcaacaacaaaaaggtggaagaggtgctgcagctggtggacgaggtggtacgaggggtcgtggccgaggtcagggccaaaactggaaccaaggatttaataactattatgatcaaggatatggaaattacaatagtgcctatggtggtgatcaaaactatagtggctatggcggatatgattatactgggtataactatgggaactatggatatggacagggatatgcagactacagtggccaacagagcacttatggcaaggcatctcgagggggtggcaatcaccaaaacaattaccagccatactaaaggagaacattggagaaaacaggtgtgtataagagtacaggaaaacagtagaaatgtctaatttaatttaaagatcaatagacaaatgaaacgtaaaaacaaaatactatgtagcctgtttttactaaattgttgattttttaattgctttatgagcctgttttgcctaaagtgtctatagatctttaactttaaagtcttatctcactttctttagtattgcagaaaaacttaagagtttttctgtttgcttttgtgtaccaggtggtctagaggaataattaaacattttagaactattaacaggtaaagtactgaaatgggtacaacttaaggaaaacaagaatgttgtcttctaactctgacattataccttgtttgtacccgccagcgggaacttcattgcaggccgtgtgtcaccctgaccacgtctatctctgggggtcgcacgttgcgggcagagcgcaaggcatacaccagaaaacgctgtcctgtggtatggtctcttccaacttcatgtaccagcgtaaagattaaagtggaaaacttcagactttggcttcatttttaatctttttggagattaagtgtctaaacttaacttaaatggttttttacaggagttaaagtacataaatgcctttttacagcttaatcattttggtcttctgtttagtgttgtatttcaattgtggagcctcattttaagtgttcattcttttaagatttaatgcttgctttttctttttatagctaatagtgaaatctacaaaccaaaacaagaacttttaaatctgggatataaattaaagatcatatgcacagatcaatttatgttcttgtaataaacttattagaaattggtgtttgtgatagcattttacttgggttactagagatgcttctagtagaccttaatctagcatagttgaacctctgaatatgggaaggttgtattcccagattctttcctgaatagatttgaatttaatgtcatttgggaactccagggtgagtttattgactacccaaactgtattttaccaataaatatgcatatgatctttaattattgaagaaaataaagtgaggacttaaaacaattcatgaaagtggacctttaaaagcttgtcagagttgcacaaatctaactggtattttgtttttgtttttaggaggagatgttaaagtaacccatcttgcaggacgacattgaagattggtcttctgttgatctaagatgattattttgtaaaagactttctagtgtacaagacaccattgtgtccaactgtatatagctgccaattagttttctttgtttttactttgtcctttgctatctgtgttatgactcaatgtggatttgtttatacacattttatttgtatcatttcatgttaaacctcaaataaatgcttccttatgtgattgcttttctgcgtcaggtactacatagctctgtaaaaaatgtaatttaaaataagcaataattaaggcacagttgattttgtagagtattggtccatacagagaaactgtggtcctttataaatagccagccagcgtcaccctcttctccaatttgtaggtgtattttatgctcttaaggcttcatcttctccctgtaactgagatttctaccacacctttgaacaatgttctttcccttctggttatctgaagactgtcctgaaaggaagacataagtgttgtgattagtagaagctttctagtagaccatatttcttctggattgtaataaaattgttagtagctccttttactttgttcctgtctctggaaagccatttttgaattgctgattactttggctttaatcagtggtcacctagaaaaagctttgtaatcataacacaatgagtaattcttgataaaagttcagatacaaaaggagcactgtaaaactggtaggagctatggtttaagagcattggaagtagttacaactcaaggattttggtagaaaggtatgagtttggtcgaaaaattaaaatagtggcaaaataagatttagttgtgttttctcagagccgccacaagattgaacaaaatgttttctgtttgggcatcctgaggaagttgtattagctgttaatgctctgtgagtttagaaaaagtcttgatagtaaatctagtttttgacacagtgcatgaactaagtagttaaatatttacatattcagaaaggaatagtggaaaaggtatcttggttatgacaaagtcattacaaatgtgactaagtcattacaaatgtgactgagtcattacagtggaccctctgggtgcattgaaaagaatccgttttatatccaggtttcagaggacctggaataataaaaagctttggattttgcattcagtgtagttggattttgggaccttggcctcagtgttatttactgggattggcatacgtgttcacaggcagagtagttgatctcacacaacgggtgatctcacaaaactggtaagtttcttatgctcatgagccctccctttttttttttaatttggtgcctgcaactttcttaacaatgattctacttcctgggctatcacattataatgctcttggcctcttttttgctgctgttttgctattcttaaacttaggccaagtaccaatgttggctgttagaagggattctgttcattcaacatgcaactttagggaatggaagtaagttcatttttaagttgtgttgtcagtaggtgcggtgtctagggtagtgaatcctgtaagttcaaatttatgattaggtgacgagttgacattgagattgtccttttccctgatcaaaaaatgaataaagcctttttaaacaaaa

SEQ ID NO: 418634 - DNA, 2568 bp, Homo sapiens
ggccgggtgttaatcggccgaggtacaacgctccgccgccgctgctgccgcgacccggactgcgcgccagcacccccctgccgacagctccgtcactatggaggatatgaacgagtacagcaatatagaggaattcgcagagggatccaagatcaacgcgagcaagaatcagcaggatgacggtaaaatgtttattggaggcttgagctgggatacaagcaaaaaagatctgacagagtacttgtctcgatttggggaagttgtagactgcacaattaaaacagatccagtcactgggagatcaagaggatttggatttgtgcttttcaaagatgctgctagtgttgataaggttttggaactgaaagaacacaaactggatggcaaattgatagatcccaaaagggccaaagctttaaaagggaaagaacctcccaaaaaggtttttgtgggtggattgagcccggatacttctgaagaacaaattaaagaatattttggagcctttggagagattgaaaatattgaacttcccatggatacaaaaacaaatgaaagaagaggattttgttttatcacatatactgatgaagagccagtaaaaaaattgttagaaagcagataccatcaaattggttctgggaagtgtgaaatcaaagttgcacaacccaaagaggtatataggcagcaacagcaacaacaaaaaggtggaagaggtgctgcagctggtggacgaggtggtacgaggggtcgtggccgaggtcagggccaaaactggaaccaaggatttaataactattatgatcaaggatatggaaattacaatagtgcctatggtggtgatcaaaactatagtggctatggcggatatgattatactgggtataactatgggaactatggatatggacagggatatgcagactacagtggccaacagagcacttatggcaaggcatctcgagggggtggcaatcaccaaaacaattaccagccatactaaaggagaacattggagaaaacaggaggagatgttaaagtaacccatcttgcaggacgacattgaagattggtcttctgttgatctaagatgattattttgtaaaagactttctagtgtacaagacaccattgtgtccaactgtatatagctgccaattagttttctttgtttttactttgtcctttgctatctgtgttatgactcaatgtggatttgtttatacacattttatttgtatcatttcatgttaaacctcaaataaatgcttccttatgtgattgcttttctgcgtcaggtactacatagctctgtaaaaaatgtaatttaaaataagcaataattaaggcacagttgattttgtagagtattggtccatacagagaaactgtggtcctttataaatagccagccagcgtcaccctcttctccaatttgtaggtgtattttatgctcttaaggcttcatcttctccctgtaactgagatttctaccacacctttgaacaatgttctttcccttctggttatctgaagactgtcctgaaaggaagacataagtgttgtgattagtagaagctttgtaatcataacacaatgagtaattcttgataaaagttcagatacaaaaggagcactgtaaaactggtaggagctatggtttaagagcattggaagtagttacaactcaaggattttggtagaaaggtatgagtttggtcgaaaaattaaaatagtggcaaaataagatttagttgtgttttctcagagccgccacaagattgaacaaaatgttttctgtttgggcatcctgaggaagttgtattagctgttaatgctctgtgagtttagaaaaagtcttgatagtaaatctagtttttgacacagtgcatgaactaagtagttaaatatttacatattcagaaaggaatagtggaaaaggtatcttggttatgacaaagtcattacaaatgtgactaagtcattacaaatgtgactgagtcattacagtggaccctctgggtgcattgaaaagaatccgttttatatccaggtttcagaggacctggaataataaaaagctttggattttgcattcagtgtagttggattttgggaccttggcctcagtgttatttactgggattggcatacgtgttcacaggcagagtagttgatctcacacaacgggtgatctcacaaaactggtaagtttcttatgctcatgagccctccctttttttttttaatttggtgcctgcaactttcttaacaatgattctacttcctgggctatcacattataatgctcttggcctcttttttgctgctgttttgctattcttaaacttaggccaagtaccaatgttggctgttagaagggattctgttcattcaacatgcaactttagggaatggaagtaagttcatttttaagttgtgttgtcagtaggtgcggtgtctagggtagtgaatcctgtaagttcaaatttatgattaggtgacgagttgacattgagattgtccttttccctgatcaaaaaatgaataaagcctttttaaacaaaa

SEQ ID NO: 418635 - DNA, 2702 bp, Homo sapiens
ggccgggtgttaatcggccgaggtacaacgctccgccgccgctgctgccgcgacccggactgcgcgccagcacccccctgccgacagctccgtcactatggaggatatgaacgagtacagcaatatagaggaattcgcagagggatccaagatcaacgcgagcaagaatcagcaggatgacggtaaaatgtttattggaggcttgagctgggatacaagcaaaaaagatctgacagagtacttgtctcgatttggggaagttgtagactgcacaattaaaacagatccagtcactgggagatcaagaggatttggatttgtgcttttcaaagatgctgctagtgttgataaggttttggaactgaaagaacacaaactggatggcaaattgatagatcccaaaagggccaaagctttaaaagggaaagaacctcccaaaaaggtttttgtgggtggattgagcccggatacttctgaagaacaaattaaagaatattttggagcctttggagagattgaaaatattgaacttcccatggatacaaaaacaaatgaaagaagaggattttgttttatcacatatactgatgaagagccagtaaaaaaattgttagaaagcagataccatcaaattggttctgggaagtgtgaaatcaaagttgcacaacccaaagaggtatataggcagcaacagcaacaacaaaaaggtggaagaggtgctgcagctggtggacgaggtggtacgaggggtcgtggccgaggtcagggccaaaactggaaccaaggatttaataactattatgatcaaggatatggaaattacaatagtgcctatggtggtgatcaaaactatagtggctatggcggatatgattatactgggtataactatgggaactatggatatggacagggatatgcagactacagtggccaacagagcacttatggcaaggcatctcgagggggtggcaatcaccaaaacaattaccagccatactaaaggagaacattggagaaaacaggaggagatgttaaagtaacccatcttgcaggacgacattgaagattggtcttctgttgatctaagatgattattttgtaaaagactttctagtgtacaagacaccattgtgtccaactgtatatagctgccaattagttttctttgtttttactttgtcctttgctatctgtgttatgactcaatgtggatttgtttatacacattttatttgtatcatttcatgttaaacctcaaataaatgcttccttatgtgattgcttttctgcgtcaggtactacatagctctgtaaaaaatgtaatttaaaataagcaataattaaggcacagttgattttgtagagtattggtccatacagagaaactgtggtcctttataaatagccagccagcgtcaccctcttctccaatttgtaggtgtattttatgctcttaaggcttcatcttctccctgtaactgagatttctaccacacctttgaacaatgttctttcccttctggttatctgaagactgtcctgaaaggaagacataagtgttgtgattagtagaagctttctagtagaccatatttcttctggattgtaataaaattgttagtagctccttttactttgttcctgtctctggaaagccatttttgaattgctgattactttggctttaatcagtggtcacctagaaaaagctttgtaatcataacacaatgagtaattcttgataaaagttcagatacaaaaggagcactgtaaaactggtaggagctatggtttaagagcattggaagtagttacaactcaaggattttggtagaaaggtatgagtttggtcgaaaaattaaaatagtggcaaaataagatttagttgtgttttctcagagccgccacaagattgaacaaaatgttttctgtttgggcatcctgaggaagttgtattagctgttaatgctctgtgagtttagaaaaagtcttgatagtaaatctagtttttgacacagtgcatgaactaagtagttaaatatttacatattcagaaaggaatagtggaaaaggtatcttggttatgacaaagtcattacaaatgtgactaagtcattacaaatgtgactgagtcattacagtggaccctctgggtgcattgaaaagaatccgttttatatccaggtttcagaggacctggaataataaaaagctttggattttgcattcagtgtagttggattttgggaccttggcctcagtgttatttactgggattggcatacgtgttcacaggcagagtagttgatctcacacaacgggtgatctcacaaaactggtaagtttcttatgctcatgagccctccctttttttttttaatttggtgcctgcaactttcttaacaatgattctacttcctgggctatcacattataatgctcttggcctcttttttgctgctgttttgctattcttaaacttaggccaagtaccaatgttggctgttagaagggattctgttcattcaacatgcaactttagggaatggaagtaagttcatttttaagttgtgttgtcagtaggtgcggtgtctagggtagtgaatcctgtaagttcaaatttatgattaggtgacgagttgacattgagattgtccttttccctgatcaaaaaatgaataaagcctttttaaacaaaa

SEQ ID NO: 418636 - DNA, 4475 bp, Homo sapiens
ggccgggtgttaatcggccgaggtacaacgctccgccgccgctgctgccgcgacccggactgcgcgccagcacccccctgccgacagctccgtcactatggaggatatgaacgagtacagcaatatagaggaattcgcagagggatccaagatcaacgcgagcaagaatcagcaggatgacggtaaaatgtttattggaggcttgagctgggatacaagcaaaaaagatctgacagagtacttgtctcgatttggggaagttgtagactgcacaattaaaacagatccagtcactgggagatcaagaggatttggatttgtgcttttcaaagatgctgctagtgttgataaggttttggaactgaaagaacacaaactggatggcaaattgatagatcccaaaagggccaaagctttaaaagggaaagaacctcccaaaaaggtttttgtgggtggattgagcccggatacttctgaagaacaaattaaagaatattttggagcctttggagagattgaaaatattgaacttcccatggatacaaaaacaaatgaaagaagaggattttgttttatcacatatactgatgaagagccagtaaaaaaattgttagaaagcagataccatcaaattggttctgggaagtgtgaaatcaaagttgcacaacccaaagaggtatataggcagcaacagcaacaacaaaaaggtggaagaggtgctgcagctggtggacgaggtggtacgaggggtcgtggccgaggtcagggccaaaactggaaccaaggatttaataactattatgatcaaggatatggaaattacaatagtgcctatggtggtgatcaaaactatagtggctatggcggatatgattatactgggtataactatgggaactatggatatggacagggatatgcagactacagtggccaacagagcacttatggcaaggcatctcgagggggtggcaatcaccaaaacaattaccagccatactaaaggagaacattggagaaaacaggtgtgtataagagtacaggaaaacagtagaaatgtctaatttaatttaaagatcaatagacaaatgaaacgtaaaaacaaaatactatgtagcctgtttttactaaattgttgattttttaattgctttatgagcctgttttgcctaaagtgtctatagatctttaactttaaagtcttatctcactttctttagtattgcagaaaaacttaagagtttttctgtttgcttttgtgtaccaggtggtctagaggaataattaaacattttagaactattaacaggtaaagtactgaaatgggtacaacttaaggaaaacaagaatgttgtcttctaactctgacattataccttgtttgtacccgccagcgggaacttcattgcaggccgtgtgtcaccctgaccacgtctatctctgggggtcgcacgttgcgggcagagcgcaaggcatacaccagaaaacgctgtcctgtggtatggtctcttccaacttcatgtaccagcgtaaagattaaagtggaaaacttcagactttggcttcatttttaatctttttggagattaagtgtctaaacttaacttaaatggttttttacaggagttaaagtacataaatgcctttttacagcttaatcattttggtcttctgtttagtgttgtatttcaattgtggagcctcattttaagtgttcattcttttaagatttaatgcttgctttttctttttatagctaatagtgaaatctacaaaccaaaacaagaacttttaaatctgggatataaattaaagatcatatgcacagatcaatttatgttcttgtaataaacttattagaaattggtgtttgtgatagcattttacttgggttactagagatgcttctagtagaccttaatctagcatagttgaacctctgaatatgggaaggttgtattcccagattctttcctgaatagatttgaatttaatgtcatttgggaactccagggtgagtttattgactacccaaactgtattttaccaataaatatgcatatgatctttaattattgaagaaaataaagtgaggacttaaaacaattcatgaaagtggacctttaaaagcttgtcagagttgcacaaatctaactggtattttgtttttgtttttaggaggagatgttaaagtaacccatcttgcaggacgacattgaagattggtcttctgttgatctaagatgattattttgtaaaagactttctagtgtacaagacaccattgtgtccaactgtatatagctgccaattagttttctttgtttttactttgtcctttgctatctgtgttatgactcaatgtggatttgtttatacacattttatttgtatcatttcatgttaaacctcaaataaatgcttccttatgtgattgcttttctgcgtcaggtactacatagctctgtaaaaaatgtaatttaaaataagcaataattaaggcacagttgattttgtagagtattggtccatacagagaaactgtggtcctttataaatagccagccagcgtcaccctcttctccaatttgtaggtgtattttatgctcttaaggcttcatcttctccctgtaactgagatttctaccacacctttgaacaatgttctttcccttctggttatctgaagactgtcctgaaaggaagacataagtgttgtgattagtagaagctttctagtagaccatatttcttctggattgtaataaaattgttagtagctccttttactttgttcctgtctctggaaagccatttttgaattgctgattactttggctttaatcagtggtcacctagaaaaagctttgtaatcataacacaatgagtaattcttgataaaagttcagatacaaaaggagcactgtaaaactggtaggagctatggtttaagagcattggaagtagttacaactcaaggattttggtagaaaggtatgagtttggtcgaaaaattaaaatagtggcaaaataagatttagttgtgttttctcagagccgccacaagattgaacaaaatgttttctgtttgggcatcctgaggaagttgtattagctgttaatgctctgtgagtttagaaaaagtcttgatagtaaatctagtttttgacacagtgcatgaactaagtagttaaatatttacatattcagaaaggaatagtggaaaaggtatcttggttatgacaaagtcattacaaatgtgactaagtcattacaaatgtgactgagtcattacagtggaccctctgggtgcattgaaaagaatccgttttatatccaggtttcagaggacctggaataataaaaagctttggattttgcattcagtgtagttggattttgggaccttggcctcagtgttatttactgggattggcatacgtgttcacaggcagagtagttgatctcacacaacgggtgatctcacaaaactggtaagtttcttatgctcatgagccctccctttttttttttaatttggtgcctgcaactttcttaacaatgattctacttcctgggctatcacattataatgctcttggcctcttttttgctgctgttttgctattcttaaacttaggccaagtaccaatgttggctgttagaagggattctgttcattcaacatgcaactttagggaatggaagtaagttcatttttaagttgtgttgtcagtaggtgcggtgtctagggtagtgaatcctgtaagttcaaatttatgattaggtgacgagttgacattgagattgtccttttccctgatcaaaaaatgaataaagcctttttaaacaaaatccaaacttttaatcaagtcttgatatgtatgactgagaaaaaatacactacatctagagatgattgagatgttttgcaaagaattgaagggggagtgagaattggtttttcttgcaggggctttgaactctagatttaattcagatttcagggtctatcagttcaccaactgatgcaaatttgaacagatactctaaggctaagtgtcctaggttggatgaactgaagctactatcaagatctcgttcccaaggattaatttagaacaaagtaattggacaagtttattggggaggggatagaaatgaattctaaagtacctataacaaatactctgtgtatgttttttacatcgtatttgccttttacattgtttagaccaaattctgtgtgatgttatcctcgggaagaggatagaaattaattctaaagtacctataacaaatgctcggtttgtatatgtttttatacatcgtatttgccttttgcattgttcagaccaaattctgtgtgatgttatcctaacaaaacaccttagtaatttctttggttaacatgttaatctgtaatctcacttttataagatgaggactattaaaatgagatgtctgttgggatg

SEQ ID NO: 418637 - DNA, 3486 bp, Homo sapiens
ggccgggtgttaatcggccgaggtacaacgctccgccgccgctgctgccgcgacccggactgcgcgccagcacccccctgccgacagctccgtcactatggaggatatgaacgagtacagcaatatagaggaattcgcagagggatccaagatcaacgcgagcaagaatcagcaggatgacggtaaaatgtttattggaggcttgagctgggatacaagcaaaaaagatctgacagagtacttgtctcgatttggggaagttgtagactgcacaattaaaacagatccagtcactgggagatcaagaggatttggatttgtgcttttcaaagatgctgctagtgttgataaggttttggaactgaaagaacacaaactggatggcaaattgatagatcccaaaagggccaaagctttaaaagggaaagaacctcccaaaaaggtttttgtgggtggattgagcccggatacttctgaagaacaaattaaagaatattttggagcctttggagagattgaaaatattgaacttcccatggatacaaaaacaaatgaaagaagaggattttgttttatcacatatactgatgaagagccagtaaaaaaattgttagaaagcagataccatcaaattggttctgggaagtgtgaaatcaaagttgcacaacccaaagaggtatataggcagcaacagcaacaacaaaaaggtggaagaggtgctgcagctggtggacgaggtggtacgaggggtcgtggccgaggtcagggccaaaactggaaccaaggatttaataactattatgatcaaggatatggaaattacaatagtgcctatggtggtgatcaaaactatagtggctatggcggatatgattatactgggtataactatgggaactatggatatggacagggatatgcagactacagtggccaacagagcacttatggcaaggcatctcgagggggtggcaatcaccaaaacaattaccagccatactaaaggagaacattggagaaaacagcgggaacttcattgcaggccgtgtgtcaccctgaccacgtctatctctgggggtcgcacgttgcgggcagagcgcaaggcatacaccagaaaacgctgtcctgtggtatggtctcttccaacttcatgtaccagcgtaaagattaaagtggaaaacttcagactttggcttcatttttaatctttttggagattaagtgtctaaacttaacttaaatggttttttacaggagttaaagtacataaatgcctttttacagcttaatcattttggtcttctgtttagtgttgtatttcaattgtggagcctcattttaagtgttcattcttttaagatttaatgcttgctttttctttttatagctaatagtgaaatctacaaaccaaaacaagaacttttaaatctgggatataaattaaagatcatatgcacagatcaatttatgttcttgtaataaacttattagaaattggtgtttgtgatagcattttacttgggttactagagatgcttctagtagaccttaatctagcatagttgaacctctgaatatgggaaggttgtattcccagattctttcctgaatagatttgaatttaatgtcatttgggaactccagggtgagtttattgactacccaaactgtattttaccaataaatatgcatatgatctttaattattgaagaaaataaagtgaggacttaaaacaattcatgaaagtggacctttaaaagcttgtcagagttgcacaaatctaactggtattttgtttttgtttttaggaggagatgttaaagtaacccatcttgcaggacgacattgaagattggtcttctgttgatctaagatgattattttgtaaaagactttctagtgtacaagacaccattgtgtccaactgtatatagctgccaattagttttctttgtttttactttgtcctttgctatctgtgttatgactcaatgtggatttgtttatacacattttatttgtatcatttcatgttaaacctcaaataaatgcttccttatgtgattgcttttctgcgtcaggtactacatagctctgtaaaaaatgtaatttaaaataagcaataattaaggcacagttgattttgtagagtattggtccatacagagaaactgtggtcctttataaatagccagccagcgtcaccctcttctccaatttgtaggtgtattttatgctcttaaggcttcatcttctccctgtaactgagatttctaccacacctttgaacaatgttctttcccttctggttatctgaagactgtcctgaaaggaagacataagtgttgtgattagtagaagctttctagtagaccatatttcttctggattgtaataaaattgttagtagctccttttactttgttcctgtctctggaaagccatttttgaattgctgattactttggctttaatcagtggtcacctagaaaaagctttgtaatcataacacaatgagtaattcttgataaaagttcagatacaaaaggagcactgtaaaactggtaggagctatggtttaagagcattggaagtagttacaactcaaggattttggtagaaaggtatgagtttggtcgaaaaattaaaatagtggcaaaataagatttagttgtgttttctcagagccgccacaagattgaacaaaatgttttctgtttgggcatcctgaggaagttgtattagctgttaatgctctgtgagtttagaaaaagtcttgatagtaaatctagtttttgacacagtgcatgaactaagtagttaaatatttacatattcagaaaggaatagtggaaaaggtatcttggttatgacaaagtcattacaaatgtgactaagtcattacaaatgtgactgagtcattacagtggaccctctgggtgcattgaaaagaatccgttttatatccaggtttcagaggacctggaataataaaaagctttggattttgcattcagtgtagttggattttgggaccttggcctcagtgttatttactgggattggcatacgtgttcacaggcagagtagttgatctcacacaacgggtgatctcacaaaactggtaagtttcttatgctcatgagccctccctttttttttttaatttggtgcctgcaactttcttaacaatgattctacttcctgggctatcacattataatgctcttggcctcttttttgctgctgttttgctattcttaaacttaggccaagtaccaatgttggctgttagaagggattctgttcattcaacatgcaactttagggaatggaagtaagttcatttttaagttgtgttgtcagtaggtgcggtgtctagggtagtgaatcctgtaagttcaaatttatgattaggtgacgagttgacattgagattgtccttttccctgatcaaaaaatgaataaagcctttttaaacaaaa

SEQ ID NO: 418638 - DNA, 3176 bp, Homo sapiens
ggccgggtgttaatcggccgaggtacaacgctccgccgccgctgctgccgcgacccggactgcgcgccagcacccccctgccgacagctccgtcactatggaggatatgaacgagtacagcaatatagaggaattcgcagagggatccaagatcaacgcgagcaagaatcagcaggatgacggtaaaatgtttattggaggcttgagctgggatacaagcaaaaaagatctgacagagtacttgtctcgatttggggaagttgtagactgcacaattaaaacagatccagtcactgggagatcaagaggatttggatttgtgcttttcaaagatgctgctagtgttgataaggttttggaactgaaagaacacaaactggatggcaaattgatagatcccaaaagggccaaagctttaaaagggaaagaacctcccaaaaaggtttttgtgggtggattgagcccggatacttctgaagaacaaattaaagaatattttggagcctttggagagattgaaaatattgaacttcccatggatacaaaaacaaatgaaagaagaggattttgttttatcacatatactgatgaagagccagtaaaaaaattgttagaaagcagataccatcaaattggttctgggaagtgtgaaatcaaagttgcacaacccaaagaggtatataggcagcaacagcaacaacaaaaaggtggaagaggtgctgcagctggtggacgaggtggtacgaggggtcgtggccgaggtcagggccaaaactggaaccaaggatttaataactattatgatcaaggatatggaaattacaatagtgcctatggtggtgatcaaaactatagtggctatggcggatatgattatactgggtataactatgggaactatggatatggacagggatatgcagactacagtggccaacagagcacttatggcaaggcatctcgagggggtggcaatcaccaaaacaattaccagccatactaaaggagaacattggagaaaacaggtgtgtataagagtacaggaaaacagtagaaatgtctaatttaatttaaagatcaatagacaaatgaaacgtaaaaacaaaatactatgtagcctgtttttactaaattgttgattttttaattgctttatgagcctgttttgcctaaagtgtctatagatctttaactttaaagtcttatctcactttctttagtattgcagaaaaacttaagagtttttctgtttgcttttgtgtaccaggtggtctagaggaataattaaacattttagaactattaacaggtaaagtactgaaatgggtacaacttaaggaaaacaagaatgttgtcttctaactctgacattataccttgtttgtacccgccagcgggaacttcattgcaggccgtgtgtcaccctgaccacgtctatctctgggggtcgcacgttgcgggcagagcgcaaggcatacaccagaaaacgctgtcctgtggaggagatgttaaagtaacccatcttgcaggacgacattgaagattggtcttctgttgatctaagatgattattttgtaaaagactttctagtgtacaagacaccattgtgtccaactgtatatagctgccaattagttttctttgtttttactttgtcctttgctatctgtgttatgactcaatgtggatttgtttatacacattttatttgtatcatttcatgttaaacctcaaataaatgcttccttatgtgattgcttttctgcgtcaggtactacatagctctgtaaaaaatgtaatttaaaataagcaataattaaggcacagttgattttgtagagtattggtccatacagagaaactgtggtcctttataaatagccagccagcgtcaccctcttctccaatttgtaggtgtattttatgctcttaaggcttcatcttctccctgtaactgagatttctaccacacctttgaacaatgttctttcccttctggttatctgaagactgtcctgaaaggaagacataagtgttgtgattagtagaagctttctagtagaccatatttcttctggattgtaataaaattgttagtagctccttttactttgttcctgtctctggaaagccatttttgaattgctgattactttggctttaatcagtggtcacctagaaaaagctttgtaatcataacacaatgagtaattcttgataaaagttcagatacaaaaggagcactgtaaaactggtaggagctatggtttaagagcattggaagtagttacaactcaaggattttggtagaaaggtatgagtttggtcgaaaaattaaaatagtggcaaaataagatttagttgtgttttctcagagccgccacaagattgaacaaaatgttttctgtttgggcatcctgaggaagttgtattagctgttaatgctctgtgagtttagaaaaagtcttgatagtaaatctagtttttgacacagtgcatgaactaagtagttaaatatttacatattcagaaaggaatagtggaaaaggtatcttggttatgacaaagtcattacaaatgtgactaagtcattacaaatgtgactgagtcattacagtggaccctctgggtgcattgaaaagaatccgttttatatccaggtttcagaggacctggaataataaaaagctttggattttgcattcagtgtagttggattttgggaccttggcctcagtgttatttactgggattggcatacgtgttcacaggcagagtagttgatctcacacaacgggtgatctcacaaaactggtaagtttcttatgctcatgagccctccctttttttttttaatttggtgcctgcaactttcttaacaatgattctacttcctgggctatcacattataatgctcttggcctcttttttgctgctgttttgctattcttaaacttaggccaagtaccaatgttggctgttagaagggattctgttcattcaacatgcaactttagggaatggaagtaagttcatttttaagttgtgttgtcagtaggtgcggtgtctagggtagtgaatcctgtaagttcaaatttatgattaggtgacgagttgacattgagattgtccttttccctgatcaaaaaatgaataaagcctttttaaacaaaa

SEQ ID NO: 418639 - DNA, 4411 bp, Homo sapiens
ggccgggtgttaatcggccgaggtacaacgctccgccgccgctgctgccgcgacccggactgcgcgccagcacccccctgccgacagctccgtcactatggaggatatgaacgagtacagcaatatagaggaattcgcagagggatccaagatcaacgcgagcaagaatcagcaggatgacggtaaaatgtttattggaggcttgagctgggatacaagcaaaaaagatctgacagagtacttgtctcgatttggggaagttgtagactgcacaattaaaacagatccagtcactgggagatcaagaggatttggatttgtgcttttcaaagatgctgctagtgttgataaggttttggaactgaaagaacacaaactggatggcaaattgatagatcccaaaagggccaaagctttaaaagggaaagaacctcccaaaaaggtttttgtgggtggattgagcccggatacttctgaagaacaaattaaagaatattttggagcctttggagagattgaaaatattgaacttcccatggatacaaaaacaaatgaaagaagaggattttgttttatcacatatactgatgaagagccagtaaaaaaattgttagaaagcagataccatcaaattggttctgggaagtgtgaaatcaaagttgcacaacccaaagaggtatataggcagcaacagcaacaacaaaaaggtggaagaggtgctgcagctggtggacgaggtggtacgaggggtcgtggccgagaggtgagacttaattcttgaaatatgactccgtggtttatttaagctgtatactgctgaatatgagtagtcctgtaccaaagcaaaactttaaacttaaaaccattccagcggaggggggactgttcagcttagtggaggttgtgtgtggtggttttttgttgtgagctcactggtttcaaaaaactgttaaaagtgtggccactttgacaattagtgtcatcactgataggaaaagtgtaccattacatgatacaccgtggtgtgataggttttcttgggcaggagtccttgttttaaacagaacagtgtacctgtcttcggctttaatggaaaattgaatgattttccattaagtttaggaagtttgatactggcacaattggactttctgcctccttttttataacagctggaaaaatagtttttcaagcagatagcaatatatatgtccattctgccctttaagatttgcagagtgagagacaagaacgcatcattttatgttagaattgggggtcagaagttgtttcctaacaatcattgtgcattgtttcgtcagggccaaaactggaaccaaggatttaataactattatgatcaaggatatggaaattacaatagtgcctatggtggtgatcaaaactatagtggctatggcggatatgattatactgggtataactatgggaactatggatatggacagggatatgcagactacagtggccaacagagcacttatggcaaggcatctcgagggggtggcaatcaccaaaacaattaccagccatactaaaggagaacattggagaaaacaggtgtgtataagagtacaggaaaacagtagaaatgtctaatttaatttaaagatcaatagacaaatgaaacgtaaaaacaaaatactatgtagcctgtttttactaaattgttgattttttaattgctttatgagcctgttttgcctaaagtgtctatagatctttaactttaaagtcttatctcactttctttagtattgcagaaaaacttaagagtttttctgtttgcttttgtgtaccaggtggtctagaggaataattaaacattttagaactattaacaggtaaagtactgaaatgggtacaacttaaggaaaacaagaatgttgtcttctaactctgacattataccttgtttgtacccgccagcgggaacttcattgcaggccgtgtgtcaccctgaccacgtctatctctgggggtcgcacgttgcgggcagagcgcaaggcatacaccagaaaacgctgtcctgtggtatggtctcttccaacttcatgtaccagcgtaaagattaaagtggaaaacttcagactttggcttcatttttaatctttttggagattaagtgtctaaacttaacttaaatggttttttacaggagttaaagtacataaatgcctttttacagcttaatcattttggtcttctgtttagtgttgtatttcaattgtggagcctcattttaagtgttcattcttttaagatttaatgcttgctttttctttttatagctaatagtgaaatctacaaaccaaaacaagaacttttaaatctgggatataaattaaagatcatatgcacagatcaatttatgttcttgtaataaacttattagaaattggtgtttgtgatagcattttacttgggttactagagatgcttctagtagaccttaatctagcatagttgaacctctgaatatgggaaggttgtattcccagattctttcctgaatagatttgaatttaatgtcatttgggaactccagggtgagtttattgactacccaaactgtattttaccaataaatatgcatatgatctttaattattgaagaaaataaagtgaggacttaaaacaattcatgaaagtggacctttaaaagcttgtcagagttgcacaaatctaactggtattttgtttttgtttttaggaggagatgttaaagtaacccatcttgcaggacgacattgaagattggtcttctgttgatctaagatgattattttgtaaaagactttctagtgtacaagacaccattgtgtccaactgtatatagctgccaattagttttctttgtttttactttgtcctttgctatctgtgttatgactcaatgtggatttgtttatacacattttatttgtatcatttcatgttaaacctcaaataaatgcttccttatgtgattgcttttctgcgtcaggtactacatagctctgtaaaaaatgtaatttaaaataagcaataattaaggcacagttgattttgtagagtattggtccatacagagaaactgtggtcctttataaatagccagccagcgtcaccctcttctccaatttgtaggtgtattttatgctcttaaggcttcatcttctccctgtaactgagatttctaccacacctttgaacaatgttctttcccttctggttatctgaagactgtcctgaaaggaagacataagtgttgtgattagtagaagctttctagtagaccatatttcttctggattgtaataaaattgttagtagctccttttactttgttcctgtctctggaaagccatttttgaattgctgattactttggctttaatcagtggtcacctagaaaaagctttgtaatcataacacaatgagtaattcttgataaaagttcagatacaaaaggagcactgtaaaactggtaggagctatggtttaagagcattggaagtagttacaactcaaggattttggtagaaaggtatgagtttggtcgaaaaattaaaatagtggcaaaataagatttagttgtgttttctcagagccgccacaagattgaacaaaatgttttctgtttgggcatcctgaggaagttgtattagctgttaatgctctgtgagtttagaaaaagtcttgatagtaaatctagtttttgacacagtgcatgaactaagtagttaaatatttacatattcagaaaggaatagtggaaaaggtatcttggttatgacaaagtcattacaaatgtgactaagtcattacaaatgtgactgagtcattacagtggaccctctgggtgcattgaaaagaatccgttttatatccaggtttcagaggacctggaataataaaaagctttggattttgcattcagtgtagttggattttgggaccttggcctcagtgttatttactgggattggcatacgtgttcacaggcagagtagttgatctcacacaacgggtgatctcacaaaactggtaagtttcttatgctcatgagccctccctttttttttttaatttggtgcctgcaactttcttaacaatgattctacttcctgggctatcacattataatgctcttggcctcttttttgctgctgttttgctattcttaaacttaggccaagtaccaatgttggctgttagaagggattctgttcattcaacatgcaactttagggaatggaagtaagttcatttttaagttgtgttgtcagtaggtgcggtgtctagggtagtgaatcctgtaagttcaaatttatgattaggtgacgagttgacattgagattgtccttttccctgatcaaaaaatgaataaagcctttttaaacaaaa

SEQ ID NO: 418640 - DNA, 3684 bp, Homo sapiens
ggccgggtgttaatcggccgaggtacaacgctccgccgccgctgctgccgcgacccggactgcgcgccagcacccccctgccgacagctccgtcactatggaggatatgaacgagtacagcaatatagaggaattcgcagagggatccaagatcaacgcgagcaagaatcagcaggatgacggtaaaatgtttattggaggcttgagctgggatacaagcaaaaaagatctgacagagtacttgtctcgatttggggaagttgtagactgcacaattaaaacagatccagtcactgggagatcaagaggatttggatttgtgcttttcaaagatgctgctagtgttgataaggttttggaactgaaagaacacaaactggatggcaaattgatagatcccaaaagggccaaagctttaaaagggaaagaacctcccaaaaaggtttttgtgggtggattgagcccggatacttctgaagaacaaattaaagaatattttggagcctttggagagattgaaaatattgaacttcccatggatacaaaaacaaatgaaagaagaggattttgttttatcacatatactgatgaagagccagtaaaaaaattgttagaaagcagataccatcaaattggttctgggaagtgtgaaatcaaagttgcacaacccaaagaggtatataggcagcaacagcaacaacaaaaaggtggaagaggtgctgcagctggtggacgaggtggtacgaggggtcgtggccgaggccaacagagcacttatggcaaggcatctcgagggggtggcaatcaccaaaacaattaccagccatactaaaggagaacattggagaaaacaggtgtgtataagagtacaggaaaacagtagaaatgtctaatttaatttaaagatcaatagacaaatgaaacgtaaaaacaaaatactatgtagcctgtttttactaaattgttgattttttaattgctttatgagcctgttttgcctaaagtgtctatagatctttaactttaaagtcttatctcactttctttagtattgcagaaaaacttaagagtttttctgtttgcttttgtgtaccaggtggtctagaggaataattaaacattttagaactattaacaggtaaagtactgaaatgggtacaacttaaggaaaacaagaatgttgtcttctaactctgacattataccttgtttgtacccgccagcgggaacttcattgcaggccgtgtgtcaccctgaccacgtctatctctgggggtcgcacgttgcgggcagagcgcaaggcatacaccagaaaacgctgtcctgtggtatggtctcttccaacttcatgtaccagcgtaaagattaaagtggaaaacttcagactttggcttcatttttaatctttttggagattaagtgtctaaacttaacttaaatggttttttacaggagttaaagtacataaatgcctttttacagcttaatcattttggtcttctgtttagtgttgtatttcaattgtggagcctcattttaagtgttcattcttttaagatttaatgcttgctttttctttttatagctaatagtgaaatctacaaaccaaaacaagaacttttaaatctgggatataaattaaagatcatatgcacagatcaatttatgttcttgtaataaacttattagaaattggtgtttgtgatagcattttacttgggttactagagatgcttctagtagaccttaatctagcatagttgaacctctgaatatgggaaggttgtattcccagattctttcctgaatagatttgaatttaatgtcatttgggaactccagggtgagtttattgactacccaaactgtattttaccaataaatatgcatatgatctttaattattgaagaaaataaagtgaggacttaaaacaattcatgaaagtggacctttaaaagcttgtcagagttgcacaaatctaactggtattttgtttttgtttttaggaggagatgttaaagtaacccatcttgcaggacgacattgaagattggtcttctgttgatctaagatgattattttgtaaaagactttctagtgtacaagacaccattgtgtccaactgtatatagctgccaattagttttctttgtttttactttgtcctttgctatctgtgttatgactcaatgtggatttgtttatacacattttatttgtatcatttcatgttaaacctcaaataaatgcttccttatgtgattgcttttctgcgtcaggtactacatagctctgtaaaaaatgtaatttaaaataagcaataattaaggcacagttgattttgtagagtattggtccatacagagaaactgtggtcctttataaatagccagccagcgtcaccctcttctccaatttgtaggtgtattttatgctcttaaggcttcatcttctccctgtaactgagatttctaccacacctttgaacaatgttctttcccttctggttatctgaagactgtcctgaaaggaagacataagtgttgtgattagtagaagctttctagtagaccatatttcttctggattgtaataaaattgttagtagctccttttactttgttcctgtctctggaaagccatttttgaattgctgattactttggctttaatcagtggtcacctagaaaaagctttgtaatcataacacaatgagtaattcttgataaaagttcagatacaaaaggagcactgtaaaactggtaggagctatggtttaagagcattggaagtagttacaactcaaggattttggtagaaaggtatgagtttggtcgaaaaattaaaatagtggcaaaataagatttagttgtgttttctcagagccgccacaagattgaacaaaatgttttctgtttgggcatcctgaggaagttgtattagctgttaatgctctgtgagtttagaaaaagtcttgatagtaaatctagtttttgacacagtgcatgaactaagtagttaaatatttacatattcagaaaggaatagtggaaaaggtatcttggttatgacaaagtcattacaaatgtgactaagtcattacaaatgtgactgagtcattacagtggaccctctgggtgcattgaaaagaatccgttttatatccaggtttcagaggacctggaataataaaaagctttggattttgcattcagtgtagttggattttgggaccttggcctcagtgttatttactgggattggcatacgtgttcacaggcagagtagttgatctcacacaacgggtgatctcacaaaactggtaagtttcttatgctcatgagccctccctttttttttttaatttggtgcctgcaactttcttaacaatgattctacttcctgggctatcacattataatgctcttggcctcttttttgctgctgttttgctattcttaaacttaggccaagtaccaatgttggctgttagaagggattctgttcattcaacatgcaactttagggaatggaagtaagttcatttttaagttgtgttgtcagtaggtgcggtgtctagggtagtgaatcctgtaagttcaaatttatgattaggtgacgagttgacattgagattgtccttttccctgatcaaaaaatgaataaagcctttttaaacaaaa

SEQ ID NO: 418641 - DNA, 2810 bp, Homo sapiens
ggccgggtgttaatcggccgaggtacaacgctccgccgccgctgctgccgcgacccggactgcgcgccagcacccccctgccgacagctccgtcactatggaggatatgaacgagtacagcaatatagaggaattcgcagagggatccaagatcaacgcgagcaagaatcagcaggatgacggtaaaatgtttattggaggcttgagctgggatacaagcaaaaaagatctgacagagtacttgtctcgatttggggaagttgtagactgcacaattaaaacagatccagtcactgggagatcaagaggatttggatttgtgcttttcaaagatgctgctagtgttgataaggttttggaactgaaagaacacaaactggatggcaaattgatagatcccaaaagggccaaagctttaaaagggaaagaacctcccaaaaaggtttttgtgggtggattgagcccggatacttctgaagaacaaattaaagaatattttggagcctttggagagattgaaaatattgaacttcccatggatacaaaaacaaatgaaagaagaggattttgttttatcacatatactgatgaagagccagtaaaaaaattgttagaaagcagataccatcaaattggttctgggaagtgtgaaatcaaagttgcacaacccaaagaggtatataggcagcaacagcaacaacaaaaaggtggaagaggtgctgcagctggtggacgaggtggtacgaggggtcgtggccgaggtcagggccaaaactggaaccaaggatttaataactattatgatcaaggatatggaaattacaatagtgcctatggtggtgatcaaaactatagtggctatggcggatatgattatactgggtataactatgggaactatggatatggacagggatatgcagactacagtggccaacagagcacttatggcaaggcatctcgagggggtggcaatcaccaaaacaattaccagccatactaaaggagaacattggagaaaacaggtgtgtataagagtacaggaaaacagtagaaatgtctaatttaatttaaagatcaatagacaaatgaaacgtaaaaacaaaatactatgtagcctgtttttactaaattgttgattttttaattgctttatgagcctgttttgcctaaagtgtctatagatctttaactttaaagtcttatctcactttctttagtattgcagaaaaacttaagagtttttctgtttgcttttgtgtaccaggtggtctagaggaataattaaacattttagaactattaacaggtaaagtactgaaatgggtacaacttaaggaaaacaagaatgttgtcttctaactctgacattataccttgtttgtacccgccagcgggaacttcattgcaggccgtgtgtcaccctgaccacgtctatctctgggggtcgcacgttgcgggcagagcgcaaggcatacaccagaaaacgctgtcctgtggtatggtctcttccaacttcatgtaccagcgtaaagattaaagtggaaaacttcagactttggcttcatttttaatctttttggagattaagtgtctaaacttaacttaaatggttttttacaggagttaaagtacataaatgcctttttacagcttaatcattttggtcttctgtttagtgttgtatttcaattgtggagcctcattttaagtgttcattcttttaagatttaatgcttgctttttctttttatagctaatagtgaaatctacaaaccaaaacaagaacttttaaatctgggatataaattaaagatcatatgcacagatcaatttatgttcttgtaataaacttattagaaattggtgtttgtgatagcattttacttgggttactagagatgcttctagtagaccttaatctagcatagttgaacctctgaatatgggaaggttgtattcccagattctttcctgaatagatttgaatttaatgtcatttgggaactccagggtgagtttattgactacccaaactgtattttaccaataaatatgcatatgatctttaattattgaagaaaataaagtgaggacttaaaacaattcatgaaagtggacctttaaaagcttgtcagagttgcacaaatctaactggtattttgtttttgtttttaggaggagatgttaaagtaacccatcttgcaggacgacattgaagattggtcttctgttgatctaagatgattattttgtaaaagactttctagtgtacaagacaccattgtgtccaactgtatatagctgccaattagttttctttgtttttactttgtcctttgctatctgtgttatgactcaatgtggatttgtttatacacattttatttgtatcatttcatgttaaacctcaaataaatgcttccttatgtgattgcttttctgcgtcaggtactacatagctctgtaaaaaatgtaatttaaaataagcaataattaaggcacagttgattttgtagagtattggtccatacagagaaactgtggtcctttataaatagccagccagcgtcaccctcttctccaatttgtaggtgtattttatgctcttaaggcttcatcttctccctgtaactgagatttctaccacacctttgaacaatgttctttcccttctggttatctgaagactgtcctgaaaggaagacataagtgttgtgattagtagaagctttctagtagaccatatttcttctggattgtaataaaattgttagtagctccttttaaaaaaaacacaacacaaaaac

SEQ ID NO: 418642 - DNA, 3356 bp, Homo sapiens
atggggactcgggatagtccaggtacttctgcttcacaaactcatcagtgactgagcttcttcacgtcccaccagagtgaatgatgtatcctgagagaagaaaaagaaaaataaataaacaaataaattcacgtcaaggcatatggcacttcccagtatgtgggcagaggcatttccaacgatggaaacagaggtttccatgcacaacgagggaagcgtccatagaagcccaagcagacactgcagagagggcagcagcagagtcagggccaaaactggaaccaaggatttaataactattatgatcaaggatatggaaattacaatagtgcctatggtggtgatcaaaactatagtggctatggcggatatgattatactgggtataactatgggaactatggatatggacagggatatgcagactacagtggccaacagagcacttatggcaaggcatctcgagggggtggcaatcaccaaaacaattaccagccatactaaaggagaacattggagaaaacaggtgtgtataagagtacaggaaaacagtagaaatgtctaatttaatttaaagatcaatagacaaatgaaacgtaaaaacaaaatactatgtagcctgtttttactaaattgttgattttttaattgctttatgagcctgttttgcctaaagtgtctatagatctttaactttaaagtcttatctcactttctttagtattgcagaaaaacttaagagtttttctgtttgcttttgtgtaccaggtggtctagaggaataattaaacattttagaactattaacaggtaaagtactgaaatgggtacaacttaaggaaaacaagaatgttgtcttctaactctgacattataccttgtttgtacccgccagcgggaacttcattgcaggccgtgtgtcaccctgaccacgtctatctctgggggtcgcacgttgcgggcagagcgcaaggcatacaccagaaaacgctgtcctgtggtatggtctcttccaacttcatgtaccagcgtaaagattaaagtggaaaacttcagactttggcttcatttttaatctttttggagattaagtgtctaaacttaacttaaatggttttttacaggagttaaagtacataaatgcctttttacagcttaatcattttggtcttctgtttagtgttgtatttcaattgtggagcctcattttaagtgttcattcttttaagatttaatgcttgctttttctttttatagctaatagtgaaatctacaaaccaaaacaagaacttttaaatctgggatataaattaaagatcatatgcacagatcaatttatgttcttgtaataaacttattagaaattggtgtttgtgatagcattttacttgggttactagagatgcttctagtagaccttaatctagcatagttgaacctctgaatatgggaaggttgtattcccagattctttcctgaatagatttgaatttaatgtcatttgggaactccagggtgagtttattgactacccaaactgtattttaccaataaatatgcatatgatctttaattattgaagaaaataaagtgaggacttaaaacaattcatgaaagtggacctttaaaagcttgtcagagttgcacaaatctaactggtattttgtttttgtttttaggaggagatgttaaagtaacccatcttgcaggacgacattgaagattggtcttctgttgatctaagatgattattttgtaaaagactttctagtgtacaagacaccattgtgtccaactgtatatagctgccaattagttttctttgtttttactttgtcctttgctatctgtgttatgactcaatgtggatttgtttatacacattttatttgtatcatttcatgttaaacctcaaataaatgcttccttatgtgattgcttttctgcgtcaggtactacatagctctgtaaaaaatgtaatttaaaataagcaataattaaggcacagttgattttgtagagtattggtccatacagagaaactgtggtcctttataaatagccagccagcgtcaccctcttctccaatttgtaggtgtattttatgctcttaaggcttcatcttctccctgtaactgagatttctaccacacctttgaacaatgttctttcccttctggttatctgaagactgtcctgaaaggaagacataagtgttgtgattagtagaagctttctagtagaccatatttcttctggattgtaataaaattgttagtagctccttttactttgttcctgtctctggaaagccatttttgaattgctgattactttggctttaatcagtggtcacctagaaaaagctttgtaatcataacacaatgagtaattcttgataaaagttcagatacaaaaggagcactgtaaaactggtaggagctatggtttaagagcattggaagtagttacaactcaaggattttggtagaaaggtatgagtttggtcgaaaaattaaaatagtggcaaaataagatttagttgtgttttctcagagccgccacaagattgaacaaaatgttttctgtttgggcatcctgaggaagttgtattagctgttaatgctctgtgagtttagaaaaagtcttgatagtaaatctagtttttgacacagtgcatgaactaagtagttaaatatttacatattcagaaaggaatagtggaaaaggtatcttggttatgacaaagtcattacaaatgtgactaagtcattacaaatgtgactgagtcattacagtggaccctctgggtgcattgaaaagaatccgttttatatccaggtttcagaggacctggaataataaaaagctttggattttgcattcagtgtagttggattttgggaccttggcctcagtgttatttactgggattggcatacgtgttcacaggcagagtagttgatctcacacaacgggtgatctcacaaaactggtaagtttcttatgctcatgagccctccctttttttttttaatttggtgcctgcaactttcttaacaatgattctacttcctgggctatcacattataatgctcttggcctcttttttgctgctgttttgctattcttaaacttaggccaagtaccaatgttggctgttagaagggattctgttcattcaacatgcaactttagggaatggaagtaagttcatttttaagttgtgttgtcagtaggtgcggtgtctagggtagtgaatcctgtaagttcaaatttatgattaggtgacgagttgacattgagattgtccttttccctgatcaaaaaatgaataaagcctttttaaacaaaa

SEQ ID NO: 418643 - DNA, 2636 bp, Homo sapiens
ggccgggtgttaatcggccgaggtacaacgctccgccgccgctgctgccgcgacccggactgcgcgccagcacccccctgccgacagctccgtcactatggaggatatgaacgagtacagcaatatagaggaattcgcagagggatccaagatcaacgcgagcaagaatcagcaggatgacggtaaaatgtttattggaggcttgagctgggatacaagcaaaaaagatctgacagagtacttgtctcgatttggggaagttgtagactgcacaattaaaacagatccagtcactgggagatcaagaggatttggatttgtgcttttcaaagatgctgctagtgttgataaggttttggaactgaaagaacacaaactggatggcaaattgatagatcccaaaagggccaaagctttaaaagggaaagaacctcccaaaaaggtttttgtgggtggattgagcccggatacttctgaagaacaaattaaagaatattttggagcctttggagagattgaaaatattgaacttcccatggatacaaaaacaaatgaaagaagaggattttgttttatcacatatactgatgaagagccagtaaaaaaattgttagaaagcagataccatcaaattggttctgggaagtgtgaaatcaaagttgcacaacccaaagaggtatataggcagcaacagcaacaacaaaaaggtggaagaggtgctgcagctggtggacgaggtggtacgaggggtcgtggccgaggccaacagagcacttatggcaaggcatctcgagggggtggcaatcaccaaaacaattaccagccatactaaaggagaacattggagaaaacagcgggaacttcattgcaggccgtgtgtcaccctgaccacgtctatctctgggggtcgcacgttgcgggcagagcgcaaggcatacaccagaaaacgctgtcctgtggaggagatgttaaagtaacccatcttgcaggacgacattgaagattggtcttctgttgatctaagatgattattttgtaaaagactttctagtgtacaagacaccattgtgtccaactgtatatagctgccaattagttttctttgtttttactttgtcctttgctatctgtgttatgactcaatgtggatttgtttatacacattttatttgtatcatttcatgttaaacctcaaataaatgcttccttatgtgattgcttttctgcgtcaggtactacatagctctgtaaaaaatgtaatttaaaataagcaataattaaggcacagttgattttgtagagtattggtccatacagagaaactgtggtcctttataaatagccagccagcgtcaccctcttctccaatttgtaggtgtattttatgctcttaaggcttcatcttctccctgtaactgagatttctaccacacctttgaacaatgttctttcccttctggttatctgaagactgtcctgaaaggaagacataagtgttgtgattagtagaagctttctagtagaccatatttcttctggattgtaataaaattgttagtagctccttttactttgttcctgtctctggaaagccatttttgaattgctgattactttggctttaatcagtggtcacctagaaaaagctttgtaatcataacacaatgagtaattcttgataaaagttcagatacaaaaggagcactgtaaaactggtaggagctatggtttaagagcattggaagtagttacaactcaaggattttggtagaaaggtatgagtttggtcgaaaaattaaaatagtggcaaaataagatttagttgtgttttctcagagccgccacaagattgaacaaaatgttttctgtttgggcatcctgaggaagttgtattagctgttaatgctctgtgagtttagaaaaagtcttgatagtaaatctagtttttgacacagtgcatgaactaagtagttaaatatttacatattcagaaaggaatagtggaaaaggtatcttggttatgacaaagtcattacaaatgtgactaagtcattacaaatgtgactgagtcattacagtggaccctctgggtgcattgaaaagaatccgttttatatccaggtttcagaggacctggaataataaaaagctttggattttgcattcagtgtagttggattttgggaccttggcctcagtgttatttactgggattggcatacgtgttcacaggcagagtagttgatctcacacaacgggtgatctcacaaaactggtaagtttcttatgctcatgagccctccctttttttttttaatttggtgcctgcaactttcttaacaatgattctacttcctgggctatcacattataatgctcttggcctcttttttgctgctgttttgctattcttaaacttaggccaagtaccaatgttggctgttagaagggattctgttcattcaacatgcaactttagggaatggaagtaagttcatttttaagttgtgttgtcagtaggtgcggtgtctagggtagtgaatcctgtaagttcaaatttatgattaggtgacgagttgacattgagattgtccttttccctgatcaaaaaatgaataaagcctttttaaacaaaa

SEQ ID NO: 418644 - DNA, 2363 bp, Homo sapiens
ggccgggtgttaatcggccgaggtacaacgctccgccgccgctgctgccgcgacccggactgcgcgccagcacccccctgccgacagctccgtcactatggaggatatgaacgagtacagcaatatagaggaattcgcagagggatccaagatcaacgcgagcaagaatcagcaggatgacggtaaaatgtttattggaggcttgagctgggatacaagcaaaaaagatctgacagagtacttgtctcgatttggggaagttgtagactgcacaattaaaacagatccagtcactgggagatcaagaggatttggatttgtgcttttcaaagatgctgctagtgttgataaggttttggaactgaaagaacacaaactggatggcaaattgatagatcccaaaagggccaaagctttaaaagggaaagaacctcccaaaaaggtttttgtgggtggattgagcccggatacttctgaagaacaaattaaagaatattttggagcctttggagagattgaaaatattgaacttcccatggatacaaaaacaaatgaaagaagaggattttgttttatcacatatactgatgaagagccagtaaaaaaattgttagaaagcagataccatcaaattggttctgggaagagttgcacaaatctaactggtattttgtttttgtttttaggaggagatgttaaagtaacccatcttgcaggacgacattgaagattggtcttctgttgatctaagatgattattttgtaaaagactttctagtgtacaagacaccattgtgtccaactgtatatagctgccaattagttttctttgtttttactttgtcctttgctatctgtgttatgactcaatgtggatttgtttatacacattttatttgtatcatttcatgttaaacctcaaataaatgcttccttatgtgattgcttttctgcgtcaggtactacatagctctgtaaaaaatgtaatttaaaataagcaataattaaggcacagttgattttgtagagtattggtccatacagagaaactgtggtcctttataaatagccagccagcgtcaccctcttctccaatttgtaggtgtattttatgctcttaaggcttcatcttctccctgtaactgagatttctaccacacctttgaacaatgttctttcccttctggttatctgaagactgtcctgaaaggaagacataagtgttgtgattagtagaagctttctagtagaccatatttcttctggattgtaataaaattgttagtagctccttttactttgttcctgtctctggaaagccatttttgaattgctgattactttggctttaatcagtggtcacctagaaaaagctttgtaatcataacacaatgagtaattcttgataaaagttcagatacaaaaggagcactgtaaaactggtaggagctatggtttaagagcattggaagtagttacaactcaaggattttggtagaaaggtatgagtttggtcgaaaaattaaaatagtggcaaaataagatttagttgtgttttctcagagccgccacaagattgaacaaaatgttttctgtttgggcatcctgaggaagttgtattagctgttaatgctctgtgagtttagaaaaagtcttgatagtaaatctagtttttgacacagtgcatgaactaagtagttaaatatttacatattcagaaaggaatagtggaaaaggtatcttggttatgacaaagtcattacaaatgtgactaagtcattacaaatgtgactgagtcattacagtggaccctctgggtgcattgaaaagaatccgttttatatccaggtttcagaggacctggaataataaaaagctttggattttgcattcagtgtagttggattttgggaccttggcctcagtgttatttactgggattggcatacgtgttcacaggcagagtagttgatctcacacaacgggtgatctcacaaaactggtaagtttcttatgctcatgagccctccctttttttttttaatttggtgcctgcaactttcttaacaatgattctacttcctgggctatcacattataatgctcttggcctcttttttgctgctgttttgctattcttaaacttaggccaagtaccaatgttggctgttagaagggattctgttcattcaacatgcaactttagggaatggaagtaagttcatttttaagttgtgttgtcagtaggtgcggtgtctagggtagtgaatcctgtaagttcaaatttatgattaggtgacgagttgacattgagattgtccttttccctgatcaaaaaatgaataaagcctttttaaacaaaa

SEQ ID NO: 418645 - DNA, 1023 bp, Homo sapiens
ggccgggtgttaatcggccgaggtacaacgctccgccgccgctgctgccgcgacccggactgcgcgccagcacccccctgccgacagctccgtcactatggaggatatgaacgagtacagcaatatagaggaattcgcagagggatccaagatcaacgcgagcaagaatcagcaggatgacggtaaaatgtttattggaggcttgagctgggatacaagcaaaaaagatctgacagagtacttgtctcgatttggggaagttgtagactgcacaattaaaacagatccagtcactgggagatcaagaggatttggatttgtgcttttcaaagatgctgctagtgttgataaggttttggaactgaaagaacacaaactggatggcaaattgatagatcccaaaagggccaaagctttaaaagggaaagaacctcccaaaaaggtttttgtgggtggattgagcccggatacttctgaagaacaaattaaagaatattttggagcctttggagagattgaaaatattgaacttcccatggatacaaaaacaaatgaaagaagaggattttgttttatcacatatactgatgaagagccagtaaaaaaattgttagaaagcagataccatcaaattggttctgggaagtgtgaaatcaaagttgcacaacccaaagaggtatataggcagcaacagcaacaacaaaaaggtggaagaggtgctgcagctggtggacgaggtggtacgaggggtcgtggccgaggtcagggccaaaactggaaccaaggatttaataactattatgatcaaggatatggaaattacaatagtgcctatggtggtgatcaaaactatagtggctatggcggatatgattatactgggtataactatgggaactatggatatggacagggatatgcagactacagtggccaacagagcacttatggcaaggcatctcgagggggtggcaatcaccaaaacaattaccagcctgggtgacagagcgagactccctctca

SEQ ID NO: 418646 - DNA, 1294 bp, Homo sapiens
  misc_feature (667)..(667): n is a, c, g, or t
  misc_feature (702)..(702): n is a, c, g, or t
  misc_feature (706)..(706): n is a, c, g, or t
  misc_feature (708)..(708): n is a, c, g, or t
  misc_feature (736)..(736): n is a, c, g, or t
  misc_feature (757)..(757): n is a, c, g, or t
  misc_feature (771)..(771): n is a, c, g, or t
  misc_feature (777)..(777): n is a, c, g, or t
  misc_feature (779)..(780): n is a, c, g, or t
  misc_feature (789)..(789): n is a, c, g, or t
  misc_feature (791)..(791): n is a, c, g, or t
  misc_feature (796)..(796): n is a, c, g, or t
  misc_feature (807)..(807): n is a, c, g, or t
ggccgggtgttaatcggccgaggtacaacgctccgccgccgctgctgccgcgacccggactgcgcgccagcacccccctgccgacagctccgtcactatggaggatatgaacgagtacagcaatatagaggaattcgcagagggatccaagatcaacgcgagcaagaatcagcaggatgacggtaaaatgtttattggaggcttgagctgggatacaagcaaaaaagatctgacagagtacttgtctcgatttggggaagttgtagactgcacaattaaaacagatccagtcactgggagatcaagaggatttggatttgtgcttttcaaagatgctgctagtgttgataaggttttggaactgaaagaacacaaactggatggcaaattgatagatcccaaaagggccaaagctttaaaagggaaagaacctcccaaaaaggtttttgtgggtggattgagcccggatacttctgaagaacaaattaaagaatattttggagcctttggagagattgaaaatattgaacttcccatggatacaaaaacaaatgaaagaagaggattttgttttatcacatatactgatgaagagccagtaaaaaaattgttagaaagcagataccatcaaattggttctgggaagaccgccccgggaaacggaaancaaagcgcacaacccaaaaaaccaaaaaaccaacnacancnacaacaaaaaagccgaacaccccccccncccggcgcaccaaccggcacnaggggccccgcccnacgccncnnccaagaccngngccanggaaggaaggnccaagaggaacaaggatatggaaattacaatagtgcctatggtggtgatcaaaactatagtggctatggcggatatgattatactgggtataactatgggaactatggatatggacagggatatgcagactacagtggccaacagagcacttatggcaaggcatctcgagggggtggcaatcaccaaaacaattaccagccatactaaaggagaacattggagaaaacaggaggagatgttaaagtaacccatcttgcaggacgacattgaagattggtcttctgttgatctaagatgattattttgtaaaagactttctagtgtacaagacaccattgtgtccaactgtatatagctgccaattagttttctttgtttttactttgtcctttgctatctgtgttatgactcaatgtggatttgtttatacacattttatttgtatcatttcatgttaaacctcaaataaatgcttccttatgtgat

SEQ ID NO: 418647 - DNA, 863 bp, Homo sapiens
  misc_feature (765)..(765): n is a, c, g, or t
  misc_feature (773)..(773): n is a, c, g, or t
  misc_feature (780)..(780): n is a, c, g, or t
  misc_feature (794)..(794): n is a, c, g, or t
  misc_feature (806)..(806): n is a, c, g, or t
  misc_feature (811)..(811): n is a, c, g, or t
  misc_feature (815)..(815): n is a, c, g, or t
  misc_feature (850)..(850): n is a, c, g, or t
ggccgggtgttaatcggccgaggtacaacgctccgccgccgctgctgccgcgacccggactgcgcgccagcacccccctgccgacagctccgtcactatggaggatatgaacgagtacagcaatatagaggaattcgcagagggatccaagatcaacgcgagcaagaatcagcaggatgacggtaaaatgtttattggaggcttgagctgggatacaagcaaaaaagatctgacagagtacttgtctcgatttggggaagttgtagactgcacaattaaaacagatccagtcactgggagatcaagaggatttggatttgtgcttttcaaagatgctgctagtgttgataaggttttggaactgaaagaacacaaactggatggcaaattgatagatcccaaaagggccaaagctttaaaagggaaagaacctcccaaaaaggtttttgtgggtggattgagcccggatacttctgaagaacaaattaaagaatattttggagcctttggagagattgaaaatattgaacttcccatggatacaaaaacaaatgaaagaagaggattttgttttatcacatatactgatgaagagccagtaaaaaaattgttagaaagcagataccatcaaattggttctgggaagtgtgaaatcaaagttgcacaacccaaagaggtatataggcagcaacagcaacaacaaaaaggtggaagaggtgctgcagctggtggacgaggtggtacgaggggtcgtggccgagcaanggggtccntgggccnaaggtcaagggccnaaaactgggaanccaanggantttaaataaacctaattatggatccaaagggattnttgggaaaaattt

SEQ ID NO: 418648 - DNA, 774 bp, Homo sapiens
  misc_feature (649)..(649): n is a, c, g, or t
  misc_feature (655)..(656): n is a, c, g, or t
  misc_feature (662)..(662): n is a, c, g, or t
  misc_feature (670)..(670): n is a, c, g, or t
  misc_feature (674)..(675): n is a, c, g, or t
  misc_feature (678)..(678): n is a, c, g, or t
  misc_feature (681)..(681): n is a, c, g, or t
  misc_feature (684)..(684): n is a, c, g, or t
  misc_feature (691)..(691): n is a, c, g, or t
  misc_feature (696)..(696): n is a, c, g, or t
  misc_feature (713)..(713): n is a, c, g, or t
  misc_feature (720)..(720): n is a, c, g, or t
  misc_feature (722)..(722): n is a, c, g, or t
  misc_feature (730)..(730): n is a, c, g, or t
ggccgggtgttaatcggccgaggtacaacgctccgccgccgctgctgccgcgacccggactgcgcgccagcacccccctgccgacagctccgtcactatggaggatatgaacgagtacagcaatatagaggaattcgcagagggatccaagatcaacgcgagcaagaatcagcaggatgacggtaaaatgtttattggaggcttgagctgggatacaagcaaaaaagatctgacagagtacttgtctcgatttggggaagttgtagactgcacaattaaaacagatccagtcactgggagatcaagaggatttggatttgtgcttttcaaagatgctgctagtgttgataaggttttggaactgaaagaacacaaactggatggcaaattgatagatcccaaaagggccaaagctttaaaagggaaagaacctcccaaaaaggtttttgtgggtggattgagcccggatacttctgaagaacaaattaaagaatattttggagcctttggagagattgaaaatattgaacttcccatggatacaaaaacaaatgaaagaagaggattttgttttatcacatatactgatgaagagccagtaaaaaaattgttagaaagcagataccatcaaattggttctgggaagganatcaanntgcacnccaaaggntatnngcnganagnacacaanggganagtgctgcgggggcagngccaggncnggcggtcnggcaagaccggtaacttgcaggagaacaagcatggggcaaaggc

SEQ ID NO: 418649 - DNA, 1562 bp, Homo sapiens
tggagctcaaggatccttaattaaattaatcccccccctacaacgctccgccgccgctgctgccgcgacccggactgcgcgccagcacccccctgccgacagctccgtcactatggaggatatgaacgagtacagcaatatagaggaattcgcagagggatccaagatcaacgcgagcaagaatcagcaggatgacggtaaaatgtttattggaggcttgagctgggatacaagcaaaaaagatctgacagagtacttgtctcgatttggggaagttgtagactgcacaattaaaacagatccagtcactgggagatcaagaggatttggatttgtgcttttcaaagatgctgctagtgttgataagatttactgggattggcatacgtgttcacaggcagagtagttgatctcacacaacgggtgatctcacaaaactggtaagtttcttatgctcatgagccctccctttttttttttaatttggtgcctgcaactttcttaacaatgattctacttcctgggctatcacattataatgctcttggcctcttttttgctgctgttttgctattcttaaacttaggccaagtaccaatgttggctgttagaagggattctgttcattcaacatgcaactttagggaatggaagtaagttcatttttaagttgtgttgtcagtaggtgcggtgtctagggtagtgaatcctgtaagttcaaatttatgattaggtgacgagttgacattgagattgtccttttccctgatcaaaaaatgaataaagcctttttaaacaaaaaaaaaaaaaaaacaaaaaaaaaaaaaacattggggggggccggagaatgaggtggaacgcgtggcacgagaagcagagcaaaccgaccaggacagaaggtacaaagaggggagccggcggagcgcgcgaatggagcaagacaaacacacgaccagaccggacaaagaaacagacaacaagcgaggagaaagaaaggaggcaccagagcgacaccacgaggaagagaagaaacaaaaacaaagagcggagaaaggagcagaagtaaaaaccaaaacacgacggcaacgaaccaacagtaggagaggagggaagcagacaagacaaacgacaagaaaaaacgaacaagacacaaagacacagacaaaagcaagacaaccaagcggaaaggagaagacgagaagagacaaagaagccaaagaaaaaccaatcatcacgaataaggggaacaacgaaggacagaaagagaacaggggggaaggacacgagagcggagcagagcaggtaaaagtgagtgagcaacagaggcaacgcacagcagaggagaacagaagagagagtgaggaagaaggggcgagaagagcgagaaacggaggtgaaggaggcagcacagggcgcgacgcggaacagaggagaaaaggagcggcaccgagcagaggagagggaggaagagagaggcgaggagggacaggagagagagcacgagaggcaagagggcgacagaggagcgaagaggacgaaagaaggagcagagagtagactcg

SEQ ID NO: 418650 - DNA, 487 bp, Homo sapiens
gagtatctctccagttattcccagattcactagtgatccttaaagtctctattcagggagaggaagacactttccatctcagagatagactcgtgttaccttgatggatattggatttgtctaagtctcttctaccattttttgaaactacaatactggaacatccaggaactggagttattctacgctaatggattggaaagaatgttgggaaaggacatcttaaatcttttctaactatgccctaaactgcagaactcaaaggaaatatagtgccattgttagtagtcattctagatgaattgggagtatctctccagttattcccagattcactagtgatccttaaagtctctattcagggagaggaagacactttccatctcagagatagactcgtgttaccttgatggatattggatttgtctaagtctcttctagaaaaaataaattctagattattatttatatgtgtcatttcaaagct

SEQ ID NO: 418651 - DNA, 939 bp, Homo sapiens
ggaaaatgggctcctgcgcgcgcgcactcgccgagtcttccggcgggtccgcccagttccgttcctgctccgcttgaggagaagcgccaagtgcgcatggggacgctatagcaattcgtttgctgtccttcctctccttcgaagatgacaaggcctaccatcgtttcttcctgcctttgggccgtcaggcagttggttgggacccgctccaaccctcggttcttcctgcaatacagtggatacaatttgtcatggctactctgagataagaccacttttttatctgagcttctgtgacctgctcctgggactttgctggctcacggagacacttctctatggagcttcagtagcaaataaggacatcatctgctataacctacaagcagttggacagatattctacatttcctcatttctctacaccgtcaattacatctggtatttgtacacagagctgaggatgaaacacacccagagtggacagagcacatctccactggtgatagattatacttgtcgagtttgtcaaatggcctttgttttctcaagcctgatacctctgctattgatgacacctgtattctgtctgggaaatactagtgaatgtttccaaaacttcagtcagagccacaagtgtatcttgatgcactcaccaccatcagccatggctgaacttccaccttctgccaacacatctgtctgtagcacactttatttttatggtatcgccattttcctgggcagctttgtactcagcctccttaccattatggtcttacttatccgagcccagacattgtataagaagtttgtgaagtcaactggctttctggggagtgaacagtgggcagtgattcacattgtggaccaacgggtgcgcttctacccagtggccttcttttgctgctggggcccagggtaggtacttaacaagaa

SEQ ID NO: 418652 - DNA, 447 bp, Homo sapiens
tcactgatggattttattatgcctattgtttccattctgataatgctcagacgtgtgtggaggaacctgatacttcagacagtcagggctgacaagaaggtttacactttgtgtattcacagctgtcattctaatgatcataaagctgactaagccacaggacaccaagcttcacatggccctttatgttctccaggtaacaccttcaacattcagtatctctgttcttacacccgcttatcctattttcttatactacctttactcggtaaggatgattttttccctccgggtacttctacattgcaaaagagaaaatgtattatttacactcagttatgaagaatgtgaaaattttctcaaagtcgaggtagataatgttgtaaaagtacctccatgcattccagagcgtatatatctctggtcaacttcattttactgatgtgt

SEQ ID NO: 418653 - DNA, 1806 bp, Homo sapiens
ggaaaatgggctcctgcgcgcgcgcactcgccgagtcttccggcgggtccgcccagttccgttcctgctccgcttgaggagaagcgccaagtgcgcatggggacgctatagcaattcgtttgctgtccttcctctccttcgaagatgacaaggcctaccatcgtttcttcctgcctttgggccgtcaggcagttggttgggacccgctccaaccctcgacagagcaggattcagtataggaggagcccagctgggataggggtggagccacctgttcactgcttcaggattcagaacctgactaggaaggatcggctgctcaagggtagctgggactgaagtccctatgacctttccactagacgctagcattctggaggacagttgggacttgttttctctcccaggtttcttttttcttaaactcctggcctcaagtgatcgtcttagcctcggcctcttcaaagtgtcgggattacaggttcttcctgcaatacagtggatacaatttgtcatggctactctgagataagaccacttttttatctgagcttctgtgacctgctcctgggactttgctggctcacggagacacttctctatggagcttcagtagcaaataaggacatcatctgctataacctacaagcagttggacagatattctacatttcctcatttctctacaccgtcaattacatctggtatttgtacacagagctgaggatgaaacacacccagagtggacagagcacatctccactggtgatagattatacttgtcgagtttgtcaaatggcctttgttttctcaagcctgatacctctgctattgatgacacctgtattctgtctgggaaatactagtgaatgtttccaaaacttcagtcagagccacaagtgtatcttgatgcactcaccaccatcagccatggctgaacttccaccttctgccaacacatctgtctgtagcacactttatttttatggtatcgccattttcctgggcagctttgtactcagcctccttaccattatggtcttacttatccgagcccagacattgtataagaagtttgtgaagtcaactggctttctggggagtgaacagtgggcagtgattcacattgtggaccaacgggtgcgcttctacccagtggccttcttttgctgctggggcccagctgtcattctaatgatcataaagctgactaagccacaggacaccaagcttcacatggccctttatgttctccaggctctaacggcaacatctcagggtctactcaactgtggagtatatggctggacgcagcacaaattccaccaactaaagcaggaggctcggcgtgatgcagatacccagacaccattattatgctcacagaagagattctatagcaggggcttaaattcactggaatccaccctgacttttcctgccagtacttctaccattttttgaaactacaatactggaacatccaggaactggagttattctacgctaatggattggaaagaatgttgggaaaggacatcttaaatcttttctaactatgccctaaactgcagaactcaaaggaaatatagtgccattgttagtagtcattctagatgaattgggagtatctctccagttattcccagattcactagtgatccttaaagtctctattcagggagaggaagacactttccatctcagagatagactcgtgttaccttgatggatattggatttgtctaagtctcttctagaaaaaataaattctagattattatttatatgtgtcatttcaaagct

SEQ ID NO: 418654 - DNA, 1543 bp, Homo sapiens
ggaaaatgggctcctgcgcgcgcgcactcgccgagtcttccggcgggtccgcccagttccgttcctgctccgcttgaggagaagcgccaagtgcgcatggggacgctatagcaattcgtttgctgtccttcctctccttcgaagatgacaaggcctaccatcgtttcttcctgcctttgggccgtcaggcagttggttgggacccgctccaaccctcggttcttcctgcaatacagtggatacaatttgtcatggctactctgagataagaccacttttttatctgagcttctgtgacctgctcctgggactttgctggctcacggagacacttctctatggagcttcagtagcaaataaggacatcatctgctataacctacaagcagttggacagatattctacatttcctcatttctctacaccgtcaattacatctggtatttgtacacagagctgaggatgaaacacacccagagtggacagagcacatctccactggtgatagattatacttgtcgagtttgtcaaatggcctttgttttctcaagcctgatacctctgctattgatgacacctgtattctgtctgggaaatactagtgaatgtttccaaaacttcagtcagagccacaagtgtatcttgatgcactcaccaccatcagccatggctgaacttccaccttctgccaacacatctgtctgtagcacactttatttttatggtatcgccattttcctgggcagctttgtactcagcctccttaccattatggtcttacttatccgagcccagacattgtataagaagtttgtgaagtcaactggctttctggggagtgaacagtgggcagtgattcacattgtggaccaacgggtgcgcttctacccagtggccttcttttgctgctggggcccagctgtcattctaatgatcataaagctgactaagccacaggacaccaagcttcacatggccctttatgttctccaggctctaacggcaacatctcagggtctactcaactgtggagtatatggctggacgcagcacaaattccaccaactaaagcaggaggctcggcgtgatgcagatacccagacaccattattatgctcacagaagagattctatagcaggggcttaaattcactggaatccaccctgacttttcctgccagtacttctaccattttttgaaactacaatactggaacatccaggaactggagttattctacgctaatggattggaaagaatgttgggaaaggacatcttaaatcttttctaactatgccctaaactgcagaactcaaaggaaatatagtgccattgttagtagtcattctagatgaattgggagtatctctccagttattcccagattcactagtgatccttaaagtctctattcagggagaggaagacactttccatctcagagatagactcgtgttaccttgatggatattggatttgtctaagtctcttctagaaaaaataaattctagattattatttatatgtgtcatttcaaagct

SEQ ID NO: 418655 - DNA, 1279 bp, Homo sapiens
tctagaggatcactcacgccatgtcacaaggtgaagtcaactggctttctggggagtgaacagtgggcagtgattcacattgtggaccaacgggtgcgcttctacccagtgaccttcttttgctagctggggcatattctacatttcctcatttctctacaccgtcaattacatctggtatttgtacacagagctgaggatgaaacacacccagagtggacagagcacatctccactggtgatagattatacttgtcgagtttgtcaaatggcctttgttttctcaagcctgatacctctgctattgatgacacctgtattctgtctgggaaatactagtgaatgtttccaaaacttcagtcagagccacaagtgtatcttgatgcactcaccaccatcagccatggctgaacttccaccttctgccaacacatctgtctgtagcacactttatttttatggtatcgccattttcctgggcagctttgtactcagcctccttaccattatggtcttacttatccgagcccagacattgtataagaagtttgtgaagtcaactggctttctggggagtgaacagtgggcagtgattcacattgtggaccaacgggtgcgcttctacccagtggccttcttttgctgctggggcccagctgtcattctaatgatcataaagctgactaagccacaggacaccaagcttcacatggccctttatgttctccaggctctaacggcaacatctcagggtctactcaactgtggagtatatggctggacgcagcacaaattccaccaactaaagcaggaggctcggcgtgatgcagatacccagacaccattattatgctcacagaagagattctatagcaggggcttaaattcactggaatccaccctgacttttcctgccagtacttctaccattttttgaaactacaatactggaacatccaggaactggagttattctacgctaatggattggaaagaatgttgggaaaggacatcttaaatcttttctaactatgccctaaactgcagaactcaaaggaaatatagtgccattgttagtagtcattctagatgaattgggagtatctctccagttattcccagattcactagtgatccttaaagtctctattcagggagaggaagacactttccatctcagagatagactcgtgttaccttgatggatattggatttgtctaagtctcttctagaaaaaataaattctagattattatttatatgtgtcatttcaaagct

SEQ ID NO: 418656 - DNA, 1468 bp, Homo sapiens
ggaaaatgggctcctgcgcgcgcgcactcgccgagtcttccggcgggtccgcccagttccgttcctgctccgcttgaggagaagcgccaagtgcgcatggggacgctatagcaattcgtttgctgtccttcctctccttcgaagatgacaaggcctaccatcgtttcttcctgcctttgggccgtcaggcagttggttgggacccgctccaaccctcggttcttcctgcaatacagtggatacaatttgtcatggctactctgagtgttataggttcaagttcacttattgcctatgctgtattccataatatacagaaatctccagagataagaccacttttttatctgagcttctgtgacctgctcctgggactttgctggctcacggagacacttctctatggagcttcagtagcaaataaggacatcatctgctataacctacaagcagttggacagatattctacatttcctcatttctctacaccgtcaattacatctggtatttgtacacagagctgaggatgaaacacacccagagtggacagagcacatctccactggtgatagattatacttgtcgagtttgtcaaatggcctttgttttctcaagcctgatacctctgctattgatgacacctgtattctgtctgggaaatactagtgaatgtttccaaaacttcagtcagagccacaagtcttacttatccgagcccagacattgtataagaagtttgtgaagtcaactggctttctggggagtgaacagtgggcagtgattcacattgtggaccaacgggtgcgcttctacccagtggccttcttttgctgctggggcccagctgtcattctaatgatcataaagctgactaagccacaggacaccaagcttcacatggccctttatgttctccaggctctaacggcaacatctcagggtctactcaactgtggagtatatggctggacgcagcacaaattccaccaactaaagcaggaggctcggcgtgatgcagatacccagacaccattattatgctcacagaagagattctatagcaggggcttaaattcactggaatccaccctgacttttcctgccagtacttctaccattttttgaaactacaatactggaacatccaggaactggagttattctacgctaatggattggaaagaatgttgggaaaggacatcttaaatcttttctaactatgccctaaactgcagaactcaaaggaaatatagtgccattgttagtagtcattctagatgaattgggagtatctctccagttattcccagattcactagtgatccttaaagtctctattcagggagaggaagacactttccatctcagagatagactcgtgttaccttgatggatattggatttgtctaagtctcttctagaaaaaataaattctagattattatttatatgtgtcatttcaaagct

SEQ ID NO: 418657 - DNA, 1565 bp, Homo sapiens
ggaaaatgggctcctgcgcgcgcgcactcgccgagtcttccggcgggtccgcccagttccgttcctgctccgcttgaggagaagcgccaagtgcgcatggggacgctatagcaattcgtttgctgtccttcctctccttcgaagatgacaaggcctaccatcgtttcttcctgcctttgggccgtcaggcagttggttgggacccgctccaaccctcggttcttcctgcaatacagtggatacaatttgtcatggctactctgagataagaccacttttttatctgagcttctgtgacctgctcctgggactttgctggctcacggagacacttctctatggagcttcagtagcaaataaggacatcatctgctataacctacaagcagttggacagatattctacatttcctcatttctctacaccgtcaattacatctggtatttgtacacagagctgaggatgaaacacacccagagtggacagagcacatctccactggtgatagattatacttgtcgagtttgtcaaatggcctttgttttctcaagcctgatacctctgctattgatgacacctgtattctgtctgggaaatactagtgaatgtttccaaaacttcagtcagagccacaagtgtatcttgatgcactcaccaccatcagccatggctgaacttccaccttctgccaacacatctgtctgtagcacactttatttttatggtcttacttatccgagcccagacattgtataagaagtttgtgaagtcaactggctttctggggagtgaacagtgggcagtgattcacattgtggaccaacgggtgcgcttctacccagtggccttcttttgctgctggggcccagacgtgtgtggaggaacctgatacttcagacagtcagggctgacaagaaggtttacactttgtgtattcacagctgtcattctaatgatcataaagctgactaagccacaggacaccaagcttcacatggccctttatgttctccaggctctaacggcaacatctcagggtctactcaactgtggagtatatggctggacgcagcacaaattccaccaactaaagcaggaggctcggcgtgatgcagatacccagacaccattattatgctcacagaagagattctatagcaggggcttaaattcactggaatccaccctgacttttcctgccagtacttctaccattttttgaaactacaatactggaacatccaggaactggagttattctacgctaatggattggaaagaatgttgggaaaggacatcttaaatcttttctaactatgccctaaactgcagaactcaaaggaaatatagtgccattgttagtagtcattctagatgaattgggagtatctctccagttattcccagattcactagtgatccttaaagtctctattcagggagaggaagacactttccatctcagagatagactcgtgttaccttgatggatattggatttgtctaagtctcttctagaaaaaataaattctagattattatttatatgtgtcatttcaaagct

SEQ ID NO: 418658 - DNA, 885 bp, Homo sapiens
tggatttaagaagatttttgggctatctgactattccgatgagacagttttctcaagggtaccctggaaaatgaggcaataagggggggcactgaagctatttcattgtccctatgtatatactaagaagtatgaccaactctcagtcatccgtaacagtgtagtgtagacagtgagttcaggatgaactagaaaaatataaaaaactgatgtcagatcttcatgtttgagatagagaaaatataacaatgctttatgaataaggggagtgagaattattccctggatccctgaaaacctgaagcatgggctgcatcaccccttcatctcctccaggctctaacggcaacatctcagggtctactcaactgtggagtatatggctggacgcagcacaaattccaccaactaaagcaggaggctcggcgtgatgcagatacccagacaccattattatgctcacagaagagattctatagcaggggcttaaattcactggaatccaccctgacttttcctgccagtacttctaccattttttgaaactacaatactggaacatccaggaactggagttattctacgctaatggattggaaagaatgttgggaaaggacatcttaaatcttttctaactatgccctaaactgcagaactcaaaggaaatatagtgccattgttagtagtcattctagatgaattgggagtatctctccagttattcccagattcactagtgatccttaaagtctctattcagggagaggaagacactttccatctcagagatagactcgtgttaccttgatggatattggatttgtctaagtctcttctagaaaaaataaattctagattattatttatatgtgtcatttcaaagct

SEQ ID NO: 418659 - DNA, 1033 bp, Homo sapiens
ggaaaatgggctcctgcgcgcgcgcactcgccgagtcttccggcgggtccgcccagttccgttcctgctccgcttgaggagaagcgccaagtgcgcatggggacgctatagcaattcgtttgctgtccttcctctccttcgaagatgacaaggcctaccatcgtttcttcctgcctttgggccgtcaggcagttggttgggacccgctccaaccctcggttcttcctgcaatacagtggatacaatttgtcatggctactctgagtgttataggttcaagttcacttattgcctatgctgtattccataatatacagaaatctccagagataagaccacttttttatctgagcttctgtgacctgctcctgggactttgctggctcacggagacacttctctatggagcttcagtagcaaataaggacatcatctgctataacctacaagcagttggacagatattctacatttcctcatttctctacaccgtcaattacatctggtatttgtacacagagctgaggatgaaacacacccagagtggacagagcacatctccactggtgatagattatacttgtcgagtttgtcaaatggcctttgttttctcaagcctgatacctctgctattgatgacacctgtattctgtctgggaaatactagtgaatgtttccaaaacttcagtcagagccacaagtgtatcttgatgcactcaccaccatcagccatggctgaacttccaccttctgccaacacatctgtctgtagcacactttatttttatggtatcgccattttcctgggcagctttgtactcagcctccttaccattatggggcggtgtctcggtctgttgcccgggctggagtgcagtggcgcatctcggctcactgcaacctctgcctcccgggttcgggcggttctcctgcctcggcctcctgagtggctggaattggaggcgcatgccgccacgactggctaatttttgtgttttttgtgacatggcgtgagggatcctctagaacagcc

SEQ ID NO: 418660 - DNA, 1629 bp, Homo sapiens
  misc_feature (1156)..(1156): n is a, c, g, or t
  misc_feature (1165)..(1165): n is a, c, g, or t
  misc_feature (1169)..(1170): n is a, c, g, or t
  misc_feature (1177)..(1177): n is a, c, g, or t
  misc_feature (1180)..(1180): n is a, c, g, or t
  misc_feature (1182)..(1182): n is a, c, g, or t
  misc_feature (1200)..(1200): n is a, c, g, or t
  misc_feature (1209)..(1209): n is a, c, g, or t
  misc_feature (1229)..(1229): n is a, c, g, or t
  misc_feature (1243)..(1243): n is a, c, g, or t
  misc_feature (1270)..(1270): n is a, c, g, or t
  misc_feature (1281)..(1283): n is a, c, g, or t
  misc_feature (1285)..(1285): n is a, c, g, or t
ggaaaatgggctcctgcgcgcgcgcactcgccgagtcttccggcgggtccgcccagttccgttcctgctccgcttgaggagaagcgccaagtgcgcatggggacgctatagcaattcgtttgctgtccttcctctccttcgaagatgacaaggcctaccatcgtttcttcctgcctttgggccgtcaggcagttggttgggacccgctccaaccctcggttcttcctgcaatacagtggatacaatttgtcatggctactctgagtgttataggttcaagttcacttattgcctatgctgtattccataatatacagaaatctccagagataagaccacttttttatctgagcttctgtgacctgctcctgggactttgctggctcacggagacacttctctatggagcttcagtagcaaataaggacatcatctgctataacctacaagcagttggacagatattctacatttcctcatttctctacaccgtcaattacatctggtatttgtacacagagctgaggatgaaacacacccagagtggacagagcacatctccactggtgatagattatacttgtcgagtttgtcaaatggcctttgttttctcaagcctgatacctctgctattgatgacacctgtattctgtctgggaaatactagtgaatgtttccaaaacttcagtcagagccacaagtgtatcttgatgcactcaccaccatcagccatggctgaacttccaccttctgccaacacatctgtctgtagcacactttatttttatggtcttacttatccgagcccagacattgtataagaagtttgtgaagtcaactggctttctggggagtgaacagtgggcagtgattcacattgtggaccaacgggtgcgcttctacccagtggccttcttttgctgctggggcccagacgtgtgtggaggaacctgatacttcagacagtcagggctgacaagaaggtttacactttgtgtattcacagctgtcattctaatgatcataaagctgactaagccacaggacaccaagcttcacatggccctttatgttctccaggctctaacggcaacatctcagggtctactcaactgtggagtatatggctggacgcagcacaaattccccccccccnccccggccncccnncctgacnccncnccccccccccccctcttncgccccccnccccccccccctcccaggcncccccccccccccnaccccccccccccccccccccccagcncctctcccccnnncngacaccccaatactggaacatccaggaactggagttattctacgctaatggattggaaagaatgttgggaaaggacatcttaaatcttttctaactatgccctaaactgcagaactcaaaggaaatatagtgccattgttagtagtcattctagatgaattgggagtatctctccagttattcccagattcactagtgatccttaaagtctctattcagggagaggaagacactttccatctcagagatagactcgtgttaccttgatggatattggatttgtctaagtctcttctagaaaaaataaattctagattattatttatatgtgtcatttcaaagct

SEQ ID NO: 418661 - DNA, 1352 bp, Homo sapiens
ggaaaatgggctcctgcgcgcgcgcactcgccgagtcttccggcgggtccgcccagttccgttcctgctccgcttgaggagaagcgccaagtgcgcatggggacgctatagcaattcgtttgctgtccttcctctccttcgaagatgacaaggcctaccatcgtttcttcctgcctttgggccgtcaggcagttggttgggacccgctccaaccctcggttcttcctgcaatacagtggatacaatttgtcatggctactctgagtgttataggttcaagttcacttattgcctatgctgtattccataatatacagaaatctccagagataagaccacttttttatctgagcttctgtgacctgctcctgggactttgctggctcacggagacacttctctatggagcttcagtagcaaataaggacatcatctgctataacctacaagcagttggacagatattctacatttcctcatttctctacaccgtcaattacatctggtatttgtacacagagctgaggatgaaacacacccagagtggacagagcacatctccactggtgatagattatacttgtcgagtttgtcaaatggcctttgttttctcaagcctgatacctctgctattgatgacacctgtattctgtctgggaaatactagtgaatgtttccaaaacttcagtcagagccacaagtgtatcttgatgcactcaccaccatcagccatggctgaacttccaccttctgccaacacatctgtctgtagcacactttatttttatggtatcgccattttcctgggcagctttgtactcagcctccttaccattatggtatggtaccaccctaccttcctttgtggagagatgaggaaatgaaggggatgggccagtattcccaggacctgggaaagatggggcagagaggcacttcttgtggtcctagaactaagaaagtagctaggagatcttgacaatataattactgcctcagacttttgcacttccccaaatcaaatgataagagagagaaaagagcttgtatttattaggtgaaaattatgctcactctacaactagtataggcttcatcaatcccctatggccagaaaactcatatgtgccaaatatatcctttacatagttaggatgacactctgaaacatagaacatatgctttgattactttccatattaactaatttccttttattctaaacaaaaaaggggccgcaaattcccaggccagtcgtcccgtctgaaaggcccaagggggatataaaagggcggtaacggggaaagggtttgcgcacttgtggtgacccaaggaatgtgctctcgcttagc

SEQ ID NO: 418662 - DNA, 256 bp, Homo sapiens
ctgggaaatactagtgaatgtttccaaaacttcagtcagagccacaagtaagtaagaactaaatgtataattttcatggcagactacacctatttgtttctataaatagagctggaaaaagactttccacataattctgaccaaagtgctaatattagaaatgggctaaggaacaagatgtagtaaaggctgaaaatatataagtaaaagtgtaacacaaaatgactacaagataatgtgtctgtgggggagagac

SEQ ID NO: 418663 - DNA, 1502 bp, Homo sapiens
ggaaaatgggctcctgcgcgcgcgcactcgccgagtcttccggcgggtccgcccagttccgttcctgctccgcttgaggagaagcgccaagtgcgcatggggacgctatagcaattcgtttgctgtccttcctctccttcgaagatgacaaggcctaccatcgtttcttcctgcctttgggccgtcaggcagttggttgggacccgctccaaccctcggttcttcctgcaatacagtggatacaatttgtcatggctactctgagtgttataggttcaagttcacttattgcctatgctgtattccataatatacagaaatctccagagataagaccacttttttatctgagcttctgtgacctgctcctgggactttgctggctcacggagacacttctctatggagcttcagtagcaaataaggacatcatctgctataacctacaagcagttggacaggtgatagattatacttgtcgagtttgtcaaatggcctttgttttctcaagcctgatacctctgctattgatgacacctgtattctgtctgggaaatactagtgaatgtttccaaaacttcagtcagagccacaagtgtatcttgatgcactcaccaccatcagccatggctgaacttccaccttctgccaacacatctgtctgtagcacactttatttttatggtatcgccattttcctgggcagctttgtactcagcctccttaccattatggtcttacttatccgagcccagacattgtataagaagtttgtgaagtcaactggctttctggggagtgaacagtgggcagtgattcacattgtggaccaacgggtgcgcttctacccagtggccttcttttgctgctggggcccagctgtcattctaatgatcataaagctgactaagccacaggacaccaagcttcacatggccctttatgttctccaggctctaacggcaacatctcagggtctactcaactgtggagtatatggctggacgcagcacaaattccaccaactaaagcaggaggctcggcgtgatgcagatacccagacaccattattatgctcacagaagagattctatagcaggggcttaaattcactggaatccaccctgacttttcctgccagtacttctaccattttttgaaactacaatactggaacatccaggaactggagttattctacgctaatggattggaaagaatgttgggaaaggacatcttaaatcttttctaactatgccctaaactgcagaactcaaaggaaatatagtgccattgttagtagtcattctagatgaattgggagtatctctccagttattcccagattcactagtgatccttaaagtctctattcagggagaggaagacactttccatctcagagatagactcgtgttaccttgatggatattggatttgtctaagtctcttctagaaaaaataaattctagattattatttatatgtgtcatttcaaagct

SEQ ID NO: 418664 - DNA, 1607 bp, Homo sapiens
ggaaaatgggctcctgcgcgcgcgcactcgccgagtcttccggcgggtccgcccagttccgttcctgctccgcttgaggagaagcgccaagtgcgcatggggacgctatagcaattcgtttgctgtccttcctctccttcgaagatgacaaggcctaccatcgtttcttcctgcctttgggccgtcaggcagttggttgggacccgctccaaccctcggttcttcctgcaatacagtggatacaatttgtcatggctactctgagtgttataggttcaagttcacttattgcctatgctgtattccataatatacagaaatctccagagataagaccacttttttatctgagcttctgtgacctgctcctgggactttgctggctcacggagacacttctctatggagcttcagtagcaaataaggacatcatctgctataacctacaagcagttggacagatattctacatttcctcatttctctacaccgtcaattacatctggtatttgtacacagagctgaggatgaaacacacccagagtggacagagcacatctccactggtgatagattatacttgtcgagtttgtcaaatggcctttgttttctcaagcctgatacctctgctattgatgacacctgtattctgtctgggaaatactagtgaatgtttccaaaacttcagtcagagccacaagtgtatcttgatgcactcaccaccatcagccatggctgaacttccaccttctgccaacacatctgtctgtagcacactttatttttatggtatcgccattttcctgggcagctttgtactcagcctccttaccattatggtcttacttatccgagcccagacattgtataagaagtttgtgaagtcaactggctttctggggagtgaacagtgggcagtgattcacattgtggaccaacgggtgcgcttctacccagtggccttcttttgctgctggggcccagctgtcattctaatgatcataaagctgactaagccacaggacaccaagcttcacatggccctttatgttctccaggctctaacggcaacatctcagggtctactcaactgtggagtatatggctggacgcagcacaaattccaccaactaaagcaggaggctcggcgtgatgcagatacccagacaccattattatgctcacagaagagattctatagcaggggcttaaattcactggaatccaccctgacttttcctgccagtacttctaccattttttgaaactacaatactggaacatccaggaactggagttattctacgctaatggattggaaagaatgttgggaaaggacatcttaaatcttttctaactatgccctaaactgcagaactcaaaggaaatatagtgccattgttagtagtcattctagatgaattgggagtatctctccagttattcccagattcactagtgatccttaaagtctctattcagggagaggaagacactttccatctcagagatagactcgtgttaccttgatggatattggatttgtctaagtctcttctagaaaaaataaattctagattattatttatatgtgtcatttcaaagct

SEQ ID NO: 418665 - DNA, 1667 bp, Homo sapiens
ggaaaatgggctcctgcgcgcgcgcactcgccgagtcttccggcgggtccgcccagttccgttcctgctccgcttgaggagaagcgccaagtgcgcatggggacgctatagcaattcgtttgctgtccttcctctccttcgaagatgacaaggcctaccatcgtttcttcctgcctttgggccgtcaggcagttggttgggacccgctccaaccctcggttcttcctgcaatacagtggatacaatttgtcatggctactctgagtgttataggttcaagttcacttattgcctatgctgtattccataatatacagaaatctccagagataagaccacttttttatctgagcttctgtgacctgctcctgggactttgctggctcacggagacacttctctatggagcttcagtagcaaataaggacatcatctgctataacctacaagcagttggacaggggagacggggtttcgccatgtttgccaggctggtcctgaatgcctgacctcaagtgattcaccgcttgggcctcccaaagtgctgggattacaggtgtgagccactgcacctggcctccttaaatgtatctttatggcctaattttcacctttgcacccagttggtgatagattatacttgtcgagtttgtcaaatggcctttgttttctcaagcctgatacctctgctattgatgacacctgtattctgtctgggaaatactagtgaatgtttccaaaacttcagtcagagccacaagtgtatcttgatgcactcaccaccatcagccatggctgaacttccaccttctgccaacacatctgtctgtagcacactttatttttatggtatcgccattttcctgggcagctttgtactcagcctccttaccattatggtcttacttatccgagcccagacattgtataagaagtttgtgaagtcaactggctttctggggagtgaacagtgggcagtgattcacattgtggaccaacgggtgcgcttctacccagtggccttcttttgctgctggggcccagctgtcattctaatgatcataaagctgactaagccacaggacaccaagcttcacatggccctttatgttctccaggctctaacggcaacatctcagggtctactcaactgtggagtatatggctggacgcagcacaaattccaccaactaaagcaggaggctcggcgtgatgcagatacccagacaccattattatgctcacagaagagattctatagcaggggcttaaattcactggaatccaccctgacttttcctgccagtacttctaccattttttgaaactacaatactggaacatccaggaactggagttattctacgctaatggattggaaagaatgttgggaaaggacatcttaaatcttttctaactatgccctaaactgcagaactcaaaggaaatatagtgccattgttagtagtcattctagatgaattgggagtatctctccagttattcccagattcactagtgatccttaaagtctctattcagggagaggaagacactttccatctcagagatagactcgtgttaccttgatggatattggatttgtctaagtctcttctagaaaaaataaattctagattattatttatatgtgtcatttcaaagct

SEQ ID NO: 418666 - DNA, 1774 bp, Homo sapiens
ggaaaatgggctcctgcgcgcgcgcactcgccgagtcttccggcgggtccgcccagttccgttcctgctccgcttgaggagaagcgccaagtgcgcatggggacgctatagcaattcgtttgctgtccttcctctccttcgaagatgacaaggcctaccatcgtttcttcctgcctttgggccgtcaggcagttggttgggacccgctccaaccctcggttcttcctgcaatacagtggatacaatttgtcatggctactctgagataagaccacttttttatctgagcttctgtgacctgctcctgggactttgctggctcacggagacacttctctatggagcttcagtagcaaataagggcacccattccaattcctgtggcttaaattaaaacccttaaccaaaaatgcaagtttggacaggggagacggggtttcgccatgtttgccaggctggtcctgaatgcctgacctcaagtgattcaccgcttgggcctcccaaagtgctgggattacaggtgtgagccactgcacctggcctccttaaatgtatctttatggcctaattttcacctttgcacccagttgatattcctacatttcccctccaattttccttccttaacaaccccgggctccagaatttttaacccattttcctggggcaaattgtgtaaccaccagagctgaggatgaaacacacccagagtggacagagcacatctccactggtgatagattatacttgtcgagtttgtcaaatggcctttgttttctcaagcctgatacctctgctattgatgacacctgtattctgtctgggaaatactagtgaatgtttccaaaacttcagtcagagccacaagtgtatcttgatgcactcaccaccatcagccatggctgaacttccaccttctgccaacacatctgtctgtagcacactttatttttatggtatcgccattttcctgggcagctttgtactcagcctccttaccattatggtcttacttatccgagcccagacattgtataagaagtttgtgaagtcaactggctttctggggagtgaacagtgggcagtgattcacattgtggaccaacgggtgcgcttctacccagtggccttcttttgctgctggggcccagctgtcattctaatgatcataaagctgactaagccacaggacaccaagcttcacatggccctttatgttctccaggctctaacggcaacatctcagggtctactcaactgtggagtatatggctggacgcagcacaaattccaccaactaaagcaggaggctcggcgtgatgcagatacccagacaccattattatgctcacagaagagattctatagcaggggcttaaattcactggaatccaccctgacttttcctgccagtacttctaccattttttgaaactacaatactggaacatccaggaactggagttattctacgctaatggattggaaagaatgttgggaaaggacatcttaaatcttttctaactatgccctaaactgcagaactcaaaggaaatatagtgccattgttagtagtcattctagatgaattgggagtatctctccagttattcccagattcactagtgatccttaaagtctctattcagggagaggaagacactttccatctcagagatagactcgtgttaccttgatggatattggatttgtctaagtctcttctagaaaaaataaattctagattattatttatatgtgtcatttcaaagct

SEQ ID NO: 418667 - DNA, 1404 bp, Homo sapiens
ggaaaatgggctcctgcgcgcgcgcactcgccgagtcttccggcgggtccgcccagttccgttcctgctccgcttgaggagaagcgccaagtgcgcatggggacgctatagcaattcgtttgctgtccttcctctccttcgaagatgacaaggcctaccatcgtttcttcctgcctttgggccgtcaggcagttggttgggacccgctccaaccctcggttcttcctgcaatacagtggatacaatttgtcatggctactctgagataagaccacttttttatctgagcttctgtgacctgctcctgggactttgctggctcacggagacacttctctatggagcttcagtagcaaataaggacatcatctgctataacctacaagcagttggacagatattctacatttcctcatttctctacaccgtcaattacatctggtatttgtacacagagctgaggatgaaacacacccagagtggacagagcacatctccactggtgatagattatacttgtcgagtttgtcaaatggcctttgttttctcaagcctgatacctctgctattgatgacacctgtattctgtctgggaaatactagtgaatgtttccaaaacttcagtcagagccacaagtcttacttatccgagcccagacattgtataagaagtttgtgaagtcaactggctttctggggagtgaacagtgggcagtgattcacattgtggaccaacgggtgcgcttctacccagtggccttcttttgctgctggggcccagctgtcattctaatgatcataaagctgactaagccacaggacaccaagcttcacatggccctttatgttctccaggctctaacggcaacatctcagggtctactcaactgtggagtatatggctggacgcagcacaaattccaccaactaaagcaggaggctcggcgtgatgcagatacccagacaccattattatgctcacagaagagattctatagcaggggcttaaattcactggaatccaccctgacttttcctgccagtacttctaccattttttgaaactacaatactggaacatccaggaactggagttattctacgctaatggattggaaagaatgttgggaaaggacatcttaaatcttttctaactatgccctaaactgcagaactcaaaggaaatatagtgccattgttagtagtcattctagatgaattgggagtatctctccagttattcccagattcactagtgatccttaaagtctctattcagggagaggaagacactttccatctcagagatagactcgtgttaccttgatggatattggatttgtctaagtctcttctagaaaaaataaattctagattattatttatatgtgtcatttcaaagct

SEQ ID NO: 418668 - DNA, 1375 bp, Homo sapiens
ggaaaatgggctcctgcgcgcgcgcactcgccgagtcttccggcgggtccgcccagttccgttcctgctccgcttgaggagaagcgccaagtgcgcatggggacgctatagcaattcgtttgctgtccttcctctccttcgaagatgacaaggcctaccatcgtttcttcctgcctttgggccgtcaggcagttggttgggacccgctccaaccctcggttcttcctgcaatacagtggatacaatttgtcatggctactctgagtgttataggttcaagttcacttattgcctatgctgtattccataatatacagaaatctccagagataagaccacttttttatctgagcttctgtgacctgctcctgggactttgctggctcacggagacacttctctatggagcttcagtagcaaataaggacatcatctgctataacctacaagcagttggacagatattctacatttcctcatttctctacaccgtcaattacatctggtatttgtacacagagctgaggatgaaacacacccagagtggacagagcacatctccactggtgatagattatacttgtcgagtttgtcaaatggcctttgttttctcaagcctgatacctctgctattgatgacacctgtattctgtctgggaaatactagtgaatgtttccaaaacttcagtcagagccacaagtgtatcttgatgcactcaccaccatcagccatggctgaacttccaccttctgccaacacatctgtctgtagcacactttatttttatggtatcgccattttcctgggcagctttgtactcagcctccttaccattatggggcggtgtctcggtctgttgcccgggctggagtgcagtggcgcatctcggctcactgcaacctctgcctcccgggttcgggcggttctcctgcctcggcctcctgagtggctggaattggaggcgcatgccgccacgactggctaatttttgtgttttttgtgacacaggtttcaccatgctggtcaggctgtcttgaactcctgacctcgtgatctgcctgcctcagcctcccaaagtgttgggattataggcgtgagccaccgcaccgggtgcaaagtgactttctaaaacttctgttgcttagagttgagaatttaagctcagccatggtgctgaagtgttaagcatagaacactttctaacaaaatctctaataaagtgttttaagaggaactagttagagcttacttttaacttcctgggtaaactgtgattagcctcagtggggggaaatgcccagaggttgatgtaaggttcatgtgttaaacgtgatacacaagtttggctagttacctgtccatttccctagccta

SEQ ID NO: 418669 - DNA, 1235 bp, Homo sapiens
ggaaaatgggctcctgcgcgcgcgcactcgccgagtcttccggcgggtccgcccagttccgttcctgctccgcttgaggagaagcgccaagtgcgcatggggacgctatagcaattcgtttgctgtccttcctctccttcgaagatgacaaggcctaccatcgtttcttcctgcctttgggccgtcaggcagttggttgggacccgctccaaccctcggttcttcctgcaatacagtggatacaatttgtcatggctactctgagtgttataggttcaagttcacttattgcctatgctgtattccataatatacagaaatctccagagataagaccacttttttatctgagcttctgtgacctgctcctgggactttgctggctcacggagacacttctctatggagcttcagtagcaaataaggacatcatctgctataacctacaagcagttggacagatattctacatttcctcatttctctacaccgtcaattacatctggtatttgtacacagagctgaggatgaaacacacccagagtggacagagcacatctccactggtgatagattatacttgtcgagtttgtcaaatggcctttgttttctcaagcctgatacctctgctattgatgacacctgtattctgtctgggaaatactagtgaatgtttccaaaacttcagtcagagccacaagtgtatcttgatgcactcaccaccatcagccatggctgaacttccaccttctgccaacacatctgtctgtagcacactttatttttatggtatcgccattttcctgggcagctttgtactcagcctccttaccattatggtatggtaccaccctaccttcctttgtggagagatgaggaaatgaaggggatgggccagtattcccaggacctgggaaagatggggcagagaggcacttcttgtggtcctagaactaagaaagtagctaggagatcttgacaatataattactgcctcagacttttgcacttccccaaatcaaatgataagagagagaaaagagcttgtatttattaggtgaaaattatgctcactctacaactagtataggcttcatcaatcccctatggccagaaaactcatatgtgccaaatatatcctttacatagttaggatgacactctgaaacatagaacatatgctttgatttaattttccaaataataaaataattttcttttttaaattctacatt

SEQ ID NO: 418670 - DNA, 895 bp, Homo sapiens
accccgccctgtaggcgggagcatccaatcaacttcgagagcgtaggccccacctatcgtgggtcgagttgcttggcggtcgtggttccggaggttcctcgggatgtcggtggccttcgtaccggactggctgaggggcaaggcggaagtcaatcaagagactatccagcggctccttgaggagaatgaccagctgatccgctgtattgtggagtatcagaacaagggccgcgggaacgagtgcgtgcagtaccagcatgtgttacatagaaatctcatttatttggctaccattgcagatgccagtccaaccagcacttcaaaagcaatggaataatctttcaaaagcaatagaataatcttccatttggctgtcgtgaggagtaattgaatgtaatccatctcttacaaaatggagacagggtctttaccaactcaactggttaaaacatgaatgaaacctctgtggctctttcgaaacgtgaaaatgtgaagaaagctactaacttagctgtattctcatgtaaatattttttaaataattaagcaaatccctcaataagttgagcccaggtgtcctctttcctgaacttggagcatgtttggataacaaagacatcactgggatgttcaagtctactttttagtttcaacctgaagaggaaactcagtaggtgttgggcaggaattggtgagattcctgacttgataccttgctaaatggacatgtaactgtgtgctccttcctatcagtttgtaaatgtggtccccctgactgctgttttcagattgctttgaaataaagcttatttttctataaaataaaacacagaaacacacaacaggacacaaacaacaaaaaaaaagtggggccccccgaaaagtacacaacgtg

SEQ ID NO: 418671 - DNA, 490 bp, Homo sapiens
accccgccctgtaggcgggagcatccaatcaacttcgagagcgtaggccccacctatcgtgggtcgagttgcttggcggtcgtggttccggaggttcctcgggatgtcggtggccttcgtaccggactggctgaggggcaaggcggaagtcaatcaagagactatccagcggctccttgaggagaatgaccagctgatccgctgtattgtggagtatcagaacaagggccgcgggaacgagtgcgtgcagtaccagcatgtgttacatagaaatctcatttatttggctaccattgcagatgccagtccaaccagcacttcaaaagcaatggaataatctttcaaaagcaatagaataatcttccatttggctgtcgtgaggagtaattgaatgtaatccatctcttacaaaatggagacagggtcttgctctgttgagggcaatggcaccatcatagctcactgcagccttaaacacctgaactctgat

SEQ ID NO: 418672 - DNA, 824 bp, Homo sapiens
accccgccctgtaggcgggagcatccaatcaacttcgagagcgtaggccccacctatcgtgggtcgagttgcttggcggtcgtggttccggaggttcctcgggatgtcggtggccttcgtaccggactggctgaggggcaaggcggaagtcaatcaagagactatccagcggctccttgaggagaatgaccagctgatccgctgtattgtggagtatcagaacaagggccgcgggaacgagtgcgtgcagtaccagcatgtgttacatagaaatctcatttatttggctaccattgcagatgccagtccaaccagcacttcaaaagcaatggaataatctttcaaaagcaatagaataatcttccatttggctgtcgtgaggagtaattgaatgtaatccatctcttacaaaatggagacagggtctttaccaactcaactggttaaaacatgaatgaaacctctgtggctctttcgaaacgtgaaaatgtgaagaaagctactaacttagctgtattctcatgtaaatattttttaaataattaagcaaatccctcaataagttgagcccaggtgtcctctttcctgaacttggagcatgtttggataacaaagacatcactgggatgttcaagtctactttttagtttcaacctgaagaggaaactcagtaggtgttgggcaggaattggtgagattcctgacttgataccttgctaaatggacatgtaactgtgtgctccttcctatcagtttgtaaatgtggtccccctgactgctgttttcagattgctttgaaataaagcttatttttctataaaata

SEQ ID NO: 418673 - DNA, 2737 bp, Homo sapiens
aagcggctgggcttcggctcggggcctatgagagccgggctccggggggcgggccggactgtggcggctgccgggggcggtggcggtggtggcggcggcggcggaggcggactggggaggcggcggcctggctcggcctggcctggcctgtcagggcgcgggcggcggcggctccagcaccatgtccctgcagtacggggcggaggagacgcccctcgccggcagttacggcgcggccgattcgtttccaaaggacttcggctacggcgtggaggaggaggaagaggaggcggcggcggcgggcggaggggttggggcaggggcaggcggtggctgtggtccggggggcgctgacagctccaagccgaggattctgctcatgggactccggcgcagcggcaagtcctccatccagaaggtggtgtttcataagatgtcacccaacgagaccctctttttggaaagtaccaacaagatttataaggatgacatttccaatagctcctttgtgaatttccagatatgggattttcctgggcaaatggacttttttgacccaacctttgactatgagatgatcttcaggggaacaggagcattgatatacgtcattgacgcacaggatgactacatggaggctttaacaagacttcacattactgtttctaaagcctacaaagttaacccagacatgaattttgaggtttttattcacaaagttgatggtctgtctgatgatcacaaaatagaaacacagagggacattcatcaaagggccaatgatgaccttgcagatgctgggctagaaaaactccatcttagcttttatctgactagtatctatgaccattcaatatttgaagcctttagtaaggtggtgcagaaactcattccacaactgccgaccttggaaaacctattaaatatctttatatcaaattcaggtattgaaaaagcttttctctttgatgttgtcagcaaaatctacattgcaacagacagttcccctgtggatatgcaatcttatgaactttgctgtgacatgatcgatgttgtaattgatgtgtcttgtatatatgggttaaaggaagatggaagtggaagtgcttatgacaaagaatctatggcaattatcaagctgaataatacaactgtcctttatttaaaggaggtgactaaatttttggcactggtctgcattctaagggaagaaagctttgaaagaaaaggtttaatagactacaacttccactgtttccgaaaagctattcatgaggtttttgaggtgggtgtgacttctcacaggagctgtggtcaccagactagtgcctccagtctgaaagcgctgacacacaatggcacgccacgaaacgccatctagtctgaatcccagcgtcggggctctgtgccagcttactcttcactccagggtcggatgccacgtgctacaggacatgggagctgctgcttgtgggaatctggtgcctgttccactagagacaaggggtagagtttctcatttggatgaaaaccccttcaactggtggtgtacaactgaagctactatatcttttttgaaaatggcaaaaaaaaaaaaaaaaaaattctggagaccacagaactcaagtgtgtgtttctcctcttttgggtcccctttaagtagttgggatattttggacctggagataacaccagttacccatccttaccagggaatgttgccatcaattccagttgaaaataatagaaaagactgaatttttatatgcttcacttaggctttcatttgagtagactctaaaaattctgccttgcttaagttctaacactgcctctcagatttcagttttggacattgcacaactaagaccttttaaacgcatttgcttgctaactcggaagacacatagtctgcagcaagacattcctatattgaagaaatgagagaaaattttatgctgcatcaggtggagagcaaggctcaacggtggttgcattagttccctcggaagtattgaaaaaactttgaaatggaagaaaatttttgcacctatgttctgagtaccagatgtctgggttctttcttctgcattagataaatgatcatgctcagtgtaacaaagggaattaaaagttttcccacagtccccttctaggggagaaactcattgtgtcactgaaatgtttagcttactttaatcttgatatcagcctctacagaccttttattctaagctatcgagcttcttgattgcatttggttgaccacgagtgaccctaaggcattgggggactgtccactgggagttggagtgagcacgtggtgctgcaacaggcattgttttacatactttgtctccagtattctgacaccaagtgtcaactgtggtactttctttgcctaggatatgaattcataattgttgcttttgttgatggttgataccctttccattgatttaaacctaacacattatttctattccacatgcccagtagacatatattccaaagccactggaccacttgagtacataagtgccactgtttaatgcaatatgtatattcaggtctgtaaagctaacagtgtgacttggagtgcttcctgcagatgattctgacttgagtatttacatggaccatggtgatatccaaaagaaaaatgctttttatatttatagattatttcattgaactatatatgaaatgggtatcaataaatgtatttactccaaaa

SEQ ID NO: 418674 - DNA, 2864 bp, Homo sapiens
aagcggctgggcttcggctcggggcctatgagagccgggctccggggggcgggccggactgtggcggctgccgggggcggtggcggtggtggcggcggcggcggaggcggactggggaggcggcggcctggctcggcctggcctggcctgtcagggcgcgggcggcggcggctccagcaccatgtccctgcagtacggggcggaggagacgcccctcgccggcagttacggcgcggccgattcgtttccaaaggacttcggctacggcgtggaggaggaggaagaggaggcggcggcggcgggcggaggggttggggcaggggcaggcggtggctgtggtccggggggcgctgacagctccaagccgaggattctgctcatgggactccggcgcagcggcaagtcctccatccagaaggtggtgtttcataagatgtcacccaacgagaccctctttttggaaagtaccaacaagatttataaggatgacatttccaatagctcctttgtgaatttccagatatgggattttcctgggcaaatggacttttttgacccaacctttgactatgagatgatcttcaggggaacaggagcattgatatacgtcattgacgcacaggatgactacatggaggctttaacaagacttcacattactgtttctaaagcctacaaagttaacccagacatgaattttgaggtttttattcacaaagttgatggtctgtctgatgatcacaaaatagaaacacagagggacattcatcaaagggccaatgatgaccttgcagatgctgggctagaaaaactccatcttagcttttatctgactagtatctatgaccattcaatatttgaagcctttagtaaggtggtgcagaaactcattccacaactgccgaccttggaaaacctattaaatatctttatatcaaattcaggtattgaaaaagcttttctctttgatgttgtcagcaaaatctacattgcaacagacagttcccctgtggatatgcaatcttatgaactttgctgtgacatgatcgatgttgtaattgatgtgtcttgtatatatgggttaaaggaagatggaagtggaagtgcttatgacaaagaatctatggcaattatcaagctgaataatacaactgtcctttatttaaaggaggtgactaaatttttggcactggtctgcattctaagggaagaaagctttgaaagaaaaggtttaatagactacaacttccactgtttccgaaaagctattcatgaggtttttgaggtgggtgtgacttctcacaggagctgtggtcaccagactagtgcctccagtctgaaagcgctgacacacaatggcacgccacgaaacgccatctagtctgaatcccagcgtcggggctctgtgccagcttactcttcactccagggtcggatgccacgtgctacaggacatgggagctgctgcttgtgggaatctggtgcctgttccactagagacaaggggtagagtttctcatttggatgaaaaccccttcaactggtggtgtacaactgaagctactatatcttttttgaaaatggcaaaaaaaaaaaaaaaaaaattctggagaccacagaactcaagtgtgtgtttctcctcttttgggtcccctttaagtagttgggatattttggacctggagataacaccagttacccatccttaccagggaatgttgccatcaattccagttgaaaataatagaaaagactgaatttttatatgcttcacttaggctttcatttgagtagactctaaaaattctgccttgcttaagttctaacactgcctctcagatttcagttttggacattgcacaactaagaccttttaaacgcatttgcttgctaactcggaagacacatagtctgcagcaagacattcctatattgaagaaatgagagaaaattttatgctgcatcaggtggagagcaaggctcaacggtggttgcattagttccctcggaagtattgaaaaaactttgaaatggaagaaaatttttgcacctatgttctgagtaccagatgtctgggttctttcttctgcattagataaatgatcatgctcagtgtaacaaagggaattaaaagttttcccacagtccccttctaggggagaaactcattgtgtcactgaaatgtttagcttactttaatcttgatatcagcctctacagaccttttattctaagctatcgagcttcttgattgcatttggttgaccacgagtgaccctaaggcattgggggactgtccactgggagttggagtgagcacgtggtgctgcaacaggcattgttttacatactttgtctccagtattctgacaccaagtgtcaactgtggtactttctttgcctaggatatgaattcataattgttgcttttgttgatggttgataccctttccattgatttaaacctaacacattatttctattccacatgcccagtagacatatattccaaagccactggaccacttgagtacataagtgccactgtttaatgcaatatgtatattcaggtctgtaaagctaacagtgtgacttggagtgcttcctgcagatgattctgacttgagtatttacatggaccatggtgatatccaaaagaaaaatgctttttatatttatagattatttcattgaactatatatgaaatgggtatcaataaatgtatttactccaaaaaaaaaatcacaacactttttgggccgccttggctgaaaaattttcaaaccttctttgggcccggggcccccggtagtgacccgggccagcggtcccaggaacccggcgagacggcctggctccccca

SEQ ID NO: 418675 - DNA, 2677 bp, Homo sapiens
aagcggctgggcttcggctcggggcctatgagagccgggctccggggggcgggccggactgtggcggctgccgggggcggtggcggtggtggcggcggcggcggaggcggactggggaggcggcggcctggctcggcctggcctggcctgtcagggcgcgggcggcggcggctccagcaccatgtccctgcagtacggggcggaggagacgcccctcgccggcagttacggcgcggccgattcgtttccaaaggacttcggctacggcgtggaggaggaggaagaggaggcggcggcggcgggcggaggggttggggcaggggcaggcggtggctgtggtccggggggcgctgacagctccaagccgaggattctgctcatgggactccggcgcagcggcaagtcctccatccagaaggtggtgtttcataagatgtcacccaacgagaccctctttttggaaagtaccaacaagatttataaggatgacatttccaatagctcctttgtgaatttccagatatgggattttcctgggcaaatggacttttttgacccaacctttgactatgagatgatcttcaggggaacaggagcattgatatacgtcattgacgcacaggatgactacatggaggctttaacaagacttcacattactgtttctaaagcctacaaagttaacccagacatgaattttgaggtttttattcacaaagttgatggtctgtctgatgatcacaaaatagaaacacagagggacattcatcaaagggccaatgatgaccttgcagatgctgggctagaaaaactccatcttagcttttatctgactagtatctatgaccattcaatatttgaagcctttagtaaggtggtgcagaaactcattccacaactgccgaccttggaaaacctattaaatatctttatatcaaattcaggtattgaaaaagcttttctctttgatgttgtcagcaaaatctacattgcaacagacagttcccctgtggatatgcaatcttatgaactttgctgtgacatgatcgatgttgtaattgatgtgtcttgtatatatgggttaaaggaagatggaagtggaagtgcttatgacaaagaatctatggcaattatcaagctgaataatacaactgtcctttatttaaaggaggtgactaaatttttggcactggtctgcattctaagggaagaaagctttgaaagaaaaggtttaatagactacaacttccactgtttccgaaaagctattcatgaggtttttgaggtgggtgtgacttctcacaggagctgtggtcaccagactagtgcctccagtctgaaagcgctgacacacaatggcacgccacgaaacgccatctagtctgaatcccagcgtcggggctctgtgccagcttactcttcactccagggtcggatgccacgtgctacaggacatgggagctgctgcttgtgggaatctggtgcctgttccactagagacaaggggtagagtttctcatttggatgaaaaccccttcaactggtggtgtacaactgaagctactatatcttttttgaaaatggcaaaaaaaaaaaaaaaaaaattctggagaccacagaactcaagtgtgtgtttctcctcttttgggtcccctttaagtagttgggatattttggacctggagataacaccagttacccatccttaccagggaatgttgccatcaattccagttgaaaataatagaaaagactgaatttttatatgcttcacttaggctttcatttgagtagactctaaaaattctgccttgcttaagttctaacactgcctctcagatttcagttttggacattgcacaactaagaccttttaaacgcatttgcttgctaactcggaagacacatagtctgcagcaagacattcctatattgaagaaatgagagaaaattttatgctgcatcaggtggagagcaaggctcaacggtggttgcattagttccctcggaagtattgaaaaaactttgaaatggaagaaaatttttgcacctatgttctgagtaccagatgtctgggttctttcttctgcattagataaatgatcatgctcagtgtaacaaagggaattaaaagttttcccacagtccccttctaggggagaaactcattgtgtcactgaaatgtttagcttactttaatcttgatatcagcctctacagaccttttattctaagctatcgagcttcttgattgcatttggttgaccacgagtgaccctaaggcattgggggactgtccactgggagttggagtgagcacgtggtgctgcaacaggcattgttttacatactttgtctccagtattctgacaccaagtgtcaactgtggtactttctttgcctaggatatgaattatttctattccacatgcccagtagacatatattccaaagccactggaccacttgagtacataagtgccactgtttaatgcaatatgtatattcaggtctgtaaagctaacagtgtgacttggagtgcttcctgcagatgattctgacttgagtatttacatggaccatggtgatatccaaaagaaaaatgctttttatatttatagattatttcattgaactatatatgaaatgggtatcaataaatgtatttactccaaaa

SEQ ID NO: 418676 - DNA, 2683 bp, Homo sapiens
aagcggctgggcttcggctcggggcctatgagagccgggctccggggggcgggccggactgtggcggctgccgggggcggtggcggtggtggcggcggcggcggaggcggactggggaggcggcggcctggctcggcctggcctggcctgtcagggcgcgggcggcggcggctccagcaccatgtccctgcagtacggggcggaggagacgcccctcgccggcagttacggcgcggccgattcgtttccaaaggacttcggctacggcgtggaggaggaggaagaggaggcggcggcggcgggcggaggggttggggcaggggcaggcggtggctgtggtccggggggcgctgacagctccaagccgaggattctgctcatgggactccggcgcagcggcaagtcctccatccagaaggtggtgtttcataagatgtcacccaacgagaccctctttttggaaagtaccaacaagatttataaggatgacatttccaatagctcctttgtgaatttccagatatgggattttcctgggcaaatggacttttttgacccaacctttgactatgagatgatcttcaggggaacaggagcattgatatacgtcattgacgcacaggatgactacatggaggctttaacaagacttcacattactgtttctaaagcctacaaagttaacccagacatgaattttgaggtttttattcacaaagttgatggtctgtctgatgatcacaaaatagaaacacagagggacattcatcaaagggccaatgatgaccttgcagatgctgggctagaaaaactccatcttagcttttatctgactagtatctatgaccattcaatatttgaagcctttagtaaggtggtgcagaaactcattccacaactgccgaccttggaaaacctattaaatatctttatatcaaattcaggtattgaaaaagcttttctctttgatgttgtcagcaaaatctacattgcaacagacagttcccctgtggatatgcaatcttatgaactttgctgtgacatgatcgatgttgtaattgatgtgtcttgtatatatgggttaaaggaagatggaagtggaagtgcttatgacaaagaatctatggcaattatcaagctgaataatacaactgtcctttatttaaaggaggtgactaaatttttggcactggtctgcattctaagggaagaaagctttgaaagaaaaggtttaatagactacaacttccactgtttccgaaaagctattcatgaggtttttgaggtgggtgtgacttctcacaggagctgtggtcaccagactagtgcctccagtctgaaagcgctgacacacaatggcacgccacgaaacgccatctagtctgaatcccagcgtcggggctctgtgccagcttactcttcactccagggtcggatgccacgtgctacaggacatgggagctgctgcttgtgggaatctggtgcctgttccactagagacaaggggtagagtttctcatttggatgaaaaccccttcaactggtggtgtacaactgaagctactatatcttttttgaaaatggcaaaaaaaaaaaaaaaaaaattctggagaccacagaactcaagtgtgtgtttctcctcttttgggtcccctttaagtagttgggatattttggacctggagataacaccagttacccatccttaccagggaatgttgccatcaattccagttgaaaataatagaaaagactgaatttttatatgcttcacttaggctttcatttgagtagactctaaaaattctgccttgcttaagttctaacactgcctctcagatttcagttttggacattgcacaactaagaccttttaaacgcatttgcttgctaactcggaagacacatagtctgcagcaagacattcctatattgaagaaatgagagaaaattttatgctgcatcaggtggagagcaaggctcaacggtggttgcattagttccctcggaagtattgaaaaaactttgaaatggaagaaaatttttgcacctatgttctgagtaccagatgtctgggttctttcttctgcattagataaatgatcatgctcagtgtaacaaagggaattgtttagcttactttaatcttgatatcagcctctacagaccttttattctaagctatcgagcttcttgattgcatttggttgaccacgagtgaccctaaggcattgggggactgtccactgggagttggagtgagcacgtggtgctgcaacaggcattgttttacatactttgtctccagtattctgacaccaagtgtcaactgtggtactttctttgcctaggatatgaattcataattgttgcttttgttgatggttgataccctttccattgatttaaacctaacacattatttctattccacatgcccagtagacatatattccaaagccactggaccacttgagtacataagtgccactgtttaatgcaatatgtatattcaggtctgtaaagctaacagtgtgacttggagtgcttcctgcagatgattctgacttgagtatttacatggaccatggtgatatccaaaagaaaaatgctttttatatttatagattatttcattgaactatatatgaaatgggtatcaataaatgtatttactccaaaa

SEQ ID NO: 418677 - DNA, 2253 bp, Homo sapiens
gaaaaagatgtagaaacaaaggaaagttgtttatcttctttgtcatgtggttgcagcttatctctttggcagtagattccctaacagtgtaagagatgcagttgcagagtgctttgggagcagacatgcattgtgcaggatgactacatggaggctttaacaagacttcacattactgtttctaaagcctacaaagttaacccagacatgaattttgaggtttttattcacaaagttgatggtctgtctgatgatcacaaaatagaaacacagagggacattcatcaaagggccaatgatgaccttgcagatgctgggctagaaaaactccatcttagcttttatctgactagtatctatgaccattcaatatttgaagcctttagtaaggtggtgcagaaactcattccacaactgccgaccttggaaaacctattaaatatctttatatcaaattcaggtattgaaaaagcttttctctttgatgttgtcagcaaaatctacattgcaacagacagttcccctgtggatatgcaatcttatgaactttgctgtgacatgatcgatgttgtaattgatgtgtcttgtatatatgggttaaaggaagatggaagtggaagtgcttatgacaaagaatctatggcaattatcaagctgaataatacaactgtcctttatttaaaggaggtgactaaatttttggcactggtctgcattctaagggaagaaagctttgaaagaaaaggtttaatagactacaacttccactgtttccgaaaagctattcatgaggtttttgaggtgggtgtgacttctcacaggagctgtggtcaccagactagtgcctccagtctgaaagcgctgacacacaatggcacgccacgaaacgccatctagtctgaatcccagcgtcggggctctgtgccagcttactcttcactccagggtcggatgccacgtgctacaggacatgggagctgctgcttgtgggaatctggtgcctgttccactagagacaaggggtagagtttctcatttggatgaaaaccccttcaactggtggtgtacaactgaagctactatatcttttttgaaaatggcaaaaaaaaaaaaaaaaaaattctggagaccacagaactcaagtgtgtgtttctcctcttttgggtcccctttaagtagttgggatattttggacctggagataacaccagttacccatccttaccagggaatgttgccatcaattccagttgaaaataatagaaaagactgaatttttatatgcttcacttaggctttcatttgagtagactctaaaaattctgccttgcttaagttctaacactgcctctcagatttcagttttggacattgcacaactaagaccttttaaacgcatttgcttgctaactcggaagacacatagtctgcagcaagacattcctatattgaagaaatgagagaaaattttatgctgcatcaggtggagagcaaggctcaacggtggttgcattagttccctcggaagtattgaaaaaactttgaaatggaagaaaatttttgcacctatgttctgagtaccagatgtctgggttctttcttctgcattagataaatgatcatgctcagtgtaacaaagggaattaaaagttttcccacagtccccttctaggggagaaactcattgtgtcactgaaatgtttagcttactttaatcttgatatcagcctctacagaccttttattctaagctatcgagcttcttgattgcatttggttgaccacgagtgaccctaaggcattgggggactgtccactgggagttggagtgagcacgtggtgctgcaacaggcattgttttacatactttgtctccagtattctgacaccaagtgtcaactgtggtactttctttgcctaggatatgaattcataattgttgcttttgttgatggttgataccctttccattgatttaaacctaacacattatttctattccacatgcccagtagacatatattccaaagccactggaccacttgagtacataagtgccactgtttaatgcaatatgtatattcaggtctgtaaagctaacagtgtgacttggagtgcttcctgcagatgattctgacttgagtatttacatggaccatggtgatatccaaaagaaaaatgctttttatatttatagattatttcattgaactatatatgaaatgggtatcaataaatgtatttactccaaaa

SEQ ID NO: 418678 - DNA, 745 bp, Homo sapiens
aaatctcaagacacattcacaaacaaatggttatcaccaaggtcttcatgctctactcatgttgacatgagttgtattaattggtgactggaagtccaggatctgttgaggaagtcagtgacccttaatcaggaacactgccttggaaggtggtggacctttaaaacagaagcttctcagtttttgtagcatctgatatgagagaatatgctagatattcataaacttagggccaggcaatgtggggcccctggaatgctactgggcactctctaacctagtcctagaaatttcagttccaataatgttttcttcttcttttctagataagaaactatatgtatctcgtggatctgccagtaccagccttccaaatgaaactctttcagagttagagacacctgggaaatactcacttacaccaccaaaccactggggccacccacatcgatacctgcagcatctttagtcaagttggaggagaaagacaacacttggtctaagacacggcagcaagacatccctgcatattgttccagataaaaatgaaagctgctcacacccacttgcctccccaatctgttaaacagcttcgtgtctagtatgagctcagtacttgccctgtgaaaatcccagaagcccccgctgtcaatgttccccatccacaccctgcttgctcctgtgtaacagctcagatgatgaataataataaaactgtacttttttggatggtgctaaaaaaaaa

SEQ ID NO: 418679 - DNA, 626 bp, Homo sapiens
aaatctgataacttactcattagaaattgagtaaactgcccgtcacaagttgaataaattctgttgtggctgcaatagaatttactctgtatccagagcatttcttggatgcagtttcatgagtttctgtcttcccttcctctgaggttgaggactctggtatctgacatcccacaggtgttcatctggaccctggaggagacttacagccttccataggggcctaactggctttcattaaccatgtaacttctcctttagctctttcagagttagagacacctgggaaatactcacttacaccaccaaaccactggggccacccacatcgatacctgcagcatctttagtcaagttggaggagaaagacaacacttggtctaagacacggcagcaagacatccctgcatattgttccagataaaaatgaaagctgctcacacccacttgcctccccaatctgttaaacagcttcgtgtctagtatgagctcagtacttgccctgtgaaaatcccagaagcccccgctgtcaatgttccccatccacaccctgcttgctcctgtgtaacagctcagatgatgaataataataaaactgtacttttttggatggtgctaaaaaaaaa

SEQ ID NO: 418680 - DNA, 1223 bp, Homo sapiens
ctagaggggcggaaagtaacaaggaggtgggggtacaaatcctcagctcctgcttccgcaagcactaacctgctctgaagtgagccaggcagctctggccatcttttcccagccacagaatcaggtgatggtccagaattaagagctgtcacctgtgtcattcactcacaatggaagaaatgaagaagactgccatccggctgcccaaaggcaaacagaagcctataaagacggaatggaattcccggtgtgtccttttcacctacttccaaggggacatcagcagcgtagtggatgaacacttctccagagctctgagcaatatcaagagcccccaggaattgaccccctcgagtcagagtgaaggtgtgatgctgaaaaacgatgatagcatgtctccaaatcagtggcgttactcgtctccatggacaaagccacaaccagaagtacctgtcacaaaccgtgccgccaactgcaacttgcatgtgcctggtcccatggctgtgaatcagttctcaccgtccctggctaggagggcctctgttcggcctggggagctgtggcatttctcctccctggcgggcaccagctccttagagcctggctactctcatcccttccccgctcggcacctggttccagagccccagcctgatgggaaacgtgagcctctcctaagtctcctccagcaagacagatgcctagcccgtcctcaggaatctgccgccagggagaatggcaaccctggccagatagctggaagcacagggttgctcttcaacctgcctcccggctcagttcactataagaaactatatgtatctcgtggatctgccagtaccagccttccaaatgaaactctttcagagttagagacacctgggaaatactcacttacaccaccaaaccactggggccacccacatcgatacctgcagcatctttagtcaagttggaggagaaagacaacacttggtctaagacacggcagcaagacatccctgcatattgttccagataaaaatgaaagctgctcacacccacttgcctccccaatctgttaaacagcttcgtgtctagtatgagctcagtacttgccctgtgaaaatcccagaagcccccgctgtcaatgttccccatccacaccctgcttgctcctgtgtaacagctcagatgatgaataataataaaactgtacttttttggatggtgctaaaaaaaaa

SEQ ID NO: 418681 - DNA, 378 bp, Homo sapiens
gctgtaggcgttacgacgacaagactcccgatggtgctgcctaggaagaatggagctagctccccctggggccacccacatcgatacctgcagcatctttagtcaagttggaggagaaagacaacacttggtctaagacacggcagcaagacatccctgcatattgttccagataaaaatgaaagctgctcacacccacttgcctccccaatctgttaaacagcttcgtgtctagtatgagctcagtacttgccctgtgaaaatcccagaagcccccgctgtcaatgttccccatccacaccctgcttgctcctgtgtaacagctcagatgatgaataataataaaactgtacttttttggatggtgctaaaaaaaaa

SEQ ID NO: 418682 - DNA, 1082 bp, Homo sapiens
ctagaggggcggaaagtaacaaggaggtgggggtacaaatcctcagctcctgcttccgcaagcactaacctgctctgaagtgagccaggcagctctggccatcttttcccagccacagaatcaggtgatggtccagaattaagagctgtcacctgtgtcattcactcacaatggaagaaatgaagaagactgccatccggctgcccaaaggcaaacagaagcctataaagacggaatggaattcccggtgtgtccttttcacctacttccaaggggacatcagcagcgtagtggatgaacacttctccagagctctgagcaatatcaagagcccccaggaattgaccccctcgagtcagagtgaaggtgtgatgctgaaaaacgatgatagcatgtctccaaatcagtggcgttactcgtctccatggacaaagccacaaccagaagtacctgtcacaaaccgtgccgccaactgcaacttgcatgtgcctggtcccatggctgtgaatcagttctcaccgtccctggctaggagggcctctgttcggcctggggagctgtggcatttctcctccctggcgggcaccagctccttagagcctggctactctcatcccttccccgctcggcacctggttccagagccccagcctgatgggaaacataagaaactatatgtatctcgtggatctgccagtaccagccttccaaatgaaactctttcagagttagagacacctgggaaatactcacttacaccaccaaaccactggggccacccacatcgatacctgcagcatctttagtcaagttggaggagaaagacaacacttggtctaagacacggcagcaagacatccctgcatattgttccagataaaaatgaaagctgctcacacccacttgcctccccaatctgttaaacagcttcgtgtctagtatgagctcagtacttgccctgtgaaaatcccagaagcccccgctgtcaatgttccccatccacaccctgcttgctcctgtgtaacagctcagatgatgaataataataaaactgtacttttttggatggtgctaaaaaaaaa

SEQ ID NO: 418683 - DNA, 442 bp, Homo sapiens
  misc_feature (17)..(17): n is a, c, g, or t
ggaaaggcaccacaggnttcacgaccctaggcacagtgacatgcaccgtctccaccagccttgccggggcggtgggccacagcactagtgcttccctggccacgccatcaccaccttgggcaccattgcctggggccacccacatcgatacctgcagcatctttagtcaagttggaggagaaagacaacacttggtctaagacacggcagcaagacatccctgcatattgttccagataaaaatgaaagctgctcacacccacttgcctccccaatctgttaaacagcttcgtgtctagtatgagctcagtacttgccctgtgaaaatcccagaagcccccgctgtcaatgttccccatccacaccctgcttgctcctgtgtaacagctcagatgatgaataataataaaactgtacttttttggatggtgctaaaaaaaaa

SEQ ID NO: 418684 - DNA, 1208 bp, Homo sapiens
ggctctggcagagcatgtctgagccatcacattggagaatcagctggtgatcctcgccaccacaaccagtgatgccggggcatactacgtgcaggccgtgaatgagaaaaatggagaaaacaagacaagcccattcattcatttgagcatagcaagcttttgtggaaacaccacacaagattgaggaaaatttgtaaaaactttctggccagcgtttctgaaaaatcaaaagatattacagccaattatcatttaatgaagatacatttttgcttgctgtcgggagaataaagcagggaacctttatgtagtgaacaccatcgggatgatcgggtactggtaattaaattcctggtggattgtgctgtaattagtttaaaatcggagtgtcatgcagccccgcctcttgtttgctgttgtggtaataatccgttccttccttgaggacagcaccgtgttagagtggagcggcaaccaggtctagccctgtctcaaaacatctaaataagtgatgcgctgtcacccagctaacaggaggaaataatacattttcatcaacaaccttgtacttgagagttcaaaaacgtcaccccttttcaattgctagatactgtggctacacctgaagcttatgggaagcaaaagatagataggttttagatttaaatttttttttaaagaaagcatgactgttagaactgagatgcagtcccataatggtaccgcctgctgtttagtgcatatttagtagatggcattattatctctcaacatttctcccctcttgcgtggttaagaagataaattccagcatgttctgaaccgatattcctgtagggaaggagaggatttccctgaactctccaccccgctgccctggtgagagcttgctgccatcccaggggtggatccactttgaagttttaatgtgatgtgaagccagcagatgttaaggacataggtgggactgttgaagcatcctgcatgaatttttcatggccagctcccactgctcaggtgcacaccagaaaaagaagggtttgggcctgcctgagagtagatgtgtcttccgaggtcagacccgggaaagctttatgaacctgtcaacctatttttggcttttgctttgaagattttacgttgagttaacctttgtggaacagaacttctgaactgaattactatgtgaataagagtttcttcctcta

SEQ ID NO: 418685 - DNA, 511 bp, Homo sapiens
atgggagcactcctgcaaagaaaatcagaagttcaagtcgcatatatgggaagtttcatggatacggaccagaggaaaacagtttctcaaggacgtgcagcgattctaaacctgctgcccatcaccagctaccccagacctcaagtgacttggtttagagaagggcacaagattattccaagcaacagaatagccatcacattggagaatcagctggtgatcctcgccaccacaaccagtgatgccggggcatactacgtgcaggccgtgaatgagaaaaatggagaaaacaagacaagcccattcattcatttgagcatagcaagtgagttttgaaatcccaaatggtaattctgcaagcaataaaatcttgctttaatcagtaaccactgtctgacaggacattttgcaataaattttctctctctagtgtagtagttacggtttaatattgatccagtgccaatagttcggagagctttagggctcttgctttcttcaaaatgatatg

SEQ ID NO: 418686 - DNA, 481 bp, Homo sapiens
acatttctcttttctctgccacaggagatgttggcacacctgaaaccatggccccaaccattgtggttcccccgggcaacagaagtgtggtggctggatccagtgagaccaccttggaatgtatagccagtgccaggtacgaggcgcgtctcctgtgagactcctagtaaatattccatgacctgtgacgagccgacgatagaaggatacactggagcatgaggttcagccttctagcgacagtggtcttgtttggccgggtgggccatgaatacgagatatgggtagataaggaaatggacacactgatgtcttccagagtcccccactgcaacagggcggtgctttcaatgcagctctgggtggtagtggggggctcctctgagatcctctctagggaagagagaggagttgaggcagaggaaaaagttcattgctcttctcctcttagtcagccaaggtgttctctgcctacttagcg

SEQ ID NO: 418687 - DNA, 1378 bp, Homo sapiens
atgggagcactcctgcaaagaaaatcagaagttcaagtcgcatatatgggaagtttcatggatacggaccagaggaaaacagtttctcaaggacgtgcagcgattctaaacctgctgcccatcaccagctaccccagacctcaagtgacttggtttagagaagggcacaagattattccaagcaacagaatagccatcacattggagaatcagctggtgatcctcgccaccacaaccagtgatgccggggcatactacgtgcaggccgtgaatgagaaaaatggagaaaacaagacaagcccattcattcatttgagcatagcaagcttttgtggaaacaccacacaagattgaggaaaatttgtaaaaactttctggccagcgtttctgaaaaatcaaaagatattacagccaattatcatttaatgaagatacatttttgcttgctgtcgggagaataaagcagggaacctttatgtagtgaacaccatcgggatgatcgggtactggtaattaaattcctggtggattgtgctgtaattagtttaaaatcggagtgtcatgcagccccgcctcttgtttgctgttgtggtaataatccgttccttccttgaggacagcaccgtgttagagtggagcggcaaccaggtctagccctgtctcaaaacatctaaataagtgatgcgctgtcacccagctaacaggaggaaataatacattttcatcaacaaccttgtacttgagagttcaaaaacgtcaccccttttcaattgctagatactgtggctacacctgaagcttatgggaagcaaaagatagataggttttagatttaaatttttttttaaagaaagcatgactgttagaactgagatgcagtcccataatggtaccgcctgctgtttagtgcatatttagtagatggcattattatctctcaacatttctcccctcttgcgtggttaagaagataaattccagcatgttctgaaccgatattcctgtagggaaggagaggatttccctgaactctccaccccgctgccctggtgagagcttgctgccatcccaggggtggatccactttgaagttttaatgtgatgtgaagccagcagatgttaaggacataggtgggactgttgaagcatcctgcatgaatttttcatggccagctcccactgctcaggtgcacaccagaaaaagaagggtttgggcctgcctgagagtagatgtgtcttccgaggtcagacccgggaaagctttatgaacctgtcaacctatttttggcttttgctttgaagattttacgttgagttaacctttgtggaacagaacttctgaactgaattactatgtgaataagagtttcttcctcta

SEQ ID NO: 418688 - DNA, 815 bp, Homo sapiens
atgggagcactcctgcaaagaaaatcagaagttcaagtcgcatatatgggaagtttcatggatacggaccagaggaaaacagtttctcaaggacgtgcagcgattctaaacctgctgcccatcaccagctaccccagacctcaagtgacttggtttagagaagggcacaagattattccaagcaacagaatagccatcacattggagaatcagctggtgatcctcgccaccacaaccagtgatgccggggcatactacgtgcaggccgtgaatgagaaaaatggagaaaacaagacaagcccattcattcatttgagcatagcaagagatgttggcacacctgaaaccatggccccaaccattgtggttcccccgggcaacagaagtgtggtggctggatccagtgagaccaccttggaatgtatagccagtgccaggcctgtggaggacctgagtgtgacctggaagaggaatggagtgagaatcaccagtggcctccacagctttggaagacgcctcaccatcagcaacccgacgtccgcggacaccgggccatacgtctgcgaggcggcgctgccggggagcgcttttgaaccggccagggcgacggcctttcttttcatcataggtaatgcgggagcctctaagtggtgttgccagcatctcagatagcatccgacactgactcttctgcagaaacaaaatagcgtatttcagtggctttatttgtaactcggcaaatgaaggtgaggttgagtttaccttcgaaatccttcctagccttctttcccaagaatataagtccattaaatcca

SEQ ID NO: 418689 - DNA, 881 bp, Homo sapiens
atgggagcactcctgcaaagaaaatcagaagttcaagtcgcatatatgggaagtttcatggatacggaccagaggaaaacagtttctcaaggacgtgcagcgattctaaacctgctgcccatcaccagctaccccagacctcaagtgacttggtttagagaagggcacaagattattccaagcaacagaatagccatcacattggagaatcagctggtgatcctcgccaccacaaccagtgatgccggggcatactacgtgcaggccgtgaatgagaaaaatggagaaaacaagacaagcccattcattcatttgagcatagcaagagatgttggcacacctgaaaccatggccccaaccattgtggttcccccgggcaacagaagtgtggtggctggatccagtgagaccaccttggaatgtatagccagtgccaggcctgtggaggacctgagtgtgacctggaagaggaatggagtgagaatcaccagtggcctccacagctttggaagacgcctcaccatcagcaacccgacgtccgcggacaccgggccatacgtctgcgaggcggcgctgccggggagcgcttttgaaccggccagggcgacggcctttcttttcatcatagagccaccatattttactgctgagcccgagagtcggatttcagctgaagtagaagaaactgtggacatcggatgtcaagccatgggggtcccccttcccaccctccagtggtacaaggatgccatctccatcagcaggctccagaatcctcgatacaaagtgctcgccagcggaggcctgcgcatccagaagctgcgtccagaggactccggaatcttccagtgcttcgccagcaatgaaggaggggagatcca

SEQ ID NO: 418690 - DNA, 791 bp, Homo sapiens
taagaagaggaaaactataattaatcataagcaaatgttgttgtcgaatgtatgtttttttcctttttccttccatgcttttaatcagatcatgacggtagatattgacttagcttccctgatgaatacaggtcaggacctgcacacaagggccctgacagcaggcagctactgtatgtatagttggaatataaataatactgccttcatgattattgattgaggaaacgtgatcaaatgggggatgtatgagttgtgcaatgaagatgagcttgaaaaaggtagacattaaatgctggcaatatttcttcaggcttggtctgtacacatgaaaacttaagtagaggaatctgcttccttctaatgaatttgcagccatctcctcagccggagtggttgattcaggcagattctttctgcttgagtggtccaggtaatcgcagaagtgaaacatcactttgcctccttccagaaaccttcagccgcttcccccttaatcgtttctttgaaatgcttagttttcatttctctttttcatcttttaggtcccaccttgttttaaagatacagtcaatataggaggcatgccaagctatcttatccacattcaacacaattataatgaaagtaaaccagctctggaagacagttcccagaaattaattatcgcacagaaagtgaacacaacagccttttgttatcatgataatgaaatcaccaccaccttaatacttgacaaacttggccatgcctctgttgaatttctgctgaataaactggaaaaatgttgc

SEQ ID NO: 418691 - DNA, 874 bp, Homo sapiens
atgggagcactcctgcaaagaaaatcagaagttcaagtcgcatatatgggaagtttcatggatacggaccagaggaaaacagtttctcaaggacgtgcagcgattctaaacctgctgcccatcaccagctaccccagacctcaagtgacttggtttagagaagggcacaagattattccaagcaacagaatagccatcacattggagaatcagctggtgatcctcgccaccacaaccagtgatgccggggcatactacgtgcaggccgtgaatgagaaaaatggagaaaacaagacaagcccattcattcatttgagcatagcaagagatgttggcacacctgaaaccatggccccaaccattgtggttcccccgggcaacagaagtgtggtggctggatccagtgagaccaccttggaatgtatagccagtgccaggcctgtggaggacctgagtgtgacctggaagaggaatggagtgagaatcaccagtggcctccacagctttggaagacgcctcaccatcagcaacccgacgtccgcggacaccgggccatacgtctgcgaggcggcgctgccggggagcgcttttgaaccggccagggcgacggcctttcttttcatcataggtcccaccttgttttaaagatacagtcaatataggaggcatgccaagctatcttatccacattcaacacaattataatgaaagtaaaccagctctggaagacagttcccagaaattaattatcgcacagaaagtgaacacaacagccttttgttatcatgataatgaaatcaccaccaccttaatacttgacaaacttggccatgcctctgttgaatttctgctgaataaactggaaaaatgttgc

SEQ ID NO: 418692 - DNA, 2430 bp, Homo sapiens
atcgcccccgcccgccgcgcagcttccccgagcgagaccaaaacaggtggaatccgggctggagccggagctccggcggcgcgggtggcggcacgtccctccagacagtaccacaggcacctggagtaccggcatcggtcgctgtggcccccgagtgtccgtcagagcctaggggagcctgccctcccgcgcctcgtcggggcccggccaggcaccttggccgccggcgcacggacgcgggcacgagcactagatcacggctgctggacctcggcacgttgacaagatttctctggggtaccgcggaggattactttgaatttcggtggtcgcctgtggtctggcatatttagaacttaagtctattatttcgggcaccatgactttgaggcttttagaagactggtgcagggggatggacatgaaccctcggaaagcgctattgattgccggcatctcccagagctgcagtgtggcagaaatcgaggaggctctgcaggctggtttagctcccttgggggagtacagactgcttggaaggatgttcaggagggatgagaacaggaaagtagccttagtagggcttactgcggagactagtcacgccctggtccctaaggagataccgggaaaagggggtatctggagagtgatctttaagccccctgacccagataatacatttttaagcagattaaatgaatttttagcgggagagggcatgacagtgggtgagttgagcagagctcttggacatgaaaatggctccttagacccagagcagggcatgatcccggaaatgtgggcccctatgttggcacaggcattagaggctcttcagcctgccctgcaatgcttgaagtataaaaagctgagagtgttctcgggcagggagtctccagaaccaggagaagaagaatttggacgctggatgtttcatactactcagatgataaaggcgtggcaggtgccagatgtagagaagagaaggcgattgctagagagccttcgaggcccagcacttgatgttattcgtgtcctcaagataaacaatcctttaattactgtcgatgaatgtctgcaggctcttgaggaggtatttggggttacagataatcctagggagttgcaggtcaaatatctaaccacttaccagaaggatgaggaaaagttgtcggcttatgtactaaggctggagcctttgttacagaagctggtacagagaggagcaattgagagagatgctgtgaatcaggcccgcctagaccaagtcattgctggggcagtccacaaaacaattcgcagagagcttaatctgccagaggatggcccagcccctggtttcttgcagttattggtactaataaaggattatgaggcagctgaggaggaggaggcccttctccaggcaatattggaaggtaatttcacctgagtctcagggaaccacgaagggatatggcaacgagtagagcatgaaggtagaacagtctatatactcttgtgacacatacaatccctaccttgtgctgccaagtaactcatttttgtgcaattctcagtataagccctttgtcgtttctatgcctatttaaagtctcctaaaggtgtaattgactaggaaggatgtagttctacactgccatttacctatttaaattcatccttgtgaatatctttgttgttgttgttgagacagagtctcgctctgtcacccaggctggagtgcagtggcgtgatcttggctcactgcatcctccgccttccaggtttaagctattctcctgcctcagttgcccgagtagctgggactacaggcatgtgccaccacgcccagctaagttttgcattatcagtagagacggggtttcaccatgttggccaggctagtttcgaactcctgacctcaagtgatccacctgcttcggcctctgaaagtgctgggattacaggcgtgagacactgcgcccagcctcatccctgtgaatttcttattgtacacaagttctttcactatctgtgtgcagtgctctgaggggacagacaaggcttgggtgtatatgccaaccagatctcattgaagtatcagcttgtttggtactaggtgcaagtgtagcatgtcacatgtgaccatgttggatcattgacaatttttaggtatgtactgacctacatttatgatgaagatcctgagcggaggttaagatattaagttattttccatatgaatcagaattatattgattctgtgcaatcaaaacaaaaggcagaatagaatgctgagattggttaagtttgcaatgaccatcttgaaccacagatttctgctatgtgtcatcaaaacatctagttctgagtaacattttcacgattgttataaaattataggtgtgaacttctaaaataaaggaatgctaataaaatgacttt

SEQ ID NO: 418693 - DNA, 467 bp, Homo sapiens
tatgtggcttgccagttatcccagcaccatttgttgaaaagggtgtcctttccccactttatgattttgtttgctttgttgaagaagagttggctgtaagtatttgggtttatttctgggttgtttattctgtttcactggtttatgtgcctatttttataccagtaccatgttggatcattgacaatttttaggtatgtactgacctacatttatgatgaagatcctgagcggaggttaagatattaagttattttccatatgaatcagaattatattgattctgtgcaatcaaaacaaaaggcagaatagaatgctgagattggttaagtttgcaatgaccatcttgaaccacagatttctgctatgtgtcatcaaaacatctagttctgagtaacattttcacgattgttataaaattataggtgtgaacttctaaaataaaggaatgctaataaaatgacttt

SEQ ID NO: 418694 - DNA, 2526 bp, Homo sapiens
atcgcccccgcccgccgcgcagcttccccgagcgagaccaaaacaggtggaatccgggctggagccggagctccggcggcgcgggtggcggcacgtccctccaggtgggtggctctctgggtctggcgactcagcgctcctcagccttgccccctggtgcccgctcgcgactgtcatcgccccatcacttctcgttgcagacagtaccacaggcacctggagtaccggcatcggtcgctgtggcccccgagtgtccgtcagagcctaggggagcctgccctcccgcgcctcgtcggggcccggccaggcaccttggccgccggcgcacggacgcgggcacgagcactagatcacggctgctggacctcggcacgttgacaagatttctctggggtaccgcggaggattactttgaatttcggtggtcgcctgtggtctggcatatttagaacttaagtctattatttcgggcaccatgactttgaggcttttagaagactggtgcagggggatggacatgaaccctcggaaagcgctattgattgccggcatctcccagagctgcagtgtggcagaaatcgaggaggctctgcaggctggtttagctcccttgggggagtacagactgcttggaaggatgttcaggagggatgagaacaggaaagtagccttagtagggcttactgcggagactagtcacgccctggtccctaaggagataccgggaaaagggggtatctggagagtgatctttaagccccctgacccagataatacatttttaagcagattaaatgaatttttagcgggagagggcatgacagtgggtgagttgagcagagctcttggacatgaaaatggctccttagacccagagcagggcatgatcccggaaatgtgggcccctatgttggcacaggcattagaggctcttcagcctgccctgcaatgcttgaagtataaaaagctgagagtgttctcgggcagggagtctccagaaccaggagaagaagaatttggacgctggatgtttcatactactcagatgataaaggcgtggcaggtgccagatgtagagaagagaaggcgattgctagagagccttcgaggcccagcacttgatgttattcgtgtcctcaagataaacaatcctttaattactgtcgatgaatgtctgcaggctcttgaggaggtatttggggttacagataatcctagggagttgcaggtcaaatatctaaccacttaccagaaggatgaggaaaagttgtcggcttatgtactaaggctggagcctttgttacagaagctggtacagagaggagcaattgagagagatgctgtgaatcaggcccgcctagaccaagtcattgctggggcagtccacaaaacaattcgcagagagcttaatctgccagaggatggcccagcccctggtttcttgcagttattggtactaataaaggattatgaggcagctgaggaggaggaggcccttctccaggcaatattggaaggtaatttcacctgagtctcagggaaccacgaagggatatggcaacgagtagagcatgaaggtagaacagtctatatactcttgtgacacatacaatccctaccttgtgctgccaagtaactcatttttgtgcaattctcagtataagccctttgtcgtttctatgcctatttaaagtctcctaaaggtgtaattgactaggaaggatgtagttctacactgccatttacctatttaaattcatccttgtgaatatctttgttgttgttgttgagacagagtctcgctctgtcacccaggctggagtgcagtggcgtgatcttggctcactgcatcctccgccttccaggtttaagctattctcctgcctcagttgcccgagtagctgggactacaggcatgtgccaccacgcccagctaagttttgcattatcagtagagacggggtttcaccatgttggccaggctagtttcgaactcctgacctcaagtgatccacctgcttcggcctctgaaagtgctgggattacaggcgtgagacactgcgcccagcctcatccctgtgaatttcttattgtacacaagttctttcactatctgtgtgcagtgctctgaggggacagacaaggcttgggtgtatatgccaaccagatctcattgaagtatcagcttgtttggtactaggtgcaagtgtagcatgtcacatgtgaccatgttggatcattgacaatttttaggtatgtactgacctacatttatgatgaagatcctgagcggaggttaagatattaagttattttccatatgaatcagaattatattgattctgtgcaatcaaaacaaaaggcagaatagaatgctgagattggttaagtttgcaatgaccatcttgaaccacagatttctgctatgtgtcatcaaaacatctagttctgagtaacattttcacgattgttataaaattataggtgtgaacttctaaaataaaggaatgctaataaaatgacttt

SEQ ID NO: 418695 - DNA, 2365 bp, Homo sapiens
atcgcccccgcccgccgcgcagcttccccgagcgagaccaaaacaggtggaatccgggctggagccggagctccggcggcgcgggtggcggcacgtccctccagacagtaccacaggcacctggagtaccggcatcggtcgctgtggcccccgagtgtccgtcagagcctaggggagcctgccctcccgcgcctcgtcggggcccggccaggcaccttggccgccggcgcacggacgcgggcacgagcactagatcacggctgctggacctcggcacgttgacaagatttctctggggtaccgcggaggattactttgaatttcggtggtcgcctgtggtctggcatatttagaacttaagtctattatttcgggcaccatgactttgaggcttttagaagactggtgcagggggatggacatgaaccctcggaaagcgctattgattgccggcatctcccagagctgcagtgtggcagaaatcgaggaggctctgcaggctggtttagctcccttgggggagtacagactgcttggaaggatgttcaggagggatgagaacaggaaagtagccttagtagggcttactgcggagactagtcacgccctggtccctaaggagataccgggaaaagggggtatctggagagtgatctttaagccccctgacccagataatacatttttaagcagattaaatgaatttttagcgggagaggggcatgatcccggaaatgtgggcccctatgttggcacaggcattagaggctcttcagcctgccctgcaatgcttgaagtataaaaagctgagagtgttctcgggcagggagtctccagaaccaggagaagaagaatttggacgctggatgtttcatactactcagatgataaaggcgtggcaggtgccagatgtagagaagagaaggcgattgctagagagccttcgaggcccagcacttgatgttattcgtgtcctcaagataaacaatcctttaattactgtcgatgaatgtctgcaggctcttgaggaggtatttggggttacagataatcctagggagttgcaggtcaaatatctaaccacttaccagaaggatgaggaaaagttgtcggcttatgtactaaggctggagcctttgttacagaagctggtacagagaggagcaattgagagagatgctgtgaatcaggcccgcctagaccaagtcattgctggggcagtccacaaaacaattcgcagagagcttaatctgccagaggatggcccagcccctggtttcttgcagttattggtactaataaaggattatgaggcagctgaggaggaggaggcccttctccaggcaatattggaaggtaatttcacctgagtctcagggaaccacgaagggatatggcaacgagtagagcatgaaggtagaacagtctatatactcttgtgacacatacaatccctaccttgtgctgccaagtaactcatttttgtgcaattctcagtataagccctttgtcgtttctatgcctatttaaagtctcctaaaggtgtaattgactaggaaggatgtagttctacactgccatttacctatttaaattcatccttgtgaatatctttgttgttgttgttgagacagagtctcgctctgtcacccaggctggagtgcagtggcgtgatcttggctcactgcatcctccgccttccaggtttaagctattctcctgcctcagttgcccgagtagctgggactacaggcatgtgccaccacgcccagctaagttttgcattatcagtagagacggggtttcaccatgttggccaggctagtttcgaactcctgacctcaagtgatccacctgcttcggcctctgaaagtgctgggattacaggcgtgagacactgcgcccagcctcatccctgtgaatttcttattgtacacaagttctttcactatctgtgtgcagtgctctgaggggacagacaaggcttgggtgtatatgccaaccagatctcattgaagtatcagcttgtttggtactaggtgcaagtgtagcatgtcacatgtgaccatgttggatcattgacaatttttaggtatgtactgacctacatttatgatgaagatcctgagcggaggttaagatattaagttattttccatatgaatcagaattatattgattctgtgcaatcaaaacaaaaggcagaatagaatgctgagattggttaagtttgcaatgaccatcttgaaccacagatttctgctatgtgtcatcaaaacatctagttctgagtaacattttcacgattgttataaaattataggtgtgaacttctaaaataaaggaatgctaataaaatgacttt

SEQ ID NO: 418696 - DNA, 2257 bp, Homo sapiens
agttcgacggagactctctattcacatgtgggaatagagagtaggtggggagaggcaaaggtgggaggagttaaagtcaagtcaaaggtaacaaaatgtgaagctgatatgtgaagcttgaaatatctcctgcagattgagagggacactaataaagtgtcttttctaatgacctgccagattacagaagtggaagatgaggtcatggaaagcttctcagacataagggagctaaaatcatttatgtgttaaagaagcattctcggccgggcgcggcggctcacgcctgtaatcccaaagtgttgggattacaggcatgaaccaccacgctcggctgtcaagtttttttacttgagcattttaatcagcttattgttattcctgttttaaagatgacaaaccagagactttgagagtctccgtcgaactagttcgacggagactctcagataccgggaaaagggggtatctggagagtgatctttaagccccctgacccagataatacatttttaagcagattaaatgaatttttagcgggagagggcatgacagtgggtgagttgagcagagctcttggacatgaaaatggctccttagacccagagcagggcatgatcccggaaatgtgggcccctatgttggcacaggcattagaggctcttcagcctgccctgcaatgcttgaagtataaaaagctgagagtgttctcgggcagggagtctccagaaccaggagaagaagaatttggacgctggatgtttcatactactcagatgataaaggcgtggcaggtgccagatgtagagaagagaaggcgattgctagagagccttcgaggcccagcacttgatgttattcgtgtcctcaagataaacaatcctttaattactgtcgatgaatgtctgcaggctcttgaggaggtatttggggttacagataatcctagggagttgcaggtcaaatatctaaccacttaccagaaggatgaggaaaagttgtcggcttatgtactaaggctggagcctttgttacagaagctggtacagagaggagcaattgagagagatgctgtgaatcaggcccgcctagaccaagtcattgctggggcagtccacaaaacaattcgcagagagcttaatctgccagaggatggcccagcccctggtttcttgcagttattggtactaataaaggattatgaggcagctgaggaggaggaggcccttctccaggcaatattggaaggtaatttcacctgagtctcagggaaccacgaagggatatggcaacgagtagagcatgaaggtagaacagtctatatactcttgtgacacatacaatccctaccttgtgctgccaagtaactcatttttgtgcaattctcagtataagccctttgtcgtttctatgcctatttaaagtctcctaaaggtgtaattgactaggaaggatgtagttctacactgccatttacctatttaaattcatccttgtgaatatctttgttgttgttgttgagacagagtctcgctctgtcacccaggctggagtgcagtggcgtgatcttggctcactgcatcctccgccttccaggtttaagctattctcctgcctcagttgcccgagtagctgggactacaggcatgtgccaccacgcccagctaagttttgcattatcagtagagacggggtttcaccatgttggccaggctagtttcgaactcctgacctcaagtgatccacctgcttcggcctctgaaagtgctgggattacaggcgtgagacactgcgcccagcctcatccctgtgaatttcttattgtacacaagttctttcactatctgtgtgcagtgctctgaggggacagacaaggcttgggtgtatatgccaaccagatctcattgaagtatcagcttgtttggtactaggtgcaagtgtagcatgtcacatgtgaccatgttggatcattgacaatttttaggtatgtactgacctacatttatgatgaagatcctgagcggaggttaagatattaagttattttccatatgaatcagaattatattgattctgtgcaatcaaaacaaaaggcagaatagaatgctgagattggttaagtttgcaatgaccatcttgaaccacagatttctgctatgtgtcatcaaaacatctagttctgagtaacattttcacgattgttataaaattataggtgtgaacttctaaaataaaggaatgctaataaaatgacttt

SEQ ID NO: 418697 - DNA, 5450 bp, Homo sapiens
ggggagattcgggaccatggcacctgtgcacggcgacgactctctgtcagattcagggagttttgtatcttctcgagcccggcgagaaaaaaaatcaaagaaggggcgccaagaagccctagaaagactgaaaaaggctaaagctggtgagaagtataaatatgaagtcgaggacttcacaggtgtttatgaagaagttgatgaagaacagtattcgaagctggttcaggcacgccaggatgatgactggattgtggatgatgatggtattggctatgtggaagatggccgagagatttttgatgatgaccttgaagatgatgcccttgatgctgatgagaaaggaaaagatggtaaagcacgcaataaagacaagaggaatgtaaagaagctcgcagtgacaaaaccgaacaacattaagtcaatgttcattgcttgtgctggaaagaaaactgcagataaagctgtagacttgtccaaggatggtctgctaggtgacattctacaggatcttaacactgagacacctcaaataactccaccacctgtaatgatactgaagaagaaaagatccattggagcttcaccgaatcctttctctgtgcacaccgccacggcagttccttcaggaaaaattgcttcccctgtctccagaaaggagcctccattaactcctgttcctcttaaacgtgctgaatttgctggcgatgatgtacaggtcgagagtacagaagaagagcaggagtcaggggcaatggagtttgaagatggtgactttgatgagcccatggaagttgaagaggtggacctggagcctatggctgccaaggcttgggacaaagagagtgagccagcagaggaagtgaaacaagaggcggattctgggaaagggaccgtgtcctacttaggaagttttctcccggatgtctcttgttgggacattgatcaagaaggtgatagcagtttctcagtgcaagaagttcaagtggattccagtcacctcccattggtaaaaggggcagatgaggaacaagtattccacttttattggttggatgcttatgaggatcagtacaaccaaccaggtgtggtatttctgtttgggaaagtttggattgaatcagccgagacccatgtgagctgttgtgtcatggtgaaaaatatcgagcgaacgctttacttccttccccgtgaaatgaaaattgatctaaatacggggaaagaaacaggaactccaatttcaatgaaggatgtttatgaggaatttgatgagaaaatagcaacaaaatataaaattatgaagttcaagtctaagccagtggaaaagaactatgcttttgagatacctgatgttccagaaaaatctgagtacttggaagttaaatactcggctgaaatgccacagcttcctcaagatttgaaaggagaaactttttctcatgtatttgggaccaacacatctagcctggaactgttcttgatgaacagaaagatcaaaggaccttgttggcttgaagtaaaaaagtccacagctcttgaatcagccagtcagttggtgtaaagttgaggcaatggctttgaaaccagacctggtgaatgtaattaaggatgtcagtccaccaccgcttgtcgtgatggctttcagcatgaagacaatgcagaatgcaaagaaccatcaaaatgagattattgctatggcagctttggtccatcacagttttgcattggataaagcagccccaaagcctccctttcagtcacacttctgtgttgtgtctaaaccaaaggactgtatttttccatatgctttcaaagaagtcattgagaaaaagaatgtgaaggttgaggttgctgcaacagaaagaacactgctaggttttttccttgcaaaagttcacaaaattgatcctgatatcattgtgggtcataatatttatgggtttgaactggaagtactactgcagagaattaatgtgtgcaaagctcctcactggtccaagataggtcgactgaagcgatccaacatgccaaagcttgggggccggagtggatttggtgaaagaaatgctacctgtggtcgaatgatctgtgatgtggaaatttcagcaaaggaattgattcgttgtaaaagctaccatctgtctgaacttgttcagcagattctaaaaactgaaagggttgtaatcccaatggaaaatatacaaaatatgtacagtgaatcttctcaactgttatacctgttggaacacacctggaaagatgccaagttcattttgcagatcatgtgtgagctaaatgttcttccattagcattgcagatcactaacatcgctgggaacattatgtccaggacgctgatgggtggacgatccgagcgtaacgagttcttgttgcttcatgcattttacgaaaacaactatattgtgcctgacaagcagattttcagaaagcctcagcaaaaactgggagatgaagatgaagaaattgatggagataccaataaatacaagaaaggacgtaagaaaggagcttatgctggaggcttggttttggaccccaaagttggtttttatgataagttcattttgcttctggacttcaacagtctatatccttccatcattcaggaatttaacatttgttttacaacagtacaaagagttgcttcagaggcacagaaagttacagaggatggagaacaagaacagatccctgagttgccagatccaagcttagaaatgggcattttgcccagagagatccggaaactggtagaacggagaaaacaagtcaaacagctaatgaaacagcaagacttaaatccagaccttattcttcagtatgacattcgacagaaggctttgaagctcacagcgaacagtatgtatggttgcctgggattttcctatagcagattttacgccaaaccactggctgccttggtgacatacaaaggaagggagattttgatgcatacgaaagagatggtacaaaagatgaatcttgaagttatttatggagatacagattcaattatgataaacaccaatagcaccaatctggaagaagtatttaagttgggaaacaaggtaaaaagtgaagtgaataagttgtacaaactgcttgaaatagacattgatggggttttcaagtctctgctactgctgaaaaaaaagaagtacgctgctctggttgttgagccaacgtcggatgggaattatgtcaccaaacaggagctcaaaggattagatatagttagaagagattggtgtgatcttgctaaagacactggaaactttgtgattggccagattctttctgatcaaagccgggacactatagtggaaaacattcagaagaggctgatagaaattggagaaaatgtgctaaatggcagtgtcccagtgagccagtttgaaattaacaaggcattgacaaaggatccccaggattaccctgataaaaaaagcctacctcatgtacatgttgccctctggataaattctcaaggaggcagaaaggtgaaagctggagatactgtgtcatatgtcatctgtcaggatggatcaaacctcactgcaagtcagagggcctatgcgcctgagcagctgcagaaacaggataatctaaccattgacacccagtactacctggcccagcagatccacccagtcgtggctcggatctgtgaaccaatagacggaattgatgctgtcctcattgcaacgtggttgggacttgaccccacccaatttagagttcatcattatcataaagatgaagagaatgatgctctacttggtggcccagcacagctcactgatgaagagaaatacagggactgtgaaagattcaaatgtccatgccctacatgtggaactgagaatatttatgataatgtctttgatggttcgggaacagatatggagcccagcttgtatcgttgcagtaacatcgattgtaaggcttcacctctgacctttacagtacaactgagcaacaaattgatcatggacattagacgtttcattaaaaagtactatgatggctggttgatatgtgaagagccaacctgtcgcaatcgaactcgtcaccttccccttcaattctcccgaactgggcctctttgcccagcctgcatgaaagctacacttcaaccagagtattctgacaagtccctgtacacccagctgtgcttttaccggtacatttttgatgcggagtgtgcactggagaaacttactaccgatcatgagaaagataaattgaagaagcaattttttacccccaaagttctgcaggactacagaaaactcaagaacacagcagagcaattcttgtcccgaagtggctactccgaagtgaatctgagcaaactcttcgctggttgtgccgtgaaatcctaagggaatcccaggagtaaccaaggagggggtagttgaaaaatcccagcttcctctgtgcctccactctggccctaaatgctcctccagcatctgtttctcccttgggactgtgtctcatgtttgtgtgaatgtagaccaggaaagggggctgcaaaaatgttgagtctaatgttcgtaagcatcatagaaattcctgtcttcatattaagatgtactgctttaaaacacaactccagagcccctccccaagctcccctccccaagctcctgaagacccggtttctgagggagggaaattgctacttggattgagagtagctggaatgtaagtgaccccaggctttgcctcagggcctttagcctatgtcccccccacataaagagagcttctcagagcctgactgaagagctgacgttttgctttttcatatgccaattaaacccggtctaaatccaaatgcttctccagccatccaggagtggctgtccttttcagtcttgtcttttatataggtagctgagggggaagatttagaagccttgcactcactaaatagattaaacagagcaggcttgtttgttgaattgctccaaagtccaacagacacacactgagcaggtgttttacactcacattccctttttgccccttaaatagaaagtgcaggtaaaggtttatacaacaagaaagcacattgaaaataatttgatactctaacaatccattaacatgtgtaggggttacggtgaggatcactgtgttgtattcagaaaaacggggagagggatgcttaattggccctggcgcttgctatttttttctcatttcttcacaataggaccgtctttggcagcagcaaaatgtatttcagtatggcagtctttcctctcttacattattggtaagattatactaacaaaatgtttccccttgtacaattatgctgtgtttttaaaaaacattgacctgtgtgtttttataaaagaaaaagtatgttgtgccttcttcttaagaataaagttttctaaagggaaaaaaaatgt

SEQ ID NO: 418698 - DNA, 966 bp, Homo sapiens
  misc_feature (6)..(6): n is a, c, g, or t
agactngaagtaaatactcggctgaaatgccacagcttcctcaagatttgaaaggagaaactttttctcatgtatttgggaccaacacatctagcctggaactgttcttgatgaacagaaagatcaaaggaccttgttggcttgaagtaaaaaagtccacagctcttgaatcagccagtcagttggtgtaaagttgaggcaatggctttgaaaccagacctggtgaatgtaattaaggatgtcagtccaccaccgcttgtcgtgatggctttcagcatgaagacaatgcagaatgcaaagaaccatcaaaatgagattattgctatggcagctttggtccatcacagttttgcattggataaagcagccccaaagcctccctttcagtcacacttctgtgttgtgtctaaaccaaaggactgtatttttccatatgctttcaaagaagtcattgagaaaaaggtaaagtgctcattatatgaagcatctgtttgtttggagcgagaaagaaaaggggggtggtatggactagtagaaaaaaggtgttttatattttattagattcattcctgccagattggactatgacatcgacccattaaaatgtattagacatacacctagaagcattatttaacaatgtttaaatgttttactacctgaaaataatgggattctgtactgtattggtggttggataggctcaaacccccctccaatagcttaattagaagcttctctaaaatgcatgatcatatgattcctgttttgggaaggtgttgggtagagtccctccccagcttgagggaagctaaatgaagttgggaatactgtggacgttaaagagccatgtattgacaaagttgacatggggttggccaaaatggatcagtgatctctaaattccagcgtgctccatgaagaagttttcatgggtccttaataaaatggggaggagtgggaagt

SEQ ID NO: 418699 - DNA, 5570 bp, Homo sapiens
tagtggtcatctccacatactgatcatcctgaaagattcactcatatactagccataatatctatctatactaaatttacagatcttcctccaagtcataccctaagaatcaatgtaaaatcacacctattgcagtttctcttttccatactcctttgggccaaacatggggtataatatatatcatttggttttgactccacacctgctgtgtggatgctgtgcattgtctgacacctgtgtgaacagaattctgctgcacttaaaaatagcacaggccaggaaaacatctgagcaggtataaaaggtttttttggtcatggctaaaatattattggccacttttagaaatttgatcccagtattaaattttgtccctgcagatggtattggctatgtggaagatggccgagagatttttgatgatgaccttgaagatgatgcccttgatgctgatgagaaaggaaaagatggtaaagcacgcaataaagacaagaggaatgtaaagaagctcgcagtgacaaaaccgaacaacattaagtcaatgttcattgcttgtgctggaaagaaaactgcagataaagctgtagacttgtccaaggatggtctgctaggtgacattctacaggatcttaacactgagacacctcaaataactccaccacctgtaatgatactgaagaagaaaagatccattggagcttcaccgaatcctttctctgtgcacaccgccacggcagttccttcaggaaaaattgcttcccctgtctccagaaaggagcctccattaactcctgttcctcttaaacgtgctgaatttgctggcgatgatgtacaggtcgagagtacagaagaagagcaggagtcaggggcaatggagtttgaagatggtgactttgatgagcccatggaagttgaagaggtggacctggagcctatggctgccaaggcttgggacaaagagagtgagccagcagaggaagtgaaacaagaggcggattctgggaaagggaccgtgtcctacttaggaagttttctcccggatgtctcttgttgggacattgatcaagaaggtgatagcagtttctcagtgcaagaagttcaagtggattccagtcacctcccattggtaaaaggggcagatgaggaacaagtattccacttttattggttggatgcttatgaggatcagtacaaccaaccaggtgtggtatttctgtttgggaaagtttggattgaatcagccgagacccatgtgagctgttgtgtcatggtgaaaaatatcgagcgaacgctttacttccttccccgtgaaatgaaaattgatctaaatacggggaaagaaacaggaactccaatttcaatgaaggatgtttatgaggaatttgatgagaaaatagcaacaaaatataaaattatgaagttcaagtctaagccagtggaaaagaactatgcttttgagatacctgatgttccagaaaaatctgagtacttggaagttaaatactcggctgaaatgccacagcttcctcaagatttgaaaggagaaactttttctcatgtatttgggaccaacacatctagcctggaactgttcttgatgaacagaaagatcaaaggaccttgttggcttgaagtaaaaaagtccacagctcttgaatcagccagtcagttggtgtaaagttgaggcaatggctttgaaaccagacctggtgaatgtaattaaggatgtcagtccaccaccgcttgtcgtgatggctttcagcatgaagacaatgcagaatgcaaagaaccatcaaaatgagattattgctatggcagctttggtccatcacagttttgcattggataaagcagccccaaagcctccctttcagtcacacttctgtgttgtgtctaaaccaaaggactgtatttttccatatgctttcaaagaagtcattgagaaaaagaatgtgaaggttgaggttgctgcaacagaaagaacactgctaggttttttccttgcaaaagttcacaaaattgatcctgatatcattgtgggtcataatatttatgggtttgaactggaagtactactgcagagaattaatgtgtgcaaagctcctcactggtccaagataggtcgactgaagcgatccaacatgccaaagcttgggggccggagtggatttggtgaaagaaatgctacctgtggtcgaatgatctgtgatgtggaaatttcagcaaaggaattgattcgttgtaaaagctaccatctgtctgaacttgttcagcagattctaaaaactgaaagggttgtaatcccaatggaaaatatacaaaatatgtacagtgaatcttctcaactgttatacctgttggaacacacctggaaagatgccaagttcattttgcagatcatgtgtgagctaaatgttcttccattagcattgcagatcactaacatcgctgggaacattatgtccaggacgctgatgggtggacgatccgagcgtaacgagttcttgttgcttcatgcattttacgaaaacaactatattgtgcctgacaagcagattttcagaaagcctcagcaaaaactgggagatgaagatgaagaaattgatggagataccaataaatacaagaaaggacgtaagaaaggagcttatgctggaggcttggttttggaccccaaagttggtttttatgataagttcattttgcttctggacttcaacagtctatatccttccatcattcaggaatttaacatttgttttacaacagtacaaagagttgcttcagaggcacagaaagttacagaggatggagaacaagaacagatccctgagttgccagatccaagcttagaaatgggcattttgcccagagagatccggaaactggtagaacggagaaaacaagtcaaacagctaatgaaacagcaagacttaaatccagaccttattcttcagtatgacattcgacagaaggctttgaagctcacagcgaacagtatgtatggttgcctgggattttcctatagcagattttacgccaaaccactggctgccttggtgacatacaaaggaagggagattttgatgcatacgaaagagatggtacaaaagatgaatcttgaagttatttatggagatacagattcaattatgataaacaccaatagcaccaatctggaagaagtatttaagttgggaaacaaggtaaaaagtgaagtgaataagttgtacaaactgcttgaaatagacattgatggggttttcaagtctctgctactgctgaaaaaaaagaagtacgctgctctggttgttgagccaacgtcggatgggaattatgtcaccaaacaggagctcaaaggattagatatagttagaagagattggtgtgatcttgctaaagacactggaaactttgtgattggccagattctttctgatcaaagccgggacactatagtggaaaacattcagaagaggctgatagaaattggagaaaatgtgctaaatggcagtgtcccagtgagccagtttgaaattaacaaggcattgacaaaggatccccaggattaccctgataaaaaaagcctacctcatgtacatgttgccctctggataaattctcaaggaggcagaaaggtgaaagctggagatactgtgtcatatgtcatctgtcaggatggatcaaacctcactgcaagtcagagggcctatgcgcctgagcagctgcagaaacaggataatctaaccattgacacccagtactacctggcccagcagatccacccagtcgtggctcggatctgtgaaccaatagacggaattgatgctgtcctcattgcaacgtggttgggacttgaccccacccaatttagagttcatcattatcataaagatgaagagaatgatgctctacttggtggcccagcacagctcactgatgaagagaaatacagggactgtgaaagattcaaatgtccatgccctacatgtggaactgagaatatttatgataatgtctttgatggttcgggaacagatatggagcccagcttgtatcgttgcagtaacatcgattgtaaggcttcacctctgacctttacagtacaactgagcaacaaattgatcatggacattagacgtttcattaaaaagtactatgatggctggttgatatgtgaagagccaacctgtcgcaatcgaactcgtcaccttccccttcaattctcccgaactgggcctctttgcccagcctgcatgaaagctacacttcaaccagagtattctgacaagtccctgtacacccagctgtgcttttaccggtacatttttgatgcggagtgtgcactggagaaacttactaccgatcatgagaaagataaattgaagaagcaattttttacccccaaagttctgcaggactacagaaaactcaagaacacagcagagcaattcttgtcccgaagtggctactccgaagtgaatctgagcaaactcttcgctggttgtgccgtgaaatcctaagggaatcccaggagtaaccaaggagggggtagttgaaaaatcccagcttcctctgtgcctccactctggccctaaatgctcctccagcatctgtttctcccttgggactgtgtctcatgtttgtgtgaatgtagaccaggaaagggggctgcaaaaatgttgagtctaatgttcgtaagcatcatagaaattcctgtcttcatattaagatgtactgctttaaaacacaactccagagcccctccccaagctcccctccccaagctcctgaagacccggtttctgagggagggaaattgctacttggattgagagtagctggaatgtaagtgaccccaggctttgcctcagggcctttagcctatgtcccccccacataaagagagcttctcagagcctgactgaagagctgacgttttgctttttcatatgccaattaaacccggtctaaatccaaatgcttctccagccatccaggagtggctgtccttttcagtcttgtcttttatataggtagctgagggggaagatttagaagccttgcactcactaaatagattaaacagagcaggcttgtttgttgaattgctccaaagtccaacagacacacactgagcaggtgttttacactcacattccctttttgccccttaaatagaaagtgcaggtaaaggtttatacaacaagaaagcacattgaaaataatttgatactctaacaatccattaacatgtgtaggggttacggtgaggatcactgtgttgtattcagaaaaacggggagagggatgcttaattggccctggcgcttgctatttttttctcatttcttcacaataggaccgtctttggcagcagcaaaatgtatttcagtatggcagtctttcctctcttacattattggtaagattatactaacaaaatgtttccccttgtacaattatgctgtgtttttaaaaaacattgacctgtgtgtttttataaaagaaaaagtatgttgtgccttcttcttaagaataaagttttctaaagggaaaaaaaatgt

SEQ ID NO: 418700 - DNA, 2906 bp, Homo sapiens
gacgtggctttttaatttcaggtttttatgataagttcattttgcttctggacttcaacagtctatatccttccatcattcaggaatttaacatttgttttacaacagtacaaagagttgcttcagaggcacagaaagttacagaggatggagaacaagaacagatccctgagttgccagatccaagcttagaaatgggcattttgcccagagagatccggaaactggtagaacggagaaaacaagtcaaacagctaatgaaacagcaagacttaaatccagaccttattcttcagtatgacattcgacagaaggctttgaagctcacagcgaacagtatgtatggttgcctgggattttcctatagcagattttacgccaaaccactggctgccttggtgacatacaaaggaagggagattttgatgcatacgaaagagatggtacaaaagatgaatcttgaagttatttatggagatacagattcaattatgataaacaccaatagcaccaatctggaagaagtatttaagttgggaaacaaggtaaaaagtgaagtgaataagttgtacaaactgcttgaaatagacattgatggggttttcaagtctctgctactgctgaaaaaaaagaagtacgctgctctggttgttgagccaacgtcggatgggaattatgtcaccaaacaggagctcaaaggattagatatagttagaagagattggtgtgatcttgctaaagacactggaaactttgtgattggccagattctttctgatcaaagccgggacactatagtggaaaacattcagaagaggctgatagaaattggagaaaatgtgctaaatggcagtgtcccagtgagccagtttgaaattaacaaggcattgacaaaggatccccaggattaccctgataaaaaaagcctacctcatgtacatgttgccctctggataaattctcaaggaggcagaaaggtgaaagctggagatactgtgtcatatgtcatctgtcaggatggatcaaacctcactgcaagtcagagggcctatgcgcctgagcagctgcagaaacaggataatctaaccattgacacccagtactacctggcccagcagatccacccagtcgtggctcggatctgtgaaccaatagacggaattgatgctgtcctcattgcaacgtggttgggacttgaccccacccaatttagagttcatcattatcataaagatgaagagaatgatgctctacttggtggcccagcacagctcactgatgaagagaaatacagggactgtgaaagattcaaatgtccatgccctacatgtggaactgagaatatttatgataatgtctttgatggttcgggaacagatatggagcccagcttgtatcgttgcagtaacatcgattgtaaggcttcacctctgacctttacagtacaactgagcaacaaattgatcatggacattagacgtttcattaaaaagtactatgatggctggttgatatgtgaagagccaacctgtcgcaatcgaactcgtcaccttccccttcaattctcccgaactgggcctctttgcccagcctgcatgaaagctacacttcaaccagagtattctgacaagtccctgtacacccagctgtgcttttaccggtacatttttgatgcggagtgtgcactggagaaacttactaccgatcatgagaaagataaattgaagaagcaattttttacccccaaagttctgcaggactacagaaaactcaagaacacagcagagcaattcttgtcccgaagtggctactccgaagtgaatctgagcaaactcttcgctggttgtgccgtgaaatcctaagggaatcccaggagtaaccaaggagggggtagttgaaaaatcccagcttcctctgtgcctccactctggccctaaatgctcctccagcatctgtttctcccttgggactgtgtctcatgtttgtgtgaatgtagaccaggaaagggggctgcaaaaatgttgagtctaatgttcgtaagcatcatagaaattcctgtcttcatattaagatgtactgctttaaaacacaactccagagcccctccccaagctcccctccccaagctcctgaagacccggtttctgagggagggaaattgctacttggattgagagtagctggaatgtaagtgaccccaggctttgcctcagggcctttagcctatgtcccccccacataaagagagcttctcagagcctgactgaagagctgacgttttgctttttcatatgccaattaaacccggtctaaatccaaatgcttctccagccatccaggagtggctgtccttttcagtcttgtcttttatataggtagctgagggggaagatttagaagccttgcactcactaaatagattaaacagagcaggcttgtttgttgaattgctccaaagtccaacagacacacactgagcaggtgttttacactcacattccctttttgccccttaaatagaaagtgcaggtaaaggtttatacaacaagaaagcacattgaaaataatttgatactctaacaatccattaacatgtgtaggggttacggtgaggatcactgtgttgtattcagaaaaacggggagagggatgcttaattggccctggcgcttgctatttttttctcatttcttcacaataggaccgtctttggcagcagcaaaatgtatttcagtatggcagtctttcctctcttacattattggtaagattatactaacaaaatgtttccccttgtacaattatgctgtgtttttaaaaaacattgacctgtgtgtttttataaaagaaaaagtatgttgtgccttcttcttaagaataaagttttctaaagggaaaaaaaatgt

SEQ ID NO: 418701 - DNA, 4647 bp, Homo sapiens
ggggagattcgggaccatggcacctgtgcacggcgacgactctctgtcagattcagggagttttgtatcttctcgagcccggcgagaaaaaaaatcaaagaaggggcgccaagaagccctagaaagactgaaaaaggctaaagctggtgagaagtataaatatgaagtcgaggacttcacaggtgtttatgaagaagttgatgaagaacagtattcgaagctggttcaggcacgccaggatgatgactggattgtggatgatgatggtattggctatgtggaagatggccgagagatttttgatgatgaccttgaagatgatgcccttgatgctgatgagaaaggaaaagatggtaaagcacgcaataaagacaagaggaatgtaaagaagctcgcagtgacaaaaccgaacaacattaagtcaatgttcattgcttgtgctggaaagaaaactgcagataaagctgtagacttgtccaaggatggtctgctaggtgacattctacaggatcttaacactgagacacctcaaataactccaccacctgtaatgatactgaagaagaaaagatccattggagcttcaccgaatcctttctctgtgcacaccgccacggcagttccttcaggaaaaattgcttcccctgtctccagaaaggagcctccattaactcctgttcctcttaaacgtgctgaatttgctggcgatgatgtacaggtcgagagtacagaagaagagcaggagtcaggggcaatggagtttgaagatggtgactttgatgagcccatggaagttgaagaggtggacctggagcctatggctgccaaggcttgggacaaagagagtgagccagcagaggaagtgaaacaagaggcggattctgggaaagggaccgtgtcctacttaggaagttttctcccggatgtctcttgttgggacattgatcaagaaggtgatagcagtttctcagtgcaagaagttcaagtggattccagtcacctcccattggtaaaaggggcagatgaggaacaagtattccacttttattggttggatgcttatgaggatcagtacaaccaaccaggtgtggtatttctgtttgggaaagtttggattgaatcagccgagacccatgtgagctgttgtgtcatggtgaaaaatatcgagcgaacgctttacttccttccccgtgaaatgaaaattgatctaaatacggggaaagaaacaggaactccaatttcaatgaaggatgtttatgaggaatttgatgagaaaatagcaacaaaatataaaattatgaagttcaagtctaagccagtggaaaagaactatgcttttgagatacctgatgttccagaaaaatctgagtacttggaagttaaatactcggctgaaatgccacagcttcctcaagatttgaaaggagaaactttttctcatgtatttgggaccaacacatctagcctggaactgttcttgatgaacagaaagatcaaaggaccttgttggcttgaagtaaaaaagtccacagctcttgaatcagccagtcagttggtgtaaagttgaggcaatggctttgaaaccagacctggtgaatgtaattaaggatgtcagtccaccaccgcttgtcgtgatggctttcagcatgaagacaatgcagaatgcaaagaaccatcaaaatgagattattgctatggcagctttggtccatcacagttttgcattggataaagcagccccaaagcctccctttcagtcacacttctgtgttgtgtctaaaccaaaggactgtatttttccatatgctttcaaagaagtcattgagaaaaagaatgtgaaggttgaggttgctgcaacagaaagaacactgctaggttttttccttgcaaaagttcacaaaattgatcctgatatcattgtgggtcataatatttatgggtttgaactggaagtactactgcagagaattaatgtgtgcaaagctcctcactggtccaagataggtcgactgaagcgatccaacatgccaaagcttgggggccggagtggatttggtgaaagaaatgctacctgtggtcgaatgatctgtgatgtggaaatttcagcaaaggaattgattcgttgtaaaagctaccatctgtctgaacttgttcagcagattctaaaaactgaaagggttgtaatcccaatggaaaatatacaaaatatgtacagtgaatcttctcaactgttatacctgttggaacacacctggaaagatgccaagttcattttgcagatcatgtgtgagctaaatgttcttccattagcattgcagatcactaacatcgctgggaacattatgtccaggacgctgatgggtggacgatccgagcgtaacgagttcttgttgcttcatgcattttacgaaaacaactatattgtgcctgacaagcagattttcagaaagcctcagcaaaaactgggagatgaagatgaagaaattgatggagataccaataaatacaagaaaggacgtaagaaaggagcttatgctggaggcttggttttggaccccaaagttggtttttatgataagttcattttgcttctggacttcaacagtctatatccttccatcattcaggaatttaacatttgttttacaacagtacaaagagttgcttcagaggcacagaaagttacagaggatggagaacaagaacagatccctgagttgccagatccaagcttagaaatgggcattttgcccagagagatccggaaactggtagaacggagaaaacaagtcaaacagctaatgaaacagcaagacttaaatccagaccttattcttcagtatgacattcgacagaaggctttgaagctcacagcgaacagtatgtatggttgcctgggattttcctatagcagattttacgccaaaccactggctgccttggtgacatacaaaggaagggagattttgatgcatacgaaagagatggtacaaaagatgaatcttgaagttatttatggagatacagattcaattatgataaacaccaatagcaccaatctggaagaagtatttaagttgggaaacaaggtaaaaagtgaagtgaataagttgtacaaactgcttgaaatagacattgatggggttttcaagtctctgctactgctgaaaaaaaagaagtacgctgctctggttgttgagccaacgtcggatgggaattatgtcaccaaacaggagctcaaaggattagatatagttagaagagattggtgtgatcttgctaaagacactggaaactttgtgattggccagattctttctgatcaaagccgggacactatagtggaaaacattcagaagaggctgatagaaattggagaaaatgtgctaaatggcagtgtcccagtgagccagtttgaaattaacaaggcattgacaaaggatccccaggattaccctgataaaaaaagcctacctcatgtacatgttgccctctggataaattctcaaggaggcagaaaggtgaaagctggagatactgtgtcatatgtcatctgtcaggatggatcaaacctcactgcaagtcagagggcctatgcgcctgagcagctgcagaaacaggataatctaaccattgacacccagtactacctggcccagcagatccacccagtcgtggctcggatctgtgaaccaatagacggaattgatgctgtcctcattgcaacgtggttgggacttgaccccacccaatttagagttcatcattatcataaagatgaagagaatgatgctctacttggtggcccagcacagctcactgatgaagagaaatacagggactgtgaaagattcaaatgtccatgccctacatgtggaactgagaatatttatgataatgtctttgatggttcggttagttgtttctgtctttcattttgtgagtgaacttgtataaaggccttacccccttcccccactatggggtatataaaaagggcgaaataaacacacacatgttgctttcatgtgtttaaagaattttagcatcatgtgaaatctaccttcacagcttgcttttatttctgtttgaaaactcttacttgaatgtgcttgaatattgttttggcttcctagagtgcttgaccttggtttttaagtggaatcccttaaaaattctaaattatcttaaagtatttttattataatttcttaattagtaacctgtattgtcccactgtcaacccccatctattaagacttagaccaatatttttccttatcttaaatcaagttactgggaactaagtgttttgggaaagtttgtgtttgtctttacacatcccacttacctccattttgcaaaggtactcttatcttttctgctgtctttgcatattagacatttaaaaagtcacagggagacattcctttcaagaagtactgccaaaaaatgtattattgaccttggatcagagcttgaaacttggccaatttacttgatttccactgcagtgttatgcatgtactagccattggcaaaggaataggcagcagaactgtgtaaaaccttgaaactgaaagaaaagacgccctttatctaaattaaaagtaattattttaagttaatttggacaaacagcagatg

SEQ ID NO: 418702 - DNA, 295 bp, Homo sapiens
ctttgtgattggccagattctttctgatcaaagccgggacactatagtggaaaacattcagaagaggctgatagaaattggagaaaatgtgctaaatggcagtgtcccagtgagccagtttgaaattaacaaggtaaatgtagcatttattgctgagcccagctgctgtcatgtgtttttcacctccttcagatagttgaagaaccacctcatccttgcaattgaaataaattctagctggtgatgaaagctgcttaacaactatctcacagattgagtattagcatacctcttc

SEQ ID NO: 418703 - DNA, 490 bp, Homo sapiens
tgaatcttctcaactgttatacctgttggaacacacctggaaagatgccaagttcattttgcagatcatgtgtgagctaaatgttcttccattagcattgcagatcactaacatcgctgggaacattatggtaaatttaacttagaaagggggaaaaagcatttcctgttggattcagtgtttgcttggggtagttgttatatgataatgagtctaaatgcatgcttataaaatgagtaacttggattctgaaagctggatttcttttgtaaaaggaagaactggttgggagaaggggaggaatgccaggtgcagcgtgttgaaatttgggtgaacatacggatcatctctctaacatctggatgtgtctttttagtggaatggtccatttgggagtaaataaatagccaagttgtcaatattttaagctctctttgtctcctttagctataatgcttaaagaaaacgttaggaataatttagtaccttt

SEQ ID NO: 418704 - DNA, 1622 bp, Homo sapiens
ggcgggaagccagtggggcgttgtttcgtccgatatccgcgtttcagtctccgcccatacccctccgggttaggcggctgtagcggagctcgaaaagagtggcgcagggtcgcgcggccccgcctccttccccgcccagcgaagctctctgaccacccctcttttctagagttctgcctcgcttcccggcgcggtcgcagccctcagcccacttaggataatggcgacagctgaggtactgaacattggtaaaaaattatatgagggtaaaacaaaagaagtctacgaattgttagacagtccaggaaaagtcctcctgcagtccaaggaccagattacagcaggaaatgcagctagaaaaaaccacctggaaggaaaagctgcaatctcaaataaaatcaccagttgtatttttcagttattacaggaagcaggtattaaaactgccttcaccagaaaatgtggggagacagctttcattgcaccgcagtgtgaaatgattccaattgaatgggtttgcagaagaatagcaactggttcttttctcaaaagaaatcctggtgtcaaggaaggatataagttttacccacctaaagtggagttgtttttcaaggatgatgccaataatgacccacagtggtctgaggaacagctgattgctgcaaaattttgctttgctggacttcttataggccagactgaagtggatatcatgagtcatgctacacaggctatatttgaaatactggagaaatcctggttgccccagaattgtacactggttgatatgaagattgaatttggtgttgatgtaaccaccaaagaaattgttcttgctgatgttattgacaatgattcctggagactctggccatcaggagatcgaagccaacagaaagacaaacagtcttatcgggacctcaaagaagtaactcctgaagggctccaaatggtaaagaaaaactttgagtgggttgcagagagagtagagttgcttttgaaatcagaaagtcagtgcagggttgtagtgttgatgggctctacttctgatcttggtcactgtgaaaaaatcaagaaggcctgtggaaattttggcattccatgtgaacttcgagtaacatctgcgcataaaggaccagatgaaactctgaggattaaagctgagtatgaaggggatggcattcctactgtatttgtggcagtggcaggcagaagtaatggtttgggaccagtgatgtctgggaacactgcatatccagttatcagctgtcctcccctcacaccagactggggagttcaggatgtgtggtcttctcttcgactacccagtggtcttggctgttcaaccgtactttctccagaaggatcagctcaatttgctgctcagatatttgggttaagcaaccatttggtatggagcaaactgcgagcaagcattttgaacacatggatttccttgaagcaggctgacaagaaaatcagagaatgtaatttataagaaagaatgccattgaattttttaggggaaaaactacaaatttctaatttagctgaaggaaaatcaagcaagatgaaaaggtaattttaaattagagaacacaaataaaatgtattagtgaata

SEQ ID NO: 418705 - DNA, 645 bp, Homo sapiens
gctgtccatgaaaccttctgtaaccacagtgactacaagtagttctttctctattgaattattaggtccagaatagaacccctgtctctactaaaaatacaaaaagtagccagccgtgatgacaggcacctgtaatcccagctactcgggaggctgaggcatgagaattgcttgaacccgggaggcggaggttgcagtgagcctggatcatgccactgcactccaacctgggcagcagagcaagactctgtctcaaaaggggaaaaaaaaaattgctgatgtgacccatgaagggaactcattttcctcgtaattttggactgccacacattggtacctttagttctctgaaggcccacgtttttatcattaagacctatttgttagctagtagagctttatgttcgctgtccatgaaaccttctgtaaccacagtgactacaagtagttctttctctattgaattattaggtccagaatagaagatgtcattgtacactttatttccctcacactgtgttatgctctgatgtgctatgcttagctatctgtcagagattagtaaattataaaactcatgtgtactacttaagtttatatcttatgctagtttataagaacaattaaaaggacttagaagattaa

SEQ ID NO: 418706 - DNA, 1008 bp, Homo sapiens
aaaacttaggctagtacgaggctgggtgtgctggagtgcagtggcgtgatctcagttcactgctgctttccctcctgggctcaagcagttctcccacctcagcctctcgactaacagggactataatcttgcagcaccatgccgagctaattttattttttgtagagatgagctctcactatgtcacccaggttcgtctcaaactcctgaaccctagtaattctcctatctcagcctcccaaagtgctagggttacagacatgagccactgtgcctgtctagacttgtactttcaactgtccatttctccctgtctgtcccatgggcactcatgaaaaaacagaatgctcccaactttattcatcttccaagcctgtagctcttggtatactcactgttgcaagtcagaagcttgatttcatcattgatgtttttctcacgtttcacatctcactcatcaccaagtcatgttggtgttaatttctgattaacccttgaatttaccgtcttctcatcctctgtacaaaagcctcaagtgagggtcaaattcaacattatcctgatctagacagcccccattctcaatccacccttttccaagttgattgcccaaggacttctaacaataaactctcttttgcaccacagacttctttgaaaatatacatgctgttgaccctctctgtagaaaaccgcacacataaaacttaccaacagatttcattggttcttgggttctcccgaagcctatccatggtttatagattaagaattgatgaggtagctgggcacagtggctcacacctacgatcacagcacttcgggaggctgaagcaagcagatcacttgaggtcaggagtttgagaccagcctggccaacatggtgaaagaccgttttttaaattcaagtgcgcggtgcaggccgtatcccttcggggggggggaagggacccgggggggggggcgtttccggcccggcgggcctccgggaaggggcccggcccttgc

SEQ ID NO: 418707 - DNA, 1536 bp, Homo sapiens
tcccaataatacagtttttaaccttttatgataaagacatgcttagaattgctgttaagctttctgagatttaaccactgaaactaagtaaaagacaaagcacttaggtaaagcttcattcagtatccattcacccaatactggtttgattctagggcctaggaaaataggactgagcaaagcccttgtccagatggaacttatgttttagaggggaaaacaaaccataaaaaggtaaacagtataaaatcaggaaaggataaatgtatatgaagaatcaaaatgaggacggtgatggggataagaggggaaggtttttgaggagagcagagcaatgatgtaaaagcaagacacacagatagggaaatagctttccatactaagggaatgggaaataaagctgagttttgccttgaggacctccaaacatgagaattgctagagctctgtgaacaaggatgagagtggaagacaatataagcaaaggctacatcacttagggcctataggccacactgaagtgtgacaggaaaaactcagtttgagcagaggcttgacatacttaacatatttaaaggttctctggctgttgtgtggacaagaggagaagcagagattagttaagaggctattgtagcccaggtgagggatgatgtatgatcttcaacatgtctaatttttttgtgcctcaatttcatgaaatgaaaatgcgactaataccacctcataaagttgtgagaattacatgagtcaatatatgtaaggcccatcatggcacacaaatgtgttatgtaatatccatttggcagactgaagaacaacagtatgaatggaattcattcaccatgagaattacctggaattctctgggcatggtggctcatgcctgtaatcccagcactttgggtggccgaggcaagcagatcacttgaggtcaggagtttgagaccagcctggccaacatggtgaaaccctgtctctactaaaaatacaaaaagtagccagtcgtgatgacaggcacctgtaatcccagctactcgggaggctgaggcatgagaattgcttgaacccgggaggcggaggttgcagtgagcctggatcgtgccactgcactccaacctgggcagcagagcaagactctgtctcaaaaggggaaaaaaaaaattgctgatgtgacccatgaagggaactcattttcctcgtaattttggactgccacacattggtacctttagttctctgaaggcccacgtttttatcattaagacctatttgttagctagtagagctttatgttcgctgtccatgaaaccttctgtaaccacagtgactacaagtagttctttctctattgaattattaggtccagaatagaagatgtcattgtacactttatttccctcacactgtgttatgctctgatgtgctatgcttagctatctgtcagagattagtaaattataaaactcatgtgtactacttaagtttatatcttatgctagtttataagaacaattaaaaggacttagaagatta

SEQ ID NO: 418708 - DNA, 417 bp, Homo sapiens
ttagaataatgcagtagctttttattttctgtggcaggactgctctgagtataaaattttttgtaaggttgtattttcattactaattgagctcaattttctgtcttttccttgctgaaccaataggtcttggctgttcaaccgtactttctccagaaggatcagctcaatttgctgctcagatatttgggttaagcaaccatttggtatggagcaaactgcgagcaagcattttgaacacatggatttccttgaagcaggctgacaagaaaatcagagaatgtaatttataagaaagaatgccattgaattttttaggggaaaaactacaaatttctaatttagctgaaggaaaatcaagcaagatgaaaaggtaattttaaattagagaacacaaataaaatgtattagtgaata

SEQ ID NO: 418709 - DNA, 830 bp, Homo sapiens
aggatccccagaatgtgtaaccacgaccatgaagggaactcattttcctcgtaattttggactgccacacattggtacctttagttctctgaaggcccacgtttttatcattaagacctatttgttagctagtagagctttatgttcgctgtccatgaaaccttctgtaaccacagtgactacaagtagttctttctctattgaattattaggtccagaatagaagatgtcattgtacactttatttccctcacactgtgttatgctctgatgtgctatgcttagctatctgtcagagattagtaaattataaaactcatgtgtactacttaagtttatatcttatgctagtttataagaacaattaaaaggacttagaagattaaactttggtttcatggtctctgaagtcactgactgctatttcagcttgtttacccttacctagcattaagactccatctacttctgtgcagtatatgaaaatttttaaactttcatttagactggtggataggactgaccattacaaattgtcgttatcaattttttttcctttttttttttaagagccaagttctcactgtctcccaggctggagtgcagtggcatgattatggctccctgcagccttgaactcctggactcaagctgcagcctctcgagtagctgggtgcatgtgctaccacacccaattatgaatttcatcattagtttcttagtagagtccacatgtcctcagtagtaagttcatcagtgctaaatatttgaaggtatttctactgttttgtaaaagtaacttaagcctacctggtctgctatcttttgag

SEQ ID NO: 418710 - DNA, 868 bp, Homo sapiens
tgtacatggaagcttctcaggctaaatccattaatataaaaatacattgtggatactgatgagatggctaattctgtcaacttgactaggctacgggatgccttgatagctggtcaaacaacatttctaggtacatctgtgatggtgtttctggaagagactagcacttgaatcagtagacttgagtaaagaagactgccttcacccatgtgggtgagcgtcatctaatccattgagggcctgaatagaacaaaaaaggggaagaagggtgaactgctgggacatccatttcgtgcccccagatgttggtgctcctggtcctcaggccttcagactaggacttaacgttattgcctcccctgattctcaagccctcgggtttggaactacactggctttcctgggccttcagcctgcagaaggcagactgtgggacttcacctccattttgcagagccaatttctcataatctgtacatatcctattggttctgtattttttagagaacaaatacagcctattatgtatatataagaccctgggaatgcaaagatgaacaaaattaaccttctgctctcaatgaatcttggaagtctccagaggcagacaatttcaaaacaccgtatatagtcttaatatggaattaacaatagggtattgtgaatacacaaaagtaggaaggactctgatctctagaaaacaattgtatactgtgaatgaaaaagactaattctccacagtctatactcaatctctcttacctttccataattttcttcagcaaacttattaccaccaaacatagtacatgtttatttattacccatctctcccaactagaaaataaatgtattacactgggatgtc

SEQ ID NO: 418711 - DNA, 387 bp, Homo sapiens
tgagatggagtctccctctgttgcttaggctagagtgcagtggcgctctctcagctcactgcaacctccacctcccgggtttaaatgattctcctgcctcagcctcccaagtagctgggattacaggtgcacaccaccacacccagctaattttttgtaattttagtagacagggtttcactgtgttggccaggctggtgagtcatgctacacaggctatatttgaaatactggagaaatcctggttgccccagaattgtacactggttgatatgaaggtacagataaaacaagtacagataaaacaacaggatttgaaagtaaaggttatagttgagagatgctttcataaaatagtttttgaaaactttgttgacatgctgtttc

SEQ ID NO: 418712 - DNA, 3321 bp, Homo sapiens
ggcgggaagccagtggggcgttgtttcgtccgatatccgcgtttcagtctccgcccatacccctccgggttaggcggctgtagcggagctcgaaaagagtggcgcagggtcgcgcggccccgcctccttccccgcccagcgaagctctctgaccacccctcttttctagagttctgcctcgcttcccggcgcggtcgcagccctcagcccacttaggataatggcgacagctgaggtactgaacattggtaaaaaattatatgagggtaaaacaaaagaagtctacgaattgttagacagtccaggaaaagtcctcctgcagtccaaggaccagattacagcaggaaatgcagctagaaaaaaccacctggaaggaaaagctgcaatctcaaataaaatcaccagttgtatttttcagttattacaggaagcaggtattaaaactgccttcaccagaaaatgtggggagacagctttcattgcaccgcagtgtgaaatgattccaattgaatgggtttgcagaagaatagcaactggttcttttctcaaaagaaatcctggtgtcaaggaaggatataagttttacccacctaaagtggagttgtttttcaaggatgatgccaataatgacccacagtggtctgaggaacagctgattgctgcaaaattttgctttgctggacttcttataggccagactgaagtggatatcatgagtcatgctacacaggctatatttgaaatactggagaaatcctggttgccccagaattgtacactggttgatatgaagattgaatttggtgttgatgtaaccaccaaagaaattgttcttgctgatgttattgacaatgattcctggagactctggccatcaggagatcgaagccaacagaaagacaaacagtcttatcgggacctcaaagaagtaactcctgaagggctccaaatggtaaagaaaaactttgagtgggttgcagagagagtagagttgcttttgaaatcagaaagtcagtgcagggttgtagtgttgatgggctctacttctgatcttggtcactgtgaaaaaatcaagaaggcctgtggaaattttggcattccatgtgaacttcgagtaacatctgcgcataaaggaccagatgaaactctgaggattaaagctgagtatgaaggggatggcattcctactgtatttgtggcagtggcaggcagaagtaatggtttgggaccagtgatgtctgggaacactgcatatccagttatcagctgtcctcccctcacaccagactggggagttcaggatgtgtggtcttctcttcgactacccagtggtcttggctgttcaaccgtactttctccagaaggatcagctcaatttgctgctcagatatttgggttaagcaaccatttggtatggagcaaactgcgagcaagcattttgaacacatggatttccttgaagcaggctgacaagaaaatcagagaatgtaatttataagaaagaatgccattgaattttttaggggaaaaactacaaatttctaatttagctgaaggaaaatcaagcaagatgaaaaggtaattttaaattagagaacacaaataaaatgtattagtgaataaatgcttctctagatccatattaataaacatgagcatctaacccctcctttcttaggctagacaccaagatatttcagccagcctttatcattcctcttactttatcctttttccttaagtattggtggtcactactattgagtttcttccttaacactgattaaatgatcttaactccctcagctaaaactggcattactgactcccagctatatttctccagacttgcatttttttttttttttttgagacagggtctcactgtcgcccaggctggagtgcagtggcgtgatctcagttcactgctgctttccctcctgggctcaagcagttctcccacctcagcctctcgactaacagggactataatcttgcagcaccatgccgagctaattttattttttgtagagatgagctctcactatgtcacccaggttcgtctcaaactcctgaaccctagtaattctcctatctcagcctcccaaagtgctagggttacagacatgagccactgtgcctgtctagacttgtactttcaactgtccatttctccctgtctgtcccatgggcactcatgaaaaaacagaatgctcccaactttattcatcttccaagcctgtagctcttggtatactcactgttgcaagtcagaagcttgatttcatcattgatgtttttctcacgtttcacatctcactcatcaccaagtcatgttggtgttaatttctgattaacccttgaatttaccgtcttctcatcctctgtacaaaagcctcaagtgagggtcaaattcaacattatcctgatctagacagcccccattctcaatccacccttttccaagttgattgcccaaggacttctaacaataaactctcttttgcaccacagacttctttgaaaatatacatgctgttgaccctctctgtagaaaaccgcacacataaaacttaccaacagatttcattggttcttgggttctcccgaagcctatccatggtttatagattaagaattgatgaggtagctgggcacagtggctcacacctacgatcacagcacttcgggaggctgaagcaagcagatcacttgaggtcaggagtttgagaccagcctggccaacatggtgaaaccctgtctctactaaaaatacaaaaagtagccagccgtgatgacaggcacctgtaatcccagctactcgggaggctgaggcatgagaattgcttgaacccgggaggcggaggttgcagtgagcctggatcatgccactgcactccaacctgggcagcagagcaagactctgtctcaaaaggggaaaaaaaaaattgctgatgtgacccatgaagggaactcattttcctcgtaattttggactgccacacattggtacctttagttctctgaaggcccacgtttttatcattaagacctatttgttagctagtagagctttatgttcgctgtccatgaaaccttctgtaaccacagtgactacaagtagttctttctctattgaattattaggtccagaatagaagatgtcattgtacactttatttccctcacactgtgttatgctctgatgtgctatgcttagctatctgtcagagattagtaaattataaaactcatgtgtactacttaagtttatatcttatgctagtttataagaacaattaaaaggacttagaagattaa

SEQ ID NO: 418713 - DNA, 3792 bp, Homo sapiens
ggcgggaagccagtggggcgttgtttcgtccgatatccgcgtttcagtctccgcccatacccctccgggttaggcggctgtagcggagctcgaaaagagtggcgcagggtcgcgcggccccgcctccttccccgcccagcgaagctctctgaccacccctcttttctagagttctgcctcgcttcccggcgcggtcgcagccctcagcccacttaggataatggcgacagctgaggtactgaacattggtaaaaaattatatgagggtaaaacaaaagaagtctacgaattgttagacagtccaggaaaagtcctcctgcagtccaaggaccagattacagcaggaaatgcagctagaaaaaaccacctggaaggaaaagctgcaatctcaaataaaatcaccagttgtatttttcagttattacaggaagcaggtattaaaactgccttcaccagaaaatgtggggagacagctttcattgcaccgcagtgtgaaatgattccaattgaatgggtttgcagaagaatagcaactggttcttttctcaaaagaaatcctggtgtcaaggaaggatataagttttacccacctaaagtggagttgtttttcaaggatgatgccaataatgacccacagtggtctgaggaacagctgattgctgcaaaattttgctttgctggacttcttataggccagactgaagtggatatcatgagtcatgctacacaggctatatttgaaatactggagaaatcctggttgccccagaattgtacactggttgatatgaagattgaatttggtgttgatgtaaccaccaaagaaattgttcttgctgatgttattgacaatgattcctggagactctggccatcaggagatcgaagccaacagaaagacaaacagtcttatcgggacctcaaagaagtaactcctgaagggctccaaatggtaaagaaaaactttgagtgggttgcagagagagtagagttgcttttgaaatcagaaagtcagtgcagggttgtagtgttgatgggctctacttctgatcttggtcactgtgaaaaaatcaagaaggcctgtggaaattttggcattccatgtgaacttcgagtaacatctgcgcataaaggaccagatgaaactctgaggattaaagctgagtatgaaggggatggcattcctactgtatttgtggcagtggcaggcagaagtaatggtttgggaccagtgatgtctgggaacactgcatatccagttatcagctgtcctcccctcacaccagactggggagttcaggatgtgtggtcttctcttcgactacccagtggtcttggctgttcaaccgtactttctccagaaggatcagctcaatttgctgctcagatatttgggttaagcaaccatttggtatggagcaaactgcgagcaagcattttgaacacatggatttccttgaagcaggctgacaagaaaatcagagaatgtaatttataagaaagaatgccattgaattttttaggggaaaaactacaaatttctaatttagctgaaggaaaatcaagcaagatgaaaaggtaattttaaattagagaacacaaataaaatgtattagtgaataaatgcttctctagatccatattaataaacatgagcatctaacccctcctttcttaggctagacaccaagatatttcagccagcctttatcattcctcttactttatcctttttccttaagtattggtggtcactactattgagtttcttccttaacactgattaaatgatcttaactccctcagctaaaactggcattactgactcccagctatatttctccagacttgcatttttttttttttttttgagacagggtctcactgtcgcccaggctggagtgcagtggcgtgatctcagttcactgctgctttccctcctgggctcaagcagttctcccacctcagcctctcgactaacagggactataatcttgcagcaccatgccgagctaattttattttttgtagagatgagctctcactatgtcacccaggttcgtctcaaactcctgaaccctagtaattctcctatctcagcctcccaaagtgctagggttacagacatgagccactgtgcctgtctagacttgtactttcaactgtccatttctccctgtctgtcccatgggcactcatgaaaaaacagaatgctcccaactttattcatcttccaagcctgtagctcttggtatactcactgttgcaagtcagaagcttgatttcatcattgatgtttttctcacgtttcacatctcactcatcaccaagtcatgttggtgttaatttctgattaacccttgaatttaccgtcttctcatcctctgtacaaaagcctcaagtgagggtcaaattcaacattatcctgatctagacagcccccattctcaatccacccttttccaagttgattgcccaaggacttctaacaataaactctcttttgcaccacagacttctttgaaaatatacatgctgttgaccctctctgtagaaaaccgcacacataaaacttaccaacagatttcattggttcttgggttctcccgaagcctatccatggtttatagattaagaattgatgaggtagctgggcacagtggctcacacctacgatcacagcacttcgggaggctgaagcaagcagatcacttgaggtcaggagtttgagaccagcctggccaacatggtgaaaccctgtctctactaaaaatacaaaaagtagccagccgtgatgacaggcacctgtaatcccagctactcgggaggctgaggcatgagaattgcttgaacccgggaggcggaggttgcagtgagcctggatcatgccactgcactccaacctgggcagcagagcaagactctgtctcaaaaggggaaaaaaaaaattgctgatgtgacccatgaagggaactcattttcctcgtaattttggactgccacacattggtacctttagttctctgaaggcccacgtttttatcattaagacctatttgttagctagtagagctttatgttcgctgtccatgaaaccttctgtaaccacagtgactacaagtagttctttctctattgaattattaggtccagaatagaagatgtcattgtacactttatttccctcacactgtgttatgctctgatgtgctatgcttagctatctgtcagagattagtaaattataaaactcatgtgtactacttaagtttatatcttatgctagtttataagaacaattaaaaggacttagaagattaaaaaaaaaaaaaaaaaaaaaaaaaaaaaaaaaaaaaaaaaaaaaaaaaaaaaaaaaaaaaacacgaaaaaaaaaaaaaaaaaaaaaaaggaacccaaacaaacaaaacacaaacgaaaaaaacaaacacgcaacaaacaacacgccgcaaaaatacagcaagcgagcacaaccagaacaacaaacaagcaagctcagagaagataaacacaagaaggagaccaaccggagcaccctaatcaccacgtcaggacagccacaagcctagctcggaagcaaccagcagacaatcgagcgacggcggcacaagagcagagcacggaagcgaagacatagcagaagacagataaaagccgaaaaaaatccagaccgatcgcgcagcacaccgcacagagccacgaggccagcaccgagaagatcgagaaaacacaaggaagccagaagacagagagaccagccgagcaggaatgccg

SEQ ID NO: 418714 - DNA, 3765 bp, Homo sapiens
ggcgggaagccagtggggcgttgtttcgtccgatatccgcgtttcagtctccgcccatacccctccgggttaggcggctgtagcggagctcgaaaagagtggcgcagggtcgcgcggccccgcctccttccccgcccagcgaagctctctgaccacccctcttttctagagttctgcctcgcttcccggcgcggtcgcagccctcagcccacttaggataatggcgacagctgaggtactgaacattggtaaaaaattatatgagggtaaaacaaaagaagtctacgaattgttagacagtccaggaaaagtcctcctgcagtccaaggaccagattacagcaggaaatgcagctagaaaaaaccacctggaaggaaaagctgcaatctcaaataaaatcaccagttgtatttttcagttattacaggaagcaggtattaaaactgccttcaccagaaaatgtggggagacagctttcattgcaccgcagtgtgaaatgattccaattgaatgggtttgcagaagaatagcaactggttcttttctcaaaagaaatcctggtgtcaaggaaggatataagttttacccacctaaagtggagttgtttttcaaggatgatgccaataatgacccacagtggtctgaggaacagctgattgctgcaaaattttgctttgctggacttcttataggccagactgaagtggatatcatgagtcatgctacacaggctatatttgaaatactggagaaatcctggttgccccagaattgtacactggttgatatgaagattgaatttggtgttgatgtaaccaccaaagaaattgttcttgctgatgttattgacaatgattcctggagactctggccatcaggagatcgaagccaacagaaagacaaacagtcttatcgggacctcaaagaagtaactcctgaagggctccaaatggtaaagaaaaactttgagtgggttgcagagagagtagagttgcttttgaaatcagaaagtcagtgcagggttgtagtgttgatgggctctacttctgatcttggtcactgtgaaaaaatcaagaaggcctgtggaaattttggcattccatgtgaacttcgagtaacatctgcgcataaaggaccagatgaaactctgaggattaaagctgagtatgaaggggatggcattcctactgtatttgtggcagtggcaggcagaagtaatggtttgggaccagtgatgtctgggaacactgcatatccagttatcagctgtcctcccctcacaccagactggggagttcaggatgtgtggtcttctcttcgactacccagtggtcttggctgttcaaccgtactttctccagaaggatcagctcaatttgctgctcagatatttgggttaagcaaccatttggtatggagcaaactgcgagcaagcattttgaacacatggatttccttgaagcaggctgacaagaaaatcagagaatgtaatttataagaaagaatgccattgaattttttaggggaaaaactacaaatttctaatttagctgaaggaaaatcaagcaagatgaaaaggtaattttaaattagagaacacaaataaaatgtattagtgaataaatgcttctctagatccatattaataaacatgagcatctaacccctcctttcttaggctagacaccaagatatttcagccagcctttatcattcctcttactttatcctttttccttaagtattggtggtcactactattgagtttcttccttaacactgattaaatgatcttaactccctcagctaaaactggcattactgactcccagctatatttctccagacttgcatttttttttttttttttgagacagggtctcactgtcgcccaggctggagtgcagtggcgtgatctcagttcactgctgctttccctcctgggctcaagcagttctcccacctcagcctctcgactaacagggactataatcttgcagcaccatgccgagctaattttattttttgtagagatgagctctcactatgtcacccaggttcgtctcaaactcctgaaccctagtaattctcctatctcagcctcccaaagtgctagggttacagacatgagccactgtgcctgtctagacttgtactttcaactgtccatttctccctgtctgtcccatgggcactcatgaaaaaacagaatgctcccaactttattcatcttccaagcctgtagctcttggtatactcactgttgcaagtcagaagcttgatttcatcattgatgtttttctcacgtttcacatctcactcatcaccaagtcatgttggtgttaatttctgattaacccttgaatttaccgtcttctcatcctctgtacaaaagcctcaagtgagggtcaaattcaacattatcctgatctagacagcccccattctcaatccacccttttccaagttgattgcccaaggacttctaacaataaactctcttttgcaccacagacttctttgaaaatatacatgctgttgaccctctctgtagaaaaccgcacacataaaacttaccaacagatttcattggttcttgggttctcccgaagcctatccatggtttatagattaagaattgatgaggtagctgggcacagtggctcacacctacgatcacagcacttcgggaggctgaagcaagcagatcacttgaggtcaggagtttgagaccagcctggccaacatggtgaaaccctgtctctactaaaaatacaaaaagtagccagccgtgatgacaggcacctgtaatcccagctactcgggaggctgaggcatgagaattgcttgaacccgggaggcggaggttgcagtgagcctggatcatgccactgcactccaacctgggcagcagagcaagactctgtctcaaaaggggaaaaaaaaaattgctgatgtgacccatgaagggaactcattttcctcgtaattttggactgccacacattggtacctttagttctctgaaggcccacgtttttatcattaagacctatttgttagctagtagagctttatgttcgctgtccatgaaaccttctgtaaccacagtgactacaagtagttctttctctattgaattattaggtccagaatagaagatgtcattgtacactttatttccctcacactgtgttatgctctgatgtgctatgcttagctatctgtcagagattagtaaattataaaactcatgtgtactacttaagtttatatcttatgctagtttataagaacaattaaaaggacttagaagattaaactttggtttcatggtctctgaagtcactgactgctatttcagcttgtttacccttacctagcattaagactccatctacttctgtgcagtatatgaaaatttttaaactttcatttagactggtggataggactgaccattacaaattgtcgttatcaattttttttcctttttttttttaagagccaagttctcactgtctcccaggctggagtgcagtggcatgattatggctccctgcagccttgaactcctggactcaagctgcagcctctcgagtagctgggtgcatgtgctaccacacccaattatgaatttcatcattagtttcttagtagagtccacatgtcctcagtagtaagttcatcagtgctaaatatttgaaggtatttctactgttttgtaaaagtaacttaagcctacctggtctgctatcttttgag

SEQ ID NO: 418715 - DNA, 3709 bp, Homo sapiens
ggcgggaagccagtggggcgttgtttcgtccgatatccgcgtttcagtctccgcccatacccctccgggttaggcggctgtagcggagctcgaaaagagtggcgcagggtcgcgcggccccgcctccttccccgcccagcgaagctctctgaccacccctcttttctagagttctgcctcgcttcccggcgcggtcgcagccctcagcccacttaggataatggcgacagctgaggtactgaacattggtaaaaaattatatgagggtaaaacaaaagaagtctacgaattgttagacagtccaggaaaagtcctcctgcagtccaaggaccagattacagcaggaaatgcagctagaaaaaaccacctggaaggaaaagctgcaatctcaaataaaatcaccagttgtatttttcagttattacaggaagcaggtattaaaactgccttcaccagaaaatgtggggagacagctttcattgcaccgcagtgtgaaatgattccaattgaatgggtttgcagaagaatagcaactggttcttttctcaaaagaaatcctggtgtcaaggaaggatataagttttacccacctaaagtggagttgtttttcaaggatgatgccaataatgacccacagtggtctgaggaacagctgattgctgcaaaattttgctttgctggacttcttataggccagactgaagtggatatcatgagtcatgctacacaggctatatttgaaatactggagaaatcctggttgccccagaattgtacactggttgatatgaagattgaatttggtgttgatgtaaccaccaaagaaattgttcttgctgatgttattgacaatgattcctggagactctggccatcaggagatcgaagccaacagaaagacaaacagtcttatcgggacctcaaagaagtaactcctgaagggctccaaatggtaaagaaaaactttgagtgggttgcagagagagtagagttgcttttgaaatcagaaagtcagtgcagggttgtagtgttgatgggctctacttctgatcttggtcactgtgaaaaaatcaagaaggcctgtggaaattttggcattccatgtgaacttcgagtaacatctgcgcataaaggaccagatgaaactctgaggattaaagctgagtatgaaggggatggcattcctactgtatttgtggcagtggcaggcagaagtaatggtttgggaccagtgatgtctgggaacactgcatatccagttatcagctgtcctcccctcacaccagactggggagttcaggatgtgtggtcttctcttcgactacccagtggtcttggctgttcaaccgtactttctccagaaggatcagctcaatttgctgctcagatatttgggttaagcaaccatttggtatggagcaaactgcgagcaagcattttgaacacatggatttccttgaagcaggctgacaagaaaatcagagaatgtaatttataagaaagaatgccattgaattttttaggggaaaaactacaaatttctaatttagctgaaggaaaatcaagcaagatgaaaaggtaattttaaattagagaacacaaataaaatgtattagtgaataaatgcttctctagatccatattaataaacatgagcatctaacccctcctttcttaggctagacaccaagatatttcagccagcctttatcattcctcttactttatcctttttccttaagtattggtggtcactactattgagtttcttccttaacactgattaaatgatcttaactccctcagctaaaactggcattactgactcccagctatatttctccagacttgcatttttttttttttttttgagacagggtctcactgtcgcccaggctggagtgcagtggcgtgatctcagttcactgctgctttccctcctgggctcaagcagttctcccacctcagcctctcgactaacagggactataatcttgcagcaccatgccgagctaattttattttttgtagagatgagctctcactatgtcacccaggttcgtctcaaactcctgaaccctagtaattctcctatctcagcctcccaaagtgctagggttacagacatgagccactgtgcctgtctagacttgtactttcaactgtccatttctccctgtctgtcccatgggcactcatgaaaaaacagaatgctcccaactttattcatcttccaagcctgtagctcttggtatactcactgttgcaagtcagaagcttgatttcatcattgatgtttttctcacgtttcacatctcactcatcaccaagtcatgttggtgttaatttctgattaacccttgaatttaccgtcttctcatcctctgtacaaaagcctcaagtgagggtcaaattcaacattatcctgatctagacagcccccattctcaatccacccttttccaagttgattgcccaaggacttctaacaataaactctcttttgcaccacagacttctttgaaaatatacatgctgttgaccctctctgtagaaaaccgcacacataaaacttaccaacagatttcattggttcttgggttctcccgaagcctatccatggtttatagattaagaattgatgaggtagctgggcacagtggctcacacctacgatcacagcacttcgggaggctgaagcaagcagatcacttgaggtcaggagtttgagaccagcctggccaacatggtgaaaccctgtctctactaaaaatacaaaaagtagccagccgtgatgacaggcacctgtaatcccagctactcgggaggctgaggcatgagaattgcttgaacccgggaggcggaggttgcagtgagcctggatcatgccactgcactccaacctgggcagcagagcaagactctgtctcaaaaggggaaatgccacacattggtacctttagttctctgaaggcccacgtttttatcattaagacctatttgttagctagtagagctttatgttcgctgtccatgaaaccttctgtaaccacagtgactacaagtagttctttctctattgaattattaggtccagaatagaagatgtcattgtacactttatttccctcacactgtgttatgctctgatgtgctatgcttagctatctgtcagagattagtaaattataaaactcatgtgtactacttaagtttatatcttatgctagtttataagaacaattaaaaggacttagaagattaaactttggtttcatggtctctgaagtcactgactgctatttcagcttgtttacccttacctagcattaagactccatctacttctgtgcagtatatgaaaatttttaaactttcatttagactggtggataggactgaccattacaaattgtcgttatcaattttttttcctttttttttttaagagccaagttctcactgtctcccaggctggagtgcagtggcatgattatggctccctgcagccttgaactcctggactcaagctgcagcctctcgagtagctgggtgcatgtgctaccacacccaattatgaatttcatcattagtttcttagtagagtccacatgtcctcagtagtaagttcatcagtgctaaatatttgaaggtatttctactgttttgtaaaagtaacttaagcctacctggtctgctatcttttgag

SEQ ID NO: 418716 - DNA, 3443 bp, Homo sapiens
ggcgggaagccagtggggcgttgtttcgtccgatatccgcgtttcagtctccgcccatacccctccgggttaggcggctgtagcggagctcgaaaagagtggcgcagggtcgcgcggccccgcctccttccccgcccagcgaagctctctgaccacccctcttttctagagttctgcctcgcttcccggcgcggtcgcagccctcagcccacttaggataatggcgacagctgaggtactgaacattggtaaaaaattatatgagggtaaaacaaaagaagtctacgaattgttagacagtccaggaaaagtcctcctgcagtccaaggaccagattacagcaggaaatgcagctagaaaaaaccacctggaaggaaaagctgcaatctcaaataaaatcaccagttgtatttttcagttattacaggaagcaggtattaaaactgccttcaccagaaaatgtggggagacagctttcattgcaccgcagtgtgaaatgattccaattgaatgggtttgcagaagaatagcaactggttcttttctcaaaagaaatcctggtgtcaaggaaggatataagttttacccacctaaagtggagttgtttttcaaggatgatgccaataatgacccacagtggtctgaggaacagctgattgctgcaaaattttgctttgctggacttcttataggccagactgaagtggatatcatgagtcatgctacacaggctatatttgaaatactggagaaatcctggttgccccagaattgtacactggttgatatgaagattgaatttggtgttgatgtaaccaccaaagaaattgttcttgctgatgttattgacaatgattcctggagactctggccatcaggagatcgaagccaacagaaagacaaacagtcttatcgggacctcaaagaagtaactcctgaagggctccaaatggtaaagaaaaactttgagtgggttgcagagagagtagagttgcttttgaaatcagaaagtcagtgcagggttgtagtgttgatgggctctacttctgatcttggtcactgtgaaaaaatcaagaaggcctgtggaaattttggcattccatgtgaacttcgagtaacatctgcgcataaaggaccagatgaaactctgaggattaaagctgagtatgaaggggatggcattcctactgtatttgtggcagtggcaggcagaagtaatggtttgggaccagtgatgtctgggaacactgcatatccagttatcagctgtcctcccctcacaccagactggggagttcaggatgtgtggtcttctcttcgactacccagtgacggagtcgggctctcttgcccaggctggagtgcaatggcgcaatctcagcttactgcagcctccgcctcccaggttcaagcggttctcgtgcctcaacctcctgagtacctgggattataggtcttggctgttcaaccgtactttctccagaaggatcagctcaatttgctgctcagatatttgggttaagcaaccatttggtatggagcaaactgcgagcaagcattttgaacacatggatttccttgaagcaggctgacaagaaaatcagagaatgtaatttataagaaagaatgccattgaattttttaggggaaaaactacaaatttctaatttagctgaaggaaaatcaagcaagatgaaaaggtaattttaaattagagaacacaaataaaatgtattagtgaataaatgcttctctagatccatattaataaacatgagcatctaacccctcctttcttaggctagacaccaagatatttcagccagcctttatcattcctcttactttatcctttttccttaagtattggtggtcactactattgagtttcttccttaacactgattaaatgatcttaactccctcagctaaaactggcattactgactcccagctatatttctccagacttgcatttttttttttttttttgagacagggtctcactgtcgcccaggctggagtgcagtggcgtgatctcagttcactgctgctttccctcctgggctcaagcagttctcccacctcagcctctcgactaacagggactataatcttgcagcaccatgccgagctaattttattttttgtagagatgagctctcactatgtcacccaggttcgtctcaaactcctgaaccctagtaattctcctatctcagcctcccaaagtgctagggttacagacatgagccactgtgcctgtctagacttgtactttcaactgtccatttctccctgtctgtcccatgggcactcatgaaaaaacagaatgctcccaactttattcatcttccaagcctgtagctcttggtatactcactgttgcaagtcagaagcttgatttcatcattgatgtttttctcacgtttcacatctcactcatcaccaagtcatgttggtgttaatttctgattaacccttgaatttaccgtcttctcatcctctgtacaaaagcctcaagtgagggtcaaattcaacattatcctgatctagacagcccccattctcaatccacccttttccaagttgattgcccaaggacttctaacaataaactctcttttgcaccacagacttctttgaaaatatacatgctgttgaccctctctgtagaaaaccgcacacataaaacttaccaacagatttcattggttcttgggttctcccgaagcctatccatggtttatagattaagaattgatgaggtagctgggcacagtggctcacacctacgatcacagcacttcgggaggctgaagcaagcagatcacttgaggtcaggagtttgagaccagcctggccaacatggtgaaaccctgtctctactaaaaatacaaaaagtagccagccgtgatgacaggcacctgtaatcccagctactcgggaggctgaggcatgagaattgcttgaacccgggaggcggaggttgcagtgagcctggatcatgccactgcactccaacctgggcagcagagcaagactctgtctcaaaaggggaaaaaaaaaattgctgatgtgacccatgaagggaactcattttcctcgtaattttggactgccacacattggtacctttagttctctgaaggcccacgtttttatcattaagacctatttgttagctagtagagctttatgttcgctgtccatgaaaccttctgtaaccacagtgactacaagtagttctttctctattgaattattaggtccagaatagaagatgtcattgtacactttatttccctcacactgtgttatgctctgatgtgctatgcttagctatctgtcagagattagtaaattataaaactcatgtgtactacttaagtttatatcttatgctagtttataagaacaattaaaaggacttagaagattaa

SEQ ID NO: 418717 - DNA, 2730 bp, Homo sapiens
ggcgggaagccagtggggcgttgtttcgtccgatatccgcgtttcagtctccgcccatacccctccgggttaggcggctgtagcggagctcgaaaagagtggcgcagggtcgcgcggccccgcctccttccccgcccagcgaagctctctgaccacccctcttttctagagttctgcctcgcttcccggcgcggtcgcagccctcagcccacttaggataatggcgacagctgaggtactgaacattggtaaaaaattatatgagggtaaaacaaaagaagtctacgaattgttagacagtccaggaaaagtcctcctgcagtccaaggaccagattacagcaggaaatgcagctagaaaaaaccacctggaaggaaaagctgcaatctcaaataaaatcaccagttgtatttttcagttattacaggaagcaggtattaaaactgccttcaccagaaaatgtggggagacagctttcattgcaccgcagtgtgaaatgattccaattgaatgggtttgcagaagaatagcaactggttcttttctcaaaagaaatcctggtgtcaaggaaggatataagttttacccacctaaagtggagttgtttttcaaggatgatgccaataatgacccacagtggtctgaggaacagctgattgctgcaaaattttgctttgctggacttcttataggccagactgaagtggatatcatgagtcatgctacacaggctatatttgaaatactggagaaatcctggttgccccagaattgtacactggttgatatgaagattgaatttggtgttgatgtaaccaccaaagaaattgttcttgctgatgttattgacaatgattcctggagactctggccatcaggagatcgaagccaacagaaagacaaacagtcttatcgggacctcaaagaagtaactcctgaagggctccaaatggtaaagaaaaactttgagtgggttgcagagagagtagagttgcttttgaaatcagaaagtcagtgcagggttgtagtgttgatgggctctacttctgatcttggtcactgtgaaaaaatcaagaaggcctgtggaaattttggcattccatgtgaacttcgagtaacatctgcgcataaaggaccagatgaaactctgaggattaaagctgagtatgaaggggatggcattcctactgtatttgtggcagtggcaggcagaagtaatggtttgggaccagtgatgtctgggaacactgcatatccagttatcagctgtcctcccctcacaccagactggggagttcaggatgtgtggtcttctcttcgactacccagtggtcttggctgttcaaccgtactttctccagaaggatcagctcaatttgctgctcagatatttgggttaagcaaccatttggtatggagcaaactgcgagcaagcattttgaacacatggatttccttgaagcaggctgacaagaaaatcagagaatgtaatttataagaaagaatgccattgaattttttaggggaaaaactacaaatttctaatttagctgaaggaaaatcaagcaagatgaaaaggtaattttaaattagagaacacaaataaaatgtattagtgaataaatgcttctctagatccatattaataaacatgagcatctaacccctcctttcttaggctagacaccaagatatttcagccagcctttatcattcctcttactttatcctttttccttaagtattggtggtcactactattgagtttcttccttaacactgattaaatgatcttaactccctcagctaaaactggcattactgactcccagctatatttctccagacttgcatttttttttttttttttgagacagggtctcactgtcgcccaggctggagtgcagtggcgtgatctcagttcactgctgctttccctcctgggctcaagcagttctcccacctcagcctctcgactaacagggactataatcttgcagcaccatgccgagctaattttattttttgtagagatgagctctcactatgtcacccaggttcgtctcaaactcctgaaccctagtaattctcctatctcagcctcccaaagtgctagggttacagacatgagccactgtgcctgtctagacttgtactttcaactccctgtctctactaaaaatacaaaaagtagccagccgtgatgacaggcacctgtaatcccagctactcgggaggctgaggcatgagaattgcttgaacccgggaggcggaggttgcagtgagcctggatcatgccactgcactccaacctgggcagcagagcaagactctgtctcaaaaggggaaaaaaaaaattgctgatgtgacccatgaagggaactcattttcctcgtaattttggactgccacacattggtacctttagttctctgaaggcccacgtttttatcattaagacctatttgttagctagtagagctttatgttcgctgtccatgaaaccttctgtaaccacagtgactacaagtagttctttctctattgaattattaggtccagaatagaagatgtcattgtacactttatttccctcacactgtgttatgctctgatgtgctatgcttagctatctgtcagagattagtaaattataaaactcatgtgtactacttaagtttatatcttatgctagtttataagaacaattaaaaggacttagaagattaa

SEQ ID NO: 418718 - DNA, 2327 bp, Homo sapiens
ggcgggaagccagtggggcgttgtttcgtccgatatccgcgtttcagtctccgcccatacccctccgggttaggcggctgtagcggagctcgaaaagagtggcgcagggtcgcgcggccccgcctccttccccgcccagcgaagctctctgaccacccctcttttctagagttctgcctcgcttcccggcgcggtcgcagccctcagcccacttaggataatggcgacagctgaggtactgaacattggtaaaaaattatatgagggtaaaacaaaagaagtctacgaattgttagacagtccaggaaaagtcctcctgcagtccaaggaccagattacagcaggaaatgcagctagaaaaaaccacctggaaggaaaagctgcaatctcaaataaaatcaccagttgtatttttcagttattacaggaagcaggtattaaaactgccttcaccagaaaatgtggggagacagctttcattgcaccgcagtgtgaaatgattccaattgaatgggtttgcagaagaatagcaactggttcttttctcaaaagaaatcctggtgtcaaggaaggatataagttttacccacctaaagtggagttgtttttcaaggatgatgccaataatgacccacagtggtctgaggaacagctgattgctgcaaaattttgctttgctggacttcttataggccagactgaagtggatatcatgagtcatgctacacaggctatatttgaaatactggagaaatcctggttgccccagaattgtacactggttgatatgaagattgaatttggtgttgatgtaaccaccaaagaaattgttcttgctgatgttattgacaatgattcctggagactctggccatcaggagatcgaagccaacagaaagacaaacagtcttatcgggacctcaaagaagtaactcctgaagggctccaaatggtaaagaaaaactttgagtgggttgcagagagagtagagttgcttttgaaatcagaaagtcagtgcagggttgtagtgttgatgggctctacttctgatcttggtcactgtgaaaaaatcaagaaggcctgtggaaattttggcattccatgtgaacttcgagtaacatctgcgcataaaggaccagatgaaactctgaggattaaagctgagtatgaaggggatggcattcctactgtatttgtggcagtggcaggcagaagtaatggtttgggaccagtgatgtctgggaacactgcatatccagttatcagctgtcctcccctcacaccagactggggagttcaggatgtgtggtcttctcttcgactacccagtggtcttggctgttcaaccgtactttctccagaaggatcagctcaatttgctgctcagatatttgggttaagcaaccatttggtatggagcaaactgcgagcaagcattttgaacacatggatttccttgaagcaggctgacaagaaaatcagagaatgtaatttataagaaagaatgccattgaattttttaggggaaaaactacaaatttctaatttagctgaaggaaaatcaagcaagatgaaaaggtaattttaaattagagaacacaaataaaatgtattagtgaataaatgcttctctagatccatattaataaacatgagcatctaacccctcctttcttaggctagacaccaagatatttcagccagcctttatcattcctcttactttatcctttttccttaagtattggtggtcactactattgagtttcttccttaacactgattaaatgatcttaactccctcagctaaaactggcattactgactcccagctatatttctccagacttgcatttttttttttttttttgagacagggtctcactgtcgcccagcactgcactccaacctgggcagcagagcaagactctgtctcaaaaggggaaaaaaaaaattgctgatgtgacccatgaagggaactcattttcctcgtaattttggactgccacacattggtacctttagttctctgaaggcccacgtttttatcattaagacctatttgttagctagtagagctttatgttcgctgtccatgaaaccttctgtaaccacagtgactacaagtagttctttctctattgaattattaggtccagaatagaagatgtcattgtacactttatttccctcacactgtgttatgctctgatgtgctatgcttagctatctgtcagagattagtaaattataaaactcatgtgtactacttaagtttatatcttatgctagtttataagaacaattaaaaggacttagaagattaa

SEQ ID NO: 418719 - DNA, 2253 bp, Homo sapiens
ggcgggaagccagtggggcgttgtttcgtccgatatccgcgtttcagtctccgcccatacccctccgggttaggcggctgtagcggagctcgaaaagagtggcgcagggtcgcgcggccccgcctccttccccgcccagcgaagctctctgaccacccctcttttctagagttctgcctcgcttcccggcgcggtcgcagccctcagcccacttaggataatggcgacagctgaggtactgaacattggtaaaaaattatatgagggtaaaacaaaagaagtctacgaattgttagacagtccaggaaaagtcctcctgcagtccaaggaccagattacagcaggaaatgcagctagaaaaaaccacctggaaggaaaagctgcaatctcaaataaaatcaccagttgtatttttcagttattacaggaagcaggtattaaaactgccttcaccagaaaatgtggggagacagctttcattgcaccgcagtgtgaaatgattccaattgaatgggtttgcagaagaatagcaactggttcttttctcaaaagaaatcctggtgtcaaggaaggatataagttttacccacctaaagtggagttgtttttcaaggatgatgccaataatgacccacagtggtctgaggaacagctgattgctgcaaaattttgctttgctggacttcttataggccagactgaagtggatatcatgagtcatgctacacaggctatatttgaaatactggagaaatcctggttgccccagaattgtacactggttgatatgaagattgaatttggtgttgatgtaaccaccaaagaaattgttcttgctgatgttattgacaatgattcctggagactctggccatcaggagatcgaagccaacagaaagacaaacagtcttatcgggacctcaaagaagtaactcctgaagggctccaaatggtaaagaaaaactttgagtgggttgcagagagagtagagttgcttttgaaatcagaaagtcagtgcagggttgtagtgttgatgggctctacttctgatcttggtcactgtgaaaaaatcaagaaggcctgtggaaattttggcattccatgtgaacttcgagtaacatctgcgcataaaggaccagatgaaactctgaggattaaagctgagtatgaaggggatggcattcctactgtatttgtggcagtggcaggcagaagtaatggtttgggaccagtgatgtctgggaacactgcatatccagttatcagctgtcctcccctcacaccagactggggagttcaggatgtgtggtcttctcttcgactacccagtggtcttggctgttcaaccgtactttctccagaaggatcagctcaatttgctgctcagatatttgggttaagcaaccatttggtatggagcaaactgcgagcaagcattttgaacacatggatttccttgaagcaggctgacaagaaaatcagagaatgtaatttataagaaagaatgccattgaattttttaggggaaaaactacaaatttctaatttagctgaaggaaaatcaagcaagatgaaaaggtaattttaaattagagaacacaaataaaatgtattagtgaataaatgcttctctagatccatattaataaacatgagcatctaacccctcctttcttaggctagacaccaagatatttcagccagcctttatcattcctcttactttatcctttttccttaagtattggtggtcactactattgagtttcttccttaacactgattaaatgatcttaactccctcagctaaaactggcattacactgcactccaacctgggcagcagagcaagactctgtctcaaaaggggaaaaaaaaaattgctgatgtgacccatgaagggaactcattttcctcgtaattttggactgccacacattggtacctttagttctctgaaggcccacgtttttatcattaagacctatttgttagctagtagagctttatgttcgctgtccatgaaaccttctgtaaccacagtgactacaagtagttctttctctattgaattattaggtccagaatagaagatgtcattgtacactttatttccctcacactgtgttatgctctgatgtgctatgcttagctatctgtcagagattagtaaattataaaactcatgtgtactacttaagtttatatcttatgctagtttataagaacaattaaaaggacttagaagattaa

SEQ ID NO: 418720 - DNA, 3162 bp, Homo sapiens
ggcgggaagccagtggggcgttgtttcgtccgatatccgcgtttcagtctccgcccatacccctccgggttaggcggctgtagcggagctcgaaaagagtggcgcagggtcgcgcggccccgcctccttccccgcccagcgaagctctctgaccacccctcttttctagagttctgcctcgcttcccggcgcggtcgcagccctcagcccacttaggataatggcgacagctgaggtactgaacattggtaaaaaattatatgagggtaaaacaaaagaagtctacgaattgttagacagtccaggaaaagtcctcctgcagtccaaggaccagattacagcaggaaatgcagctagaaaaaaccacctggaaggaaaagctgcaatctcaaataaaatcaccagttgtatttttcagttattacaggaagcaggtattaaaactgccttcaccagaaaatgtggggagacagctttcattgcaccgcagtgtgaaatgattccaattgaatgggtttgcagaagaatagcaactggttcttttctcaaaagaaatcctggtgtcaaggaaggatataagttttacccacctaaagtggagttgtttttcaaggatgatgccaataatgacccacagtggtctgaggaacagctgattgctgcaaaattttgctttgctggacttcttataggccagactgaagtggatatcatgagtcatgctacacaggctatatttgaaatactggagaaatcctggttgccccagaattgtacactggttgatatgaagattgaatttggtgttgatgtaaccaccaaagaaattgttcttgctgatgttattgacaatgattcctggagactctggccatcaggagatcgaagccaacagaaagacaaacagtcttatcgggacctcaaagaagtaactcctgaagggctccaaatggtaaagaaaaactttgagtgggttgcagagagagtagagttgcttttgaaatcagaaagtcagtgcagggttgtagtgttgatgggctctacttctgatcttggtcactgtgaaaaaatcaagaaggcctgtggaaattttggcattccatgtgaacttcgagtaacatctgcgcataaaggaccagatgaaactctgaggattaaagctgagtatgaaggtcttggctgttcaaccgtactttctccagaaggatcagctcaatttgctgctcagatatttgggttaagcaaccatttggtatggagcaaactgcgagcaagcattttgaacacatggatttccttgaagcaggctgacaagaaaatcagagaatgtaatttataagaaagaatgccattgaattttttaggggaaaaactacaaatttctaatttagctgaaggaaaatcaagcaagatgaaaaggtaattttaaattagagaacacaaataaaatgtattagtgaataaatgcttctctagatccatattaataaacatgagcatctaacccctcctttcttaggctagacaccaagatatttcagccagcctttatcattcctcttactttatcctttttccttaagtattggtggtcactactattgagtttcttccttaacactgattaaatgatcttaactccctcagctaaaactggcattactgactcccagctatatttctccagacttgcatttttttttttttttttgagacagggtctcactgtcgcccaggctggagtgcagtggcgtgatctcagttcactgctgctttccctcctgggctcaagcagttctcccacctcagcctctcgactaacagggactataatcttgcagcaccatgccgagctaattttattttttgtagagatgagctctcactatgtcacccaggttcgtctcaaactcctgaaccctagtaattctcctatctcagcctcccaaagtgctagggttacagacatgagccactgtgcctgtctagacttgtactttcaactgtccatttctccctgtctgtcccatgggcactcatgaaaaaacagaatgctcccaactttattcatcttccaagcctgtagctcttggtatactcactgttgcaagtcagaagcttgatttcatcattgatgtttttctcacgtttcacatctcactcatcaccaagtcatgttggtgttaatttctgattaacccttgaatttaccgtcttctcatcctctgtacaaaagcctcaagtgagggtcaaattcaacattatcctgatctagacagcccccattctcaatccacccttttccaagttgattgcccaaggacttctaacaataaactctcttttgcaccacagacttctttgaaaatatacatgctgttgaccctctctgtagaaaaccgcacacataaaacttaccaacagatttcattggttcttgggttctcccgaagcctatccatggtttatagattaagaattgatgaggtagctgggcacagtggctcacacctacgatcacagcacttcgggaggctgaagcaagcagatcacttgaggtcaggagtttgagaccagcctggccaacatggtgaaaccctgtctctactaaaaatacaaaaagtagccagccgtgatgacaggcacctgtaatcccagctactcgggaggctgaggcatgagaattgcttgaacccgggaggcggaggttgcagtgagcctggatcatgccactgcactccaacctgggcagcagagcaagactctgtctcaaaaggggaaaaaaaaaattgctgatgtgacccatgaagggaactcattttcctcgtaattttggactgccacacattggtacctttagttctctgaaggcccacgtttttatcattaagacctatttgttagctagtagagctttatgttcgctgtccatgaaaccttctgtaaccacagtgactacaagtagttctttctctattgaattattaggtccagaatagaagatgtcattgtacactttatttccctcacactgtgttatgctctgatgtgctatgcttagctatctgtcagagattagtaaattataaaactcatgtgtactacttaagtttatatcttatgctagtttataagaacaattaaaaggacttagaagattaa

SEQ ID NO: 418721 - DNA, 2607 bp, Homo sapiens
ggcgggaagccagtggggcgttgtttcgtccgatatccgcgtttcagtctccgcccatacccctccgggttaggcggctgtagcggagctcgaaaagagtggcgcagggtcgcgcggccccgcctccttccccgcccagcgaagctctctgaccacccctcttttctagagttctgcctcgcttcccggcgcggtcgcagccctcagcccacttaggataatggcgacagctgaggtactgaacattggtaaaaaattatatgagggtaaaacaaaagaagtctacgaattgttagacagtccaggaaaagtcctcctgcagtccaaggaccagattacagcaggaaatgcagctagaaaaaaccacctggaaggaaaagctgcaatctcaaataaaatcaccagttgtatttttcagttattacaggaagcaggtattaaaactgccttcaccagaaaatgtggggagacagctttcattgcaccgcagtgtgaaatgattccaattgaatgggtttgcagaagaatagcaactggttcttttctcaaaagaaatcctggtgtcaaggaaggatataagttttacccacctaaagtggagttgtttttcaaggatgatgccaataatgacccacagtggtctgaggaacagctgattgctgcaaaattttgctttgctggacttcttataggccagactgaagtggatatcatgagtcatgctacacaggctatatttgaaatactggagaaatcctggttgccccagaattgtacactggttgatatgaagattgaatttggtgttgatgtaaccaccaaagaaattgttcttgctgatgttattgacaatgattcctggagactctggccatcaggagatcgaagccaacagaaagacaaacagtcttatcgggacctcaaagaagtaactcctgaagggctccaaatggtaaagaaaaactttgagtgggttgcagagagagtagagttgcttttgaaatcagaaagtcagtgcagggttgtagtgttgatgggctctacttctgatcttggtcactgtgaaaaaatcaagaaggcctgtggaaattttggcattccatgtgaacttcgagtaacatctgcgcataaaggaccagatgaaactctgaggattaaagctgagtatgaaggggatggcattcctactgtatttgtggcagtggcaggcagaagtaatggtttgggaccagtgatgtctgggaacactgcatatccagttatcagctgtcctcccctcacaccagactggggagttcaggatgtgtggtcttctcttcgactacccagtggtcttggctgttcaaccgtactttctccagaaggatcagctcaatttgctgctcagatatttgggttaagcaaccatttggtatggagcaaactgcgagcaagcattttgaacacatggatttccttgaagcaggctgacaagaaaatcagagaatgtaatttataagaaagaatgccattgaattttttaggggaaaaactacaaatttctaatttagctgaaggaaaatcaagcaagatgaaaaggtaattttaaattagagaacacaaataaaatgtattagtgaataaatgcttctctagatccatattaataaacatgagcatctaacccctcctttcttaggctagacaccaagatatttcagccagcctttatcattcctcttactttatcctttttccttaagtattggtggtcactactattgagtttcttccttaacactgattaaatgatcttaactccctcagctaaaactggcattactgactcccagctatatttctccagacttgcatttttttttttttttttgagacagggtctcactgtcgcccaggctggagtgcagtggcgtgatctcagttcactgctgctttccctcctgggctcaagcagttctcccacctcagcctctcgactaacagggactataatcttgcagcaccatgccgagctaattttattttttgtagagatgagctctcactatgtcacccaggttcgtctcaaactcctgaaccctagtaattctcctatctcagcctcccaaagtgctagggttacagacatgagccactgtgcctgtctagacttgtactttcaactgtccatttctccctgtctgtcccatgggcactcatgaaaaaacagaatgctcccaactttattcatcttccaagcctgtagctcttggtatactcactgttgcaagtcagaagcttgatttcatcattgatgtttttctcacgtttcacatctcactcatcaccaagtcatgttggtgttaatttctgattaacccttgaatttaccgtcttctcatcctctgtacaaaagcctcaagtgagggtcaaattcaacattatcctgatctagacagcccccattctcaatccacccttttccaagaccgactgacagggaggtgggaggagaggaaaagaatggtggcaactactcacatttttatccagagccaagtcttataagaatcttgaatctgtaatcatctgactttaacttttcttttaaaaaaaatcctgagacta

SEQ ID NO: 418722 - DNA, 2798 bp, Homo sapiens
ggcgggaagccagtggggcgttgtttcgtccgatatccgcgtttcagtctccgcccatacccctccgggttaggcggctgtagcggagctcgaaaagagtggcgcagggtcgcgcggccccgcctccttccccgcccagcgaagctctctgaccacccctcttttctagagttctgcctcgcttcccggcgcggtcgcagccctcagcccacttaggataatggcgacagctgaggtactgaacattggtaaaaaattatatgagggtaaaacaaaagaagtctacgaattgttagacagtccaggaaaagtcctcctgcagtccaaggaccagattacagcaggaaatgcagctagaaaaaaccacctggaaggaaaagctgcaatctcaaataaaatcaccagttgtatttttcagttattacaggaagcaggtattaaaactgccttcaccagaaaatgtggggagacagctttcattgcaccgcagtgtgaaatgattccaattgaatgggtttgcagaagaatagcaactggttcttttctcaaaagaaatcctggtgtcaaggaaggatataagttttacccacctaaagtggagttgtttttcaaggatgatgccaataatgacccacagtggtctgaggaacagctgattgctgcaaaattttgctttgctggacttcttataggccagactgaagtggatatcatgagtcatgctacacaggctatatttgaaatactggagaaatcctggttgccccagaattgtacactggttgatatgaagattgaatttggtgttgatgtaaccaccaaagaaattgttcttgctgatgttattgacaatgattcctggagactctggccatcaggagatcgaagccaacagaaagacaaacagtcttatcgggacctcaaagaagtaactcctgaagggctccaaatggtaaagaaaaactttgagtgggttgcagagagagtagagttgcttttgaaatcagaaagtcagtgcagggttgtagtgttgatgggctctacttctgatcttggtcactgtgaaaaaatcaagaaggcctgtggaaattttggcattccatgtgaacttcgagtaacatctgcgcataaaggaccagatgaaactctgaggattaaagctgagtatgaaggggatggcattcctactgtatttgtggcagtggcaggcagaagtaatggtttgggaccagtgatgtctgggaacactgcatatccagttatcagctgtcctcccctcacaccagactggggagttcaggatgtgtggtcttctcttcgactacccagtggtcttggctgttcaaccgtactttctccagaaggatcagctcaatttgctgctcagatatttgggttaagcaaccatttggtatggagcaaactgcgagcaagcattttgaacacatggatttccttgaagcaggctgacaagaaaatcagagaatgtaatttataagaaagaatgccattgaattttttaggggaaaaactacaaatttctaatttagctgaaggaaaatcaagcaagatgaaaaggtaattttaaattagagaacacaaataaaatgtattagtgaataaatgcttctctagatccatattaataaacatgagcatctaacccctcctttcttaggctagacaccaagatatttcagccagcctttatcattcctcttactttatcctttttccttaagtattggtggtcactactattgagtttcttccttaacactgattaaatgatcttaactccctcagctaaaactggcattactgactcccagctatatttctccagacttgcatttttttttttttttttgagacagggtctcactgtcgcccagcactgcactccaacctgggcagcagagcaagactctgtctcaaaaggggaaaaaaaaaattgctgatgtgacccatgaagggaactcattttcctcgtaattttggactgccacacattggtacctttagttctctgaaggcccacgtttttatcattaagacctatttgttagctagtagagctttatgttcgctgtccatgaaaccttctgtaaccacagtgactacaagtagttctttctctattgaattattaggtccagaatagaagatgtcattgtacactttatttccctcacactgtgttatgctctgatgtgctatgcttagctatctgtcagagattagtaaattataaaactcatgtgtactacttaagtttatatcttatgctagtttataagaacaattaaaaggacttagaagattaaaaaaaaaaaaaaaaaaaaaaaaaaaaaaaaaaaaaaaaaaaaaaaaaaaaaaaaaaaaaacacgaaaaaaaaaaaaaaaaaaaaaaaggaacccaaacaaacaaaacacaaacgaaaaaaacaaacacgcaacaaacaacacgccgcaaaaatacagcaagcgagcacaaccagaacaacaaacaagcaagctcagagaagataaacacaagaaggagaccaaccggagcaccctaatcaccacgtcaggacagccacaagcctagctcggaagcaaccagcagacaatcgagcgacggcggcacaagagcagagcacggaagcgaagacatagcagaagacagataaaagccgaaaaaaatccagaccgatcgcgcagcacaccgcacagagccacgaggccagcaccgagaagatcgagaaaacacaaggaagccagaagacagagagaccagccgagcaggaatgccg

SEQ ID NO: 418723 - DNA, 2043 bp, Homo sapiens
ggcgggaagccagtggggcgttgtttcgtccgatatccgcgtttcagtctccgcccatacccctccgggttaggcggctgtagcggagctcgaaaagagtggcgcagggtcgcgcggccccgcctccttccccgcccagcgaagctctctgaccacccctcttttctagagttctgcctcgcttcccggcgcggtcgcagccctcagcccacttaggataatggcgacagctgaggtactgaacattggtaaaaaattatatgagggtaaaacaaaagaagtctacgaattgttagacagtccaggaaaagtcctcctgcagtccaaggaccagattacagcaggaaatgcagctagaaaaaaccacctggaaggaaaagctgcaatctcaaataaaatcaccagttgtatttttcagttattacaggaagcaggtattaaaactgccttcaccagaaaatgtggggagacagctttcattgcaccgcagtgtgaaatgattccaattgaatgggtttgcagaagaatagcaactggttcttttctcaaaagaaatcctggtgtcaaggaaggatataagttttacccacctaaagtggagttgtttttcaaggatgatgccaataatgacccacagtggtctgaggaacagctgattgctgcaaaattttgctttgctggacttcttataggccagactgaagtggatatcatgagtcatgctacacaggctatatttgaaatactggagaaatcctggttgccccagaattgtacactggttgatatgaagattgaatttggtgttgatgtaaccaccaaagaaattgttcttgctgatgttattgacaatgattcctggagactctggccatcaggagatcgaagccaacagaaagacaaacagtcttatcgggacctcaaagaagtaactcctgaagggctccaaatggtaaagaaaaactttgagtgggttgcagagagagtagagttgcttttgaaatcagaaagtcagtgcagggttgtagtgttgatgggctctacttctgatcttggtcactgtgaaaaaatcaagaaggcctgtggaaattttggcattccatgtgaacttcgagtaacatctgcgcataaaggaccagatgaaactctgaggattaaagctgagtatgaaggggatggcattcctactgtatttgtggcagtggcaggcagaagtaatggtttgggaccagtgatgtctgggaacactgcatatccagttatcagctgtcctcccctcacaccagactggggagttcaggatgtgtggtcttctcttcgactacccagtggtcttggctgttcaaccgtactttctccagaaggatcagctcaatttgctgctcagatatttgggttaagcaaccatttggtatggagcaaactgcgagcaagcattttgaacacatggatttccttgaagcaggctgacaagaaaatcagagaatgtaatttataagaaagaatgccattgaattttttaggggaaaaactacaaatttctaatttagctgaaggaaaatcaagcaagatgaaaaggtaattttaaattagagaacacaaataaaatgtattagtgaataaatgcttctctagatccatattaataaacatgagcatctaacccctcctttcttaggctagacaccaagatatttcagccagcctttatcattcctcttactttatcctttttccttaagtattggtggtcactactattgagtttcttccttaacactgattaaatgatcttaactccctcagctaaaactggcattactgactcccagctatatttctccagacttgcatttttttttttttttttgagacagggtctcactgtcgcccaggctggagtgcagtggcgtgatctcagttcactgctgctttccctcctgggctcaagcagttctcccacctcagcctctcgactaacagggactataatcttgcagcaccgtcgacgcggccgcgaatttagtagtagtaggcggccgc

SEQ ID NO: 418724 - DNA, 3303 bp, Homo sapiens
agctgtatttgctgcacgtggaaatctccgttattttccagcacccaacagtagcgtaatgggagtaacggacttaacctcatttctctttcagagcatttagccttcatatgcccttccctgcatgcttcccccaggccgtcaagacttgagttctgcctcgcttcccggcgcggtcgcagccctcagcccacttaggataatggcgacagctgaggtactgaacattggtaaaaaattatatgagggtaaaacaaaagaagtctacgaattgttagacagtccaggaaaagtcctcctgcagtccaaggaccagattacagcaggaaatgcagctagaaaaaaccacctggaaggaaaagctgcaatctcaaataaaatcaccagttgtatttttcagttattacaggaagcaggtattaaaactgccttcaccagaaaatgtggggagacagctttcattgcaccgcagtgtgaaatgattccaattgaatgggtttgcagaagaatagcaactggttcttttctcaaaagaaatcctggtgtcaaggaaggatataagttttacccacctaaagtggagttgtttttcaaggatgatgccaataatgacccacagtggtctgaggaacagctgattgctgcaaaattttgctttgctggacttcttataggccagactgaagtggatatcatgagtcatgctacacaggctatatttgaaatactggagaaatcctggttgccccagaattgtacactggttgatatgaagattgaatttggtgttgatgtaaccaccaaagaaattgttcttgctgatgttattgacaatgattcctggagactctggccatcaggagatcgaagccaacagaaagacaaacagtcttatcgggacctcaaagaagtaactcctgaagggctccaaatggtaaagaaaaactttgagtgggttgcagagagagtagagttgcttttgaaatcagaaagtcagtgcagggttgtagtgttgatgggctctacttctgatcttggtcactgtgaaaaaatcaagaaggcctgtggaaattttggcattccatgtgaacttcgagtaacatctgcgcataaaggaccagatgaaactctgaggattaaagctgagtatgaaggggatggcattcctactgtatttgtggcagtggcaggcagaagtaatggtttgggaccagtgatgtctgggaacactgcatatccagttatcagctgtcctcccctcacaccagactggggagttcaggatgtgtggtcttctcttcgactacccagtggtcttggctgttcaaccgtactttctccagaaggatcagctcaatttgctgctcagatatttgggttaagcaaccatttggtatggagcaaactgcgagcaagcattttgaacacatggatttccttgaagcaggctgacaagaaaatcagagaatgtaatttataagaaagaatgccattgaattttttaggggaaaaactacaaatttctaatttagctgaaggaaaatcaagcaagatgaaaaggtaattttaaattagagaacacaaataaaatgtattagtgaataaatgcttctctagatccatattaataaacatgagcatctaacccctcctttcttaggctagacaccaagatatttcagccagcctttatcattcctcttactttatcctttttccttaagtattggtggtcactactattgagtttcttccttaacactgattaaatgatcttaactccctcagctaaaactggcattactgactcccagctatatttctccagacttgcatttttttttttttttttgagacagggtctcactgtcgcccaggctggagtgcagtggcgtgatctcagttcactgctgctttccctcctgggctcaagcagttctcccacctcagcctctcgactaacagggactataatcttgcagcaccatgccgagctaattttattttttgtagagatgagctctcactatgtcacccaggttcgtctcaaactcctgaaccctagtaattctcctatctcagcctcccaaagtgctagggttacagacatgagccactgtgcctgtctagacttgtactttcaactgtccatttctccctgtctgtcccatgggcactcatgaaaaaacagaatgctcccaactttattcatcttccaagcctgtagctcttggtatactcactgttgcaagtcagaagcttgatttcatcattgatgtttttctcacgtttcacatctcactcatcaccaagtcatgttggtgttaatttctgattaacccttgaatttaccgtcttctcatcctctgtacaaaagcctcaagtgagggtcaaattcaacattatcctgatctagacagcccccattctcaatccacccttttccaagttgattgcccaaggacttctaacaataaactctcttttgcaccacagacttctttgaaaatatacatgctgttgaccctctctgtagaaaaccgcacacataaaacttaccaacagatttcattggttcttgggttctcccgaagcctatccatggtttatagattaagaattgatgaggtagctgggcacagtggctcacacctacgatcacagcacttcgggaggctgaagcaagcagatcacttgaggtcaggagtttgagaccagcctggccaacatggtgaaaccctgtctctactaaaaatacaaaaagtagccagccgtgatgacaggcacctgtaatcccagctactcgggaggctgaggcatgagaattgcttgaacccgggaggcggaggttgcagtgagcctggatcatgccactgcactccaacctgggcagcagagcaagactctgtctcaaaaggggaaaaaaaaaattgctgatgtgacccatgaagggaactcattttcctcgtaattttggactgccacacattggtacctttagttctctgaaggcccacgtttttatcattaagacctatttgttagctagtagagctttatgttcgctgtccatgaaaccttctgtaaccacagtgactacaagtagttctttctctattgaattattaggtccagaatagaagatgtcattgtacactttatttccctcacactgtgttatgctctgatgtgctatgcttagctatctgtcagagattagtaaattataaaactcatgtgtactacttaagtttatatcttatgctagtttataagaacaattaaaaggacttagaagattaa

SEQ ID NO: 418725 - DNA, 3175 bp, Homo sapiens
ctgaccacccctcttttttagagagttctgcctcgcttcccggcgcggtcgcagccctcagcccacttaggataatggcgacagctgaggtactgaacattggtaaaaaattatatgagggtaaaacaaaagaagtctacgaattgttagacagtccaggaaaagtcctcctgcagtccaaggaccagattacagcaggaaatgcagctagaaaaaaccacctggaaggaaaagctgcaatctcaaataaaatcaccagttgtatttttcagttattacaggaagcaggtattaaaactgccttcaccagaaaatgtggggagacagctttcattgcaccgcagtgtgaaatgattccaattgaatgggtttgcagaagaatagcaactggttcttttctcaaaagaaatcctggtgtcaaggaaggatataagttttacccacctaaagtggagttgtttttcaaggatgatgccaataatgacccacagtggtctgaggaacagctgattgctgcaaaattttgctttgctggacttcttataggccagactgaagtggatatcatgagtcatgctacacaggctatatttgaaatactggagaaatcctggttgccccagaattgtacactggttgatatgaagattgaatttggtgttgatgtaaccaccaaagaaattgttcttgctgatgttattgacaatgattcctggagactctggccatcaggagatcgaagccaacagaaagacaaacagtcttatcgggacctcaaagaagtaactcctgaagggctccaaatggtaaagaaaaactttgagtgggttgcagagagagtagagttgcttttgaaatcagaaagtcagtgcagggttgtagtgttgatgggctctacttctgatcttggtcactgtgaaaaaatcaagaaggcctgtggaaattttggcattccatgtgaacttcgagtaacatctgcgcataaaggaccagatgaaactctgaggattaaagctgagtatgaaggggatggcattcctactgtatttgtggcagtggcaggcagaagtaatggtttgggaccagtgatgtctgggaacactgcatatccagttatcagctgtcctcccctcacaccagactggggagttcaggatgtgtggtcttctcttcgactacccagtggtcttggctgttcaaccgtactttctccagaaggatcagctcaatttgctgctcagatatttgggttaagcaaccatttggtatggagcaaactgcgagcaagcattttgaacacatggatttccttgaagcaggctgacaagaaaatcagagaatgtaatttataagaaagaatgccattgaattttttaggggaaaaactacaaatttctaatttagctgaaggaaaatcaagcaagatgaaaaggtaattttaaattagagaacacaaataaaatgtattagtgaataaatgcttctctagatccatattaataaacatgagcatctaacccctcctttcttaggctagacaccaagatatttcagccagcctttatcattcctcttactttatcctttttccttaagtattggtggtcactactattgagtttcttccttaacactgattaaatgatcttaactccctcagctaaaactggcattactgactcccagctatatttctccagacttgcatttttttttttttttttgagacagggtctcactgtcgcccaggctggagtgcagtggcgtgatctcagttcactgctgctttccctcctgggctcaagcagttctcccacctcagcctctcgactaacagggactataatcttgcagcaccatgccgagctaattttattttttgtagagatgagctctcactatgtcacccaggttcgtctcaaactcctgaaccctagtaattctcctatctcagcctcccaaagtgctagggttacagacatgagccactgtgcctgtctagacttgtactttcaactgtccatttctccctgtctgtcccatgggcactcatgaaaaaacagaatgctcccaactttattcatcttccaagcctgtagctcttggtatactcactgttgcaagtcagaagcttgatttcatcattgatgtttttctcacgtttcacatctcactcatcaccaagtcatgttggtgttaatttctgattaacccttgaatttaccgtcttctcatcctctgtacaaaagcctcaagtgagggtcaaattcaacattatcctgatctagacagcccccattctcaatccacccttttccaagttgattgcccaaggacttctaacaataaactctcttttgcaccacagacttctttgaaaatatacatgctgttgaccctctctgtagaaaaccgcacacataaaacttaccaacagatttcattggttcttgggttctcccgaagcctatccatggtttatagattaagaattgatgaggtagctgggcacagtggctcacacctacgatcacagcacttcgggaggctgaagcaagcagatcacttgaggtcaggagtttgagaccagcctggccaacatggtgaaaccctgtctctactaaaaatacaaaaagtagccagccgtgatgacaggcacctgtaatcccagctactcgggaggctgaggcatgagaattgcttgaacccgggaggcggaggttgcagtgagcctggatcatgccactgcactccaacctgggcagcagagcaagactctgtctcaaaaggggaaaaaaaaaattgctgatgtgacccatgaagggaactcattttcctcgtaattttggactgccacacattggtacctttagttctctgaaggcccacgtttttatcattaagacctatttgttagctagtagagctttatgttcgctgtccatgaaaccttctgtaaccacagtgactacaagtagttctttctctattgaattattaggtccagaatagaagatgtcattgtacactttatttccctcacactgtgttatgctctgatgtgctatgcttagctatctgtcagagattagtaaattataaaactcatgtgtactacttaagtttatatcttatgctagtttataagaacaattaaaaggacttagaagattaa

SEQ ID NO: 418726 - DNA, 3174 bp, Homo sapiens
ggacgcgtgggtcgacccacgcagttctgcctcgcttcccggcgcggtcgcagccctcagcccacttaggataatggcgacagctgaggtactgaacattggtaaaaaattatatgagggtaaaacaaaagaagtctacgaattgttagacagtccaggaaaagtcctcctgcagtccaaggaccagattacagcaggaaatgcagctagaaaaaaccacctggaaggaaaagctgcaatctcaaataaaatcaccagttgtatttttcagttattacaggaagcaggtattaaaactgccttcaccagaaaatgtggggagacagctttcattgcaccgcagtgtgaaatgattccaattgaatgggtttgcagaagaatagcaactggttcttttctcaaaagaaatcctggtgtcaaggaaggatataagttttacccacctaaagtggagttgtttttcaaggatgatgccaataatgacccacagtggtctgaggaacagctgattgctgcaaaattttgctttgctggacttcttataggccagactgaagtggatatcatgagtcatgctacacaggctatatttgaaatactggagaaatcctggttgccccagaattgtacactggttgatatgaagattgaatttggtgttgatgtaaccaccaaagaaattgttcttgctgatgttattgacaatgattcctggagactctggccatcaggagatcgaagccaacagaaagacaaacagtcttatcgggacctcaaagaagtaactcctgaagggctccaaatggtaaagaaaaactttgagtgggttgcagagagagtagagttgcttttgaaatcagaaagtcagtgcagggttgtagtgttgatgggctctacttctgatcttggtcactgtgaaaaaatcaagaaggcctgtggaaattttggcattccatgtgaacttcgagtaacatctgcgcataaaggaccagatgaaactctgaggattaaagctgagtatgaaggggatggcattcctactgtatttgtggcagtggcaggcagaagtaatggtttgggaccagtgatgtctgggaacactgcatatccagttatcagctgtcctcccctcacaccagactggggagttcaggatgtgtggtcttctcttcgactacccagtggtcttggctgttcaaccgtactttctccagaaggatcagctcaatttgctgctcagatatttgggttaagcaaccatttggtatggagcaaactgcgagcaagcattttgaacacatggatttccttgaagcaggctgacaagaaaatcagagaatgtaatttataagaaagaatgccattgaattttttaggggaaaaactacaaatttctaatttagctgaaggaaaatcaagcaagatgaaaaggtaattttaaattagagaacacaaataaaatgtattagtgaataaatgcttctctagatccatattaataaacatgagcatctaacccctcctttcttaggctagacaccaagatatttcagccagcctttatcattcctcttactttatcctttttccttaagtattggtggtcactactattgagtttcttccttaacactgattaaatgatcttaactccctcagctaaaactggcattactgactcccagctatatttctccagacttgcatttttttttttttttttgagacagggtctcactgtcgcccaggctggagtgcagtggcgtgatctcagttcactgctgctttccctcctgggctcaagcagttctcccacctcagcctctcgactaacagggactataatcttgcagcaccatgccgagctaattttattttttgtagagatgagctctcactatgtcacccaggttcgtctcaaactcctgaaccctagtaattctcctatctcagcctcccaaagtgctagggttacagacatgagccactgtgcctgtctagacttgtactttcaactgtccatttctccctgtctgtcccatgggcactcatgaaaaaacagaatgctcccaactttattcatcttccaagcctgtagctcttggtatactcactgttgcaagtcagaagcttgatttcatcattgatgtttttctcacgtttcacatctcactcatcaccaagtcatgttggtgttaatttctgattaacccttgaatttaccgtcttctcatcctctgtacaaaagcctcaagtgagggtcaaattcaacattatcctgatctagacagcccccattctcaatccacccttttccaagttgattgcccaaggacttctaacaataaactctcttttgcaccacagacttctttgaaaatatacatgctgttgaccctctctgtagaaaaccgcacacataaaacttaccaacagatttcattggttcttgggttctcccgaagcctatccatggtttatagattaagaattgatgaggtagctgggcacagtggctcacacctacgatcacagcacttcgggaggctgaagcaagcagatcacttgaggtcaggagtttgagaccagcctggccaacatggtgaaaccctgtctctactaaaaatacaaaaagtagccagccgtgatgacaggcacctgtaatcccagctactcgggaggctgaggcatgagaattgcttgaacccgggaggcggaggttgcagtgagcctggatcatgccactgcactccaacctgggcagcagagcaagactctgtctcaaaaggggaaaaaaaaaattgctgatgtgacccatgaagggaactcattttcctcgtaattttggactgccacacattggtacctttagttctctgaaggcccacgtttttatcattaagacctatttgttagctagtagagctttatgttcgctgtccatgaaaccttctgtaaccacagtgactacaagtagttctttctctattgaattattaggtccagaatagaagatgtcattgtacactttatttccctcacactgtgttatgctctgatgtgctatgcttagctatctgtcagagattagtaaattataaaactcatgtgtactacttaagtttatatcttatgctagtttataagaacaattaaaaggacttagaagattaa

SEQ ID NO: 418727 - DNA, 3152 bp, Homo sapiens
tactgcctcggggatggggagaaggagcaaagtagaggagaacgagaaatggccaaggggtggaaagtactgaacattggtaaaaaattatatgagggtaaaacaaaagaagtctacgaattgttagacagtccaggaaaagtcctcctgcagtccaaggaccagattacagcaggaaatgcagctagaaaaaaccacctggaaggaaaagctgcaatctcaaataaaatcaccagttgtatttttcagttattacaggaagcaggtattaaaactgccttcaccagaaaatgtggggagacagctttcattgcaccgcagtgtgaaatgattccaattgaatgggtttgcagaagaatagcaactggttcttttctcaaaagaaatcctggtgtcaaggaaggatataagttttacccacctaaagtggagttgtttttcaaggatgatgccaataatgacccacagtggtctgaggaacagctgattgctgcaaaattttgctttgctggacttcttataggccagactgaagtggatatcatgagtcatgctacacaggctatatttgaaatactggagaaatcctggttgccccagaattgtacactggttgatatgaagattgaatttggtgttgatgtaaccaccaaagaaattgttcttgctgatgttattgacaatgattcctggagactctggccatcaggagatcgaagccaacagaaagacaaacagtcttatcgggacctcaaagaagtaactcctgaagggctccaaatggtaaagaaaaactttgagtgggttgcagagagagtagagttgcttttgaaatcagaaagtcagtgcagggttgtagtgttgatgggctctacttctgatcttggtcactgtgaaaaaatcaagaaggcctgtggaaattttggcattccatgtgaacttcgagtaacatctgcgcataaaggaccagatgaaactctgaggattaaagctgagtatgaaggggatggcattcctactgtatttgtggcagtggcaggcagaagtaatggtttgggaccagtgatgtctgggaacactgcatatccagttatcagctgtcctcccctcacaccagactggggagttcaggatgtgtggtcttctcttcgactacccagtggtcttggctgttcaaccgtactttctccagaaggatcagctcaatttgctgctcagatatttgggttaagcaaccatttggtatggagcaaactgcgagcaagcattttgaacacatggatttccttgaagcaggctgacaagaaaatcagagaatgtaatttataagaaagaatgccattgaattttttaggggaaaaactacaaatttctaatttagctgaaggaaaatcaagcaagatgaaaaggtaattttaaattagagaacacaaataaaatgtattagtgaataaatgcttctctagatccatattaataaacatgagcatctaacccctcctttcttaggctagacaccaagatatttcagccagcctttatcattcctcttactttatcctttttccttaagtattggtggtcactactattgagtttcttccttaacactgattaaatgatcttaactccctcagctaaaactggcattactgactcccagctatatttctccagacttgcatttttttttttttttttgagacagggtctcactgtcgcccaggctggagtgcagtggcgtgatctcagttcactgctgctttccctcctgggctcaagcagttctcccacctcagcctctcgactaacagggactataatcttgcagcaccatgccgagctaattttattttttgtagagatgagctctcactatgtcacccaggttcgtctcaaactcctgaaccctagtaattctcctatctcagcctcccaaagtgctagggttacagacatgagccactgtgcctgtctagacttgtactttcaactgtccatttctccctgtctgtcccatgggcactcatgaaaaaacagaatgctcccaactttattcatcttccaagcctgtagctcttggtatactcactgttgcaagtcagaagcttgatttcatcattgatgtttttctcacgtttcacatctcactcatcaccaagtcatgttggtgttaatttctgattaacccttgaatttaccgtcttctcatcctctgtacaaaagcctcaagtgagggtcaaattcaacattatcctgatctagacagcccccattctcaatccacccttttccaagttgattgcccaaggacttctaacaataaactctcttttgcaccacagacttctttgaaaatatacatgctgttgaccctctctgtagaaaaccgcacacataaaacttaccaacagatttcattggttcttgggttctcccgaagcctatccatggtttatagattaagaattgatgaggtagctgggcacagtggctcacacctacgatcacagcacttcgggaggctgaagcaagcagatcacttgaggtcaggagtttgagaccagcctggccaacatggtgaaaccctgtctctactaaaaatacaaaaagtagccagccgtgatgacaggcacctgtaatcccagctactcgggaggctgaggcatgagaattgcttgaacccgggaggcggaggttgcagtgagcctggatcatgccactgcactccaacctgggcagcagagcaagactctgtctcaaaaggggaaaaaaaaaattgctgatgtgacccatgaagggaactcattttcctcgtaattttggactgccacacattggtacctttagttctctgaaggcccacgtttttatcattaagacctatttgttagctagtagagctttatgttcgctgtccatgaaaccttctgtaaccacagtgactacaagtagttctttctctattgaattattaggtccagaatagaagatgtcattgtacactttatttccctcacactgtgttatgctctgatgtgctatgcttagctatctgtcagagattagtaaattataaaactcatgtgtactacttaagtttatatcttatgctagtttataagaacaattaaaaggacttagaagattaa

SEQ ID NO: 418728 - DNA, 3342 bp, Homo sapiens
ggcgggaagccagtggggcgttgtttcgtccgatatccgcgtttcagtctccgcccatacccctccgggttaggcggctgtagcggagctcgaaaagagtggcgcagggtcgcgcggccccgcctccttccccgcccagcgaagctctctgaccacccctcttttctagagttctgcctcgcttcccggcgcggtcgcagccctcagcccacttaggataatggcgacagctgaggtactgaacattggtaaaaaattatatgagggtaaaacaaaagaagtctacgaattgttagacagtccaggaaaagtcctcctgcagtccaaggaccagattacagcaggaaatgcagctagaaaaaaccacctggaaggaaaagctgcaatctcaaataaaatcaccagttgtatttttcagttattacaggaagcagttacctcatataagtcaaatcgtattaaaactgccttcaccagaaaatgtggggagacagctttcattgcaccgcagtgtgaaatgattccaattgaatgggtttgcagaagaatagcaactggttcttttctcaaaagaaatcctggtgtcaaggaaggatataagttttacccacctaaagtggagttgtttttcaaggatgatgccaataatgacccacagtggtctgaggaacagctgattgctgcaaaattttgctttgctggacttcttataggccagactgaagtggatatcatgagtcatgctacacaggctatatttgaaatactggagaaatcctggttgccccagaattgtacactggttgatatgaagattgaatttggtgttgatgtaaccaccaaagaaattgttcttgctgatgttattgacaatgattcctggagactctggccatcaggagatcgaagccaacagaaagacaaacagtcttatcgggacctcaaagaagtaactcctgaagggctccaaatggtaaagaaaaactttgagtgggttgcagagagagtagagttgcttttgaaatcagaaagtcagtgcagggttgtagtgttgatgggctctacttctgatcttggtcactgtgaaaaaatcaagaaggcctgtggaaattttggcattccatgtgaacttcgagtaacatctgcgcataaaggaccagatgaaactctgaggattaaagctgagtatgaaggggatggcattcctactgtatttgtggcagtggcaggcagaagtaatggtttgggaccagtgatgtctgggaacactgcatatccagttatcagctgtcctcccctcacaccagactggggagttcaggatgtgtggtcttctcttcgactacccagtggtcttggctgttcaaccgtactttctccagaaggatcagctcaatttgctgctcagatatttgggttaagcaaccatttggtatggagcaaactgcgagcaagcattttgaacacatggatttccttgaagcaggctgacaagaaaatcagagaatgtaatttataagaaagaatgccattgaattttttaggggaaaaactacaaatttctaatttagctgaaggaaaatcaagcaagatgaaaaggtaattttaaattagagaacacaaataaaatgtattagtgaataaatgcttctctagatccatattaataaacatgagcatctaacccctcctttcttaggctagacaccaagatatttcagccagcctttatcattcctcttactttatcctttttccttaagtattggtggtcactactattgagtttcttccttaacactgattaaatgatcttaactccctcagctaaaactggcattactgactcccagctatatttctccagacttgcatttttttttttttttttgagacagggtctcactgtcgcccaggctggagtgcagtggcgtgatctcagttcactgctgctttccctcctgggctcaagcagttctcccacctcagcctctcgactaacagggactataatcttgcagcaccatgccgagctaattttattttttgtagagatgagctctcactatgtcacccaggttcgtctcaaactcctgaaccctagtaattctcctatctcagcctcccaaagtgctagggttacagacatgagccactgtgcctgtctagacttgtactttcaactgtccatttctccctgtctgtcccatgggcactcatgaaaaaacagaatgctcccaactttattcatcttccaagcctgtagctcttggtatactcactgttgcaagtcagaagcttgatttcatcattgatgtttttctcacgtttcacatctcactcatcaccaagtcatgttggtgttaatttctgattaacccttgaatttaccgtcttctcatcctctgtacaaaagcctcaagtgagggtcaaattcaacattatcctgatctagacagcccccattctcaatccacccttttccaagttgattgcccaaggacttctaacaataaactctcttttgcaccacagacttctttgaaaatatacatgctgttgaccctctctgtagaaaaccgcacacataaaacttaccaacagatttcattggttcttgggttctcccgaagcctatccatggtttatagattaagaattgatgaggtagctgggcacagtggctcacacctacgatcacagcacttcgggaggctgaagcaagcagatcacttgaggtcaggagtttgagaccagcctggccaacatggtgaaaccctgtctctactaaaaatacaaaaagtagccagccgtgatgacaggcacctgtaatcccagctactcgggaggctgaggcatgagaattgcttgaacccgggaggcggaggttgcagtgagcctggatcatgccactgcactccaacctgggcagcagagcaagactctgtctcaaaaggggaaaaaaaaaattgctgatgtgacccatgaagggaactcattttcctcgtaattttggactgccacacattggtacctttagttctctgaaggcccacgtttttatcattaagacctatttgttagctagtagagctttatgttcgctgtccatgaaaccttctgtaaccacagtgactacaagtagttctttctctattgaattattaggtccagaatagaagatgtcattgtacactttatttccctcacactgtgttatgctctgatgtgctatgcttagctatctgtcagagattagtaaattataaaactcatgtgtactacttaagtttatatcttatgctagtttataagaacaattaaaaggacttagaagattaa

SEQ ID NO: 418729 - DNA, 3270 bp, Homo sapiens
ggcgggaagccagtggggcgttgtttcgtccgatatccgcgtttcagtctccgcccatacccctccgggttaggcggctgtagcggagctcgaaaagagtggcgcagggtcgcgcggccccgcctccttccccgcccagcgaagctctctgaccacccctcttttctagagttctgcctcgcttcccggcgcggtcgcagccctcagcccacttaggataatggcgacagctgaggtactgaacattggtaaaaaattatatgagggtaaaacaaaagaagtctacgaattgttagacagtccaggaaaagtcctcctgcagtccaaggaccagattacagcaggaaatgcagctagaaaaaaccacctggaaggaaaagctgcaatctcaaataaaatcaccagttgtatttttcagttattacaggaagcaggtattaaaactgccttcaccagaaaatgtggggagacagctttcattgcaccgcagtgtgaaatgattccaattgaatgggtttgcagaagaatagcaactggttcttttctcaaaagaaatcctggtgtcaaggaaggatataagttttacccacctaaagtggagttgtttttcaaggatgatgccaataatgacccacagtggtctgaggaacagctgattgctgcgagtcatgctacacaggctatatttgaaatactggagaaatcctggttgccccagaattgtacactggttgatatgaagattgaatttggtgttgatgtaaccaccaaagaaattgttcttgctgatgttattgacaatgattcctggagactctggccatcaggagatcgaagccaacagaaagacaaacagtcttatcgggacctcaaagaagtaactcctgaagggctccaaatggtaaagaaaaactttgagtgggttgcagagagagtagagttgcttttgaaatcagaaagtcagtgcagggttgtagtgttgatgggctctacttctgatcttggtcactgtgaaaaaatcaagaaggcctgtggaaattttggcattccatgtgaacttcgagtaacatctgcgcataaaggaccagatgaaactctgaggattaaagctgagtatgaaggggatggcattcctactgtatttgtggcagtggcaggcagaagtaatggtttgggaccagtgatgtctgggaacactgcatatccagttatcagctgtcctcccctcacaccagactggggagttcaggatgtgtggtcttctcttcgactacccagtggtcttggctgttcaaccgtactttctccagaaggatcagctcaatttgctgctcagatatttgggttaagcaaccatttggtatggagcaaactgcgagcaagcattttgaacacatggatttccttgaagcaggctgacaagaaaatcagagaatgtaatttataagaaagaatgccattgaattttttaggggaaaaactacaaatttctaatttagctgaaggaaaatcaagcaagatgaaaaggtaattttaaattagagaacacaaataaaatgtattagtgaataaatgcttctctagatccatattaataaacatgagcatctaacccctcctttcttaggctagacaccaagatatttcagccagcctttatcattcctcttactttatcctttttccttaagtattggtggtcactactattgagtttcttccttaacactgattaaatgatcttaactccctcagctaaaactggcattactgactcccagctatatttctccagacttgcatttttttttttttttttgagacagggtctcactgtcgcccaggctggagtgcagtggcgtgatctcagttcactgctgctttccctcctgggctcaagcagttctcccacctcagcctctcgactaacagggactataatcttgcagcaccatgccgagctaattttattttttgtagagatgagctctcactatgtcacccaggttcgtctcaaactcctgaaccctagtaattctcctatctcagcctcccaaagtgctagggttacagacatgagccactgtgcctgtctagacttgtactttcaactgtccatttctccctgtctgtcccatgggcactcatgaaaaaacagaatgctcccaactttattcatcttccaagcctgtagctcttggtatactcactgttgcaagtcagaagcttgatttcatcattgatgtttttctcacgtttcacatctcactcatcaccaagtcatgttggtgttaatttctgattaacccttgaatttaccgtcttctcatcctctgtacaaaagcctcaagtgagggtcaaattcaacattatcctgatctagacagcccccattctcaatccacccttttccaagttgattgcccaaggacttctaacaataaactctcttttgcaccacagacttctttgaaaatatacatgctgttgaccctctctgtagaaaaccgcacacataaaacttaccaacagatttcattggttcttgggttctcccgaagcctatccatggtttatagattaagaattgatgaggtagctgggcacagtggctcacacctacgatcacagcacttcgggaggctgaagcaagcagatcacttgaggtcaggagtttgagaccagcctggccaacatggtgaaaccctgtctctactaaaaatacaaaaagtagccagccgtgatgacaggcacctgtaatcccagctactcgggaggctgaggcatgagaattgcttgaacccgggaggcggaggttgcagtgagcctggatcatgccactgcactccaacctgggcagcagagcaagactctgtctcaaaaggggaaaaaaaaaattgctgatgtgacccatgaagggaactcattttcctcgtaattttggactgccacacattggtacctttagttctctgaaggcccacgtttttatcattaagacctatttgttagctagtagagctttatgttcgctgtccatgaaaccttctgtaaccacagtgactacaagtagttctttctctattgaattattaggtccagaatagaagatgtcattgtacactttatttccctcacactgtgttatgctctgatgtgctatgcttagctatctgtcagagattagtaaattataaaactcatgtgtactacttaagtttatatcttatgctagtttataagaacaattaaaaggacttagaagattaa

SEQ ID NO: 418730 - DNA, 1468 bp, Homo sapiens
ggcgggaagccagtggggcgttgtttcgtccgatatccgcgtttcagtctccgcccatacccctccgggttaggcggctgtagcggagctcgaaaagagtggcgcagggtcgcgcggccccgcctccttccccgcccagcgaagctctctgaccacccctcttttctagagttctgcctcgcttcccggcgcggtcgcagccctcagcccacttaggataatggcgacagctgaggtactgaacattggtaaaaaattatatgagggtaaaacaaaagaagtctacgaattgttagacagtccaggaaaagtcctcctgcagtccaaggaccagattacagcaggaaatgcagctagaaaaaaccacctggaaggaaaagctgcaatctcaaataaaatcaccagttgtatttttcagttattacaggaagcaggtattaaaactgccttcaccagaaaatgtggggagacagctttcattgcaccgcagtgtgaaatgattccaattgaatgggtttgcagaagaatagcaactggttcttttctcaaaagaaatcctggtgtcaaggaaggatataagttttacccacctaaagtggagttgtttttcaaggatgatgccaataatgacccacagtggtctgaggaacagctgattgctgcaaaattttgctttgctggacttcttataggccagactgaagtggatatcatgagtcatgctacacaggctatatttgaaatactggagaaatcctggttgccccagaattgtacactggttgatatgaagattgaatttggtgttgatgtaaccaccaaagaaattgttcttgctgatgttattgacaatgattcctggagactctggccatcaggagatcgaagccaacagaaagacaaacagtcttatcgggacctcaaagaagtaactcctgaagggctccaaatggtaaagaaaaactttgagtgggttgcagagagagtagagttgcttttgaaatcagaaagtcagtgcagggttgtagtgttgatgggctctacttctgatcttggtcactgtgaaaaaatcaagaaggcctgtggaaattttggcattccatgtgaacttcgagtaacatctgcgcataaaggaccagatgaaactctgaggattaaagctgagtatgaaggggatggcattcctactgtatttgtggcaaggcagacaatttcaaaacaccgtatatagtcttaatatggaattaacaatagggtattgtgaatacacaaaagtaggaaggactctgatctctagaaaacaattgtatactgtgaatgaaaaagactaattctccacagtctatactcaatctctcttacctttccataattttcttcagcaaacttattaccaccaaacatagtacatgtttatttattacccatctctcccaactagaaaataaatgtattacactgggatgtc

SEQ ID NO: 418731 - DNA, 3252 bp, Homo sapiens
agctgtatttgctgcacgtggaaatctccgttattttccagcacccaacagtagcgtaatgggagtaacggacttaacctcatttctctttcagagcatttagccttcatatgcccttccctgcatgcttcccccaggccgtcaagacttgagttctgcctcgcttcccggcgcggtcgcagccctcagcccacttaggataatggcgacagctgaggtactgaacattggtaaaaaattatatgagggtaaaacaaaagaagtctacgaattgttagacagtccaggaaaagtcctcctgcagtccaaggaccagattacagcaggaaatgcagctagaaaaaaccacctggaaggaaaagctgcaatctcaaataaaatcaccagttgtatttttcagttattacaggaagcaggtattaaaactgccttcaccagaaaatgtggggagacagctttcattgcaccgcagtgtgaaatgattccaattgaatgggtttgcagaagaatagcaactggttcttttctcaaaagaaatcctggtgtcaaggaaggatataagttttacccacctaaagtggagttgtttttcaaggatgatgccaataatgacccacagtggtctgaggaacagctgattgctgcgagtcatgctacacaggctatatttgaaatactggagaaatcctggttgccccagaattgtacactggttgatatgaagattgaatttggtgttgatgtaaccaccaaagaaattgttcttgctgatgttattgacaatgattcctggagactctggccatcaggagatcgaagccaacagaaagacaaacagtcttatcgggacctcaaagaagtaactcctgaagggctccaaatggtaaagaaaaactttgagtgggttgcagagagagtagagttgcttttgaaatcagaaagtcagtgcagggttgtagtgttgatgggctctacttctgatcttggtcactgtgaaaaaatcaagaaggcctgtggaaattttggcattccatgtgaacttcgagtaacatctgcgcataaaggaccagatgaaactctgaggattaaagctgagtatgaaggggatggcattcctactgtatttgtggcagtggcaggcagaagtaatggtttgggaccagtgatgtctgggaacactgcatatccagttatcagctgtcctcccctcacaccagactggggagttcaggatgtgtggtcttctcttcgactacccagtggtcttggctgttcaaccgtactttctccagaaggatcagctcaatttgctgctcagatatttgggttaagcaaccatttggtatggagcaaactgcgagcaagcattttgaacacatggatttccttgaagcaggctgacaagaaaatcagagaatgtaatttataagaaagaatgccattgaattttttaggggaaaaactacaaatttctaatttagctgaaggaaaatcaagcaagatgaaaaggtaattttaaattagagaacacaaataaaatgtattagtgaataaatgcttctctagatccatattaataaacatgagcatctaacccctcctttcttaggctagacaccaagatatttcagccagcctttatcattcctcttactttatcctttttccttaagtattggtggtcactactattgagtttcttccttaacactgattaaatgatcttaactccctcagctaaaactggcattactgactcccagctatatttctccagacttgcatttttttttttttttttgagacagggtctcactgtcgcccaggctggagtgcagtggcgtgatctcagttcactgctgctttccctcctgggctcaagcagttctcccacctcagcctctcgactaacagggactataatcttgcagcaccatgccgagctaattttattttttgtagagatgagctctcactatgtcacccaggttcgtctcaaactcctgaaccctagtaattctcctatctcagcctcccaaagtgctagggttacagacatgagccactgtgcctgtctagacttgtactttcaactgtccatttctccctgtctgtcccatgggcactcatgaaaaaacagaatgctcccaactttattcatcttccaagcctgtagctcttggtatactcactgttgcaagtcagaagcttgatttcatcattgatgtttttctcacgtttcacatctcactcatcaccaagtcatgttggtgttaatttctgattaacccttgaatttaccgtcttctcatcctctgtacaaaagcctcaagtgagggtcaaattcaacattatcctgatctagacagcccccattctcaatccacccttttccaagttgattgcccaaggacttctaacaataaactctcttttgcaccacagacttctttgaaaatatacatgctgttgaccctctctgtagaaaaccgcacacataaaacttaccaacagatttcattggttcttgggttctcccgaagcctatccatggtttatagattaagaattgatgaggtagctgggcacagtggctcacacctacgatcacagcacttcgggaggctgaagcaagcagatcacttgaggtcaggagtttgagaccagcctggccaacatggtgaaaccctgtctctactaaaaatacaaaaagtagccagccgtgatgacaggcacctgtaatcccagctactcgggaggctgaggcatgagaattgcttgaacccgggaggcggaggttgcagtgagcctggatcatgccactgcactccaacctgggcagcagagcaagactctgtctcaaaaggggaaaaaaaaaattgctgatgtgacccatgaagggaactcattttcctcgtaattttggactgccacacattggtacctttagttctctgaaggcccacgtttttatcattaagacctatttgttagctagtagagctttatgttcgctgtccatgaaaccttctgtaaccacagtgactacaagtagttctttctctattgaattattaggtccagaatagaagatgtcattgtacactttatttccctcacactgtgttatgctctgatgtgctatgcttagctatctgtcagagattagtaaattataaaactcatgtgtactacttaagtttatatcttatgctagtttataagaacaattaaaaggacttagaagattaa

SEQ ID NO: 418732 - DNA, 1554 bp, Homo sapiens
ggcgggaagccagtggggcgttgtttcgtccgatatccgcgtttcagtctccgcccatacccctccgggttaggcggctgtagcggagctcgaaaagagtggcgcagggtcgcgcggccccgcctccttccccgcccagcgaagctctctgaccacccctcttttctagagttctgcctcgcttcccggcgcggtcgcagccctcagcccacttaggataatggcgacagctgaggtactgaacattggtaaaaaattatatgagggtaaaacaaaagaagtctacgaattgttagacagtccaggaaaagtcctcctgcagtccaaggaccagattacagcaggaaatgcagctagaaaaaaccacctggaaggaaaagctgcaatctcaaataaaatcaccagttgtatttttcagttattacaggaagcaggtattaaaactgccttcaccagaaaatgtggggagacagctttcattgcaccgcagtgtgaaatgattccaattgaatgggtttgcagaagaatagcaactggttcttttctcaaaagaaatcctggtgtcaaggaaggatataagttttacccacctaaagtggagttgtttttcaaggatgatgccaataatgacccacagtggtctgaggaacagctgattgctgcaaaattttgctttgctggacttcttataggccagactgaagtggatatcatgagtcatgctacacaggctatatttgaaatactggagaaatcctggttgccccagaattgtacactggttgatatgaagattgaatttggtgttgatgtaaccaccaaagaaattgttcttgctgatgttattgacaatgattcctggagactctggccatcaggagatcgaagccaacagaaagacaaacagtcttatcgggacctcaaagaagtaactcctgaagggctccaaatggtaaagaaaaactttgagtgggttgcagagagagtagagttgcttttgaaatcagaaagtcagtgcagggttgtagtgttgatgggctctacttctgatcttggtcactgtgaaaaaatcaagaaggcctgtggaaattttggcattccatgtgaacttcgagtaacatctgcgcataaaggaccagatgaaactctgaagactctgtctcaaaaggggaaaaaaaaaattgctgatgtgacccatgaagggaactcattttcctcgtaattttggactgccacacattggtacctttagttctctgaaggcccacgtttttatcattaagacctatttgttagctagtagagctttatgttcgctgtccatgaaaccttctgtaaccacagtgactacaagtagttctttctctattgaattattaggtccagaatagaagatgtcattgtacactttatttccctcacactgtgttatgctctgatgtgctatgcttagctatctgtcagagattagtaaattataaaactcatgtgtactacttaagtttatatcttatgctagtttataagaacaattaaaaggacttagaagattaa

SEQ ID NO: 418733 - DNA, 2720 bp, Homo sapiens
ttaagtttagtagtaaaagactggttaatgataacaatgcatcgtaaaaccttcagaaggaaaggagaatgttttgtggaccactttggttttcttttttgcgtgtggcagtcgagtcatgctacacaggctatatttgaaatactggagaaatcctggttgccccagaattgtacactggttgatatgaagattgaatttggtgttgatgtaaccaccaaagaaattgttcttgctgatgttattgacaatgattcctggagactctggccatcaggagatcgaagccaacagaaagacaaacagtcttatcgggacctcaaagaagtaactcctgaagggctccaaatggtaaagaaaaactttgagtgggttgcagagagagtagagttgcttttgaaatcagaaagtcagtgcagggttgtagtgttgatgggctctacttctgatcttggtcactgtgaaaaaatcaagaaggcctgtggaaattttggcattccatgtgaacttcgagtaacatctgcgcataaaggaccagatgaaactctgaggattaaagctgagtatgaaggggatggcattcctactgtatttgtggcagtggcaggcagaagtaatggtttgggaccagtgatgtctgggaacactgcatatccagttatcagctgtcctcccctcacaccagactggggagttcaggatgtgtggtcttctcttcgactacccagtggtcttggctgttcaaccgtactttctccagaaggatcagctcaatttgctgctcagatatttgggttaagcaaccatttggtatggagcaaactgcgagcaagcattttgaacacatggatttccttgaagcaggctgacaagaaaatcagagaatgtaatttataagaaagaatgccattgaattttttaggggaaaaactacaaatttctaatttagctgaaggaaaatcaagcaagatgaaaaggtaattttaaattagagaacacaaataaaatgtattagtgaataaatgcttctctagatccatattaataaacatgagcatctaacccctcctttcttaggctagacaccaagatatttcagccagcctttatcattcctcttactttatcctttttccttaagtattggtggtcactactattgagtttcttccttaacactgattaaatgatcttaactccctcagctaaaactggcattactgactcccagctatatttctccagacttgcatttttttttttttttttgagacagggtctcactgtcgcccaggctggagtgcagtggcgtgatctcagttcactgctgctttccctcctgggctcaagcagttctcccacctcagcctctcgactaacagggactataatcttgcagcaccatgccgagctaattttattttttgtagagatgagctctcactatgtcacccaggttcgtctcaaactcctgaaccctagtaattctcctatctcagcctcccaaagtgctagggttacagacatgagccactgtgcctgtctagacttgtactttcaactgtccatttctccctgtctgtcccatgggcactcatgaaaaaacagaatgctcccaactttattcatcttccaagcctgtagctcttggtatactcactgttgcaagtcagaagcttgatttcatcattgatgtttttctcacgtttcacatctcactcatcaccaagtcatgttggtgttaatttctgattaacccttgaatttaccgtcttctcatcctctgtacaaaagcctcaagtgagggtcaaattcaacattatcctgatctagacagcccccattctcaatccacccttttccaagttgattgcccaaggacttctaacaataaactctcttttgcaccacagacttctttgaaaatatacatgctgttgaccctctctgtagaaaaccgcacacataaaacttaccaacagatttcattggttcttgggttctcccgaagcctatccatggtttatagattaagaattgatgaggtagctgggcacagtggctcacacctacgatcacagcacttcgggaggctgaagcaagcagatcacttgaggtcaggagtttgagaccagcctggccaacatggtgaaaccctgtctctactaaaaatacaaaaagtagccagccgtgatgacaggcacctgtaatcccagctactcgggaggctgaggcatgagaattgcttgaacccgggaggcggaggttgcagtgagcctggatcatgccactgcactccaacctgggcagcagagcaagactctgtctcaaaaggggaaaaaaaaaattgctgatgtgacccatgaagggaactcattttcctcgtaattttggactgccacacattggtacctttagttctctgaaggcccacgtttttatcattaagacctatttgttagctagtagagctttatgttcgctgtccatgaaaccttctgtaaccacagtgactacaagtagttctttctctattgaattattaggtccagaatagaagatgtcattgtacactttatttccctcacactgtgttatgctctgatgtgctatgcttagctatctgtcagagattagtaaattataaaactcatgtgtactacttaagtttatatcttatgctagtttataagaacaattaaaaggacttagaagattaa

SEQ ID NO: 418734 - DNA, 1444 bp, Homo sapiens
ggcgggaagccagtggggcgttgtttcgtccgatatccgcgtttcagtctccgcccatacccctccgggttaggcggctgtagcggagctcgaaaagagtggcgcagggtcgcgcggccccgcctccttccccgcccagcgaagctctctgaccacccctcttttctagagttctgcctcgcttcccggcgcggtcgcagccctcagcccacttaggataatggcgacagctgaggtactgaacattggtaaaaaattatatgagggtaaaacaaaagaagtctacgaattgttagacagtccaggaaaagtcctcctgcagtccaaggaccagattacagcaggaaatgcagctagaaaaaaccacctggaaggaaaagctgcaatctcaaataaaatcaccagttgtatttttcagttattacaggaagcaggtattaaaactgccttcaccagaaaatgtggggagacagctttcattgcaccgcagtgtgaaatgattccaattgaatgggtttgcagaagaatagcaactggttcttttctcaaaagaaatcctggtgtcaaggaaggatataagttttacccacctaaagtggagttgtttttcaaggatgatgccaataatgacccacagtggtctgaggaacagctgattgctgcaaaattttgctttgctggacttcttataggccagactgaagtggatatcatgagtcatgctacacaggctatatttgaaatactggagaaatcctggttgccccagaattgtacactggttgatatgaagattgaatttggtgttgatgtaaccaccaaagaaattgttcttgctgatgttattgacaatgattcctggagactctggccatcaggagatcgaagccaacagaaagacaaacagtcttatcgggacctcaaagaagtaactcctgaagggctccaaatggtaaagaaaaactttgagtgggttgcagagagagtagagttgcttttgaaatcagaaagtcagtgcagggttgtagtgttgatgggctctacttctgatcttggtcactgtgaaaaaaattgctgatgtgacccatgaagggaactcattttcctcgtaattttggactgccacacattggtacctttagttctctgaaggcccacgtttttatcattaagacctatttgttagctagtagagctttatgttcgctgtccatgaaaccttctgtaaccacagtgactacaagtagttctttctctattgaattattaggtccagaatagaagatgtcattgtacactttatttccctcacactgtgttatgctctgatgtgctatgcttagctatctgtcagagattagtaaattataaaactcatgtgtactacttaagtttatatcttatgctagtttataagaacaattaaaaggacttagaagattaa

SEQ ID NO: 418735 - DNA, 2513 bp, Homo sapiens
tagaggatctccgactagtccaaccatactgatgttattgacaatgattcctggagactctggccatcaggagatcgaagccaacagaaagacaaacagtcttatcgggacctcaaagaagtaactcctgaagggctccaaatggtaaagaaaaactttgagtgggttgcagagagagtagagttgcttttgaaatcagaaagtcagtgcagggttgtagtgttgatgggctctacttctgatcttggtcactgtgaaaaaatcaagaaggcctgtggaaattttggcattccatgtgaacttcgagtaacatctgcgcataaaggaccagatgaaactctgaggattaaagctgagtatgaaggggatggcattcctactgtatttgtggcagtggcaggcagaagtaatggtttgggaccagtgatgtctgggaacactgcatatccagttatcagctgtcctcccctcacaccagactggggagttcaggatgtgtggtcttctcttcgactacccagtggtcttggctgttcaaccgtactttctccagaaggatcagctcaatttgctgctcagatatttgggttaagcaaccatttggtatggagcaaactgcgagcaagcattttgaacacatggatttccttgaagcaggctgacaagaaaatcagagaatgtaatttataagaaagaatgccattgaattttttaggggaaaaactacaaatttctaatttagctgaaggaaaatcaagcaagatgaaaaggtaattttaaattagagaacacaaataaaatgtattagtgaataaatgcttctctagatccatattaataaacatgagcatctaacccctcctttcttaggctagacaccaagatatttcagccagcctttatcattcctcttactttatcctttttccttaagtattggtggtcactactattgagtttcttccttaacactgattaaatgatcttaactccctcagctaaaactggcattactgactcccagctatatttctccagacttgcatttttttttttttttttgagacagggtctcactgtcgcccaggctggagtgcagtggcgtgatctcagttcactgctgctttccctcctgggctcaagcagttctcccacctcagcctctcgactaacagggactataatcttgcagcaccatgccgagctaattttattttttgtagagatgagctctcactatgtcacccaggttcgtctcaaactcctgaaccctagtaattctcctatctcagcctcccaaagtgctagggttacagacatgagccactgtgcctgtctagacttgtactttcaactgtccatttctccctgtctgtcccatgggcactcatgaaaaaacagaatgctcccaactttattcatcttccaagcctgtagctcttggtatactcactgttgcaagtcagaagcttgatttcatcattgatgtttttctcacgtttcacatctcactcatcaccaagtcatgttggtgttaatttctgattaacccttgaatttaccgtcttctcatcctctgtacaaaagcctcaagtgagggtcaaattcaacattatcctgatctagacagcccccattctcaatccacccttttccaagttgattgcccaaggacttctaacaataaactctcttttgcaccacagacttctttgaaaatatacatgctgttgaccctctctgtagaaaaccgcacacataaaacttaccaacagatttcattggttcttgggttctcccgaagcctatccatggtttatagattaagaattgatgaggtagctgggcacagtggctcacacctacgatcacagcacttcgggaggctgaagcaagcagatcacttgaggtcaggagtttgagaccagcctggccaacatggtgaaaccctgtctctactaaaaatacaaaaagtagccagccgtgatgacaggcacctgtaatcccagctactcgggaggctgaggcatgagaattgcttgaacccgggaggcggaggttgcagtgagcctggatcatgccactgcactccaacctgggcagcagagcaagactctgtctcaaaaggggaaaaaaaaaattgctgatgtgacccatgaagggaactcattttcctcgtaattttggactgccacacattggtacctttagttctctgaaggcccacgtttttatcattaagacctatttgttagctagtagagctttatgttcgctgtccatgaaaccttctgtaaccacagtgactacaagtagttctttctctattgaattattaggtccagaatagaagatgtcattgtacactttatttccctcacactgtgttatgctctgatgtgctatgcttagctatctgtcagagattagtaaattataaaactcatgtgtactacttaagtttatatcttatgctagtttataagaacaattaaaaggacttagaagattaa

SEQ ID NO: 418736 - DNA, 2532 bp, Homo sapiens
ggctgttcgaatttgaacgtctctgtgattggaaaacccctggcgatgtgatgttattgacaatgattcctggagactctggccatcaggagatcgaagccaacagaaagacaaacagtcttatcgggacctcaaagaagtaactcctgaagggctccaaatggtaaagaaaaactttgagtgggttgcagagagagtagagttgcttttgaaatcagaaagtcagtgcagggttgtagtgttgatgggctctacttctgatcttggtcactgtgaaaaaatcaagaaggcctgtggaaattttggcattccatgtgaacttcgagtaacatctgcgcataaaggaccagatgaaactctgaggattaaagctgagtatgaaggggatggcattcctactgtatttgtggcagtggcaggcagaagtaatggtttgggaccagtgatgtctgggaacactgcatatccagttatcagctgtcctcccctcacaccagactggggagttcaggatgtgtggtcttctcttcgactacccagtggtcttggctgttcaaccgtactttctccagaaggatcagctcaatttgctgctcagatatttgggttaagcaaccatttggtatggagcaaactgcgagcaagcattttgaacacatggatttccttgaagcaggctgacaagaaaatcagagaatgtaatttataagaaagaatgccattgaattttttaggggaaaaactacaaatttctaatttagctgaaggaaaatcaagcaagatgaaaaggtaattttaaattagagaacacaaataaaatgtattagtgaataaatgcttctctagatccatattaataaacatgagcatctaacccctcctttcttaggctagacaccaagatatttcagccagcctttatcattcctcttactttatcctttttccttaagtattggtggtcactactattgagtttcttccttaacactgattaaatgatcttaactccctcagctaaaactggcattactgactcccagctatatttctccagacttgcatttttttttttttttttgagacagggtctcactgtcgcccaggctggagtgcagtggcgtgatctcagttcactgctgctttccctcctgggctcaagcagttctcccacctcagcctctcgactaacagggactataatcttgcagcaccatgccgagctaattttattttttgtagagatgagctctcactatgtcacccaggttcgtctcaaactcctgaaccctagtaattctcctatctcagcctcccaaagtgctagggttacagacatgagccactgtgcctgtctagacttgtactttcaactgtccatttctccctgtctgtcccatgggcactcatgaaaaaacagaatgctcccaactttattcatcttccaagcctgtagctcttggtatactcactgttgcaagtcagaagcttgatttcatcattgatgtttttctcacgtttcacatctcactcatcaccaagtcatgttggtgttaatttctgattaacccttgaatttaccgtcttctcatcctctgtacaaaagcctcaagtgagggtcaaattcaacattatcctgatctagacagcccccattctcaatccacccttttccaagttgattgcccaaggacttctaacaataaactctcttttgcaccacagacttctttgaaaatatacatgctgttgaccctctctgtagaaaaccgcacacataaaacttaccaacagatttcattggttcttgggttctcccgaagcctatccatggtttatagattaagaattgatgaggtagctgggcacagtggctcacacctacgatcacagcacttcgggaggctgaagcaagcagatcacttgaggtcaggagtttgagaccagcctggccaacatggtgaaaccctgtctctactaaaaatacaaaaagtagccagccgtgatgacaggcacctgtaatcccagctactcgggaggctgaggcatgagaattgcttgaacccgggaggcggaggttgcagtgagcctggatcatgccactgcactccaacctgggcagcagagcaagactctgtctcaaaaggggaaaaaaaaaattgctgatgtgacccatgaagggaactcattttcctcgtaattttggactgccacacattggtacctttagttctctgaaggcccacgtttttatcattaagacctatttgttagctagtagagctttatgttcgctgtccatgaaaccttctgtaaccacagtgactacaagtagttctttctctattgaattattaggtccagaatagaagatgtcattgtacactttatttccctcacactgtgttatgctctgatgtgctatgcttagctatctgtcagagattagtaaattataaaactcatgtgtactacttaagtttatatcttatgctagtttataagaacaattaaaaggacttagaagattaa

SEQ ID NO: 418737 - DNA, 1063 bp, Homo sapiens
ggcgggaagccagtggggcgttgtttcgtccgatatccgcgtttcagtctccgcccatacccctccgggttaggcggctgtagcggagctcgaaaagagtggcgcagggtcgcgcggccccgcctccttccccgcccagcgaagctctctgaccacccctcttttctagagttctgcctcgcttcccggcgcggtcgcagccctcagcccacttaggataatggcgacagctgaggtactgaacattggtaaaaaattatatgagggtaaaacaaaagaagtctacgaattgttagacagtccaggaaaagtcctcctgcagtccaaggaccagattacagcaggaaatgcagctagaaaaaaccacctggaaggaaaagctgcaatctcaaataaaatcaccagttgtatttttcagttattacaggaagcaggtattaaaactgccttcaccagaaaatgtggggagacagctttcattgcaccgcagtgtgaaatgattccaattgaatgggtttgcagaagaatagcaactggttcttttctcaaaagaaatcctggtgtcaaggaaggatataagttttacccacctaaagtggagttgtttttcaaggatgatgccaataatgacccacagtggtctgaggaacagctgattgctgcaaaattttgctttgctggacttcttataggccagactgaagtggatatcatgagtcatgctacacaggctatatttgaaatactggagaaatcctggttgccccagaattgtacactggttgatatgaagattgaatttggtgttgatgtaaccaccaaagaaattgttcttgctgatgttattgacaatgattcctggagactctggccatcaggagatcgaagccaacagaaagacaaacagtcttatcgggacctcaaagaagtaactcctgaagggctccaaatggtaaagaaaaactttgagtgggttgcagagagagtagaggtaaaccttctatagtaaaactgtatgtattatgtgtttttcttctaagaaaatcttgtttcaaaagaaaaa

SEQ ID NO: 418738 - DNA, 2120 bp, Homo sapiens
gaccacacatcctgaactccccagtctggtgtgaggggaggacagctgataactggatatgcagtgttcccagacatcacaccagactggggagttcaggatgtgtggtcttctcttcgactacccagtggtcttggctgttcaaccgtactttctccagaaggatcagctcaatttgctgctcagatatttgggttaagcaaccatttggtatggagcaaactgcgagcaagcattttgaacacatggatttccttgaagcaggctgacaagaaaatcagagaatgtaatttataagaaagaatgccattgaattttttaggggaaaaactacaaatttctaatttagctgaaggaaaatcaagcaagatgaaaaggtaattttaaattagagaacacaaataaaatgtattagtgaataaatgcttctctagatccatattaataaacatgagcatctaacccctcctttcttaggctagacaccaagatatttcagccagcctttatcattcctcttactttatcctttttccttaagtattggtggtcactactattgagtttcttccttaacactgattaaatgatcttaactccctcagctaaaactggcattactgactcccagctatatttctccagacttgcatttttttttttttttttgagacagggtctcactgtcgcccaggctggagtgcagtggcgtgatctcagttcactgctgctttccctcctgggctcaagcagttctcccacctcagcctctcgactaacagggactataatcttgcagcaccatgccgagctaattttattttttgtagagatgagctctcactatgtcacccaggttcgtctcaaactcctgaaccctagtaattctcctatctcagcctcccaaagtgctagggttacagacatgagccactgtgcctgtctagacttgtactttcaactgtccatttctccctgtctgtcccatgggcactcatgaaaaaacagaatgctcccaactttattcatcttccaagcctgtagctcttggtatactcactgttgcaagtcagaagcttgatttcatcattgatgtttttctcacgtttcacatctcactcatcaccaagtcatgttggtgttaatttctgattaacccttgaatttaccgtcttctcatcctctgtacaaaagcctcaagtgagggtcaaattcaacattatcctgatctagacagcccccattctcaatccacccttttccaagttgattgcccaaggacttctaacaataaactctcttttgcaccacagacttctttgaaaatatacatgctgttgaccctctctgtagaaaaccgcacacataaaacttaccaacagatttcattggttcttgggttctcccgaagcctatccatggtttatagattaagaattgatgaggtagctgggcacagtggctcacacctacgatcacagcacttcgggaggctgaagcaagcagatcacttgaggtcaggagtttgagaccagcctggccaacatggtgaaaccctgtctctactaaaaatacaaaaagtagccagccgtgatgacaggcacctgtaatcccagctactcgggaggctgaggcatgagaattgcttgaacccgggaggcggaggttgcagtgagcctggatcatgccactgcactccaacctgggcagcagagcaagactctgtctcaaaaggggaaaaaaaaaattgctgatgtgacccatgaagggaactcattttcctcgtaattttggactgccacacattggtacctttagttctctgaaggcccacgtttttatcattaagacctatttgttagctagtagagctttatgttcgctgtccatgaaaccttctgtaaccacagtgactacaagtagttctttctctattgaattattaggtccagaatagaagatgtcattgtacactttatttccctcacactgtgttatgctctgatgtgctatgcttagctatctgtcagagattagtaaattataaaactcatgtgtactacttaagtttatatcttatgctagtttataagaacaattaaaaggacttagaagattaa

SEQ ID NO: 418739 - DNA, 2116 bp, Homo sapiens
ttagaataatgcagtagctttttattttctgtggcaggactgctctgagtataaaattttttgtaaggttgtattttcattactaattgagctcaattttctgtcttttccttgctgaaccaataggtcttggctgttcaaccgtactttctccagaaggatcagctcaatttgctgctcagatatttgggttaagcaaccatttggtatggagcaaactgcgagcaagcattttgaacacatggatttccttgaagcaggctgacaagaaaatcagagaatgtaatttataagaaagaatgccattgaattttttaggggaaaaactacaaatttctaatttagctgaaggaaaatcaagcaagatgaaaaggtaattttaaattagagaacacaaataaaatgtattagtgaataaatgcttctctagatccatattaataaacatgagcatctaacccctcctttcttaggctagacaccaagatatttcagccagcctttatcattcctcttactttatcctttttccttaagtattggtggtcactactattgagtttcttccttaacactgattaaatgatcttaactccctcagctaaaactggcattactgactcccagctatatttctccagacttgcatttttttttttttttttgagacagggtctcactgtcgcccaggctggagtgcagtggcgtgatctcagttcactgctgctttccctcctgggctcaagcagttctcccacctcagcctctcgactaacagggactataatcttgcagcaccatgccgagctaattttattttttgtagagatgagctctcactatgtcacccaggttcgtctcaaactcctgaaccctagtaattctcctatctcagcctcccaaagtgctagggttacagacatgagccactgtgcctgtctagacttgtactttcaactgtccatttctccctgtctgtcccatgggcactcatgaaaaaacagaatgctcccaactttattcatcttccaagcctgtagctcttggtatactcactgttgcaagtcagaagcttgatttcatcattgatgtttttctcacgtttcacatctcactcatcaccaagtcatgttggtgttaatttctgattaacccttgaatttaccgtcttctcatcctctgtacaaaagcctcaagtgagggtcaaattcaacattatcctgatctagacagcccccattctcaatccacccttttccaagttgattgcccaaggacttctaacaataaactctcttttgcaccacagacttctttgaaaatatacatgctgttgaccctctctgtagaaaaccgcacacataaaacttaccaacagatttcattggttcttgggttctcccgaagcctatccatggtttatagattaagaattgatgaggtagctgggcacagtggctcacacctacgatcacagcacttcgggaggctgaagcaagcagatcacttgaggtcaggagtttgagaccagcctggccaacatggtgaaaccctgtctctactaaaaatacaaaaagtagccagccgtgatgacaggcacctgtaatcccagctactcgggaggctgaggcatgagaattgcttgaacccgggaggcggaggttgcagtgagcctggatcatgccactgcactccaacctgggcagcagagcaagactctgtctcaaaaggggaaaaaaaaaattgctgatgtgacccatgaagggaactcattttcctcgtaattttggactgccacacattggtacctttagttctctgaaggcccacgtttttatcattaagacctatttgttagctagtagagctttatgttcgctgtccatgaaaccttctgtaaccacagtgactacaagtagttctttctctattgaattattaggtccagaatagaagatgtcattgtacactttatttccctcacactgtgttatgctctgatgtgctatgcttagctatctgtcagagattagtaaattataaaactcatgtgtactacttaagtttatatcttatgctagtttataagaacaattaaaaggacttagaagattaa

SEQ ID NO: 418740 - DNA, 1738 bp, Homo sapiens
ggcgggaagccagtggggcgttgtttcgtccgatatccgcgtttcagtctccgcccatacccctccgggttaggcggctgtagcggagctcgaaaagagtggcgcagggtcgcgcggccccgcctccttccccgcccagcgaagctctctgaccacccctcttttctagagttctgcctcgcttcccggcgcggtcgcagccctcagcccacttaggataatggcgacagctgaggtactgaacattggtaaaaaattatatgagggtaaaacaaaagaagtctacgaattgttagacagtccaggaaaagtcctcctgcagtccaaggaccagattacagcaggaaatgcagctagaaaaaaccacctggaaggaaaagctgcaatctcaaataaaatcaccagttgtatttttcagttattacaggaagcaggtattaaaactgccttcaccagaaaatgtggggagacagctttcattgcaccgcagtgtgaaatgattccaattgaatgggtttgcagaagaatagcaactggttcttttctcaaaagaaatcctggtgtcaaggaaggatataagttttacccacctaaagtggagttgtttttcaaggatgatgccaataatgacccacagtggtctgaggaacagctgattgctgcaaaattttgctttgctggacttcttataggccagactgaagtggatatcatgagtcatgctacacaggctatatttgaaatactggagaaatcctggttgccccagaattgtacactggttgatatgaagattgaatttggtgttgatgtaaccaccaaagaaattgttcttgctgatgttattgacaatgattcctggagactctggccatcaggagatcgaagccaacagaaagacaaacagtcttatcgggacctcaaagaagtaactcctggaagggaactcattttcctcgtaattttggactgccacacattggtacctttagttctctgaaggcccacgtttttatcattaagacctatttgttagctagtagagctttatgttcgctgtccatgaaaccttctgtaaccacagtgactacaagtagttctttctctattgaattattaggtccagaatagaagatgtcattgtacactttatttccctcacactgtgttatgctctgatgtgctatgcttagctatctgtcagagattagtaaattataaaactcatgtgtactacttaagtttatatcttatgctagtttataagaacaattaaaaggacttagaagattaaactttggtttcatggtctctgaagtcactgactgctatttcagcttgtttacccttacctagcattaagactccatctacttctgtgcagtatatgaaaatttttaaactttcatttagactggtggataggactgaccattacaaattgtcgttatcaattttttttcctttttttttttaagagccaagttctcactgtctcccaggctggagtgcagtggcatgattatggctccctgcagccttgaactcctggactcaagctgcagcctctcgagtagctgggtgcatgtgctaccacacccaattatgaatttcatcattagtttcttagtagagtccacatgtcctcagtagtaagttcatcagtgctaaatatttgaaggtatttctactgttttgtaaaagtaacttaagcctacctggtctgctatcttttgag

SEQ ID NO: 418741 - DNA, 1494 bp, Homo sapiens
ggcgggaagccagtggggcgttgtttcgtccgatatccgcgtttcagtctccgcccatacccctccgggttaggcggctgtagcggagctcgaaaagagtggcgcagggtcgcgcggccccgcctccttccccgcccagcgaagctctctgaccacccctcttttctagagttctgcctcgcttcccggcgcggtcgcagccctcagcccacttaggataatggcgacagctgaggtactgaacattggtaaaaaattatatgagggtaaaacaaaagaagtctacgaattgttagacagtccaggaaaagtcctcctgcagtccaaggaccagattacagcaggaaatgcagctagaaaaaaccacctggaaggaaaagctgcaatctcaaataaaatcaccagttgtatttttcagttattacaggaagcaggtattaaaactgccttcaccagaaaatgtggggagacagctttcattgcaccgcagtgtgaaatgattccaattgaatgggtttgcagaagaatagcaactggttcttttctcaaaagaaatcctggtgtcaaggaaggatataagttttacccacctaaagtggagttgtttttcaaggatgatgccaataatgacccacagtggtctgaggaacagctgattgctgcaaaattttgctttgctggacttcttataggccagactgaagtggatatcatgagtcatgctacacaggctatatttgaaatactggagaaatcctggttgccccagaattgtacactggttgatatgaagattgaatttggtgttgatgtaaccaccaaagaaattgttcttgctgatgttattgacaatgattcctggagactctggccatcaggagatcgaagccaacagaaagacaaacaggtagataatgcttcaggtttttttatcctttttgagatcaagctgagattagccagtcgtgatgacaggcacctgtaatcccagctactcgggaggctgaggcatgagaattgcttgaacccgggaggcggaggttgcagtgagcctggatcgtgccactgcactccaacctgggcagcagagcaagactctgtctcaaaaggggaaaaaaaaaattgctgatgtgacccatgaagggaactcattttcctcgtaattttggactgccacacattggtacctttagttctctgaaggcccacgtttttatcattaagacctatttgttagctagtagagctttatgttcgctgtccatgaaaccttctgtaaccacagtgactacaagtagttctttctctattgaattattaggtccagaatagaagatgtcattgtacactttatttccctcacactgtgttatgctctgatgtgctatgcttagctatctgtcagagattagtaaattataaaactcatgtgtactacttaagtttatatcttatgctagtttataagaacaattaaaaggacttagaagatta

SEQ ID NO: 418742 - DNA, 1661 bp, Homo sapiens
  misc_feature (1639)..(1639): n is a, c, g, or t
  misc_feature (1642)..(1642): n is a, c, g, or t
  misc_feature (1655)..(1655): n is a, c, g, or t
ggcgggaagccagtggggcgttgtttcgtccgatatccgcgtttcagtctccgcccatacccctccgggttaggcggctgtagcggagctcgaaaagagtggcgcagggtcgcgcggccccgcctccttccccgcccagcgaagctctctgaccacccctcttttctagagttctgcctcgcttcccggcgcggtcgcagccctcagcccacttaggataatggcgacagctgaggtactgaacattggtaaaaaattatatgagggtaaaacaaaagaagtctacgaattgttagacagtccaggaaaagtcctcctgcagtccaaggaccagattacagcaggaaatgcagctagaaaaaaccacctggaaggaaaagctgcaatctcaaataaaatcaccagttgtatttttcagttattacaggaagcaggtattaaaactgccttcaccagaaaatgtggggagacagctttcattgcaccgcagtgtgaaatgattccaattgaatgggtttgcagaagaatagcaactggttcttttctcaaaagaaatcctggtgtcaaggaaggatataagttttacccacctaaagtggagttgtttttcaaggatgatgccaataatgacccacagtggtctgaggaacagctgattgctgcaaaattttgctttgctggacttcttataggccagactgaagtggatatcatgagtcatgctacacaggctatatttgaaatactggagaaatcctggttgccccagaattgtacactggttgatatgaagattgaatttggtgttgatgtaaccaccaaagaaattgttcttgctgatgttattgacaatgattcctggagactctggccatcaggagatcgaagccaacagaaagacaaacaggtagataatgcttcaggtttttttatcctttttgagatcaagctgagattagccagtcgtgatgacaggcacctgtaatcccagctactcgggaggctgaggcatgagaattgcttgaacccgggaggcggaggttgcagtgagcctggatcgtgccactgcactccaacctgggcagcagagcaagactctgtctcaaaaggggaaaaaaaaaattgctgatgtgacccatgaagggaactcattttcctcgtaattttggactgccacacattggtacctttagttctctgaaggcccacgtttttatcattaagacctatttgttagctagtagagctttatgttcgctgtccatgaaaccttctgtaaccacagtgactacaagtagttctttctctattgaattattaggtccagaatagaagatgtcattgtacactttatttccctcacactgtgttatgctctgatgtgctatgcttagctatctgtcagagattagtaaattataaaactcatgtgtactacttaagtttatatcttatgctagtttataagaacaattaaaaggacttagaagattaactttggtttcatggtctctgaagtcactgactgctatttcagcttgtttacccttacctagcattaagactccatctacttctgtgcagtatatgaaaatttttaaactttcatttagactggtggataggactgaccattacnatngtcgttgtacacnttctct

SEQ ID NO: 418743 - DNA, 1455 bp, Homo sapiens
aaaacttaggctagtacgaggctgggtgtgctggagtgcagtggcgtgatctcagttcactgctgctttccctcctgggctcaagcagttctcccacctcagcctctcgactaacagggactataatcttgcagcaccatgccgagctaattttattttttgtagagatgagctctcactatgtcacccaggttcgtctcaaactcctgaaccctagtaattctcctatctcagcctcccaaagtgctagggttacagacatgagccactgtgcctgtctagacttgtactttcaactgtccatttctccctgtctgtcccatgggcactcatgaaaaaacagaatgctcccaactttattcatcttccaagcctgtagctcttggtatactcactgttgcaagtcagaagcttgatttcatcattgatgtttttctcacgtttcacatctcactcatcaccaagtcatgttggtgttaatttctgattaacccttgaatttaccgtcttctcatcctctgtacaaaagcctcaagtgagggtcaaattcaacattatcctgatctagacagcccccattctcaatccacccttttccaagttgattgcccaaggacttctaacaataaactctcttttgcaccacagacttctttgaaaatatacatgctgttgaccctctctgtagaaaaccgcacacataaaacttaccaacagatttcattggttcttgggttctcccgaagcctatccatggtttatagattaagaattgatgaggtagctgggcacagtggctcacacctacgatcacagcacttcgggaggctgaagcaagcagatcacttgaggtcaggagtttgagaccagcctggccaacatggtgaaaccctgtctctactaaaaatacaaaaagtagccagccgtgatgacaggcacctgtaatcccagctactcgggaggctgaggcatgagaattgcttgaacccgggaggcggaggttgcagtgagcctggatcatgccactgcactccaacctgggcagcagagcaagactctgtctcaaaaggggaaaaaaaaaattgctgatgtgacccatgaagggaactcattttcctcgtaattttggactgccacacattggtacctttagttctctgaaggcccacgtttttatcattaagacctatttgttagctagtagagctttatgttcgctgtccatgaaaccttctgtaaccacagtgactacaagtagttctttctctattgaattattaggtccagaatagaagatgtcattgtacactttatttccctcacactgtgttatgctctgatgtgctatgcttagctatctgtcagagattagtaaattataaaactcatgtgtactacttaagtttatatcttatgctagtttataagaacaattaaaaggacttagaagattaa

SEQ ID NO: 418744 - DNA, 1538 bp, Homo sapiens
aatcccagcactttgggaggctaaggtgggcagatcacctgaggtcaggagtttgagaccagcctgaccaacatggagaaaccctgtctctactaaaaatacaaaattagctgctggagtgcagtggcgtgatctcagttcactgctgctttccctcctgggctcaagcagttctcccacctcagcctctcgactaacagggactataatcttgcagcaccatgccgagctaattttattttttgtagagatgagctctcactatgtcacccaggttcgtctcaaactcctgaaccctagtaattctcctatctcagcctcccaaagtgctagggttacagacatgagccactgtgcctgtctagacttgtactttcaactgtccatttctccctgtctgtcccatgggcactcatgaaaaaacagaatgctcccaactttattcatcttccaagcctgtagctcttggtatactcactgttgcaagtcagaagcttgatttcatcattgatgtttttctcacgtttcacatctcactcatcaccaagtcatgttggtgttaatttctgattaacccttgaatttaccgtcttctcatcctctgtacaaaagcctcaagtgagggtcaaattcaacattatcctgatctagacagcccccattctcaatccacccttttccaagttgattgcccaaggacttctaacaataaactctcttttgcaccacagacttctttgaaaatatacatgctgttgaccctctctgtagaaaaccgcacacataaaacttaccaacagatttcattggttcttgggttctcccgaagcctatccatggtttatagattaagaattgatgaggtagctgggcacagtggctcacacctacgatcacagcacttcgggaggctgaagcaagcagatcacttgaggtcaggagtttgagaccagcctggccaacatggtgaaaccctgtctctactaaaaatacaaaaagtagccagccgtgatgacaggcacctgtaatcccagctactcgggaggctgaggcatgagaattgcttgaacccgggaggcggaggttgcagtgagcctggatcatgccactgcactccaacctgggcagcagagcaagactctgtctcaaaaggggaaaaaaaaaattgctgatgtgacccatgaagggaactcattttcctcgtaattttggactgccacacattggtacctttagttctctgaaggcccacgtttttatcattaagacctatttgttagctagtagagctttatgttcgctgtccatgaaaccttctgtaaccacagtgactacaagtagttctttctctattgaattattaggtccagaatagaagatgtcattgtacactttatttccctcacactgtgttatgctctgatgtgctatgcttagctatctgtcagagattagtaaattataaaactcatgtgtactacttaagtttatatcttatgctagtttataagaacaattaaaaggacttagaagattaa

SEQ ID NO: 418745 - DNA, 1759 bp, Homo sapiens
ttttttcaatagaattttctatattttggatttggcttcttacatttctaggtggtggtaaacatgctcttccattccctatattttctataaactgatggtgagatctgtaataaaatcaagtttagatatttttttcccaagaattcatggtattgatttttttttttaaagtaaatgtgatcatgttacttctgtagagagaatacaattttattcttaaatattggggataaggctgggtgcagtggctcatgcctgtcatcccagcactttgggaggctgaagtgggcagatctctggaggtcaggagttcaagacctgcctggccaatatggtgaaaccccatctctactaaaaatacaaaaattacctaggcatggtggtgagcatctgtaatcccagctactcagaggctgagggactataatcttgcagcaccatgccgagctaattttattttttgtagagatgagctctcactatgtcacccaggttcgtctcaaactcctgaaccctagtaattctcctatctcagcctcccaaagtgctagggttacagacatgagccactgtgcctgtctagacttgtactttcaactgtccatttctccctgtctgtcccatgggcactcatgaaaaaacagaatgctcccaactttattcatcttccaagcctgtagctcttggtatactcactgttgcaagtcagaagcttgatttcatcattgatgtttttctcacgtttcacatctcactcatcaccaagtcatgttggtgttaatttctgattaacccttgaatttaccgtcttctcatcctctgtacaaaagcctcaagtgagggtcaaattcaacattatcctgatctagacagcccccattctcaatccacccttttccaagttgattgcccaaggacttctaacaataaactctcttttgcaccacagacttctttgaaaatatacatgctgttgaccctctctgtagaaaaccgcacacataaaacttaccaacagatttcattggttcttgggttctcccgaagcctatccatggtttatagattaagaattgatgaggtagctgggcacagtggctcacacctacgatcacagcacttcgggaggctgaagcaagcagatcacttgaggtcaggagtttgagaccagcctggccaacatggtgaaaccctgtctctactaaaaatacaaaaagtagccagccgtgatgacaggcacctgtaatcccagctactcgggaggctgaggcatgagaattgcttgaacccgggaggcggaggttgcagtgagcctggatcatgccactgcactccaacctgggcagcagagcaagactctgtctcaaaaggggaaaaaaaaaattgctgatgtgacccatgaagggaactcattttcctcgtaattttggactgccacacattggtacctttagttctctgaaggcccacgtttttatcattaagacctatttgttagctagtagagctttatgttcgctgtccatgaaaccttctgtaaccacagtgactacaagtagttctttctctattgaattattaggtccagaatagaagatgtcattgtacactttatttccctcacactgtgttatgctctgatgtgctatgcttagctatctgtcagagattagtaaattataaaactcatgtgtactacttaagtttatatcttatgctagtttataagaacaattaaaaggacttagaagattaa

SEQ ID NO: 418746 - DNA, 1187 bp, Homo sapiens
ccatgggcactcatgaataaagttgggagcattctgttttttcatgagtgcccatgggcactcatgaaaaaacagaatgctcccaactttattcatcttccaagcctgtagctcttggtatactcactgttgcaagtcagaagcttgatttcatcattgatgtttttctcacgtttcacatctcactcatcaccaagtcatgttggtgttaatttctgattaacccttgaatttaccgtcttctcatcctctgtacaaaagcctcaagtgagggtcaaattcaacattatcctgatctagacagcccccattctcaatccacccttttccaagttgattgcccaaggacttctaacaataaactctcttttgcaccacagacttctttgaaaatatacatgctgttgaccctctctgtagaaaaccgcacacataaaacttaccaacagatttcattggttcttgggttctcccgaagcctatccatggtttatagattaagaattgatgaggtagctgggcacagtggctcacacctacgatcacagcacttcgggaggctgaagcaagcagatcacttgaggtcaggagtttgagaccagcctggccaacatggtgaaaccctgtctctactaaaaatacaaaaagtagccagccgtgatgacaggcacctgtaatcccagctactcgggaggctgaggcatgagaattgcttgaacccgggaggcggaggttgcagtgagcctggatcatgccactgcactccaacctgggcagcagagcaagactctgtctcaaaaggggaaaaaaaaaattgctgatgtgacccatgaagggaactcattttcctcgtaattttggactgccacacattggtacctttagttctctgaaggcccacgtttttatcattaagacctatttgttagctagtagagctttatgttcgctgtccatgaaaccttctgtaaccacagtgactacaagtagttctttctctattgaattattaggtccagaatagaagatgtcattgtacactttatttccctcacactgtgttatgctctgatgtgctatgcttagctatctgtcagagattagtaaattataaaactcatgtgtactacttaagtttatatcttatgctagtttataagaacaattaaaaggacttagaagattaa

SEQ ID NO: 418747 - DNA, 943 bp, Homo sapiens
agcggccgctcgcgatctagaacgtgagggtcaaattcaacattatcctgatctagacagcccccattctcaatccacccttttccaagttgattgcccaaggacttctaacaataaactctcttttgcaccacagacttctttgaaaatatacatgctgttgaccctctctgtagaaaaccgcacacataaaacttaccaacagatttcattggttcttgggttctcccgaagcctatccatggtttatagattaagaattgatgaggtagctgggcacagtggctcacacctacgatcacagcacttcgggaggctgaagcaagcagatcacttgaggtcaggagtttgagaccagcctggccaacatggtgaaaccctgtctctactaaaaatacaaaaagtagccagccgtgatgacaggcacctgtaatcccagctactcgggaggctgaggcatgagaattgcttgaacccgggaggcggaggttgcagtgagcctggatcatgccactgcactccaacctgggcagcagagcaagactctgtctcaaaaggggaaaaaaaaaattgctgatgtgacccatgaagggaactcattttcctcgtaattttggactgccacacattggtacctttagttctctgaaggcccacgtttttatcattaagacctatttgttagctagtagagctttatgttcgctgtccatgaaaccttctgtaaccacagtgactacaagtagttctttctctattgaattattaggtccagaatagaagatgtcattgtacactttatttccctcacactgtgttatgctctgatgtgctatgcttagctatctgtcagagattagtaaattataaaactcatgtgtactacttaagtttatatcttatgctagtttataagaacaattaaaaggacttagaagattaa

SEQ ID NO: 418748 - DNA, 910 bp, Homo sapiens
ttttttcaatagaattttctatattttggatttggcttcttacatttctaggtggtggtaaacatgctcttccattccctatattttctataaactgatggtgagatctgtaataaaatcaagtttagatatttttttcccaagaattcatggtattgatttttttttttaaagtaaatgtgatcatgttacttctgtagagagaatacaattttattcttaaatattggggataaggctgggtgcagtggctcatgcctgtcgatcacagcacttcgggaggctgaagcaagcagatcacttgaggtcaggagtttgagaccagcctggccaacatggtgaaaccctgtctctactaaaaatacaaaaagtagccagccgtgatgacaggcacctgtaatcccagctactcgggaggctgaggcatgagaattgcttgaacccgggaggcggaggttgcagtgagcctggatcatgccactgcactccaacctgggcagcagagcaagactctgtctcaaaaggggaaaaaaaaaattgctgatgtgacccatgaagggaactcattttcctcgtaattttggactgccacacattggtacctttagttctctgaaggcccacgtttttatcattaagacctatttgttagctagtagagctttatgttcgctgtccatgaaaccttctgtaaccacagtgactacaagtagttctttctctattgaattattaggtccagaatagaagatgtcattgtacactttatttccctcacactgtgttatgctctgatgtgctatgcttagctatctgtcagagattagtaaattataaaactcatgtgtactacttaagtttatatcttatgctagtttataagaacaattaaaaggacttagaagattaa

SEQ ID NO: 418749 - DNA, 1027 bp, Homo sapiens
agctgtatttgctgcacgtggaaatctccgttattttccagcacccaacagtagcgtaatgggagtaacggacttaacctcatttctctttcagagcatttagccttcatatgcccttccctgcatgcttcccccaggccgtcaagacttgagttctgcctcgcttcccggcgcggtcgcagccctcagcccacttaggataatggcgacagctgaggtactgaacattggtaaaaaattatatgagggtaaaacaaaagaagtctacgaattgttagacagtccaggaaaagtcctcctgcagtccaaggaccagattacagcaggaaatgcagctagaaaaaaccacctggaaggaaaagctgcaatctcaaataaaatcaccagttgtatttttcagttattacaggaagcaggtattaaaactgccttcaccagaaaatgtggggagacagctttcattgcaccgcagtgtgaaatgattccaattgaatgggtttgcagaagaatagcaactggttcttttctcaaaagaaatcctggtgtcaaggaaggatataagttttacccacctaaagtggagttgtttttcaagcactgcactccaacctgggcagcagagcaagactctgtctcaaaaggggaaaaaaaaaattgctgatgtgacccatgaagggaactcattttcctcgtaattttggactgccacacattggtacctttagttctctgaaggcccacgtttttatcattaagacctatttgttagctagtagagctttatgttcgctgtccatgaaaccttctgtaaccacagtgactacaagtagttctttctctattgaattattaggtccagaatagaagatgtcattgtacactttatttccctcacactgtgttatgctctgatgtgctatgcttagctatctgtcagagattagtaaattataaaactcatgtgtactacttaagtttatatcttatgctagtttataagaacaattaaaaggacttagaagattaa

SEQ ID NO: 418750 - DNA, 1175 bp, Homo sapiens
ggcgggaagccagtggggcgttgtttcgtccgatatccgcgtttcagtctccgcccatacccctccgggttaggcggctgtagcggagctcgaaaagagtggcgcagggtcgcgcggccccgcctccttccccgcccagcgaagctctctgaccacccctcttttctagagttctgcctcgcttcccggcgcggtcgcagccctcagcccacttaggataatggcgacagctgaggtactgaacattggtaaaaaattatatgagggtaaaacaaaagaagtctacgaattgttagacagtccaggaaaagtcctcctgcagtccaaggaccagattacagcaggaaatgcagctagaaaaaaccacctggaaggaaaagctgcaatctcaaataaaatcaccagttgtatttttcagttattacaggaagcaggtaagcagctccctcaaagtctcttctctcaccttctctggtaagcatgtcgatgtctttcatgtgaagttggcattaatatgaacaacttgtttgcacgatgtctcaaaagctaagtgaatttaaatcaaacccagaacccttaaacttcactataacaccttatctggtttgggattattagtatcattgaattaaaaggaatcttaacaagtttgctgtaatctttatctggcacatgcactctctgtgcagcttacctctccaaggccatcttcactttaaggaatttaactatgaaggaaacccattttaatgttaagccgttctaacatgaagaactgaaatttactccctgtaattctatacaaatggtctttgttctgcctctgggagataatacagaatttcaattcctcttccacttgaaagccctgaaaagtagttgaagacagcaaccaaaccttctcctcctgccattccccaagtgagatatttgaactaaaaccccagagcgccctcctgttcaaaaactgaatgaaggctctattttcaatagagaaatagattcaaaagaccaaatgaagatcagaacattgtgtggtgggtatttgaagcaaagggaaggaaattaggataaaggggttttctgcagggattcagtcagttgctggttggtctgtagtatatgaaatttcagctaggaaaagatttgaactcttgccacacagtgtaaatagc

SEQ ID NO: 418751 - DNA, 252 bp, Homo sapiens
cattcaatgaaatacaacattcacatcaagtgaatcactcacatcgtcttggtgtggtggctcatgcctgtaatcccagcacttggggaggctgtggtgggaggattgcttgagcccaggagttccagaccagcttgggcaacacggcaagatccccgtctctttcctcacgtttgcttctctgccagaatgtcttcccgcactttccccagaacccaagttctcctaatcatctttcaagatccctttccc

SEQ ID NO: 418752 - DNA, 400 bp, Homo sapiens
aattttactacaaactctagctcatttattcatttttgtttttatgttcttttcatatccacgtattttttcttcagttgcttttgaaatcagaaagtcagtgcagggttgtagtgttgatgggctctacttctgatcttggtcactgtgaaaaaatcaagaaggcctgtggaaattttggcattccatgtgaacttcgagtaacatctgcgcataaaggaccagatgaaactctgaggattaaagctgagtatgaaggtaaaccacaagtaatatggacatttcaggtatttctgattttgctaaaagtaattacacactttagactaataatgctgaaaaaagagctttgtcagttttctaagggaaaaacacatgatatactaggctttcttttttt

SEQ ID NO: 418753 - DNA, 1307 bp, Homo sapiens
ggcgggaagccagtggggcgttgtttcgtccgatatccgcgtttcagtctccgcccatacccctccgggttaggcggctgtagcggagctcgaaaagagtggcgcagggtcgcgcggccccgcctccttccccgcccagcgaagctctctgaccacccctcttttctagagttctgcctcgcttcccggcgcggtcgcagccctcagcccacttaggataatggcgacagctgaggtactgaacattggtaaaaaattatatgagggtaaaacaaaagaagtctacgaattgttagacagtccaggaaaagtcctcctgcagtccaaggaccagattacagcaggaaatgcagctagaaaaaaccacctggaaggaaaagctgcaatctcaaataaaatcaccagttgtatttttcagttattacaggaagcaggtattaaaactgccttcaccagaaaatgtggggagacagctttcattgcaccgcagtgtgaaatgattccaattgaatgggtttgcagaagaatagcaactggttcttttctcaaaagaaatcctggtgtcaaggaaggatataagttttacccacctaaagtggagttgtttttcaaggatgatgccaataatgacccacagtggtctgaggaacagctgattgctgcaaaattttgctttgctggacttcttataggccagactgaagtggatatcatgagtcatgctacacaggctatatttgaaatactggagaaatcctggttgccccagaattgtacactggttgatatgaagattgaatttggtgttgatgtaaccaccaaagaaattgttcttgctgatgttattgacaatgattcctggagactctggccatcaggagatcgaagccaacagaaagacaaacaggtagataatgcttcaggtttttttatcctttttgagatcaagctgagattagccagtcgtgatgacaggcacctgtaatcccagctactcgggaggctgaggcatgagaattgcttgaacccgggaggcggaggttgcagtgagcctggatcgtgccactgcactccaacctgggcagcagagcaagactatcgtcttggtgtggtggctcatgcctgtaatcccagcacttggggaggctgtggtgggaggattgcttgagcccaggagttccagaccagcttgggcaacacggcaagatccccgtctctttcctcacgtttgcttctctgccagaatgtcttcccgcactttccccagaacccaagttctcctaatcatctttcaagatccctttccc

SEQ ID NO: 418754 - DNA, 765 bp, Homo sapiens
ggcgggaagccagtggggcgttgtttcgtccgatatccgcgtttcagtctccgcccatacccctccgggttaggcggctgtagcggagctcgaaaagagtggcgcagggtcgcgcggccccgcctccttccccgcccagcgaagctctctgaccacccctcttttctagagttctgcctcgcttcccggcgcggtcgcagccctcagcccacttaggataatggcgacagctgaggtactgaacattggtaaaaaattatatgagggtaaaacaaaagaagtctacgaattgttagacagtccaggaaaagtcctcctgcagtccaaggaccagattacagcaggaaatgcagctagaaaaaaccacctggaaggaaaagctgcaatctcaaataaaatcaccagttgtatttttcagttattacaggaagcaggtattaaaactgccttcaccagaaaatgtggggagacagctttcattgcaccgcagtgtgaaatgattccaattgaatgggtttgcagaagaatagcaactggttcttttctcaaaagaaatcctggtgtcaaggaaggatataagttttacccacctaaagtggagttgtttttcaaggatgatgccaataatgacccacagtggtctgaggaacagctgattgctgcaaaattttgctttgctggacttcttataggccagactgaagtggatatcatttctccagtatttcaaatatagcctgtgtagcatgactccccacgcgtccg

SEQ ID NO: 418755 - DNA, 363 bp, Homo sapiens
ggacgcgtgggtcgacccacgcagttctgcctcgcttcccggcgcggtcgcagccctcagcccacttaggataatggcgacagctgaggtactgaacattggtaaaaaattatatgagggtaaaacaaaagaagtctacgaattgttagacagtccaggaaaagtcctcctgcagtccaaggaccagattacagcaggaaatgcagctagaaaaaaccacctggaaggaaaagctgcaatctcaaataaaatcaccagttgtatttttcagttattacaggaagcaggtaccactgctcttaaccagacaattcgggtgagtgatgatttgatcgaagcagtcactccccgatcaggacactc

SEQ ID NO: 418756 - DNA, 910 bp, Homo sapiens
cacagtgcgcatgtgtgcggctgtgctttggctcttcgggtaaagatggcggagcgcgggtacagcttttcgctgactacattcagcccgtctggtaaacttgtccagattgaatatgctttggctgctgtagctggaggagccccgtccgtgggaattaaagctgcaaatggtgtggtattagcaactgagaaaaaacagaaatccattctgtatgatgagcgaagtgtacacaaagtagaaccaattaccaagcatataggtttggtgtacagtggcatgggccccgattacagagtgcttgtgcacagagctcgaaaactagctcaacaatactatcttgtgtaccaagaacccattcctacagctcagctggtacagagagtagcttctgtgatgcaagaatatactcagtcaggtggtgttcgtccatttggagtttctttacttatttgtggttggaatgagggacgaccatatttatttcagtcagatccatctggagcttactttgcctggaaagctacagcaatgggaaagaactatgtgaatgggaagactttccttgagaaaagatataatgaagatctggaacttgaagatgccattcatacagccatcttaaccctaaaggaaagctttgaagggcaaatgacagaggataacatagaagttggaatctgcaatgaagctggatttaggaggcttactccaactgaagttaaggattacttggctgccatagcataacaatgaagtgactgaaaaatccagaatttcagataatctatctacttaaacatgtttaaagtatgttttgttttgcagactttttgcatacttatttctacatggtttaaatcgactgtttttaaaatgacacttataaatcctaataaactgttaaacc

SEQ ID NO: 418757 - DNA, 887 bp, Homo sapiens
  misc_feature (47)..(47): n is a, c, g, or t
ataggctaggtgcgaggcctgggtggtgggagcgcgggtcagctttncgctgactacattcagcccgtctggtaaacttgtccagattgaatatgctttggctgctgtagctggaggagccccgtccgtgggaattaaagctgcaaatggtgtggtattagcaactgagaaaaaacagaaatccattctgtatgatgagcgaagtgtacacaaagtagaaccaattaccaagcatataggtttggtgtacagtggcatgggccccgattacagagtgcttgtgcacagagctcgaaaactagctcaacaatactatcttgtgtaccaagaacccattcctacagctcagctggtacagagagtagcttctgtgatgcaagaatatactcagtcaggtggtgttcgtccatttggagtttctttacttatttgtggttggaatgagggacgaccatatttatttcagtcagatccatctggagcttactttgcctggaaagctacagcaatgggaaagaactatgtgaatgggaagactttccttgagaaaagatataatgaagatctggaacttgaagatgccattcatacagccatcttaaccctaaaggaaagctttgaagggcaaatgacagaggataacatagaagttggaatctgcaatgaagctggatttaggaggcttactccaactgaagttaaggattacttggctgccatagcataacaatgaagtgactgaaaaatccagaatttcagataatctatctacttaaacatgtttaaagtatgttttgttttgcagactttttgcatacttatttctacatggtttaaatcgactgtttttaaaatgacacttataaatcctaataaactgttaaacc

SEQ ID NO: 418758 - DNA, 1524 bp, Homo sapiens
  misc_feature (1511)..(1511): n is a, c, g, or t
cacagtgcgcatgtgtgcggctgtgctttggctcttcgggtaaagatggcggagcgcgggtacagcttttcgctgactacattcagcccgtctggtaaacttgtccagattgaatatgctttggctgctgtagctggaggagccccgtccgtgggaattaaagctgcaaatggtgtggtattagcaactgagaaaaaacagaaatccattctgtatgatgagcgaagtgtacacaaagtagaaccaattaccaagcatataggtttggtgtacagtggcatgggccccgattacagagtgcttgtgcacagagctcgaaaactagctcaacaatactatcttgtgtaccaagaacccattcctacagctcagctggtacagagagtagcttctgtgatgcaagaatatactcagtcaggtggtgttcgtccatttggagtttctttacttatttgtggttggaatgagggacgaccatatttatttcagtcagatccatctggagcttactttgcctggaaagctacagcaatgggaaagaactatgtgaatgggaagactttccttgagaaaagatataatgaagatctggaacttgaagatgccattcatacagccatcttaaccctaaaggaaagctttgaagggcaaatgacagaggataacatagaagttggaatctgcaatgaagctggatttaggaggcttactccaactgaagttaaggattacttggctgccatagcataacaatgaagtgactgaaaaatccagaatttcagataatctatctacttaaacatgtttaaagtatgttttgttttgcagactttttgcatacttatttctacatggtttaaatcgactgtttttaaaatgacacttataaatcctaataaactgttaaacccaccttccagccttttaggagttgctaaaattttaacagttatttcctgctttttatcacagttgatttctgaagactacattgccaagcagaatgatgaaatgactttttcgttgtcaggcaattttggttaagtcaaatcttaatgccctcttcgctatcagatgttgcctgtgtttccataaagcaaaatgctgattttggtaaaaaacatgactgcttctagagctgggaggatctgcagactttcacggattcatggaacaagaaaagaagcataggtacttttaggtgccattaggtattgatcagtgaaatcctagggtgctctatgagattgtactaggcctatgaagagtggtaagccaaataggtctccatgggagatacattatgtaaataaataaacaatggtttgctggttcctgttggtgtctccacaagtaggtaaacatgtttaaaggaacccgggttcttagattttgttagactttttaaactcaaggatgagcataagtgcttgaaataaaatgctaatacttaagtgtcaaaaaaaaaaaaaaaaaaaaaaaaaaaaaaaaggggggggggggggaaaaancccccgggggggg

SEQ ID NO: 418759 - DNA, 1440 bp, Homo sapiens
  misc_feature (47)..(47): n is a, c, g, or t
ataggctaggtgcgaggcctgggtggtgggagcgcgggtcagctttncgctgactacattcagcccgtctggtaaacttgtccagattgaatatgctttggctgctgtagctggaggagccccgtccgtgggaattaaagctgcaaatggtgtggtattagcaactgagaaaaaacagaaatccattctgtatgatgagcgaagtgtacacaaagtagaaccaattaccaagcatataggtttggtgtacagtggcatgggccccgattacagagtgcttgtgcacagagctcgaaaactagctcaacaatactatcttgtgtaccaagaacccattcctacagctcagctggtacagagagtagcttctgtgatgcaagaatatactcagtcaggtggtgttcgtccatttggagtttctttacttatttgtggttggaatgagggacgaccatatttatttcagtcagatccatctggagcttactttgcctggaaagctacagcaatgggaaagaactatgtgaatgggaagactttccttgagaaaagatataatgaagatctggaacttgaagatgccattcatacagccatcttaaccctaaaggaaagctttgaagggcaaatgacagaggataacatagaagttggaatctgcaatgaagctggatttaggaggcttactccaactgaagttaaggattacttggctgccatagcataacaatgaagtgactgaaaaatccagaatttcagataatctatctacttaaacatgtttaaagtatgttttgttttgcagactttttgcatacttatttctacatggtttaaatcgactgtttttaaaatgacacttataaatcctaataaactgttaaacccaccttccagccttttaggagttgctaaaattttaacagttatttcctgctttttatcacagttgatttctgaagactacattgccaagcagaatgatgaaatgactttttcgttgtcaggcaattttggttaagtcaaatcttaatgccctcttcgctatcagatgttgcctgtgtttccataaagcaaaatgctgattttggtaaaaaacatgactgcttctagagctgggaggatctgcagactttcacggattcatggaacaagaaaagaagcataggtacttttaggtgccattaggtattgatcagtgaaatcctagggtgctctatgagattgtactaggcctatgaagagtggtaagccaaataggtctccatgggagatacattatgtaaataaataaacaatggtttgctggttcctgttggtgtctccacaagtaggtaaacatgtttaaaggaacccgggttcttagattttgttagactttttaaactcaaggatgagcataagtgcttgaaataaaatgctaatacttaagtgtcaaaa

SEQ ID NO: 418760 - DNA, 1441 bp, Homo sapiens
  misc_feature (31)..(31): n is a, c, g, or t
  misc_feature (35)..(35): n is a, c, g, or t
cggacgcgtgggtcgacccacgcgtcgcggngcgngggtacagcttttcgctgactacattcagcccgtctggtaaacttgtccagattgaatatgctttggctgctgtagctggaggagccccgtccgtgggaattaaagctgcaaatggtgtggtattagcaactgagaaaaaacagaaatccattctgtatgatgagcgaagtgtacacaaagtagaaccaattaccaagcatataggtttggtgtacagtggcatgggccccgattacagagtgcttgtgcacagagctcgaaaactagctcaacaatactatcttgtgtaccaagaacccattcctacagctcagctggtacagagagtagcttctgtgatgcaagaatatactcagtcaggtggtgttcgtccatttggagtttctttacttatttgtggttggaatgagggacgaccatatttatttcagtcagatccatctggagcttactttgcctggaaagctacagcaatgggaaagaactatgtgaatgggaagactttccttgagaaaagatataatgaagatctggaacttgaagatgccattcatacagccatcttaaccctaaaggaaagctttgaagggcaaatgacagaggataacatagaagttggaatctgcaatgaagctggatttaggaggcttactccaactgaagttaaggattacttggctgccatagcataacaatgaagtgactgaaaaatccagaatttcagataatctatctacttaaacatgtttaaagtatgttttgttttgcagactttttgcatacttatttctacatggtttaaatcgactgtttttaaaatgacacttataaatcctaataaactgttaaacccaccttccagccttttaggagttgctaaaattttaacagttatttcctgctttttatcacagttgatttctgaagactacattgccaagcagaatgatgaaatgactttttcgttgtcaggcaattttggttaagtcaaatcttaatgccctcttcgctatcagatgttgcctgtgtttccataaagcaaaatgctgattttggtaaaaaacatgactgcttctagagctgggaggatctgcagactttcacggattcatggaacaagaaaagaagcataggtacttttaggtgccattaggtattgatcagtgaaatcctagggtgctctatgagattgtactaggcctatgaagagtggtaagccaaataggtctccatgggagatacattatgtaaataaataaacaatggtttgctggttcctgttggtgtctccacaagtaggtaaacatgtttaaaggaacccgggttcttagattttgttagactttttaaactcaaggatgagcataagtgcttgaaataaaatgctaatacttaagtgtcaaaa

SEQ ID NO: 418761 - DNA, 1020 bp, Homo sapiens
  misc_feature (1007)..(1007): n is a, c, g, or t
cacagtgcgcatgtgtgcggctgtgctttggctcttcgggtaaagatggcggagcgcgggtacagcttttcgctgactacattcagcccgtctggtaaacttgtccagattgaatatgctttggctgctgtagctggaggagccccgtccgtgggaattaaagctgcaaatggtgtggtattagcaactgagaaaaaacagaaatccattctgtatgatgagcgaagtgtacacaaagtagaaccaattaccaagcatataggtttggtgtacagtggcatgggccccgattacagagtgcttgtgcacagagctcgaaaactagctcaacaatactatcttgtgtaccaagaacccattcctacagctcagctggtacagagagtagcttctgtgatgcaagaatatactcagtcaggtggtgttcgtccatttggagtttctttacttatttgtggttggaatgagggacgaccatatttatttcagtcagatccatctggagcttactttgcctggaaagctacagcaatgggaaagaactatgtgaatgggaagactttccttgagaaaagatataatgaagatctggaacttgaagatgccattcatacagccatcttaaccctaaaggaaagctttgaagggcaaatgacagaggataacatagaagttggaatctgcaatgaagctggatttaggaggcttactccaactgaagttaaggattacttggctgccatagcataacaatgaagtgactgaaaaatccagaatttcagataatctatctacttaaacatgtttaaagtatgttttgttttgcagactttttgcatacttatttctacatggtttaaatcgactgtttttaaaatgacacttataaatcctaataaactgttaaaccaaaaaaaaaaaaaaaaaaaaaaaaaaaaaaaaaaaaaaaaaaaaaaaaaaaaaaaaaaaaaaaaaaaaaaaaaaaaaggggggggggggggaaaaancccccgggggggg

SEQ ID NO: 418762 - DNA, 971 bp, Homo sapiens
  misc_feature (958)..(958): n is a, c, g, or t
cacagtgcgcatgtgtgcggctgtgctttggctcttcgggtaaagatggcggagcgcgggtacagcttttcgctgactacattcagcccgtctggtaaacttgtccagattgaatatgctttggctgctgtagctggaggagccccgtccgtgggaattaaagctgcaaatggtgtggtattagcaactgagaaaaaacagaaatccattctgtatgatgagcgaagtgtacacaaagtagaaccaattaccaagcatataggtttggtgtacagtggcatgggccccgattacagagtgcttgtgcacagagctcgaaaactagctcaacaatactatcttgtgtaccaagaacccattcctacagctcagctggtacagagagtagcttctgtgatgcaagaatatactcagtcaggtggtgttcgtccatttggagtttctttacttatttgtggttggaatgagggacgaccatatttatttcagtcagatccatctggagcttactttgcctggaaagctacagcaatgggaaagaactatgtgaatgggaagactttccttgagaaaagatataatgaagatctggaacttgaagatgccattcatacagccatcttaaccctaaaggaaagctttgaagggcaaatgacagaggataacatagaagttggaatctgcaatgaagctggatttaggaggcttactccaactgaagttaaggattacttggctgccatagcataacaatgaagtgactgaaaaatccagaatttcagataatctatctacttaaacatgtttaaagtatgttttgttttgcagactttttgcatacttatttctacatggtttaaatcgactgtttttaaaatgacacttataaatcctaataaactgttaaaccaaaaaaaaaaaaaaaaaaaaaaaaaaaaggggggggggggggaaaaancccccgggggggg

SEQ ID NO: 418763 - DNA, 856 bp, Homo sapiens
cacagtgcgcatgtgtgcggctgtgctttggctcttcgggtaaagatggcggagcgcgggtacagcttttcgctgactacattcagcccgtctggtaaacttgtccagattgaatatgctttggctgctgtagctggaggagccccgtccgtgggaattaaagctgcaaatggtgtggtattagcaactgagaaaaaacagaaatccattctgtatgatgagcgaagtgtacacaaagtagaaccaattaccaagcatataggtttggtgtacagtggcatgggccccgattacagagtgcttgtgcacagagctcgaaaactagctcaacaatactatcttgtgtaccaagaacccattcctacagctcagctggtacagagagtagcttctgtgatgcaagaatatactcagtcaggtggtgttcgtccatttggagtttctttacttatttgtggttggaatgagggacgaccatatttatttcagtcagatccatctggagcttactttgcctggaaagctacagcaatgggaaagaactatgtgaatgggaagactttccttgagaaaagatataatgaagatctggaacttgaagatgccattcatacagccatcttaaccctaaaggaaagctttgaagggcaaatgacagaggataacatagaagttggaatctgcaatgaagctggatttaggaggcttactccaactgaagttaaggattacttggctgccatagcataacaatgaagtgactgagttttgcagactttttgcatacttatttctacatggtttaaatcgactgtttttaaaatgacacttataaatcctaataaactgttaaacc

SEQ ID NO: 418764 - DNA, 1405 bp, Homo sapiens
cacagtgcgcatgtgtgcggctgtgctttggctcttcgggtaaagatggcggagcgcgggtacagcttttcgctgactacattcagcccgtctggtaaacttgtccagattgaatatgctttggctgctgtagctggaggagccccgtccgtgggaattaaagctgcaaatggtgtggtattagcaactgagaaaaaacagaaatccattctgtatgatgagcgaagtgtacacaaagtagaaccaattaccaagcatataggtttggtgtacagtggcatgggccccgattacagagtgcttgtgcacagagctcgaaaactagctcaacaatactatcttgtgtaccaagaacccattcctacagctcagctggtacagagagtagcttctgtgatgcaagaatatactcagtcaggtggtgttcgtccatttggagtttctttacttatttgtggttggaatgagggacgaccatatttatttcagtcagatccatctggagcttactttgcctggaaagctacagcaatgggaaagaactatgtgaatgggaagactttccttgagaaaaggaaagctttgaagggcaaatgacagaggataacatagaagttggaatctgcaatgaagctggatttaggaggcttactccaactgaagttaaggattacttggctgccatagcataacaatgaagtgactgaaaaatccagaatttcagataatctatctacttaaacatgtttaaagtatgttttgttttgcagactttttgcatacttatttctacatggtttaaatcgactgtttttaaaatgacacttataaatcctaataaactgttaaacccaccttccagccttttaggagttgctaaaattttaacagttatttcctgctttttatcacagttgatttctgaagactacattgccaagcagaatgatgaaatgactttttcgttgtcaggcaattttggttaagtcaaatcttaatgccctcttcgctatcagatgttgcctgtgtttccataaagcaaaatgctgattttggtaaaaaacatgactgcttctagagctgggaggatctgcagactttcacggattcatggaacaagaaaagaagcataggtacttttaggtgccattaggtattgatcagtgaaatcctagggtgctctatgagattgtactaggcctatgaagagtggtaagccaaataggtctccatgggagatacattatgtaaataaataaacaatggtttgctggttcctgttggtgtctccacaagtaggtaaacatgtttaaaggaacccgggttcttagattttgttagactttttaaactcaaggatgagcataagtgcttgaaataaaatgctaatacttaagtgtcaaaa

SEQ ID NO: 418765 - DNA, 701 bp, Homo sapiens
  misc_feature (592)..(592): n is a, c, g, or t
  misc_feature (612)..(612): n is a, c, g, or t
  misc_feature (653)..(653): n is a, c, g, or t
  misc_feature (666)..(666): n is a, c, g, or t
  misc_feature (695)..(695): n is a, c, g, or t
cacagtgcgcatgtgtgcggctgtgctttggctcttcgggtaaagatggcggagcgcgggtacagcttttcgctgactacattcagcccgtctggtaaacttgtccagattgaatatgctttggctgctgtagctggaggagccccgtccgtgggaattaaagctgcaaatggtgtggtattagcaactgagaaaaaacagaaatccattctgtatgatgagcgaagtgtacacaaagtagaaccaattaccaagcatataggtttggtgtacagtggcatgggccccgattacagagtgcttgtgcacagagctcgaaaactagctcaacaatactatcttgtgtaccaagaacccattcctacagctcagctggtacagagagtagcttctgtgatgcaagaatatactcagtcaggtggtgttcgtccatttggagtttctttacttatttgtggttggaatgagggacgaccatatttatttcagtcagatccatctggagcttactttgcctggaaagctacagcaatgggaaagaactatgtgaatgggaagactttccttgagaaaagatattaatgaagatctngggaactttgaaggatgccntttcattacagccatctttaaccctaaagggaaagcttttnaagggggcaaatnacagagggataacataggaagtttgggantcttgc

SEQ ID NO: 418766 - DNA, 926 bp, Homo sapiens
  misc_feature (778)..(779): n is a, c, g, or t
  misc_feature (781)..(781): n is a, c, g, or t
  misc_feature (784)..(784): n is a, c, g, or t
  misc_feature (792)..(792): n is a, c, g, or t
  misc_feature (795)..(795): n is a, c, g, or t
  misc_feature (803)..(803): n is a, c, g, or t
  misc_feature (809)..(810): n is a, c, g, or t
  misc_feature (815)..(815): n is a, c, g, or t
  misc_feature (824)..(824): n is a, c, g, or t
  misc_feature (828)..(828): n is a, c, g, or t
  misc_feature (833)..(833): n is a, c, g, or t
  misc_feature (840)..(840): n is a, c, g, or t
  misc_feature (844)..(844): n is a, c, g, or t
  misc_feature (866)..(866): n is a, c, g, or t
  misc_feature (870)..(871): n is a, c, g, or t
  misc_feature (878)..(878): n is a, c, g, or t
  misc_feature (880)..(880): n is a, c, g, or t
cacagtgcgcatgtgtgcggctgtgctttggctcttcgggtaaagatggcggagcgcgggtacagcttttcgctgactacattcagcccgtctggtaaacttgtccagattgaatatgctttggctgctgtagctggaggagccccgtccgtgggaattaaagctgcaaatggtgtggtattagcaactgagaaaaaacagaaatccattctgtatgatgagcgaagtgtacacaaagtagaaccaattaccaagcatataggtttggtgtacagtggcatgggccccgattacagagtgcttgtgcacagagctcgaaaactagctcaacaatactatcttgtgtaccaagaacccattcctacagctcagctggtacagagagtagcttctgtgatgcaagaatatactcagtcaggtggtgttcgtccatttggagtttctttacttatttgtggttggaatgagggacgaccatatttatttcagtcagatccatctggagcttactttgcctggaaagctacagcaatgggaaagaactatgtgaatgggaagactttccttgagaaaagatataatgaagatctggaacttgaagatgccattcatacagccatcttaaccctaaaggaaagctttgaagggcaaatgacagaggataacatagaagttggaatctgcaatgaagctggatttaggaggcttactccaactgaagttaaggattacttggctgccatagcataacaatgaagtgactgaatcgaattgatanntnttntaactttngtnttggtggnagttgnnacttntcacggtancggngaagncttactntagngccaaaaaaaaaaaatgggggncgannaatgggngngaaaaggtgtgacgcggggcaaccacccgcatgttagtcctccgta

SEQ ID NO: 418767 - DNA, 1463 bp, Homo sapiens
cacagtgcgcatgtgtgcggctgtgctttggctcttcgggtaaagatggcggagcgcgggtacagcttttcgctgactacattcagcccgtctggtaaacttgtccagattgaatatgctttggctgctgtagctggaggagccccgtccgtgggaattaaagctgcaaatggtgtggtattagcaactgagaaaaaacagaaatccattctgtatgatgagcgaagtgtacacaaagtagaaccaattaccaagcatataggtttggtgtacagtggcatgggccccgattacagagtgcttgtgcacagagctcgaaaactagctcaacaatactatcttgtgtaccaagaacccattcctacagctcagctggtacagagagtagcttctgtgatgcaagaatatactcagtcaggtggtgttcgtccatttggagtttctttacttatttgtggttggaatgagggacgaccatatttatttcagtcagatccatctggagcttactttgcctggaaagctacagcaatgggaaagaactatgtgaatgggaagactttccttgagaaaagatataatgaagatctggaacttgaagatgccattcatacagccatcttaaccctaaaggaaagctttgaagggcaaatgacagaggataacatagaagttggaatctgcaatgaagctggatttaggaggcttactccaactgaagttaaggattacttggctgccatagcataacaatgaagtgactgaaaaatccagaatttcagataatctatctacttaaacatgtttaaagtatgttttgttttgcagactttttgcatacttatttctacatggtttaaatcgactgtttttaaaatgacacttataaatcctaataaactgttaaacccaccttccagccttttaggagttgctaaaattttaacagttatttcctgctttttatcacagttgatttctgaagactacattgccaagcagaatgatgaaatgactttttcgttgtcaggcaattttggttaagtcaaatcttaatgccctcttcgctatcagatgttgcctgtgtttccataaagcaaaatgctgattttggtaaaaaacatgactgcttctagagctgggaggatctgcagactttcacggattcatggaacaagaaaagaagcataggtacttttaggtgccattaggtattgatcagtgaaatcctagggtgctctatgagattgtactaggcctatgaagagtggtaagccaaataggtctccatgggagatacattatgtaaataaataaacaatggtttgctggttcctgttggtgtctccacaagtaggtaaacatgtttaaaggaacccgggttcttagattttgttagactttttaaactcaaggatgagcataagtgcttgaaataaaatgctaatacttaagtgtcaaaa

SEQ ID NO: 418768 - DNA, 1509 bp, Homo sapiens
gcatgacgagaccgcgctacttgtagcaacttacgagtttcagtggcggaacggaatatgcccggaattcggccatacggccggggtaaagatggcggagcgcgggtacagcttttcgctgactacattcagcccgtctggtaaacttgtccagattgaatatgctttggctgctgtagctggaggagccccgtccgtgggaattaaagctgcaaatggtgtggtattagcaactgagaaaaaacagaaatccattctgtatgatgagcgaagtgtacacaaagtagaaccaattaccaagcatataggtttggtgtacagtggcatgggccccgattacagagtgcttgtgcacagagctcgaaaactagctcaacaatactatcttgtgtaccaagaacccattcctacagctcagctggtacagagagtagcttctgtgatgcaagaatatactcagtcaggtggtgttcgtccatttggagtttctttacttatttgtggttggaatgagggacgaccatatttatttcagtcagatccatctggagcttactttgcctggaaagctacagcaatgggaaagaactatgtgaatgggaagactttccttgagaaaagatataatgaagatctggaacttgaagatgccattcatacagccatcttaaccctaaaggaaagctttgaagggcaaatgacagaggataacatagaagttggaatctgcaatgaagctggatttaggaggcttactccaactgaagttaaggattacttggctgccatagcataacaatgaagtgactgaaaaatccagaatttcagataatctatctacttaaacatgtttaaagtatgttttgttttgcagactttttgcatacttatttctacatggtttaaatcgactgtttttaaaatgacacttataaatcctaataaactgttaaacccaccttccagccttttaggagttgctaaaattttaacagttatttcctgctttttatcacagttgatttctgaagactacattgccaagcagaatgatgaaatgactttttcgttgtcaggcaattttggttaagtcaaatcttaatgccctcttcgctatcagatgttgcctgtgtttccataaagcaaaatgctgattttggtaaaaaacatgactgcttctagagctgggaggatctgcagactttcacggattcatggaacaagaaaagaagcataggtacttttaggtgccattaggtattgatcagtgaaatcctagggtgctctatgagattgtactaggcctatgaagagtggtaagccaaataggtctccatgggagatacattatgtaaataaataaacaatggtttgctggttcctgttggtgtctccacaagtaggtaaacatgtttaaaggaacccgggttcttagattttgttagactttttaaactcaaggatgagcataagtgcttgaaataaaatgctaatacttaagtgtcaaaa

SEQ ID NO: 418769 - DNA, 1425 bp, Homo sapiens
  misc_feature (38)..(38): n is a, c, g, or t
tatacggtagcgaggcctgggtggcggttttcgctgangtacattcagcccgtctggtaaacttgtccagattgaatatgctttggctgctgtagctggaggagccccgtccgtgggaattaaagctgcaaatggtgtggtattagcaactgagaaaaaacagaaatccattctgtatgatgagcgaagtgtacacaaagtagaaccaattaccaagcatataggtttggtgtacagtggcatgggccccgattacagagtgcttgtgcacagagctcgaaaactagctcaacaatactatcttgtgtaccaagaacccattcctacagctcagctggtacagagagtagcttctgtgatgcaagaatatactcagtcaggtggtgttcgtccatttggagtttctttacttatttgtggttggaatgagggacgaccatatttatttcagtcagatccatctggagcttactttgcctggaaagctacagcaatgggaaagaactatgtgaatgggaagactttccttgagaaaagatataatgaagatctggaacttgaagatgccattcatacagccatcttaaccctaaaggaaagctttgaagggcaaatgacagaggataacatagaagttggaatctgcaatgaagctggatttaggaggcttactccaactgaagttaaggattacttggctgccatagcataacaatgaagtgactgaaaaatccagaatttcagataatctatctacttaaacatgtttaaagtatgttttgttttgcagactttttgcatacttatttctacatggtttaaatcgactgtttttaaaatgacacttataaatcctaataaactgttaaacccaccttccagccttttaggagttgctaaaattttaacagttatttcctgctttttatcacagttgatttctgaagactacattgccaagcagaatgatgaaatgactttttcgttgtcaggcaattttggttaagtcaaatcttaatgccctcttcgctatcagatgttgcctgtgtttccataaagcaaaatgctgattttggtaaaaaacatgactgcttctagagctgggaggatctgcagactttcacggattcatggaacaagaaaagaagcataggtacttttaggtgccattaggtattgatcagtgaaatcctagggtgctctatgagattgtactaggcctatgaagagtggtaagccaaataggtctccatgggagatacattatgtaaataaataaacaatggtttgctggttcctgttggtgtctccacaagtaggtaaacatgtttaaaggaacccgggttcttagattttgttagactttttaaactcaaggatgagcataagtgcttgaaataaaatgctaatacttaagtgtcaaaa

SEQ ID NO: 418770 - DNA, 1003 bp, Homo sapiens
  misc_feature (990)..(990): n is a, c, g, or t
cacagtgcgcatgtgtgcggctgtgctttggctcttcgggtaaagatggcggagcgcgggtacagcttttcgctgactacattcagcccgtctggtaaacttgtccagattgaatatgctttggctgctgtagctggaggagccccgtccgtgggaattaaagctgcaaatggtgtggtattagcaactgagaaaaaacagaaatccattctgtatgatgagcgaagtgtacacaaagtagaaccaattaccaagcatataggtttggtgtacagtggcatgggccccgattacagagtgcttgtgcacagagctcgaaaactagctcaacaatactatcttgtgtaccaagaacccattcctacagctcagctggtacagagagtagcttctgtgatgcaagaatatactcagtcaggtggtgttcgtccatttggagtttctttacttatttgtggttggaatgagggacgaccatatttatttcagtcagatccatctggagcttactttgcctggaaagctacagcaatgggaaagaactatgtgaatgggaagactttccttgagaaaagatataatgaagatctggaacttgaagatgccattcatacagccatcttaaccctaaaggaaagctttgaagggcaaatgacagaggataacatagaagttggaatctgcaatgaagctggatttaggaggcttactccaactgaagttaaggattacttggctgccatagcataacaatgaagtgactgaaaaatccagaatttcagataatctatctacttaaacatgtttaaagtatgttttgttttgcagactttttgcatacttatttctacatggtttaaatcgactgtttttaaaatgacacttataaatcctaataaactgttaaaccaaaaaaaaaaaaacaaaaaaaaaaaaaaaaaaaaaaaaaaaaaaaaaaaaaaaaaaaaaaggggggggggggggaaaaancccccgggggggg

SEQ ID NO: 418771 - DNA, 1440 bp, Homo sapiens
gcatgacgagaccgcgctacttgtagcaacttacgagtttcagtggcggaacggaatatgcccggaattcggccatacggccggggtaaagatggcggagcgcgggtacagcttttcgctgactacattcagcccgtctggtaaacttgtccagattgaatatgctttggctgctgtagctggaggagccccgtccgtgggaattaaagctgcaaatggtgtggtattagcaactgagaaaaaacagaaatccattctgtatgatgagcgaagtgtacacaaagtagaaccaattaccaagcatataggtttggtgtacagtggcatgggccccgattacagagctcagctggtacagagagtagcttctgtgatgcaagaatatactcagtcaggtggtgttcgtccatttggagtttctttacttatttgtggttggaatgagggacgaccatatttatttcagtcagatccatctggagcttactttgcctggaaagctacagcaatgggaaagaactatgtgaatgggaagactttccttgagaaaagatataatgaagatctggaacttgaagatgccattcatacagccatcttaaccctaaaggaaagctttgaagggcaaatgacagaggataacatagaagttggaatctgcaatgaagctggatttaggaggcttactccaactgaagttaaggattacttggctgccatagcataacaatgaagtgactgaaaaatccagaatttcagataatctatctacttaaacatgtttaaagtatgttttgttttgcagactttttgcatacttatttctacatggtttaaatcgactgtttttaaaatgacacttataaatcctaataaactgttaaacccaccttccagccttttaggagttgctaaaattttaacagttatttcctgctttttatcacagttgatttctgaagactacattgccaagcagaatgatgaaatgactttttcgttgtcaggcaattttggttaagtcaaatcttaatgccctcttcgctatcagatgttgcctgtgtttccataaagcaaaatgctgattttggtaaaaaacatgactgcttctagagctgggaggatctgcagactttcacggattcatggaacaagaaaagaagcataggtacttttaggtgccattaggtattgatcagtgaaatcctagggtgctctatgagattgtactaggcctatgaagagtggtaagccaaataggtctccatgggagatacattatgtaaataaataaacaatggtttgctggttcctgttggtgtctccacaagtaggtaaacatgtttaaaggaacccgggttcttagattttgttagactttttaaactcaaggatgagcataagtgcttgaaataaaatgctaatacttaagtgtcaaaa

SEQ ID NO: 418772 - DNA, 965 bp, Homo sapiens
  misc_feature (38)..(38): n is a, c, g, or t
  misc_feature (952)..(952): n is a, c, g, or t
tatacggtagcgaggcctgggtggcggttttcgctgangtacattcagcccgtctggtaaacttgtccagattgaatatgctttggctgctgtagctggaggagccccgtccgtgggaattaaagctgcaaatggtgtggtattagcaactgagaaaaaacagaaatccattctgtatgatgagcgaagtgtacacaaagtagaaccaattaccaagcatataggtttggtgtacagtggcatgggccccgattacagagtgcttgtgcacagagctcgaaaactagctcaacaatactatcttgtgtaccaagaacccattcctacagctcagctggtacagagagtagcttctgtgatgcaagaatatactcagtcaggtggtgttcgtccatttggagtttctttacttatttgtggttggaatgagggacgaccatatttatttcagtcagatccatctggagcttactttgcctggaaagctacagcaatgggaaagaactatgtgaatgggaagactttccttgagaaaagatataatgaagatctggaacttgaagatgccattcatacagccatcttaaccctaaaggaaagctttgaagggcaaatgacagaggataacatagaagttggaatctgcaatgaagctggatttaggaggcttactccaactgaagttaaggattacttggctgccatagcataacaatgaagtgactgaaaaatccagaatttcagataatctatctacttaaacatgtttaaagtatgttttgttttgcagactttttgcatacttatttctacatggtttaaatcgactgtttttaaaatgacacttataaatcctaataaactgttaaaccaaaaaaaaaaaaacaaaaaaaaaaaaaaaaaaaaaaaaaaaaaaaaaaaaaaaaaaaaaaggggggggggggggaaaaancccccgggggggg

SEQ ID NO: 418773 - DNA, 739 bp, Homo sapiens
  misc_feature (38)..(38): n is a, c, g, or t
tatacggtagcgaggcctgggtggcggttttcgctgangtacattcagcccgtctggtaaacttgtccagattgaatatgctttggctgctgtagctggaggagccccgtccgtgggaattaaagagtgcttgtgcacagagctcgaaaactagctcaacaatactatcttgtgtaccaagaacccattcctacagctcagctggtacagagagtagcttctgtgatgcaagaatatactcagtcaggtggtgttcgtccatttggagtttctttacttatttgtggttggaatgagggacgaccatatttatttcagtcagatccatctggagcttactttgcctggaaagctacagcaatgggaaagaactatgtgaatgggaagactttccttgagaaaagatataatgaagatctggaacttgaagatgccattcatacagccatcttaaccctaaaggaaagctttgaagggcaaatgacagaggataacatagaagttggaatctgcaatgaagctggatttaggaggcttactccaactgaagttaaggattacttggctgccatagcataacaatgaagtgactgaaaaatccagaatttcagataatctatctacttaaacatgtttaaagtatgttttgttttgcagactttttgcatacttatttctacatggtttaaatcgactgtttttaaaatgacacttataaatcctaataaactgttaaacc

SEQ ID NO: 418774 - DNA, 824 bp, Homo sapiens
attttcccttggccgttaatctcctgagggatgtgcccacagtatgcgccccccccagaagtagggtccctttccagagaggttccagccgtgcgagtgttcccagcgcgaacggtgtttaacccccgccccttgcccttcgcgttattaaatcctgccccctttattggagcccccgcctttgtccaagaaaaacctgtggtatcgcgctataaccttggcgcccccccccgggggagtatatttttttagaggcgccccgcgccctttttttgtttttttttttttttttttcaacaaaagcaagtttggtttatttgaatggtttcattaaataagtctacaaaggtaacaaactgaagcacaaagcgcaatcttacaagaagcgcaacacccagagttagtgcaaaatgtacaattaacggctgctgagaaacccccaaagtttgaatttttatttttatttttaacagtgtacattgttaaataatgtaaggaaaacatttataattcagaaagtttttaatgtggaaaaagatactcaaagtgtactattaacacaaaaataatttaaacagttcagtagcactagttcattcctctaggcttgttatttcatacacaggaggatgaaatcaacagtaaataacaccagttctgactttttttgtgtatgagtgaaaagatgtcaaaattattattaaacccaaataacaaatgataatgtgctgcatgaggctccactgctcctctggtataaagtatgtttcactcttgggtggcccccggacgcgtgggtcgacccacgcgtccgcgacgcgtgg

SEQ ID NO: 418775 - DNA, 2361 bp, Homo sapiens
  misc_feature (2096)..(2097): n is a, c, g, or t
  misc_feature (2154)..(2154): n is a, c, g, or t
  misc_feature (2361)..(2361): n is a, c, g, or t
ggtggtagttgggtgccacgacccttgtgtgtttgtctcggtcctttatttctgggttgtcgcctgtttgtggcacgccaagggtttcttctctcctcatatccctcggcgttctgttgtcctgctgccgttgttttgacgccgcgccgcttttttttttatctcttccttctctgggggactctctttcttgtcgtcgaatgtcttgtcgtgtcctctactgttgtcgtcccccgcggggtttttgttgtggtccgccccccccccttgttgtttgtctttgttgtagttttgtttttttttttcttcttcttgtttttttttttttttttttttttgtgtttttttttttttttgtttttttttttttttttttcaacaaaagcaagtttggtttatttgaatggtttcattaaataagtctacaaaggtaacaaactgaagcacaaagcgcaatcttacaagaagcgcaacacccagagttagtgcaaaatgtacaattaacggctgctgagaaacccccaaagtttgaatttttatttttatttttaacagtgtacattgttaaataatgtaaggaaaacatttataattcagaaagtttttaatgtggaaaaagatactcaaagtgtactattaacacaaaaataatttaaacagttcagtagcactagttcattcctctaggcttgttatttcatacacaggaggatgaaatcaacagtaaataacaccagttctgactttttttgtgtatgagtgaaaagatgtcaaaattattattaaacccaaataacaaatgataatgtgctgcatgaggctccactgctcctctggtataaagtatgtttcactcttgggtggcccctttctcagctactcagccccttgttggttctatccttactctctccacaagaaatacaagcagagaataaataaatcattttaaagcaggggtggaagcccttgcccttttcctttctaccttttaaaaaccttcagctctcatttgcatatttagggccgtagaccaacttacttacttattaagggaagcagggcccttaaggaatgaacagggtacaggagcctccagcctctttctgtggtagtggtggtggtggtggtgattcccagaatatgccattgacgtgggtaaaaggttggaaatattttcagtttcccaactaagagtcaagaagcaccccaaaattaagagtcctagcttctttctttgtcttcagagataacaaagatcctaaacatagccagttaggacagtatttccggaaagctctgaaaataattaataactacccattacaaggaggcatagcactgaataacactgattggttgcagttattacttacggggagtattatttatttgaaaatgtgaacatattagttgtacttctagaaataaaggtggcacaatagattatgatcctgcaaccatttggacatcataaaggaaatgagtaggaataagtattctttcctagaatgattaattcagatgtggaaagatagatagattaactttccacaaaatgtagtaccccaagctgagaaatgcatggtacatgtgcaacaagaggaaagcaatccaaacagtttttctgagagcaattttctccatctgtgacttttcactatcaggttccccaacttgaaaactagccccccacccccttctctttatgttcagtttcttctaggtcacgtctgttcaagcctagctcaaataagaaaggtttatatgacagtcactggccaggcatcacgtttgtttcctcattctttagtctttgtctttcacccagcacacaccattcttttaagttgtccaattttgttacaacaccccctcctcactattcccgaaacagaactttctgtttttaaccactgatgccaacctaacttcccaccctactcatcttacacctgctctagacaaagttgttgaatgacttaaaaaaatactttttcaatttccctttggcataaccactgctggactgctggggtcacatggacctacgatttccttccacatgccctttattgatctggggtctggtaagnngatgctaatggcagaagcaatagaagtccaaggcactaaaatgtccagcaagcaacnctgggaaacagaagtattcaagtacagtaatttatacaattttacattcacatttatttatctaatacaatggaaatacaaaggaaaagttaaagtgtctcaataagtaaaggacagagctagctttttttggaactttttaaacgtttcatattttactcttaaaactactgttgtccaacaacattttatatatcacagtgtttn

SEQ ID NO: 418776 - DNA, 960 bp, Homo sapiens
ggtggtagttgggtgccacgacccttgtgtgtttgtctcggtcctttatttctgggttgtcgcctgtttgtggcacgccaagggtttcttctctcctcatatccctcggcgttctgttgtcctgctgccgttgttttgacgccgcgccgcttttttttttatctcttccttctctgggggactctctttcttgtcgtcgaatgtcttgtcgtgtcctctactgttgtcgtcccccgcggggtttttgttgtggtccgccccccccccttgttgtttgtctttgttgtagttttgtttttttttttcttcttcttgtttttttttttttttttttttttgtgtttttttttttttttgtttttttttttttttttttcaacaaaagcaagtttggtttatttgaatggtttcattaaataagtctacaaaggtaacaaactgaagcacaaagcgcaatcttacaagaagcgcaacacccagagttagtgcaaaatgtacaattaacggctgctgagaaacccccaaagtttgaatttttatttttatttttaacagtgtacattgttaaataatgtaaggaaaacatttataattcagaaagtttttaatgtggaaaaagatactcaaagtgtactattaacacaaaaataatttaaacagttcagtagcactagttcattcctctaggcttgttatttcatacacaggaggatgaaatcaacagtaaataacaccagttctgactttttttgtgtatgagtgaaaagatgtcaaaattattattaaacccaaataacaaatgataatgtgctgcatgaggctccactgctcctctggtataaagtatgtttcactcttgggtggcccctttctcagctactcagccccttgttggttctatccttactctctccacaagaaatacaagcagagaaaggatagagccaaccgtggactagt

SEQ ID NO: 418777 - DNA, 907 bp, Homo sapiens
tgacttttaaattcatctaatttttattaatgattatgataacatataaaattatgctcagcagtacaaaatagatccatttagctcatcagcgttttacacatttataaattttataaaatatgaataccaatttcacagcattttctgataatgcctcactagagaataaaatttctatttttggaaaaaaccaacaacaacttttgaagctgacctggtttgccatgtttatttcgggtctgtggttatgcttatctctgattccagagtgaagggaggtgggcagggcgtgggtgtccattaaggcacctctgtccttcctgcaggccaaatcctgccctggcttgtcctgtgtcaagggacaatgtcctgctttacaaagtcaaggctgtgcccatagaaagccttgtaatcttttgggttctccgtttccttatgagtgatgcacaggctctgatgattgtcatcctcttcacagcctccatgaatctcctgatgaactccctcagaaggtggaaggagcacctgacaccgacccgagatcagcagcagctacgcccacgctgtgggcagttaagaggcagccagtggtaccagtcgtgagcgatcagatttgaggactcaggattctggtttcctgagtgtcatggacctgcgggctgcagaaatgacagcgacaggtcttcaggcaggtgccacagcacccacacactgccagcattttgtgcaaaatacccaaagccacatcaccagatctgggctctcctagcttccctttgctaaaatgctggccaaagagcttaacgagccactcaggggcacaagataggtgaaacctgcatgttttgtttgttaaactatttgccacatggcacaagaaaataacaaaaaataaacaaaagga

SEQ ID NO: 418778 - DNA, 662 bp, Homo sapiens
atggcaactctgtgggaatccttccagcagcccgcttatggctggagacagaggtgtggcttctatctaagcttttccctctgactcagtccaggaggcaactgtcttgggaagcaaatgataacagcatctgggagattctcttctggatggactagcagggaatcaggacatgaactcagtggactaactgcaccgagactcacctggtcattacttgaaggtcattacttaaacctccatgaatctcctgatgaactccctcagaaggtggaaggagcacctgacaccgacccgagatcagcagcagctacgcccacgctgtgggcagttaagaggcagccagtggtaccagtcgtgagcgatcagatttgaggactcaggattctggtttcctgagtgtcatggacctgcgggctgcagaaatgacagcgacaggtcttcaggcaggtgccacagcacccacacactgccagcattttgtgcaaaatacccaaagccacatcaccagatctgggctctcctagcttccctttgctaaaatgctggccaaagagcttaacgagccactcaggggcacaagataggtgaaacctgcatgttttgtttgttaaactatttgccacatggcacaagaaaataacaaaaaataaacaaaagga

SEQ ID NO: 418779 - DNA, 4880 bp, Homo sapiens
agaccacctgctgccgaatcacacgatgctgggtgaaaacgcggatggcctgggccccaccctggaatctcagagtccgaatacttaactacgggtgtggctctgaagtctgcgctttccaccagtacgccaggtggctccgtctttggcgcgcaagtttgagagccgtggggccccgccctccgccaaggtgggcgtgggtggcgtagcagagccccaagctcaggccgcctgcgcaggctagggccggaggcacgcaaccctgaggcagcgagtcgccaagtctcgtatgcgccccgcaacgcgggaactaggcgatcgctccacgctcctcccctcctttcccctcccacagcgtcctgcgcgcatgcgcttcgcagcttctctcgccgccgcgcccccagctgctctggttacggttggtgtttgcgaattctctgcggcaccttcttcgctgaactccaccgtcagttccataggcgcgcgcccgcgtcacgtgggccgaggttccggcgcggctgctggccggcggctgagccgggagaaaggagctgcggccaccgttcgccctacttctgcgcctcggggcgggcgcgccggtaaaaatggcgaaatgggggtaggcggcgctggacctgaagagatggggcgcgcaggtggggcggttgtcagagccccctgacgtgggcgccgggcttttatcggcgatttgatctggcgacctcgggccggcgcctaagaggtcagactgcggagcctgcgggtcgccagcggccccgccgagagccggaggcaatggatgaacagagcgtggagagcattgctgaggttttccgatgtttcatttgtatggagaaattgcgggatgcacgcctgtgtcctcattgctccaaactgtgttgtttcagctgtattaggcgctggctgacagagcagagagctcaatgtcctcattgccgtgctccactccagctacgagaactagtaaattgtcgttgggcagaagaagtaacacaacagcttgatactcttcaactctgcagtctcaccaaacatgaagaaaatgaaaaggacaaatgtgaaaatcaccatgaaaaacttagtgtattttgctggacttgtaagaagtgtatctgccatcagtgtgcactttggggaggaatgcatggcggacatacctttaaacctttggcagaaatttatgagcaacacgtcactaaagtgaatgaagaggtagccaaacttcgtcggcgtctcatggaactgatcagcttagttcaagaagtggaaaggaatgtagaagctgtaagaaatgcaaaagatgagcgtgttcgggaaattaggaatgcagtggagatgatgattgcacggttagacacacagctgaagaataagcttataacactgatgggtcagaagacatctctaacccaagaaacagagcttttggaatccttacttcaggaggtggagcaccagttgcggtcttgtagtaagagtgagttgatatctaagagctcagagatccttatgatgtttcagcaagttcatcggaagcccatggcatcttttgttaccactcctgttccaccagactttaccagtgaattagtgccatcttacgattcagctacttttgttttagagaatttcagcactttgcgtcagagagcagatcctgtttacagtccacctcttcaagtttcaggactttgctggaggttaaaagtttacccagatggaaatggagttgtgcgaggttactacttatctgtgtttctggagctctcagctggcttgcctgaaacttctaaatatgaatatcgtgtagagatggttcaccagtcctgtaatgatcctacaaaaaatatcattcgagaatttgcatctgactttgaagttggagaatgctggggctataatagatttttccgtttggacttactcgcaaatgaaggatacttgaatccacaaaatgatacagtgattttaaggtttcaggtacgttcaccaactttctttcaaaaatcccgggaccagcattggtacattactcagttggaagctgcacagactagttatatccaacaaataaacaaccttaaagagagacttactattgagctgtctcgaactcagaagtcaagagatttgtcaccaccagataaccatcttagcccccaaaatgatgatgctctggagacacgagctaagaagtctgcatgctctgacatgcttctcgaaggtggtcctactacagcttctgtaagagaggccaaagaggatgaagaagatgaggagaagattcagaatgaagattatcatcacgagctttcagatggagatctggatctggatcttgtttatgaggatgaagtaaatcagctcgatggcagcagttcctctgctagttccacagcaacaagtaatacagaagaaaatgatattgatgaagaaactatgtctggagaaaatgatgtggaatataacaacatggaattagaagagggagaactcatggaagatgcagctgctgcaggacccgcaggtagtagccatggttatgtgggttccagtagtagaatatcaagaagaacacatttatgctccgctgctaccagtagtttactagacattgatccattaattttaatacatttgttggaccttaaggaccggagcagtatagaaaatttgtggggcttacagcctcgcccacctgcttcacttctgcagcccacagcatcatattctcgaaaagataaagaccaaaggaagcaacaggcaatgtggcgagtgccctctgatttaaagatgctaaaaagactcaaaactcaaatggccgaagttcgatgtatgaaaactgatgtaaagaatacactttcagaaataaaaagcagcagtgctgcttctggagacatgcagacaagccttttttctgctgaccaggcagctctggctgcatgtggaactgaaaactctggcagattgcaggatttgggaatggaactcctggcaaagtcatcagttgccaattgttacatacgaaactccacaaataagaagagtaattcgcccaagccagctcgatccagtgtagcaggtagtctatcacttcgaagagcagtggaccctggagaaaatagtcgttcaaagggagactgtcagactctgtctgaaggctccccaggaagctctcagtctgggagcaggcacagttctccccgagccttgatacatggcagtatcggtgatattctgccaaaaactgaagaccggcagtgtaaagctttggattcagatgctgttgtggttgcagttttcagtggcttgcctgcggttgagaaaaggaggaaaatggtcaccttgggggctaatgctaaaggaggtcatctggaaggactgcagatgactgatttggaaaataattctgaaactggagagttacagcctgtactacctgaaggagcttcagctgcccctgaagaaggaatgagtagcgacagtgacattgaatgtgacactgagaatgaggagcaggaagagcataccagtgtgggcgggtttcacgactccttcatggtcatgacacagcccccggatgaagatacacattccagttttcctgatggtgaacaaataggccctgaagatctcagcttcaatacagatgaaaatagtggaaggtaattgccaaatcaagagaactgacttgcaagctaccttgaccctgaattttgctgtagttggtgctcaaatttgtcatcagtcagataatcagatttggtcttatttcttcattatctcgacctgaaatagtaatttggaaactgttggaaggtggcacagtttagtctaagacagcagtagtacatgggaaaaacagtatgggaagagttctttgtaatgtaaggaaataacaatgtagttctctattaatttagcaaatttgtacattcacaaaaggcagtttgtctactacagcagaaggctggttaactgccagaaaatgtacctccaggccctgcatgccgtcagtaacccgcccggcattggtgctctactgtctttggctagagcttagttgtgtttaaataatcatctttatatttggggttttaattacagttccattagtgcctgtagattagtgaacagaaaattgctttggaagagattctgccctgtagacactatgtgaataactgaagtaacactagactgaatctcctttttggagtatgtatcttctctcacttgttcaagtacaggcacactgttcaaccgcatggtatctttctgttgtgtgacttctacaaatgtaattttaaatgaaattaagttaacatggattcattacgttcctggccctgtagacacgtgtaagattatttaaaattctttcatttttttctgcctcttactatacgactgtagtgcaacaaatattttaaagcccccttttcttctttattttcattagttgtacattgatttcagtgtcaacacatttaaagattcattcatgttgcacagtggcttacatgaacgtgaaactgtgatataaggttttctttcatactcataattagcccaaaacagttgccaaactttgccattgtgctcctgcatttgtgtttgagctgctatatatttgtggaaattacactgaaagttgactaagagactattgaaaaagcatgaataattaaatatacatgtgagagacatctcatctgctgtattttacttagtgaatattgttcactcttccgtgtctgatgtcttgctgaatgctgtgactcatagtttacttttgttcaaaatagtttgcactttttgttaataaaatcaacttgagaaaaagatgcctctgctgt

SEQ ID NO: 418780 - DNA, 665 bp, Homo sapiens
tttaagctatttgcagatcagaatagaagagtgggcatttgtcctttcacatcacgtgattttcaaaggtgaaaaaaatttcttttgctaacttacgattcaaagaaaaatggtctcaaattaaagtgtggacaaaactgtagtattcccttttatagccttgcttaggtaagaatgttcactgagtgaataaattaggtttaaaaattaaaacaataatttagatcattttcccacaaagccttatcaaggatttgatggggaaggaagcacttgaaccacagcagttttatctgtaaacactgaacttggccatgcatcattttcatctgcccactggatgttgcacttctcactggcacagtgtttcaacagtggagtgtggttgtcatgaaaatgcagtattgacactataccactataaatgtggtcaaaattagactcagtgttgacattgacattgttgccattgtccttggaaaaggtgttactttcaaggagcctcctaaatgcaacagtaactttaatcataataattcaaggacaatggatggcacttctaggtaaagaaaaggtatatacatatgtgtttctacccatcctctttagtacagacctaaatgggattaatagccccagtgtggagagagggagagagaagagcg

SEQ ID NO: 418781 - DNA, 1458 bp, Homo sapiens
  misc_feature (1181)..(1181): n is a, c, g, or t
  misc_feature (1192)..(1192): n is a, c, g, or t
  misc_feature (1203)..(1203): n is a, c, g, or t
  misc_feature (1338)..(1338): n is a, c, g, or t
  misc_feature (1359)..(1359): n is a, c, g, or t
  misc_feature (1386)..(1386): n is a, c, g, or t
  misc_feature (1393)..(1393): n is a, c, g, or t
  misc_feature (1401)..(1401): n is a, c, g, or t
  misc_feature (1422)..(1422): n is a, c, g, or t
  misc_feature (1431)..(1431): n is a, c, g, or t
  misc_feature (1445)..(1445): n is a, c, g, or t
agaccacctgctgccgaatcacacgatgctgggtgaaaacgcggatggcctgggccccaccctggaatctcagagtccgaatacttaactacgggtgtggctctgaagtctgcgctttccaccagtacgccaggtggctccgtctttggcgcgcaagtttgagagccgtggggccccgccctccgccaaggtgggcgtgggtggcgtagcagagccccaagctcaggccgcctgcgcaggctagggccggaggcacgcaaccctgaggcagcgagtcgccaagtctcgtatgcgccccgcaacgcgggaactaggcgatcgctccacgctcctcccctcctttcccctcccacagcgtcctgcgcgcatgcgcttcgcagcttctctcgccgccgcgcccccagctgctctggttacggttggtgtttgcgaattctctgcggcaccttcttcgctgaactccaccgtcagttccataggcgcgcgcccgcgtcacgtgggccgaggttccggcgcggctgctggccggcggctgagccgggagaaaggagctgcggccaccgttcgccctacttctgcgcctcggggcgggcgcgccggtaaaaatggcgaaatgggggtaggcggcgctggacctgaagagatggggcgcgcaggtggggcggttgtcagagccccctgacgtgggcgccgggcttttatcggcgatttgatctggcgacctcgggccggcgcctaagaggtcagactgcggagcctgcgggtcgccagcggccccgccgagagccggaggcaatggatgaacagagcgtggagagcattgctgaggttttccgatgtttcatttgtatggagaaattgcgggatgcacgcctgtgtcctcattgctccaaactgtgttgtttcagctgtattaggcgctggctgacagagcagagagctcaatgtcctcattgccgagtctcgctctgtcgtccaggccggagtgcaatggcgtgatttcagctcactgcagcctcgacctcctgggctcagtgctccactccagctacgagaactagtaaattgtcgttgggcagaagaagtaacacaacagcttgatactcttcaactctgcagtctcaccaaacatgaagaaaatgaaaaggacaagtatgtcctcaatttctttgttcaatatngaatggatttngcctttgtatngtttaatgacactatatgggtagttgcctttagttatttatgaataagtagtgttatatttcttgtttttaattctttcagtcatgcgctgttactgttaagtaacatattcttattggtcatttaacaacagtnatttcatgccatgtatacacnagatacctctcggcctcccctcccccncacaganagtacttngctagatgataggcatacaanggtacatgngacatgattctgtnactgttaatgggg

SEQ ID NO: 418782 - DNA, 215 bp, Homo sapiens
cagttttagatttttgtgtttgattaaaaaaaaacagtagcatcatggcttttaacatattatgtgctaaaacagtaggctaaaaatattgtccattgatttccattagtaatgtatgtatgcccttatgtaaatgttaataagtcagaagttgttgaatcaaagcatttcaaggtgtgagccactgtgcctggcgatttttggatttttaaacc

SEQ ID NO: 418783 - DNA, 4763 bp, Homo sapiens
agaccacctgctgccgaatcacacgatgctgggtgaaaacgcggatggcctgggccccaccctggaatctcagagtccgaatacttaactacgggtgtggctctgaagtctgcgctttccaccagtacgccaggtggctccgtctttggcgcgcaagtttgagagccgtggggccccgccctccgccaaggtgggcgtgggtggcgtagcagagccccaagctcaggccgcctgcgcaggctagggccggaggcacgcaaccctgaggcagcgagtcgccaagtctcgtatgcgccccgcaacgcgggaactaggcgatcgctccacgctcctcccctcctttcccctcccacagcgtcctgcgcgcatgcgcttcgcagcttctctcgccgccgcgcccccagctgctctggttacggttggtgtttgcgaattctctgcggcaccttcttcgctgaactccaccgtcagttccataggcgcgcgcccgcgtcacgtgggccgaggttccggcgcggctgctggccggcggctgagccgggagaaaggagctgcggccaccgttcgccctacttctgcgcctcggggcgggcgcgccggtaaaaatggcgaaatgggggtaggcggcgctggacctgaagagatggggcgcgcaggtggggcggttgtcagagccccctgacgtgggcgccgggcttttatcggcgatttgatctggcgacctcgggccggcgcctaagaggtcagactgcggagcctgcgggtcgccagcggccccgccgagagccggaggcaatggatgaacagagcgtggagagcattgctgaggttttccgatgtttcatttgtatggagaaattgcgggatgcacgcctgtgtcctcattgctccaaactgtgttgtttcagctgtattaggcgctggctgacagagcagagagctcaatgtcctcattgccgtgctccactccagctacgagaactagtaaattgtcgttgggcagaagaagtaacacaacagcttgatactcttcaactctgcagtctcaccaaacatgaagaaaatgaaaaggacaaatgtgaaaatcaccatgaaaaacttagtgtattttgctggacttgtaagaagtgtatctgccatcagtgtgcactttggggaggaatgcatggcggacatacctttaaacctttggcagaaatttatgagcaacacgtcactaaagtgaatgaagaggtagccaaacttcgtcggcgtctcatggaactgatcagcttagttcaagaagtggaaaggaatgtagaagctgtaagaaatgcaaaagatgagcgtgttcgggaaattaggaatgcagtggagatgatgattgcacggttagacacacagctgaagaataagcttataacactgatgggtcagaagacatctctaacccaagaaacagagcttttggaatccttacttcaggaggtggagcaccagttgcggtcttgtagtaagagtgagttgatatctaagagctcagagatccttatgatgtttcagcaagttcatcggaagcccatggcatcttttgttaccactcctgttccaccagactttaccagtgaattagtgccatcttacgattcagctacttttgttttagagaatttcagcactttgcgtcagagagcagatcctgtttacagtccacctcttcaagtttcaggactttgctggaggttaaaagtttacccagatggaaatggagttgtgcgaggttactacttatctgtgtttctggagctctcagctggcttgcctgaaacttctaaatatgaatatcgtgtagagatggttcaccagtcctgtaatgatcctacaaaaaatatcattcgagaatttgcatctgactttgaagttggagaatgctggggctataatagatttttccgtttggacttactcgcaaatgaaggatacttgaatccacaaaatgatacagtgattttaaggtttcaggtacgttcaccaactttctttcaaaaatcccgggaccagcattggtacattactcagttggaagctgcacagactagttatatccaacaaataaacaaccttaaagagagacttactattgagctgtctcgaactcagaagtcaagagatttgtcaccaccagataaccatcttagcccccaaaatgatgatgctctggagacacgagctaagaagtctgcatgctctgacatgcttctcgaaggtggtcctactacagcttctgtaagagaggccaaagaggatgaagaagatgaggagaagattcagaatgaagattatcatcacgagctttcagatggagatctggatctggatcttgtttatgaggatgaagtaaatcagctcgatggcagcagttcctctgctagttccacagcaacaagtaatacagaagaaaatgatattgatgaagaaactatgtctggagaaaatgatgtggaatataacaacatggaattagaagagggagaactcatggaagatgcagctgctgcaggacccgcaggtagtagccatggttatgtgggttccagtagtagaatatcaagaagaacacatttatgctccgctgctaccagtagtttactagacattgatccattaattttaatacatttgttggaccttaaggaccggagcagtatagaaaatttgtggggcttacagcctcgcccacctgcttcacttctgcagcccacagcatcatattctcgaaaagataaagaccaaaggaagcaacaggcaatgtggcgagtgccctctgatttaaagatgctaaaaagactcaaaactcaaatggccgaagttcgatgtatgaaaactgatgtaaagaatacactttcagaaataaaaagcagcagtgctgcttctggagacatgcagacaagccttttttctgctgaccaggcagctctggctgcatgtggaactgaaaactctggcagattgcaggatttgggaatggaactcctggcaaagtcatcagttgccaattgttacatacgaaactccacaaataagaagagtaattcgcccaagccagctcgatccagtgtagcaggtagtctatcacttcgaagagcagtggaccctggagaaaatagtcgttcaaagggagactgtcagactctgtctgaaggctccccaggaagctctcagtctgggagcaggcacagttctccccgagccttgatacatggcagtatcggtgatattctgccaaaaactgaagaccggcagtgtaaagctttggattcagatgctgttgtggttgcagttttcagtggcttgcctgcggttgagaaaaggaggaaaatggtcaccttgggggctaatgctaaaggaggtcatctggaaggactgcagatgactgatttggaaaataattctgaaactggagagttacagcctgtactacctgaaggagcttcagctgcccctgaagaagatacacattccagttttcctgatggtgaacaaataggccctgaagatctcagcttcaatacagatgaaaatagtggaaggtaattgccaaatcaagagaactgacttgcaagctaccttgaccctgaattttgctgtagttggtgctcaaatttgtcatcagtcagataatcagatttggtcttatttcttcattatctcgacctgaaatagtaatttggaaactgttggaaggtggcacagtttagtctaagacagcagtagtacatgggaaaaacagtatgggaagagttctttgtaatgtaaggaaataacaatgtagttctctattaatttagcaaatttgtacattcacaaaaggcagtttgtctactacagcagaaggctggttaactgccagaaaatgtacctccaggccctgcatgccgtcagtaacccgcccggcattggtgctctactgtctttggctagagcttagttgtgtttaaataatcatctttatatttggggttttaattacagttccattagtgcctgtagattagtgaacagaaaattgctttggaagagattctgccctgtagacactatgtgaataactgaagtaacactagactgaatctcctttttggagtatgtatcttctctcacttgttcaagtacaggcacactgttcaaccgcatggtatctttctgttgtgtgacttctacaaatgtaattttaaatgaaattaagttaacatggattcattacgttcctggccctgtagacacgtgtaagattatttaaaattctttcatttttttctgcctcttactatacgactgtagtgcaacaaatattttaaagcccccttttcttctttattttcattagttgtacattgatttcagtgtcaacacatttaaagattcattcatgttgcacagtggcttacatgaacgtgaaactgtgatataaggttttctttcatactcataattagcccaaaacagttgccaaactttgccattgtgctcctgcatttgtgtttgagctgctatatatttgtggaaattacactgaaagttgactaagagactattgaaaaagcatgaataattaaatatacatgtgagagacatctcatctgctgtattttacttagtgaatattgttcactcttccgtgtctgatgtcttgctgaatgctgtgactcatagtttacttttgttcaaaatagtttgcactttttgttaataaaatcaacttgagaaaaagatgcctctgctgt

SEQ ID NO: 418784 - DNA, 2442 bp, Homo sapiens
atctcgctgactcttgaggatccagtctggagaaaatgatgtggaatataacaacatggaattagaagagggagaactcatggaagatgcagctgctgcaggacccgcaggtagtagccatggttatgtgggttccagtagtagaatatcaagaagaacacatttatgctccgctgctaccagtagtttactagacattgatccattaattttaatacatttgttggaccttaaggaccggagcagtatagaaaatttgtggggcttacagcctcgcccacctgcttcacttctgcagcccacagcatcatattctcgaaaagataaagaccaaaggaagcaacaggcaatgtggcgagtgccctctgatttaaagatgctaaaaagactcaaaactcaaatggccgaagttcgatgtatgaaaactgatgtaaagaatacactttcagaaataaaaagcagcagtgctgcttctggagacatgcagacaagccttttttctgctgaccaggcagctctggctgcatgtggaactgaaaactctggcagattgcaggatttgggaatggaactcctggcaaagtcatcagttgccaattgttacatacgaaactccacaaataagaagagtaattcgcccaagccagctcgatccagtgtagcaggtagtctatcacttcgaagagcagtggaccctggagaaaatagtcgttcaaagggagactgtcagactctgtctgaaggctccccaggaagctctcagtctgggagcaggcacagttctccccgagccttgatacatggcagtatcggtgatattctgccaaaaactgaagaccggcagtgtaaagctttggattcagatgctgttgtggttgcagttttcagtggcttgcctgcggttgagaaaaggaggaaaatggtcaccttgggggctaatgctaaaggaggtcatctggaaggactgcagatgactgatttggaaaataattctgaaactggagagttacagcctgtactacctgaaggagcttcagctgcccctgaagaaggaatgagtagcgacagtgacattgaatgtgacactgagaatgaggagcaggaagagcataccagtgtgggcgggtttcacgactccttcatggtcatgacacagcccccggatgaagatacacattccagttttcctgatggtgaacaaataggccctgaagatctcagcttcaatacagatgaaaatagtggaaggtaattgccaaatcaagagaactgacttgcaagctaccttgaccctgaattttgctgtagttggtgctcaaatttgtcatcagtcagataatcagatttggtcttatttcttcattatctcgacctgaaatagtaatttggaaactgttggaaggtggcacagtttagtctaagacagcagtagtacatgggaaaaacagtatgggaagagttctttgtaatgtaaggaaataacaatgtagttctctattaatttagcaaatttgtacattcacaaaaggcagtttgtctactacagcagaaggctggttaactgccagaaaatgtacctccaggccctgcatgccgtcagtaacccgcccggcattggtgctctactgtctttggctagagcttagttgtgtttaaataatcatctttatatttggggttttaattacagttccattagtgcctgtagattagtgaacagaaaattgctttggaagagattctgccctgtagacactatgtgaataactgaagtaacactagactgaatctcctttttggagtatgtatcttctctcacttgttcaagtacaggcacactgttcaaccgcatggtatctttctgttgtgtgacttctacaaatgtaattttaaatgaaattaagttaacatggattcattacgttcctggccctgtagacacgtgtaagattatttaaaattctttcatttttttctgcctcttactatacgactgtagtgcaacaaatattttaaagcccccttttcttctttattttcattagttgtacattgatttcagtgtcaacacatttaaagattcattcatgttgcacagtggcttacatgaacgtgaaactgtgatataaggttttctttcatactcataattagcccaaaacagttgccaaactttgccattgtgctcctgcatttgtgtttgagctgctatatatttgtggaaattacactgaaagttgactaagagactattgaaaaagcatgaataattaaatatacatgtgagagacatctcatctgctgtattttacttagtgaatattgttcactcttccgtgtctgatgtcttgctgaatgctgtgactcatagtttacttttgttcaaaatagtttgcactttttgttaataaaatcaacttgagaaaaagatgcctctgctgt

SEQ ID NO: 418785 - DNA, 4827 bp, Homo sapiens
agaccacctgctgccgaatcacacgatgctgggtgaaaacgcggatggcctgggccccaccctggaatctcagagtccgaatacttaactacgggtgtggctctgaagtctgcgctttccaccagtacgccaggtggctccgtctttggcgcgcaagtttgagagccgtggggccccgccctccgccaaggtgggcgtgggtggcgtagcagagccccaagctcaggccgcctgcgcaggctagggccggaggcacgcaaccctgaggcagcgagtcgccaagtctcgtatgcgccccgcaacgcgggaactaggcgatcgctccacgctcctcccctcctttcccctcccacagcgtcctgcgcgcatgcgcttcgcagcttctctcgccgccgcgcccccagctgctctggttacggttggtgtttgcgaattctctgcggcaccttcttcgctgaactccaccgtcagttccataggcgcgcgcccgcgtcacgtgggccgaggttccggcgcggctgctggccggcggctgagccgggagaaaggagctgcggccaccgttcgccctacttctgcgcctcggggcgggcgcgccggtaaaaatggcgaaatgggggtaggcggcgctggacctgaagagatggggcgcgcaggtggggcggttgtcagagccccctgacgtgggcgccgggcttttatcggcgatttgatctggcgacctcgggccggcgcctaagaggtcagactgcggagcctgcgggtcgccagcggccccgccgagagccggaggcaatggatgaacagagcgtggagagcattgctgaggttttccgatgtttcatttgtatggagaaattgcgggatgcacgcctgtgtcctcattgctccaaactgtgttgtttcagctgtattaggcgctggctgacagagcagagagctcaatgtcctcattgccgtgctccactccagctacgagaactagtaaattgtcgttgggcagaagaagtaacacaacagcttgatactcttcaactctgcagtctcaccaaacatgaagaaaatgaaaaggacaaatgtgaaaatcaccatgaaaaacttagtgtattttgctggacttgtaagaagtgtatctgccatcagtgtgcactttggggaggaatgcatggcggacatacctttaaacctttggcagaaatttatgagcaacacgtcactaaagtgaatgaagaggtagccaaacttcgtcggcgtctcatggaactgatcagcttagttcaagaagtggaaaggaatgtagaagctgtaagaaatgcaaaagatgagcgtgttcgggaaattaggaatgcagtggagatgatgattgcacggttagacacacagctgaagaataagcttataacactgatgggtcagaagacatctctaacccaagaaacagagcttttggaatccttacttcaggaggtggagcaccagttgcggtcttgtagtaagagtgagttgatatctaagagctcagagatccttatgatgtttcagcaagttcatcggaagcccatggcatcttttgttaccactcctgttccaccagactttaccagtgaattagtgccatcttacgattcagctacttttgttttagagaatttcagcactttgcgtcagagagcagatcctgtttacagtccacctcttcaagtttcaggactttgctggaggttaaaagtttacccagatggaaatggagttgtgcgaggttactacttatctgtgtttctggagctctcagctggcttgcctgaaacttctaaatatgaatatcgtgtagagatggttcaccagtcctgtaatgatcctacaaaaaatatcattcgagaatttgcatctgactttgaagttggagaatgctggggctataatagatttttccgtttggacttactcgcaaatgaaggatacttgaatccacaaaatgatacagtgattttaaggtttcaggtacgttcaccaactttctttcaaaaatcccgggaccagcattggtacattactcagttggaagctgcacagactagttatatccaacaaataaacaaccttaaagagagacttactattgagctgtctcgaactcagaagtcaagagatttgtcaccaccagataaccatcttagcccccaaaatgatgatgctctggagacacgagctaagaagtctgcatgctctgacatgcttctcgaaggtggtcctactacagcttctgtaagagaggccaaagaggatgaagaagatgaggagaagattcagaatgaagattatcatcacgagctttcagatggagatctggatctggatcttgtttatgaggatgaagtaaatcagctcgatggcagcagttcctctgctagttccacagcaacaagtaatacagaagaaaatgatattgatgaagaaactatgtctggagaaaatgatgtggaatataacaacatggaattagaagagggagaactcatggaagatgcagctgctgcaggacccgcaggtagtagccatggttatgtgggttccagtagtagaatatcaagaagaacacatttatgctccgctgctaccagtagtttactagacattgatccattaattttaatacatttgttggaccttaaggaccggagcagtatagaaaatttgtggggcttacagcctcgcccacctgcttcacttctgcagcccacagcatcatattctcgaaaagataaagaccaaaggaagcaacaggcaatgtggcgagtgccctctgatttaaagatgctaaaaagactcaaaactcaaatggccgaagttcgatgtatgaaaactgatgtaaagaatacactttcagaaataaaaagcagcagtgctgcttctggagacatgcagacaagccttttttctgctgaccaggcagctctggctgcatgtggaactgaaaactctggcagattgcaggatttgggaatggaactcctggcaaagtcatcagttgccaattgttacatacgaaactccacaaataagaagagtaattcgcccaagccagctcgatccagtgtagcaggtagtctatcacttcgaagagcagtggaccctggagaaaatagtcgttcaaagggagactgtcagactctgtctgaaggctccccaggaagctctcagtctgggagcaggcacagttctccccgagccttgatacatggcagtatcggtgatattctgccaaaaactgaagaccggcagtgtaaagctttggattcagatgctgttgtggttgcagttttcagtggcttgcctgcggttgagaaaaggaggaaaatggtcaccttgggggctaatgctaaaggaggtcatctggaaggactgcagatgactgatttggaaaataattctgaaactggagagttacagcctgtactacctgaaggagcttcagctgcccctgaagaaggaatgagtagcgacagtgacattgaatgtgacactgagaatgaggagcaggaagagcataccagtgtgggcgggtttcacgactccttcatggtcatgacacagcccccggatgaagatacacattccagttttcctgatggtgaacaaataggccctgaagatctcagcttcaatacagatgaaaatagtggaaggtaattgccaaatcaagagaactgacttgcaagctaccttgaccctgaattttgctgtagttggtgctcaaatttgtcatcagtcagataatcagatttggtcttatttcttcattatctcgacctgaaatagtaatttggaaactgttggaaggtggcacagtttagtctaagacagcagtagtacatgggaaaaacagtatgggaagagttctttgtaatgtaaggaaataacaatgtagttctctattaatttagcaaatttgtacattcacaaaaggcagtttgtctactacagcagaaggctggttaactgccagaaaatgtacctccaggccctgcatgccgtcagtaacccgcccggcattggtgctctactgtctttggctagagcttagttgtgtttaaataatcatctttatatttggggttttaattacagttccattagtgcctgtagattagtgaacagtaacactagactgaatctcctttttggagtatgtatcttctctcacttgttcaagtacaggcacactgttcaaccgcatggtatctttctgttgtgtgacttctacaaatgtaattttaaatgaaattaagttaacatggattcattacgttcctggccctgtagacacgtgtaagattatttaaaattctttcatttttttctgcctcttactatacgactgtagtgcaacaaatattttaaagcccccttttcttctttattttcattagttgtacattgatttcagtgtcaacacatttaaagattcattcatgttgcacagtggcttacatgaacgtgaaactgtgatataaggttttctttcatactcataattagcccaaaacagttgccaaactttgccattgtgctcctgcatttgtgtttgagctgctatatatttgtggaaattacactgaaagttgactaagagactattgaaaaagcatgaataattaaatatacatgtgagagacatctcatctgctgtattttacttagtgaatattgttcactcttccgtgtctgatgtcttgctgaatgctgtgactcatagtttacttttgttcaaaatagtttgcactttttgttaataaaatcaacttgagaaaaagatgcctctgctgt

SEQ ID NO: 418786 - DNA, 1682 bp, Homo sapiens
gctggtgggtttttgtagtgatacttgaatgcgtagtttaattggctttgaaatatgttttatgtttataaggtcttgaatcttgagaatatacaccattgcttcttgttccctttttaagctgtcccccattgtccccaggaggacaaaatgagacaattcctgtcatcttttaattgtgggtgtctattacacattttgtttttttctcctttatttttcctttgtgtttgcttatacctgactcagatcacaaattctctgaagacagagatttgttcacaacccagcacatctttatcacttaaataacacatttggtaagattatttaaagacttgggaaggaaaatactgcccttgttatatgcttttaaattttaaattttttatttattttttaatcatagatacacattccagttttcctgatggtgaacaaataggccctgaagatctcagcttcaatacagatgaaaatagtggaaggtaattgccaaatcaagagaactgacttgcaagctaccttgaccctgaattttgctgtagttggtgctcaaatttgtcatcagtcagataatcagatttggtcttatttcttcattatctcgacctgaaatagtaatttggaaactgttggaaggtggcacagtttagtctaagacagcagtagtacatgggaaaaacagtatgggaagagttctttgtaatgtaaggaaataacaatgtagttctctattaatttagcaaatttgtacattcacaaaaggcagtttgtctactacagcagaaggctggttaactgccagaaaatgtacctccaggccctgcatgccgtcagtaacccgcccggcattggtgctctactgtctttggctagagcttagttgtgtttaaataatcatctttatatttggggttttaattacagttccattagtgcctgtagattagtgaacagaaaattgctttggaagagattctgccctgtagacactatgtgaataactgaagtaacactagactgaatctcctttttggagtatgtatcttctctcacttgttcaagtacaggcacactgttcaaccgcatggtatctttctgttgtgtgacttctacaaatgtaattttaaatgaaattaagttaacatggattcattacgttcctggccctgtagacacgtgtaagattatttaaaattctttcatttttttctgcctcttactatacgactgtagtgcaacaaatattttaaagcccccttttcttctttattttcattagttgtacattgatttcagtgtcaacacatttaaagattcattcatgttgcacagtggcttacatgaacgtgaaactgtgatataaggttttctttcatactcataattagcccaaaacagttgccaaactttgccattgtgctcctgcatttgtgtttgagctgctatatatttgtggaaattacactgaaagttgactaagagactattgaaaaagcatgaataattaaatatacatgtgagagacatctcatctgctgtattttacttagtgaatattgttcactcttccgtgtctgatgtcttgctgaatgctgtgactcatagtttacttttgttcaaaatagtttgcactttttgttaataaaatcaacttgagaaaaagatgcctctgctgt

SEQ ID NO: 418787 - DNA, 4268 bp, Homo sapiens
agaccacctgctgccgaatcacacgatgctgggtgaaaacgcggatggcctgggccccaccctggaatctcagagtccgaatacttaactacgggtgtggctctgaagtctgcgctttccaccagtacgccaggtggctccgtctttggcgcgcaagtttgagagccgtggggccccgccctccgccaaggtgggcgtgggtggcgtagcagagccccaagctcaggccgcctgcgcaggctagggccggaggcacgcaaccctgaggcagcgagtcgccaagtctcgtatgcgccccgcaacgcgggaactaggcgatcgctccacgctcctcccctcctttcccctcccacagcgtcctgcgcgcatgcgcttcgcagcttctctcgccgccgcgcccccagctgctctggttacggttggtgtttgcgaattctctgcggcaccttcttcgctgaactccaccgtcagttccataggcgcgcgcccgcgtcacgtgggccgaggttccggcgcggctgctggccggcggctgagccgggagaaaggagctgcggccaccgttcgccctacttctgcgcctcggggcgggcgcgccggtaaaaatggcgaaatgggggtaggcggcgctggacctgaagagatggggcgcgcaggtggggcggttgtcagagccccctgacgtgggcgccgggcttttatcggcgatttgatctggcgacctcgggccggcgcctaagaggtcagactgcggagcctgcgggtcgccagcggccccgccgagagccggaggcaatggatgaacagagcgtggagagcattgctgaggttttccgatgtttcatttgtatggagaaattgcgggatgcacgcctgtgtcctcattgctccaaactgtgttgtttcagctgtattaggcgctggctgacagagcagagagctcaatgtcctcattgccgtgctccactccagctacgagaactagtaaattgtcgttgggcagaagaagtaacacaacagcttgatactcttcaactctgcagtctcaccaaacatgaagaaaatgaaaaggacaaatgtgaaaatcaccatgaaaaacttagtgtattttgctggacttgtaagaagtgtatctgccatcagtgtgcactttggggaggaatgcatggcggacatacctttaaacctttggcagaaatttatgagcaacacgtcactaaagtgaatgaagaggtagccaaacttcgtcggcgtctcatggaactgatcagcttagttcaagaagtggaaaggaatgtagaagctgtaagaaatgcaaaagatgagcgtgttcgggaaattaggaatgcagtggagatgatgattgcacggttagacacacagctgaagaataagcttataacactgatgggtcagaagacatctctaacccaagaaacagagcttttggaatccttacttcaggaggtggagcaccagttgcggtcttgtagtaagagtgagttgatatctaagagctcagagatccttatgatgtttcagcaagttcatcggaagcccatggcatcttttgttaccactcctgttccaccagactttaccagtgaattagtgccatcttacgattcagctacttttgttttagagaatttcagcactttgcgtcagagagcagatcctgtttacagtccacctcttcaagtttcaggactttgctggaggttaaaagtttacccagatggaaatggagttgtgcgaggttactacttatctgtgtttctggagctctcagctggcttgcctgaaacttctaaatatgaatatcgtgtagagatggttcaccagtcctgtaatgatcctacaaaaaatatcattcgagaatttgcatctgactttgaagttggagaatgctggggctataatagatttttccgtttggacttactcgcaaatgaaggatacttgaatccacaaaatgatacagtgattttaaggtttcaggtacgttcaccaactttctttcaaaaatcccgggaccagcattggtacattactcagttggaagctgcacagactagttatatccaacaaataaacaaccttaaagagagacttactattgagctgtctcgaactcagaagtcaagagatttgtcaccaccagataaccatcttagcccccaaaatgatgatgctctggagacacgagctaagaagtctgcatgctctgacatgcttctcgaaggtggtcctactacagcttctgtaagagaggccaaagaggatgaagaagatgaggagaagattcagaatgaagattatcatcacgagctttcagatggagatctggatctggatcttgtttatgaggatgaagtaaatcagctcgatggcagcagttcctctgctagttccacagcaacaagtaatacagaagaaaatgatattgatgaagaaactatgtctggagaaaatgatgtggaatataacaacatggaattagaagagggagaactcatggaagatgcagctgctgcaggacccgcaggtagtagccatggttatgtgggttccagtagtagaatatcaagaagaacacatttatgctccgctgctaccagtagtttactagacattgatccattaattttaatacatttgttggaccttaaggaccggagcagtatagaaaatttgtggggcttacagcctcgcccacctgcttcacttctgcagcccacagcatcatattctcgaaaagataaagaccaaaggaagcaacaggcaatgtggcgagtgccctctgatttaaagatgctaaaaagactcaaaactcaaatggccgaagttcgatgtatgaaaactgatgtaaagaatacactttcagaaataaaaagcagcagtgctgcttctggagacatgcagacaagccttttttctgctgaccaggcagctctggctgcatgtggaactgaaaactctggcagattgcaggatttgggaatggaactcctggcaaagtcatcagttgccaattgttacatacgaaactccacaaataagaagagtaattcgcccaagccagctcgatccagtgtagcaggtagtctatcacttcgaagagcagtggaccctggagaaaatagtcgttcaaagggagactgtcagactctgtctgaaggctccccaggaagctctcagtctgggagcaggcacagttctccccgagccttgatacatggcagtatcggtgatattctgccaaaaactgaagaccggcagtgtaaagctttggattcagatgctgttgtggttgcagttttcagtggcttgcctgcggttgagaaaaggaggaaaatggtcaccttgggggctaatgctaaaggaggtcatctggaaggactgcagatgactgatttggaaaataattctgaaactggagagttacagcctgtactacctgaaggagcttcagctgcccctgaagaagaaacatgttctccttccttcctgccaggaatgagtagcgacagtgacattgaatgtgacactgagaatgaggagcaggaagagcataccagtgtgggcgggtttcacgactccttcatggtcatgacacagcccccggatgaagatacacattccagttttcctgatggtgaacaaataggccctgaagatctcagcttcaatacagatgaaaatagtggaagataatttgatttgaaactgacactgcacctgatgggttaacaagatctaggcttcagaaggtgacagatatgagtgaggaccatgtgtggggcaaagcctcagaatgatgaaaaggttccggcactatagttggggccatgttgactccttttcaaccatttgtcacagacgtgagaagaagaaatgacttcaaaatcaagagaaaacaaatactgaaagtctctacttacatccaaattttaaaaaataaaatctgtagattaacaatctgatcattgctaaagtgaagctgtttttgtctatttgatatagctatactggtatccaaaatatgccagtcatctgtgtctttaaaattcagagattttagtcctctgttatgggcctggggaacgtgtactatcctataaacacatgattaggcgggggacacttcttagcgagagcactcacccttgttagtgagcactccagaggggccacccataggcattggccaggctggtctgctgttgactaggggagggtaacactaagacattcgtgactcttag

SEQ ID NO: 418788 - DNA, 2298 bp, Homo sapiens
tttaagctatttgcagatcagaatagaagagtgggcatttgtcctttcacatcacgtgattttcaaaggtgaaaaaaatttcttttgctaacttacgattcaaagaaaaatggtctcaaattaaagtgtggacaaaactgtagtattcccttttatagccttgcttaggtaagaatgttcactgagtgaataaattaggtttaaaaattaaaacaataatttagatcattttcccacaaagccttatcaaggatttgatggggaaggaagcacttgaaccacagcagttttatctgtaaacactgaacttggccatgcatcattttcatctgcccactggatgttgcacttctcactggcacagtgtttcaacagtggagtgtggttgtcatgaaaatgcagtattgacactataccactataaatgtggtcaaaattagactcagtgttgacattgacattgttgccattgtccttggaaaaggtgttactttcaaggagcctcctaaatgcaacagtaactttaatcataataattcaaggacaatggatggcacttctaggtaaagaaaaggtatatacatatgtgtttctacccatcctctttagtacagacctaaatgggattaatagccccagtgtgtgttgctgtaatgttgcctaacctcatgtccctcaaaagtacacatctagaaagtgaacaaaggaaacctgtaaattagggactgactccctttgaaactcacagtgaatgtacaaggagtttgtaatgacttcagttggtgacttgaagtttgtttccctaaccaatattacactcttgtttggatttattttactatttcctattctaacttgtttagcaggcaaacagattgatgcagaccatgttaaattgaaaaagggatactgccactctttaaggattgagtgtagaactttcaccaccactaaattacacaatgaataaaaatacaaaacacataattcacagactatacctcagcattaacagtttatagatattatatagatacttttatatctgtctaatatttttacaatcaccaggtacaccatcattaaatacaagttacagaaatatgtagataccattagttagagggttacttattgcttacgtcagcaagcagcaaataagggcacaggatttgaactgaagggaactacttcctatcaccagtggcgttaagagagaacactgcatttcacaaagcactgcttttatctagtttatagaaccaagagcagcatatatcagaccaataaccactattttagtatgtattatagaattttaaaggatttaccttacaaatggtacctaactactctataaatacgcatgttgtgaacaaatgaatagttgctatttttcacaatattggtttataacgaccacactagaactactttgctttattttgtagagagctaatggcatgagaaatgagttaacactgctgtgtagtcggacctacaaaatccagacccctaaagatgggtctgtgtttgtcccagttctatccagccatttttttccccactgagaaagcctagcatgtgtagtaactttttccctttaccctctttattctgatcaaaaacattaccaatagacaacaatagaaattttaaaaagcttttttttttacttcgctaagcactttggactataatgtgtaccaatagtctgctgcctttgttttcttgttttcttagataatttgatttgaaactgacactgcacctgatgggttaacaagatctaggcttcagaaggtgacagatatgagtgaggaccatgtgtggggcaaagcctcagaatgatgaaaaggttccggcactatagttggggccatgttgactccttttcaaccatttgtcacagacgtgagaagaagaaatgacttcaaaatcaagagaaaacaaatactgaaagtctctacttacatccaaattttaaaaaataaaatctgtagattaacaatctgatcattgctaaagtgaagctgtttttgtctatttgatatagctatactggtatccaaaatatgccagtcatctgtgtctttaaaattcagagattttagtcctctgttatgggcctggggaacgtgtactatcctataaacacatgattaggcgggggacacttcttagcgagagcactcacccttgttagtgagcactccagaggggccacccataggcattggccaggctggtctgctgttgactaggggagggtaacactaagacattcgtgactcttag

SEQ ID NO: 418789 - DNA, 1858 bp, Homo sapiens
agaccacctgctgccgaatcacacgatgctgggtgaaaacgcggatggcctgggccccaccctggaatctcagagtccgaatacttaactacgggtgtggctctgaagtctgcgctttccaccagtacgccaggtggctccgtctttggcgcgcaagtttgagagccgtggggccccgccctccgccaaggtgggcgtgggtggcgtagcagagccccaagctcaggccgcctgcgcaggctagggccggaggcacgcaaccctgaggcagcgagtcgccaagtctcgtatgcgccccgcaacgcgggaactaggcgatcgctccacgctcctcccctcctttcccctcccacagcgtcctgcgcgcatgcgcttcgcagcttctctcgccgccgcgcccccagctgctctggttacggttggtgtttgcgaattctctgcggcaccttcttcgctgaactccaccgtcagttccataggcgcgcgcccgcgtcacgtgggccgaggttccggcgcggctgctggccggcggctgagccgggagaaaggagctgcggccaccgttcgccctacttctgcgcctcggggcgggcgcgccggtaaaaatggcgaaatgggggtaggcggcgctggacctgaagagatggggcgcgcaggtggggcggttgtcagagccccctgacgtgggcgccgggcttttatcggcgatttgatctggcgacctcgggccggcgcctaagaggtcagactgcggagcctgcgggtcgccagcggccccgccgagagccggaggcaatggatgaacagagcgtggagagcattgctgaggttttccgatgtttcatttgtatggagaaattgcgggatgcacgcctgtgtcctcattgctccaaactgtgttgtttcagctgtattaggcgctggctgacagagcagagagctcaatgtcctcattgccgtgctccactccagctacgagaactagtaaattgtcgttgggcagaagaagtaacacaacagcttgatactcttcaactctgcagtctcaccaaacatgaagaaaatgaaaaggacaaatgtgaaaatcaccatgaaaaacttagtgtattttgctggacttgtaagaagtgtatctgccatcagtgtgcactttggggaggaatgcatggcggacatacctttaaacctttggcagaaatttatgagcaacacgtcactaaagtgaatgaagaggtagccaaacttcgtcggcgtctcatggaactgatcagcttagttcaagaagtggaaaggaatgtagaagctgtaagaaatgcaaaagatgagcgtgttcgggaaattaggaatgcagtggagatgatgattgcacggttagacacacagctgaagaataagcttataacactgatgggtcagaagacatctctaacccaagaaacagagcttttggaatccttacttcaggaggtggagcaccagttgcggtcttgtagtaagagtgagttgatatctaagagctcagagatccttatgatgtttcagcaagttcatcggaagcccatggcatcttttgttaccactcctgttccaccagactttaccagtgaattagtgccatcttacgattcagctacttttgttttagagaatttcaggtaagagtttttgacaattctggtttttttgtatgtgtatataaggaagagccagaaaggtattctttggtaagacagtaatctagtgaactgtgtcactcactttagaagtcttagaagaataagtttcctattagaaatgtagagataatttgtgctggattatattgtatctttagactgactgcttctctagtctggga

SEQ ID NO: 418790 - DNA, 1382 bp, Homo sapiens
  misc_feature (1105)..(1105): n is a, c, g, or t
  misc_feature (1116)..(1116): n is a, c, g, or t
  misc_feature (1127)..(1127): n is a, c, g, or t
  misc_feature (1262)..(1262): n is a, c, g, or t
  misc_feature (1283)..(1283): n is a, c, g, or t
  misc_feature (1310)..(1310): n is a, c, g, or t
  misc_feature (1317)..(1317): n is a, c, g, or t
  misc_feature (1325)..(1325): n is a, c, g, or t
  misc_feature (1346)..(1346): n is a, c, g, or t
  misc_feature (1355)..(1355): n is a, c, g, or t
  misc_feature (1369)..(1369): n is a, c, g, or t
agaccacctgctgccgaatcacacgatgctgggtgaaaacgcggatggcctgggccccaccctggaatctcagagtccgaatacttaactacgggtgtggctctgaagtctgcgctttccaccagtacgccaggtggctccgtctttggcgcgcaagtttgagagccgtggggccccgccctccgccaaggtgggcgtgggtggcgtagcagagccccaagctcaggccgcctgcgcaggctagggccggaggcacgcaaccctgaggcagcgagtcgccaagtctcgtatgcgccccgcaacgcgggaactaggcgatcgctccacgctcctcccctcctttcccctcccacagcgtcctgcgcgcatgcgcttcgcagcttctctcgccgccgcgcccccagctgctctggttacggttggtgtttgcgaattctctgcggcaccttcttcgctgaactccaccgtcagttccataggcgcgcgcccgcgtcacgtgggccgaggttccggcgcggctgctggccggcggctgagccgggagaaaggagctgcggccaccgttcgccctacttctgcgcctcggggcgggcgcgccggtaaaaatggcgaaatgggggtaggcggcgctggacctgaagagatggggcgcgcaggtggggcggttgtcagagccccctgacgtgggcgccgggcttttatcggcgatttgatctggcgacctcgggccggcgcctaagaggtcagactgcggagcctgcgggtcgccagcggccccgccgagagccggaggcaatggatgaacagagcgtggagagcattgctgaggttttccgatgtttcatttgtatggagaaattgcgggatgcacgcctgtgtcctcattgctccaaactgtgttgtttcagctgtattaggcgctggctgacagagcagagagctcaatgtcctcattgccgtgctccactccagctacgagaactagtaaattgtcgttgggcagaagaagtaacacaacagcttgatactcttcaactctgcagtctcaccaaacatgaagaaaatgaaaaggacaagtatgtcctcaatttctttgttcaatatngaatggatttngcctttgtatngtttaatgacactatatgggtagttgcctttagttatttatgaataagtagtgttatatttcttgtttttaattctttcagtcatgcgctgttactgttaagtaacatattcttattggtcatttaacaacagtnatttcatgccatgtatacacnagatacctctcggcctcccctcccccncacaganagtacttngctagatgataggcatacaanggtacatgngacatgattctgtnactgttaatgggg

SEQ ID NO: 418791 - DNA, 4778 bp, Homo sapiens
agaccacctgctgccgaatcacacgatgctgggtgaaaacgcggatggcctgggccccaccctggaatctcagagtccgaatacttaactacgggtgtggctctgaagtctgcgctttccaccagtacgccaggtggctccgtctttggcgcgcaagtttgagagccgtggggccccgccctccgccaaggtgggcgtgggtggcgtagcagagccccaagctcaggccgcctgcgcaggctagggccggaggcacgcaaccctgaggcagcgagtcgccaagtctcgtatgcgccccgcaacgcgggaactaggcgatcgctccacgctcctcccctcctttcccctcccacagcgtcctgcgcgcatgcgcttcgcagcttctctcgccgccgcgcccccagctgctctggttacggttggtgtttgcgaattctctgcggcaccttcttcgctgaactccaccgtcagttccataggcgcgcgcccgcgtcacgtgggccgaggttccggcgcggctgctggccggcggctgagccgggagaaaggagctgcggccaccgttcgccctacttctgcgcctcggggcgggcgcgccggtaaaaatggcgaaatgggggtaggcggcgctggacctgaagagatggggcgcgcaggtggggcggttgtcagagccccctgacgtgggcgccgggcttttatcggcgatttgatctggcgacctcgggccggcgcctaagaggtcagactgcggagcctgcgggtcgccagcggccccgccgagagccggaggcaatggatgaacagagcgtggagcgctggctgacagagcagagagctcaatgtcctcattgccgtgctccactccagctacgagaactagtaaattgtcgttgggcagaagaagtaacacaacagcttgatactcttcaactctgcagtctcaccaaacatgaagaaaatgaaaaggacaaatgtgaaaatcaccatgaaaaacttagtgtattttgctggacttgtaagaagtgtatctgccatcagtgtgcactttggggaggaatgcatggcggacatacctttaaacctttggcagaaatttatgagcaacacgtcactaaagtgaatgaagaggtagccaaacttcgtcggcgtctcatggaactgatcagcttagttcaagaagtggaaaggaatgtagaagctgtaagaaatgcaaaagatgagcgtgttcgggaaattaggaatgcagtggagatgatgattgcacggttagacacacagctgaagaataagcttataacactgatgggtcagaagacatctctaacccaagaaacagagcttttggaatccttacttcaggaggtggagcaccagttgcggtcttgtagtaagagtgagttgatatctaagagctcagagatccttatgatgtttcagcaagttcatcggaagcccatggcatcttttgttaccactcctgttccaccagactttaccagtgaattagtgccatcttacgattcagctacttttgttttagagaatttcagcactttgcgtcagagagcagatcctgtttacagtccacctcttcaagtttcaggactttgctggaggttaaaagtttacccagatggaaatggagttgtgcgaggttactacttatctgtgtttctggagctctcagctggcttgcctgaaacttctaaatatgaatatcgtgtagagatggttcaccagtcctgtaatgatcctacaaaaaatatcattcgagaatttgcatctgactttgaagttggagaatgctggggctataatagatttttccgtttggacttactcgcaaatgaaggatacttgaatccacaaaatgatacagtgattttaaggtttcaggtacgttcaccaactttctttcaaaaatcccgggaccagcattggtacattactcagttggaagctgcacagactagttatatccaacaaataaacaaccttaaagagagacttactattgagctgtctcgaactcagaagtcaagagatttgtcaccaccagataaccatcttagcccccaaaatgatgatgctctggagacacgagctaagaagtctgcatgctctgacatgcttctcgaaggtggtcctactacagcttctgtaagagaggccaaagaggatgaagaagatgaggagaagattcagaatgaagattatcatcacgagctttcagatggagatctggatctggatcttgtttatgaggatgaagtaaatcagctcgatggcagcagttcctctgctagttccacagcaacaagtaatacagaagaaaatgatattgatgaagaaactatgtctggagaaaatgatgtggaatataacaacatggaattagaagagggagaactcatggaagatgcagctgctgcaggacccgcaggtagtagccatggttatgtgggttccagtagtagaatatcaagaagaacacatttatgctccgctgctaccagtagtttactagacattgatccattaattttaatacatttgttggaccttaaggaccggagcagtatagaaaatttgtggggcttacagcctcgcccacctgcttcacttctgcagcccacagcatcatattctcgaaaagataaagaccaaaggaagcaacaggcaatgtggcgagtgccctctgatttaaagatgctaaaaagactcaaaactcaaatggccgaagttcgatgtatgaaaactgatgtaaagaatacactttcagaaataaaaagcagcagtgctgcttctggagacatgcagacaagccttttttctgctgaccaggcagctctggctgcatgtggaactgaaaactctggcagattgcaggatttgggaatggaactcctggcaaagtcatcagttgccaattgttacatacgaaactccacaaataagaagagtaattcgcccaagccagctcgatccagtgtagcaggtagtctatcacttcgaagagcagtggaccctggagaaaatagtcgttcaaagggagactgtcagactctgtctgaaggctccccaggaagctctcagtctgggagcaggcacagttctccccgagccttgatacatggcagtatcggtgatattctgccaaaaactgaagaccggcagtgtaaagctttggattcagatgctgttgtggttgcagttttcagtggcttgcctgcggttgagaaaaggaggaaaatggtcaccttgggggctaatgctaaaggaggtcatctggaaggactgcagatgactgatttggaaaataattctgaaactggagagttacagcctgtactacctgaaggagcttcagctgcccctgaagaaggaatgagtagcgacagtgacattgaatgtgacactgagaatgaggagcaggaagagcataccagtgtgggcgggtttcacgactccttcatggtcatgacacagcccccggatgaagatacacattccagttttcctgatggtgaacaaataggccctgaagatctcagcttcaatacagatgaaaatagtggaaggtaattgccaaatcaagagaactgacttgcaagctaccttgaccctgaattttgctgtagttggtgctcaaatttgtcatcagtcagataatcagatttggtcttatttcttcattatctcgacctgaaatagtaatttggaaactgttggaaggtggcacagtttagtctaagacagcagtagtacatgggaaaaacagtatgggaagagttctttgtaatgtaaggaaataacaatgtagttctctattaatttagcaaatttgtacattcacaaaaggcagtttgtctactacagcagaaggctggttaactgccagaaaatgtacctccaggccctgcatgccgtcagtaacccgcccggcattggtgctctactgtctttggctagagcttagttgtgtttaaataatcatctttatatttggggttttaattacagttccattagtgcctgtagattagtgaacagaaaattgctttggaagagattctgccctgtagacactatgtgaataactgaagtaacactagactgaatctcctttttggagtatgtatcttctctcacttgttcaagtacaggcacactgttcaaccgcatggtatctttctgttgtgtgacttctacaaatgtaattttaaatgaaattaagttaacatggattcattacgttcctggccctgtagacacgtgtaagattatttaaaattctttcatttttttctgcctcttactatacgactgtagtgcaacaaatattttaaagcccccttttcttctttattttcattagttgtacattgatttcagtgtcaacacatttaaagattcattcatgttgcacagtggcttacatgaacgtgaaactgtgatataaggttttctttcatactcataattagcccaaaacagttgccaaactttgccattgtgctcctgcatttgtgtttgagctgctatatatttgtggaaattacactgaaagttgactaagagactattgaaaaagcatgaataattaaatatacatgtgagagacatctcatctgctgtattttacttagtgaatattgttcactcttccgtgtctgatgtcttgctgaatgctgtgactcatagtttacttttgttcaaaatagtttgcactttttgttaataaaatcaacttgagaaaaagatgcctctgctgt

SEQ ID NO: 418792 - DNA, 4907 bp, Homo sapiens
agaccacctgctgccgaatcacacgatgctgggtgaaaacgcggatggcctgggccccaccctggaatctcagagtccgaatacttaactacgggtgtggctctgaagtctgcgctttccaccagtacgccaggtggctccgtctttggcgcgcaagtttgagagccgtggggccccgccctccgccaaggtgggcgtgggtggcgtagcagagccccaagctcaggccgcctgcgcaggctagggccggaggcacgcaaccctgaggcagcgagtcgccaagtctcgtatgcgccccgcaacgcgggaactaggcgatcgctccacgctcctcccctcctttcccctcccacagcgtcctgcgcgcatgcgcttcgcagcttctctcgccgccgcgcccccagctgctctggttacggttggtgtttgcgaattctctgcggcaccttcttcgctgaactccaccgtcagttccataggcgcgcgcccgcgtcacgtgggccgaggttccggcgcggctgctggccggcggctgagccgggagaaaggagctgcggccaccgttcgccctacttctgcgcctcggggcgggcgcgccggtaaaaatggcgaaatgggggtaggcggcgctggacctgaagagatggggcgcgcaggtggggcggttgtcagagccccctgacgtgggcgccgggcttttatcggcgatttgatctggcgacctcgggccggcgcctaagaggtcagactgcggagcctgcgggtcgccagcggccccgccgagagccggaggcaatggatgaacagagcgtggagagcattgctgaggttttccgatgtttcatttgtatggagaaattgcgggatgcacgcctgtgtcctcattgctccaaactgtgttgtttcagctgtattaggcgctggctgacagagcagagagctcaatgtcctcattgccgtgctccactccagctacgagaactagtaaattgtcgttgggcagaagaagtaacacaacagcttgatactcttcaactctgcagtctcaccaaacatgaagaaaatgaaaaggacaaatgtgaaaatcaccatgaaaaacttagtgtattttgctggacttgtaagaagtgtatctgccatcagtgtgcactttggggaggaatgcatggcggacatacctttaaacctttggcagaaatttatgagcaacacgtcactaaagtgaatgaagaggtagccaaacttcgtcggcgtctcatggaactgatcagcttagttcaagaagtggaaaggaatgtagaagctgtaagaaatgcaaaagatgagcgtgttcgggaaattaggaatgcagtggagatgatgattgcacggttagacacacagctgaagaataagcttataacactgatgggtcagaagacatctctaacccaagaaacagagcttttggaatccttacttcaggaggtggagcaccagttgcggtcttgtagtaagagtgagttgatatctaagagctcagagatccttatgatgtttcagcaagttcatcggaagcccatggcatcttttgttaccactcctgttccaccagactttaccagtgaattagtgccatcttacgattcagctacttttgttttagagaatttcagcactttgcgtcagagagcagatcctgtttacagtccacctcttcaagtttcaggactttgctggaggttaaaagtttacccagatggaaatggagttgtgcgaggttactacttatctgtgtttctggagctctcagctggcttgcctgaaacttctaaatatgaatatcgtgtagagatggttcaccagtcctgtaatgatcctacaaaaaatatcattcgagaatttgcatctgactttgaagttggagaatgctggggctataatagatttttccgtttggacttactcgcaaatgaaggatacttgaatccacaaaatgatacagtgattttaaggtttcaggtacgttcaccaactttctttcaaaaatcccgggaccagcattggtacattactcagttggaagctgcacagactagttatatccaacaaataaacaaccttaaagagagacttactattgagctgtctcgaactcagaagtcaagagatttgtcaccaccagataaccatcttagcccccaaaatgatgatgctctggagacacgagctaagaagtctgcatgctctgacatgcttctcgaaggtggtcctactacagcttctgtaagagaggccaaagaggatgaagaagatgaggagaagattcagaatgaagattatcatcacgagctttcagatggagatctggatctggatcttgtttatgaggatgaagtaaatcagctcgatggcagcagttcctctgctagttccacagcaacaagtaatacagaagaaaatgatattgatgaagaaactatgtctggagaaaatgatgtggaatataacaacatggaattagaagagggagaactcatggaagatgcagctgctgcaggacccgcaggtagtagccatggttatgtgggttccagtagtagaatatcaagaagaacacatttatgctccgctgctaccagtagtttactagacattgatccattaattttaatacatttgttggaccttaaggaccggagcagtatagaaaatttgtggggcttacagcctcgcccacctgcttcacttctgcagcccacagcatcatattctcgaaaagataaagaccaaaggaagcaacaggcaatgtggcgagtgccctctgatttaaagatgctaaaaagactcaaaactcaaatggccgaagttcgatgtatgaaaactgatgtaaagaatacactttcagaaataaaaagcagcagtgctgcttctggagacatgcagacaagccttttttctgctgaccaggcagctctggctgcatgtggaactgaaaactctggcagattgcaggatttgggaatggaactcctggcaaagtcatcagttgccaattgttacatacgaaactccacaaataagaagagtaattcgcccaagccagctcgatccagtgtagcaggtagtctatcacttcgaagagcagtggaccctggagaaaatagtcgttcaaagggagactgtcagactctgtctgaaggctccccaggaagctctcagtctgggagcaggcacagttctccccgagccttgatacatggcagtatcggtgatattctgccaaaaactgaagaccggcagtgtaaagctttggattcagatgctgttgtggttgcagttttcagtggcttgcctgcggttgagaaaaggaggaaaatggtcaccttgggggctaatgctaaaggaggtcatctggaaggactgcagatgactgatttggaaaataattctgaaactggagagttacagcctgtactacctgaaggagcttcagctgcccctgaagaagaaacatgttctccttccttcctgccaggaatgagtagcgacagtgacattgaatgtgacactgagaatgaggagcaggaagagcataccagtgtgggcgggtttcacgactccttcatggtcatgacacagcccccggatgaagatacacattccagttttcctgatggtgaacaaataggccctgaagatctcagcttcaatacagatgaaaatagtggaaggtaattgccaaatcaagagaactgacttgcaagctaccttgaccctgaattttgctgtagttggtgctcaaatttgtcatcagtcagataatcagatttggtcttatttcttcattatctcgacctgaaatagtaatttggaaactgttggaaggtggcacagtttagtctaagacagcagtagtacatgggaaaaacagtatgggaagagttctttgtaatgtaaggaaataacaatgtagttctctattaatttagcaaatttgtacattcacaaaaggcagtttgtctactacagcagaaggctggttaactgccagaaaatgtacctccaggccctgcatgccgtcagtaacccgcccggcattggtgctctactgtctttggctagagcttagttgtgtttaaataatcatctttatatttggggttttaattacagttccattagtgcctgtagattagtgaacagaaaattgctttggaagagattctgccctgtagacactatgtgaataactgaagtaacactagactgaatctcctttttggagtatgtatcttctctcacttgttcaagtacaggcacactgttcaaccgcatggtatctttctgttgtgtgacttctacaaatgtaattttaaatgaaattaagttaacatggattcattacgttcctggccctgtagacacgtgtaagattatttaaaattctttcatttttttctgcctcttactatacgactgtagtgcaacaaatattttaaagcccccttttcttctttattttcattagttgtacattgatttcagtgtcaacacatttaaagattcattcatgttgcacagtggcttacatgaacgtgaaactgtgatataaggttttctttcatactcataattagcccaaaacagttgccaaactttgccattgtgctcctgcatttgtgtttgagctgctatatatttgtggaaattacactgaaagttgactaagagactattgaaaaagcatgaataattaaatatacatgtgagagacatctcatctgctgtattttacttagtgaatattgttcactcttccgtgtctgatgtcttgctgaatgctgtgactcatagtttacttttgttcaaaatagtttgcactttttgttaataaaatcaacttgagaaaaagatgcctctgctgt

SEQ ID NO: 418793 - DNA, 4241 bp, Homo sapiens
agaccacctgctgccgaatcacacgatgctgggtgaaaacgcggatggcctgggccccaccctggaatctcagagtccgaatacttaactacgggtgtggctctgaagtctgcgctttccaccagtacgccaggtggctccgtctttggcgcgcaagtttgagagccgtggggccccgccctccgccaaggtgggcgtgggtggcgtagcagagccccaagctcaggccgcctgcgcaggctagggccggaggcacgcaaccctgaggcagcgagtcgccaagtctcgtatgcgccccgcaacgcgggaactaggcgatcgctccacgctcctcccctcctttcccctcccacagcgtcctgcgcgcatgcgcttcgcagcttctctcgccgccgcgcccccagctgctctggttacggttggtgtttgcgaattctctgcggcaccttcttcgctgaactccaccgtcagttccataggcgcgcgcccgcgtcacgtgggccgaggttccggcgcggctgctggccggcggctgagccgggagaaaggagctgcggccaccgttcgccctacttctgcgcctcggggcgggcgcgccggtaaaaatggcgaaatgggggtaggcggcgctggacctgaagagatggggcgcgcaggtggggcggttgtcagagccccctgacgtgggcgccgggcttttatcggcgatttgatctggcgacctcgggccggcgcctaagaggtcagactgcggagcctgcgggtcgccagcggccccgccgagagccggaggcaatggatgaacagagcgtggagagcattgctgaggttttccgatgtttcatttgtatggagaaattgcgggatgcacgcctgtgtcctcattgctccaaactgtgttgtttcagctgtattaggcgctggctgacagagcagagagctcaatgtcctcattgccgtgctccactccagctacgagaactagtaaattgtcgttgggcagaagaagtaacacaacagcttgatactcttcaactctgcagtctcaccaaacatgaagaaaatgaaaaggacaaatgtgaaaatcaccatgaaaaacttagtgtattttgctggacttgtaagaagtgtatctgccatcagtgtgcactttggggaggaatgcatggcggacatacctttaaacctttggcagaaatttatgagcaacacgtcactaaagtgaatgaagaggtagccaaacttcgtcggcgtctcatggaactgatcagcttagttcaagaagtggaaaggaatgtagaagctgtaagaaatgcaaaagatgagcgtgttcgggaaattaggaatgcagtggagatgatgattgcacggttagacacacagctgaagaataagcttataacactgatgggtcagaagacatctctaacccaagaaacagagcttttggaatccttacttcaggaggtggagcaccagttgcggtcttgtagtaagagtgagttgatatctaagagctcagagatccttatgatgtttcagcaagttcatcggaagcccatggcatcttttgttaccactcctgttccaccagactttaccagtgaattagtgccatcttacgattcagctacttttgttttagagaatttcagcactttgcgtcagagagcagatcctgtttacagtccacctcttcaagtttcaggactttgctggaggttaaaagtttacccagatggaaatggagttgtgcgaggttactacttatctgtgtttctggagctctcagctggcttgcctgaaacttctaaatatgaatatcgtgtagagatggttcaccagtcctgtaatgatcctacaaaaaatatcattcgagaatttgcatctgactttgaagttggagaatgctggggctataatagatttttccgtttggacttactcgcaaatgaaggatacttgaatccacaaaatgatacagtgattttaaggtttcaggtacgttcaccaactttctttcaaaaatcccgggaccagcattggtacattactcagttggaagctgcacagactagttatatccaacaaataaacaaccttaaagagagacttactattgagctgtctcgaactcagaagtcaagagatttgtcaccaccagataaccatcttagcccccaaaatgatgatgctctggagacacgagctaagaagtctgcatgctctgacatgcttctcgaaggtggtcctactacagcttctgtaagagaggccaaagaggatgaagaagatgaggagaagattcagaatgaagattatcatcacgagctttcagatggagatctggatctggatcttgtttatgaggatgaagtaaatcagctcgatggcagcagttcctctgctagttccacagcaacaagtaatacagaagaaaatgatattgatgaagaaactatgtctggagaaaatgatgtggaatataacaacatggaattagaagagggagaactcatggaagatgcagctgctgcaggacccgcaggtagtagccatggttatgtgggttccagtagtagaatatcaagaagaacacatttatgctccgctgctaccagtagtttactagacattgatccattaattttaatacatttgttggaccttaaggaccggagcagtatagaaaatttgtggggcttacagcctcgcccacctgcttcacttctgcagcccacagcatcatattctcgaaaagataaagaccaaaggaagcaacaggcaatgtggcgagtgccctctgatttaaagatgctaaaaagactcaaaactcaaatggccgaagttcgatgtatgaaaactgatgtaaagaatacactttcagaaataaaaagcagcagtgctgcttctggagacatgcagacaagccttttttctgctgaccaggcagctctggctgcatgtggaactgaaaactctggcagattgcaggatttgggaatggaactcctggcaaagtcatcagttgccaattgttacatacgaaactccacaaataagaagagtaattcgcccaagccagctcgatccagtgtagcaggtagtctatcacttcgaagagcagtggaccctggagaaaatagtcgttcaaagggagactgtcagactctgtctgaaggctccccaggaagctctcagtctgggagcaggcacagttctccccgagccttgatacatggcagtatcggtgatattctgccaaaaactgaagaccggcagtgtaaagctttggattcagatgctgttgtggttgcagttttcagtggcttgcctgcggttgagaaaaggaggaaaatggtcaccttgggggctaatgctaaaggaggtcatctggaaggactgcagatgactgatttggaaaataattctgaaactggagagttacagcctgtactacctgaaggagcttcagctgcccctgaagaaggaatgagtagcgacagtgacattgaatgtgacactgagaatgaggagcaggaagagcataccagtgtgggcgggtttcacgactccttcatggtcatgacacagcccccggatgaagatacacattccagttttcctgatggtgaacaaataggccctgaagatctcagcttcaatacagatgaaaatagtggaagataatttgatttgaaactgacactgcacctgatgggttaacaagatctaggcttcagaaggtgacagatatgagtgaggaccatgtgtggggcaaagcctcagaatgatgaaaaggttccggcactatagttggggccatgttgactccttttcaaccatttgtcacagacgtgagaagaagaaatgacttcaaaatcaagagaaaacaaatactgaaagtctctacttacatccaaattttaaaaaataaaatctgtagattaacaatctgatcattgctaaagtgaagctgtttttgtctatttgatatagctatactggtatccaaaatatgccagtcatctgtgtctttaaaattcagagattttagtcctctgttatgggcctggggaacgtgtactatcctataaacacatgattaggcgggggacacttcttagcgagagcactcacccttgttagtgagcactccagaggggccacccataggcattggccaggctggtctgctgttgactaggggagggtaacactaagacattcgtgactcttag

SEQ ID NO: 418794 - DNA, 1816 bp, Homo sapiens
agaccacctgctgccgaatcacacgatgctgggtgaaaacgcggatggcctgggccccaccctggaatctcagagtccgaatacttaactacgggtgtggctctgaagtctgcgctttccaccagtacgccaggtggctccgtctttggcgcgcaagtttgagagccgtggggccccgccctccgccaaggtgggcgtgggtggcgtagcagagccccaagctcaggccgcctgcgcaggctagggccggaggcacgcaaccctgaggcagcgagtcgccaagtctcgtatgcgccccgcaacgcgggaactaggcgatcgctccacgctcctcccctcctttcccctcccacagcgtcctgcgcgcatgcgcttcgcagcttctctcgccgccgcgcccccagctgctctggttacggttggtgtttgcgaattctctgcggcaccttcttcgctgaactccaccgtcagttccataggcgcgcgcccgcgtcacgtgggccgaggttccggcgcggctgctggccggcggctgagccgggagaaaggagctgcggccaccgttcgccctacttctgcgcctcggggcgggcgcgccggtaaaaatggcgaaatgggggtaggcggcgctggacctgaagagatggggcgcgcaggtggggcggttgtcagagccccctgacgtgggcgccgggcttttatcggcgatttgatctggcgacctcgggccggcgcctaagaggtcagactgcggagcctgcgggtcgccagcggccccgccgagagccggaggcaatggatgaacagagcgtggagagcattgctgaggttttccgatgtttcatttgtatggagaaattgcgggatgcacgcctgtgtcctcattgctccaaactgtgttgtttcagctgtattaggcgctggctgacagagcagagagctcaatgtcctcattgccgtgctccactccagctacgagaactagtaaattgtcgttgggcagaagaagtaacacaacagcttgatactcttcaactctgcagtctcaccaaacatgaagaaaatgaaaaggacaaatgtgaaaatcaccatgaaaaacttagtgtattttgctggacttgtaagaagtgtatctgccatcagtgtgcactttggggaggaatgcatggcggacatacctttaaacctttggcagaaatttatgagcaacacgtcactaaagtgaatgaagaggtagccaaacttcgtcggcgtctcatggaactgatcagcttagttcaagaagtggaaaggaatgtagaagctgtaagaaatgcaaaagatgagcgtgttcgggaaattaggaatgcagtggagatgatgattgcacggttagacacacagctgaagaataagcttataacactgatgggtcagaagacatctctaacccaagaaacagagcttttggaatccttacttcaggaggtggagcaccagggagcaagttgcttttggaagaaatggtgtcaaggaaggatatatacattgcggtcttgtagtaagagtgagttgatatctaagagctcagagatccttatgatgtttcagcaagttcatcggaagcccatggcatcttttgttaccactcctgttccaccagactttaccagtgaattagtgccatcttacgattcagctacttttgttttagagaatttcagcactttgcgtcagagagcagatcctgtttacagtccacctcttcaagtttcaggactttgctggaggttaaaagtttacccagatggaaatggagttgtgcgggcctgtagcg

SEQ ID NO: 418795 - DNA, 763 bp, Homo sapiens
cgaactcagaagtcaagagatttgtcaccaccagataaccatcttagcccccaaaatgatgatgctctggagacacgagctaagaagtctgcatgctctgacatgcttctcgaaggtggtcctactacagcttctgtaagagaggccaaagaggatgaagaagatgaggagaagattcagaatgaagattatcatgtaataatgaggccagttttagatttttgtgtttgattaaaaaaaaacagtagcatcatggcttttaacatattatgtgctaaaacagtaggctaaaaatattgtccattgatttccattagtaatgtatgtatgcccttatgtaaatgttaataagtcagaagttgttgaatcaaagcatttcaaggttgtgaaaaaaacaatacattgtataaaacaaaccgtgatacacattttaaaacctaaactaccatacattgtggattttaaaaatgtgttctggccgggtgcggtggctcacacctgtaatcccagcactttgggaggccaaggtgggtggatcacatgaggtcaggagttcgagactatcctggccaacatggccaaaccctgtctctacgaaaaatacaaaaattagctgggtgtggtggtgcttgcctgtaatcccagctacttgggaggctgaggtaggagaatcacttgaacctaggaggcggaggttgcagtgagccaagattgtgccactgcactccagcctgggagacagagcaagactctgtctcaaaga

SEQ ID NO: 418796 - DNA, 499 bp, Homo sapiens
  misc_feature (499)..(499): n is a, c, g, or t
cttccatcttccttccagggatcctggacacactggagggccccaacatcccgcccatccagagggtccccagagacatccctgccatgctccctgctgctcggcttcccaccaccgtcctcaacgccacagccaaagctgttgcggtgaccctgcagtcacactgaccccacctgaaattcttggccagtcctctttcccgcagctgcagagaggaggaagactattaaaggacagtcctgatgacatgtttcgtagatggggtttgcagctgccactgagctgtagctgcgtaagtacctccttgatgcctgtcgggtgggcagccacttcgtgggcagcgctgcccacgaagtgcacctaattggaagcaccaccctagcaatatcaaccattaaccttccctctacacttatcatcttcacaattctaattctactgactatcctagaaatcgctgtcgccttaatccaagctacgttttcacatcgtgggcagn

SEQ ID NO: 418797 - DNA, 1631 bp, Homo sapiens
  misc_feature (26)..(26): n is a, c, g, or t
  misc_feature (1557)..(1557): n is a, c, g, or t
  misc_feature (1564)..(1564): n is a, c, g, or t
  misc_feature (1566)..(1566): n is a, c, g, or t
  misc_feature (1569)..(1569): n is a, c, g, or t
atgcaggctggtacggccgagtgtangatccgggcttctcctttttgtgttccggccgatcccacctctcctcgaccctggacgtctaccttccggaggcccacatcttgcccactccgcgcgcggggctagcgcgggtttcagcgacgggagccctcaagggacatggcaactacagcggcgccggcgggcggcgcccgaaatggagctggcccggaatggggagggttcgaagaaaacatccagggcggaggctcagctgtgattgacatggagaacatggatgatacctcaggctctagcttcgaggatatgggtgagctgcatcagcgcctgcgcgaggaagaagtagacgctgatgcagctgatgcagctgctgctgaagaggaggatggagagttcctgggcatgaagggctttaagggacagctgagccggcaggtggcagatcagatgtggcaggctgggaaaagacaagcctccagggccttcagcttgtacgccaacatcgacatcctcagaccctactttgatgtggagcctgctcaggtgcgaagcaggctcctggagtccatgatccctatcaagatggtcaacttcccccagaaaattgcaggtgaactctatggacctctcatgctggtcttcactctggttgctatcctactccatgggatgaagacgtctgacactattatccgggagggcaccctgatgggcacagccattggcacctgcttcggctactggctgggagtctcatccttcatttacttccttgcctacctgtgcaacgcccagatcaccatgctgcagatgttggcactgctgggctatggcctctttgggcattgcattgtcctgttcatcacctataatatccacctccacgccctcttctacctcttctggctgttggtgggtggactgtccacactgcgcatggtagcagtgttggtgtctcggaccgtgggccccacacagcggctgctcctctgtggcaccctggctgccctacacatgctcttcctgctctatctgcattttgcctaccacaaagtggtagaggggatcctggacacactggagggccccaacatcccgcccatccagagggtccccagagacatccctgccatgctccctgctgctcggcttcccaccaccgtcctcaacgccacagccaaagctgttgcggtgaccctgcagtcacactgaccccacctgaaattcttggccagtcctctttcccgcagctgcagagaggaggaagactattaaaggacagtcctgatgacatgtttcgtagatggggtttgcagctgccactgagctgtagctgcgtaagtacctccttgatgcctgtcggcacttctgaaaggcacaaggccaagaactcctggccaggactgcaaggctctgcagccaatgcagaaaatgggtcagctcctttgagaacccctccccacctaccccttccttcctctttatctctcccacattgtcttgctaaatatagacttggtaattaaaatgttgattgaagtctggaaaacncaacacncncanccacaccaattcccagacgtatatggtaccgcctcacactcgtcccgtatctcgcgttgggt

SEQ ID NO: 418798 - DNA, 2046 bp, Homo sapiens
  misc_feature (26)..(26): n is a, c, g, or t
atgcaggctggtacggccgagtgtangatccgggcttctcctttttgtgttccggccgatcccacctctcctcgaccctggacgtctaccttccggaggcccacatcttgcccactccgcgcgcggggctagcgcgggtttcagcgacgggagccctcaagggacatggcaactacagcggcgccggcgggcggcgcccgaaatggagctggcccggaatggggagggttcgaagaaaacatccagggcggaggctcagctgtgattgacatggagaacatggatgatacctcaggctctagcttcgaggatatgggtgagctgcatcagcgcctgcgcgaggaagaagtagacgctgatgcagctgatgcagctgctgctgaagaggaggatggagagttcctgggcatgaagggctttaagggacagctgagccggcaggtggcagatcagatgtggcaggctgggaaaagacaagcctccagggccttcagcttgtacgccaacatcgacatcctcagaccctactttgatgtggagcctgctcaggtgcgaagcaggctcctggagtccatgatccctatcaagatggtcaacttcccccagaaaattgcaggtgaactctatggacctctcatgctggtcttcactctggttgctatcctactccatgggatgaagacgtctgacactattatccgggagggcaccctgatgggcacagccattggcacctgcttcggctactggctgggagtctcatccttcatttacttccttgcctacctgtgcaacgcccagatcaccatgctgcagatgttggcactgctgggctatggcctctttgggcattgcattgtcctgttcatcacctataatatccacctccacgccctcttctacctcttctggctgttggtgggtggactgtccacactgcgcatggtagcagtgttggtgtctcggaccgtgggccccacacagcggctgctcctctgtggcaccctggctgccctacacatgctcttcctgctctatctgcattttgcctaccacaaagtggtagaggggatcctggacacactggagggccccaacatcccgcccatccagagggtccccagagacatccctgccatgctccctgctgctcggcttcccaccaccgtcctcaacgccacagccaaagctgttgcggtgaccctgcagtcacactgaccccacctgaaattcttggccagtcctctttcccgcagctgcagagaggaggaagactattaaaggacagtcctgatgacatgtttcgtagatggggtttgcagctgccactgagctgtagctgcgtaagtacctccttgatgcctgtcggcacttctgaaaggcacaaggccaagaactcctggccaggactgcaaggctctgcagccaatgcagaaaatgggtcagctcctttgagaacccctccccacctaccccttccttcctctttatctctcccacattgtcttgctaaatatagacttggtaattaaaatgttgattgaagtctggaaaaaaaaaaaaaaaaaaaaaaaaggggggggggcccaaaagttattccccgcggggggcccaggttataggcgtccccaggcttcctgtggctacacagggggccccaaattagaggagccgatataataaacgcaaggcaccgggccgccggtttcaacaacggctcgtgacggggaacaccggctaccctgggagactctgggcgacgggacaccttatacctccgggcgggggggggacactattgtgggcgcaatacttaccttacggagtactttcaaagagccttcctaagggggctaaagtctcttcacacactttcttcaaaagcccggggttacctaacagcggctgttctcaacatcttaacgcgtggccatatatgcctcgtggcgcgccttgttgaagaaagcttggaggccacaaagcgcggagttcgacacattctcgttgcaccatctctttttacccgcgggctattgtgaacacaac

SEQ ID NO: 418799 - DNA, 1518 bp, Homo sapiens
  misc_feature (6)..(8): n is a, c, g, or t
  misc_feature (38)..(38): n is a, c, g, or t
ggtccnnnccatctaacggctaggtacgaggctgggtntaccctggacgtctaccttccggaggcccacatcttgcccactccgcgcgcggggctagcgcgggtttcagcgacgggagccctcaagggacatggcaactacagcggcgccggcgggcggcgcccgaaatggagctggcccggaatggggagggttcgaagaaaacatccagggcggaggctcagctgtgattgacatggagaacatggatgatacctcaggctctagcttcgaggatatgggtgagctgcatcagcgcctgcgcgaggaagaagtagacgctgatgcagctgatgcagctgctgctgaagaggaggatggagagttcctgggcatgaagggctttaagggacagctgagccggcaggtggcagatcagatgtggcaggctgggaaaagacaagcctccagggccttcagcttgtacgccaacatcgacatcctcagaccctactttgatgtggagcctgctcaggtgcgaagcaggctcctggagtccatgatccctatcaagatggtcaacttcccccagaaaattgcaggtgaactctatggacctctcatgctggtcttcactctggttgctatcctactccatgggatgaagacgtctgacactattatccgggagggcaccctgatgggcacagccattggcacctgcttcggctactggctgggagtctcatccttcatttacttccttgcctacctgtgcaacgcccagatcaccatgctgcagatgttggcactgctgggctatggcctctttgggcattgcattgtcctgttcatcacctataatatccacctccacgccctcttctacctcttctggctgttggtgggtggactgtccacactgcgcatggtagcagtgttggtgtctcggaccgtgggccccacacagcggctgctcctctgtggcaccctggctgccctacacatgctcttcctgctctatctgcattttgcctaccacaaagtggtagaggggatcctggacacactggagggccccaacatcccgcccatccagagggtccccagagacatccctgccatgctccctgctgctcggcttcccaccaccgtcctcaacgccacagccaaagctgttgcggtgaccctgcagtcacactgaccccacctgaaattcttggccagtcctctttcccgcagctgcagagaggaggaagactattaaaggacagtcctgatgacatgtttcgtagatggggtttgcagctgccactgagctgtagctgcgtaagtacctccttgatgcctgtcggcacttctgaaaggcacaaggccaagaactcctggccaggactgcaaggctctgcagccaatgcagaaaatgggtcagctcctttgagaacccctccccacctaccccttccttcctctttatctctcccacattgtcttgctaaatatagacttggtaattaaaatgttgattgaagtctggaa

SEQ ID NO: 418800 - DNA, 1645 bp, Homo sapiens
  misc_feature (26)..(26): n is a, c, g, or t
atgcaggctggtacggccgagtgtangatccgggcttctcctttttgtgttccggccgatcccacctctcctcgaccctggacgtctaccttccggaggcccacatcttgcccactccgcgcgcggggctagcgcgggtttcagcgacgggagccctcaagggacatggcaactacagcggcgccggcgggcggcgcccgaaatggagctggcccggaatggggagggttcgaagaaaacatccagtggaagaacaaagccctaaaccctgggatgagcagaggacttaatggatggaacagaaaagtcctgcactctaggagccattgtcttcacagggcggaggctcagctgtgattgacatggagaacatggatgatacctcaggctctagcttcgaggatatgggtgagctgcatcagcgcctgcgcgaggaagaagtagacgctgatgcagctgatgcagctgctgctgaagaggaggatggagagttcctgggcatgaagggctttaagggacagctgagccggcaggtggcagatcagatgtggcaggctgggaaaagacaagcctccagggccttcagcttgtacgccaacatcgacatcctcagaccctactttgatgtggagcctgctcaggtgcgaagcaggctcctggagtccatgatccctatcaagatggtcaacttcccccagaaaattgcaggtgaactctatggacctctcatgctggtcttcactctggttgctatcctactccatgggatgaagacgtctgacactattatccgggagggcaccctgatgggcacagccattggcacctgcttcggctactggctgggagtctcatccttcatttacttccttgcctacctgtgcaacgcccagatcaccatgctgcagatgttggcactgctgggctatggcctctttgggcattgcattgtcctgttcatcacctataatatccacctccacgccctcttctacctcttctggctgttggtgggtggactgtccacactgcgcatggtagcagtgttggtgtctcggaccgtgggccccacacagcggctgctcctctgtggcaccctggctgccctacacatgctcttcctgctctatctgcattttgcctaccacaaagtggtagaggggatcctggacacactggagggccccaacatcccgcccatccagagggtccccagagacatccctgccatgctccctgctgctcggcttcccaccaccgtcctcaacgccacagccaaagctgttgcggtgaccctgcagtcacactgaccccacctgaaattcttggccagtcctctttcccgcagctgcagagaggaggaagactattaaaggacagtcctgatgacatgtttcgtagatggggtttgcagctgccactgagctgtagctgcgtaagtacctccttgatgcctgtcggcacttctgaaaggcacaaggccaagaactcctggccaggactgcaaggctctgcagccaatgcagaaaatgggtcagctcctttgagaacccctccccacctaccccttccttcctctttatctctcccacattgtcttgctaaatatagacttggtaattaaaatgttgattgaagtctggaa

SEQ ID NO: 418801 - DNA, 1610 bp, Homo sapiens
  misc_feature (6)..(8): n is a, c, g, or t
  misc_feature (38)..(38): n is a, c, g, or t
ggtccnnnccatctaacggctaggtacgaggctgggtntaccctggacgtctaccttccggaggcccacatcttgcccactccgcgcgcggggctagcgcgggtttcagcgacgggagccctcaagggacatggcaactacagcggcgccggcgggcggcgcccgaaatggagctggcccggaatggggagggttcgaagaaaacatccagtggaagaacaaagccctaaaccctgggatgagcagaggacttaatggatggaacagaaaagtcctgcactctaggagccattgtcttcacagggcggaggctcagctgtgattgacatggagaacatggatgatacctcaggctctagcttcgaggatatgggtgagctgcatcagcgcctgcgcgaggaagaagtagacgctgatgcagctgatgcagctgctgctgaagaggaggatggagagttcctgggcatgaagggctttaagggacagctgagccggcaggtggcagatcagatgtggcaggctgggaaaagacaagcctccagggccttcagcttgtacgccaacatcgacatcctcagaccctactttgatgtggagcctgctcaggtgcgaagcaggctcctggagtccatgatccctatcaagatggtcaacttcccccagaaaattgcaggtgaactctatggacctctcatgctggtcttcactctggttgctatcctactccatgggatgaagacgtctgacactattatccgggagggcaccctgatgggcacagccattggcacctgcttcggctactggctgggagtctcatccttcatttacttccttgcctacctgtgcaacgcccagatcaccatgctgcagatgttggcactgctgggctatggcctctttgggcattgcattgtcctgttcatcacctataatatccacctccacgccctcttctacctcttctggctgttggtgggtggactgtccacactgcgcatggtagcagtgttggtgtctcggaccgtgggccccacacagcggctgctcctctgtggcaccctggctgccctacacatgctcttcctgctctatctgcattttgcctaccacaaagtggtagaggggatcctggacacactggagggccccaacatcccgcccatccagagggtccccagagacatccctgccatgctccctgctgctcggcttcccaccaccgtcctcaacgccacagccaaagctgttgcggtgaccctgcagtcacactgaccccacctgaaattcttggccagtcctctttcccgcagctgcagagaggaggaagactattaaaggacagtcctgatgacatgtttcgtagatggggtttgcagctgccactgagctgtagctgcgtaagtacctccttgatgcctgtcggcacttctgaaaggcacaaggccaagaactcctggccaggactgcaaggctctgcagccaatgcagaaaatgggtcagctcctttgagaacccctccccacctaccccttccttcctctttatctctcccacattgtcttgctaaatatagacttggtaattaaaatgttgattgaagtctggaa

SEQ ID NO: 418802 - DNA, 1035 bp, Homo sapiens
  misc_feature (26)..(26): n is a, c, g, or t
  misc_feature (1035)..(1035): n is a, c, g, or t
atgcaggctggtacggccgagtgtangatccgggcttctcctttttgtgttccggccgatcccacctctcctcgaccctggacgtctaccttccggaggcccacatcttgcccactccgcgcgcggggctagcgcgggtttcagcgacgggagccctcaagggacatggcaactacagcggcgccggcgggcggcgcccgaaatggagctggcccggaatggggagggttcgaagaaaacatccagggcggaggctcagctgtgattgacatggagaacatggatgatacctcaggctctagcttcgaggatatgggtgagctgcatcagcgcctgcgcgaggaagaagtagacgctgatgcagctgatgcagctgctgctgaagaggaggatggagagttcctgggcatgaagggctttaagggacagctgagccggcaggtggcagatcagatgtggcaggctgggaaaagacaagcctccagggccttcagcttgtacgccaacatcgacatcctcagaccctactttgatgtggagcctgctcaggtgcgaagcaggctcctggagtccatgatccctatcaagatggtcaacttcccccagaaaattgcaggtgaactctatggacctctcatgctggtcttcactctggttgctatcctactccatgggatgaagacgtctgacactattatccgggagggcaccctgatgggcacagccattggcacctgcttcggctactggctgggagtctcatccttcatttacttccttgcctacctgtgcaacgcccagatcaccatgctgcagatgttggcactgctgggtatggctcttgggcattgcttgtctgtcatcactataaattcactcagcctcttaccttcgtggggggggtggccctggctgtacgtgggtcgacgggcccaaggggcttggactggggctaggtccggtctgtggcccagggaggcggcggggcctccggggatggggcgcccactgccaactgcaagagggggccgcgcn

SEQ ID NO: 418803 - DNA, 1712 bp, Homo sapiens
  misc_feature (26)..(26): n is a, c, g, or t
atgcaggctggtacggccgagtgtangatccgggcttctcctttttgtgttccggccgatcccacctctcctcgaccctggacgtctaccttccggaggcccacatcttgcccactccgcgcgcggggctagcgcgggtttcagcgacgggagccctcaagggacatggcaactacagcggcgccggcgggcggcgcccgaaatggagctggcccggaatggggagggttcgaagaaaacatccagggcggaggctcagctgtgattgacatggagaacatggatgatacctcaggctctagcttcgaggatatgggtgagctgcatcagcgcctgcgcgaggaagaagtagacgctgatgcagctgatgcagctgctgctgaagaggaggatggagagttcctgggcatgaagggctttaagggacagctgagccggcaggtggcagatcagatgtggcaggctgggaaaagacaagcctccagggccttcagcttgtacgccaacatcgacatcctcagaccctactttgatgtggagcctgctcaggtgcgaagcaggctcctggagtccatgatccctatcaagatggtcaacttcccccagaaaattgcaggtgaactctatggacctctcatgctggtcttcactctggttgctatcctactccatgggatgaagacgtctgacactattatccgtaagcaggacagacaactttgggggggtggctgcactaggttgaaagctgcctgaggatacaatggtggagtgagacaggaacagcccctgcggaaggccctaggtgaggctgagatcagaggcctcctaggactaaatagagccttcaccccacagcgggagggcaccctgatgggcacagccattggcacctgcttcggctactggctgggagtctcatccttcatttacttccttgcctacctgtgcaacgcccagatcaccatgctgcagatgttggcactgctgggctatggcctctttgggcattgcattgtcctgttcatcacctataatatccacctccacgccctcttctacctcttctggctgttggtgggtggactgtccacactgcgcatggtagcagtgttggtgtctcggaccgtgggccccacacagcggctgctcctctgtggcaccctggctgccctacacatgctcttcctgctctatctgcattttgcctaccacaaagtggtagaggggatcctggacacactggagggccccaacatcccgcccatccagagggtccccagagacatccctgccatgctccctgctgctcggcttcccaccaccgtcctcaacgccacagccaaagctgttgcggtgaccctgcagtcacactgaccccacctgaaattcttggccagtcctctttcccgcagctgcagagaggaggaagactattaaaggacagtcctgatgacatgtttcgtagatggggtttgcagctgccactgagctgtagctgcgtaagtacctccttgatgcctgtcggcacttctgaaaggcacaaggccaagaactcctggccaggactgcaaggctctgcagccaatgcagaaaatgggtcagctcctttgagaacccctccccacctaccccttccttcctctttatctctcccacattgtcttgctaaatatagacttggtaattaaaatgttgattgaagtctggaa

SEQ ID NO: 418804 - DNA, 1454 bp, Homo sapiens
  misc_feature (26)..(26): n is a, c, g, or t
atgcaggctggtacggccgagtgtangatccgggcttctcctttttgtgttccggccgatcccacctctcctcgaccctggacgtctaccttccggaggcccacatcttgcccactccgcgcgcggggctagcgcgggtttcagcgacgggagccctcaagggacatggcaactacagcggcgccggcgggcggcgcccgaaatggagctggcccggaatggggagggttcgaagaaaacatccagggcggaggctcagctgtgattgacatggagaacatggatgatacctcaggctctagcttcgaggatatgggtgagctgcatcagcgcctgcgcgaggaagaagtagacgctgatgcagctgatgcagctgctgctgaagaggaggatggagagttcctgggcatgaagggctttaagggacagctgagccggcaggtggcagatcagatgtggcaggctgggaaaagacaagcctccagggccttcagcttgtacgccaacatcgacatcctcagaccctactttgatgtggagcctgctcaggtgcgaagcaggctcctggagtccatgatccctatcaagatggtcaacttcccccagaaaattgcaggtgaactctatggacctctcatgctggtcttcactctggttgctatcctactccatgggatgaagacgtctgacactattatccagatcaccatgctgcagatgttggcactgctgggctatggcctctttgggcattgcattgtcctgttcatcacctataatatccacctccacgccctcttctacctcttctggctgttggtgggtggactgtccacactgcgcatggtagcagtgttggtgtctcggaccgtgggccccacacagcggctgctcctctgtggcaccctggctgccctacacatgctcttcctgctctatctgcattttgcctaccacaaagtggtagaggggatcctggacacactggagggccccaacatcccgcccatccagagggtccccagagacatccctgccatgctccctgctgctcggcttcccaccaccgtcctcaacgccacagccaaagctgttgcggtgaccctgcagtcacactgaccccacctgaaattcttggccagtcctctttcccgcagctgcagagaggaggaagactattaaaggacagtcctgatgacatgtttcgtagatggggtttgcagctgccactgagctgtagctgcgtaagtacctccttgatgcctgtcggcacttctgaaaggcacaaggccaagaactcctggccaggactgcaaggctctgcagccaatgcagaaaatgggtcagctcctttgagaacccctccccacctaccccttccttcctctttatctctcccacattgtcttgctaaatatagacttggtaattaaaatgttgattgaagtctggaa

SEQ ID NO: 418805 - DNA, 1906 bp, Homo sapiens
  misc_feature (26)..(26): n is a, c, g, or t
atgcaggctggtacggccgagtgtangatccgggcttctcctttttgtgttccggccgatcccacctctcctcgaccctggacgtctaccttccggaggcccacatcttgcccactccgcgcgcggggctagcgcgggtttcagcgacgggagccctcaagggacatggcaactacagcggcgccggcgggcggcgcccgaaatggagctggcccggaatggggagggttcgaagaaaacatccagggcggaggctcagctgtgattgacatggagaacatggatgatacctcaggctctagcttcgaggatatgggtgagctgcatcagcgcctgcgcgaggaagaagtagacgctgatgcagctgatgcagctgctgctgaagaggaggatggagagttcctgggcatgaagggctttaagggacagctgagccggcaggtggcagatcagatgtggcaggctgggaaaagacaagcctccagggccttcagcttgtacgccaacatcgacatcctcagaccctactttgatgtggagcctgctcaggtgcgaagcaggctcctggagtccatgatccctatcaagatggtcaacttcccccagaaaattgcaggtgaactctatggacctctcatgctggtcttcactctggttgctatcctactccatgggatgaagacgtctgacactattatccgtaagcaggacagacaactttgggggggtggctgcactaggttgaaagctgcctgaggatacaatggtggagtgagacaggaacagcccctgcggaaggccctaggtgaggctgagatcagaggcctcctaggactaaatagagccttcaccccacagcgggagggcaccctgatgggcacagccattggcacctgcttcggctactggctgggagtctcatccttcatttacttccttgcctacctgtgcaacgcccagatcaccatgctgcagatgttggcactgctggtaaggagccaggtgtggtgggcaagagtgatgttaaaaagagtagccaggccttggtcggcatctgtcctggggccccaaagcctggaatgggaggagtaggccaatggaccatgtgtttcccagggtccccatgaggggccagaaagcagcccaacctgaatgattttcctctccaccatcctccttcccagggctatggcctctttgggcattgcattgtcctgttcatcacctataatatccacctccacgccctcttctacctcttctggctgttggtgggtggactgtccacactgcgcatggtagcagtgttggtgtctcggaccgtgggccccacacagcggctgctcctctgtggcaccctggctgccctacacatgctcttcctgctctatctgcattttgcctaccacaaagtggtagaggggatcctggacacactggagggccccaacatcccgcccatccagagggtccccagagacatccctgccatgctccctgctgctcggcttcccaccaccgtcctcaacgccacagccaaagctgttgcggtgaccctgcagtcacactgaccccacctgaaattcttggccagtcctctttcccgcagctgcagagaggaggaagactattaaaggacagtcctgatgacatgtttcgtagatggggtttgcagctgccactgagctgtagctgcgtaagtacctccttgatgcctgtcggcacttctgaaaggcacaaggccaagaactcctggccaggactgcaaggctctgcagccaatgcagaaaatgggtcagctcctttgagaacccctccccacctaccccttccttcctctttatctctcccacattgtcttgctaaatatagacttggtaattaaaatgttgattgaagtctggaa

SEQ ID NO: 418806 - DNA, 1782 bp, Homo sapiens
  misc_feature (26)..(26): n is a, c, g, or t
atgcaggctggtacggccgagtgtangatccgggcttctcctttttgtgttccggccgatcccacctctcctcgaccctggacgtctaccttccggaggcccacatcttgcccactccgcgcgcggggctagcgcgggtttcagcgacgggagccctcaagggacatggcaactacagcggcgccggcgggcggcgcccgaaatggagctggcccggaatggggagggttcgaagaaaacatccagtggaagaacaaagccctaaaccctgggatgagcagaggacttaatggatggaacagaaaagtcctgcactctaggagccattgtcttcacagggcggaggctcagctgtgattgacatggagaacatggatgatacctcaggctctagcttcgaggatatgggtgagctgcatcagcgcctgcgcgaggaagaagtagacgctgatgcagctgatgcagctgctgctgaagaggaggatggagagttcctgggcatgaagggctttaagggacagctgagccggcaggtggcagatcagatgtggcaggctgggaaaagacaagcctccagggccttcagcttgtacgccaacatcgacatcctcagaccctactttgatgtggagcctgctcaggtgcgaagcaggctcctggagtccatgatccctatcaagatggtcaacttcccccaggtgaatagagggtggccatgtctggagagccgggggaagcaccagggcagagggtgggaccaccaggcaaatcctgggaagccataaacagatgagctgttgtaccctccagcctgaatgaattggtatattgacagaaaattgcaggtgaactctatggacctctcatgctggtcttcactctggttgctatcctactccatgggatgaagacgtctgacactattatccgggagggcaccctgatgggcacagccattggcacctgcttcggctactggctgggagtctcatccttcatttacttccttgcctacctgtgcaacgcccagatcaccatgctgcagatgttggcactgctgggctatggcctctttgggcattgcattgtcctgttcatcacctataatatccacctccacgccctcttctacctcttctggctgttggtgggtggactgtccacactgcgcatggtagcagtgttggtgtctcggaccgtgggccccacacagcggctgctcctctgtggcaccctggctgccctacacatgctcttcctgctctatctgcattttgcctaccacaaagtggtagaggggatcctggacacactggagggccccaacatcccgcccatccagagggtccccagagacatccctgccatgctccctgctgctcggcttcccaccaccgtcctcaacgccacagccaaagctgttgcggtgaccctgcagtcacactgaccccacctgaaattcttggccagtcctctttcccgcagctgcagagaggaggaagactattaaaggacagtcctgatgacatgtttcgtagatggggtttgcagctgccactgagctgtagctgcgtaagtacctccttgatgcctgtcggcacttctgaaaggcacaaggccaagaactcctggccaggactgcaaggctctgcagccaatgcagaaaatgggtcagctcctttgagaacccctccccacctaccccttccttcctctttatctctcccacattgtcttgctaaatatagacttggtaattaaaatgttgattgaagtctggaa

SEQ ID NO: 418807 - DNA, 992 bp, Homo sapiens
  misc_feature (26)..(26): n is a, c, g, or t
  misc_feature (900)..(900): n is a, c, g, or t
  misc_feature (908)..(908): n is a, c, g, or t
atgcaggctggtacggccgagtgtangatccgggcttctcctttttgtgttccggccgatcccacctctcctcgaccctggacgtctaccttccggaggcccacatcttgcccactccgcgcgcggggctagcgcgggtttcagcgacgggagccctcaagggacatggcaactacagcggcgccggcgggcggcgcccgaaatggagctggcccggaatggggagggttcgaagaaaacatccaggctctagcttcgaggatatgggtgagctgcatcagcgcctgcgcgaggaagaagtagacgctgatgcagctgatgcagctgctgctgaagaggaggatggagagttcctgggcatgaagggctttaagggacagctgagccggcaggtggcagatcagatgtggcaggctgggaaaagacaagcctccagggccttcagcttgtacgccaacatcgacatcctcagaccctactttgatgtggagcctgctcaggtgcgaagcaggctcctggagtccatgatccctatcaagatggtcaacttcccccagaaaattgcaggtgaactctatggacctctcatgctggtcttcactctggttgctatcctactccatgggatgaagacgtctgacactattatccgggagggcaccctgatgggcacagccattggcacctgcttcggctactggctgggagtctcatccttcatttacttccttgcctacctgtgcaacgcccagatcaccatgctgcagatgttggcactgctgggctatggcctctttgggcattgcattgtcctgttcatcacctataatatccacctccacgccctcttctacctcttctggctgttggtgggtggactgtccacactgcgcatgtccntgggtccngccgggcccccggggtcctttggccggggcctccggctcgcgcctcgttggcccggggggccggtggggcccccaggcaacccc

SEQ ID NO: 418808 - DNA, 1553 bp, Homo sapiens
  misc_feature (26)..(26): n is a, c, g, or t
atgcaggctggtacggccgagtgtangatccgggcttctcctttttgtgttccggccgatcccacctctcctcgaccctggacgtctaccttccggaggcccacatcttgcccactccgcgcgcggggctagcgcgggtttcagcgacgggagccctcaagggacatggcaactacagcggcgccggcgggcggcgcccgaaatggagctggcccggaatggggagggttcgaagaaaacatccagggcggaggctcagctgtgattgacatggagaacatggatgatacctcaggctctagcttcgaggatatgggtgagctgcatcagcgcctgcgcgaggaagaagtagacgctgatgcagctgatgcagctgctgctgaagaggaggatggagagttcctgggcatgaagggctttaagggacagctgagccggcaggtggcagatcagatgtggcaggctgggaaaagacaagcctccagggccttcagcttgtacgccaacatcgacatcctcagaccctactttgatgtggagcctgctcaggtgcgaagcaggctcctggagtccatgatccctatcaagatggtcaacttcccccagaaaattgcaggtgaactctatggacctctcatgctggtcttcactctggttgctatcctactccatgggatgaagacgtctgacactattatccgggagggcaccctgatgggcacagccattggcacctgcttcggctactggctgggagtctcatccttcatttacttccttgcctacctgtgcaacgcccagatcaccatgctgcagatgttggcactgctgggctatggcctctttgggcattgcattgtcctgttcatcacctataatatccacctccacgccctcttctacctcttctggctgttggtgggtggactgtccacactgcgcatggtagcagtgttggtgtctcggaccgtgggccccacacagcggctgctcctctgtggcaccctggctgccctacacatgctcttcctgctctatctgcattttgcctaccacaaagtggtagaggggatcctggacacactggagggccccaacatcccgcccatccagagggtccccagagacatccctgccatgctccctgctgctcggcttcccaccaccgtcctcaacgccacagccaaagctgttgcggtgaccctgcagtcacactgaccccacctgaaattcttggccagtcctctttcccgcagctgcagagaggaggaagactattaaaggacagtcctgatgacatgtttcgtagatggggtttgcagctgccactgagctgtagctgcgtaagtacctccttgatgcctgtcggcacttctgaaaggcacaaggccaagaactcctggccaggactgcaaggctctgcagccaatgcagaaaatgggtcagctcctttgagaacccctccccacctaccccttccttcctctttatctctcccacattgtcttgctaaatatagacttggtaattaaaatgttgattgaagtctggaa

SEQ ID NO: 418809 - DNA, 1530 bp, Homo sapiens
  misc_feature (26)..(26): n is a, c, g, or t
  misc_feature (1502)..(1502): n is a, c, g, or t
atgcaggctggtacggccgagtgtangatccgggcttctcctttttgtgttccggccgatcccacctctcctcgaccctggacgtctaccttccggaggcccacatcttgcccactccgcgcgcggggctagcgcgggtttcagcgacgggagccctcaagggacatggcaactacagcggcgccggcgggcggcgcccgaaatggagctggcccggaatggggagggttcgaagaaaacatccagggcggaggctcagctgtgattgacatggagaacatggatgatacctcaggctctagcttcgaggatatgggtgagctgcatcagcgcctgcgcgaggaagaagtagacgctgatgcagctgatgcagctgctgctgaagaggaggatggagagttcctgggcatgaagggctttaagggacagctgagccggcaggtggcagatcagatgtggcaggctgggaaaagacaagcctccagggccttcagcttgtacgccaacatcgacatcctcagaccctactttgatgtggagcctgctcaggtgcgaagcaggctcctggagtccatgatccctatcaagatggtcaacttcccccagaaaattgcaggtgaactctatggacctctcatgctggtcttcactctggttgctatcctactccatgggatgaagacgtctgacactattatccgggagggcaccctgatgggcacagccattggcacctgcttcggctactggctgggagtctcatccttcatttacttccttgcctacctgtgcaacgcccagatcaccatgctgcagatgttggcactgctgggctatggcctctttgggcattgcattgtcctgttcatcacctataatatccacctccacgccctcttctacctcttctggctgttggtgggtggactgtccacactgcgcatggtagcagtgttggtgtctcggaccgtgggccccacacagcggctgctcctctgtggcaccctggctgccctacacatgctcttcctgctctatctgcattttgcctaccacaaagtggtagaggggatcctggacacactggagggccccaacatcccgcccatccagagggtccccagagacatccctgccatgctccctgctgctcggcttcccaccaccgtcctcaacgccacagccaaagctgttgcggtgaccctgcagtcacactgaccccacctgaaattcttggccagtcctctttcccgcagctgcagagaggaggaagactattaaaggacagtcctgatgacatgtttcgtagatggggtttgcagctgccactgagctgtagctgcgtaagtacctccttgatgcctgtcggcacttctgaaaggcacaaggccaagaactgtgggcgcgaggaggggagagggggggcgagcgcgaatggcgaggagagagaggggggggggggggggggggggggggggggggggggggggcggggggggggngggggggggggggggggaaggggagggg

SEQ ID NO: 418810 - DNA, 1550 bp, Homo sapiens
  misc_feature (26)..(26): n is a, c, g, or t
  misc_feature (1550)..(1550): n is a, c, g, or t
atgcaggctggtacggccgagtgtangatccgggcttctcctttttgtgttccggccgatcccacctctcctcgaccctggacgtctaccttccggaggcccacatcttgcccactccgcgcgcggggctagcgcgggtttcagcgacgggagccctcaagggacatggcaactacagcggcgccggcgggcggcgcccgaaatggagctggcccggaatggggagggttcgaagaaaacatccagggcggaggctcagctgtgattgacatggagaacatggatgatacctcaggctctagcttcgaggatatgggtgagctgcatcagcgcctgcgcgaggaagaagtagacgctgatgcagctgatgcagctgctgctgaagaggaggatggagagttcctgggcatgaagggctttaagggacagctgagccggcaggtggcagatcagatgtggcaggctgggaaaagacaagcctccagggccttcagcttgtacgccaacatcgacatcctcagaccctactttgatgtggagcctgctcaggtgcgaagcaggctcctggagtccatgatccctatcaagatggtcaacttcccccagaaaattgcaggtgaactctatggacctctcatgctggtcttcactctggttgctatcctactccatgggatgaagacgtctgacactattatccgggagggcaccctgatgggcacagccattggcacctgcttcggctactggctgggagtctcatccttcatttacttccttgcctacctgtgcaacgcccagatcaccatgctgcagatgttggcactgctgggctatggcctctttgggcattgcattgtcctgttcatcacctataatatccacctccacgccctcttctacctcttctggctgttggtgggtggactgtccacactgcgcatggtagcagtgttggtgtctcggaccgtgggccccacacagcggctgctcctctgtggcaccctggctgccctacacatgctcttcctgctctatctgcattttgcctaccacaaagtggtagaggggatcctggacacactggagggccccaacatcccgcccatccagagggtccccagagacatccctgccatgctccctgctgctcggcttcccaccaccgtcctcaacgccacagccaaagctgttgcggtgaccctgcagtcacactgaccccacctgaaattcttggccagtcctctttcccgcagctgcagagaggaggaagactattaaaggacagtcctgatgacatgtttcgtagatggggtttgcagctgccactgagctgtagctgcgtaagtacctccttgatgcctgtcgggtgggcagccacttcgtgggcagcgctgcccacgaagtgcacctaattggaagcaccaccctagcaatatcaaccattaaccttccctctacacttatcatcttcacaattctaattctactgactatcctagaaatcgctgtcgccttaatccaagctacgttttcacatcgtgggcagn

SEQ ID NO: 418811 - DNA, 1747 bp, Homo sapiens
  misc_feature (26)..(26): n is a, c, g, or t
atgcaggctggtacggccgagtgtangatccgggcttctcctttttgtgttccggccgatcccacctctcctcgaccctggacgtctaccttccggaggcccacatcttgcccactccgcgcgcggggctagcgcgggtttcagcgacgggagccctcaagggacatggcaactacagcggcgccggcgggcggcgcccgaaatggagctggcccggaatggggagggttcgaagaaaacatccagggcggaggctcagctgtgattgacatggagaacatggatgatacctcaggctctagcttcgaggatatgggtgagctgcatcagcgcctgcgcgaggaagaagtagacgctgatgcagctgatgcagctgctgctgaagaggaggatggagagttcctgggcatgaagggctttaagggacagctgagccggcaggtggcagatcagatgtggcaggctgggaaaagacaagcctccagggccttcagcttgtacgccaacatcgacatcctcagaccctactttgatgtggagcctgctcaggtgcgaagcaggctcctggagtccatgatccctatcaagatggtcaacttcccccagaaaattgcaggtgaactctatggacctctcatgctggtcttcactctggttgctatcctactccatgggatgaagacgtctgacactattatccgggagggcaccctgatgggcacagccattggcacctgcttcggctactggctgggagtctcatccttcatttacttccttgcctacctgtgcaacgcccagatcaccatgctgcagatgttggcactgctggtaaggagccaggtgtggtgggcaagagtgatgttaaaaagagtagccaggccttggtcggcatctgtcctggggccccaaagcctggaatgggaggagtaggccaatggaccatgtgtttcccagggtccccatgaggggccagaaagcagcccaacctgaatgattttcctctccaccatcctccttcccagggctatggcctctttgggcattgcattgtcctgttcatcacctataatatccacctccacgccctcttctacctcttctggctgttggtgggtggactgtccacactgcgcatggtagcagtgttggtgtctcggaccgtgggccccacacagcggctgctcctctgtggcaccctggctgccctacacatgctcttcctgctctatctgcattttgcctaccacaaagtggtagaggggatcctggacacactggagggccccaacatcccgcccatccagagggtccccagagacatccctgccatgctccctgctgctcggcttcccaccaccgtcctcaacgccacagccaaagctgttgcggtgaccctgcagtcacactgaccccacctgaaattcttggccagtcctctttcccgcagctgcagagaggaggaagactattaaaggacagtcctgatgacatgtttcgtagatggggtttgcagctgccactgagctgtagctgcgtaagtacctccttgatgcctgtcggcacttctgaaaggcacaaggccaagaactcctggccaggactgcaaggctctgcagccaatgcagaaaatgggtcagctcctttgagaacccctccccacctaccccttccttcctctttatctctcccacattgtcttgctaaatatagacttggtaattaaaatgttgattgaagtctggaa

SEQ ID NO: 418812 - DNA, 1360 bp, Homo sapiens
  misc_feature (26)..(26): n is a, c, g, or t
atgcaggctggtacggccgagtgtangatggggagggtcgaagaaaacatccaggcggaggctcagctgtgattgacatggagaacatggatgatacctcaggctctagcttcgaggatatgggtgagctgcatcagcgcctgcgcgaggaagaagtagacgctgatgcagctgatgcagctgctgctgaagaggaggatggagagttcctgggcatgaagggctttaagggacagctgagccggcaggtggcagatcagatgtggcaggctgggaaaagacaagcctccagggccttcagcttgtacgccaacatcgacatcctcagaccctactttgatgtggagcctgctcaggtgcgaagcaggctcctggagtccatgatccctatcaagatggtcaacttcccccagaaaattgcaggtgaactctatggacctctcatgctggtcttcactctggttgctatcctactccatgggatgaagacgtctgacactattatccgggagggcaccctgatgggcacagccattggcacctgcttcggctactggctgggagtctcatccttcatttacttccttgcctacctgtgcaacgcccagatcaccatgctgcagatgttggcactgctgggctatggcctctttgggcattgcattgtcctgttcatcacctataatatccacctccacgccctcttctacctcttctggctgttggtgggtggactgtccacactgcgcatggtagcagtgttggtgtctcggaccgtgggccccacacagcggctgctcctctgtggcaccctggctgccctacacatgctcttcctgctctatctgcattttgcctaccacaaagtggtagaggggatcctggacacactggagggccccaacatcccgcccatccagagggtccccagagacatccctgccatgctccctgctgctcggcttcccaccaccgtcctcaacgccacagccaaagctgttgcggtgaccctgcagtcacactgaccccacctgaaattcttggccagtcctctttcccgcagctgcagagaggaggaagactattaaaggacagtcctgatgacatgtttcgtagatggggtttgcagctgccactgagctgtagctgcgtaagtacctccttgatgcctgtcggcacttctgaaaggcacaaggccaagaactcctggccaggactgcaaggctctgcagccaatgcagaaaatgggtcagctcctttgagaacccctccccacctaccccttccttcctctttatctctcccacattgtcttgctaaatatagacttggtaattaaaatgttgattgaagtctggaa

SEQ ID NO: 418813 - DNA, 1504 bp, Homo sapiens
  misc_feature (26)..(26): n is a, c, g, or t
atgcaggctggtacggccgagtgtangatccgggcttctcctttttgtgttccggccgatcccacctctcctcgaccctggacgtctaccttccggaggcccacatcttgcccactccgcgcgcggggctagcgcgggtttcagcgacgggagccctcaagggacatggcaactacagcggcgccggcgggcggcgcccgaaatggagctggcccggaatggggagggttcgaagaaaacatccaggctctagcttcgaggatatgggtgagctgcatcagcgcctgcgcgaggaagaagtagacgctgatgcagctgatgcagctgctgctgaagaggaggatggagagttcctgggcatgaagggctttaagggacagctgagccggcaggtggcagatcagatgtggcaggctgggaaaagacaagcctccagggccttcagcttgtacgccaacatcgacatcctcagaccctactttgatgtggagcctgctcaggtgcgaagcaggctcctggagtccatgatccctatcaagatggtcaacttcccccagaaaattgcaggtgaactctatggacctctcatgctggtcttcactctggttgctatcctactccatgggatgaagacgtctgacactattatccgggagggcaccctgatgggcacagccattggcacctgcttcggctactggctgggagtctcatccttcatttacttccttgcctacctgtgcaacgcccagatcaccatgctgcagatgttggcactgctgggctatggcctctttgggcattgcattgtcctgttcatcacctataatatccacctccacgccctcttctacctcttctggctgttggtgggtggactgtccacactgcgcatggtagcagtgttggtgtctcggaccgtgggccccacacagcggctgctcctctgtggcaccctggctgccctacacatgctcttcctgctctatctgcattttgcctaccacaaagtggtagaggggatcctggacacactggagggccccaacatcccgcccatccagagggtccccagagacatccctgccatgctccctgctgctcggcttcccaccaccgtcctcaacgccacagccaaagctgttgcggtgaccctgcagtcacactgaccccacctgaaattcttggccagtcctctttcccgcagctgcagagaggaggaagactattaaaggacagtcctgatgacatgtttcgtagatggggtttgcagctgccactgagctgtagctgcgtaagtacctccttgatgcctgtcggcacttctgaaaggcacaaggccaagaactcctggccaggactgcaaggctctgcagccaatgcagaaaatgggtcagctcctttgagaacccctccccacctaccccttccttcctctttatctctcccacattgtcttgctaaatatagacttggtaattaaaatgttgattgaagtctggaa

SEQ ID NO: 418814 - DNA, 1081 bp, Homo sapiens
gttagagatgaataaaattcaggccttgccctccagaacctcatggccttgtgctgcctttgctttaatctctcctctcctctcccaggctcctggagtccatgatccctatcaagatggtcaacttcccccagaaaattgcaggtgaactctatggacctctcatgctggtcttcactctggttgctatcctactccatgggatgaagacgtctgacactattatccgggagggcaccctgatgggcacagccattggcacctgcttcggctactggctgggagtctcatccttcatttacttccttgcctacctgtgcaacgcccagatcaccatgctgcagatgttggcactgctgggctatggcctctttgggcattgcattgtcctgttcatcacctataatatccacctccacgccctcttctacctcttctggctgttggtgggtggactgtccacactgcgcatggtagcagtgttggtgtctcggaccgtgggccccacacagcggctgctcctctgtggcaccctggctgccctacacatgctcttcctgctctatctgcattttgcctaccacaaagtggtagaggggatcctggacacactggagggccccaacatcccgcccatccagagggtccccagagacatccctgccatgctccctgctgctcggcttcccaccaccgtcctcaacgccacagccaaagctgttgcggtgaccctgcagtcacactgaccccacctgaaattcttggccagtcctctttcccgcagctgcagagaggaggaagactattaaaggacagtcctgatgacatgtttcgtagatggggtttgcagctgccactgagctgtagctgcgtaagtacctccttgatgcctgtcggcacttctgaaaggcacaaggccaagaactcctggccaggactgcaaggctctgcagccaatgcagaaaatgggtcagctcctttgagaacccctccccacctaccccttccttcctctttatctctcccacattgtcttgctaaatatagacttggtaattaaaatgttgattgaagtctggaa

SEQ ID NO: 418815 - DNA, 1693 bp, Homo sapiens
cccccgtccacgtccccagcttccggaagttgcttttgtccaaacatccgggcttctcctttttgtgttccggccgatcccacctctcctcgaccctggacgtctaccttccggaggcccacatcttgcccactccgcgcgcggggctagcgcgggtttcagcgacgggagccctcaagggacatggcaactacagcggcgccggcgggcggcgcccgaaatggagctggcccggaatggggagggttcgaagaaaacatccagtggaagaacaaagccctaaaccctgggatgagcagaggacttaatggatggaacagaaaagtcctgcactctaggagccattgtcttcacagggcggaggctcagctgtgattgacatggagaacatggatgatacctcaggctctagcttcgaggatatgggtgagctgcatcagcgcctgcgcgaggaagaagtagacgctgatgcagctgatgcagctgctgctgaagaggaggatggagagttcctgggcatgaagggctttaagggacagctgagccggcaggtggcagatcaggctcctggagtccatgatccctatcaagatggtcaacttcccccaggtgaatagagggtggccatgtctggagagccgggggaagcaccagggcagagggtgggaccaccaggcaaatcctgggaagccataaacagatgagctgttgtaccctccagcctgaatgaattggtatattgacagaaaattgcaggtgaactctatggacctctcatgctggtcttcactctggttgctatcctactccatgggatgaagacgtctgacactattatccgggagggcaccctgatgggcacagccattggcacctgcttcggctactggctgggagtctcatccttcatttacttccttgcctacctgtgcaacgcccagatcaccatgctgcagatgttggcactgctgggctatggcctctttgggcattgcattgtcctgttcatcacctataatatccacctccacgccctcttctacctcttctggctgttggtgggtggactgtccacactgcgcatggtagcagtgttggtgtctcggaccgtgggccccacacagcggctgctcctctgtggcaccctggctgccctacacatgctcttcctgctctatctgcattttgcctaccacaaagtggtagaggggatcctggacacactggagggccccaacatcccgcccatccagagggtccccagagacatccctgccatgctccctgctgctcggcttcccaccaccgtcctcaacgccacagccaaagctgttgcggtgaccctgcagtcacactgaccccacctgaaattcttggccagtcctctttcccgcagctgcagagaggaggaagactattaaaggacagtcctgatgacatgtttcgtagatggggtttgcagctgccactgagctgtagctgcgtaagtacctccttgatgcctgtcggcacttctgaaaggcacaaggccaagaactcctggccaggactgcaaggctctgcagccaatgcagaaaatgggtcagctcctttgagaacccctccccacctaccccttccttcctctttatctctcccacattgtcttgctaaatatagacttggtaattaaaatgttgattgaagtctggaa

SEQ ID NO: 418816 - DNA, 1849 bp, Homo sapiens
  misc_feature (26)..(26): n is a, c, g, or t
atgcaggctggtacggccgagtgtangatccgggcttctcctttttgtgttccggccgatcccacctctcctcgaccctggacgtctaccttccggaggcccacatcttgcccactccgcgcgcggggctagcgcgggtttcagcgacgggagccctcaagggacatggcaactacagcggcgccggcgggcggcgcccgaaatggagctggcccggaatggggagggttcgaagaaaacatccagggcggaggctcagctgtgattgacatggagaacatggatgatacctcaggctctagcttcgaggatatgggtgagctgcatcagcgcctgcgcgaggaagaagtagacgctgatgcagctgatgcagctgctgctgaagaggaggatggagagttcctgggcatgaagggctttaagggacagctgagccggcaggtggcagatcagatgtggcaggctgggaaaagacaagcctccagggccttcagcttgtacgccaacatcgacatcctcagaccctactttgatgtggagcctgctcaggtgcgaagcaggctcctggagtccatgatccctatcaagatggtcaacttcccccaggtgaatagagggtggccatgtctggagagccgggggaagcaccagggcagagggtgggaccaccaggcaaatcctgggaagccataaacagatgagctgttgtaccctccagcctgaatgaattggtatattgacagaaaattgcaggtgaactctatggacctctcatgctggtcttcactctggttgctatcctactccatgggatgaagacgtctgacactattatccgtaagcaggacagacaactttgggggggtggctgcactaggttgaaagctgcctgaggatacaatggtggagtgagacaggaacagcccctgcggaaggccctaggtgaggctgagatcagaggcctcctaggactaaatagagccttcaccccacagcgggagggcaccctgatgggcacagccattggcacctgcttcggctactggctgggagtctcatccttcatttacttccttgcctacctgtgcaacgcccagatcaccatgctgcagatgttggcactgctgggctatggcctctttgggcattgcattgtcctgttcatcacctataatatccacctccacgccctcttctacctcttctggctgttggtgggtggactgtccacactgcgcatggtagcagtgttggtgtctcggaccgtgggccccacacagcggctgctcctctgtggcaccctggctgccctacacatgctcttcctgctctatctgcattttgcctaccacaaagtggtagaggggatcctggacacactggagggccccaacatcccgcccatccagagggtccccagagacatccctgccatgctccctgctgctcggcttcccaccaccgtcctcaacgccacagccaaagctgttgcggtgaccctgcagtcacactgaccccacctgaaattcttggccagtcctctttcccgcagctgcagagaggaggaagactattaaaggacagtcctgatgacatgtttcgtagatggggtttgcagctgccactgagctgtagctgcgtaagtacctccttgatgcctgtcggcacttctgaaaggcacaaggccaagaactcctggccaggactgcaaggctctgcagccaatgcagaaaatgggtcagctcctttgagaacccctccccacctaccccttccttcctctttatctctcccacattgtcttgctaaatatagacttggtaattaaaatgttgattgaagtctggaa

SEQ ID NO: 418817 - DNA, 839 bp, Homo sapiens
  misc_feature (26)..(26): n is a, c, g, or t
atgcaggctggtacggccgagtgtangatccgggcttctcctttttgtgttccggccgatcccacctctcctcgaccctggacgtctaccttccggaggcccacatcttgcccactccgcgcgcggggctagcgcgggtttcagcgacgggagccctcaagggacatggcaactacagcggcgccggcgggcggcgcccgaaatggagctggcccggaatggggagggttcgaagaaaacatccagggcggaggctcagctgtgattgacatggagaacatggatgatacctcaggctctagcttcgaggatatgggtgactgctgctgaagaggaggatggagagttcctgggcatgaagggctttaagggacagctgagccggcaggtggcagatcagatgtggcaggctgggaaaagacaagcctccagggccttcagcttgtacgccaacatcgacatcctcagaccctactttgatgtggagcctgctcaggtgcgaagcaggtgaggagccttctcttgaagaagcttccctcctaacacctagaccttcatgcacactacagtcagatttcaagccctgggctctgatgggctccccgtcttcatgaccccatcacctctcatcactgcacctgtcactgaaacaagtaataatagcacaccatcttcctcttcttttccatctaactgactactcatcttccctcaaaacctacctcagatgtcacttcctctgttccacattcctcaatcccatccccagtttgttctctcctggtgttcctatagaactctgtgcttgccagccgggcatggtggctcacgcctggaat

SEQ ID NO: 418818 - DNA, 2269 bp, Homo sapiens
aagaggactagaggctggagagtaaaaagaactgggggtaagagcccctctgcctagcactgctcccccaaggctcccagaaatctcaggtcagaggcacggacagcctctggagctctcgtctggtgggaccatgaactgccagcagctgtggctgggcttcctactccccatgacagtctcaggccgggtcctggggcttgcagaggtggcgcccgtggactacctgtcacaatatgggtacctacagaagcctctagaaggatctaataacttcaagccagaagatatcaccgaggctctgagagcttttcaggaagcatctgaacttccagtctcaggtcagctggatgatgccacaagggcccgcatgaggcagcctcgttgtggcctagaggatcccttcaaccagaagacccttaaatacctgttgctgggccgctggagaaagaagcacctgactttccgcatcttgaacctgccctccacccttccaccccacacagcccgggcagccctgcgtcaagccttccaggactggagcaatgtggctcccttgaccttccaagaggtgcaggctggtgcggctgacatccgcctctccttccatggccgccaaagctcgtactgttccaatacttttgatgggcctgggagagtcctggcccatgccgacatcccagagctgggcagtgtgcacttcgacgaagacgagttctggactgaggggacctaccgtggggtgaacctgcgcatcattgcagcccatgaagtgggccatgctctggggcttgggcactcccgatattcccaggccctcatggccccagtctacgagggctaccggccccactttaagctgcacccagatgatgtggcagggatccaggctctctatggcaagaagagtccagtgataagggatgaggaagaagaagagacagagctgcccactgtgcccccagtgcccacagaacccagtcccatgccagacccttgcagtagtgaactggatgccatgatgctggggccccgtgggaagacctatgctttcaagggggactatgtgtggactgtatcagattcaggaccgggccccttgttccgagtgtctgccctttgggaggggctccccggaaacctggatgctgctgtctactcgcctcgaacacaatggattcacttctttaagggagacaaggtgtggcgctacattaatttcaagatgtctcctggcttccccaagaagctgaatagggtagaacctaacctggatgcagctctctattggcctctcaaccaaaaggtgttcctctttaagggctccgggtactggcagtgggacgagctagcccgaactgacttcagcagctaccccaaaccaatcaagggtttgtttacgggagtgccaaaccagccctcggctgctatgagttggcaagatggccgagtctacttcttcaagggcaaagtctactggcgcctcaaccagcagcttcgagtagagaaaggctatcccagaaatatttcccacaactggatgcactgtcgtccccggactatagacactaccccatcaggtgggaataccactccctcaggtacgggcataaccttggataccactctctcagccacagaaaccacgtttgaatactgactgctcacccacagacacaatcttggacattaacccctgaggctccaccacccaccctttcatttcccccccagaagcctaaggcctaatagctgaatgaaatacctgtctgctcagtagaaccttgcaggtgctgtagcaggcgcaagaccgtagatctcaggcctctaacacttccaactccagccaccactttcctgtgcattttcactcctgagaagtgctcccctaactcagatcccctaacttagatttggcccccaactccatttcctgtctgtcttagacagcccttccaactgtgtcatctcttctctggaggtcaatggtggagggagatgcctgggtcctgttcttcctacataaaatgcaagaaaacagcatggccagtaaactgagcaagggccttggaatccttgagaatcacatttatgtgcttatgattacgggcaagctaattaaccttgttgaatctcagattccccatttgcaacattaggttaagaccagtactgcaggattgttgcactaaatgaaatactgtatgtgaagtgcctggcacagtgtctggtacatttgtgtttaataaaagctaactccatgttcata

SEQ ID NO: 418819 - DNA, 3832 bp, Homo sapiens
ggcacgagtctttttctcccttaagttcccctgttcaaggcataccttagaggtatgggccagagaggactgggtcagagagcagggagtggctgggaaggtaagggacagtgatgggcattcctgagagaactgggtgatgacaggggaatctgaaaggggagaaagaagcatccaagagacagtgaacatagctgggggaattttaaaggtatgcattaattagagtttataataggcagggtgtgctctagcctagcgggctctgacctccttcctgttcacctttgcctttgtccagggagagtcctggcccatgccgacatcccagagctgggcagtgtgcacttcgacgaagacgagttctggactgaggggacctaccgtggggtgaacctgcgcatcattgcagcccatgaagtgggccatgctctggggcttgggcactcccgatattcccaggccctcatggccccagtctacgagggctaccggccccactttaagctgcacccagatgatgtggcagggatccaggctctctatggcaagaagagtccagtgataagggatgaggaagaagaagagacagagctgcccactgtgcccccagtgcccacagaacccagtcccatgccagacccttgcagtagtgaactggatgccatgatgctgggtgaggcccctcccctccaggtgatcctgaggcctggacaaatgggagtgacatgggacttcagcatgagcaatggaggttagaccccaggcattaatgaccatggaaggagacatgtgacatggggagggagagttcggagccaaattaaaggtggcttaggcaggcacttaccaaggctgccacgctctaagggccactagaacacatctggaaatgcagcaagatggagaaaactatattacccagattgcctgttagagagggtgcacctggttggaaggacaactaggaagccacttggaggggagggtgaggttcctaaggaggaatagctatctgcagggcttttgttttgttgagtggaccaaagctgaaacgctctgagcaacaaagcattctgagtcctctttgtctgcctttaattttctctttgaattaaagttgaatgaatttttgaagaatcagcctgcagggagagggcaaattgttagtcagcctgagatacccccaagtttctgtctacttgacctctgtctttttgacttgttgacacaccattacgctcagggccccgtgggaagacctatgctttcaagggggactatgtgtggactgtatcagattcaggaccgggccccttgttccgagtgtctgccctttgggaggggctccccggaaacctggatgctgctgtctactcgcctcgaacacaatggattcacttctttaagggtaaggaggctagttacagtgtcttacttgaggagggcctaatcttaaagaaactataaaagggagggagatgagaagtttctgaataggtggaccggaggagaccaaaagctatcacctgaggacagaggtgacttgttctttcctcacatgctctcaggagacaaggtgtggcgctacattaatttcaagatgtctcctggcttccccaagaagctgaatagggtagaacctaacctggatgcagctctctattggcctctcaaccaaaaggtgttcctctttaaggtataaagttcaaagcaagggcaaatcccttcttaggaggagtgggctaccttatactgagaagcaaagcttgcgcttgaagggagatgttctgcagctgcagtgggctgggggtggacccctgggggtcctaagctctctcctcttcctctcccctctccccacccatcccatatccagggctccgggtactggcagtgggacgagctagcccgaactgacttcagcagctaccccaaaccaatcaagggtttgtttacgggagtgccaaaccagccctcggctgctatgagttggcaagatggccgagtctacttcttcaagggcaaagtctactggcgcctcaaccagcagcttcgagtagagaaaggctatcccagaaatatttcccacaactggatgcactgtcgtccccggactatagacactaccccatcaggtgggaataccactccctcaggtacgggcataaccttggataccactctctcagccacagaaaccacgtttgaatactgactgctcacccacagacacaatcttggacattaacccctgaggctccaccacccaccctttcatttcccccccagaagcctaaggcctaatagctgaatgaaatacctgtctgctcagtagaaccttgcaggtgctgtagcaggcgcaagaccgtagatctcaggcctctaacacttccaactccagccaccactttcctgtgcattttcactcctgagaagtgctcccctaactcagatcccctaacttagatttggcccccaactccatttcctgtctgtcttagacagcccttccaactgtgtcatctcttctctggaggtcaatggtggagggagatgcctgggtcctgttcttcctacataaaatgcaagaaaacagcatggccagtaaactgagcaagggccttggaatccttgagaatcacatttatgtgcttatgattacgggcaagctaattaaccttgttgaatctcagattccccatttgcaacattaggttaagaccagtactgcaggattgttgcactaaatgaaatactgtatgtgaagtgcctggcacagtgtctggtacatttgtgtttaataaaagctaactccatgttcataagagaggactgaacagctcttcctctagctgtctggctgtataactcttacagtagtctgtataataagggcatctctattagatctttaggggacagaggatttgtcaagatggttagctctttgttttggggtgcagagaaagaaaagagcagcaacagcagaggctggactccctggttcagtatttaatgccattttattcacatgctcccatgttctccctccctcccattgtagccttgctgcccaggggagggatatgtcttcctttatgcatctgggaaaccaggaacagaccctgcgcaggagagtcagagggggaagagttagaatgggtcagtggctggaacaaagttctggttaaggaggaaattagtgccacccacggtgagaagcagagaaggcacttgcatcctatgcagccctgaagaccaggctcctttgggcaaaaggcaagactctggcaggtgggtcaatgctctctccttggagcaagaagccagcttttggggaaggcaggtcctgaggcaggcactgccctgtggtcttccccaggttgaggagagaagtggaagccccatggaagacagtgctcccagctgaggtaggaggcggaggtgggggtgggggtagtttaagcctatggggcccagggggaaaggccaaacagaaacccaactaccccctaatgaagggcctggaggttggggtatcttggagctcctcagagcccttcttcccatcaaaaaggtatcaaatgccttggaagctccctgatcctacaaaacaaaaaaatgcttatttttaccactgtgaggcaagctgaggtgaacatttaaaaggctatttcaagacgaggtgcggtggctataatcctagcactttgggaggctgaagcaggaggatcacttgagcccaggagttcaagaccagcttgggcaacatagggagaccctgtctctgcaaaaaaataaaaacgaatacataaaaattaaaaaaaaa

SEQ ID NO: 418820 - DNA, 2023 bp, Homo sapiens
ggcacgagtctttttctcccttaagttcccctgttcaaggcataccttagaggtatgggccagagaggactgggtcagagagcagggagtggctgggaaggtaagggacagtgatgggcattcctgagagaactgggtgatgacaggggaatctgaaaggggagaaagaagcatccaagagacagtgaacatagctgggggaattttaaaggtatgcattaattagagtttataataggcagggtgtgctctagcctagcgggctctgacctccttcctgttcacctttgcctttgtccagggagagtcctggcccatgccgacatcccagagctgggcagtgtgcacttcgacgaagacgagttctggactgaggggacctaccgtggggtgaacctgcgcatcattgcagcccatgaagtgggccatgctctggggcttgggcactcccgatattcccaggccctcatggccccagtctacgagggctaccggccccactttaagctgcacccagatgatgtggcagggatccaggctctctatggcaagaagagtccagtgataagggatgaggaagaagaagagacagagctgcccactgtgcccccagtgcccacagaacccagtcccatgccagacccttgcagtagtgaactggatgccatgatgctgggtgaggcccctcccctccaggctgttggcaggcggtgggggcagcctgctgatcctgaggcctggacaaatgggagtgacatgggacttcagcatgagcaatggagggccccgtgggaagacctatgctttcaagggggactatgtgtggactgtatcagattcaggaccgggccccttgttccgagtgtctgccctttgggaggggctccccggaaacctggatgctgctgtctactcgcctcgaacacaatggattcacttctttaagggagacaaggtgtggcgctacattaatttcaagatgtctcctggcttccccaagaagctgaatagggtagaacctaacctggatgcagctctctattggcctctcaaccaaaaggtgttcctctttaagggctccgggtactggcagtgggacgagctagcccgaactgacttcagcagctaccccaaaccaatcaagggtttgtttacgggagtgccaaaccagccctcggctgctatgagttggcaagatggccgagtctacttcttcaagggcaaagtctactggcgcctcaaccagcagcttcgagtagagaaaggctatcccagaaatatttcccacaactggatgcactgtcgtccccggactatagacactaccccatcaggtgggaataccactccctcaggtacgggcataaccttggataccactctctcagccacagaaaccacgtttgaatactgactgctcacccacagacacaatcttggacattaacccctgaggctccaccacccaccctttcatttcccccccagaagcctaaggcctaatagctgaatgaaatacctgtctgctcagtagaaccttgcaggtgctgtagcaggcgcaagaccgtagatctcaggcctctaacacttccaactccagccaccactttcctgtgcattttcactcctgagaagtgctcccctaactcagatcccctaacttagatttggcccccaactccatttcctgtctgtcttagacagcccttccaactgtgtcatctcttctctggaggtcaatggtggagggagatgcctgggtcctgttcttcctacataaaatgcaagaaaacagcatggccagtaaactgagcaagggccttggaatccttgagaatcacatttatgtgcttatgattacgggcaagctaattaaccttgttgaatctcagattccccatttgcaacattaggttaagaccagtactgcaggattgttgcactaaatgaaatactgtatgtgaagtgcctggcacagtgtctggtacatttgtgtttaataaaagctaactccatgttcata

SEQ ID NO: 418821 - DNA, 3003 bp, Homo sapiens
  misc_feature (2908)..(2908): n is a, c, g, or t
aagaggactagaggctggagagtaaaaagaactgggggtaagagcccctctgcctagcactgctcccccaaggctcccagaaatctcaggtcagaggcacggacagcctctggagctctcgtctggtgggaccatgaactgccagcagctgtggctgggcttcctactccccatgacagtctcaggccgggtcctggggcttgcagaggtggcgcccgtggactacctgtcacaatatgggtacctacagaagcctctagaaggatctaataacttcaagccagaagatatcaccgaggctctgagagcttttcaggaagcatctgaacttccagtctcaggtcagctggatgatgccacaagggcccgcatgaggcagcctcgttgtggcctagaggatcccttcaaccagaagacccttaaatacctgttgctgggccgctggagaaagaagcacctgactttccgcatcttgaacctgccctccacccttccaccccacacagcccgggcagccctgcgtcaagccttccaggactggagcaatgtggctcccttgaccttccaagaggtgcaggctggtgcggctgacatccgcctctccttccatggccgccaaagctcgtactgttccaatacttttgatgggcctgggagagtcctggcccatgccgacatcccagagctgggcagtgtgcacttcgacgaagacgagttctggactgaggggacctaccgtggggtgaacctgcgcatcattgcagcccatgaagtgggccatgctctggggcttgggcactcccgatattcccaggccctcatggccccagtctacgagggctaccggccccactttaagctgcacccagatgatgtggcagggatccaggctctctatggcaagaagagtccagtgataagggatgaggaagaagaagagacagagctgcccactgtgcccccagtgcccacagaacccagtcccatgccagacccttgcagtagtgaactggatgccatgatgctggggccccgtgggaagacctatgctttcaagggggactatgtgtggactgtatcagattcaggaccgggccccttgttccgagtgtctgccctttgggaggggctccccggaaacctggatgctgctgtctactcgcctcgaacacaatggattcacttctttaagggagacaaggtgtggcgctacattaatttcaagatgtctcctggcttccccaagaagctgaatagggtagaacctaacctggatgcagctctctattggcctctcaaccaaaaggtgttcctctttaagggctccgggtactggcagtgggacgagctagcccgaactgacttcagcagctaccccaaaccaatcaagggtttgtttacgggagtgccaaaccagccctcggctgctatgagttggcaagatggccgagtctacttcttcaagggcaaagtctactggcgcctcaaccagcagcttcgagtagagaaaggctatcccagaaatatttcccacaactggatgcactgtcgtccccggactatagacactaccccatcaggtgggaataccactccctcaggtacgggcataaccttggataccactctctcagccacagaaaccacgtttgaatactgactgctcacccacagacacaatcttggacattaacccctgaggctccaccacccaccctttcatttcccccccagaagcctaaggcctaatagctgaatgaaatacctgtctgctcagtagaaccttgcaggtgctgtagcaggcgcaagaccgtagatctcaggcctctaacacttccaactccagccaccactttcctgtgcattttcactcctgagaagtgctcccctaactcagatcccctaacttagatttggcccccaactccatttcctgtctgtcttagacagcccttccaactgtgtcatctcttctctggaggtcaatggtggagggagatgcctgggtcctgttcttcctacataaaatgcaagaaaacagcatggccagtaaactgagcaagggccttggaatccttgagaatcacatttatgtgcttatgattacgggcaagctaattaaccttgttgaatctcagattccccatttgcaacattaggttaagaccagtactgcaggattgttgcactaaatgaaatactgtatgtgaagtgcctggcacagtgtctggtacatttgtgtttaataaaagctaactccatgttcataagagaggactgaacagctcttcctctagctgtctggctgtataactcttacagtagtctgtataataagggcatctctattagatctttaggggacagaggatttgtcaagatggttagctctttgttttggggtgcagagaaagaaaagagcagcaacagcagaggctggactccctggttcagtatttaatgccattttattcacatgctcccatgttctccctccctcccattgtagccttgctgcccaggggagggatatgtcttcctttatgcatctgggaaaccaggaacagaccctgcgcaggagagtcagagggggaagagttagaatgggtcagtggctggaacaaagttctggttaaggaggaaattagtgccacccacggtgagaagcagagaaggcacttgcatcctatgcagccctgaagaccaggctcctttgggcaaaaggcaagactctggcaggtgggtcaatgctctctccttggagcaagaagccagcttttggggaaggcaggtcctgaggcaggcactgccctgtggtcttccccaggttgaggagagaagtggaagccccatggaagacagtgctcccagctgaggtaggaggcggaggtgggggtgggggcccccnggtacccccgggacaatagggagccggtataaggccggtggggtgtcaattttataaccactggaagtttttttttctcttgaactttatttaaa

SEQ ID NO: 418822 - DNA, 2755 bp, Homo sapiens
aagaggactagaggctggagagtaaaaagaactgggggtaagagcccctctgcctagcactgctcccccaaggctcccagaaatctcaggtcagaggcacggacagcctctggagctctcgtctggtgggaccatgaactgccagcagctgtggctgggcttcctactccccatgacagtctcaggccgggtcctggggcttgcagaggtggcgcccgtggactacctgtcacaatatgggtacctacagaagcctctagaaggatctaataacttcaagccagaagatatcaccgaggctctgagagcttttcaggaagcatctgaacttccagtctcaggtcagctggatgatgccacaagggcccgcatgaggcagcctcgttgtggcctagaggatcccttcaaccagaagacccttaaatacctgttgctgggccgctggagaaagaagcacctgactttccgcatcttgaacctgccctccacccttccaccccacacagcccgggcagccctgcgtcaagccttccaggactggagcaatgtggctcccttgaccttccaagaggtgcaggctggtgcggctgacatccgcctctccttccatggccgccaaagctcgtactgttccaatacttttgatgggcctgggagagtcctggcccatgccgacatcccagagctgggcagtgtgcacttcgacgaagacgagttctggactgaggggacctaccgtggggtgaacctgcgcatcattgcagcccatgaagtgggccatgctctggggcttgggcactcccgatattcccaggccctcatggccccagtctacgagggctaccggccccactttaagctgcacccagatgatgtggcagggatccaggctctctatggcaagaagagtccagtgataagggatgaggaagaagaagagacagagctgcccactgtgcccccagtgcccacagaacccagtcccatgccagacccttgcagtagtgaactggatgccatgatgctggggccccgtgggaagacctatgctttcaagggggactatgtgtggactgtatcagattcaggaccgggccccttgttccgagtgtctgccctttgggaggggctccccggaaacctggatgctgctgtctactcgcctcgaacacaatggattcacttctttaagggagacaaggtgtggcgctacattaatttcaagatgtctcctggcttccccaagaagctgaatagggtagaacctaacctggatgcagctctctattggcctctcaaccaaaaggtgttcctctttaagggctccgggtactggcagtgggacgagctagcccgaactgacttcagcagctaccccaaaccaatcaagggtttgtttacgggagtgccaaaccagccctcggctgctatgagttggcaagatggccgagtctacttcttcaagggcaaagtctactggcgcctcaaccagcagcttcgagtagagaaaggctatcccagaaatatttcccacaactggatgcactgtcgtccccggactatagacactaccccatcaggtgggaataccactccctcaggtacgggcataaccttggataccactctctcagccacagaaaccacgtttgaatactgactgctcacccacagacacaatcttggacattaacccctgaggctccaccacccaccctttcatttcccccccagaagcctaaggcctaatagctgaatgaaatacctgtctgctcagtagaaccttgcaggtgctgtagcaggcgcaagaccgtagatctcaggcctctaacacttccaactccagccaccactttcctgtgcattttcactcctgagaagtgctcccctaactcagatcccctaacttagatttggcccccaactccatttcctgtctgtcttagacagcccttccaactgtgtcatctcttctctggaggtcaatggtggagggagatgcctgggtcctgttcttcctacataaaatgcaagaaaacagcatggccagtaaactgagcaagggccttggaatccttgagaatcacatttatgtgcttatgattacgggcaagctaattaaccttgttgaatctcagattccccatttgcaacattaggttaagaccagtactgcaggattgttgcactaaatgaaatactgtatgtgaagtgcctggcacagtgtctggtacatttgtgtttaataaaagctaactccatgttcataagagaggactgaacagctcttcctctagctgtctggctgtataactcttacagtagtctgtataataagggcatctctattagatctttaggggacagaggatttgtcaagatggttagctctttgttttggggtgcagagaaagaaaagagcagcaacagcagaggctggactccctggttcagtatttaatgccattttattcacatgctcccatgttctccctccctcccattgtagccttgctgcccaggggagggatatgtcttcctttatgcatctgggaaaccagcactgtgaggcaagctgaggtgaacatttaaaaggctatttcaagacgaggtgcggtggctataatcctagcactttgggaggctgaagcaggaggatcacttgagcccaggagttcaagaccagcttgggcaacatagggagaccctgtctctgcaaaaaaataaaaacgaatacataaaaattaaaaaaaaa

SEQ ID NO: 418823 - DNA, 2610 bp, Homo sapiens
aagaggactagaggctggagagtaaaaagaactgggggtaagagcccctctgcctagcactgctcccccaaggctcccagaaatctcaggtcagaggcacggacagcctctggagctctcgtctggtgggaccatgaactgccagcagctgtggctgggcttcctactccccatgacagtctcaggccgggtcctggggcttgcagaggtggcgcccgtggactacctgtcacaatatgggtacctacagaagcctctagaaggatctaataacttcaagccagaagatatcaccgaggctctgagagcttttcaggaagcatctgaacttccagtctcaggtcagctggatgatgccacaagggcccgcatgaggcagcctcgttgtggcctagaggatcccttcaaccagaagacccttaaatacctgttgctgggccgctggagaaagaagcacctgactttccgcatcttgaacctgccctccacccttccaccccacacagcccgggcagccctgcgtcaagccttccaggactggagcaatgtggctcccttgaccttccaagaggtgcaggctggtgcggctgacatccgcctctccttccatggccgccaaagctcgtactgttccaatacttttgatgggcctgggagagtcctggcccatgccgacatcccagagctgggcagtgtgcacttcgacgaagacgagttctggactgaggggacctaccgtggggtgaacctgcgcatcattgcagcccatgaagtgggccatgctctggggcttgggcactcccgatattcccaggccctcatggccccagtctacgagggctaccggccccactttaagctgcacccagatgatgtggcagggatccaggctctctatggcaagaagagtccagtgataagggatgaggaagaagaagagacagagctgcccactgtgcccccagtgcccacagaacccagtcccatgccagacccttgcagtagtgaactggatgccatgatgctggggccccgtgggaagacctatgctttcaagggggactatgtgtggactgtatcagattcaggaccgggccccttgttccgagtgtctgccctttgggaggggctccccggaaacctggatgctgctgtctactcgcctcgaacacaatggattcacttctttaagggagacaaggtgtggcgctacattaatttcaagatgtctcctggcttccccaagaagctgaatagggtagaacctaacctggatgcagctctctattggcctctcaaccaaaaggtgttcctctttaagggctccgggtactggcagtgggacgagctagcccgaactgacttcagcagctaccccaaaccaatcaagggtttgtttacgggagtgccaaaccagccctcggctgctatgagttggcaagatggccgagtctacttcttcaagggcaaagtctactggcgcctcaaccagcagcttcgagtagagaaaggctatcccagaaatatttcccacaactggatgcactgtcgtccccggactatagacactaccccatcaggtgggaataccactccctcaggtacgggcataaccttggataccactctctcagccacagaaaccacgtttgaatactgactgctcacccacagacacaatcttggacattaacccctgaggctccaccacccaccctttcatttcccccccagaagcctaaggcctaatagctgaatgaaatacctgtctgctcagtagaaccttgcaggtgctgtagcaggcgcaagaccgtagatctcaggcctctaacacttccaactccagccaccactttcctgtgcattttcactcctgagaagtgctcccctaactcagatcccctaacttagatttggcccccaactccatttcctgtctgtcttagacagcccttccaactgtgtcatctcttctctggaggtcaatggtggagggagatgcctgggtcctgttcttcctacataaaatgcaagaaaacagcatggccagtaaactgagcaagggccttggaatccttgagaatcacatttatgtgcttatgattacgggcaagctaattaaccttgttgaatctcagattccccatttgcaacattaggttaagaccagtactgcaggattgttgcactaaatgaaatactgtatgtgaagtgcctggcacagtgtctggtacatttgtgtttaataaaagctaactccatgttcataagagaggactgaacagctcttcctctagctgtctggctgtataactcttacagtagtctgtataataagggcatctctattagatctttaggggacagaggatttgtcaagatggttagctctttgttttggggtgcagagaaagaaaagagcagcaacagcagaggctggactccctggttcagtatttaatgccattttattcacatgctcccatgttctccctccctcccattgtagccttgctgcccaggggagggatatgtcttcctttatgcatctgggaaaccagaacggacagaccgtgagacatcgcagggatcctctaatcacctttgcaa

SEQ ID NO: 418824 - DNA, 1922 bp, Homo sapiens
aagaggactagaggctggagagtaaaaagaactgggggtaagagcccctctgcctagcactgctcccccaaggctcccagaaatctcaggtcagaggcacggacagcctctggagctctcgtctggtgggaccatgaactgccagcagctgtggctgggcttcctactccccatgacagtctcaggccgggtcctggggcttgcagaggtggcgcccgtggactacctgtcacaatatgggtacctacagaagcctctagaaggatctaataacttcaagccagaagatatcaccgaggctctgagggagagtcctggcccatgccgacatcccagagctgggcagtgtgcacttcgacgaagacgagttctggactgaggggacctaccgtggggtgaacctgcgcatcattgcagcccatgaagtgggccatgctctggggcttgggcactcccgatattcccaggccctcatggccccagtctacgagggctaccggccccactttaagctgcacccagatgatgtggcagggatccaggctctctatggcaagaagagtccagtgataagggatgaggaagaagaagagacagagctgcccactgtgcccccagtgcccacagaacccagtcccatgccagacccttgcagtagtgaactggatgccatgatgctggggccccgtgggaagacctatgctttcaagggggactatgtgtggactgtatcagattcaggaccgggccccttgttccgagtgtctgccctttgggaggggctccccggaaacctggatgctgctgtctactcgcctcgaacacaatggattcacttctttaagggagacaaggtgtggcgctacattaatttcaagatgtctcctggcttccccaagaagctgaatagggtagaacctaacctggatgcagctctctattggcctctcaaccaaaaggtgttcctctttaagggctccgggtactggcagtgggacgagctagcccgaactgacttcagcagctaccccaaaccaatcaagggtttgtttacgggagtgccaaaccagccctcggctgctatgagttggcaagatggccgagtctacttcttcaagggcaaagtctactggcgcctcaaccagcagcttcgagtagagaaaggctatcccagaaatatttcccacaactggatgcactgtcgtccccggactatagacactaccccatcaggtgggaataccactccctcaggtacgggcataaccttggataccactctctcagccacagaaaccacgtttgaatactgactgctcacccacagacacaatcttggacattaacccctgaggctccaccacccaccctttcatttcccccccagaagcctaaggcctaatagctgaatgaaatacctgtctgctcagtagaaccttgcaggtgctgtagcaggcgcaagaccgtagatctcaggcctctaacacttccaactccagccaccactttcctgtgcattttcactcctgagaagtgctcccctaactcagatcccctaacttagatttggcccccaactccatttcctgtctgtcttagacagcccttccaactgtgtcatctcttctctggaggtcaatggtggagggagatgcctgggtcctgttcttcctacataaaatgcaagaaaacagcatggccagtaaactgagcaagggccttggaatccttgagaatcacatttatgtgcttatgattacgggcaagctaattaaccttgttgaatctcagattccccatttgcaacattaggttaagaccagtactgcaggattgttgcactaaatgaaatactgtatgtgaagtgcctggcacagtgtctggtacatttgtgtttaataaaagctaactccatgttcata

SEQ ID NO: 418825 - DNA, 2309 bp, Homo sapiens
tagagatggggtttcaccatgttgcccaggctggtcttaaattcctgagctcaggcaatccacccgcctcagcctcccaaagtcctaggattataggcgtgagccaccacacccggcaagaatgcacattttaacaatcctccttctccctttctggtgtctctcaaacctagaacgtgtctcccgctgatatcaacataatattgcctaccacaaatgaaaacgctctaggattcccttttcccctctgtatggggactctgagcaaaacttacaggagactggtgtggaggacaggtgctgtgagttctctccctaagcagcattactttaccttataggcaagaagagtccagtgataagggatgaggaagaagaagagacagagctgcccactgtgcccccagtgcccacagaacccagtcccatgccagacccttgcagtagtgaactggatgccatgatgctgggtgaggcccctcccctccaggctgttggcaggcggtgggggcagcctgctgatcctgaggcctggacaaatgggagtgacatgggacttcagcatgagcaatggaggttagaccccaggcattaatgaccatggaaggagacatgtgacatggggagggagagttcggagccaaattaaaggtggcttaggcaggcacttaccaaggctgccacgctctaagggccactagaacacatctggaaatgcagcaagatggagaaaactatattacccagattgcctgttagagagggtgcacctggttggaaggacaactaggaagccacttggaggggagggtgaggttcctaaggaggaatagctatctgcagggcttttgttttgttgagtggaccaaagctgaaacgctctgagcaacaaagcattctgagtcctctttgtctgcctttaattttctctttgaattaaagttgaatgaatttttgaagaatcagcctgcagggagagggcaaattgttagtcagcctgagatacccccaagtttctgtctacttgacctctgtctttttgacttgttgacacaccattacgctcagggccccgtgggaagacctatgctttcaagggggactatgtgtggactgtatcagattcaggaccgggccccttgttccgagtgtctgccctttgggaggggctccccggaaacctggatgctgctgtctactcgcctcgaacacaatggattcacttctttaagggagacaaggtgtggcgctacattaatttcaagatgtctcctggcttccccaagaagctgaatagggtagaacctaacctggatgcagctctctattggcctctcaaccaaaaggtgttcctctttaagggctccgggtactggcagtgggacgagctagcccgaactgacttcagcagctaccccaaaccaatcaagggtttgtttacgggagtgccaaaccagccctcggctgctatgagttggcaagatggccgagtctacttcttcaagggcaaagtctactggcgcctcaaccagcagcttcgagtagagaaaggctatcccagaaatatttcccacaactggatgcactgtcgtccccggactatagacactaccccatcaggtgggaataccactccctcaggtacgggcataaccttggataccactctctcagccacagaaaccacgtttgaatactgactgctcacccacagacacaatcttggacattaacccctgaggctccaccacccaccctttcatttcccccccagaagcctaaggcctaatagctgaatgaaatacctgtctgctcagtagaaccttgcaggtgctgtagcaggcgcaagaccgtagatctcaggcctctaacacttccaactccagccaccactttcctgtgcattttcactcctgagaagtgctcccctaactcagatcccctaacttagatttggcccccaactccatttcctgtctgtcttagacagcccttccaactgtgtcatctcttctctggaggtcaatggtggagggagatgcctgggtcctgttcttcctacataaaatgcaagaaaacagcatggccagtaaactgagcaagggccttggaatccttgagaatcacatttatgtgcttatgattacgggcaagctaattaaccttgttgaatctcagattccccatttgcaacattaggttaagaccagtactgcaggattgttgcactaaatgaaatactgtatgtgaagtgcctggcacagtgtctggtacatttgtgtttaataaaagctaactccatgttcata

SEQ ID NO: 418826 - DNA, 959 bp, Homo sapiens
ctggtgatctagaggatcccatctcaggccaggacgagctagcccgaactgacttcagcagctaccccaaaccaatcaagggtttgtttacgggagtgccaaaccagccctcggctgctatgagttggcaagatggccgagtctacttcttcaagggcaaagtctactggcgcctcaaccagcagcttcgagtagagaaaggctatcccagaaatatttcccacaactggatgcactgtcgtccccggactatagacactaccccatcaggtgggaataccactccctcaggtacgggcataaccttggataccactctctcagccacagaaaccacgtttgaatactgactgctcacccacagacacaatcttggacattaacccctgaggctccaccacccaccctttcatttcccccccagaagcctaaggcctaatagctgaatgaaatacctgtctgctcagtagaaccttgcaggtgctgtagcaggcgcaagaccgtagatctcaggcctctaacacttccaactccagccaccactttcctgtgcattttcactcctgagaagtgctcccctaactcagatcccctaacttagatttggcccccaactccatttcctgtctgtcttagacagcccttccaactgtgtcatctcttctctggaggtcaatggtggagggagatgcctgggtcctgttcttcctacataaaatgcaagaaaacagcatggccagtaaactgagcaagggccttggaatccttgagaatcacatttatgtgcttatgattacgggcaagctaattaaccttgttgaatctcagattccccatttgcaacattaggttaagaccagtactgcaggattgttgcactaaatgaaatactgtatgtgaagtgcctggcacagtgtctggtacatttgtgtttaataaaagctaactccatgttcata

SEQ ID NO: 418827 - DNA, 1584 bp, Homo sapiens
aagaggactagaggctggagagtaaaaagaactgggggtaagagcccctctgcctagcactgctcccccaaggctcccagaaatctcaggtcagaggcacggacagcctctggagctctcgtctggtgggaccatgaactgccagcagctgtggctgggcttcctactccccatgacagtctcaggccgggtcctggggcttgcagaggtggcgcccgtggactacctgtcacaatatgggtacctacagaagcctctagaaggatctaataacttcaagccagaagatatcaccgaggctctgagagcttttcaggaagcatctgaacttccagtctcaggtcagctggatgatgccacaagggcccgcatgaggcagcctcgttgtggcctagaggatcccttcaaccagaagacccttaaatacctgttgctgggccgctggagaaagaagcacctgactttccgcatcttgaacctgccctccacccttccaccccacacagcccgggcagccctgcgtcaagccttccaggactggagcaatgtggctcccttgaccttccaagaggtgcaggctggtgcggctgacatccgcctctccttccatggccgccaaagctcgtactgttccaatacttttgatgggcctgggagagtcctggcccatgccgacatcccagagctgggcagtgtgcacttcgacgaagacgagttctggactgaggggacctaccgtggggtgaacctgcgcatcattgcagcccatgaagtgggccatgctctggggcttgggcactcccgatattcccaggccctcatggccccagtctacgagggctaccggccccactttaagctgcacccagatgatgtggcagggatccaggctctctatggcaagaagagtccagtgataagggatgaggaagaagaagagacagagctgcccactgtgcccccagtgcccacagaacccagtcccatgccagacccttgcagtagtgaactggatgccatgatgctggggccccgtgggaagacctatgctttcaagggggactatgtgtggactgtatcagattcaggaccgggccccttgttccgagtgtctgccctttgggaggggctccccggaaacctggatgctgctgtctactcgcctcgaacacaatggattcacttctttaagggagacaaggtgtggcgctacattaatttcaagatgtctcctggcttccccaagaagctgaatagggtagaacctaacctggatgcagctctctattggcctctcaaccaaaaggtgttcctctttaagggctccgggtactggcagtgggacgagctagcccgaactgacttcagcagctaccccaaaccaatcaagggtttgtttacgggagtgccaaaccagccctcggctgctatgagttggcaagatggccgagtctacttcttcaagggcaaagtctactggcgcctcaaccagcagcttcgagtagagaaaggctatcccagaaatatttcccacaactggatgcactgtcgtcctggcctgagatgggatcctctagaccacct

SEQ ID NO: 418828 - DNA, 3274 bp, Homo sapiens
aagaggactagaggctggagagtaaaaagaactgggggtaagagcccctctgcctagcactgctcccccaaggctcccagaaatctcaggtcagaggcacggacagcctctggagctctcgtctggtgggaccatgaactgccagcagctgtggctgggcttcctactccccatgacagtctcaggccgggtcctggggcttgcagaggtggcgcccgtggactacctgtcacaatatgggtacctacagaagcctctagaaggatctaataacttcaagccagaagatatcaccgaggctctgagagcttttcaggaagcatctgaacttccagtctcaggtcagctggatgatgccacaagggcccgcatgaggcagcctcgttgtggcctagaggatcccttcaaccagaagacccttaaatacctgttgctgggccgctggagaaagaagcacctgactttccgcatcttgaacctgccctccacccttccaccccacacagcccgggcagccctgcgtcaagccttccaggactggagcaatgtggctcccttgaccttccaagaggtgcaggctggtgcggctgacatccgcctctccttccatggccgccaaagctcgtactgttccaatacttttgatgggcctgggagagtcctggcccatgccgacatcccagagctgggcagtgtgcacttcgacgaagacgagttctggactgaggggacctaccgtggggtgaacctgcgcatcattgcagcccatgaagtgggccatgctctggggcttgggcactcccgatattcccaggccctcatggccccagtctacgagggctaccggccccactttaagctgcacccagatgatgtggcagggatccaggctctctatggcaagaagagtccagtgataagggatgaggaagaagaagagacagagctgcccactgtgcccccagtgcccacagaacccagtcccatgccagacccttgcagtagtgaactggatgccatgatgctggggccccgtgggaagacctatgctttcaagggggactatgtgtggactgtatcagattcaggaccgggccccttgttccgagtgtctgccctttgggaggggctccccggaaacctggatgctgctgtctactcgcctcgaacacaatggattcacttctttaagggagacaaggtgtggcgctacattaatttcaagatgtctcctggcttccccaagaagctgaatagggtagaacctaacctggatgcagctctctattggcctctcaaccaaaaggtgttcctctttaagggctccgggtactggcagtgggacgagctagcccgaactgacttcagcagctaccccaaaccaatcaagggtttgtttacgggagtgccaaaccagccctcggctgctatgagttggcaagatggccgagtctacttcttcaagggcaaagtctactggcgcctcaaccagcagcttcgagtagagaaaggctatcccagaaatatttcccacaactggatgcactgtcgtccccggactatagacactaccccatcaggtgggaataccactccctcaggtacgggcataaccttggataccactctctcagccacagaaaccacgtttgaatactgactgctcacccacagacacaatcttggacattaacccctgaggctccaccacccaccctttcatttcccccccagaagcctaaggcctaatagctgaatgaaatacctgtctgctcagtagaaccttgcaggtgctgtagcaggcgcaagaccgtagatctcaggcctctaacacttccaactccagccaccactttcctgtgcattttcactcctgagaagtgctcccctaactcagatcccctaacttagatttggcccccaactccatttcctgtctgtcttagacagcccttccaactgtgtcatctcttctctggaggtcaatggtggagggagatgcctgggtcctgttcttcctacataaaatgcaagaaaacagcatggccagtaaactgagcaagggccttggaatccttgagaatcacatttatgtgcttatgattacgggcaagctaattaaccttgttgaatctcagattccccatttgcaacattaggttaagaccagtactgcaggattgttgcactaaatgaaatactgtatgtgaagtgcctggcacagtgtctggtacatttgtgtttaataaaagctaactccatgttcataagagaggactgaacagctcttcctctagctgtctggctgtataactcttacagtagtctgtataataagggcatctctattagatctttaggggacagaggatttgtcaagatggttagctctttgttttggggtgcagagaaagaaaagagcagcaacagcagaggctggactccctggttcagtatttaatgccattttattcacatgctcccatgttctccctccctcccattgtagccttgctgcccaggggagggatatgtcttcctttatgcatctgggaaaccaggaacagaccctgcgcaggagagtcagagggggaagagttagaatgggtcagtggctggaacaaagttctggttaaggaggaaattagtgccacccacggtgagaagcagagaaggcacttgcatcctatgcagccctgaagaccaggctcctttgggcaaaaggcaagactctggcaggtgggtcaatgctctctccttggagcaagaagccagcttttggggaaggcaggtcctgaggcaggcactgccctgtggtcttccccaggttgaggagagaagtggaagccccatggaagacagtgctcccagctgaggtaggaggcggaggtgggggtgggggtagtttaagcctatggggcccagggggaaaggccaaacagaaacccaactaccccctaatgaagggcctggaggttggggtatcttggagctcctcagagcccttcttcccatcaaaaaggtatcaaatgccttggaagctccctgatcctacaaaacaaaaaaatgcttatttttaccactgtgaggcaagctgaggtgaacatttaaaaggctatttcaagacgaggtgcggtggctataatcctagcactttgggaggctgaagcaggaggatcacttgagcccaggagttcaagaccagcttgggcaacatagggagaccctgtctctgcaaaaaaataaaaacgaatacataaaaattaaaaaaaaa

SEQ ID NO: 418829 - DNA, 2346 bp, Homo sapiens
aagaggactagaggctggagagtaaaaagaactgggggtaagagcccctctgcctagcactgctcccccaaggctcccagaaatctcaggtcagaggcacggacagcctctggagctctcgtctggtgggaccatgaactgccagcagctgtggctgggcttcctactccccatgacagtctcaggccgggtcctggggcttgcagaggtggcgcccgtggactacctgtcacaatatgggtacctacagaagcctctagaaggatctaataacttcaagccagaagatatcaccgaggctctgagtctcaggtcagctggatgatgccacaagggcccgcatgaggcagcctcgttgtggcctagaggatcccttcaaccagaagacccttaaatacctgttgctgggccgctggagaaagaagcacctgactttccgcatcttgaacctgccctccacccttccaccccacacagcccgggcagccctgcgtcaagccttccaggactggagcaatgtggctcccttgaccttccaagaggtgcaggctggtgcggctgacatccgcctctccttccatggccgccaaagctcgtactgttccaatacttttgatgggcctgggagagtcctggcccatgccgacatcccagagctgggcagtgtgcacttcgacgaagacgagttctggactgaggggacctaccgtggggtgaacctgcgcatcattgcagcccatgaagtgggccatgctctggggcttgggcactcccgatattcccaggccctcatggccccagtctacgagggctaccggccccactttaagctgcacccagatgatgtggcagggatccaggctctctatggcaagaagagtccagtgataagggatgaggaagaagaagagacagagctgcccactgtgcccccagtgcccacagaacccagtcccatgccagacccttgcagtagtgaactggatgccatgatgctgggtgaggcccctcccctccaggctgttggcaggcggtgggggcagcctgctgatcctgaggcctggacaaatgggagtgacatgggacttcagcatgagcaatggagggccccgtgggaagacctatgctttcaagggggactatgtgtggactgtatcagattcaggaccgggccccttgttccgagtgtctgccctttgggaggggctccccggaaacctggatgctgctgtctactcgcctcgaacacaatggattcacttctttaagggagacaaggtgtggcgctacattaatttcaagatgtctcctggcttccccaagaagctgaatagggtagaacctaacctggatgcagctctctattggcctctcaaccaaaaggtgttcctctttaagggctccgggtactggcagtgggacgagctagcccgaactgacttcagcagctaccccaaaccaatcaagggtttgtttacgggagtgccaaaccagccctcggctgctatgagttggcaagatggccgagtctacttcttcaagggcaaagtctactggcgcctcaaccagcagcttcgagtagagaaaggctatcccagaaatatttcccacaactggatgcactgtcgtccccggactatagacactaccccatcaggtgggaataccactccctcaggtacgggcataaccttggataccactctctcagccacagaaaccacgtttgaatactgactgctcacccacagacacaatcttggacattaacccctgaggctccaccacccaccctttcatttcccccccagaagcctaaggcctaatagctgaatgaaatacctgtctgctcagtagaaccttgcaggtgctgtagcaggcgcaagaccgtagatctcaggcctctaacacttccaactccagccaccactttcctgtgcattttcactcctgagaagtgctcccctaactcagatcccctaacttagatttggcccccaactccatttcctgtctgtcttagacagcccttccaactgtgtcatctcttctctggaggtcaatggtggagggagatgcctgggtcctgttcttcctacataaaatgcaagaaaacagcatggccagtaaactgagcaagggccttggaatccttgagaatcacatttatgtgcttatgattacgggcaagctaattaaccttgttgaatctcagattccccatttgcaacattaggttaagaccagtactgcaggattgttgcactaaatgaaatactgtatgtgaagtgcctggcacagtgtctggtacatttgtgtttaataaaagctaactccatgttcata

SEQ ID NO: 418830 - DNA, 274 bp, Homo sapiens
ctggtgatctagaggatcccatctcaggccaggacgagctagcccgaactgacttcagcagctaccccaaaccaatcaagggtttgtttacgggagtgccaaaccagccctcggctgctatgagttggcaagatggccgagtctacttcttcaagggcaaagtctactggcgcctcaaccagcagcttcgagtagagaaaggctatcccagaaatatttcccacaactggatgcactgtcgtcctggcctgagatgggatcctctagaccacct

SEQ ID NO: 418831 - DNA, 2867 bp, Homo sapiens
aagaggactagaggctggagagtaaaaagaactgggggtaagagcccctctgcctagcactgctcccccaaggctcccagaaatctcaggtcagaggcacggacagcctctggagctctcgtctggtgggaccatgaactgccagcagctgtggctgggcttcctactccccatgacagtctcaggccgggtcctggggcttgcagaggtggcgcccgtggactacctgtcacaatatgggtacctacagaagcctctagaaggatctaataacttcaagccagaagatatcaccgaggctctgagagcttttcaggaagcatctgaacttccagtctcaggtcagctggatgatgccacaagggcccgcatgaggcagcctcgttgtggcctagaggatcccttcaaccagaagacccttaaatacctgttgctgggccgctggagaaagaagcacctgactttccgcatcttgaacctgccctccacccttccaccccacacagcccgggcagccctgcgtcaagccttccaggactggagcaatgtggctcccttgaccttccaagaggtgcaggctggtgcggctgacatccgcctctccttccatggccgccaaagctcgtactgttccaatacttttgatgggcctgggagagtcctggcccatgccgacatcccagagctgggcagtgtgcacttcgacgaagacgagttctggactgaggggacctaccgtggggtgaacctgcgcatcattgcagcccatgaagtgggccatgctctggggcttgggcactcccgatattcccaggccctcatggccccagtctacgagggctaccggccccactttaagctgcacccagatgatgtggcagggatccaggctctctatggcaagaagagtccagtgataagggatgaggaagaagaagagacagagctgcccactgtgcccccagtgcccacagaacccagtcccatgccagacccttgcagtagtgaactggatgccatgatgctgggtgaggcccctcccctccaggctgttggcaggcggtgggggcagcctgctgatcctgaggcctggacaaatgggagtgacatgggacttcagcatgagcaatggaggttagaccccaggcattaatgaccatggaaggagacatgtgacatggggagggagagttcggagccaaattaaaggtggcttaggcaggcacttaccaaggctgccacgctctaagggccactagaacacatctggaaatgcagcaagatggagaaaactatattacccagattgcctgttagagagggtgcacctggttggaaggacaactaggaagccacttggaggggagggtgaggttcctaaggaggaatagctatctgcagggcttttgttttgttgagtggaccaaagctgaaacgctctgagcaacaaagcattctgagtcctctttgtctgcctttaattttctctttgaattaaagttgaatgaatttttgaagaatcagcctgcagggagagggcaaattgttagtcagcctgagatacccccaagtttctgtctacttgacctctgtctttttgacttgttgacacaccattacgctcagggccccgtgggaagacctatgctttcaagggggactatgtgtggactgtatcagattcaggaccgggccccttgttccgagtgtctgccctttgggaggggctccccggaaacctggatgctgctgtctactcgcctcgaacacaatggattcacttctttaagggagacaaggtgtggcgctacattaatttcaagatgtctcctggcttccccaagaagctgaatagggtagaacctaacctggatgcagctctctattggcctctcaaccaaaaggtgttcctctttaagggctccgggtactggcagtgggacgagctagcccgaactgacttcagcagctaccccaaaccaatcaagggtttgtttacgggagtgccaaaccagccctcggctgctatgagttggcaagatggccgagtctacttcttcaagggcaaagtctactggcgcctcaaccagcagcttcgagtagagaaaggctatcccagaaatatttcccacaactggatgcactgtcgtccccggactatagacactaccccatcaggtgggaataccactccctcaggtacgggcataaccttggataccactctctcagccacagaaaccacgtttgaatactgactgctcacccacagacacaatcttggacattaacccctgaggctccaccacccaccctttcatttcccccccagaagcctaaggcctaatagctgaatgaaatacctgtctgctcagtagaaccttgcaggtgctgtagcaggcgcaagaccgtagatctcaggcctctaacacttccaactccagccaccactttcctgtgcattttcactcctgagaagtgctcccctaactcagatcccctaacttagatttggcccccaactccatttcctgtctgtcttagacagcccttccaactgtgtcatctcttctctggaggtcaatggtggagggagatgcctgggtcctgttcttcctacataaaatgcaagaaaacagcatggccagtaaactgagcaagggccttggaatccttgagaatcacatttatgtgcttatgattacgggcaagctaattaaccttgttgaatctcagattccccatttgcaacattaggttaagaccagtactgcaggattgttgcactaaatgaaatactgtatgtgaagtgcctggcacagtgtctggtacatttgtgtttaataaaagctaactccatgttcata

SEQ ID NO: 418832 - DNA, 2449 bp, Homo sapiens
aagaggactagaggctggagagtaaaaagaactgggggtaagagcccctctgcctagcactgctcccccaaggctcccagaaatctcaggtcagaggcacggacagcctctggagctctcgtctggtgggaccatgaactgccagcagctgtggctgggcttcctactccccatgacagtctcaggccgggtcctggggcttgcagaggtggcgcccgtggactacctgtcacaatatgggtacctacagaagcctctagaaggatctaataacttcaagccagaagatatcaccgaggctctgagagcttttcaggaagcatctgaacttccagtctcaggtcagctggatgatgccacaagggcccgcatgaggcagcctcgttgtggcctagaggatcccttcaaccagaagacccttaaatacctgttgctgggccgctggagaaagaagcacctgactttccgcatcttgaacctgccctccacccttccaccccacacagcccgggcagccctgcgtcaagccttccaggactggagcaatgtggctcccttgaccttccaagaggtgcaggctggtgcggctgacatccgcctctccttccatggccgccaaagctcgtactgttccaatacttttgatgggcctgggagagtcctggcccatgccgacatcccagagctgggcagtgtgcacttcgacgaagacgagttctggactgaggggacctaccgtggggtgaacctgcgcatcattgcagcccatgaagtgggccatgctctggggcttgggcactcccgatattcccaggccctcatggccccagtctacgagggctaccggccccactttaagctgcacccagatgatgtggcagggatccaggctctctatggcaagaagagtccagtgataagggatgaggaagaagaagagacagagctgcccactgtgcccccagtgcccacagaacccagtcccatgccagacccttgcagtagtgaactggatgccatgatgctggggccccgtgggaagacctatgctttcaagggggactatgtgtggactgtatcagattcaggaccgggccccttgttccgagtgtctgccctttgggaggggctccccggaaacctggatgctgctgtctactcgcctcgaacacaatggattcacttctttaagggagacaaggtgtggcgctacattaatttcaagatgtctcctggcttccccaagaagctgaatagggtagaacctaacctggatgcagctctctattggcctctcaaccaaaaggtgttcctctttaaggtataaagttcaaagcaagggcaaatcccttcttaggaggagtgggctaccttatactgagaagcaaagcttgcgcttgaagggagatgttctgcagctgcagtgggctgggggtggacccctgggggtcctaagctctctcctcttcctctcccctctccccacccatcccatatccagggctccgggtactggcagtgggacgagctagcccgaactgacttcagcagctaccccaaaccaatcaagggtttgtttacgggagtgccaaaccagccctcggctgctatgagttggcaagatggccgagtctacttcttcaagggcaaagtctactggcgcctcaaccagcagcttcgagtagagaaaggctatcccagaaatatttcccacaactggatgcactgtcgtccccggactatagacactaccccatcaggtgggaataccactccctcaggtacgggcataaccttggataccactctctcagccacagaaaccacgtttgaatactgactgctcacccacagacacaatcttggacattaacccctgaggctccaccacccaccctttcatttcccccccagaagcctaaggcctaatagctgaatgaaatacctgtctgctcagtagaaccttgcaggtgctgtagcaggcgcaagaccgtagatctcaggcctctaacacttccaactccagccaccactttcctgtgcattttcactcctgagaagtgctcccctaactcagatcccctaacttagatttggcccccaactccatttcctgtctgtcttagacagcccttccaactgtgtcatctcttctctggaggtcaatggtggagggagatgcctgggtcctgttcttcctacataaaatgcaagaaaacagcatggccagtaaactgagcaagggccttggaatccttgagaatcacatttatgtgcttatgattacgggcaagctaattaaccttgttgaatctcagattccccatttgcaacattaggttaagaccagtactgcaggattgttgcactaaatgaaatactgtatgtgaagtgcctggcacagtgtctggtacatttgtgtttaataaaagctaactccatgttcata

SEQ ID NO: 418833 - DNA, 1193 bp, Homo sapiens
cactgaatttgtgatagcagatctagaggtatcacctcggacgtgttatccccgggaatactggatgctgtcgctgtgtactcgcctcgagcacaactggattcacattctttaagggagacaaggtgtggcgctacattaatttcaagatgtctcctggcttccccaagaagctgaatagggtagaacctaacctggatgcagctctctattggcctctcaaccaaaaggtgttcctctttaagggctccgggtactggcagtgggacgagctagcccgaactgacttcagcagctaccccaaaccaatcaagggtttgtttacgggagtgccaaaccagccctcggctgctatgagttggcaagatggccgagtctacttcttcaagggcaaagtctactggcgcctcaaccagcagcttcgagtagagaaaggctatcccagaaatatttcccacaactggatgcactgtcgtccccggactatagacactaccccatcaggtgggaataccactccctcaggtacgggcataaccttggataccactctctcagccacagaaaccacgtttgaatactgactgctcacccacagacacaatcttggacattaacccctgaggctccaccacccaccctttcatttcccccccagaagcctaaggcctaatagctgaatgaaatacctgtctgctcagtagaaccttgcaggtgctgtagcaggcgcaagaccgtagatctcaggcctctaacacttccaactccagccaccactttcctgtgcattttcactcctgagaagtgctcccctaactcagatcccctaacttagatttggcccccaactccatttcctgtctgtcttagacagcccttccaactgtgtcatctcttctctggaggtcaatggtggagggagatgcctgggtcctgttcttcctacataaaatgcaagaaaacagcatggccagtaaactgagcaagggccttggaatccttgagaatcacatttatgtgcttatgattacgggcaagctaattaaccttgttgaatctcagattccccatttgcaacattaggttaagaccagtactgcaggattgttgcactaaatgaaatactgtatgtgaagtgcctggcacagtgtctggtacatttgtgtttaataaaagctaactccatgttcata

SEQ ID NO: 418834 - DNA, 6047 bp, Homo sapiens
  misc_feature (193)..(193): n is a, c, g, or t
  misc_feature (2070)..(2070): n is a, c, g, or t
  misc_feature (2101)..(2101): n is a, c, g, or t
  misc_feature (2145)..(2145): n is a, c, g, or t
  misc_feature (2162)..(2162): n is a, c, g, or t
  misc_feature (2184)..(2184): n is a, c, g, or t
  misc_feature (2186)..(2186): n is a, c, g, or t
  misc_feature (2219)..(2219): n is a, c, g, or t
  misc_feature (2228)..(2228): n is a, c, g, or t
  misc_feature (2235)..(2235): n is a, c, g, or t
  misc_feature (2321)..(2321): n is a, c, g, or t
  misc_feature (2552)..(2552): n is a, c, g, or t
  misc_feature (2686)..(2686): n is a, c, g, or t
  misc_feature (3344)..(3344): n is a, c, g, or t
  misc_feature (3531)..(3531): n is a, c, g, or t
  misc_feature (3976)..(3976): n is a, c, g, or t
  misc_feature (4079)..(4079): n is a, c, g, or t
  misc_feature (4560)..(4560): n is a, c, g, or t
agaagggcgctgagaagggagctggaaggaaaagaaggaaacattccttcctcaactggaggaagacacgcggccacacacagaaccagcggccccaggaccgtcaccctgcgtgcccgggcctgtccctcctgaccccaggattatagtggcgaggcagggtgttagccaagcggattgagccaggacacancaccgcggagccctgcaggcgagtcctccggaggctgagagcaaacggctgcactaggaacccagcagtcagaccggcccccaccctggagtgaacacatcgccactgccaggcatcgcagggaggactaccccaatggcacctggctgggcgacgagaacaaccccgagatgcgggtacgctgcgccatcatcccctccgacatgctgcacatcagcaccaactgccgcacggccgagaagatggcgctaacgctgctggactacctcttccaccgcgaggtgcaggctgtgtccaacctctcggggcagggcaagcacgggaagaagcagctggacccgctcaccatctacggcatccggtgtcaccttttctataaatttggcatcacagaatccgactggtaccgaatcaagcagagcatcgactccaagtgccgcacggcgtggcggcgcaagcagcggggccagagcctggcggtcaagagcttctcgcggagaacgcccaactcgtcctcctactgcccttcagagccgatgatgagcaccccacctcctgccagcgagctcccgcagccacagccgcagccgcaggccctgcactacgcgctggccaacgcacagcaggtgcagatccaccagatcggagaagacggacaggtgcaagtaatcccacagggacacctccacatcgcccaggtgccgcagggggagcaagtccagatcacgcaggacagcgaggagcccgtgttctggtactacgtgaaggaggtcctcaacaagcacgagctgcaagcgcttctactccctgcgccacatcgcctcagacgtgggccggggccgcacctggctgcgctgtgccctcaacgaacactccctggagcgctacctgcacatgctcctggccgaccgctgcaggctcagtactttttatgaagactggtcttttgtgatggatgaagagaggtccagtatgcttcctaccatggcagcaggtccgaactccatactctttgcgattaacattgacaacaaggatttgaacgggcagagtaagtttgctcccaccgtttcagacctcttaaaggagtcaacgcagaatgtgaccttgctgaaggagtccacgcaaggagtgagcagcgtgttcagggagatcacagcctcctctgccatctccatcctcatcaaacctgaacaggagaccgaccccttgcccgtcgtgtccaggaatgtcagtgctgatgccaaatgcaaaaaggagcggaagaagaaaaagcaagtgaccaacattatctcatttgatgatgaggaagatgagcagaactctggggacatgtttaaaaagacacctggggcaggggagagctcagaggacaactccgaccactcctctgtcaatatcatgtccgcctttgaaagccccttcgggccaaactccaatggaagtcagagcagcaactcgtggaaaattgattccctgtctttgaacagggagtttgggtaccagaagcttgatgtgaaaagcatcgatgatgaagatgtgggatgaaaacgaagatgacgtgtatggaaactcatcaggacggaagcacaggggccactcagagtcgcccgagaaaaacggagcacactctgtcacccaggctggagtgcaatggcacgatctcagctcactacaacctctgcctcccgggttcaagtgattctactgcctcagcctcccgtgtagctgggattacaggcgcgcaccaacacacccgactaatttttgtatttttagtaaagacagggtttcaccatgttggccaggctggtcttgcactcctgacctcacgtgatctgccccaccttggcctcccaaagtgctgggattacagngtctcgctctgtcgcacagtctggagtgcantggcgtgatctcggcccactaaaacctccacctcctgaatctangcaattctcctgtctcngcctcctgagtagctgggactncnggctcacaccaccatgcccggctaatttttgtntttttagtngggacgnggttttgccatattggtcaggctggtcttgaagtcctggcctcaggtgatccaccagcctcagcctcccaaaatgctgggattacnggcatgagtcaccatgcccagcctaaacttggcaagataataaataacctttttaagtgtcgttgggcacttgtctggttgtttttctttaggttaccatgccagcaatgattccttttgagtttctgacagaagatagtggttttcatccaaataagtcaactactctaccccatccctaagccacttgtatggaaagaaaaagaggaagaagccagtactgtgactgcntaagcttcccccagcatcacccgctatgagatgtgtggcagctgagacccgggaactgctcaagggcaccaggccccatctgtctgcactcactcaccttcctcaggtactcgcatgggcatgtcactgacttnacgtgctgctgcagctccttggtgagctggccctggtcatgggacaggaactgtggggtcaggacaatagagagcttcaccatttgcagaatgagaacaggggctcatgatgagtgccaacctattagataatttaaaaaaaaagtgttgaatgagtggaaaaacaaggtgatgtttgagtctatagtggtcaagggcttcagaaaaggacagaaccaagttcaaattcctgtactttgaatttctacttcatgccatgcaaaattactttaccccttttaacctcagttttcttctgtgtgaaacaggaacaatagtttcattcgtcattcagtttctctcaaggtttcacgagatcatacctataaaacatccaagtcatttaaatgtatcatcatttctgtcataattagtgggatccatttcactattattggatatacagttctgtgcctgaaacctacaaaaaaagaaaatgttaagtctaaaaagcattagtgatttctcatttttatattactaattataaccctatttaatcacacaaggccttgtccgtggcaggtgctcaataaacacttgtcgaatcaatgcatgtgggctccggagccacactgtttagattctattctgcctccaccacttatcagctgtgtgntctgggtaagataattcacctctttatgtctgcacttccctctccataaactatatataatgagaatccttagctcattcggttgtggtgaggggtgaatgatttggcacacaggaggggcttgttaaacattagctgtgatgatctccttccaaatcttcattttcagagccacagatgaggccanagtgcaaccaggtgaccttagagtgtaagtacacatgatcgccagctatgctctgtctccaccataggtccaagactgggtagttccggcctggaggtttctgctgcatctgccttctcagtgctcacctaagggcttttgtattttcctcctcgcatccccacagatggggttcaggctgccggacacagctgggtgatgccagggcagtggtcacctgtgccagccctgtgaggtagctggaggatcattgttccttccttctcgggctctgggcagatgccagggctggggtgacccatgccctcaagtttcttgctttggtgggccacattttcccttggcaaagagggtaaaggtcacaggatgccagagagctgtgacttctctgtgccctgggcccaaactatgaagacctgacacactatgctaaaagtccaaggcngggtgctccccagagcttcttgcctcaccgcttctgctgagggaggaatgaatactatgtcctcccagagctttgggagcttgtagcaagcagcctccccagnacaaaatctcttggaaacctctaactgtgtctgaaacattagtgcaaatgttgcatcatatttcccatatgtccgcatgttttaggaaaaaaccctcaatttcctaaatatgcaagaaaaatcgatattgtaggacaatgtgactttttaaaaaatgttatttaaaaatcttccccacctccttttctgccctccaagactgccaaatacttgttgaacaaatattattaaaagcctactacgtgccagccatgattcatggtcttggggacacagcagagaacaaactgacaggattcctctcttatgcaactcacattcttatacgataatgataagggttaacattaattaagccgtcaccacgtgttagtcacggtgcagtcattcccacacattattacacttaaacctgctagcaagcttgcaaggtagttagttgtttttcctttaaaaactgagtctcggaatgatgaagcantctgtccaatgtcacacggctagtaagtgtggagaccttgcatccaatcaatgcccgtctcattctaaaggccatgttatgtgttctccagcccatggagaataattttaacacagtcaatgaaatttctacacaacaatgttcttgtttcaagtccaagaatgcctcctacacctcctataatactggctttctggtgagtaaagatggcattctcatgtgtaatcaggtggcaaatggagatatgaccaaagtaaccatctgcctacactcataaccctgtacacactcttcctgtgtcgattcaattcaagtaccccttttgatcacttagcaaatctgacctttaaaagggttaaggtttttatatccatgtaagtttctgtattgctttggaagtctctggttaaattaatactcttttaatagtgacctgtgattctgttttgatcaagtgttttcaaacttgacgtctttgatgggtttctccagtgtcaaaatcctaaatcaagtctttttggcttaaaactaactttgggattttttcagctgcatcccttggggagtctaaagaatgtatctctcatcttgtagaggtattaagtgattcgatttatttggtagattaaatgggcaggcattgtcaaatgtggcgatactgcatgggagggcactgtcaagtgaggtgacattagatctcatctcagttatatttatgggtatgttgttgatatacgtgttccaaaaattgcatacatttatacaaatttaatatgatttgtaattttgatagttatgctaaatgtttgctaaagttatatttgtataaacacgtcatgaatggctgggcaccgtcactcatgcctgtaatcccagcactttgggagacaaaggcaggtggatcacctgaggtcgggagttccagaccagcctaatagagtgaaaccctgtctccactaaaaatacaaaagttagccatgcctggtggcacatgcctgtggtctcagctactcgggaggctgagacaggagaattgcttgaacccaggaggcggaggttgcagtgagccgagatcatgccactgcactcccgcctgggtgacagaggtagaatctaactaaaaaaaaaaaaaagttattaattatttctgaagattgtatgaaatttataaaagtctggtggccctgatatgatgctgccagtcatgattctgattactgtcttaaaatgctgcacgtaagtaattaaatttccttgtgaactgggaagtttcatcagacttctatcataactattgtttccatcatccacagttactattttgaattcttctctaaaaatatttgtaattggcaatagtccaaattttcttttgttttctttcctgtttttgagacacagtctggctctgttgcctaagctggagtgcagtgagccgagatcatgccactgcactcccgcctgggtgacagaggtagaatctaact

SEQ ID NO: 418835 - DNA, 2145 bp, Homo sapiens
  misc_feature (1244)..(1244): n is a, c, g, or t
gtgctcgcttcggcagcacatatactaaaattggaacgatacagagaagattagcatggcccctgcgcaaggatgacacgcgaattcgtgaagcgttccatatttttacctgctttgaaacgccagcgactagaaatcaattgccaggatccatctataaagtcattcctgtattccatcaaccagacaatctgcttgcggttggatagcattgaagccaaattgcaagccctggaggctacttgtaaatccttagaagaaaagctggatctggtcacgaacaagcagcacagccccatccaggttcccatggtggccggctcccctctcggggcaacccagacgtgcaacaaagtgcgatggctgtgcctgggcgtcggcagaacaccattgtggtgaaggtgccgggccaagaagacagccaccacgaggacggggagagcggctcggaggccagcgactctgtgtccagctgtgggcaggcgggcagtcagagcatcgggagcaacgtcacgctcatcaccctgaactcggaagaggactaccccaatggcacctggctgggcgacgagaacaaccccgagatgcgggtacgctgcgccatcatcccctccgacatgctgcacatcagcaccaactgccgcacggccgagaagatggcgctaacgctgctggactacctcttccaccgcgaggtgcaggctgtgtccaacctctcggggcagggcaagcacgggaagaagcagctggacccgctcaccatctacggcatccggtgtcaccttttctataaatttggcatcacagaatccgactggtaccgaatcaagcagagcatcgactccaagtgccgcacggcgtggcggcgcaagcagcggggccagagcctggcggtcaagagcttctcgcggagaacgcccaactcgtcctcctactgcccttcagagccgatgatgagcaccccacctcctgccagcgagctcccgcagccacagccgcagccgcaggccctgcactacgcgctggccaacgcacagcaggtgcagatccaccagatcggagaagacggacaggtgcaagtaatcccacagggacacctccacatcgcccaggtgccgcagggggagcaagtccagatcacgcaggacagcgagggcaacctccagatccatcacgtggggcaggacggtcaggtgctgcagggtgcacagctgatcgccgtggcctcctcggaccccgcggcngcgggcgtggatgggtcgccactccagggcagcgacatccaggttcagtacgtgcagctggcgccagtgagtgaccacacggccggggcacagacggccgaagccctgcagcccacgctacagccggagatgcagctcgagcacggggccatccagattcagtgagcggtgcccatggcaccaggagcccctcgccggctccgcctacggcccggcccccacgcgccctgctctcacggcctcggcacaggcagcggctgcacgtgttctgctgaagtgcgtctgaaggccgctgcctccgcggggaacagcatcctatcaactgaaagagcagccgccgccgcccccagccggagacccctttcgtttgagtcctgctgttggtgtcggagcacgaggggaggcacggtgcggagagcgtcgcatatgcgcgggaaatcaagaactatgatatttttctgtttaaacagctttttttaatttgctatggtgtttataacaaaaaagaaaatttgaaaaaaaaaatcccaggggagtagcaggagccctttgctgtgtgctctgtccagtgtcatgagacgggagccctttgctgtgtgctctgtccagtgtcatgagacgggagccctttgctgtgtgctctgtccagtgtcatgagacgggagccctttgctgtgtgctctgtccagtgtcatgagacgggagccctttgctgtgtgctctgtccagtgtcatgagacgggagccctttgctgtgtgctctgtccagtgtcatgaggcaggtgtttgcaaagccagctctcggttccgatggggtattgctgacctacttttctaggggaaatgctcttaaacactgtaattatgcatttctaatgaaataaaatgtatttatgaccac

SEQ ID NO: 418836 - DNA, 964 bp, Homo sapiens
atgctgtttcgatgttaggtgtaatctgtttttattgttgagaagatttgactagttttatatgtaaatttactgattaataataacatattaaagtacatttttaaaattaaatgggcttaaccaagaattgcaactgcacatagaagtgaaaccatgactaaatcatcacatttgaaacaggacgtgtgacttgtgtgtaaaatgtgaacttgttactcacatgtttctggctcatagctcagaagctagttccagtgtggggattgttctgtctgaatagatagagttgagatcaggaaatagctgtttggtgtttcttggggttgtcttcttacagttcaggagacccttcctaaagccggtcttttctcacttccagtcattcctgtattccatcaaccagacaatctgcttgcggttggatagcattgaagccaaattgcaagccctggaggctacttgtaaatccttagaagaaaagctggatctggtcacgaacaagcagcacagccccatccaggttcccatggtggccggctcccctctcggggcaacccagacgtgcaacaaagtgcgatggtgaacccgtgagcaactgtggtacctccacctgtcccacaacctacaactcagcagtaccaagggctggacgctggtgccaccacacgggtcccgcgaagcctgctgcgaagtgaaggaagccagacacaaaagtctccatcctgcgggagtcactcacaggacaattctggaggacgcaaagctgtaggagcgaggagagacaggtggtggttgggggccgggaaggggcctgactgcagaggggcaaaatgtgggctgcctctgtcggggcagaagtgccccactctagacccttaccaagtcgtcggctgtacatcgaaaacgggtgagccttatgtgtgtacgtgataccgcaataaacctgacttgtaaaagcaaa

SEQ ID NO: 418837 - DNA, 641 bp, Homo sapiens
cttagtttcaagggcagcctaggcaaaatatggggcccctttctcccccaaaaataaaaatttttattattattaaataaattaaaggaaagagccacccatgaagatacttagctgaggccaggtacagtggctcatgcctatactcccaaagtgctgggattacaggtgtgaaccactgcgcccagccccaagtggctttttcaattacatgagccaacatattctcacaagtccattcgagtttggtgtctgttacttgcaaataagggagttctgattggttcccagtgaaacctcatctgtaagacctctgagccaccagtatccacggggcttgtcctataacagctcctgtgcaatccagtaaccttgaacactggaagccactgagcccttctgtgagtagatgcacacctctgaggctaagattactggtgtactcattgggaccagtttggtctcagtgactgaaaactcaacccaaacttgttcatttggaaaggaaaagtcaaccaggcacagtggctcatgcctgtagttccagcactttgggaggctgaggtggacagatcgcttgagcccaggggttcaagaccaacctgggcaacatagcaaaaccctgcctctacaaaaaaaaa

SEQ ID NO: 418838 - DNA, 740 bp, Homo sapiens
gcagagcggcggcttctctcgcgaggacggacgccattatcgcatctccccgacaaacaccacgagaattccgcagcccacacggtgaccaaaagccagccccactgtgagttgaactctttcgtgttgaccggccactctccgtgctctggatgatgtcggaacacgacctggccgatgtggttcagattgcagtggaagacctgagccctgaccacccaggtacagagctgtgggacagtagttgttttggagaatcatgtagtgacagatgaagacgaacctgctttgaaacgccagcgactagaaatcaattgccaggatccatctataaagtcattcctgtattccatcaaccagacaatctgcttgcggttggatagcattgaagccaaattgcaagccctggaggctacttgtaaatccttagaagaaaagctggatctggtcacgaacaagcagcacagccccatccaggttcccatggtggccggctcccctctcggggcaacccagacgtgcaacaaagtgcgatggctgtgcctgggcgtcggcagaacaccattgtggtgaaggtgccgggccaagaagacagccaccacgaggacggggagagcggctcggaggccagcgactctgtgtccagctgtgggcaggcgggcagtcagagcatcgggagcaacgtcacgctcatcaccctgaactcggaagaggactaacccaattggcacctggctggg

SEQ ID NO: 418839 - DNA, 2119 bp, Homo sapiens
  misc_feature (1378)..(1378): n is a, c, g, or t
taggctaggtacgaggccgggtgttaatcggccgaggaacaccacgagaattccgcagcccacacggtgaccaaaagccagccccactgtgagttgaactctttcgtgttgaccggccactctccgtgctctggatgatgtcggaacacgacctggccgatgtggttcagattgcagtggaagacctgagccctgaccacccagttgttttggagaatcatgtagtgacagatgaagacgaacctgctttgaaacgccagcgactagaaatcaattgccaggatccatctataaagtcattcctgtattccatcaaccagacaatctgcttgcggttggatagcattgaagccaaattgcaagccctggaggctacttgtaaatccttagaagaaaagctggatctggtcacgaacaagcagcacagccccatccaggttcccatggtggccggctcccctctcggggcaacccagacgtgcaacaaagtgcgatggctgtgcctgggcgtcggcagaacaccattgtggtgaaggtgccgggccaagaagacagccaccacgaggacggggagagcggctcggaggccagcgactctgtgtccagctgtgggcaggcgggcagtcagagcatcgggagcaacgtcacgctcatcaccctgaactcggaagaggactaccccaatggcacctggctgggcgacgagaacaaccccgagatgcgggtacgctgcgccatcatcccctccgacatgctgcacatcagcaccaactgccgcacggccgagaagatggcgctaacgctgctggactacctcttccaccgcgaggtgcaggctgtgtccaacctctcggggcagggcaagcacgggaagaagcagctggacccgctcaccatctacggcatccggtgtcaccttttctataaatttggcatcacagaatccgactggtaccgaatcaagcagagcatcgactccaagtgccgcacggcgtggcggcgcaagcagcggggccagagcctggcggtcaagagcttctcgcggagaacgcccaactcgtcctcctactgcccttcagagccgatgatgagcaccccacctcctgccagcgagctcccgcagccacagccgcagccgcaggccctgcactacgcgctggccaacgcacagcaggtgcagatccaccagatcggagaagacggacaggtgcaagtaatcccacagggacacctccacatcgcccaggtgccgcagggggagcaagtccagatcacgcaggacagcgagggcaacctccagatccatcacgtggggcaggacggtcaggtgctgcagggtgcacagctgatcgccgtggcctcctcggaccccgcggcngcgggcgtggatgggtcgccactccagggcagcgacatccaggttcagtacgtgcagctggcgccagtgagtgaccacacggccggggcacagacggccgaagccctgcagcccacgctacagccggagatgcagctcgagcacggggccatccagattcagtgagcggtgcccatggcaccaggagcccctcgccggctccgcctacggcccggcccccacgcgccctgctctcacggcctcggcacaggcagcggctgcacgtgttctgctgaagtgcgtctgaaggccgctgcctccgcggggaacagcatcctatcaactgaaagagcagccgccgccgcccccagccggagacccctttcgtttgagtcctgctgttggtgtcggagcacgaggggaggcacggtgcggagagcgtcgcatatgcgcgggaaatcaagaactatgatatttttctgtttaaacagctttttttaatttgctatggtgtttataacaaaaaagaaaatttgaaaaaaaaaatcccaggggagtagcaggagccctttgctgtgtgctctgtccagtgtcatgagacgggagccctttgctgtgtgctctgtccagtgtcatgaggcaggtgtttgcaaagccagctctcggttccgatggggtattgctgacctacttttctaggggaaatgctcttaaacactgtaattatgcatttctaatgaaataaaatgtatttatgaccac

SEQ ID NO: 418840 - DNA, 5206 bp, Homo sapiens
  misc_feature (1132)..(1132): n is a, c, g, or t
  misc_feature (1163)..(1163): n is a, c, g, or t
  misc_feature (1207)..(1207): n is a, c, g, or t
  misc_feature (1224)..(1224): n is a, c, g, or t
  misc_feature (1246)..(1246): n is a, c, g, or t
  misc_feature (1248)..(1248): n is a, c, g, or t
  misc_feature (1281)..(1281): n is a, c, g, or t
  misc_feature (1290)..(1290): n is a, c, g, or t
  misc_feature (1297)..(1297): n is a, c, g, or t
  misc_feature (1383)..(1383): n is a, c, g, or t
  misc_feature (1614)..(1614): n is a, c, g, or t
  misc_feature (1748)..(1748): n is a, c, g, or t
  misc_feature (2406)..(2406): n is a, c, g, or t
  misc_feature (2593)..(2593): n is a, c, g, or t
  misc_feature (3038)..(3038): n is a, c, g, or t
  misc_feature (3141)..(3141): n is a, c, g, or t
  misc_feature (3622)..(3622): n is a, c, g, or t
ggttcaatcttctgtttgtaaccagaagctttaaaccagcagagacctcagacaaatcatatccctcctggggtgaccaggtgcagatcttccagggagccgtctaatggaatttcctggttaatggacacagagaaccactgctaagaacgatttccttttctctttcaatctgcagtactttttatgaagactggtcttttgtgatggatgaagagaggtccagtatgcttcctaccatggcagcaggtccgaactccatactctttgcgattaacattgacaacaaggatttgaacgggcagagtaagtttgctcccaccgtttcagacctcttaaaggagtcaacgcagaatgtgaccttgctgaaggagtccacgcaaggagtgagcagcgtgttcagggagatcacagcctcctctgccatctccatcctcatcaaacctgaacaggagaccgaccccttgcccgtcgtgtccaggaatgtcagtgctgatgccaaatgcaaaaaggagcggaagaagaaaaagcaagtgaccaacattatctcatttgatgatgaggaagatgagcagaactctggggacatgtttaaaaagacacctggggcaggggagagctcagaggacaactccgaccactcctctgtcaatatcatgtccgcctttgaaagccccttcgggccaaactccaatggaagtcagagcagcaactcgtggaaaattgattccctgtctttgaacagggagtttgggtaccagaagcttgatgtgaaaagcatcgatgatgaagatgtgggatgaaaacgaagatgacgtgtatggaaactcatcaggacggaagcacaggggccactcagagtcgcccgagaaaaacggagcacactctgtcacccaggctggagtgcaatggcacgatctcagctcactacaacctctgcctcccgggttcaagtgattctactgcctcagcctcccgtgtagctgggattacaggcgcgcaccaacacacccgactaatttttgtatttttagtaaagacagggtttcaccatgttggccaggctggtcttgcactcctgacctcacgtgatctgccccaccttggcctcccaaagtgctgggattacagngtctcgctctgtcgcacagtctggagtgcantggcgtgatctcggcccactaaaacctccacctcctgaatctangcaattctcctgtctcngcctcctgagtagctgggactncnggctcacaccaccatgcccggctaatttttgtntttttagtngggacgnggttttgccatattggtcaggctggtcttgaagtcctggcctcaggtgatccaccagcctcagcctcccaaaatgctgggattacnggcatgagtcaccatgcccagcctaaacttggcaagataataaataacctttttaagtgtcgttgggcacttgtctggttgtttttctttaggttaccatgccagcaatgattccttttgagtttctgacagaagatagtggttttcatccaaataagtcaactactctaccccatccctaagccacttgtatggaaagaaaaagaggaagaagccagtactgtgactgcntaagcttcccccagcatcacccgctatgagatgtgtggcagctgagacccgggaactgctcaagggcaccaggccccatctgtctgcactcactcaccttcctcaggtactcgcatgggcatgtcactgacttnacgtgctgctgcagctccttggtgagctggccctggtcatgggacaggaactgtggggtcaggacaatagagagcttcaccatttgcagaatgagaacaggggctcatgatgagtgccaacctattagataatttaaaaaaaaagtgttgaatgagtggaaaaacaaggtgatgtttgagtctatagtggtcaagggcttcagaaaaggacagaaccaagttcaaattcctgtactttgaatttctacttcatgccatgcaaaattactttaccccttttaacctcagttttcttctgtgtgaaacaggaacaatagtttcattcgtcattcagtttctctcaaggtttcacgagatcatacctataaaacatccaagtcatttaaatgtatcatcatttctgtcataattagtgggatccatttcactattattggatatacagttctgtgcctgaaacctacaaaaaaagaaaatgttaagtctaaaaagcattagtgatttctcatttttatattactaattataaccctatttaatcacacaaggccttgtccgtggcaggtgctcaataaacacttgtcgaatcaatgcatgtgggctccggagccacactgtttagattctattctgcctccaccacttatcagctgtgtgntctgggtaagataattcacctctttatgtctgcacttccctctccataaactatatataatgagaatccttagctcattcggttgtggtgaggggtgaatgatttggcacacaggaggggcttgttaaacattagctgtgatgatctccttccaaatcttcattttcagagccacagatgaggccanagtgcaaccaggtgaccttagagtgtaagtacacatgatcgccagctatgctctgtctccaccataggtccaagactgggtagttccggcctggaggtttctgctgcatctgccttctcagtgctcacctaagggcttttgtattttcctcctcgcatccccacagatggggttcaggctgccggacacagctgggtgatgccagggcagtggtcacctgtgccagccctgtgaggtagctggaggatcattgttccttccttctcgggctctgggcagatgccagggctggggtgacccatgccctcaagtttcttgctttggtgggccacattttcccttggcaaagagggtaaaggtcacaggatgccagagagctgtgacttctctgtgccctgggcccaaactatgaagacctgacacactatgctaaaagtccaaggcngggtgctccccagagcttcttgcctcaccgcttctgctgagggaggaatgaatactatgtcctcccagagctttgggagcttgtagcaagcagcctccccagnacaaaatctcttggaaacctctaactgtgtctgaaacattagtgcaaatgttgcatcatatttcccatatgtccgcatgttttaggaaaaaaccctcaatttcctaaatatgcaagaaaaatcgatattgtaggacaatgtgactttttaaaaaatgttatttaaaaatcttccccacctccttttctgccctccaagactgccaaatacttgttgaacaaatattattaaaagcctactacgtgccagccatgattcatggtcttggggacacagcagagaacaaactgacaggattcctctcttatgcaactcacattcttatacgataatgataagggttaacattaattaagccgtcaccacgtgttagtcacggtgcagtcattcccacacattattacacttaaacctgctagcaagcttgcaaggtagttagttgtttttcctttaaaaactgagtctcggaatgatgaagcantctgtccaatgtcacacggctagtaagtgtggagaccttgcatccaatcaatgcccgtctcattctaaaggccatgttatgtgttctccagcccatggagaataattttaacacagtcaatgaaatttctacacaacaatgttcttgtttcaagtccaagaatgcctcctacacctcctataatactggctttctggtgagtaaagatggcattctcatgtgtaatcaggtggcaaatggagatatgaccaaagtaaccatctgcctacactcataaccctgtacacactcttcctgtgtcgattcaattcaagtaccccttttgatcacttagcaaatctgacctttaaaagggttaaggtttttatatccatgtaagtttctgtattgctttggaagtctctggttaaattaatactcttttaatagtgacctgtgattctgttttgatcaagtgttttcaaacttgacgtctttgatgggtttctccagtgtcaaaatcctaaatcaagtctttttggcttaaaactaactttgggattttttcagctgcatcccttggggagtctaaagaatgtatctctcatcttgtagaggtattaagtgattcgatttatttggtagattaaatgggcaggcattgtcaaatgtggcgatactgcatgggagggcactgtcaagtgaggtgacattagatctcatctcagttatatttatgggtatgttgttgatatacgtgttccaaaaattgcatacatttatacaaatttaatatgatttgtaattttgatagttatgctaaatgtttgctaaagttatatttgtataaacacgtcatgaatggctgggcaccgtcactcatgcctgtaatcccagcactttgggagacaaaggcaggtggatcacctgaggtcgggagttccagaccagcctaatagagtgaaaccctgtctccactaaaaatacaaaagttagccatgcctggtggcacatgcctgtggtctcagctactcgggaggctgagacaggagaattgcttgaacccaggaggcggaggttgcagtgagccgagatcatgccactgcactcccgcctgggtgacagaggtagaatctaactaaaaaaaaaaaaaagttattaattatttctgaagattgtatgaaatttataaaagtctggtggccctgatatgatgctgccagtcatgattctgattactgtcttaaaatgctgcacgtaagtaattaaatttccttgtgaactgggaagtttcatcagacttctatcataactattgtttccatcatccacagttactattttgaattcttctctaaaaatatttgtaattggcaatagtccaaattttcttttgttttctttcctgtttttgagacacagtctggctctgttgcctaagctggagtgcagtggtgggatctcggctcactgcaagctccgcctcccgggttcacaccattctcctgcctcagctaaaaatacaaaattacccgggcgtggtggtacatgcctgtaatcccagctactcgggaggctgaggcaggagaatcgcttgaacctcgg

SEQ ID NO: 418841 - DNA, 3035 bp, Homo sapiens
aaagtagatgacattccatccacactgtgtgagcaaattggagagattgccttgatagaggactgatgtttttcactgatgagatggtgaccaaaagccagccccactgtgagttgaactctttcgtgttgaccggccactctccgtgctctggatgatgtcggaacacgacctggccgatgtggttcagattgcagtggaagacctgagccctgaccacccagttgttttggagaatcatgtagtgacagatgaagacgaacctgctttgaaacgccagcgactagaaatcaattgccaggatccatctataaagtcattcctgtattccatcaaccagacaatctgcttgcggttggatagcattgaagccaaattgcaagccctggaggctacttgtaaatccttagaagaaaagctggatctggtcacgaacaagcagcacagccccatccaggttcccatggtggccggctcccctctcggggcaacccagacgtgcaacaaagtgcgatgcgtcgtcccccagactacagtaatactcaacaatgatcggcagaacgccattgtagccaagatggaagaccccttgagcaacagggcaccggattccctggaaaatgtcattagcaacgctgtgcctgggcgtcggcagaacaccattgtggtgaaggtgccgggccaagaagacagccaccacgaggacggggagagcggctcggaggccagcgactctgtgtccagctgtgggcaggcgggcagtcagagcatcgggagcaacgtcacgctcatcaccctgaactcggaagaggactaccccaatggcacctggctgggcgacgagaacaaccccgagatgcgggtacgctgcgccatcatcccctccgacatgctgcacatcagcaccaactgccgcacggccgagaagatggcgctaacgctgctggactacctcttccaccgcgaggtgcaggctgtgtccaacctctcggggcagggcaagcacgggaagaagcagctggacccgctcaccatctacggcatccggtgtcaccttttctataaatttggcatcacagaatccgactggtaccgaatcaagcagagcatcgactccaagtgccgcacggcgtggcggcgcaagcagcggggccagagcctggcggtcaagagcttctcgcggagaacgcccaactcgtcctcctactgcccttcagagccgatgatgagcaccccacctcctgccagcgagctcccgcagccacagccgcagccgcaggccctgcactacgcgctggccaacgcacagcaggtgcagatccaccagatcggagaagacggacaggtgcaagtaatcccacagggacacctccacatcgcccaggtgccgcagggggagcaagtccagatcacgcaggacagcgaggagcccgtgttctggtactacgtgaaggaggtcctcaacaagcacgagctgcaagcgcttctactccctgcgccacatcgcctcagacgtgggccggggccgcacctggctgcgctgtgccctcaacgaacactccctggagcgctacctgcacatgctcctggccgaccgctgcaggctcagtactttttatgaagactggtcttttgtgatggatgaagagaggtccagtatgcttcctaccatggcagcaggtccgaactccatactctttgcgattaacattgacaacaaggatttgaacgggcagagtaagtttgctcccaccgtttcagacctcttaaaggagtcaacgcagaatgtgaccttgctgaaggagtccacgcaaggagtgagcagcgtgttcagggagatcacagcctcctctgccatctccatcctcatcaaacctgaacaggagaccgaccccttgcccgtcgtgtccaggaatgtcagtgctgatgccaaatgcaaaaaggagcggaagaagaaaaagcaagtgaccaacattatctcatttgatgatgaggaagatgagcagaactctggggacatgtttaaaaagacacctggggcaggggagagctcagaggacaactccgaccactcctctgtcaatatcatgtccgcctttgaaagccccttcgggccaaactccaatggaagtcagagcagcaactcgtggaaaattgattccctgtctttgaacagggagtttgggtaccagaagcttgatgtgaaaagcatcgatgatgaagatgtgggatgaaaacgaagatgacgtgtatggaaactcatcaggacggaagcacaggggccactcagagtcgcccgagaaaaacggagcacactctgtcacccaggctggagtgcaatggcacgatctcagctcactacaacctctgcctcccgggttcaagtgattctactgcctcagcctcccgtgtagctgggattacaggcgcgcaccaacacacccgactaatttttgtatttttagtaaagacagggtttcaccatgttggccaggctggtcttgcactcctgacctcacgtgatctgccccaccttggcctcccaaagtgctgggattacaggtgtgaaccactgcgcccagccccaagtggctttttcaattacatgagccaacatattctcacaagtccattcgagtttggtgtctgttacttgcaaataagggagttctgattggttcccagtgaaacctcatctgtaagacctctgagccaccagtatccacggggcttgtcctataacagctcctgtgcaatccagtaaccttgaacactggaagccactgagcccttctgtgagtagatgcacacctctgaggctaagattactggtgtactcattgggaccagtttggtctcagtgactgaaaactcaacccaaacttgttcatttggaaaggaaaagtcaaccaggcacagtggctcatgcctgtagttccagcactttgggaggctgaggtggacagatcgcttgagcccaggggttcaagaccaacctgggcaacatagcaaaaccctgcctctacaaaaaaaaa

SEQ ID NO: 418842 - DNA, 3055 bp, Homo sapiens
gcagagcggcggcttctctcgcgaggacggacgccattatcgcatctccccgacaaacaccacgagaattccgcagcccacacggtgaccaaaagccagccccactgtgagttgaactctttcgtgttgaccggccactctccgtgctctggatgatgtcggaacacgacctggccgatgtggttcagattgcagtggaagacctgagccctgaccacccaggtacagagctgtgggacagtagttgttttggagaatcatgtagtgacagatgaagacgaacctgctttgaaacgccagcgactagaaatcaattgccaggatccatctataaagtcattcctgtattccatcaaccagacaatctgcttgcggttggatagcattgaagccaaattgcaagccctggaggctacttgtaaatccttagaagaaaagctggatctggtcacgaacaagcagcacagccccatccaggttcccatggtggccggctcccctctcggggcaacccagacgtgcaacaaagtgcgatgcgtcgtcccccagactacagtaatactcaacaatgatcggcagaacgccattgtagccaagatggaagaccccttgagcaacagggcaccggattccctggaaaatgtcattagcaacgctgtgcctgggcgtcggcagaacaccattgtggtgaaggtgccgggccaagaagacagccaccacgaggacggggagagcggctcggaggccagcgactctgtgtccagctgtgggcaggcgggcagtcagagcatcgggagcaacgtcacgctcatcaccctgaactcggaagaggactaccccaatggcacctggctgggcgacgagaacaaccccgagatgcgggtacgctgcgccatcatcccctccgacatgctgcacatcagcaccaactgccgcacggccgagaagatggcgctaacgctgctggactacctcttccaccgcgaggtgcaggctgtgtccaacctctcggggcagggcaagcacgggaagaagcagctggacccgctcaccatctacggcatccggtgtcaccttttctataaatttggcatcacagaatccgactggtaccgaatcaagcagagcatcgactccaagtgccgcacggcgtggcggcgcaagcagcggggccagagcctggcggtcaagagcttctcgcggagaacgcccaactcgtcctcctactgcccttcagagccgatgatgagcaccccacctcctgccagcgagctcccgcagccacagccgcagccgcaggccctgcactacgcgctggccaacgcacagcaggtgcagatccaccagatcggagaagacggacaggtgcaagtaatcccacagggacacctccacatcgcccaggtgccgcagggggagcaagtccagatcacgcaggacagcgaggagcccgtgttctggtactacgtgaaggaggtcctcaacaagcacgagctgcaagcgcttctactccctgcgccacatcgcctcagacgtgggccggggccgcacctggctgcgctgtgccctcaacgaacactccctggagcgctacctgcacatgctcctggccgaccgctgcaggctcagtactttttatgaagactggtcttttgtgatggatgaagagaggtccagtatgcttcctaccatggcagcaggtccgaactccatactctttgcgattaacattgacaacaaggatttgaacgggcagagtaagtttgctcccaccgtttcagacctcttaaaggagtcaacgcagaatgtgaccttgctgaaggagtccacgcaaggagtgagcagcgtgttcagggagatcacagcctcctctgccatctccatcctcatcaaacctgaacaggagaccgaccccttgcccgtcgtgtccaggaatgtcagtgctgatgccaaatgcaaaaaggagcggaagaagaaaaagcaagtgaccaacattatctcatttgatgatgaggaagatgagcagaactctggggacatgtttaaaaagacacctggggcaggggagagctcagaggacaactccgaccactcctctgtcaatatcatgtccgcctttgaaagccccttcgggccaaactccaatggaagtcagagcagcaactcgtggaaaattgattccctgtctttgaacagggagtttgggtaccagaagcttgatgtgaaaagcatcgatgatgaagatgtgggatgaaaacgaagatgacgtgtatggaaactcatcaggacggaagcacaggggccactcagagtcgcccgagaaaaacggagcacactctgtcacccaggctggagtgcaatggcacgatctcagctcactacaacctctgcctcccgggttcaagtgattctactgcctcagcctcccgtgtagctgggattacaggcgcgcaccaacacacccgactaatttttgtatttttagtaaagacagggtttcaccatgttggccaggctggtcttgcactcctgacctcacgtgatctgccccaccttggcctcccaaagtgctgggattacaggtgtgaaccactgcgcccagccccaagtggctttttcaattacatgagccaacatattctcacaagtccattcgagtttggtgtctgttacttgcaaataagggagttctgattggttcccagtgaaacctcatctgtaagacctctgagccaccagtatccacggggcttgtcctataacagctcctgtgcaatccagtaaccttgaacactggaagccactgagcccttctgtgagtagatgcacacctctgaggctaagattactggtgtactcattgggaccagtttggtctcagtgactgaaaactcaacccaaacttgttcatttggaaaggaaaagtcaaccaggcacagtggctcatgcctgtagttccagcactttgggaggctgaggtggacagatcgcttgagcccaggggttcaagaccaacctgggcaacatagcaaaaccctgcctctacaaaaaaaaa

SEQ ID NO: 418843 - DNA, 3101 bp, Homo sapiens
atgctgtttcgatgttaggtgtaatctgtttttattgttgagaagatttgactagttttatatgtaaatttactgattaataataacatattaaagtacatttttaaaattaaatgggcttaaccaagaattgcaactgcacatagaagtgaaaccatgactaaatcatcacatttgaaacaggacgtgtgacttgtgtgtaaaatgtgaacttgttactcacatgtttctggctcatagctcagaagctagttccagtgtggggattgttctgtctgaatagatagagttgagatcaggaaatagctgtttggtgtttcttggggttgtcttcttacagttcaggagacccttcctaaagccggtcttttctcacttccagtcattcctgtattccatcaaccagacaatctgcttgcggttggatagcattgaagccaaattgcaagccctggaggctacttgtaaatccttagaagaaaagctggatctggtcacgaacaagcagcacagccccatccaggttcccatggtggccggctcccctctcggggcaacccagacgtgcaacaaagtgcgatgcgtcgtcccccagactacagtaatactcaacaatgatcggcagaacgccattgtagccaagatggaagaccccttgagcaacagggcaccggattccctggaaaatgtcattagcaacgctgtgcctgggcgtcggcagaacaccattgtggtgaaggtgccgggccaagaagacagccaccacgaggacggggagagcggctcggaggccagcgactctgtgtccagctgtgggcaggcgggcagtcagagcatcgggagcaacgtcacgctcatcaccctgaactcggaagaggactaccccaatggcacctggctgggcgacgagaacaaccccgagatgcgggtacgctgcgccatcatcccctccgacatgctgcacatcagcaccaactgccgcacggccgagaagatggcgctaacgctgctggactacctcttccaccgcgaggtgcaggctgtgtccaacctctcggggcagggcaagcacgggaagaagcagctggacccgctcaccatctacggcatccggtgtcaccttttctataaatttggcatcacagaatccgactggtaccgaatcaagcagagcatcgactccaagtgccgcacggcgtggcggcgcaagcagcggggccagagcctggcggtcaagagcttctcgcggagaacgcccaactcgtcctcctactgcccttcagagccgatgatgagcaccccacctcctgccagcgagctcccgcagccacagccgcagccgcaggccctgcactacgcgctggccaacgcacagcaggtgcagatccaccagatcggagaagacggacaggtgcaagtaatcccacagggacacctccacatcgcccaggtgccgcagggggagcaagtccagatcacgcaggacagcgaggagcccgtgttctggtactacgtgaaggaggtcctcaacaagcacgagctgcaagcgcttctactccctgcgccacatcgcctcagacgtgggccggggccgcacctggctgcgctgtgccctcaacgaacactccctggagcgctacctgcacatgctcctggccgaccgctgcaggctcagtactttttatgaagactggtcttttgtgatggatgaagagaggtccagtatgcttcctaccatggcagcaggtccgaactccatactctttgcgattaacattgacaacaaggatttgaacgggcagagtaagtttgctcccaccgtttcagacctcttaaaggagtcaacgcagaatgtgaccttgctgaaggagtccacgcaaggagtgagcagcgtgttcagggagatcacagcctcctctgccatctccatcctcatcaaacctgaacaggagaccgaccccttgcccgtcgtgtccaggaatgtcagtgctgatgccaaatgcaaaaaggagcggaagaagaaaaagcaagtgaccaacattatctcatttgatgatgaggaagatgagcagaactctggggacatgtttaaaaagacacctggggcaggggagagctcagaggacaactccgaccactcctctgtcaatatcatgtccgcctttgaaagccccttcgggccaaactccaatggaagtcagagcagcaactcgtggaaaattgattccctgtctttgaacagggagtttgggtaccagaagcttgatgtgaaaagcatcgatgatgaagatgtgggatgaaaacgaagatgacgtgtatggaaactcatcaggacggaagcacaggggccactcagagtcgcccgagaaaaacggagcacactctgtcacccaggctggagtgcaatggcacgatctcagctcactacaacctctgcctcccgggttcaagtgattctactgcctcagcctcccgtgtagctgggattacaggcgcgcaccaacacacccgactaatttttgtatttttagtaaagacagggtttcaccatgttggccaggctggtcttgcactcctgacctcacgtgatctgccccaccttggcctcccaaagtgctgggattacaggtgtgaaccactgcgcccagccccaagtggctttttcaattacatgagccaacatattctcacaagtccattcgagtttggtgtctgttacttgcaaataagggagttctgattggttcccagtgaaacctcatctgtaagacctctgagccaccagtatccacggggcttgtcctataacagctcctgtgcaatccagtaaccttgaacactggaagccactgagcccttctgtgagtagatgcacacctctgaggctaagattactggtgtactcattgggaccagtttggtctcagtgactgaaaactcaacccaaacttgttcatttggaaaggaaaagtcaaccaggcacagtggctcatgcctgtagttccagcactttgggaggctgaggtggacagatcgcttgagcccaggggttcaagaccaacctgggcaacatagcaaaaccctgcctctacaaaaaaaaa

SEQ ID NO: 418844 - DNA, 2601 bp, Homo sapiens
gcagagcggcggcttctctcgcgaggacggacgccattatcgcatctccccgacaaacaccacgagaattccgcagcccacacttgttttggagaatcatgtagtgacagatgaagacgaacctgctttgaaacgccagcgactagaaatcaattgccaggatccatctataaagtcattcctgtattccatcaaccagacaatctgcttgcggttggatagcattgaagccaaattgcaagccctggaggctacttgtaaatccttagaagaaaagctggatctggtcacgaacaagcagcacagccccatccaggttcccatggtggccggctcccctctcggggcaacccagacgtgcaacaaagtgcgatgaggactaccccaatggcacctggctgggcgacgagaacaaccccgagatgcgggtacgctgcgccatcatcccctccgacatgctgcacatcagcaccaactgccgcacggccgagaagatggcgctaacgctgctggactacctcttccaccgcgaggtgcaggctgtgtccaacctctcggggcagggcaagcacgggaagaagcagctggacccgctcaccatctacggcatccggtgtcaccttttctataaatttggcatcacagaatccgactggtaccgaatcaagcagagcatcgactccaagtgccgcacggcgtggcggcgcaagcagcggggccagagcctggcggtcaagagcttctcgcggagaacgcccaactcgtcctcctactgcccttcagagccgatgatgagcaccccacctcctgccagcgagctcccgcagccacagccgcagccgcaggccctgcactacgcgctggccaacgcacagcaggtgcagatccaccagatcggagaagacggacaggtgcaagtaatcccacagggacacctccacatcgcccaggtgccgcagggggagcaagtccagatcacgcaggacagcgaggagcccgtgttctggtactacgtgaaggaggtcctcaacaagcacgagctgcaagcgcttctactccctgcgccacatcgcctcagacgtgggccggggccgcacctggctgcgctgtgccctcaacgaacactccctggagcgctacctgcacatgctcctggccgaccgctgcaggctcagtactttttatgaagactggtcttttgtgatggatgaagagaggtccagtatgcttcctaccatggcagcaggtccgaactccatactctttgcgattaacattgacaacaaggatttgaacgggcagagtaagtttgctcccaccgtttcagacctcttaaaggagtcaacgcagaatgtgaccttgctgaaggagtccacgcaaggagtgagcagcgtgttcagggagatcacagcctcctctgccatctccatcctcatcaaacctgaacaggagaccgaccccttgcccgtcgtgtccaggaatgtcagtgctgatgccaaatgcaaaaaggagcggaagaagaaaaagcaagtgaccaacattatctcatttgatgatgaggaagatgagcagaactctggggacatgtttaaaaagacacctggggcaggggagagctcagaggacaactccgaccactcctctgtcaatatcatgtccgcctttgaaagccccttcgggccaaactccaatggaagtcagagcagcaactcgtggaaaattgattccctgtctttgaacagggagtttgggtaccagaagcttgatgtgaaaagcatcgatgatgaagatgtgggatgaaaacgaagatgacgtgtatggaaactcatcaggacggaagcacaggggccactcagagtcgcccgagaaaaacggagcacactctgtcacccaggctggagtgcaatggcacgatctcagctcactacaacctctgcctcccgggttcaagtgattctactgcctcagcctcccgtgtagctgggattacaggcgcgcaccaacacacccgactaatttttgtatttttagtaaagacagggtttcaccatgttggccaggctggtcttgcactcctgacctcacgtgatctgccccaccttggcctcccaaagtgctgggattacaggtgtgaaccactgcgcccagccccaagtggctttttcaattacatgagccaacatattctcacaagtccattcgagtttggtgtctgttacttgcaaataagggagttctgattggttcccagtgaaacctcatctgtaagacctctgagccaccagtatccacggggcttgtcctataacagctcctgtgcaatccagtaaccttgaacactggaagccactgagcccttctgtgagtagatgcacacctctgaggctaagattactggtgtactcattgggaccagtttggtctcagtgactgaaaactcaacccaaacttgttcatttggaaaggaaaagtcaaccaggcacagtggctcatgcctgtagttccagcactttgggaggctgaggtggacagatcgcttgagcccaggggttcaagaccaacctgggcaacatagcaaaaccctgcctctacaaaaaaaaa

SEQ ID NO: 418845 - DNA, 1972 bp, Homo sapiens
tgttttgttttgtttttagagacagggccttgctctgttaactaggctggagtgcagtggtgcaatcatagctcattacagcctcaaactcctggggtccagccatcctcctgcctccgcctcccaactactcatgagcctgaaatgggaagatcgcttgagcccaggagttcaagactgcagtgaactatgatcgtgccactgtgctctagcctgggtgacagagtgagaccttgtccccaccccacccctcaaaaacaaaacaaaacaaaaaaaacccaaacaaggaaaaggaatgctgtttggtgcacgtgtagtagtgatattaatagttggttttcattgagcaccaattatatgccagagcccgtgttctggtactacgtgaaggaggtcctcaacaagcacgagctgcaagcgcttctactccctgcgccacatcgcctcagacgtgggccggggccgcacctggctgcgctgtgccctcaacgaacactccctggagcgctacctgcacatgctcctggccgaccgctgcaggctcagtactttttatgaagactggtcttttgtgatggatgaagagaggtccagtatgcttcctaccatggcagcaggtccgaactccatactctttgcgattaacattgacaacaaggatttgaacgggcagagtaagtttgctcccaccgtttcagacctcttaaaggagtcaacgcagaatgtgaccttgctgaaggagtccacgcaaggagtgagcagcgtgttcagggagatcacagcctcctctgccatctccatcctcatcaaacctgaacaggagaccgaccccttgcccgtcgtgtccaggaatgtcagtgctgatgccaaatgcaaaaaggagcggaagaagaaaaagcaagtgaccaacattatctcatttgatgatgaggaagatgagcagaactctggggacatgtttaaaaagacacctggggcaggggagagctcagaggacaactccgaccactcctctgtcaatatcatgtccgcctttgaaagccccttcgggccaaactccaatggaagtcagagcagcaactcgtggaaaattgattccctgtctttgaacagggagtttgggtaccagaagcttgatgtgaaaagcatcgatgatgaagatgtgggatgaaaacgaagatgacgtgtatggaaactcatcaggacggaagcacaggggccactcagagtcgcccgagaaaaacggagcacactctgtcacccaggctggagtgcaatggcacgatctcagctcactacaacctctgcctcccgggttcaagtgattctactgcctcagcctcccgtgtagctgggattacaggcgcgcaccaacacacccgactaatttttgtatttttagtaaagacagggtttcaccatgttggccaggctggtcttgcactcctgacctcacgtgatctgccccaccttggcctcccaaagtgctgggattacaggtgtgaaccactgcgcccagccccaagtggctttttcaattacatgagccaacatattctcacaagtccattcgagtttggtgtctgttacttgcaaataagggagttctgattggttcccagtgaaacctcatctgtaagacctctgagccaccagtatccacggggcttgtcctataacagctcctgtgcaatccagtaaccttgaacactggaagccactgagcccttctgtgagtagatgcacacctctgaggctaagattactggtgtactcattgggaccagtttggtctcagtgactgaaaactcaacccaaacttgttcatttggaaaggaaaagtcaaccaggcacagtggctcatgcctgtagttccagcactttgggaggctgaggtggacagatcgcttgagcccaggggttcaagaccaacctgggcaacatagcaaaaccctgcctctacaaaaaaaaa

SEQ ID NO: 418846 - DNA, 2137 bp, Homo sapiens
  misc_feature (1396)..(1396): n is a, c, g, or t
gcagagcggcggcttctctcgcgaggacggacgccattatcgcatctccccgacaaacaccacgagaattccgcagcccacacggtgaccaaaagccagccccactgtgagttgaactctttcgtgttgaccggccactctccgtgctctggatgatgtcggaacacgacctggccgatgtggttcagattgcagtggaagacctgagccctgaccacccagttgttttggagaatcatgtagtgacagatgaagacgaacctgctttgaaacgccagcgactagaaatcaattgccaggatccatctataaagtcattcctgtattccatcaaccagacaatctgcttgcggttggatagcattgaagccaaattgcaagccctggaggctacttgtaaatccttagaagaaaagctggatctggtcacgaacaagcagcacagccccatccaggttcccatggtggccggctcccctctcggggcaacccagacgtgcaacaaagtgcgatggctgtgcctgggcgtcggcagaacaccattgtggtgaaggtgccgggccaagaagacagccaccacgaggacggggagagcggctcggaggccagcgactctgtgtccagctgtgggcaggcgggcagtcagagcatcgggagcaacgtcacgctcatcaccctgaactcggaagaggactaccccaatggcacctggctgggcgacgagaacaaccccgagatgcgggtacgctgcgccatcatcccctccgacatgctgcacatcagcaccaactgccgcacggccgagaagatggcgctaacgctgctggactacctcttccaccgcgaggtgcaggctgtgtccaacctctcggggcagggcaagcacgggaagaagcagctggacccgctcaccatctacggcatccggtgtcaccttttctataaatttggcatcacagaatccgactggtaccgaatcaagcagagcatcgactccaagtgccgcacggcgtggcggcgcaagcagcggggccagagcctggcggtcaagagcttctcgcggagaacgcccaactcgtcctcctactgcccttcagagccgatgatgagcaccccacctcctgccagcgagctcccgcagccacagccgcagccgcaggccctgcactacgcgctggccaacgcacagcaggtgcagatccaccagatcggagaagacggacaggtgcaagtaatcccacagggacacctccacatcgcccaggtgccgcagggggagcaagtccagatcacgcaggacagcgagggcaacctccagatccatcacgtggggcaggacggtcaggtgctgcagggtgcacagctgatcgccgtggcctcctcggaccccgcggcngcgggcgtggatgggtcgccactccagggcagcgacatccaggttcagtacgtgcagctggcgccagtgagtgaccacacggccggggcacagacggccgaagccctgcagcccacgctacagccggagatgcagctcgagcacggggccatccagattcagtgagcggtgcccatggcaccaggagcccctcgccggctccgcctacggcccggcccccacgcgccctgctctcacggcctcggcacaggcagcggctgcacgtgttctgctgaagtgcgtctgaaggccgctgcctccgcggggaacagcatcctatcaactgaaagagcagccgccgccgcccccagccggagacccctttcgtttgagtcctgctgttggtgtcggagcacgaggggaggcacggtgcggagagcgtcgcatatgcgcgggaaatcaagaactatgatatttttctgtttaaacagctttttttaatttgctatggtgtttataacaaaaaagaaaatttgaaaaaaaaaatcccaggggagtagcaggagccctttgctgtgtgctctgtccagtgtcatgagacgggagccctttgctgtgtgctctgtccagtgtcatgaggcaggtgtttgcaaagccagctctcggttccgatggggtattgctgacctacttttctaggggaaatgctcttaaacactgtaattatgcatttctaatgaaataaaatgtatttatgaccac

SEQ ID NO: 418847 - DNA, 774 bp, Homo sapiens
ggttcaatcttctgtttgtaaccagaagctttaaaccagcagagacctcagacaaatcatatccctcctggggtgaccaggtgcagatcttccagggagccgtctaatggaatttcctggttaatggacacagagaaccactgctaagaacgatttccttttctctttcaatctgcagtactttttatgaagactggtcttttgtgatggatgaagagaggtccagtatgcttcctaccatggcagcaggtccgaactccatactctttgcgattaacattgacaacaaggatttgaacgggcagagtaagtttgctcccaccgtttcagacctcttaaaggagtcaacgcagaatgtgaccttgctgaaggagtccacgcaaggagtgagcagcgtgttcagggagatcacagcctcctctgccatctccatcctcatcaaacctgaacaggagaccgaccccttgcccgtcgtgtccaggaatgtcagtgctgatgccaaatgcaaaaaggagcggaagaagaaaaagcaagtgaccaacattatctcatttgatgatgaggaagatgagcagaactctggggacatgtttaaaaagacacctggggcaggggagagctcagaggacaactccgaccactcctctgtcaatatcatgtccgcctttgaaagccccttcgggccaaactccaatggaagtcagagcagctactcgggaggctgaggcagaagaatggcgtgaacccaggaggcagagcttgcagtgagctgag

SEQ ID NO: 418848 - DNA, 1604 bp, Homo sapiens
ggttcaatcttctgtttgtaaccagaagctttaaaccagcagagacctcagacaaatcatatccctcctggggtgaccaggtgcagatcttccagggagccgtctaatggaatttcctggttaatggacacagagaaccactgctaagaacgatttccttttctctttcaatctgcagtactttttatgaagactggtcttttgtgatggatgaagagaggtccagtatgcttcctaccatggcagcaggtccgaactccatactctttgcgattaacattgacaacaaggatttgaacgggcagagtaagtttgctcccaccgtttcagacctcttaaaggagtcaacgcagaatgtgaccttgctgaaggagtccacgcaaggagtgagcagcgtgttcagggagatcacagcctcctctgccatctccatcctcatcaaacctgaacaggagaccgaccccttgcccgtcgtgtccaggaatgtcagtgctgatgccaaatgcaaaaaggagcggaagaagaaaaagcaagtgaccaacattatctcatttgatgatgaggaagatgagcagaactctggggacatgtttaaaaagacacctggggcaggggagagctcagaggacaactccgaccactcctctgtcaatatcatgtccgcctttgaaagccccttcgggccaaactccaatggaagtcagagcagcaactcgtggaaaattgattccctgtctttgaacagggagtttgggtaccagaagcttgatgtgaaaagcatcgatgatgaagatgtgggatgaaaacgaagatgacgtgtatggaaactcatcaggacggaagcacaggggccactcagagtcgcccgagaaaaacggagcacactctgtcacccaggctggagtgcaatggcacgatctcagctcactacaacctctgcctcccgggttcaagtgattctactgcctcagcctcccgtgtagctgggattacaggcgcgcaccaacacacccgactaatttttgtatttttagtaaagacagggtttcaccatgttggccaggctggtcttgcactcctgacctcacgtgatctgccccaccttggcctcccaaagtgctgggattacaggtgtgaaccactgcgcccagccccaagtggctttttcaattacatgagccaacatattctcacaagtccattcgagtttggtgtctgttacttgcaaataagggagttctgattggttcccagtgaaacctcatctgtaagacctctgagccaccagtatccacggggcttgtcctataacagctcctgtgcaatccagtaaccttgaacactggaagccactgagcccttctgtgagtagatgcacacctctgaggctaagattactggtgtactcattgggaccagtttggtctcagtgactgaaaactcaacccaaacttgttcatttggaaaggaaaagtcaaccaggcacagtggctcatgcctgtagttccagcactttgggaggctgaggtggacagatcgcttgagcccaggggttcaagaccaacctgggcaacatagcaaaaccctgcctctacaaaaaaaaa

SEQ ID NO: 418849 - DNA, 3033 bp, Homo sapiens
gcagagcggcggcttctctcgcgaggacggacgccattatcgcatctccccgacaaacaccacgagaattccgcagcccacacggtgaccaaaagccagccccactgtgagttgaactctttcgtgttgaccggccactctccgtgctctggatgatgtcggaacacgacctggccgatgtggttcagattgcagtggaagacctgagccctgaccacccagttgttttggagaatcatgtagtgacagatgaagacgaacctgctttgaaacgccagcgactagaaatcaattgccaggatccatctataaagtcattcctgtattccatcaaccagacaatctgcttgcggttggatagcattgaagccaaattgcaagccctggaggctacttgtaaatccttagaagaaaagctggatctggtcacgaacaagcagcacagccccatccaggttcccatggtggccggctcccctctcggggcaacccagacgtgcaacaaagtgcgatgcgtcgtcccccagactacagtaatactcaacaatgatcggcagaacgccattgtagccaagatggaagaccccttgagcaacagggcaccggattccctggaaaatgtcattagcaacgctgtgcctgggcgtcggcagaacaccattgtggtgaaggtgccgggccaagaagacagccaccacgaggacggggagagcggctcggaggccagcgactctgtgtccagctgtgggcaggcgggcagtcagagcatcgggagcaacgtcacgctcatcaccctgaactcggaagaggactaccccaatggcacctggctgggcgacgagaacaaccccgagatgcgggtacgctgcgccatcatcccctccgacatgctgcacatcagcaccaactgccgcacggccgagaagatggcgctaacgctgctggactacctcttccaccgcgaggtgcaggctgtgtccaacctctcggggcagggcaagcacgggaagaagcagctggacccgctcaccatctacggcatccggtgtcaccttttctataaatttggcatcacagaatccgactggtaccgaatcaagcagagcatcgactccaagtgccgcacggcgtggcggcgcaagcagcggggccagagcctggcggtcaagagcttctcgcggagaacgcccaactcgtcctcctactgcccttcagagccgatgatgagcaccccacctcctgccagcgagctcccgcagccacagccgcagccgcaggccctgcactacgcgctggccaacgcacagcaggtgcagatccaccagatcggagaagacggacaggtgcaagtaatcccacagggacacctccacatcgcccaggtgccgcagggggagcaagtccagatcacgcaggacagcgaggagcccgtgttctggtactacgtgaaggaggtcctcaacaagcacgagctgcaagcgcttctactccctgcgccacatcgcctcagacgtgggccggggccgcacctggctgcgctgtgccctcaacgaacactccctggagcgctacctgcacatgctcctggccgaccgctgcaggctcagtactttttatgaagactggtcttttgtgatggatgaagagaggtccagtatgcttcctaccatggcagcaggtccgaactccatactctttgcgattaacattgacaacaaggatttgaacgggcagagtaagtttgctcccaccgtttcagacctcttaaaggagtcaacgcagaatgtgaccttgctgaaggagtccacgcaaggagtgagcagcgtgttcagggagatcacagcctcctctgccatctccatcctcatcaaacctgaacaggagaccgaccccttgcccgtcgtgtccaggaatgtcagtgctgatgccaaatgcaaaaaggagcggaagaagaaaaagcaagtgaccaacattatctcatttgatgatgaggaagatgagcagaactctggggacatgtttaaaaagacacctggggcaggggagagctcagaggacaactccgaccactcctctgtcaatatcatgtccgcctttgaaagccccttcgggccaaactccaatggaagtcagagcagcaactcgtggaaaattgattccctgtctttgaacagggagtttgggtaccagaagcttgatgtgaaaagcatcgatgatgaagatgtgggatgaaaacgaagatgacgtgtatggaaactcatcaggacggaagcacaggggccactcagagtcgcccgagaaaaacggagcacactctgtcacccaggctggagtgcaatggcacgatctcagctcactacaacctctgcctcccgggttcaagtgattctactgcctcagcctcccgtgtagctgggattacaggcgcgcaccaacacacccgactaatttttgtatttttagtaaagacagggtttcaccatgttggccaggctggtcttgcactcctgacctcacgtgatctgccccaccttggcctcccaaagtgctgggattacaggtgtgaaccactgcgcccagccccaagtggctttttcaattacatgagccaacatattctcacaagtccattcgagtttggtgtctgttacttgcaaataagggagttctgattggttcccagtgaaacctcatctgtaagacctctgagccaccagtatccacggggcttgtcctataacagctcctgtgcaatccagtaaccttgaacactggaagccactgagcccttctgtgagtagatgcacacctctgaggctaagattactggtgtactcattgggaccagtttggtctcagtgactgaaaactcaacccaaacttgttcatttggaaaggaaaagtcaaccaggcacagtggctcatgcctgtagttccagcactttgggaggctgaggtggacagatcgcttgagcccaggggttcaagaccaacctgggcaacatagcaaaaccctgcctctacaaaaaaaaa
